United States Patent 12,569,549 (FLAVIVIRUS VACCINE) - sequence listing, part 63

SEQ ID NO: 21951 - RNA, 9879 nt, synthetic construct
  misc_feature 1..9879: note = derived and/or modified CDS sequence (opt6) from DENV-1__EU482515__SS-prME
  source 1..9879: mol_type = other RNA
tctgtcacaactctgttgatgcttatgccaacagcattggcattccacctcacaacgcggggaggggaaccacacatgatagtttccaaacaagaacgcgggaaatcgcttctattcaagacttcagccggtgtaaatatgtgcactttgatcgcaatggatctaggggaactgtgcgaagacacgatgacttataaatgtccgagaataaccgaaacggagccagacgatgtggactgctggtgtaatgctaccgacacatgggtaacttacgggacgtgttcacaaacgggtgaacatagaagagataaaagatctgttgcgctagcacctcacgtcggattaggtctagagaccagaacggaaacatggatgagttcagagggagcatggaaacaaattcaaagagtcgagacgtgggcattaagacatcctgggttcacggttatagcattgttccttgctcatgctatagggacaagcataacacaaaaaggtataattttcatactattgatgctagtaacaccatcaatggcaatgagatgtgtaggaataggatccagagatttcgtcgaaggacttagtggcgccacttgggttgatgttgtactagaacatggatcttgtgtaacaacgatggcgaaggacaaacccacattagatatagagctattaaaaaccgaagtgactaatcctgctgtattaagaaaattatgcattgaagctaagatttctaacaccacgacagattctaggtgcccaactcaaggcgaagcgacactggttgaagaacaagatgccaattttgtgtgcagacggacattcgttgaccgaggttggggtaatgggtgcggactttttggcaaaggatcactaataacttgtgcaaagttcaaatgtgtaacgaaactcgaaggcaaaatagttcaatatgaaaatttaaaatactccgtcatcgtaacagtacatacaggtgaccagcatcaagttggtaatgaatctaccgaacatggaaccacagcaaccattaccccacaggcccctactacggaaatacaactgacagattatggtgcactaaccctagactgttctccgcgaacgggacttgattttaatgagatggtattattaacaatgaaagagaaaagttggctagtacataaacagtggtttttagacttaccgctgccatggacttcaggggcctcaacatctcaagaaacgtggaatcgtcaagacctcctagttactttcaaaaccgcccacgccaagaaacaggaagttgtagtactcggatcccaagaaggtgccatgcatacggctctaacaggcgccacagagattcaaacatctggtactacaacgatttttgcaggacatctcaagtgtagactcaaaatggacaaactcacgctaaaggggatgtcttatgtaatgtgtacaggttcctttaaacttgaaaaggagttagcagaaacccaacatggtacagtcctggttcaaattaaatatgaaggaacggatgcaccatgtaaaatcccattctcaactcaagacgagaaaggagtaacacaaaatgggagattgataacagccaaccctattgtaaccgataaagagaagccggtaaacattgaagctgaacctccatttggagagtcctatatagtgataggggcaggagaaaaggcactcaagctctcttggttcaaaaagggatcctcgattggaaagatgttcgaagctacagctagaggagccagacgtatggctatcctaggcgacacagcttgggactttggtagtattggaggagtatttacctccgtcggaaagttggtacatcagatctttgggacagcctatggggtattattctcaggtgtatcatggacaatgaaaataggaataggtgtactgctaacttggcttggtttaaatagtagatccacttcactttcaatgacttgcatagcagtcggcctggtaaccctatacctcggggtaatggttcaagcagattccggttgtgttataaattggaaaggacgagaactaaaatgtgggtcagggatcttcgttacaaatgaggtacacacgtggacggaacaatataagtttcaagcggactcccccaaaagactatcggcggcaattgggaaggcttgggaggaaggagtatgcgggatcagatctgcaacaaggttggaaaacatcatgtggaaacaaatttctaacgaattaaatcatattttacttgaaaatgatatgaagtttactgtggttgtgggagacgttgcagggattctagctcaggggaagaaaatgatacgtccacaacctatggagtacaaatatagttggaagtcctggggaaaagcaaagatcatcggagctgacgtccagaatacaacattcataatagacggaccaaacactccagagtgtcccgatgaccaaagggcatggaacatatgggaggtcgaggactacggtttcggaatctttactacaaatatatggctaaaacttagagatagttatacacaggtctgtgatcataggcttatgagtgcagcaataaaagactccaaagctgtccacgcagacatgggatactggattgagtcagaaaagaacgaaacgtggaaattggcccgggcctcattcattgaagtcaaaacctgtatctggcctaaatcccacactttatggagtaatggagttcttgagagcgaaatgatcataccgaaaatatatggaggtccgatgagtcaacataattacagaccaggttattttacacagactgcaggtccatggcatctcggaaagttagaattagattttgatctatgcgaaggaaccacggtagtagtggatgaacactgtggaaacagggggccaagcctacggacaactactgttacggggaaaataatacatgaatggtgttgtagatcttgtacgctcccaccattgcgttttcggggagaggatggatgctggtatggaatggaaatccgcccagttaaggagaaagaggagaaccttgttaaatccatggtcagcgctggtagtggggaagttgactcatttagcctgggactgctctgtatttcaataatgatcgaggaggtcatgcgcagtcgctggtcgaaaaagatgctcatgactgggactctagctgtgttcttcttactgattatgggccaacttacatggaatgatttaatacgattatgtattatggtaggggcaaatgcatctgatagaatgggaatgggaactacatatttggcgttaatggcaacatttaaaatgcgaccaatgtttgcagtaggattgttgttcagacgactgacatcacgcgaagttctgttgctaacaattggcctctctctggttgcatcagtggagcttccgaactcccttgaagagttgggtgacggactcgctatgggtataatgattcttaaattattaacagattttcaaagccatcaattatgggctactttacttagcctgacattcattaagacaacttttagtcttcactacgcatggaaaactatggcgatggtgctatcaatagttagcttattcccattatgcctctcaacaacgagtcagaaaaccacatggctccctgttttattgggaagccttggatgtaaacctttaacaatgttcctgatagcagagaataaaatttggggacgtaggtcatggcccttaaatgagggaataatggcggtgggcatagtgtccatattactatcctccttactgaaaaatgacgtacctttagccggcccattgatcgcgggagggatgctcattgcttgttatgttatttcgggaagtagtgcagacttgagtcttgaaaaagccgcagaggtatcctgggaagaagaagctgaacatagtggggcctctcataatatattagttgaagttcaagatgacggcaccatgaaaataaaagacgaggaaagagatgatacgttaacgatactactaaaggcgacgttattggcagtctcaggtgtttacccattatctattcctgccacattattcgtatggtatttttggcaaaagaaaaagcaacgatcaggagtattatgggatacaccatccccacctgaagtggaaagagcggtactagacgatggcatatatagaatcatgcaacgcggcttactcgggagaagccaggtaggagtaggagtgtttcaagaaaacgtgtttcacactatgtggcatgtaacaagaggtgctgtacttatgtatcaaggaaaaagactagaacctagctgggcaagcgtcaaaaaggacttaatttcttacggagggggttggagactacagggatcatggaataccggggaggaagttcaggttatcgctgtggaacccggtaagaatcccaaaaatgttcaaacagctccaggcacgttcaaaaccccggagggtgaggtaggagcaattgctttagactttaagccgggcacttctggatctccaatcgtgaatcgggaaggaaaaattgtaggactatatgggaatggagtagtcactaccagcgggacatatgtatcagccatagctcaagcgaaagcaagccaagaaggccccttgccagaaatagaagatgaggtttttagaaaaagaaatctcacaatcatggatctacatccaggatcaggtaaaactagacgatatttaccagcaatagtgcgtgaagcgattaagagaaaactaagaacattaattcttgcaccgacaagggtagtggctagcgagatggcagaagcactgaaaggcatgcctatccgttatcaaacgactgctgttaaaagcgagcacactgggaaagaaatcgtagatcttatgtgccacgccaccttcacaatgagattgttatcaccagtgcgtgtcccaaactataacatgattataatggacgaagcccatttcacagacccctcctccatcgcggcaagaggatatatttcgaccagagtaggtatgggtgaagctgccgctatctttatgacagcgacaccccctggttcagtagaagcgttcccacagtctaatgcggtgatacaagatgaagaaagagatattcccgagaggagctggaatagcggttacgagtggatcacagatttccccgggaaaacagtctggtttgtaccttcaattaaatcgggtaatgacatagcgaattgcttaaggaaaaatgggaagcgcgtgatacagttatctcgcaaaaccttcgatacagaataccagaaaactaaaaataatgactgggactatgttgtaacaaccgacattagtgaaatgggagctaattttcgggccgacagggtcatcgacccccgaaggtgcctaaagcccgtaatactcaaggacggcccagaaagggtcatattagcgggaccaatgcccgtgacagtagcatctgctgctcaaagacgaggtaggataggaaggaatcataataaagaaggagatcaatatatttatatgggacaacccttgaataatgatgaggaccatgctcactggaccgaggcaaaaatgctcttagataacataaatacacctgaaggaataatccccgccctattcgagcccgaaagagaaaaatcagcagctattgacggtgagtatcgattgagaggagaagctagaaagacctttgtagaactaatgagaaggggagatctgccagtatggctgagttacaaggttgcaagcgagggcttccaatattccgatcggcgttggtgttttgacggggaacgaaacaaccaagttttagaagaaaatatggacgttgaaatttggacaaaagagggagaaaggaagaaacttcgaccacgctggctagatgcaaggacctattccgatccacttgcgctaagagaatttaaggaatttgctgcaggacgaaggtcggtaagcggcgacctaattctagaaattggaaagttaccacaacacttgacccaaagagctcaaaacgctctggacaaccttgttatgcttcacaactcagaacaaggtggacgtgcgtatcgacatgccatggaagaactaccggatactatagaaacactaatgttattagctcttatagccgtactaacaggaggagtaacgctattctttttaagtggaaggggactcggtaaaaccagcatcggattgctatgcgtaatggcgagcagtgtactattatggatggcttccgtcgaaccacactggatagcagcaagcattatactggaatttttcctcatggtattattaatacccgagccagaccgtcaacgaacccctcaagataatcaactagcctatgtggttattggcttgctatttatgattctaacagttgctgctaatgaaatgggactcctggaaactacaaagaaagatctaggcattggccacgtagcagtggaaaaccatcaccatgctgcaatgttagatgtcgacttacaccctgcctcagcatggacattatacgcagtagctacaacaattataacacctatgatgaggcacaccatagagaacacgactgccaatataagtctcacagcaatagcgaaccaagcagcgatacttatgggactggacaaggggtggccaatatccaagatggatatcggagtcccattactggctttggggtgctatagtcaagtaaatccgctaacgttaacagctgcagttcttatgttagttgcccattatgcaattattggaccaggactacaagccaaagcaactagagaggctcaaaagaggaccgcggccggaattatgaaaaaccctaccgtcgacggtattgttgccatagatctagaccctgtagtctacgacgccaaatttgaaaaacaactaggccaaattatgttactgatcttatgtacatcacaaatcctactgatgcgaacgacttgggctctttgtgaaagcataacgctggcgacaggaccgctaacaactctttgggaaggttcgcccgggaaattttggaacacaacgattgcggtgtccatggccaatatttttcgtggatcttacctagctggagcaggtctagctttctccttaatgaagagtctaggtggtgggaggcgaggtacaggagctcaaggggagacactgggtgaaaaatggaaacgtcaacttaaccaactttcaaagagcgaatttaatacatataaaagatcaggaataatggaggttgaccgttccgaagcgaaagaaggcctgaaaaggggagaaacgacgaaacatgcagtaagtagaggaactgctaagttaagatggttcgtagagagaaacttagtcaaacctgaaggcaaagttattgatctgggctgcggaagaggtggttggtcttactactgcgcgggtttaaagaaagtaacggaagtgaaaggatacacaaaaggaggcccaggccacgaagaaccaattccaatggcaacgtatggatggaatttagtcaaactacactcgggcaaggatgttttctttattcctccggaaaaatgtgatacattactttgcgatattggtgaatcgtcgccaaacccaacaatagaagaaggcagaaccctaagagtactcaaaatggttgaaccttggttgagaggtaatcagttctgtataaagatactaaatccgtacatgcccagcgttgtcgaaacattagagcaaatgcaaaggaaacatggaggtatgcttgttagaaacccattgtcccggaatagtacgcacgaaatgtattgggtaagttgcgggaccggaaatatcgtaagtgcggttaacatgacctcaaggatgttgctaaatagatttacaatggcacacagaaagccaacttacgaacgagatgtagacttaggggcaggaaccagacatgtcgcagttgaaccggaagtggcaaatcttgatatcattggacaacgcatagaaaatattaagcacgaacataagagtacttggcattatgatgaagacaatccttataaaacgtgggcatatcatggaagttacgaggtcaaaccatccggaagcgcgagttcaatggtaaacggtgtagtgaaacttctaaccaaaccctgggatgtgatccctatggtgacacagatagccatgacagatactactccatttggacaacagagggtattcaaggagaaagttgacacccgaacaccaaaagctaagcgaggaaccgctcaaataatggaagtaactgcaaaatggttatggggcttcttaagccgaaataagaagcccaggatatgtacacgtgaagagttcactagaaaagtacgaagtaatgcagcaataggtgcagtattcgtagacgaaaatcagtggaactcagctaaagaagcggtggaagacgaacgattctgggacttagttcatagagaaagagaactacacaaacaaggaaagtgcgcaacttgtgtctacaatatgatgggaaaacgagagaagaaactgggggagttcggtaaggcaaaaggatctagagcaatatggtatatgtggcttggagcacgatttttagagtttgaggcactcggttttatgaatgaagaccattggtttagccgtgagaactcgttatctggagttgagggtgaaggactacacaaattaggatatatactacgcgatataagcaaaatccctggaggaaacatgtatgcggatgatacagccgggtgggatacaaggattactgaagacgatctccaaaatgaggcaaggataacagatatcatggaaccagaacacgctctacttgcaaaaagtatttttaaattaacttatcagaataaagtagttagagtacagcgcccggccaaaaacggaactgtaatggatgtaatctcgcgccgggatcagagagggtcgggacaagttggaacgtacggattaaatacattcacaaatatggaagcccaactcattagacaaatggaaagcgagggtatattttcgcccagtgagttagagacacccaacctagctaaacgtgtattagactggctggagaaatatggcgtagagagattgaaacgcatggccatttccggggatgattgtgtggttaaacccatagatgatcgatttgcaacagcattgaccgcgttaaacgacatgggaaaagttcgcaaagatataccgcagtgggaacctagcaaaggatggaatgattggcaacaggtaccattctgctctcatcattttcaccaactaattatgaaagacggacgagaaattgtggtgccttgtcgaaaccaagatgaattagtaggacgcgctagagtaagccaaggggcaggatggagccttcgcgaaacagcttgtctgggcaaatcatatgcgcaaatgtggcagctaatgtattttcatagaagagatttacgactggcggcaaacgctatctgctctgccgtacccgttgattggataccaacgagcagaacaacttggagcattcatgcacaccaccagtggatgacaacagaagacatgttatccgtttggaacagagtatggatagaagaaaacccctggatggaagacaaaacgcatatatctagctggggagacgtcccgtatctaggaaaacgagaagatcaatggtgtggctcattaatagggcttacagctcgcgccacatgggcaacaaacattcaagtagccattaatcaagtgaggagacttatcggcaatgagaactatctagattatatgactagcatgaaacgattcaaaaatgaatctgaccccgaaggtgcattgtggtaa

SEQ ID NO: 21952 - RNA, 9879 nt, synthetic construct
  misc_feature 1..9879: note = derived and/or modified CDS sequence (opt6) from DENV-1__EU482516__SS-prME
  source 1..9879: mol_type = other RNA
tcggtaaccatgttactaatgttaatgccaacagcactagcatttcacctaaccactagaggaggagaaccgcatatgattgtgagtaaacaagaaagaggcaaaagcctattatttaaaacaagcgccggtgtaaatatgtgcaccttaatagctatggatctcggggaattatgtgaagacactatgacttataaatgtcctcgaataacagaaactgaacccgatgacgtagactgctggtgcaatgcaacagacacgtgggttacttatggcacctgttctcaaacaggtgaacaccgaagagacaaacgaagcgttgccttagctccgcacgtcggactgggcttagaaacacgtacggagacatggatgtcgagcgaaggtgcatggaaacaaattcaaagagtagagacgtgggctctccgacatcctggctttactgtgatcgcactgtttttagcacatgcaataggtacatcaattactcaaaaaggcataatatttattctattaatgctagtaacgccgagtatggccatgagatgcgttggaatagggagtcgggatttcgtagagggattatctggagcaacgtgggtagatgtagtactagaacacgggtcatgcgtcacaaccatggcaaaagacaagcctacgttggatattgagttgttaaaaacagaagtaacgaatcccgccgtattacgaaaattgtgcatagaagctaaaataagcaatacaactacagactcgagatgccctacccaaggagaggctacgttagtagaagaacaagacgctaatttcgtgtgcagaagaacgtttgtcgacagagggtggggtaatggttgcggattgtttgggaaaggctcactaataacatgtgccaaattcaagtgtgtaacgaaactagaaggtaaaatagtacaatatgagaacttaaagtatagtgtaatagtgactgttcataccggagaccaacatcaagtgggtaatgaatcaacggagcatgggactacagccaccataacgcctcaggcacctacaactgaaatacaattaaccgactacggagctctcacgttagattgttccccacgcactggcttggactttaacgaaatggtccttttgacaatgaaagaaaaatcttggttagttcacaaacaatggttcttagacttacccctaccttggacaagtggtgcaagcacgtcacaagaaacttggaacagacaagacctcctggtgacgtttaaaactgcccatgctaaaaagcaagaagtcgtcgtattgggttcacaggagggcgcgatgcatacagctttaacgggtgctaccgaaatacaaacatctggcacgaccacaatatttgcaggtcacttaaaatgtagattaaaaatggataaattgactttaaaaggtatgtcttatgttatgtgcacaggctccttcaaactagagaaagaggtagccgagactcagcatggtactgtattagtacaaatcaaatacgaaggaacagatgcaccttgtaagataccatttagtactcaagacgagaaaggtgtaactcagaacgggcgcctcataaccgcaaacccgattgtgacagataaagaaaaaccagttaatattgaggcagaaccacctttcggagaatcgtatattgtaatcggagccggtgaaaaagcactaaaattgagttggtttaaaaagggttcctccataggaaaaatgtttgaagcgacggctagaggagcacgcagaatggccatactaggagataccgcttgggatttcggatctatcggcggggtatttacgtcagtaggaaaattggtacaccaaatatttggcacagcatatggagttctattctcaggagtaagctggactatgaagatcgggataggtgtccttctcacgtggttaggattaaatagtcggtctactagcttatcaatgacatgcattgccgttgggcttgtaacgctttacctcggagtaatggtacaagctgatagtggatgtgttataaattggaaagggcgagaattaaaatgtggctctgggatcttcgtaacgaacgaggttcatacttggacagaacagtacaagtttcaggccgattcgcctaaaagattaagtgctgcaataggaaaagcatgggaagaaggggtatgtggaataagatcagcaacaagacttgagaacataatgtggaagcagattagtaatgaactcaatcatatactactagaaaatgatatgaaattcaccgttgtcgttggtgacgtagctggtatattagctcaaggcaaaaagatgataagaccgcaaccaatggaatacaaatatagttggaaaagctggggaaaagctaaaatcataggcgctgatgttcaaaataccacatttataatcgacgggcctaatacacctgaatgtcccgatgaccagagagcatggaacatttgggaagtcgaggactacggtttcggtatatttactacgaatatttggctaaaactaagggattcgtacacccaggtttgtgaccatagactaatgtccgcagccatcaaggatagtaaggccgtacacgctgatatgggctactggattgaaagcgagaagaacgagacatggaaactcgcacgtgcctcgttcatagaagttaaaacatgcatatggcccaagtcgcatactctgtggtctaatggtgttcttgaatcagaaatgatcataccgaagatctatgggggccccataagtcagcacaattaccgcccaggatattttacacaaactgctggaccctggcatttgggcaaactagaactagatttcgatctgtgtgagggtactacggtagttgtagacgaacactgcggaaacagaggcccctcactcagaacaacaacagtaacaggaaaaataatccacgagtggtgctgccgaagttgtacacttccgcccttgagatttcgaggggaagatggatgttggtacggcatggagatccgaccagtcaaagagaaggaagaaaacttagtaaaatctatggtatccgctggtagtggtgaggtcgactctttcagcctaggattgttgtgtatctctattatgatagaggaggtaatgagatcccgttggtcaagaaaaatgctcatgaccggaactctagccgtcttctttctattaatcatgggacagttaacttggaatgacctaattcgactatgcataatggtaggcgcaaacgcctctgaccgcatgggaatgggaaccacataccttgcactcatggccactttcaaaatgaggccgatgtttgcagtcggtctactcttccgacgattaacaagtagagaggtattgttattgacgataggattaagtcttgtcgcctcagtcgaattacctaattccctagaagaattaggtgacggactagcgatgggcataatgatactaaaactcctgacggactttcaatctcatcaactatgggccacattgctaagtctgaccttcattaagactactttatccttgcactatgcgtggaaaactatggccatggttttatctatcgtatcattatttccgctatgcttatcaactacatctcagaaaactacgtggttgccggttttgttaggtagcttaggatgtaaaccgctaacaatgtttttaatagcggagaataaaatttggggacgaagaagttggccgttgaatgagggaattatggccgtaggtatagtaagcatattgttatctagtttacttaagaacgatgtcccactagcaggacctttgattgctggaggaatgttaatagcatgctatgtcattagtggatctagtgcagatctttcactggaaaaggcagcagaagtttcttgggaagaagaagctgaacattcaggtgcgagccacaatattttagtcgaagttcaagatgatggtaccatgaaaataaaagatgaggagagagatgatacattaacaatattactgaaagcgacattgcttgcagttagcggtgtttacccactgagtatacctgcaacattattcgtctggtatttctggcagaagaagaaacaaagatccggcgttctatgggacactccatcaccgccggaagttggcagagcggtactggatgacggaatatacaggattatgcaacgtggactactgggcagatcacaggtaggagtcggtgtattccaagaaaatgtatttcacaccatgtggcatgttacaagaggagctgttcttatgtatcaagggaaacgacttgaaccctcttgggcaagtgtcaagaaagacttaataagctacggcggaggatggagattacaaggatcttggaacacgggtgaagaagtccaagtgattgcggtagaaccgggtaaaaatcccaaaaatgtacagactgcaccaggaacatttaaaacacctgaaggtgaggttggcgcaatagccttagacttcaaaccaggaacgtccggttctccaatagtaaatcgagaaggaaaaattgtgggattatatggtaatggcgttgtaacaacaagtggaacttacgtatccgcaatagcgcaagcaaaggcttcacaagaagggccacttcccgaaatagaagacgaagtcttccgaaagagaaatttaacaatcatggatttgcacccagggagtggtaaaactcgacgatatttaccagcaattgtacgcgaagcaataaagcgaaaactgcgtaccttgatactggcacccacaagggtagtagcgtctgaaatggcagaggctttaaagggtatgcctattaggtatcaaacaacagcagtcaaaagtgaacatactggcaaagaaatagttgacttaatgtgccacgctacttttaccatgcgattactttcaccagtccgagtgccaaactacaacatgataataatggatgaagctcatttcactgacccgtcatcgatcgcggctagagggtacatatctactagagtcgggatgggagaggctgcagcaatattcatgacagccacaccgcctggttccgtagaagcgttcccacaatcaaatgctgtcattcaggatgaggaaagggacatacccgaaagatcctggaacagcggatatgagtggattaccgacttccccggaaaaactgtctggttcgtacctagcattaagagtggtaacgacatcgcaaattgtttaaggaaaaatggaaaaagggttatacaactatcaagaaaaactttcgacacagaatatcagaaaactaaaaataacgattgggattatgttgttacaacagatataagtgaaatgggcgcgaactttagagcagatagggtgatagatccgcgaagatgccttaaacccgtcatcttaaaagatggccctgaacgggtgattttagcaggtccaatgccagtaacagtagccagcgctgcacaaaggagaggtcgtataggtagaaaccacaataaagaaggggatcaatatatttacatgggccaacccctaaataacgatgaagatcatgctcactggaccgaagcaaaaatgctcctggataacataaataccccagaaggtataatcccggcgttattcgagcctgagagagaaaaatccgcagcaatagatggagaatacagattaagaggggaggctagaaaaacctttgtcgaactaatgagaagaggtgacctaccagtatggctatcctacaaagttgcctccgaaggctttcagtacagcgataggagatggtgtttcgatggtgaacgcaacaaccaggtactagaggagaatatggatgttgagatatggaccaaagaaggtgaaagaaagaaactaaggccacgctggttagatgcaagaacgtattcagatcctctcgctctccgagaatttaaagaatttgctgcaggaagaagatcagttagtggagacctaattcttgaaattgggaagctgccccaacatttaactcaacgggctcaaaacgcactagacaatcttgtaatgttgcataacagtgaacagggaggacgcgcttatagacatgcaatggaagaactaccagacacgattgaaaccttaatgctgttagctctaattgcagtattaacaggaggggtgaccctattctttcttagcggacgaggcctaggcaaaacatccattggattactttgtgtcatggcaagtagtgtcttgctttggatggcctccgtggagccacattggattgcggcctccataatactagaatttttcttgatggtattactcattccggaaccagaccgacaacgcactccacaagataaccagctagcttatgtagtgatcggactcttatttatgatcttaactgtcgcagcgaatgagatgggcttactagaaacaactaagaaagaccttggaatcggacatgtagcagtcgagaatcatcaccatgctgcaatgttagacgtagacttgcaccccgcaagtgcatggactctgtacgcagtcgcgactaccattatcacaccaatgatgagacatacaattgaaaacactaccgccaatatatctctaactgccatagctaatcaggcagccatcctgatgggcttagataaaggatggccgatttcgaagatggatattggggtgccgctattagcattagggtgctacagccaggtgaatccactaaccctaaccgccgccgttctaatgctagttgcccattacgcgataattggacccggtcttcaagctaaggcaacaagagaagcacagaaacgcactgctgccggtatcatgaaaaatccgacggttgacggaattgtggcaatcgatctggacccagtcgtatacgacgccaagttcgaaaaacaacttgggcaaattatgctattaatcctgtgcacatcacagatattgctcatgcgtaccacatgggcattgtgcgaatccataacattggccactggaccattaacaacattatgggaaggctcaccaggaaaattctggaacaccaccattgctgtatcgatggcgaatatctttcgtggcagttatttagctggggccggcttggccttttcgcttatgaagagtctaggaggagggcgacgcgggacaggagcacagggcgaaacattaggagagaaatggaaacggcagttaaaccaactctctaagagcgagtttaacacttataaacgaagtggtataatggaagtcgacagatccgaagcaaaagaaggcctaaagaggggagaaaccacaaaacatgctgtcagcagaggtacagctaaattacgatggttcgtcgaaagaaacctagtaaaaccggaaggaaaagtaattgacttaggctgtggacgtggaggctggtcatactattgcgctggactgaagaaagtaacagaagttaagggatatacgaaaggagggccagggcatgaagaaccaattcccatggctacttatgggtggaacttagtaaagttacatagtggcaaggatgtgttctttatcccacccgagaaatgtgatactctactctgtgacattggagaatcctcacctaatcctacaatagaagaagggaggactttaagagtcctaaaaatggtagagccgtggttgaggggaaaccaattttgtataaaaatactaaacccttatatgccatcagtagtagaaaccctagaacaaatgcaaaggaaacacggtggtatgctagtacgtaatcctctcagccgaaacagcacgcatgagatgtattgggtaagctgtggcactggaaatatcgtctccgcagttaacatgacatctcgtatgttactaaaccgatttactatggcccaccgaaagccgacatatgaacgcgatgtcgatcttggagccggaactcggcacgtcgcagttgaaccggaggttgctaacctggatataatcggtcaaagaatcgagaatattaagcatgaacataaatccacctggcactatgatgaagacaacccatataaaacatgggcatatcacggatcgtacgaagtcaaaccaagtgggtctgctagcagcatggtaaacggggtagtcaagttattaactaaaccatgggacgtcataccaatggtgacacagatagcaatgaccgacacgacaccattcgggcagcaaagagttttcaaagaaaaggtcgatacccgaacacctaaagcgaaaagaggaactgctcaaattatggaggtaacagcgaaatggttgtgggggttcctgagtcgaaacaaaaagccacgaatttgtaccagggaagagttcacaaggaaagtacggagcaatgcagctattggcgcagtttttgtagatgagaaccaatggaactcggcaaaagaagccgttgaggacgagagattttgggatttagtacatagagaaagggaactacacaaacaaggaaaatgtgcaacatgtgtttataacatgatgggaaaacgagagaagaaactcggagagttcggtaaggcaaagggctcacgagcaatatggtacatgtggttgggtgcaagatttttagaatttgaagcgctagggtttatgaatgaggaccattggttttctcgcgaaaacagcctgagtggcgttgaaggcgaaggattacataagctgggctatatacttcgagatatttctaatatcccaggaggaaatatgtatgcagacgacaccgctggatgggatacacgaataactgaagacgatctccaaaatgaggctcgtataactgatataatggagccagaacatgcgttattggccaagtcgatatttaaattaacgtatcaaaataaagtggtacgagttcaaagaccagcgaagaacggaacagttatggatgttatatcaagacgcgaccaaagaggaagtggacaggtaggtacttacggtctgaacacatttacaaatatggaagctcaactgataaggcaaatggaatcagaaggaatatttagccctagcgaactagaaactccaaacctcgcagaaagggtactggattggctagaaaagtacggtgtagagcgattaaagaggatggctatatcgggagatgactgtgtagtaaaaccgatagacgatcgatttgcaacggcattgacggcattaaacgatatggggaaggtaagaaaggatataccacagtgggaaccttctaaaggatggaatgactggcagcaggtaccattttgtagtcaccactttcatcagcttatcatgaaagacgggagagaaatagtagtcccttgtagaaaccaagatgagctagtcggaagggctcgggtttcccaaggtgcaggatggagcttgcgagagactgcttgtctaggaaagagttacgcacaaatgtggcaacttatgtatttccatagacgagaccttaggctggctgcaaatgccatatgctcagcagtacccgttgattggattcctacaagccgtacgacatggtccatccacgctcaccatcaatggatgactacagaagatatgttaagcgtctggaatagggtatggatcgaggaaaacccgtggatggaggacaaaacacatatctcaagctggggtgacgtcccttatctgggaaagcgagaggaccaatggtgtggtagtcttataggtttaaccgcaagagcgacttgggcgaccaatattcaggtagctataaatcaggtgagaagactaatcggaaatgaaaattatctagattacatgacttccatgaaacggtttaaaaatgaatccgatcctgaaggagctctatggtaa

SEQ ID NO: 21953 - RNA, 9879 nt, synthetic construct
  misc_feature 1..9879: note = derived and/or modified CDS sequence (opt6) from DENV-1__EU482517__SS-prME
  source 1..9879: mol_type = other RNA
tctgtaactatgctattaatgctgatgccgaccgcactagcgtttcatcttactacaaggggtggtgagcctcacatgattgtaagtaaacaagaaagaggaaagagcttgctttttaaaacttccgcaggggtaaatatgtgtacactcattgctatggacttgggagagctttgtgaagatacgatgacttacaaatgccccagaatcaccgagactgagcccgatgatgttgactgttggtgtaacgccaccgacacttgggttacctatggaacatgcagtcaaacgggggaacataggagagataaaagatccgttgcgcttgctccccatgttgggttgggactagaaactaggacagagacctggatgagttcggaaggcgcgtggaaacaaatacaaagagtggaaacgtgggcactaagacatccaggttttactgtaatcgctctgttcttagctcatgctattggtacgtccataacacaaaaaggtataatatttatactcttaatgctagtaacacccagtatggcaatgcgatgtgtagggatcggaagcagagattttgtagagggcttatcaggagcgacttgggtagatgtagtcctggaacacggaagctgcgttaccacaatggctaaagataaaccgactctggatattgagctattaaaaacagaagttactaatcctgctgtgctgcgaaaactgtgtatagaggccaaaatatctaatacaacgactgatagtaggtgtccaacccaaggagaagccacattagtcgaagaacaagatgccaactttgtgtgcagaaggacttttgtagatagaggttggggaaacgggtgcggattatttggaaaaggtagtctgataacatgtgcaaaattcaaatgtgtaacaaaacttgaaggaaaaattgtacaatacgaaaatcttaaatattctgttatagtaacagttcatactggagatcaacaccaagtcggaaacgaatcaaccgagcacggaacaaccgccactataactccacaagctccaacaacagaaatacaacttactgattatggtgcactaacactagactgcagccctcgtacagggctagatttcaatgaaatggtactactcactatgaaagagaaatcctggcttgtacataaacaatggtttttagacttaccattgccctggacgtcaggggcgtcaacttcacaagaaacatggaatagacaagatttacttgtgacttttaacaccgctcacgctaagaaacaagaggtagtggtgctaggttcccaagaaggggcaatgcatactgctcttacaggtgctactgagatacagacaagcggaacaacgactatattcgctgggcacctaaaatgccggctaaaaatggacaaattaacactaaaaggtatgtcgtacgttatgtgcactggaagttttaaattagaaaaagagttggctgaaactcaacacggtacagtcttagtacaaataaaatacgaaggcaccgatgcaccctgcaaaatccctttttcaacccaagatgaaaaaggcgtaacccaaaatgggagacttataaccgcgaaccctatagtaactgacaaagaaaaacccgtaaatatagaggcagagcccccgtttggagagagttacatagtaatcggcgcaggagaaaaagcacttaaactgagttggtttaagaaaggaagtagcataggcaaaatgttcgaagccacggcgagaggagctagacgaatggctatactgggtgacacagcgtgggatttcgggtcaataggcggtgtgtttacgagtgtcggaaaattagtgcatcaaatctttggaacagcctacggcgttctcttttctggtgtaagctggacgatgaaaatcggaataggggtactactgacatggttaggactaaattctagaagcacgagtctcagcatgacttgtattgctgtaggtctagttacgctatatcttggtgtgatggtgcaagcagattcgggctgtgttatcaattggaaaggtagagaattgaaatgcgggtcggggatatttgtaaccaatgaagtacatacatggaccgaacaatataaatttcaagcagactctcctaaacgattaagtgcggcaatagggaaagcatgggaagaaggcgtatgtggcataagaagtgcgactagattggaaaatataatgtggaaacaaatatcaaatgaactcaatcacattctattagagaatgatatgaaattcacagttgtggtcggtgatgtagcaggaatcctagcgcagggcaagaaaatgattagaccacaaccaatggaacataaatattcatggaaatcatggggcaaagcaaaaattattggagcggatgtgcaaaatactactttcataattgatggacccaacacgccggaatgccctgacgaccagcgtgcctggaacatatgggaagttgaagattatggattcggaatttttactacgaatatatggctcaaattaagagattcatatacacaagtatgcgaccatagattgatgagtgccgctattaaggatagcaaagccgtacatgcagacatgggatactggatagagtcagaaaagaacgaaacctggaaactcgctagggcctcatttattgaggtaaaaacatgtatatggccgaagtcgcacaccctgtggtcaaatggcgtcctagagagtgagatgattatccctaaaatatatgggggacccatctctcaacacaattaccgacctggatactttacacagactgcaggaccatggcatttaggtaaattggagttagactttgatttatgcgaagggacgactgtagtcgtcgatgaacattgtggaaaccgtggcccaagtttaaggaccactactgtcacagggaaaattatccatgaatggtgttgcaggagctgtacactaccacccctcaggtttcgcggtgaggacggctgttggtatggtatggaaattcgcccagtgaaagaaaaggaggaaaacttagttaaatcgatggtatctgctggcagcggcgaagtagattcctttagtctcggacttttatgcattagcatcatgattgaagaggtaatgaggagtcgatggtccagaaagatgttaatgacgggaacattggcagtatttttcttattaataatgggtcaattaacatggaatgacctcatcaggctatgcataatggttggggcgaatgcttcagatcgtatgggaatgggtactacatatttagccctaatggctacatttaaaatgagacctatgttcgcagtaggccttctgtttcgacgtttaacatctagagaagtactactcctaacaataggattgagcttagttgcatcagtagagttgccaaactcactagaagaattgggagacggcttagctatgggtatcatgattttgaaattactgactgattttcaatctcatcaattatgggcaacactgctgtcattaacgtttataaaaacaaccttctcgctccattatgcctggaagactatggcaatggttttaagtatagtgtcactgtttcccttatgcttgtcaacgacttcgcagaaaacgacatggttacctgtgctattaggatcattgggttgtaaacccctaactatgtttttgatagcagaaaataagatctggggtcgtcggagctggccactcaacgaaggaattatggcggtcggaatagttagtatccttttatccagcttattgaaaaacgatgtcccactagctggaccgttaatagcaggaggaatgttaatagcatgctatgttatatcggggagttctgccgacctatccttagaaaaagctgcagaagtttcatgggaagaagaagctgaacactccggagcatctcataacatcctggttgaagtacaagatgacggaactatgaagataaaggatgaggaacgtgacgatacactaaccattctcttaaaagcaacgttattagcagtaagtggtgtctacccgttaagcattccagcaacattattcgtatggtacttctggcagaagaagaaacaaaggtcaggagtattatgggacacaccttccccaccagaagttgaacgcgcagtactagacgatggcatatatcgaattatgcaacgaggattacttgggagatcacaagttggggtcggggtattccaggagaatgtgtttcacaccatgtggcacgtgactcgaggggcggtgttaatgtaccaaggcaaacgtcttgaaccttcctgggccagcgtaaagaaagacttgatatcatatgggggcgggtggaggttgcaaggctcctggaatacaggtgaagaggtgcaagttatagcagttgagccaggcaagaacccaaagaatgtacaaaccgcaccaggaacatttaaaacccccgagggagaggtcggcgctatagcgttagatttcaagccgggaacatccggttccccaatcgttaatagagaaggtaaaattgttggattatatggtaatggcgtcgtaacaacaagcggaacttacgtcagcgcaatagcacaagcaaaagcaagtcaggaaggtcccttacctgagatagaagatgaagtttttcgtaaaagaaacctaacaattatggatcttcatccaggatctgggaaaacgagacgatatttgcctgcgatagttcgagaagctattaagcgaaaactaagaactctaattctcgccccaacacgtgtggttgcaagtgaaatggcagaggcactgaagggtatgcccattagatatcagacaacggccgtgaaatctgaacatacgggtaaagaaattgtggatttaatgtgccatgcaacatttactatgaggttactttcgcctgttagagtcccgaattacaacatgataatcatggacgaggcacactttactgacccaagtagtatagcggctagagggtatatatcaactagagtgggaatgggggaagcagcagcaatattcatgacggcaaccccaccagggtcagcagaagcattcccccaatctaatgctgtcatccaagatgaagagagagatattcctgaaagatcctggaactcaggatacgagtggataacggattttcctggaaaaacagtttggtttgtgccttcaataaaatcaggtaacgatatagccaactgtctaagaaagaatggaaagcgcgtaatacagctttcgcgcaaaacatttgacacggagtatcagaagaccaaaaacaatgactgggattatgttgtcactactgatatctcggagatgggagcaaatttccgcgcagacagggtaatagacccaaggcggtgcctaaaaccagtaatattaaaagacgggccggaaagagtcatattagcaggaccaatgcccgtaacagttgcatctgctgcacaaagaagaggccgaataggaagaaatcataacaaagagggtgatcaatacatatatatgggccaaccattaaataacgatgaagatcacgcgcattggaccgaagctaaaatgctgttagacaatataaatacaccggaagggattataccggcacttttcgaacccgaaagagaaaagagcgctgcaatagatggtgaatatcggctaaggggtgaggcccgaaagaccttcgtggaattgatgagaagaggggatttacccgtttggttgagctataaagtagcttctgaaggttttcaatatagtgacagaagatggtgtttcgacggcgaacggaataatcaagttttagaagagaatatggacgtcgaaatttggactaaagaaggggagagaaagaaactacgaccgagatggctagatgcacgcacctatagcgatcccttagcacttagggaatttaaagaatttgcagcaggccgacgttcagttagtggtgatctcatattagaaattggtaaactaccccaacatttgacacaacgggctcaaaacgcactagacaatttagtaatgttacacaattcagagcagggtggcagagcttatcggcatgcaatggaggaattaccagatacaatcgaaacactgatgctgctagcgctaatagcagtcttaacaggaggtgttaccttattctttttaagtggaagaggtttaggaaaaacatctataggcctactctgtgtaatggcttcctctgtactactgtggatggcgagtgttgagccgcactggatagcggcatcaattatacttgagttcttccttatggtgctgctgataccggaaccagatcgtcaaaggacccctcaagacaatcaattagcatacgttgtaattggtcttttatttatgattttaacagtggcagccaatgaaatgggcctacttgagaccaccaagaaagacttgggaattggtcatgtagctgtggaaaaccatcatcatgcagcaatgcttgacgtcgacctgcatccagcatcggcctggactctgtatgcggtagccacaaccatcataacaccgatgatgcgtcacaccatcgaaaatacaacagctaatataagtcttacagccatcgcaaatcaagcggcaattctaatgggtttagataaaggatggcctatttcgaagatggatataggagtgccattgttggctttagggtgctactcccaggtaaatcccctaactcttaccgccgcagttttaatgctagttgcgcattatgcaattataggccctggattacaagctaaagcaacacgtgaagcacaaaaacgaaccgcagctgggatcatgaaaaaccctactgtggacgggatagtagctatagacctggacccagtcgtgtacgatgcaaagtttgaaaaacaacttggtcaaatcatgttattaatattatgtacgtcacaaattctactaatgagaaccacatgggctttatgtgaatcaattacattagctactggaccactgactacgctatgggaaggttccccaggtaagttttggaatacgactatagcagtttctatggcaaatatctttcgaggatcctacctcgctggcgcggggttggcgtttagtttaatgaagtcattaggaggtggtagaagaggtactggtgcacagggagaaactttaggggaaaagtggaaacgtcagttgaaccaattgagcaaatctgagttcaatacctataaaaggagtggaataatggaagtagatcgaagcgaggctaaagagggtttgaaaagaggagaaactactaaacatgctgtttccaggggaacagctaaattacgatggtttgttgaacggaacctcgtaaaacccgaagggaaagttattgatttgggatgtggacgagggggttggagttactattgtgccggtctaaagaaagtcactgaagtaaaagggtacaccaaaggcgggccaggacacgaagaaccaatacctatggccacttatgggtggaatctggtcaagctacatagtggtaaggatgtgtttttcataccacccgagaaatgcgatacgttactatgtgacataggagaaagtagcccaaacccaacgattgaagagggaagaacgctacgagttctcaaaatggttgaaccatggttgcgaggcaatcaattctgtataaagatactaaacccatatatgcccagcgttgttgagacattagagcaaatgcaaagaaagcacgggggtatgctagtaaggaaccctttaagcaggaatagcactcacgaaatgtactgggtctcatgtggaaccggaaatatagtttcggcagtaaacatgacttctcgaatgttgctaaatcggttcaccatggctcatagaaaaccaacttatgaaagagatgtggacttgggagccggaaccaggcacgtagcagttgaaccggaagtagcaaatctagacatcataggtcaaagaattgaaaacataaaacacgaacacaaaagcacttggcactacgatgaagataacccctataaaacctgggcgtatcatggctcatatgaagtcaaaccctcgggaagcgcttcctctatggttaatggcgttgtcaaattactgactaagccttgggatgtaattccaatggtaacacaaatcgcaatgactgataccacgccatttgggcaacaacgggtatttaaagagaaagtcgatactaggacgccgaaagcaaaacggggcaccgcacagatcatggaggtaaccgcaaaatggctatggggcttcctcagccgcaataagaaacctcgtatatgtactcgtgaagagttcactagaaaagtacgctctaatgccgccattggcgcagtctttgttgacgagaatcaatggaactctgcaaaggaagcagtcgaagacgaacgattctgggacctagtacatagggaacgcgaactgcataagcaaggaaagtgtgcaacatgtgtatataatatgatgggaaagcgcgagaagaaactcggcgaatttggcaaggccaaagggtcgagagcaatatggtatatgtggttgggagcaagatttttagagttcgaagcactaggattcatgaatgaagatcattggttctcccgcgaaaattccctaagtggagtagaaggggaggggttacataaattgggatacatactccgcgatatttctaaaataccaggtggaaacatgtatgctgatgatactgcgggatgggacactaggataacagaagatgatcttcaaaatgaagctcgtataacagatataatggaacctgaacatgctttattagctaaaagtatctttaagttgacatatcaaaataaagtggttagggtgcaacgtcccgctaagaacggaactgtgatggatgtaatatcacgaagagatcaaagaggatccggccaagtaggaacgtacgggttgaatacattcacgaatatggaagcacaactaattaggcagatggacagtgaaggcatcttctcaccttctgaattggagacgccaaaccttgctgaaagggtattagattggctggagaaatatggagttgagaggttgaaaagaatggctatttcaggtgacgactgtgtagtaaaaccgatagacgacagatttgcaactgcattaacagcgctaaatgatatggggaaggttcggaaagatattccgcaatgggagccatcaaaagggtggaatgactggcagcaagttccattctgttcccatcatttccaccaactcataatgaaagatggaagagaaatagtagttccttgtcgaaatcaagatgaattagtcggaagggctcgagtatcacaaggtgccggctggagcctacgagaaacagcttgtttaggtaaaagttatgcccaaatgtggcaacttatgtattttcatcgacgtgatctaagactcgcagcaaatgctatttgttcggcagttcccgtagattggataccaacaagccgaaccacatggtcaatccatgcacatcatcaatggatgacgactgaagatatgttgagtgtctggaatcgagtgtggatcgaagagaacccttggatggaagataaaactcacatcagttcttggggtgacgtcccttatttaggcaaacgggaggaccaatggtgtgggtcattaattggactaactgcaagagcaacatgggcgactaacatccaagtcgcaatcaatcaggtccgaaggctaataggcaacgagaattacctagattatatgaccagtatgaagcggtttaaaaatgaaagtgatcctgaaggtgcactatggtaa

SEQ ID NO: 21954 - RNA, 9879 nt, synthetic construct
  misc_feature 1..9879: note = derived and/or modified CDS sequence (opt6) from DENV-1__EU482519__SS-prME
  source 1..9879: mol_type = other RNA
tctgtgacaatgttattaatgttaatgccaacagctttagcatttcacttaacaactcgagggggagaaccacacatgatagtaacgaaacaagaaaggggaaaaagcctactatttaaaacaagcgcaggagtgaatatgtgtacattaatcgcaatggatttaggagaattgtgtgaagacactatgacttataaatgccctaggattacagaagctgaacccgacgacgtagattgttggtgcaatgccacggatacttgggtcacgtatggaacttgctcacaaacaggagaacatcggcgggacaagagatcagttgctttggcgccacatgtaggtttaggattagaaacacgtacggaaacatggatgtccagcgagggagcatggaagcaaatacagcgtgtagaaacctgggctttgcggcaccccggtttcacagtgatggccttatttttggcccacgccataggaacttccattactcaaaaagggatcatctttatcttgctcatgttggttacaccttctatggcgatgagatgtgtcggaataggaagtcgcgatttcgtcgaggggctatccggcgccacctgggtagatgtagttttggaacacggcagctgcgtcacaacaatggccaaagacaagccgacgctagatatagaactactaaaaaccgaagttacaaatcctgccgtcctaaggaaactttgtattgaagccaagataagtaatacaacaacagatagtcgatgccccacgcaaggggaggcaacgttgatggaagaacaagatgcgaacttcgtatgccgcagaacttttgtcgatcgcggatggggaaacggttgcggactcttcgggaaaggatctttaatcacatgtgcaaaatttaagtgcgtaactaaattagagggaaaggtagttcaatatgagaatttgaagtactcagtgattgtaacagttcatacaggagatcaacatcaagttggtaacgaatctacagagcacgggacaactgcaacgataacgccgcaagctccaacctcggaaatacaactaacagactacggagcattaacgttagactgttcacctcgtacgggattggacttcaacgaaatggtattacttactatgaaagaaaagagctggctggttcacaagcagtggtttttagatttgcccctaccatggacgtctggagcgtcgacgtcacaggaaacttggaatcgacaggacctcttagttacgtttaaaacagcacacgctaagaaacaagaagttgtggtgttaggttcccaggagggtgcaatgcatactgctcttacaggagcaaccgaaatacaaacgagcggtactacaacgatttttgcaggacatctaaaatgccgcttaaagatggataagttaacgttaaaaggtatgagctatgtaatgtgtactggatctttcaaattggaaaaagaggtggctgaaactcaacatgggacagttctcgttcaaataaaatacgaagggacagatgcgccctgtaaaataccattcagcacacaggacgaaaagggtgtaattcaaaatggaagactaataacagccaatccaatcgtcaccgacaaagaaaaaccagttaacatagaggcagaaccaccttttggtgaaagttatattgtcatcggtgtaggagaaaaagccttaaagttaagttggtttaagaaagggtcaagcattggaaaaatgtttgaagctacggcacgaggagctcgtcgtatggcaatactaggcgacacggcttgggacttcggatcaattggaggagtttttacgagtgtcggcaaactcgtacatcagatatttggaaccgcatatggtgtattattttcaggggtatcttggactatgaagataggcattggtgttctgctgacatggttaggattaaacagcagatcaaccagcttgagtatgacttgcattgcggtaggtttagttactctttatctgggtgttatggtacaggcagatagtgggtgcgttatcaattggaagggtagagaactaaaatgcgggagtggaatcttcgtgacgaatgaagtgcatacttggacggaacagtacaaatttcaagcagatagcccgaaacgattgtctgctgctataggcaaggcatgggaagaaggcgtgtgtggaatccggtccgctactcggttagagaatataatgtggaagcaaatcagcaatgaactcaatcatatattactagaaaacgatatgaaatttacggttgtcgtaggtgatgtagtgggtattctagcacagggcaagaaaatgataagaccccaaccaatggaacataaatattcgtggaaatcgtgggggaaagcgaaaattattggcgcagatgtacaaaatacgacgtttataattgatggacctaacacacctgagtgccctgatgatcaaagggcttggaacatttgggaagtagaggattatggtttcggaatttttacaacaaacatatggttaaagttacgtgactcttatacacaagcatgtgatcatagattgatgtccgcagcgataaaagactcgaaagcagtacacgcggacatggggtactggatagagagtgagaaaaacgaaacctggaaattggcacgagcaagtttcatcgaagtcaagacgtgtatttggccaaagtcacacacattgtggtcaaacggagtattagaatcagaaatggtaattcccaaaatttatggaggaccgatcagccaacataactatcgccccggctatttcacccaaacggctggaccgtggcatttaggcaaactagaattagatttcgatctctgcgaagggacgacggtcgttgtagacgagcactgtgggaatagaggaccaagtctacggactaccactgtaacaggcaagattatacatgaatggtgctgtagatcatgtacccttccacctttaagattcaaaggtgaagacggatgttggtacggcatggaaatcagacccgtgaaagaaaaagaagaaaatctagtaaaaagcatggtgtctgctggatcgggggaagttgattctttctccttaggattgctgtgtatctcaataatgattgaagaagtaatgcgaagtagatggtcgagaaagatgcttatgaccggaactttagcagttttcctactccttataatgggacaactcacgtggaacgatttgacccggttatgtattatggtaggggctaatgcatcagatcgtatgggcatggggactacctatttagctttgatggcgactttcaagatgagaccaatgtttgcggtaggattattatttcgaagactaacttctcgcgaagtattattactaaccatcggactaagccttgtagcttccgtagagctaccaaatagtttagaagaactgggcgatggattggcaatgggaattatgatactaaagctcttaacggattttcaaagccatcaactctgggcaacactcctcagtctgacctttattaaaactacactttctctccattatgcatggaagacaatggcaatggtactcagcatagtctccctcttcccactatgtctatcaactacttctcagaaaacaacctggttacctgtgctgctaggatctcttggctgtaagcctttgactatgttcctaatagctgaaaataaaatatggggaaggaaatcgtggcccttaaacgaaggaattatggccgtaggcgtagtatcaatattgctgtcttcgctacttaagaacgacgttccactagcaggaccgttgatagcaggaggaatgttaatagcgtgctatgtaatttcaggatcttcggccgacctcagcttagaaaaagcagctgaagttagctgggaggaggaagctgaacacagtggtgcaagtcataatatattggtagaagttcaagatgacggcacaatgaaaataaaagacgaagaaagagacgacactttaactatactactcaaagcaacgctgctagcagtgagtggtgtataccctcttagtatacctgcaacactcttcgtttggtatttttggcaaaagaagaaacagagatcgggggtattatgggatacaccatctccaccggaagttgaaagagctgtattagacgacgggatttaccgcataatgcaaagaggacttcttggtagaagccaggtcggtgttggagtttttcaagagaatgtatttcatactatgtggcacgtgacaaggggtgcagttcttatgtaccaagggaaacgattagaaccatcatgggctagtgtaaagaaagacctaatctcttatggtggtggatggagattgcaaggtagttggaatacaggggaagaagtacaggttatcgcagtagagccaggtaaaaatccgaaaaacgtgcaaacagcacccggcacattcaaaaccccagaaggagaggtaggcgctatagcattggacttcaaacccggtacatcaggttcaccaatcgttaatagagaaggaaagatagtaggcctttacggaaatggtgtagtgactacctctgggacatacgtaagcgccatcgctcaggcgaaagcatctcaagagggtccacttcctgaaatagaggatgaagtttttaggaagagaaaccttacaataatggacttacatcctggttctggtaaaactcgccggtatttgccagcgattgttagagaagcgattaaaagaaaactacgcacactaatcttggctccaactagagtagtagcatctgaaatggcagaagctcttaagggcatgccgatacgataccaaacgacagcagttaagtctgaacatacaggtaaagaaatcgttgatctcatgtgtcacgcaacgttcaccatgcgattgttatctcccgttcgtgtaccaaattacaatatgataattatggatgaagctcactttaccgaccccagttcaattgcagctcggggatatatttctacgcgtgttgggatgggtgaagcagccgcaatctttatgacagctacaccacccggatctgtagaagcatttccccagtcaaacgccgtaatccaagatgaggaacgagacatacccgaacgaagttggaactccgggtatgaatggatcacagactttcctggcaaaacagtgtggtttgttcctagcatcaagagcgggaatgatatagcaaattgtctaagaaagaatggaaaacgtgtaatacagttaagccggaagaccttcgacacagaataccaaaagaccaaaaacaatgactgggattatgtagttactactgacatcagcgaaatgggagcgaattttagagcagacagggtaatagaccctaggagatgtttaaagcccgtaatattaaaagacggacctgagcgggtaatattagcaggccctatgccagttaccgtcgcaagtgctgcacaacgtagaggtagaatcggtagaaatcacaataaggaaggagatcaatatatttatatgggtcagcccctcaataatgatgaagatcatgcacattggacagaggcaaagatgttattagataacataaacactccggaaggaataattcctgctctattcgaacctgaaagagaaaagtcagcagcgatagatggagagtatagattaaggggagaagcacgtaaaacctttgtcgaattaatgaggagaggggacttgccagtatggctgagttacaaagttgcatcagagggatttcagtactctgatagacgctggtgctttgatggtgaaagaaataatcaggtgcttgaagaaaatatggatgtagaaatctggactaaggaaggagaaagaaagaaattaagaccacgatggctagacgcgagaacttattcggatccgcttgcattaagagaatttaaagagtttgccgcgggtagacgtagcgtatccggagaccttatattggagataggaaaattaccacagcacctaactcaaagagcccaaaatgctctggacaatctcgtaatgcttcacaatagtgagcaaggtggtcgagcataccgacacgcgatggaagaattgccggatacaattgaaacccttatgttgctagcacttatagcggtactaacaggtggagtcacactatttttcctaagtggacggggactgggaaagacgtcaatagggctcctatgtgtgatggctagttccgttttattgtggatggcatcggtagaaccgcactggatagcagcatcaataatattggagttcttcctcatggtattactgattcctgaaccagataggcaacggacgccacaggataatcaacttgcctatgtagttattgggcttctattcatgatattaactgtggctgcaaacgagatggggttacttgagacaacgaagaaagacctaggcattgggcatgtcgcagttgagaaccatcatcacgccacaatgttagacgtagacctacatcctgcatctgcatggacattatatgccgtcgcaacgacgatcataacgcccatgatgagacatacaattgaaaatacaacggcaaacatatctctaaccgctattgccaatcaagcggcaatactgatgggacttgacaaaggctggccaattagtaaaatggatattggagtgccattactcgccctaggttgttacagtcaggtaaacccactcacactaaccgcggctgtgctgatgcttgttgcgcactacgcaattatagggccaggccttcaagctaaagctactcgagaagcacaaaaacgtactgctgccggcatcatgaaaaatccgacggttgatggaattgttgcgatagatttagatccggttgtatatgacgctaaatttgaaaaacaactcggtcaaataatgctattgattttatgcacaagccaaatactgttgatgagaacaacatgggcgctgtgtgagtccattacactagcgacaggaccactaaccacattatgggaaggaagtccgggtaaattttggaacacaactatagcggtttcgatggccaacatctttcgcggtagttatctagctggagcaggacttgcattctcattgatgaaatcattgggaggcggtcgcaggggtactggggctcaaggcgaaacattgggagaaaaatggaaaagacaactaaatcaactgtcgaaatcagagttcaatatatacaaaagatcaggaataatggaagttgatcggagtgaggcaaaagaaggacttaaaagaggtgaaaccaccagacatgctgtttcacgtgggactgcgaaactccgatggtttgtagagcgcaacttagttaaaccagaagggaaggtcatagacctagggtgtggacgtggcggatggtcatattattgcgccggactaaagaaagtcactgaagtaaaaggatacactaaaggaggacctggtcatgaagaaccgatacccatggctacgtatggatggaatctcgttaaacttcatagcggtaaagacgttttcttcacaccaccagaaaaatgcgacacgttattatgtgatattggagaatctagcccaaatcctaccatagaagaaggcagaacattaagggtactaaaaatggtagagccatggttaagaggtaatcaattctgtataaaaatactaaacccatatatgccaagcgtagtagaaacattagagcaaatgcaacgtaagcacggaggaatgttagtcagaaacccactaagtagaaactccacccacgaaatgtactgggtgtcttgtggcacaggcaatattgtttcggcagtaaatatgacttcaaggatgttattaaatagatttactatggctcacaggaaacccacctacgaacgcgacgtcgatttgggagccggcaccaggcatgtagcggtagaaccggaagtggccaatctagacataattggacagagaatagagaatataaagcatgagcataaatctacttggcactacgacgaagataatccgtataaaacttgggcgtatcacggaagttatgaagtaaaacctagtggttctgcctcttctatggtaaacggcgtagtcaaacttttgactaaaccttgggatgtgatcccaatggttactcaaattgctatgacggatacgacaccgtttggacagcaaagagtttttaaagaaaaggttgatactcgaacaccaaaggcaaaaaggggcacagcgcaaattatggaggttactgcaaggtggctatggggcttcttatccagaaataagaaaccacgtatctgtactagagaggaatttacacgaaaagtaaggtctaatgcagcaataggcgctgtatttgtagatgaaaaccaatggaactcagcaaaagaagcagtagaagacgagagattttgggatttagtccaaaaagaacgggaattgcataaacaaggtaaatgtgctacttgcgtgtacaatatgatgggaaaacgagagaagaagctaggagaatttggaaaggcaaaaggaagtagggccatatggtacatgtggctaggggcccgcttcctagaatttgaggctttaggttttatgaatgaagaccactggttttctagagaaaactcactttctggagtagagggtgaaggtctacataaattaggctatatcctacgcgacatttcgaagataccaggaggaaatatgtatgcagatgatacagcaggatgggatacacgaattacagaagatgacttacagaacgaggctaaaataaccgacattatggaaccagaacatgccctattggccacttcaatatttaaattaacctatcagaataaagtagttcgggtacaacgtccggccaaaaacggaacagttatggatgtgatatcacgtcgcgatcaaaggggttctggacaagtagggacatatggtctgaatacttttacgaatatggaagcacaattaattcgacaaatggagtcagagggtatatttttacctagtgaattagaaacccccaatttagcagagagagtgctcgactggctagaaaaacatggtgtagaaaggttaaaaaggatggccataagtggtgacgattgcgtagtcaagcctatcgacgaccggtttgctacggcattaactgccttaaatgatatgggcaaggtgcggaaagacattccccagtgggaaccttctaaaggttggaacgattggcaacaagtccctttctgttcgcatcactttcatcaactaattatgaaagacggtagggaaatagtagtgccatgtcgaaatcaagatgagctagtagggagagcccgcgtaagtcaaggagcaggttggagtttgcgcgaaactgcatgtctcggcaaaagttatgcacagatgtggcaattaatgtatttccaccgtcgagatttaaggttagcagcaaatgctatctgcagcgccgtgcctgtagattgggtacctacttcccgaacaacttggagtatccacgcccaccatcaatggatgacaacagaagatatgcttagtgtctggaatagagtatggatcgaggaaaatccctggatggaagataaaacgcatgtatcatcctggggtgatgtcccgtaccttggaaagcgagaagatcaatggtgcggcagcttgatcggactgactgctagagcgacctgggcatcaaatatacaggtagcaattaatcaggtacgacgactaataggaaacgaaaattatttagactacatgacctccatgaaacgcttcaaaaatgaaggtgaccctgaaggggcactatggtaa

SEQ ID NO: 21955 - RNA, 9879 nt, synthetic construct
  misc_feature 1..9879: note = derived and/or modified CDS sequence (opt6) from DENV-1__EU482520__SS-prME
  source 1..9879: mol_type = other RNA
tctgttacgatgttgttaatgctaatgccaactgcattagcattccatcttactactcgaggtggagagccacacatgattgtatcaaaacaagaaagaggaaaaagcctattattcaaaacttcggcgggagtgaatatgtgtacattgattgctatggatctaggtgaactctgcgaagacacaatgacttataaatgtccgagaatcacagaaacggagccagatgatgtggattgctggtgtaatgcaacggacacctgggttacatatgggacatgctcccaaacaggagaacatagaagagataaaagatcagtcgcattagcaccccacgtaggattaggattagaaaccaggacggaaacctggatgagttcggaaggagcttggaaacaaatccagcgagttgaaacatgggcgcttagacatccgggctttaccgttatagcgttgttcctagcgcatgctataggaacctcgataacacaaaaaggaattattttcatactactaatgttagtaaccccttctatggctatgcgatgtgttggtataggtagtcgcgatttcgtcgaaggattatcaggcgcaacatgggtcgacgtggtattggaacacggatcatgcgtaaccacgatggctaaggacaaaccaacattagacatcgaactgctaaaaaccgaagtcactaaccctgcagtacttagaaaattgtgcatagaagctaaaattagtaacaccacaacagatagtaggtgtccaactcaaggggaagctactctagtagaagaacaagacgccaacttcgtgtgccgtaggacatttgttgatagaggatggggtaatggatgtggactgttcggtaagggttcactaataacttgtgctaaatttaaatgcgtaacgaagttagaaggcaagatagtacaatatgagaacttaaaatactcggtaatcgtgacagtccacactggagatcagcaccaagtcggtaatgaatcgactgaacatggtacgacagccacgataacacctcaagcgccaactaccgaaatacaattaacagactacggtgcgcttacgttagattgttccccaaggacagggctagactttaatgaaatggtactacttacaatgagagaaaaatcatggctggtacataaacagtggtttttagacttgccgctaccttggacaagtggagccagtacaagtcaggaaacatggaatagacaagacctcctagtaacattcaaaacagcacacgcaaagaaacaagaagttgtagttcttggatcacaagagggcgccatgcacaccgcgttaacaggagctaccgaaattcaaactagcggaacgaccaccatattcgcaggacatcttaaatgcaggctcaaaatggataaactaaccttaaaagggatgagctacgtaatgtgtactggctcatttaagttggaaaaggaagtcgcagaaacacaacatgggaccgttctagtacagataaaatacgaaggaactgatgctccttgtaaaatccctttctcgacgcaagatgaaaagggcgtgacccaaaatggaagattgataactgccaacccaatagttacagacaaggagaaacctgtcaatatcgaagctgaacctcctttcggggaatcgtacatcgtcataggagctggtgaaaaggctttaaaattatcttggtttaaaaaggggagcagcatcggaaaaatgtttgaggcgacggcacgtggtgctagacgaatggcgatattgggagacacggcttgggactttggttcaataggaggggtatttacttcggtagggaagctagtccaccaaatatttggtacagcctacggggttctattttccggtgtatcctggaccatgaagataggaataggcgttttactaacgtggctaggtttaaatagcagatcaacaagtttgtcaatgacgtgtatcgccgtgggcctagtaacactgtatcttggagtcatggtacaagcagatagtgggtgtgtaataaattggaaaggtagagaattaaaatgcggatcggggatatttgtgacaaacgaagtccacacgtggacagaacaatataaatttcaagccgatagccccaaacgtttatcagcagcaataggaaaagcatgggaagagggagtgtgtggcattaggtcagcaacacgattagagaatatcatgtggaaacaaatatccaatgaactcaaccacatattgcttgaaaacgacatgaaattcacagtggtggtaggtgatgttgccggcatactagcgcaagggaagaaaatgattcgaccacaaccgatggaatacaaatatagttggaagtcatggggaaaagctaagataatcggagcagatgtccaaaatactacctttatcatagacggacccaatacgcctgaatgcccagacgatcaaagagcttggaatatttgggaagttgaagattacggatttggaatattcacaacgaacatttggttaaaactcagggatagctatacgcaagtctgtgatcacagactcatgtcggccgcaataaaggatagtaaagcagtgcacgcagacatgggatattggatcgagagtgagaaaaatgaaacgtggaaacttgcaagagccagcttcattgaggtaaaaacttgcatctggccaaaatcacatacgctatggtcaaatggcgtattggaatcagaaatgataataccaaaaatctacggagggccgatttctcaacataattacagaccaggctatttcactcagactgccggaccttggcatttaggaaaattggaactcgatttcgatctatgtgagggtacaaccgttgttgtagatggacattgcggaaatcgcgggccttccctgcgaacaacaactgtaactggaaaaattatccatgaatggtgctgccgctcttgtacacttcccccattgcggtttaggggcgaagatggctgctggtatggtatggagatacgacctgttaaggagaaagaagagaatttagtgaaatccatggtatccgcaggaagcggagaggtggactcatttagtctaggactcttatgcattagcattatgatagaagaggtaatgaggtcgaggtggagtcgcaagatgttaatgaccggaatattagcggtgtttttcctactaatcatgggacagctcacttggaacgatctaatacgattatgtattatggttggcgcaaacgcctctgatcgaatgggaatgggtacaacatatttagcactaatggcaactttcaaaatgcggccaatgtttgctgtcggattattatttcgcaggttaacaagtagagaggttctattacttactataggattatccttagtagcatcagtggaattaccaaactctttggaagaactaggagacggtcttgcaatggggattatgatcctaaagctcctgacagattttcaaagccaccaattatgggcgaccctattatcactcacattcattaaaaccacattctccttacactatgcatggaaaaccatggcaatggttttatcgatcgtgagtttattccccctttgtttgagcactacaagccaaaagaccacctggctaccagtccttttaggcagcctaggatgtaaaccattaacaatgtttttaattgcagaaaacaaaatatgggggcgaagaagttggcctttaaatgaaggaataatggcagtaggaattgtctctattctactcagttcattgctcaaaaatgatgtgcctttagctggaccattaatagcaggagggatgttaattgcctgttatgtcataagcgggagcagcgcggatttatcactcgagaaggcggcagaggtgtcatgggaagaggaagctgaacattctggtgcatctcataatatattagtagaagtccaagacgatggaaccatgaaaattaaggatgaagaaagagacgacactctaacaatattattgaaagcaaccttgctagcagtctcaggtgtttatcccctatcaatccctgccacgctctttgtttggtacttttggcagaaaaagaaacaaagaagtggcgtattatgggatactccctcacctcctgaagtgggacgtgcggtcttagatgatggtatatacagaataatgcagagaggactgctcggaagatcgcaagtgggagttggtgtcttccaggaaaacgtatttcatacaatgtggcacgtgaccagaggcgcagttttaatgtatcaggggaagcgactagaaccttcatgggccagtgtcaagaaagatctgatatcttacggcgggggatggagactacaagggtcatggaatacaggagaagaggtacaggtaatagcggtagaacctggcaaaaatcctaagaatgtccagaccgctcctgggacgtttaagacacctgaaggagaagtaggcgccattgcactagatttcaaacctggaacttctggatctcctatcgttaatagagagggaaaaatagtaggtctatacggtaatggggtagtcacaacaagtggtacatatgtatcagctatcgcacaagctaaagctagtcaagaaggccctctcccagaaatagaggatgaagtattccggaagagaaacttaacaataatggatcttcatcccggctccgggaagacaagacgatatctaccagcaatagtaagagaagcgatcaaaagaaagctacggaccttgatactagcacccacacgcgtagtagcctccgagatggccgaggcattaaaaggaatgcccatacgttatcaaactacggcagtaaaatctgaacacacaggcaaggaaatagtggatctaatgtgccacgccacctttactatgaggctattatcacccgtacgtgtgcctaactacaacatgatcattatggacgaggcgcattttacagacccaagttctatagcagcgagaggatatattagcacgcgggtcggtatgggggaggcagcagcaatatttatgacagctacacccccaggtagtgttgaggcattcccccaatcaaacgcagttatacaagacgaagaaagagatatacccgaaagaagctggaacagtgggtatgaatggataacggatttccctggaaaaaccgtatggtttgtgcctagtataaaaagcggaaatgacatagccaactgcttacgcaaaaacggaaaaagggtcatacaactctcgcgtaagacttttgacacagaataccagaaaactaagaacaatgactgggattatgtggtaactaccgatatatctgaaatgggtgcaaattttagagctgatagagtaatagacccgagacggtgtttaaaacccgtaattttgaaagatggtcctgaacgggtaatcctggcaggtccaatgcctgttactgttgccagtgcggcacaaagacgcggtagaataggtaggaaccacaataaagaaggagatcaatatatttacatgggtcagccactcaataatgacgaagaccatgcccactggaccgaagcaaagatgttgttagacaacataaacacaccagaaggaataatacccgccctatttgagccagaaagggagaaaagcgcggcgatcgatggtgaatatagacttcggggcgaagctcgaaaaacatttgttgagttaatgaggaggggtgacctgccagtttggttatcatacaaagttgccagcgaaggctttcagtattctgaccgacggtggtgttttgatggtgaacgaaacaatcaagtattggaagaaaacatggatgtcgagatatggaccaaggaaggtgagcgcaagaaactaaggccacgatggctcgatgcaaggacttactcagacccattagctcttagagagtttaaggaatttgcagcaggacggcgttccgtaagcggcgatctgatcctagagattgggaagttgccccaacacctgacacaaagggcacaaaatgcattggataatttagtaatgttacataatagcgaacaaggaggacgagcataccgacacgctatggaagaactaccagacacgatagaaacattgatgttacttgcactaatcgcagtgttaacaggcggagtgacactattctttttatctggtagaggtctaggaaagacgagcatcggacttctgtgcgtaatggctagcagtgtacttctgtggatggctagtgttgaaccgcattggatagcggcatctattattttggaatttttcttaatggtcctactgataccagaaccggatcgtcaaaggacaccacaggataatcaattagcgtacgttgtaataggacttttatttatgatactaacggttgccgcgaatgaaatgggattactagaaacgacgaagaaagatctaggcataggtcacgttgccgtagaaaaccatcaccacgcagccatgctggatgtggatctacatcctgcatcagcttggacactttacgcggtggcaactaccattataacacctatgatgagacatacaatcgaaaacacaacggctaatataagccttaccgcgatagccaatcaagccgcgatcttaatgggattagataaaggatggccaattagtaaaatggatattggagtaccgctgttagctttaggttgctattcgcaggtcaacccacttactctaacagcagctgtactaatgttagtagcacattatgcaataatcggccctggtctacaagctaaggcaacgagagaggcacagaaacgcactgcagcgggaataatgaaaaaccctacagtcgacggtatagtagcaatagacttagatccagtcgtatacgacgcaaaatttgaaaagcagctgggacagataatgctacttattttatgcacgagccaaatcctactaatgagaacaacgtgggcgctctgcgaatctattacgcttgcaactggaccactcacaacattgtgggaaggatctccgggtaaattttggaacacaacgattgctgtttcaatggcaaatatttttcgcggaagttacctagcaggggcaggacttgccttctcattgatgaaatccttaggcggaggacgacgcggaacaggagcacaaggagagactcttggagagaaatggaaacgacaattgaaccaattatccaagtcagagtttaatacatacaaaagatctgggataatggaagtagatagaagtgaggctaaggagggactaaaacgtggggaaaccacaaaacacgcggtatcacgtggtacggccaaactcaggtggtttgtcgaacgcaatctagtcaaacctgaaggtaaggtaattgatttgggatgcgggagaggaggctggagttattactgcgccggtttaaagaaagtaacagaggtaaaagggtatacgaaagggggcccaggacacgaagaacccattccaatggcaacatacggatggaacttggtaaaactccatagcggtaaagatgtcttctttatccctcctgagaaatgtgatacactactctgtgacataggtgagagtagccctaatccaacgattgaagaaggccggactttacgcgtacttaaaatggtagagccatggctgcgaggaaaccaattttgcatcaaaatattaaatccctatatgcccagcgtcgtagaaacattggaacagatgcaaagaaaacacgggggaatgttggtaagaaatcccctatcgagaaattcaactcatgagatgtattgggtttcgtgtggaacaggaaacatagtctccgcggttaatatgacatctcgcatgctgctcaacaggtttacaatggcacatagaaaacccacatacgagcgcgacgtagatttaggcgcgggaacacgtcatgttgcagtagagcccgaagtagccaacttagatattattggacaaagaattgaaaacataaaacacgagcataaatctacttggcactatgatgaagataatccttataaaacgtgggcttatcatggtagctatgaagttaagccatcgggcagcgcctcgtcaatggttaatggtgtagtaaaactattaacaaagccctgggacgtgataccgatggtaacacaaatagccatgacggatacaacaccatttggtcagcagcgtgtattcaaggaaaaggttgacactagaacacctaaagcaaaaaggggaacagctcagataatggaagtaacagcaaaatggctttggggcttcctatcgagaaacaagaaacccagaatctgtacaagagaagaatttaccaggaaggtgcggtcaaatgcagcaataggtgctgtctttgtagacgagaatcagtggaactcagcgaaggaagcggttgaagacgaacgtttttgggatcttgtgcaccgagaaagggaacttcataaacaaggaaaatgcgcaacatgtgtatataacatgatgggtaaacgagagaagaaattgggcgaatttggaaaagctaaggggtccagggccatttggtatatgtggttaggtgctagattcttggagtttgaagcactggggtttatgaacgaggatcattggtttagtagagaaaactcgctcagcggagtagaaggcgaagggctccataaattagggtatatcctccgtgatatttcaaatatacccggcggaaatatgtacgcggatgatacagcaggctgggacacaaggattactgaggatgatcttcaaaatgaggctagaattacagatattatggaaccagaacacgcacttctagctaaatcgatatttaaattaacatatcaaaataaggtggtaagggtgcaacggcctgctaaaaatggcactgtaatggacgtaataagtagaagagaccaacgaggatcagggcaagttgggacgtacggcctgaacacgtttactaacatggaagcacaactaataaggcaaatggaaagtgaaggaatcttttccccgtcagaattagaaaccccaaatctagcagaaagagtattggactggcttgaaaaatatggagtagaacggctgaaaaggatggctatctcaggagatgactgtgtagtaaaaccaattgatgaccggttcgccaccgcgttaaccgccttaaatgacatgggtaaagtaagaaaagatatccctcaatgggagccatcaaaaggttggaatgattggcaacaagtcccattttgctcacaccatttccatcaattaataatgaaagacggacgggagatcgtagttccttgccgtaaccaggatgagctcgtagggagagcaagggtcagtcagggagcgggatggagtctgagggagacagcgtgtcttggcaaaagctatgcacaaatgtggcagctaatgtattttcacagacgtgacctacgccttgcagcaaacgctatatgtagtgcagtgcccgttgattggatcccgacatctagaacaacatggagtatccatgctcaccaccaatggatgacaacagaagatatgttatccgtatggaacagagtatggatagaagagaacccatggatggaagataaaactcacatatccagctggggcgatgttccatacttaggtaaaagggaagatcaatggtgcggtagtttaatcggattgactgctagagcaacgtgggcaactaacattcaagttgctatcaatcaggtgaggagattaataggtaatgaaaattatttggactatatgacgagcatgaaaagattcaaaaacgaatctgacccagaaggagcgctatggtaa

SEQ ID NO: 21956 - RNA, 9879 nt, synthetic construct
  misc_feature 1..9879: note = derived and/or modified CDS sequence (opt6) from DENV-1__EU482521__SS-prME
  source 1..9879: mol_type = other RNA
agcgttaccatgttacttatgctaatgcctacggcattagcgtttcatttgacgaccaggggtggggaaccgcatatgatagtaagtaaacaagaacggggcaaatctctattatttaaaacaagtgcaggggtaaacatgtgtacgttgatagcaatggacctcggtgaattatgcgaagatacaatgacttacaaatgcccgagaatcacggaagctgaaccggacgatgtagattgttggtgtaacgctacagatacctgggtcacatatggtacatgttctcaaacaggagaacacagacgagataaacgcagcgttgcactagcacctcacgtcggacttggattagaaacaagaaccgaaacctggatgtcaagtgaaggggcttggaaacaaatccaacgagttgagacatgggcactacgacatcctgggttcaccgttatagccctttttctcgcgcatgccataggaacgagtataacccaaaaaggaataatattcattctgcttatgctcgtaacgccaagtatggcaatgcggtgcgtaggtattggtagccgagactttgtagaaggtttaagtggagccacgtgggtagatgtagtcttagagcatggatcatgcgtaactactatggcgaaagacaaacccaccctggatattgagcttttaaaaacagaagtcacgaacccagctatcttgcgaaaactatgtattgaagcgaaaatatccaacacaactactgacagtaggtgcccaacgcaaggcgaagcgaccttagtggaagaacaagatgcaaattttgtctgtagacgtacctttgtagatcgtggatggggcaacggctgcggcctttttggcaaaggatccttgattacctgtgcaaaattcaaatgcgtaacgaaactagaaggaaaaatagtacaatatgaaaatctcaaatattccgtcattgttacggtccacacaggagaccaacaccaagtgggtaacgaatcaactgaacatggtaccaccgccacaattacaccgcaagctccaactacagaaatacaactaactgattatggcgcattaacactagattgttcaccccgtaccggtttagatttcaatgaaatggttttattgacaatgaaagagaaatcatggctagtacacaaacaatggtttttagatttaccattgccatggacatcaggggcctcaacgtctcaagaaacatggaaccgacaggatctattagtaacttttaaaacagcacatgcgaagaaacaggaagtagttgttctgggatcccaagaaggagcaatgcacactgcgttaacaggagcgacggaaatacaaacgtctggaacaacgacgatattcgcaggacatctcaaatgtagattaaaaatggataagttaacactcaaaggaatgtcctatgtaatgtgcacaggctccttcaaattggagaaagaggttgctgaaacacaacatggcacagttctagtacaaattaaatatgaaggtacagatgctccttgcaagattccgtttagtacacaggatgaaaagggcgtaacgcaaaacggacgtctaattacggcaaatcctattgtaacggataaggaaaaaccagtgaatatagaagcagaacctccctttggtgaaagttatatagtaattggggctggtgaaaaggctttaaaactaagttggtttaagaagggatcgagtatcggtcgaatgttcgaggccactgccagaggagcacgacggatggcaatacttggagatacggcttgggacttcgggagtataggcggggtctttacaagcgtaggcaaattggttcatcaaatcttcggtacggcatatggcgtgttattcagtggagtctcatggacaatgaaaataggtattggcgtactattaacttggctaggtctgaacagcaggagcacctcctttagtatgacatgtattgcagtgggacttgttaccctatatctgggtgtaatggtccaggcagattcaggatgtgtgatcaactggaagggacgcgaactgaaatgcggttcaggcatttttgtcacaaatgaagtacatacgtggactgaacaatataaattccaagccgatagtccaaagcgtttgtcggcagcaattggaaaggcttgggaagagggagtttgtggtattcgatcagcgacacgtcttgaaaatattatgtggaaacaaattagtaatgaacttaatcatatactcttggaaaacgatatgaagtttacagtggtagtgggagacgtagctggtattcttgcgcagggcaagaaaatgattagaccccagccaatggaatataaatattcatggcgatcatggggtaaagctaagataataggcgcagatgtgcagaatactacgtttattatcgatggccctaatacaccagagtgcccagacgatcagagggcttggaacatttgggaggttgaagattatggatttggaatattcactaccaatatttggctcaaattacgtgattcttatacccaagtttgtgaccatagacttatgtcagctgcgattaaagactcgaaggcagtacatgcggatatgggctattggatagaatcagagaaaaatgagacatggaaattagcacgagcttcgtttatcgaagtcaaaacgtgcatttggccaaaaagccatacgttatggagcaacggagtgttggaaagtgaaatgattataccaaaaatttatggagggcctatcagccaacacaactatcgaccaggttacttcactcaaacagcgggaccttggcaccttgggaaattggaattggattttgatctttgtgaaggaaccactgttgttgttgatgaacactgtggaaacaggggcccgagtttaagaacaactacggtaacagggaagataattcatgaatggtgctgtcgatcgtgtaccttgcctcctctgcgatttcggggcgaggatggttgttggtatggaatggaaatacgtccggtcaaagaaaaagaagaaaacttagtcaagtcaatggtctctgcaggtagcggagaggtagatagcttttctcttgggcttttgtgcatatcgatcatgatagaagaagtgatgagatctagatggagccgaaaaatgttaatgacagggacgctcgcagtattcttactacttataatgggccaactaacatggaacgatctaatacgcctttgtatcatggtcggcgccaatgccagtgacagaatgggcatggggactacttatctagcgttaatggcaacattcaaaatgagaccaatgttcgcagtcgggttgctgttcagaagacttacaagcagggaagtgctactattgacaataggattgagtctcgtagcaagtgtagaattaccaaattcgttggaagaactcggcgatggattagcaatgggtataatgatattaaaacttcttactgatttccaatcccatcaactttgggcgacattactcagcctgacgtttataaaaactaccttcagtcttcattatgcctggaagacaatggcgatggtgttatcaatagtttcacttttccctttatgtctgagtacgacatctcagaagactacctggctacctgttcttttaggttcactcgggtgcaagcccctaaccatgtttttaattgccgaaaacaaaatatgggggcgccgctcctggccccttaacgaaggtataatggctgttggtatagttagtatacttttatcatcgttactaaagaatgatgttcctttagcgggaccgttaattgcagggggaatgcttattgcgtgctatgttatttcaggttcttcagcggatcttagcctagaaaaagctgcagaagtgagttgggaagaagaagcggaacacagtggggcgtcacataatatattagtggaagtacaagatgacggcactatgaaaattaaagatgaagaacgtgatgacactctaacgattttattaaaagcgactttattagcagtgagtggggtatacccgctaagcattcccgcaacactatttgtatggtacatatggcagaagaagaaacagcgatcaggagtattatgggatactccgtcacctccggaagttgaacgtgctgttcttgacgacggaatatatcgtatcatgcaaagaggactcttaggaagatctcaagtcggagttggagtctttcaagaaaacgttttccacacaatgtggcatgtaactcgtggtgcagtactaatgtaccaagggaagagattggaaccatcgtgggcctctgtcaagaaagacctaatttcatacggaggaggctggcggcttcaaggaagctggaacacaggagaggaggtacaagtaatagcagttgaacctggtaaaaatcccaaaaacgtccaaactgccccgggaactttcaagactccggagggggaagtcggagccatagccctagatttcaaacctggaacatcgggctcccctatcgtgaatagagagggcaagattgtgggtttatacggaaatggagtcgttacaacatcgggcacttatgttagtgcaatcgcacaagcaaaagcgtcacaagaaggtccattaccggagattgaagacgaagtttttagaaaacggaatttaactataatggatctccatccaggttctggaaaaacaagaagatacctaccagcaatagttcgcgaagccataaagcgtaaattgagaaccctcatactagctcctacaagagttgtagcttcagaaatggcagaggcattaaagggcatgcctataagatatcaaacgacagctgtcaaatcggaacatacaggtaaagaaattgtcgatctcatgtgccatgccactttcactatgagattattgtctccagttagagtacctaactacaacatgattattatggatgaagctcattttacggaccctagtagtatagcagcaaggggttatatctcaacacgtgttggtatgggagaagcagcagctatctttatgacagcaacccctcccggaagtgtcgaggctttcccccaatctaacgcggtaatccaagacgaagaaagggatattcccgagagaagttggaatagtggatatgaatggataacagacttccctggaaaaactgtatggttcgtcccatccataaagagtggtaacgatatagcaaattgtctaaggaaaaatggaaaaagggtgatccaactatcccgaaagaccttcgatacggaataccagaaaactaagaataacgattgggactatgtggtcacaacagatatctcagaaatgggagccaacttcagagcagatagagtcatcgatccacgtcgatgcttaaaaccagtcatactcaaagatggaccagagcgtgtaattctagcaggtcccatgccagtaacagtagcaagtgcagcacaacgtagagggcggataggtagaaatcataacaaggaaggagaccaatacatctatatggggcaacccctcaacaatgatgaggatcacgcgcactggacagaagctaaaatgttactagataatattaacactccagaaggtattatacccgccctatttgaacctgaacgcgagaaaagcgcagcaatagacggcgaatacagactgaggggtgaggcaagaaaaacttttgtagaattaatgagaaggggcgatctaccggtttggttatcatacaaggtagccagcgaaggttttcaatactcagatcgaaggtggtgtttcgacggggaacgtaataaccaagttttagaagaaaacatggatgtagaaatatggacaaaggagggtgaaaggaagaaattacgacctaggtggttagacgcacgtacttatagcgatccgttagcgctaagagagttcaaagaatttgcggcaggccgccgatcagtatcaggcgatttaatactcgagatcggaaaattaccacaacatttaacccaaagggcacagaatgctttagacaacctagtcatgcttcataattcggagcaaggaggaagggcatacagacatgctatggaagaactcccagacaccattgaaaccttgatgctcttagcgcttatcgcagtattaacagggggtgtaacactattctttctttccggtcgaggattaggaaagacgtcaataggtcttttgtgtgttatggcttcaagtgtattgctatggatggcctcagttgaaccacattggatagcagcaagtatcatattggagttcttcctaatggtgctcctgatcccggaaccagacagacaacgaaccccacaggataatcagcttgcctatgtggtcataggcctgctattcatgattttgaccgtagctgccaacgaaatgggattattagagacaactaaaaaggatctaggaattgggcatgtagccgttggcaatcatcatcatgccgccatgctagatgtcgatttacatccagcgtcggcgtggacattatatgctgtggcgacgaccatcataacccctatgatgagacacacaatcgaaaatacgacagccaatatctccctgactgcaatagctaaccaagcggccattcttatgggtttggataaaggttggccaataagtaaaatggacataggtgtacctctattagcattaggttgctatagccaagtcaatccattaacccttacagcagccgtactaatgttagttgctcactatgccattatcggcccaggactccaggctaaagcaacaagagaagctcagaaacggaccgcagcgggaataatgaaaaacccgacagtagacggcatagtagctatagaccttgaccctgtcgtctatgatgcaaaattcgaaaagcaactaggtcagattatgctattgatactttgcacatctcaaattttattaatgcgcacaacatgggctttgtgcgagagcataaccttagcaacgggaccgttaacgacgctgtgggaaggtagcccggggaaattttggaacaccacaatagcagtctctatggcaaacatatttagagggagctatctggctggtgcaggattagcgttttccctgatgaagtctttgggtggcggcagacgaggtactggtgcacaaggcgaaacacttggcgaaaagtggaaacgtcaactcaatcaattaagcaaatctgaatttaatacatataagaggtccggcataatggaagtagaccgatctgaagccaaggaaggacttaagcgaggggaaattacaaaacacgctgtatcgaggggtacagctaaacttcgttggtttgtggaaagaaacttagtcaaaccagaagggaaagtaatagatctaggttgtggtagaggaggttggtcgtactactgcgctggacttaagaaagtaactgaagttaaggggtacaccaaaggaggcccggggcacgaagaacctatacccatggccacctatgggtggaacctagtcaagctacattctggcaaagacgtattctttgtgccgccagaaaaatgtgatacattattgtgtgacataggagaatctagtcctaatccaactatcgaagaaggtcgcacgctacgggttctcaagatggtagaaccgtggcttcgcgggaaccaattctgtataaaaatacttaatccgtacatgccctctgtagtagagaccctggaacaaatgcagaggaagcatggaggcatgctggtcagaaatccgttatctagaaattctactcatgaaatgtattgggtgtcatgtggtactggaaatatcgtttcagctgtaaacatgacttcaagaatgctactcaaccgttttacgatggcgcatagaaagcctacttacgaacgagatgtagatctaggagcaggaactagacatgtagccgttgaaccagaagtagctaatctagacattattggacaacgcatcgaaaatataaaacacgaacacaagtcaacatggcactacgatgaggataatccatataaaacatgggcgtatcatggatcctacgaagtaaaaccgagcggtagcgcttcatcgatggtgaatggtgttgtaaaacttttgactaaaccttgggatgtcatacctatggtgacccaaattgcaatgaccgacaccacgccattcggtcagcaaagagtatttaaagaaaaagtagatacaagaacccctaaagcaaagagaggcactgcacagatcatggaggttaccgccaaatggctgtggggtttcttaagcagaaataagaaaccgcgcatttgtactcgagaggaatttacacggaaagtcagaagtaatgccgccataggggctgtttttgtagacgagaatcaatggaactctgcaaaagaagcagtagaagacgagcgtttctgggatttggtgcatcgcgaaagagaattgcataaacaaggtaaatgcgccacatgtgtgtataatatgatgggcaagagggagaagaaattaggtgaatttgggaaggcaaaaggaagccgagcaatatggtacatgtggctcggtgcacgatttttggagttcgaggcactaggttttatgaacgaggatcattggtttagtagggaaaactcactttcgggtgttgaaggagaagggttacataagttgggatacatactacgagatatcagcaaaataccgggtgggaatatgtatgctgatgacacagccggctgggatacacgaatcacagaagacgatctacaaaatgaggcccgaatcacggatatcatggagccagaacatgcactcttagcaaagagtatattcaaactgacgtatcaaaacaaagttgtaagagtacaaaggccggcaaagaatggaaccgttatggatgtcatatcacgaagggaccaaaggggatcgggacaagtgggtacctatggccttaatactttcacgaacatggaagcacaactaatccgacagatggaatccgaagggatcttctccccgtccgaactcgaaacgccaaatctagccgaacgggtactagattggctcgaaaaatatggtgtagaaagattgaaaagaatggcaatctcaggtgatgactgcgtagttaaacccatagatgacagattcgcgacagcattgactgccttaaatgacatgggaaaggttcgaaaagacatacctcaatgggaaccttccaaagggtggaatgactggcaacaagtccctttttgttctcatcactttcatcaattaataatgaaagatggtagagaaatagtggtgccctgtagaaatcaggatgaacttgtcggtagagctcgtgtttcccaaggtgcaggatggagcttaagggaaacggcatgtttaggaaaaagttacgcccaaatgtggcaattaatgtactttcaccgccgagacttacggcttgccgccaacgcaatatgttccgccgtcccagtcgattggattccaacatcaagaactacatggtctatacatgcgcatcatcaatggatgacgactgaagacatgctatcagtatggaatcgagtatggattgaagagaacccatggatggaagataaaacccatattagttcatggggagatgttccatatttgggtaaaagggaggatcaatggtgtggttcattgataggccttacggcaagagcgacgtgggcgacaaatattcaagttgccataaatcaagtaagaagattgattggaaacgaaaattatttagattatatgacgtcaatgaaaagatttaaaaacgaatcggatcccgaaggcgcactatggtaa

SEQ ID NO: 21957 - RNA, 9879 nt, synthetic construct
  misc_feature 1..9879: note = derived and/or modified CDS sequence (opt6) from DENV-1__EU482523__SS-prME
  source 1..9879: mol_type = other RNA
agtgtaactatgttactcatgcttatgcctacggctctcgctttccaccttaccacgcggggcggtgaacctcatatgatcgtaagtaaacaagaacgtggcaaatcactactattcaaaacctctgcgggagtgaacatgtgcacgttgatagcaatggaccttggagaactgtgtgaagataccatgacgtacaaatgtccacgaattacggaaactgaacctgatgacgtcgattgttggtgtaacgctactgacacttgggtcacttatggcacatgttcacaaacaggcgaacatcgacgagacaaacgttcggttgccttagctccgcacgtcggtctcggcttagagacaagaaccgaaacatggatgagttcagaaggggcatggaaacagatacaaagagtagaaacatgggcacttcgacaccccggcttcacagtgatcgcgctctttctagcacatgcgattggcacatctataacgcaaaaaggtataatttttatcttacttatgttagtaacgccttcaatggcgatgagatgcgtagggataggttcacgagattttgttgaaggactctcaggtgcgacctgggtagatgtagtgctcgaacatggatcatgcgttactactatggcaaaagacaaacctacattagacatagagctactcaaaacagaagtaacaaatccagctgtattacgaaaactctgtattgaggcaaaaattagcaacacaactacagattcgcgctgtccaacacagggcgaagcaacgttagttgaagaacaagatgctaacttcgtatgtagaagaacattcgttgatcgaggctggggaaatggatgtggactatttgggaaaggtagccttataacctgcgctaaattcaaatgtgttactaaactagagggtaaaatagtacagtacgaaaatttaaaatatagtgtgattgtcacagtgcacactggtgaccagcatcaagtcggcaacgagtctacagagcacggaacgacagctacaataactcctcaagctccaacgaccgaaatacaattaacagattacggcgctttaaccctcgattgtagtcctagaacaggattagatttcaatgaaatggtattactaacaatgaaagagaaaagttggctcgtgcacaaacaatggtttttggatttacctctaccttggacaagtggggctagtacctcacaagaaacatggaatcggcaagacttgctagtaactttcaaaaccgctcacgccaaaaagcaagaagttgtggttttaggttcccaagaaggtgcaatgcatacggcactaaccggagctacggagatacaaacatccggaacaacaacaatatttgcgggacatttgaaatgtcgattgaaaatggataaattaacgcttaaagggatgtcttacgtcatgtgtaccggtagttttaaacttgagaaagaggtagcagaaacacaacatggaacggtcttagtgcagatcaaatatgaaggaacagacgcgccatgcaaaattccattttcaacacaggatgagaaaggcgtgacacagaatggacgattaattactgcaaatccaatagtaaccgataaagagaaaccagttaatatagaagcagaacctccattcggagaatcttatattgttattggagcaggcgagaaggccctgaaactatcttggttcaagaaagggagctctattggtaaaatgttcgaagcaacagcacgcggtgcgagaagaatggccatcttaggtgacacagcatgggacttcggatcgataggaggagtcttcacttcggtaggcaagctagtacaccaaattttcggtactgcatacggtgtattgttttctggagtatcttggacaatgaaaataggcattggagtacttctaacatggttaggtttaaatagtagaagtacaagtttatccatgacatgtatagcagtaggacttgtaaccctttatcttggagttatggtacaagctgattctggatgtgttatcaactggaaaggtagagaattaaaatgtggaagtggtatttttgttacgaacgaggttcatacctggacggagcaatataaatttcaggcagattccccaaaaagattatcagccgcaatcggaaaagcctgggaagagggagtctgcggaatcagatcagcgacacgtcttgaaaacattatgtggaaacaaataagtaacgaactaaaccatatcttactggaaaatgacatgaaatttacagtggtggttggagacgtcgccggaatacttgctcagggtaagaaaatgataagaccacaacccatggaatataagtactcatggaaatcatggggcaaagcaaaaataattggagcagatgttcaaaacactacattcataatagatggaccaaatacccctgaatgtccagatgaccaaagagcttggaatatatgggaagtggaagattatggatttggtatctttacaacaaatatatggctgaagttgagagatagctatacacaagtctgtgatcaccgactaatgagtgctgctataaaagactcaaaagcagttcacgctgatatgggttattggattgagagtgagaaaaatgaaacttggaaattagcgagagcgtcctttattgaagtgaaaacatgtatatggccgaaaagccatacactatggagtaatggcgtgttagaaagcgaaatgataatccctaaaatttacggaggacctattagtcaacacaactatagaccgggatatttcacccaagcggctggtccctggcatcttggaaagttggaactagattttgacctatgcgaaggaactacagtagttgtcgatgaacattgcgggaaccgcgggccttcgttacgaacaacaacagtaactggaaaaataatacatgaatggtgttgtcgatcgtgtacattgccgccattgcggtttcgaggcgaggatggctgttggtacggtatggagattagaccagtaaaagagaaggaagaaaatctagtgaaaagcatggtatcggcgggaagtggagaagtggacagttttagcttaggattactctgcattagcattatgatagaggaagtaatgcgaagtagatggtcaaggagaatgttgatgacagggactttagcagtattcttcctattaataatgggtcagttaacttggaatgacctaatcagactatgcataatggtcggagcaaacgcgagcgatcgaatgggcatgggtacaacttacttagcactaatggctacttttaaaatgagaccaatgtttgctgtcggtctgctctttcgaagactgacaagtcgcgaagtcttactactaactatcggcttgtccttagtcgcctctgtagaattaccgaatagtctggaagaacttggtgatgggttggccatggggattatgattctgaaactacttacagattttcaaagtcatcaactgtgggcgacactgttatccttaacatttatcaaaacgaccttttctctacattacgcctggaaaacaatggcgatggtactatcgatcgtgtctctgttcccattgtgtctttcaacgacatcacagaagactacttggttaccagtactattaggttctttaggatgtaaaccgctcacgatgtttctaatcgcagaaaacaaaatttggggtagaaggagctggccactcaatgaaggaataatggctgtagggattgtttctattttgttgtcatccctcctcaaaaacgacgtaccattagccggacccctcatagcgggaggaatgcttatcgcctgttatgtaataagcggatcctcagcagatttaagcctcgaaaaagctgccgaagtctcctgggaagaagaggcagaacatagcggtgcaagtcataatatattagtggaagtacaagatgatgggacgatgaaaataaaagatgaagaacgtgatgatacgctaacgattctactgaaagcaacactcttagcagtatcaggagtttaccccctatctatacctgctacactattcgtttggtacttctggcagaagaagaaacaaagaagcggcgtcctatgggatacgccgagccctcctgaagtagaacgagcggtcttggatgacggaatttatcgtataatgcaaagaggattactgggcaggtcacaagtaggcgtgggagtatttcaggaaaatgttttccatacaatgtggcatgttactagaggggcggttctgatgtatcaaggaaaacgtctcgaacctagttgggcatcagttaagaaagacctaatctcttacggaggtggttggagattacaagggtcatggaatacaggtgaagaagttcaagtaatagcagtagaacccggcaaaaatcctaaaaatgtacaaacggctcctggaacatttaaaacgcctgaaggcgaggttggagccatagcattggacttcaagccaggcactagcggaagccctatcgtaaatagagaaggaaagatagtgggtctatatggaaacggtgttgttacgacatctggaacttatgtctcagccatagcccaggcaaaagcatcccaggaaggacccctcccggaaatagaagatgaagtgtttcgtaagaggaatttgacaattatggatctacatccaggttctggtaagactagacgctacttaccagcaatagtaagagaagctataaagaggaaattacgtacacttattttggctccaaccagagtggttgcatctgaaatggcagaggcgctaaaaggaatgccaatacgatatcagacaaccgcggttaagtcagaacataccggaaaagaaattgttgatttaatgtgccatgcgacattcacgatgagactactaagcccggttcgcgtgcccaattacaatatgattataatggatgaagcacacttcacagatcccagctctatagccgctagaggctatatatcaactcgagttggaatgggagaagcagctgccatattcatgacagccaccccaccgggatcagtcgaagcgttcccccagtcgaatgcagtaatacaggacgaagaacgtgacatcccagaaagatcctggaatagcgggtatgagtggataacagactttcccggcaagactgtatggttcgtaccaagtattaaaagcggaaacgatattgcaaactgcctaaggaaaaacggaaagagagtaatacaactaagtcgcaaaacgtttgacaccgaataccagaaaactaaaaataatgactgggactatgtcgtcaccacagatataagtgaaatgggagccaactttagagcagacagagttattgacccgcggagatgtttaaaaccagtcatattaaaagacggacctgaacgagtgatactagccggccccatgcctgtcactgttgcatcagccgcacaacggagaggacgaatagggcggaatcacaacaaagagggagaccaatatatttacatgggccagccactcaacaatgatgaagatcacgcacattggacagaagcaaaaatgctcctcgacaatatcaacacaccagaaggaataataccagcattgttcgaaccagaacgcgaaaaatccgctgctatagacggagaatatagattacggggagaggcacgaaagacattcgtagaattgatgaggcgaggagatttaccagtatggttaagctacaaggttgcaagtgaaggttttcaatatagcgataggaggtggtgttttgatggtgaaagaaataatcaagtattagaagaaaatatggatgtagaaatctggacgaaagaaggcgaaaggaagaaactacgaccacgatggcttgacgcccgaacttattccgaccccctagcattacgcgagtttaaagaatttgcagctggacgcagatcagtatcaggtgatcttatactagaaatcggcaagttaccccaacatttgacacaaagggcccagaatgcattagacaacctagtaatgctccataattcggaacagggtggccgagcgtacagacacgctatggaagaattaccagatacaattgaaaccctaatgcttcttgctttaattgctgtattgaccggaggtgttacattattctttctgtcaggaagagggttaggaaaaacgtcaataggcctattgtgtgtaatggcgtcatcagtgttattatggatggcctcagtagaaccacactggatagcggcatctataatattagaatttttcttgatggttttactgattccggaaccggatagacaacgtactccgcaagacaaccagctcgcctacgtagtcataggcttgttgttcatgatattgactgtagctgcaaatgagatgggtttacttgaaacaactaagaaagatttgggcatagggcacgttgcggttgaaaaccatcaccacgcagcgatgttagatgttgatctacacccggcaagcgcctggacgttgtatgcagtggcaactactataatcactcccatgatgcggcacactatagagaatacaaccgctaacattagtcttacggccatcgctaaccaagctgctatactaatgggacttgataaaggttggcctatctcaaagatggacattggtgttccactgttagctctaggatgttattctcaggttaatcccctgactctaactgcagctgtattaatgcttgttgcccactatgcgattattggtccgggtttacaagcaaaagctacacgtgaagcacagaaaagaacggcggctggcataatgaagaatcctacagtcgacggtatagtagcaatagacttagacccagtagtctatgatgctaaattcgaaaaacaattaggacagattatgctcttaatattatgtacgtcacaaatattactaatgcgaaccacatgggctctgtgcgaatctattacgttagctactgggcctcttacaaccctgtgggaggggtcaccgggaaagttctggaatacaactatcgccgtaagtatggcaaatatatttcgcggaagttacctagcaggagcaggcttggcattttcattaatgaagagtttgggtggcggaagaagaggaacaggcgcccaaggagaaactctgggagaaaaatggaaacgtcagctgaaccaacttagcaagtcagaatttaacacctacaaaagatctggtattatggaagtcgaccgttcagaagcaaaggagggcctaaagagaggcgaaacaacgaaacacgcggtctcgcgcggtactgctaaattaagatggttcgtagaacgaaacctagtaaaacctgagggcaaagtaattgatcttggatgtggacgaggaggttggtcatattactgtgcaggactaaagaaagtgacagaagtaaaaggatatacaaaaggtggaccaggacatgaggaacctatccccatggccacatatggttggaatttagtgaaattacattcaggaaaggacgtgttcttcattccacccgaaaagtgtgatactcttttatgtgacattggagaaagttctccaaatccaacaatagaagagggacgcacccttagagtgttaaaaatggtagaaccgtggttgagaggaaatcaattctgcattaaaatacttaacccatatatgccatcagtagttgaaacacttgaacaaatgcaacgaaaacatggcggaatgcttgtccgaaatcctctaagcagaaactcgacacatgaaatgtattgggtttcatgcggtacaggaaacattgttagtgccgtgaatatgacaagtcgaatgttattaaaccgtttcacgatggctcatcgtaaacctacatacgagagagatgtagaccttggagcgggcaccagacatgtagcggttgaacccgaagtagcgaatcttgacattataggacaacggattgaaaatatcaaacatgagcacaaaagtacgtggcactacgatgaagacaatccatacaaaacgtgggcatatcacggatcttacgaagtcaaaccgtctgggtccgctagttcaatggtgaatggagtggtaaaattacttacaaaaccctgggatgtcattcctatggttacccagatagctatgacagatacgacgccattcggtcaacaaagggtatttaaagaaaaagtggacactagaacgccaaaagcaaaaaggggtactgctcagatcatggaagtaacggcaaaatggctctgggggtttctatcgaggaacaagaaaccaaggatatgcactcgcgaggaatttactagaaaggtgaggtcaaacgctgctattggagcagtattcgttgatgaaaaccagtggaatagcgccaaagaagctgtagaagatgaacggttttgggatctagtacatagggaacgtgaactccacaagcagggaaaatgcgcgacatgcgtgtataacatgatgggaaaacgagaaaagaaattaggcgagttcgggaaagcaaaaggctcacgagcaatatggtacatgtggctaggggcgcggttccttgaatttgaagcattaggctttatgaacgaggatcattggtttagccgtgaaaattcgttatccggagttgagggagaaggtctacacaaacttggctatattctcagggatatctcgaagatcccgggaggtaacatgtatgcagatgacactgctggatgggacactaggataacggaagatgatttacagaatgaagcacgcatcactgacattatggaaccagaacacgcacttctggcaaagagcatctttaaattaacatatcaaaacaaagtagtaagagttcaacgtccagctaagaatggcacagtaatggacgtgataagccgacgagaccaaaggggtagtgggcaagtagggacatatggtctaaacaccttcacaaatatggaagcccagctgatccgtcaaatggaaagtgaagggatatttagcccttcagaactagagacacccaatctagcagagagagtgctcgattggctggagaaatacggagtggaacgtttaaagagaatggcaatctccggagatgattgcgttgtcaagcccatagatgaccgattcgcaactgcgttaacagctttgaacgacatgggaaaagtgcgaaaggacatacctcagtgggaaccaagcaaaggttggaatgactggcagcaagtaccattttgctcacaccattttcatcaattgataatgaaggacggtagggaaatagtagtaccatgtcgcaatcaagacgagctagtaggtagagcaagagtcagtcaaggtgcaggatggagtttgcgagaaacagcttgcttaggtaagtcatacgcacagatgtggcaactaatgtacttccaccgtcgtgatttaagactagcagcaaatgcaatttgctctgcagtacccgttgactggatcccgacatctcgcacaacttggtcgatacatgcccatcatcagtggatgacaacagaggatatgctaagtgtatggaatagggtatggatagaagagaacccttggatggaagataaaacacacatatcatcatggggcgatgtcccttatctcgggaaaagagaagaccaatggtgtggaagtctcattggtctaacggcacgtgctacttgggcaacaaatatacaggttgcaattaatcaagttcgacgtttaataggcaatgaaaattacttggattacatgacgtcaatgaaacggtttaaaaacgaatctgatccggagggagcattatggtaa

SEQ ID NO: 21958 - RNA, 9879 nt, synthetic construct
  misc_feature 1..9879: note = derived and/or modified CDS sequence (opt6) from DENV-1__EU482525__SS-prME
  source 1..9879: mol_type = other RNA
agcgtgacaatgttgcttatgttaatgcctacagcattagcttttcacttgacaactcgtggcggagaaccacatatgattgtaagcaaacaagaaagaggtaaaagcctattatttaaaacttcagctggagttaatatgtgcacattaattgctatggacttaggagaattatgcgaagatactatgacatacaaatgccctcgaattacagaagccgaacctgacgatgtagattgttggtgcaatgcaacagacacatgggtgacatatggcacttgttcgcaaactggagaacatcggagagataaaaggagcgttgccttagcaccgcatgtcggattaggtttagaaacacgaacagagacatggatgtccagtgaaggtgcatggaaacaaattcaacgcgtagaaacatgggcattgagacacccaggatttacagtaatagctctgtttctagcacacgcgattggaacaagtattacacaaaagggcataatttttatactgttaatgttggtaactccctcaatggccatgcgatgcgttgggattgggtctcgtgatttcgtggaaggattatcaggtgcaacttgggttgacgttgttctcgaacacggaagctgtgtaacaaccatggctaaagataaacctactcttgatatcgaactcctaaagacagaagtcacaaatccagctgtcctgaggaaactatgcatagaggcaaaaataagtaacacaacgacagattcacgttgtccgacacagggtgaagctaccttggtggaagaacaagatgcaaactttgtatgtaggagaacgtttgtcgatagaggttggggtaatggctgcgggctattcggtaaaggttccctcataacttgcgccaaatttaaatgtgtaaccaaattggaaggaaaaattgttcaatatgaaaatttgaagtactcggtcatcgtcacagttcataccggagatcaacatcaggttgggaacgaatcaactgagcatggcactactgcaaccataacgccacaggccccaacaacagaaatacaattgaccgattacggggctctgaccctagattgttcgccccgcactggtttagattttaatgaaatggtattgcttactatgaaagaaaaatcatggctagtacataaacaatggtttctggacttacctttaccgtggacttcaggagctagcacatcgcaagaaacctggaacagacaggacttgcttgttacgtttaaaactgctcacgctaaaaagcaagaagtcgtggttttagggtcacaggaaggagccatgcatacggcactaactggtgccacggaaatacaaacaagtgggacaacaacaattttcgcaggacatttgaaatgcagattaaaaatggataaactaaccctaaaaggtatgagctatgtcatgtgcaccgggtcctttaaattagaaaaagaagtggctgaaactcaacatggcaccgtcctagtacaaattaaatacgaggggaccgatgcaccttgtaaaattcctttttcaactcaggatgaaaagggcgttacacaaaatgggcgtcttatcaccgcaaaccccatagtgaccgataaagaaaaacccgtaaatatagaagcagaacctccatttggtgagagttacatagtaataggagcgggagaaaaggccctcaaactatcttggtttaagaaaggatcaagcattggaaaaatgttcgaagcgacggccaggggagctcgaagaatggcaattctaggagacactgcttgggacttcggatctataggaggtgtcttcaccagtgtcggcaaattagtacatcaaatatttggtacggcgtacggagtattattcagcggagtaagctggacaatgaagattggtataggagtactcctaacatggttaggcctaaattcacggagcacgagtttcagtatgacttgcatcgcagttggcttggtaacgttataccttggagttatggttcaagcagatagtggatgcgttataaattggaaaggcagagaactaaagtgtgggtcgggaatatttgttactaatgaagtgcatacttggactgaacaatataagtttcaggctgactcgccaaaaagactaagcgctgcaattggtaaggcttgggaagaaggtgtttgtggcattcgtagtgcaaccagacttgagaacataatgtggaaacaaatttctaatgagttaaatcacatcctattagaaaacgatatgaagctaacagtagtagtaggagacgtggcaggtattctaggtcaaggaaagaaaatgattcggccacagccaatggagtataaatactcatggaagtcatggggaaaggctaagataataggtgccgacgctcaaaacacaacctttataatcgatgggccaaatactccggagtgcccagatgaccaaagagcatggaacatctgggaagtagaagattatggtttcggaattttcactactaatatatggttgaaattgcgagattcatatacacaagtatgcgaccatagattgatgtcagcagcaataaaagattccaaggcagtacatgcagatatgggttactggatagaatctgaaaagaatgaaacgtggaaactcgcgagagcttcatttattgaagtaaagacatgtatatggccaaaatcacataccttgtggagcaatggggttcttgaatcggaaatgatcattccaaagatttatggagggcctatcagtcaacataattatcgcccggggtatttcacacaaacggcaggtccatggcatctgggaaagctggaattagactttgatctatgtgagggtacgaccgtcgttgtagacgaacactgcgggaatcgcggaccgtcgttaagaacaacaaccgtgacaggaaaaataatccatgaatggtgttgtagaagttgtacccttcctccattacgctttcggggcgaagatggatgttggtatggaatggagattagaccagtaaaagaaaaagaagaaaacctggtaaaatctatggtatcagcaggatctggggaagtcgacagtttcagcctagggctattatgtatctcaataatgatagaggaagttatgagaagtagatggtcgagaaaaatgctaatgactgggacattagccgtatttttcttgctaattatgggacagcttacatggaatgatctcattaggttgtgtattatggtgggcgcgaatgctagtgatagaatggggatggggactacgtatctagccctaatggcaaccttcaagatgcgccccatgtttgctgtaggattgctattccggagacttacctctcgagaggttctattactaacaataggactatcattggtggcaagtgttgaactaccaaattcattagaagaattgggtgacggtctagcgatgggaattatgattttaaaacttctaaccgattttcaatctcaccagttatgggctacattgcttagtctgacatttattaaaacaaccttctcattacattatgcatggaaaactatggcaatggttcttagcatcgtgtccctgttccctctttgtctctcaacgactagccagaaaacaacatggctacctgtcttgctaggatcacttggttgtaaaccgctaacaatgtttctgatcgctgaaaataaaatctggggaaggaagtcttggcctcttaatgaaggaataatggctgtgggaatagtctcaatcctactcagtagcctgctcaaaaacgatgtgcctctagctggtcccctaatagccggtggaatgttaatagcttgctacgtaatatcaggttcctcggcagatctctcactagaaaaagcagcggaagttagttgggaggaagaagccgaacactcgggggcctctcataatatattagtagaagtgcaggatgacggaaccatgaaaataaaggatgaagaaagagatgacacattaacaattttactcaaagcaacactattggcagtctcaggagtatatccattatcaataccagccacgcttttcgtgtggtatttttggcagaagaagaaacagagatctggggttttatgggacacaccttcaccaccagaagtagaaagagcagtactcgacgatgggatttaccgaatcatgcagagaggcctgctaggtagatcacaggtaggcgttggtgttttccaagagaatgttttccatacaatgtggcatgtcacaagaggagctgtgctaatgtatcaaggcaaaagattggagccatcctgggcgtccgtcaagaaagatttgatatcatatggaggtgggtggcgtttacgcggatcatggaatacaggagaagaagtccaggttatagcagtcgagcccgggaaaaaccctaaaaatgttcagaccgccccaggaacgttcaaaactccagaaggagaagtaggtgctattgctcttgactttaagccaggtacctctggcagtccaatagtaaatcgagaaggtaaaatcgtaggactgtatgggaatggcgtggttactacaagtggaacatacgtgtcggcgatagcacaagcaaaagcaagtcaagaaggtcccctgccagaaatcgaagatgaagtattccgaaagagaaacctaacaatcatggatctacatcctggaagtggtaaaacgagaaggtatcttccagccatcgtaagagaagctattaaacggaagctcagaaccttgatacttgcacctacgagggttgttgcttcggaaatggctgaggctttaaaaggcatgcccatcaggtatcaaacaacagctgtcaaatcagaacacacaggaaaagagattgtagatctaatgtgtcatgccacgtttacgatgagattactatcgccggtaagagtaccgaattataatatgataataatggatgaggcccattttacggatccctcaagtatagccgctagaggatatatatctacaagggtcggaatgggagaggcagcagcaatcttcatgacagctacaccccctggaagcgtcgaagcgtttccacaatcgaatgcagttatccaagatgaagaaagagatataccggaaagatcgtggaactccggatatgaatggatcacggattttcctgggaagacggtctggttcgtaccgtcaatcaaatcaggcaatgacatcgcgaattgtctgagaaagaatggaaaacgagttatccaactaagtagaaaaacgttcgataccgagtaccagaaaactaagaacaatgactgggattacgtggtcacgacagatattagtgagatgggagctaacttccgagcagatagagtgatcgatccaagaaggtgtctcaaacccgtcatcttaaaggacggacccgaacgagtaattttggcaggacctatgccagtcactgtcgcttcagcggcccaacgacgaggaaggataggtagaaatcacaataaggaaggagatcaatacatatacatggggcaacccctaaacaacgacgaggatcatgcgcactggactgaggcgaagatgctgctagataatatcaataccccagaaggtataatcccggcactatttgaacctgaacgagagaaaagcgcagcagttgacggggaatacagattaagaggagaagcgagaaaaaccttcgtcgaactcatgaggagaggagatctaccagtatggctaagctataaggtagcatcagaaggcttccaatacagtgacaggagatggtgctttgatggggaacgtaataatcaagtattagaagaaaatatggacgtagaaatatggaccaaggagggtgagaggaaaaagttgagacctaggtggcttgatgcgagaacatattcggacccattagccctaagggaatttaaagagtttgccgcagggaggcgaagtgtttccggagatttgatattggaaattggtaaacttcctcaacatttgacccagagagcccagaatgcactagataatttggttatgctgcataattcagagcagggtggccgtgcttacagacacgcaatggaagagttaccagatactatcgagactcttatgctcttagccctaatcgctgtgttaacaggaggagtaacacttttctttttatcaggacgtggactaggaaaaaccagtataggactactatgtgttatggctagctcagtattattatggatggcgagtgtggagccccattggatcgcagcatcaatcattttagaatttttcttaatggtgcttttaattccggaaccagatagacagagaacacctcaggataatcaattagcttacgtagttataggcctactatttatgatcctcactgtcgcagctaacgaaatgggattactagagaccactaaaaaggatctcggaatcgggcatgtggcggtagaaaaccaccatcacgctgccatgctagacgttgaccttcatcccgcctcagcctggacactatatgctgtggccaccacaatcattactccaatgatgagacatacaatcgagaatacaaccgctaacatctcattaaccgctatagcgaaccaggcagcaatcttgatggggcttgacaaggggtggcccattagtaaaatggatataggagtaccattactcgcactaggttgttatagccaagtaaacccattgactctaaccgctgctgtattgatgctagttgctcattatgcgattataggtcccgggctccaggcaaaagctacaagagaggcgcagaaaaggacggccgcgggtataatgaagaatccaacagttgatgggatagtcgcaatcgatctagatccagtggtatatgatgctaaatttgaaaaacagttgggtcagattatgttattgattctctgtacttcacagatactgctaatgagaacaacatgggcgctatgtgaatctattactttagccactgggcctttaactacattatgggaaggatcgccaggaaagttctggaatactacaatagcagtatccatggcgaatatatttagaggctcctacctagcaggagccgggttagccttttcgctaatgaaatcattaggaggaggacggagggggacgggtgcccagggagaaacactcggagaaaaatggaaaagacagctaaatcaactaagtaaatcggaatttaatacctataaaagatcgggtataatggaggttgacagaagtgaagcaaaggaaggattgaagcggggtgagactaccaagcacgcggtatcgaggggaacagcaaaacttagatggttcgtagaacgcaacctagtcaagcctgaaggtaaagtcatagacttggggtgcggtcgtggtggatggtcgtactactgtgccggattgaagaaagtgacggaagtaaagggttacacaaaaggcgggccagggcatgaagaaccaattccaatggctacttacggctggaacttggtaaaacttcatagtggaaaggacgttttctttataccaccagaaaaatgtgacactctactatgtgacatcggggaaagtagtccgaatccgacgatagaagaaggaagaacattaagagttttgaaaatggtagagccttggctacgaggaaaccaattttgcatcaaaatattaaacccatatatgccatccgttgttgagaccctggaacaaatgcaaagaaaacatgggggtatgctcgttagaaaccctttaagtagaaattctacacacgaaatgtattgggttagctgtggcactggtaatatagtatctgccgtcaacatgacgtcacgtatgttgctaaaccgatttactatggctcatagaaaaccaacttacgaaagggatgtagacctgggaacgggtactaggcatgtcgcagtagagccagaggttgcaaatttagatataataggccaaaggatagaaaatattaaacatgaacataaatccacctggcattacgatgaagacaatccatataaaacatgggcttatcatggatcatatgaagtaaaaccctcaggatcagcgtcgtcgatggtaaacggcgttgttaaactattgacgaaaccctgggacgtcatccctatggtaacccagatagctatgaccgatactacaccttttggacaacaaagagtctttaaagaaaaagttgacacgagaactccaaaagcaaagcgaggaactgcgcaaatcatggaagtcacggcacgttggctctggggattcttgtcaagaaataaaaagccaagaatctgcactcgggaagaatttacgagaaaagtcaggagtaacgcagctattggagccgtgtttgtagacgaaaatcaatggaatagtgccaaagaagccgttgaggacgaaagattttgggatttagtgcatagagagagagaacttcataaacaaggaaaatgtgcaacctgtgtctacaacatgatgggaaaaagggagaagaaattaggcgagttcgggaaagcaaagggatctagagcaatttggtatatgtggctaggagctagatttttagagtttgaagctctgggctttatgaatgaagatcactggtttagtagagaaaatagcttatccggggtggagggggaaggactacataagctcggttatatactcagagacatctcaaagataccgggaggaaatatgtatgcagacgatacggctggttgggacacacggattactgaagacgatcttcagaatgaagcaaaaattactgacataatggagcccgagcatgcactactggctaaggcaatattcaaactgacctatcagaataaagtggtaagagtccaacgccctgcgaaaaacggcacagttatggacgtaataagcaggcgagatcaaagaggatctggacaagtcggaacgtacggcttaaacacttttaccaacatggaagcgcaattaatacggcaaatggaaagcgagggcatattctcaccttctgagttagaaactccaaacttggccgaaagggcgctagattggctagaaaaatacggtatagaaagattaaaacgaatggcgatatcaggggacgattgtgttgtgaaaccaatcgatgaccggtttgctacagcattaactgctttaaacgacatgggcaaagtgcgtaaggatataccacagtgggagccatccaaaggatggaatgattggcaacaagtaccgttctgtagtcatcatttccatcagttgataatgaaagatgggagagaaatagtcgtcccgtgccggaatcaggatgagctagttggtagagctagggtatcgcaaggggcaggatggtcattaagagaaacagcttgtttaggaaaatcatacgcacagatgtggcaacttatgtattttcatcgtagagatttaagactggcagcaaacgcaatatgctcggctgtaccagttgactgggtgccgacctcaagaacaacttggtctattcatgcccaccatcagtggatgacaacagaggacatgctttccgtctggaatcgggtttggatagaggagaatccatggatggaagataaaactcatatcagctcatgggaagacgtaccttatctcggaaagcgtgaggatcaatggtgtggaagccttataggcttaactgccagagcaacctgggcgactaatatacaagtggctataaaccaagtaagacgacttataggaaatgaaaattatctcgactatatgacttcaatgaaacggttcaaaaatgaaaccgaccccgaaggcgcactatggtaa

SEQ ID NO: 21959 - RNA, 9879 nt, synthetic construct
  misc_feature 1..9879: note = derived and/or modified CDS sequence (opt6) from DENV-1__EU482526__SS-prME
  source 1..9879: mol_type = other RNA
tccgtgactatgcttttgatgttgatgcccacagcgctcgcatttcatcttacgacgagaggaggggaacctcacatgattgtcacgaaacaagaaagaggtaaatcgttgctttttaaaacatctgcaggagtaaacatgtgcacgttgattgcaatggatttaggtgaactctgcgaagatacaatgacatataaatgtcctagaataacagaagcagaaccagatgacgtagactgttggtgcaatgcaacggatacatgggtcacgtacggcacatgcagtcaaactggagaacacagaagggacaaaaggagcgtagcactagcaccacatgtcggattgggattagaaacgagaacagaaacttggatgagttcagaaggcgcctggaaacaaattcaaagagttgaaacctgggccttaagacatcctgggttcacagttatagctcttttcctagctcatgccataggaacgtcaataacccaaaaaggaataatttttatacttcttatgctcgtcacaccctccatggcaatgcgctgtgtaggcattggttctcgagatttcgttgaaggattatcaggcgccacttgggtcgatgtagttctcgaacatgggagttgtgtaacaaccatggcgaaagataaacccacgctagacatagaactgttaaaaaccgaagtgaccaatcctgcagtcctccggaaactctgtatagaggccaaaataagcaatacaacgacagattcaagatgcccaacccaaggggaggccacgttaatggaagaacaagatgcaaactttgtatgtagacgaacgttcgtcgacagggggtggggaaatggttgcggattattcggaaaaggctcgctaataacctgtgcaaaatttaaatgtgttactaaactggagggcaaaatagtgcaatatgaaaatcttaagtactcagtaatagtaacagtccacacaggagatcagcaccaggtaggaaatgagtccaccgaacatggaactacagcaacgataactcctcaagcacctacaagcgaaatacaactaacggactacggcgcgcttactttagattgcagccctaggacagggttagatttcaatgagatggtcttgttaacgatgaaagaaaagagttggctagtgcacaagcaatggtttcttgatcttccattaccttggacaagcggggcttcaacctcgcaagagacgtggaaccgccaagacttattagtgacctttaaaactgcacacgcgaagaaacaagaagtagtagttttaggtagccaggagggagcaatgcacactgctctcaccggtgccacagaaatccaaacatcaggtacaacaacaatttttgccggacaccttaaatgtaggcttaaaatggacaaactaacactaaaaggaatgtcatacgtcatgtgcacagggagctttaaattagaaaaagaagtggcggaaacgcaacatggcactgttttagtacaaataaaatatgaaggaacagatgcaccatgtaaaatacctttctcgacccaggacgaaaaaggagtaacgcagaacggccgtctaataacggcgaatcctatcgttactgataaagaaaaacccgttaatatagaggcagagccaccgtttggggaatcatatattgtaataggcgcaggcgaaaaggcgttaaaattatcatggttcaagaaagggtcttctataggaaaaatgtttgaagctaccgcccgtggagcgaggcggatggcaattttgggcgatacagcatgggattttggttcaatcggaggagtattcacatcagtgggtaaacttgtgcatcagatcttcggcacagcatatggagtactctttagtggtgtatcttggaccatgaaaatcggaattggggtgctactcacgtggctcggtctaaacagcagatctacttcattgtcaatgacttgtatagctgtaggcttagtgaccttatacttaggagtgatggtacaagcagatagtggctgtgtcataaattggaaaggacgggaactcaaatgtggttctgggatctttgttactaacgaagtacacacctggacagaacagtataaatttcaggcagacagcccgaaaagattgtccgcagccataggaaaggcttgggaagaaggcgtttgcgggatacgttcggcgacacggttggaaaatataatgtggaaacagatttccaatgagctaaaccatatacttctagaaaacgacatgaaatttacggtcgtagttggtgatgtggttgggatactagcacagggcaagaaaatgatacgaccacaacccatggaacataagtatagttggaaatcatggggaaaagcgaaaataattggcgcggatgtacaaaatacgacatttattatagatggacccaatactcctgaatgtccagatgaccagagagcatggaacatatgggaggttgaagattacggtttcggcatattcactacaaatatctggttgaagctgcgagactcgtatacacaagtgtgcgatcatcgtttaatgtcagctgctattaaagactcaaaagcggttcatgccgacatgggctattggatcgaatcagagaaaaacgaaacttggaagttagcgagagcctcatttatcgaggtcaaaacttgcatatggcctaaatcccacacattgtggagtaacggtgtactagaatctgaaatgataattccaaaaatatacggaggcccgatatcacaacataattatcggccaggatatttcactcaaacggctgggccttggcaccttggaaagttagagctcgacttcgatttatgcgaaggaacaacagtcgtggttgatgaacactgtggaaacagagggccatcattgagaacaactacagtaacaggtaaaattatacatgaatggtgttgtaggtcatgtactttgcctccactgagatttaaaggagaagacgggtgttggtatggaatggagatacgtccagtcaaggaaaaagaagaaaatctagttaagtcaatggtatcagcaggttctggggaggttgattcgtttagtttgggcttattatgtataagtattatgatagaggaagtcatgaggagtagatggagtagaaaaatgctcatgaccggtacacttgcagtattcttacttttaataatgggtcaactcacatggaatgatcttatccgtttatgtattatggttggagctaacgcatctgatagaatgggaatggggaccacttacttagcccttatggcaacttttaaaatgagacccatgttcgcggtaggcctactgttcagacgactaacgagtagggaggtgctgttactcacaataggactgagtctagtcgcttccgtcgaattacctaacagtttagaagaattaggcgacggactggcaatgggaataatgatactaaaactactaactgattttcagtcccaccagctatgggcaactctcctatcattaacatttataaaaacaacattgtccctacattatgcgtggaaaacgatggcaatggtcctatcgatagtatcccttttccctttgtgcttgtccacaacctcacaaaagacgacttggctaccagtactcttaggaagcctcggctgtaaacctctcactatgtttcttattgcagaaaataaaatatggggccgaaaaagttggccacttaatgaggggattatggcagtcggagttgtctcaatactactttcatcattgttaaagaatgatgtacctcttgccggaccactaatagctggaggtatgctaatagcatgctatgtgatttcagggtcgtcagccgacttaagtctcgaaaaagctgctgaagtaagctgggaagaggaagcagaacattctggagcttcgcacaacatcctagttgaggtacaagatgacggcacaatgaaaattaaagatgaggaacgtgatgataccctgacgattctcctaaaggctacactactagcagtaagtggcgtttacccgttatcgattcccgcgactctgtttgtatggtatttctggcagaagaagaaacaacgaagtggggtattatgggatactccaagtccacccgaagtcgaaagggccgttcttgatgatggaatatacaggatcatgcagcgaggactcctaggtagatcacaggtgggagtaggggtttttcaggaaaatgtatttcatacaatgtggcatgtaacaaggggagccgtccttatgtatcaagggaaaagacttgaacctagctgggccagcgtgaagaaagacctcataagttacggaggagggtggcgactacaaggctcttggaataccggcgaagaagtacaggtcatagccgttgagccaggtaaaaatccgaaaaacgtacaaacagcccccggaacctttaaaacaccagaaggagaagtaggagccatagcgttagatttcaagcctggtacaagtggatcaccaatagtaaatagggaaggtaaaattgtaggattatacggaaacggagtagttacgacctctgggacttatgtctctgcgattgctcaggctaaagcatcacaagaaggaccactacctgagatcgaagatgaggtttttaggaagagaaatttaacgatcatggatctccatccgggaagtggaaaaactagacgttatcttcccgctattgtacgagaagcaattaaacgtaagttaaggactctgatattagcgccaacacgagttgtcgcaagtgagatggcagaagcacttaaaggaatgcctatacgataccagactaccgcagtaaaatctgaacacacaggaaaagaaatagtcgacctgatgtgtcatgccacttttacaatgcgcttactatcacccgtgagagttcccaattacaacatgattattatggacgaagcgcattttactgaccccagctcaatagctgcgcggggctacatctcgacaagagttggtatgggagaagctgccgccattttcatgaccgcgacccctccaggatcagttgaggcttttcctcaaagcaacgcagtaatacaagacgaggaacgggatatacctgaacgatcttggaactcaggttatgaatggataacagattttccaggaaagacagtatggtttgtgcccagtattaaatctgggaatgacatagcaaattgcctgaggaaaaatggcaaacgagtaatacagttatctcgaaagacgtttgatacagaatatcagaaaactaaaaataatgactgggactatgtagttactacagatatttcagagatgggggccaattttagagccgatagggtaatagatcctcgacgatgtttaaaacccgttatattaaaagacggtccggagagagtaatattagctggaccaatgccggtaacagtagcaagtgcagcccaaagaagaggacgcatcggtagaaatcataataaagaaggagaccaatacatatacatgggacaaccacttaacaatgatgaagaccacgcacattggacggaagcaaaaatgctacttgataatattaacacgccagagggaattattcctgcgctattcgagccagagagagagaaatcggccgctatagatggagagtaccgtctaagaggagaagcgagaaagacgtttgtagaacttatgcgaagaggagatctcccagtgtggctctcgtacaaggttgcaagcgaaggatttcaatacagcgatagaagatggtgtttcgacggggagagaaataaccaggtcttagaagaaaatatggatgtagaaatatggaccaaagaaggggaaagaaagaaactaagaccccgttggttggatgctagaacctatagcgacccgctggcccttagagagtttaaagaatttgcagccggaagaagatcagtatctggggacctaatattagaaatcggcaagctaccccaacatttaacccaacgagcccaaaatgctcttgacaacctagtaatgctacacaactcagaacaaggagggagagcctataggcatgcgatggaagaacttcctgacaccattgagacactgatgctactagcgctaatagccgtactaacaggaggtgtgacactatttttcctatcaggcagaggattggggaaaacatcgattggattactgtgtgtaatggcttcttcagtgctactgtggatggcctcagttgaaccacattggatagctgctagcataatactagagttctttcttatggtactcctaataccagaaccggacaggcaacgtactccgcaagataatcaattagcttacgtagttataggtcttctttttatgatccttacagtcgctgcgaatgaaatgggactgttagaaaccactaagaaagatctcgggataggacacgtcgcagtagaaaatcatcaccacgccaccatgctggacgttgatcttcacccagcgagtgcatggacgttatatgctgtagccaccacaataattactcctatgatgcgacacactatagaaaatacaactgcgaacataagtttgacagccatagcaaatcaggcggctattcttatgggcttagataaaggttggccgataagtaaaatggatataggagtaccattgttagctttaggctgttacagtcaagtaaacccgctcacactgacggcagccgtcttgatgttggtagctcattacgcaattataggaccgggcttgcaggcgaaagccactagggaagctcaaaagcgaactgcggctggtattatgaaaaatccaactgtcgatggtattgtagcaatagatttagaccctgttgtttatgatgcaaaattcgaaaaacaactaggtcaaattatgttgctgattctatgcacctcacaaatattattaatgagaaccacatgggctttatgcgaatcaataacattggcaacaggaccattgactacattatgggaaggatcgccaggaaaattttggaatacaactatagcagttagtatggctaacatatttagaggttcatatttagctggtgctggattagcgtttagtctgatgaaatccttaggagggggacggcgaggcactggagctcaaggagaaactttaggagaaaaatggaaaagacaactaaatcaacttagcaaaagtgagttcaatatttataaacgtagtggtatcatggaagtcgaccgcagcgaggcaaaggaaggattgaagcgaggcgaaacgactagacacgccgtatcccggggaacagcaaaactccgatggtttgtcgaaagaaatctagtaaaacccgagggaaaagttattgatttaggttgtggacgagggggctggagttattactgtgcgggactaaagaaagtaacagaagtgaaagggtacacgaagggcggaccaggacatgaggagcccataccaatggcaacctatggctggaacttggttaaattacattcaggaaaagatgtattctttacaccgccagagaaatgcgatacgcttttgtgtgatataggcgagtcgagtccaaatcctacaattgaagagggtcgaacattacgagtcctgaaaatggtagaaccgtggcttagaggaaatcagttttgtataaagatattaaacccatatatgccctcagtagtggaaactctggaacaaatgcaacgaaaacatggtggtatgcttgttcgaaacccattaagccggaactcaacacacgagatgtactgggtatcatgtgggacaggcaatatcgtttcggcagttaatatgacctctagaatgttactcaacagatttaccatggcacatagaaagcctacatatgagcgagacgtagacttaggtgcagggactagacatgtagctgtagagcccgaagtcgccaatttggatataataggacaaagaatcgaaaacataaaacatgagcacaagtctacatggcattatgatgaagacaatccgtacaaaacgtgggcttaccatggtagctacgaagtgaaaccctcaggcagtgctagcagcatggtaaatggtgttgttaaactccttacaaaaccgtgggatgtaatacccatggttacccaaattgctatgacggacacaactccattcggtcaacagagggtattcaaagaaaaagtggacacgagaacaccaaaagcaaaaaggggaaccgcacaaattatggaagtgacagctcgttggttatggggatttcttagtagaaacaagaaacctcgaatttgtactcgagaagagttcacaaggaaggtgagatccaacgctgctattggtgcggtatttgtagatgaaaaccaatggaacagcgctaaggaggcagtggaagatgagcgtttttgggaccttgtgcagaaagaaagggagctccacaaacaaggaaaatgtgcaacttgcgtatataatatgatggggaaaagggagaagaaattaggtgaatttggcaaagctaaagggagtagagctatttggtatatgtggctaggagcacggttcttagaatttgaagcactagggtttatgaatgaagaccattggttttcccgagaaaactcattatcaggtgtagagggagagggtctacataaactcggttacattttaagggacatatctaagataccgggaggaaatatgtatgctgacgacaccgccggctgggacacccggataacggaagatgacctgcaaaacgaagcgaaaataactgatattatggaacccgagcatgcattactagcaacatcgatatttaaattaacatatcaaaataaagttgtaagggtgcagcgtcctgccaaaaacggaacagtaatggacgtaataagtagacgagaccaacgagggagtggacaagtaggaacgtatggtctaaatacgtttacaaatatggaagctcaactgattaggcaaatggagagcgaagggatattctctccatccgagttagaaatacccaacctcgctgaacgtgtcttagactggctggaaaaatacggagtggaaagattaaaacgtatggctatcagtggggatgactgcgttgtgaaaccgattgatgaccgatttgcaacggcattaaccgctctcaacgatatgggcaaggtgagaaaggatgttcctcaatgggaaccgagcaaaggctggaacgactggcaacaggtccctttttgttctcatcactttcatcaattgattatgaaagatgggagagaaatagtagttccatgccgcaatcaggatgaactcgtaggtcgggctagagtcagtcaaggggccggatggagtctcagagaaactgcttgcctaggtaaatcctacgcccaaatgtggcaactaatgtacttccatagaagagacctaagattggccgccaacgctatttgctcagctgtacctgttgattgggtcccaacatcaagaacgacctggagtatacacgcccatcaccaatggatgacaaccgaggacatgctttcggtctggaatcgtgtatggattgaagaaaatccctggatggaagataaaacccacgtatcgagttggggcgatgtcccgtaccttggtaaaagagaagatcaatggtgtgggtctctcataggacttacagcacgtgccacatgggccagtaatatacaagtcgcaatcaatcaggtaaggagactaataggaaatgagaattatcttgattacatgacgtcaatgaaaagattcaagaatgaaggtgatccagaaggtgcattgtggtag

SEQ ID NO: 21960 - RNA, 9879 nt, synthetic construct
  misc_feature 1..9879: note = derived and/or modified CDS sequence (opt6) from DENV-1__EU482527__SS-prME
  source 1..9879: mol_type = other RNA
agcgtgacgatgttattaatgcttatgcccacagcactagctttccacttaacaacaagaggaggcgaaccacatatgattgtaagtaaacaagaacggggtaaaagtcttctatttaaaacaagcgcaggagtaaatatgtgtacgctaatagcaatggatttgggcgagttctgtgaagacacaatgacatacaaatgtccgagaataacggaagctgaaccagacgatgttgactgttggtgtaatgcaacggacacgtgggttacatatggtacgtgtagccaaacgggagaacatcgtagggacaaacgatccgtagctcttgcacctcatgtgggattaggcttagaaacacgtactgaaacctggatgtcaagtgaaggagcctggaaacaaatccaacgcgtggaaacatgggcccttcgacatccaggatttacggttatcgcattgtttctagcacacgctattggcacatctattacacaaaaaggcataatcttcatattattaatgttagtaaccccgtctatggcaatgcgctgtgtaggaataggctctagagatttcgtcgaaggcctatcgggagctacttgggtcgatgtcgtcctagaacacggttcatgtgttacaaccatggcaaaagataaacctacattagatatagaactgttgaaaactgaagtgacaaatcctgcagttttacggaaattatgcatagaagcaaaaatttcaaatacaacaactgacagccgatgtccaacacaaggcgaagcaactctggtagaagaacaagacgcaaactttgtgtgtaggaggactttcgtagatcgtgggtggggaaacgggtgcggactatttggaaaaggaagtctcatcacttgcgctaaattcaaatgcgttaccaaattagaaggcaaaatagtacaatatgaaaatctaaaatatagtgtaatagtaacagtacatactggagatcaacaccaagttggtaatgaatcaactgagcacggaacaactgcgactattacaccacaggctccttcaactgaaattcaattaacagattacggagcgttaaccctagattgttccccaaggacgggactggactttaatgaaatggtattactgacgatgaaagagaaatcatggcttgtacacaaacaatggttccttgacttacctttaccatggactagcggggctagtacaagccaagaaacctggaatagaaaagatttattggtcacatttaaaacagcacacgccaagaaacaagaagtagtggttctaggatcacaagaaggtgctatgcatactgcattaactggagccacggagatccaaaccagcggtactacaacgatattcgctggacacctaaaatgtaggttaaaaatggacaaattgactctaaaaggcatgtcatacgtaatgtgtactggatcatttaagctggagaaagaagtcgcagaaacacaacatggaactgtcctcgtccaaataaaatacgaaggcacagacgctccctgtaaaataccatttagtactcaagacggcaaaggagttacacaaaacgggagactgataacagcaaaccctatcgtaactgataaagaaaaaccagtcaacatagaggcggagccaccgttcggtgagagttatatagtaattggagcaggagagaaagcacttaaactatcatggtttaagaaggggtcatcaataggaaaaatgttcgaagcgacggcacgtggagctagacgtatggctattttaggtgatacagcctgggacttcggatcaatcggaggagtattcacatcagttggaaaattagttcatcagatctttggtacagcatatggagttttattttcaggagtaagctggactatgaagataggcattggagtcttattaacgtggcttggattaaattctcggtccactagcttaagtatgacctgcatagcagtaggtctggtcactttatatcttggtgttatggtgcaagcagactcaggatgtgtaataaattggaagggacgggaactaaaatgcgggtctggaattttcgtaactaatgaagtacatacttggaccgaacaatacaaattccaagcagactctccaaaaagactctctgcggcaattgggaaagcatgggaagaaggagtatgcggaataagaagcgcgactagactagaaaacattatgtggaaacaaataagcaacgaattaaaccatatcctgttggaaaatgatatgaaatttaccgttgtcgttggagatgtagccggaatccttgctcagggcaagaaaatgattagaccacagcctatggaatacaagtattcatggaaatcatggggaaaagctaagataataggggccgacgtccaaaacacaacttttataatcgatggacccaataccccagagtgtccagatgatcaaagggcatggaatatatgggaagttgaagattacggttttggtatttttacaacgaatatttggctaaagctaagagatagctatacccaagtatgcgatcatcggttaatgagcgccgcaattaaggattcgaaggcggtccatgccgatatgggatactggatcgaaagtgagaaaaatgaaacatggaaattagcacgagcaagttttattgaagttaaaacctgcatatggccaaaaagccacacgctttggtccaacggtgttctagagtcagagatgataataccgaaaatttatggaggaccaataagtcagcacaactatcgaccagggtattttactcagactgcaggtccctggcatcttggtaaactcgaactagatttcgatctttgcgagggaaccacggtcgtcgttgacgagcactgcggtaacagagggcctagcttaagaaccactaccgtcacaggaaaaatcatacacgaatggtgttgtcgcagttgtactctgccgcctcttagatttaaaggagaggacggatgttggtatggaatggaaatccggcctgttaaagagaaagaagaaaatttagtcaaatcaatggttagtgcaggtagcggggaggttgattcctttagtttaggtctactttgtatatcgatcatgattgaggaggttatgaggtctcgatggagtcggaaaatgctaatgacaggcacattagccgtatttttcctactgataatgggacaactaacatggaatgatcttatccgactatgtataatggttggggcaaatgcttctgatagaatgggaatggggacaacatacttagctctcatggccacattcaaaatgcgaccaatgttcgccgtggggctactctttcgaagactcacaagcagagaagtgctattactgacgataggacttagcttagtagcattcgtagaacttcctaacagcttagaagagttaggtgatggattagccatgggaattatgattttaaaattacttaccgactttcaatcgcatcaactatgggcaaccttattgagccttacatttataaaaactacgttcagtttacattatgcctggaagactatggcaatggtactaagtatagtttcgttatttccactttgtttgtctacaacttcacagaaaactacatggttaccagtgctgttagggtcattgggatgcaagccacttacgatgttccttatcgcagaaaacaaaatatgggggaggaagtcgtggccgttaaatgaaggaataatggcagtcggaatcgtaagcatactgctatcatcacttcttaagaatgatgtacctttagccggcccactaattgcaggagggatgctaattgcatgttatgtaatctcaggatctagcgcagacttaagcctagaaaaagctgcagaggtctcttgggaagaagaggcagaacactccggcgcaagccacaatatattagtagaggtacaagatgatggaacgatgaaaataaaagacgaagaacgggatgatactctcactattcttttgaaagctacgttgctggcggtttcaggagtctacccactttctatcccagcaacactcttcgtgtggtatttctggcagaagaagaaacagagaagcggagtgctgtgggatacccctagtccgccggaggtcgagagagcggtactagacgacggcatttaccgaataatgcaacgaggactactaggccgttcacaggtaggtgtaggggtttttcaagaaaacgtcttccacacgatgtggcatgtaacaagaggagcggtactgatgtatcagggcaaacggttagaacccagttgggcaagcgtgaagaaagacctcattagttatggagggggctggagattacaagggtcttggaacacaggcgaggaagtgcaagtaatcgccgtagaaccggggaaaaatccaaagaatgtccaaacagcacctggtacttttaaaacgtccgaaggagaagttggtgctattgcattggatttcaaaccaggaacctcagggagcccaattgtaaacagggaaggcaaaatagttggtttatatggtaacggagtggtaacaacttcgggcacctatgtatctgccatagcacaagctaaagctagccaggaaggtcctctacccgaaattgaggatgaagtttttcgaaaacgaaatttaacaatcatggatttacacccaggaagcggaaaaacaagacggtacttaccagcgatagttagggaagctataaagcgtaaactgaggacgcttatattggcgccaacaagagtagttgcttcagaaatggcggaagcactaaaaggcatgccgatacgatatcaaacaacagcagtaaaatccgaacatacaggaaaagaaatagttgacctaatgtgccacgctaccttcactatgaggttgctatcgccagtacgggttccaaattataatatgataatcatggatgaagcacacttcaccgatcccagtagtatcgcggctaggggatatatatcgacgagagttggaatgggagaagcggcagcaatttttatgacagcgacaccccctggatcagttgaagcatttcctcagtccaatgccgtcatacaagatgaagaaagagatataccggaacgcagttggaactctggttacgaatggataacggactttccaggtaagactgtgtggtttgtcccctcaataaaatctggcaatgacatagctaattgtctaaggaaaaatggaaaacgcgtcatacagctaagtaggaaaacgttcgatacagaataccagaaaactaagaataatgactgggactatgtggtgacgacagatatatcagagatgggcgctaatttcagggctgaccgtgtgatagatcccagacgatgtcttaagccagtaatcttaaaggatggaccagaacgtgtgattttagcaggtccaatgcctgtcacggtagcatcagcggcacagaggcgaggaaggataggtagaaaccataataaagaaggagatcaatacatatatatgggacaaccgttaaacaacgatgaagatcatgctcattggacagaagcaaaaatgctattagataatattaacacacccgagggaataataccagcattgttcgaaccagaaagagaaaaatctgctgctatagatggggaatatcgactcagaggtgaggcccgcaaaacatttgtggaattgatgcgaaggggagacttacccgtctggcttagctataaagtagctagtgaaggctttcaatattcagatagacgatggtgttttgatggagaacgaaataaccaggtcctcgaagagaatatggatgtcgaaatttggacaaaagaaggggaaagaaagaaactcagaccgagatggcttgacgcaaggacatatagtgaccccctcgctctccgggagttcaaagagttcgccgcaggaagaaggtcagtctcaggtgatttaatactagagattggtaagttgccacaacatttaacacagcgggctcaaaatgcgcttgataatcttgttatgctccataatagtgaacaaggagggagagcatacaggcatgcaatggaagaactcccagacacaatagaaactttaatgttgctcgcactaatagctgtccttacgggcggcgtgacattgttctttctgagtggacgtggtctaggaaaaacgtcaataggactattatgcgtcatggcttcatcagtgctgctgtggatggcgtcggtagaaccacattggatcgcggctagcataatcctagagttctttctgatggtattacttatcccggaaccagatagacaacgaactccgcaagacaatcaattagcttacgtagtaataggattattattcatgattcttacagtagcagctaacgaaatgggactattggaaactaccaagaaagatttaggaatagggcatgtggctgtcgagaaccaccatcacgctgccatgttagatgtcgatctacaccctgcatcggcatggacattatatgcagttgcgacaacgattattacccccatgatgcgacatactattgaaaataccaccgcgaacatatcacttacagcaattgccaaccaagctgcaatcttaatgggattagataaagggtggccgatcagtaagatggatattggtgtgccgttactggcacttggttgctattcacaagtaaatccactaacgctaaccgcagctgtgttgatgctagtcgctcactatgctattattgggcctggcctacaggcaaaagctacgagggaagcacagaagcggacagccgcaggcataatgaaaaacccaactgtagatggaatagtcgcaattgacttagatcctgtcgtatacgatgctaaattcgaaaaacaacttggtcaaataatgttgcttatcctatgcacgtcgcaaattctacttatgcgaactacctgggcgctatgcgaatctataacactagcaacaggtccccttacaacattgtgggaaggatcgccagggaagttctggaacactactatcgcagtaagtatggcaaatattttccgtgggtcatatctagccggtgcaggcttagcctttagcttgatgaaaagcctaggaggaggaagaagaggtacgggagcacaaggcgaaacacttggagaaaaatggaaacgacaactaaatcaattatctaagagtgagtttaacacttataaaagatcagggatcatggaagtagatcgatccgaggcaaaagaaggtctaaaacgaggggagacaaccaaacacgctgtctcaagagggacagcgaaactacgctggtttgttgagagaaatttggttaaaccagagggtaaggtaatcgatctgggttgtggtagaggagggtggagctattactgcgcggggcttaagaaagtcacggaggtcaaggggtatactaaaggtggtcccgggcacgaagaaccaataccaatggccacatacggatggaatttagtaaagctgcatagcggtaaagacgtgttctttatcccacccgaaaagtgtgatactcttctatgtgacataggtgaaagctcgccaaacccaacgatcgaggagggaaggacacttcgtgttttaaaaatggtggagccatggctcagagggaatcagttctgtataaaaattctaaatccatatatgccgtcagtagtggagactctagagcaaatgcagagaaaacacggaggtatgttggtccgcaatccattatcgcgaaactcaacgcatgagatgtactgggtttcatgcgggactggaaatatagtcagtgctgtaaatatgacatctagaatgttattaaatagattcactatggcgcatagaaaaccgacttatgagagggacgtggaccttggggcgggcacacgacatgtagccgtagaaccagaggtagccaaccttgatattattggacaaagaatagaaaacatcaagcatgaacataagtcaacatggcactatgacgaggataatccgtacaaaacgtgggcctatcatggatcctatgaggttaaacccagtggaagtgcaagtagtatggtgaacggcgtagtgaagttgctaaccaaaccgtgggatgtgatccctatggtgacccaaatagcaatgacggatacgacacctttcggacaacagcgtgttttcaaagagaaagttgacactcgcacaccaaaagctaaacggggaacggcacaaataatggaggttacagctaaatggctatggggattcctgagccgaaataagaaaccaagaatctgcacaagagaagaatttactcggaaagtaagatcgaacgcagctataggagccgttttcgtagacgagaaccaatggaacagtgcaaaagaagccgtagaggacgaaagattttgggatttagtgcaccgagaaagggaattacataagcagggaaagtgcgcgacatgtgtttacaatatgatgggaaaacgcgagaagaaattgggggagttcggaaaggctaaaggttcacgggctatatggtatatgtggttgggagcgagattcctagaatttgaagcgttaggattcatgaatgaagaccattggttttcaagagaaaattctctttcgggagtcgagggggaggggcttcataaacttggctatatccttagggacatttcaaaaattcctggtggaaacatgtacgcggatgatacagcgggttgggatactagaataacagaggatgatctacaaaatgaggcaaagatcactgatatcatggaaccagagcatgcattattagctaaatcgatatttaaactcacatatcagaacaaagttgtaagagtgcaaaggcctgccaaaaacggaacggtaatggatgtcatctcacgtcgagatcagcgaggatcaggacaagtgggcacttatggcctaaacacttttacaaacatggaagctcaattgatacgtcaaatggaatccgagggtatattttcaccaagcgaattagaaacaccaaatctagcaggacgagttctagattggttagaaaaacacggagtggaacgattaaagagaatggctatatcaggagatgattgcgttgtaaaaccaatagatgatagatttgccactgccttaacagcactcaacgatatggggaaagtccgtaaagacatccctcagtgggaaccatccaaaggttggaatgattggcaacaagtaccattttgctcacatcattttcatcaattgataatgaaagatgggagagagatcgtagttccttgccgaaatcaggacgaactcgttggtagagctagagtgagtcaaggtgctggatggagtttaagagaaaccgcttgtctaggaaaatcatacgctcaaatgtggcaacttatgtatttccatagaagggatttgagattagcagctaacgcgatatgttcagccgtaccagtagactgggtcccaacatcgcgaacgacgtggtctatacatgcacatcaccaatggatgaccacagaagacatgttgagcgtttggaatagagtttggatcgaggagaacccgtggatggaagacaaaacacatatctcctcttggggagatgtgccatatcttggcaagcgtgaggaccaatggtgtggatcccttataggactaaccgctcgtgctacctgggcaacaaatatccaagtggcgattaatcaagttaggagactaattggaaacgaaaactatctagactatatgacgtcgatgaaaagatttaaaaacgaatcagacccggaaggggctttatggtaa

SEQ ID NO: 21961 - RNA, 9879 nt, synthetic construct
  misc_feature 1..9879: note = derived and/or modified CDS sequence (opt6) from DENV-1__EU482528__SS-prME
  source 1..9879: mol_type = other RNA
tcagtgactatgttactaatgcttatgcctaccgcactggcatttcatttgaccacgcgaggaggagaaccgcacatgattgtatcaaaacaagaaagaggaaaatccttactatttaaaacaagtgcaggggttaatatgtgcacattaatcgctatggatcttggggagttctgtgaagatactatgacgtacaaatgtcctaggataacggaagctgagccggatgacgttgactgttggtgcaatgctaccgatacgtgggtaacctatggaacctgttcacaaaccggtgagcataggcgcgataaacggtctgttgcactagcaccacacgtgggactagggctcgaaacaagaactgaaacctggatgagtagtgaaggagcatggaaacaaatacaacgagttgaaacatgggccctacgacatccgggctttacagtaatagcactattcctcgcacatgcaattggaacaagtatcacccaaaaaggtatcatattcatactcttaatgttagtaaccccatcgatggcaatgcggtgcgttggtataggcagtagagatttcgtcgaaggcctctcgggggctacttgggtcgatgtagtactagagcacgggagctgtgtcacgaccatggcaaaagataaaccaactctagatatcgaattattaaaaaccgaagtaacaaaccctgctgtattgagaaaattatgtatcgaagcgaaaatatcaaataccacaacagattccagatgtccgacgcaaggagaagctaccttagtcgaggaacaagatgcaaattttgtttgtagaaggacgttcgtagatagaggttggggcaatggttgcggactattcggtaaaggatcattaataacttgtgctaaatttaagtgtgttacaaagttggagggaaaaacggtacaatatgaaaatttgaaatattctgtaattgttaccgtccataccggagatcagcatcaagtcggcaacgaatccacggagcatgggacaacagcaaccataacacctcaagctccttcaacagagatacagctcactgattatggagctctaactctggactgttcaccaagaactggtttggattttaacgaaatggttctcttaacgatgaaagaaaaatcatggcttgtacataaacagtggtttctagacctaccactaccatggacatctggggcgtcaacaagtcaagaaacatggaatcgtaaggacttgttggttaccttcaaaactgcacacgccaagaaacaggaagtagttgttttgggcagtcaggagggggctatgcacacagctttgacaggagccacagagattcaaacaagtggtactacaacgatatttgcaggccacttaaagtgtcgattaaagatggataaattgactttaaaaggcatgagctacgtaatgtgtaccggtagctttaaacttgaaaaggaagtagctgagactcagcatgggacagtcttagtacaaatcaaatatgagggaacagacgcgccttgtaaaatacccttttcaacccaagatgaaaaaggtgttacgcaaaacggaagactaataacagcaaaccccatcgtcaccgataaagaaaaaccggtaaacatagaagcagaacctccctttggagaaagttatatagtcataggagctggtgaaaaggctttgaaattaagttggttcaagaaagggtcaagtatcgggaagatgtttgaagcgacggcgaggggagccagacgaatggccatactaggagacactgcatgggactttggaagcataggcggagtcttcacttcagtgggcaaattagtccatcaaatcttcggcacagcatacggagtactattttcaggtgttagttggactatgaagataggaatcggggtactactaacatggttaggtttaaattcacgctcaacaagtctctcgatgacctgtatcgccgtcggccttgtaaccctgtacctgggagccatggtccaggctgactcagggtgcgtaattaattggaaaggaagagaacttaaatgcggtagcggcatttttgtaacaaacgaagtacacacctggacagaacaatacaaatttcaggctgattctccaaagcgtctaagcgccgctataggcaaggcctgggaggaaggtgtttgtggaatccgtagtgcaactagactagaaaatataatgtggaagcaaatatcaaacgagttaaatcacattctattggaaaacgacatgaaattcaccgtggtagtgggggacgttgctggaatactggcccagggcaagaaaatgattcgaccccagccaatggaatataaacattcatggaaaagttggggcaaagctaaaattataggtgccgacgttcagaatacaacattcataatcgatggacctaacacgccagaatgccccgatgatcaaagagcgtggaatatttgggaggtcgaagattatggatttgggatattcaccaccaatatatggctcaaattacgcgacagttatactcaggtctgtgaccaccgccttatgagcgccgctatcaaagactcgaaagctgtgcatgctgacatgggatattggatagaaagcgaaaagaacgaaacatggaaattagcgcgcgcatcttttatagaagtgaaaacctgtatttggccaaaaagtcacaccttatggtctaacggcgtcttagagagtgaaatgatcatacctaaaatctacggaggcccaatatcgcaacataactacagacctggatatttcactcaaactgcaggtccatggcatttgggaaaattagaactagacttcgatttatgtgaagggaccactgtcgtagtagatgaacattgtggtaatagagggccaagtttgagaactacaacagtaaccggaaagatcatacacgagtggtgttgcaggtcatgcacacttccacctctgcgattcaaaggggaagatggatgttggtacggcatggagattcgtcctgtaaaagagaaggaagaaaacttggtaaaaagcatggtaagcgcaggcagtggggaagttgattctttttccttaggattgctgtgtataagcattatgatagaggaagtgatgaggtcacgttggtccagaaaaatgctgatgaccggcacactagcggtattctttctattgattatgggtcaattaacttggaatgacctaataagattgtgtataatggtaggagcaaatgcatcagatcgaatgggcatgggaacaacctatcttgctctcatggccacattcaagatgcgtcccatgttcgctgtgggtcttctattcagaagattaacatcgagagaggtactcttattgactatcggactatctctagtagcctccgtagaactcccaaattccctggaagaactaggtgatggcctcgctatgggtataatgatactaaagttgttaacagattttcaaagtcatcaattatgggccaccctactgtcccttacatttatcaaaacaactttctcactgcactacgcttggaaaacgatggctatggttctctcgattgtatctttattccctttatgcctaagcacgacatcacagaaaactacttggttacccgtactattaggcagcttaggatgcaaaccacttacaatgtttttgatagccgaaaataaaatttggggtagaaaatcttggccattaaatgaaggaatcatggccgtaggaattgtaagtatattacttagctcgctactcaagaacgatgtccctttagccggacctcttattgcaggagggatgctaatagcatgttatgtaatatcgggcagttcggcggatctgtctttagagaaagctgcagaagtgagttgggaggaagaagcggagcacagcggggcgagtcataacatattggttgaagtgcaagatgacgggactatgaagataaaagatgaagaaagagatgatacactaactatacttctcaaagcaactttattagccgtctcaggagtatatccactaagtataccagccaccctattcgtatggtatttttggcagaagaagaaacaaagaagcggagtgctgtgggacacacccagccctcccgaagtagaacgcgcagtacttgatgatggtatatacaggataatgcagaggggtctcctgggcaggtcccaagtaggcgtcggtgtgtttcaagagaacgtcttccacacaatgtggcatgtaactcgaggtgcagtattaatgtaccaaggcaaaagattagaaccaagctgggcgtccgttaagaaagacttgatatcatatggaggtggatggaggttacaaggatcatggaacaccggagaagaagtccaggtaattgcagtagaacccggtaaaaaccccaaaaatgtccaaacagctcctggaacattcaaaacttcagaaggtgaagtaggtgccatagcgctagatttcaaaccagggacaagtggatcgccaatagtcaatagagaaggtaaaatagtaggtctttacggaaacggagtggtaactacatcaggaacatatgtatcagcgattgcgcaggctaaagctagccaagaggggccgctaccagaaattgaagatgaagtattccgaaagagaaatttaacaataatggacctacacccagggagcggcaaaaccagaagatatctccctgctattgtaagagaagcaattaaacgaaaactcagaacactgattttggcacctactagagtggtagccagtgaaatggctgaggccttgaaagggatgccgattagatatcagacaacagcagtaaaatctgaacacactggtaaggaaatagttgacttaatgtgtcatgccacctttactatgagacttctttcgccagttagagtccctaattacaatatgatcatcatggatgaagcccactttaccgaccctagtagtatagccgctaggggttatatcagtacaagagtcggcatgggtgaagcggccgctatatttatgacagccacaccacccgggagcgtggaggctttcccacaatctaatgcagtcatacaagacgaagaacgagatattccagaacgttcgtggaactcaggttatgagtggataacagattttccgggtaaaacagtatggtttgtgccaagcatcaaatcaggcaatgatattgctaattgtttaaggaaaaacggaaagcgtgtcatacagctatctagaaaaacattcgatactgaatatcagaaaacgaaaaacaatgactgggactacgtagttacgacggatatatcagaaatgggcgcgaatttcagggcagatcgcgttatagatccaaggcgttgcttaaagcctgtaatactgaaggatggaccagaaagagtaatcctagctggtcctatgcctgtgaccgtagctagcgcagctcaacgtcgcggacgaattggacgaaatcataacaaagaaggagaccaatatatttacatgggccaaccactaaacaatgacgaagaccacgcacattggacagaagcgaaaatgttattagacaatataaatactcccgagggaataatacccgcattattcgagccagaaagagaaaagtctgcagctattgacggtgaatatagactccgaggtgaagcacgcaaaacgtttgtagaactcatgcgtaggggagacttaccagtatggctttcttataaggttgcctcagaaggattccaatactctgaccgtcgctggtgcttcgacggagaacggaataatcaagtactagaagaaaatatggacgtcgaaatttggaccaaagaaggggagaggaagaaattaagaccacgatggctggatgcgcgtacgtatagcgatcctctcgcgttaagagaatttaaagagttcgcagctggtagaagatctgtctccggagatttaatattagagattggaaagctccctcaacatttaacccagagagcacaaaatgctctagataatcttgtaatgctacataatagtgagcagggtggtagagcatatcgccatgcgatggaggaactgcccgacacaatagaaacgctcatgcttcttgcacttattgccgtactaaccggaggtgttacattgtttttcttatccggaagaggcctaggaaaaacatctataggtcttctatgtgtaatggccagttccgtattactatggatggcgtcggtagagccacactggatcgcagcgtctataatattggaatttttccttatggtgctcttaatacccgaacccgatagacagagaactccccaagataaccagttggcctatgtggtgataggtttactatttatgattctgacggtagctgcaaatgagatgggtttgttagaaacaactaagaaagatctcggcattggacacgtagccgttgaaaatcaccatcatgccgcaatgttggatgttgacttgcatccggcatccgcttggacattatacgctgttgcaactacaataataacaccaatgatgagacatacaattgaaaacacaacagctaatatcagtttaacagctatagccaatcaggcagccattttaatgggattggacaaaggatggccaatcagtaaaatggatataggggttcccttattagcactaggatgctatagccaagtgaatccattaaccctgacggcagctgtgcttatgctagtggcacactacgctataatcggtcctggattgcaagcaaaggcgacaagagaagctcagaaaagaactgcagccggaattatgaaaaatccaactgtcgacgggatcgtggcaattgacctagatcctgttgtttacgacgctaaattcgaaaagcaacttggccagatcatgctactaattctatgtacttcacaaatattactcatgcgaacaacatgggctctttgcgagtctataaccctagcaactggtccattgactacactatgggagggctcgccagggaaattctggaacactacaattgccgtcagtatggcgaacatatttagaggctcatatttagcaggagcaggactagcattctcacttatgaagtctttgggaggtggcagaagaggtacaggagcacagggagaaacgctcggagaaaaatggaagcgacaactaaaccaactaagcaagtctgaatttaatacatacaaaagatcggggataatggaagtagatcgatcagaagccaaagaaggcttgaaacgcggagagaccacgaaacatgctgtatcacgaggcaccgctaagctaaggtggtttgtagaacgcaacctagtgaaacctgaaggaaaagtgatcgatctaggctgtggccgaggtggctggtcgtattattgtgcaggtcttaagaaagtaacagaagtaaaaggttatacaaaaggaggccccggacacgaggaacctattcctatggctacctatgggtggaatttagttaaactacattctggaaaagacgtatttttcataccaccagagaaatgtgatactttattgtgcgacatcggcgaaagcagtcccaaccccacaattgaagaaggtcgaacactgagagtattaaaaatggtggaaccatggttaagagggaatcagttttgcataaaaatacttaatccatatatgcctagcgtagtcgaaactcttgaacagatgcaacgaaaacacggtggaatgctggtgcgaaacccactgagcagaaattctacccatgaaatgtattgggtatcgtgtggtactggcaatatagtaagcgctgttaacatgacatcaagaatgttgttaaatcgatttacgatggcgcataggaaaccaacatatgaacgagacgtagacctcggcgcaggtacccgacacgttgcagtcgaaccagaggtcgcaaacttagatataataggacaacgtatagaaaatatcaaacatgaacataagagtacatggcactatgacgaggacaacccctataaaacatgggcataccatggaagttacgaagtgaaacccagcggctccgcttcgtcaatggtcaatggagtagtcaaattattaactaaaccgtgggatgtcataccaatggtgacacaaatagctatgacagacaccacgccctttgggcaacaaagagtatttaaagaaaaggtagatacacgaacacccaaagcaaaacgaggcacggcacaaatcatggaagtaacagcaaagtggctatggggatttttgagtagaaataagaaacctagaatttgcactagagaggaatttacccgcaaggtacgaagtaatgctgccatcggtgccgtctttgtggacgaaaaccaatggaacagcgccaaggaagcagtcgaagatgagcgattctgggatctggttcacagggagcgggagctacacaaacagggaaaatgtgccacatgcgtctataacatgatgggcaaaagagaaaagaaacttggtgagtttggaaaagctaagggatccagagcaatctggtacatgtggttgggtgctagattcctcgaatttgaagcacttggattcatgaatgaagatcattggttcagtagggaaaattcgctttctggagtagagggtgaaggattacacaaattgggatatattcttagagacatatcgaaaataccaggaggtaacatgtacgcagatgatacggcaggatgggacactcgaataacagaagatgatttacagaacgaagcgaaaataacagatataatggagcccgaacacgctttacttgcaaaatctatttttaaactcacatatcagaacaaagtggtcagggtgcaaaggccagccaaaaatggaactgtaatggatgtgataagcagaagggaccagagagggtcaggtcaagtgggtacttacggtttaaacacctttacaaatatggaagcgcaactgattcgccaaatggagtcagaaggtatattttccccatctgaattagaaacacccaaccttgcaggtcgagtactcgattggttagaaaagcacggtgtagagagacttaaaagaatggctatatcgggtgatgattgtgtagtgaaaccaattgatgatcgattcgccacagcgctaacagcgttaaatgacatgggtaaagtgaggaaagacataccacaatgggaaccgtcaaaaggatggaatgactggcagcaagttcctttctgtagccatcacttccatcagttaataatgaaggacggccgtggtatcgtcgtaccttgtagaaatcaagacgaattagtaggtagggccagggttagccaaggagcaggatggtccttaagagaaacagcctgcttaggtaaaagctatgcacaaatgtggcagttgatgtatttccatcggagggacctgagactagctgcgaacgctatctgttctgctgtcccagtagactgggttccaacatcccgtacaacatggtcgatccacgcacatcatcaatggatgacaactgaggatatgttatcagtttggaaccgggtatggatcgaagagaatccctggatggaagataaaactcatattagcagttggggcgatgtaccgtaccttggtaaacgtgaagatcaatggtgtggttcattgatcggtttaactgctagagcgacttgggccaccaatatacaagtcgcaatcaaccaggtcagacgcctcatagggaacgaaaattatctagattacatgacaagtatgaaaagatttaaaaacgaatcagatccagaaggggccttgtggtag

SEQ ID NO: 21962 - RNA, 9879 nt, synthetic construct
  misc_feature 1..9879: note = derived and/or modified CDS sequence (opt6) from DENV-1__EU482529__SS-prME
  source 1..9879: mol_type = other RNA
tcagttacaatgttattaatgcttatgcccactgcactagcattccaccttacaactagaggaggagaacctcacatgatcgtatcaaaacaagaacggggaaaatcgttattatttaaaacatcggctggagtcaatatgtgtacgttaatcgcaatggatttaggggaattatgtgaagacactatgacgtataaatgtccacgtattacagaaaccgaaccagatgatgttgattgttggtgtaatgccactgatacgtgggtcacatacggtacctgcagtcaaacaggtgaacacagacgcgacaaaagatccgtagctttagcgccacatgttggactaggcttagaaacaagaacagagacatggatgagctcagaaggtgcatggaaacaaatacaaagagtagaaacgtgggcacttagacacccaggctttacagtcatagccttattcttggcacatgctataggtacttcaataacccagaaaggaattatattcatactgctgatgctagttacccccagtatggccatgcgctgcgtaggaattggaagtcgggattttgtggagggtttgtccggagcaacttgggttgatgtagttctggaacatggatcatgcgtaaccactatggctaaagataaacctacgttggacatagaattgcttaaaacagaagtaaccaatccagccgtattgaggaagctgtgtatagaagccaagatttcgaatacgacgacggacagccggtgtccaacacaaggcgaagcaaccttagtcgaagaacaagacgcaaattttgtttgcagaaggactttcgtagatcgagggtggggcaatggatgcggtcttttcggaaaaggcagcttaattacgtgcgccaaattcaaatgtgtgacaaaactagaaggaaaaatagtccaatatgaaaatctcaagtactcagtgatagtgacagttcatacaggggatcagcatcaagtaggtaatgaaagcacagaacatggaaccacagctacgattactccacaagcccctacaacagagatacaactaaccgattatggtgctttaacactagactgtagccccaggacaggcctagattttaatgagatggtgctacttacaatgaaagagaaaagttggctggttcacaaacaatggtttctggatcttccgctaccgtggaccagcggtgcaagtaccctgcaagaaacatggaatcgccaagatcttctagtcaccttcaaaactgcccatgctaagaaacaagaagtagtagtactaggtagccaagaaggtgccatgcatacagccctaaccggcgctaccgaaatacagacgagtggtacaaccacgattttcgccggtcaccttaagtgtagattaaagatggataaattgacactcaaaggcatgagctacgtcatgtgcacaggcagctttaaacttgagaaagaggtagcagagacccaacatggtaccgttttagtgcaaataaaatatgaaggcaccgatgcaccatgcaaaataccgttcagtacgcaggatgaaaaaggggtcacacaaaatgggcgactaattacagcgaatcccatcgtgacagacaaagaaaagccagtaaacatagaagcagaaccaccattcggagagtcatatatcataataggagcaggagaaaaagcactaaagctctcgtggtttaaaaagggttcatctattggtaagatgttcgaggctacagcaaggggagcaagaagaatggcaatacttggagacactgcatgggacttcgggagtataggcggggtttttacatcagttggtaaactcgtacaccaaatattcgggacagcatacggtgtccttttctcaggggtttcgtggaccatgaagatcggtataggggttttgctaacttggctcggacttaattctcgaagtacttctctttcaatgacatgtatagccgtcggacttgtaacactatatttaggtgtaatggtccaagcagactcaggatgtgtaataaattggaagggtcgtgagctgaagtgcggaagcggaatcttcgtcaccaacgaggttcacacatggacagaacaatacaaatttcaagcagatagtcccaaaagattgagcgccgcaatcggaaaagcatgggaggaaggagtttgtggtataagatctgccacacgacttgaaaacataatgtggaagcaaatctctaacgaactcaaccacatattattagaaaacgatatgaaattcactgttgttgtaggggacgtagcaggcatactcgcacagggtaaaaagatgattcgcccgcaaccaatggaatataagtattcttggaaatcttggggaaaagcgaaaattataggtgccgacgtccagaatacaacatttatcatcgacggacccaatacacctgaatgtccggacgaccaaagagcatggaatatatgggaagtagaggattatggctttgggatattcactactaatatatggctcaaattgagagacagccacacacaggtgtgcgatcacaggttgatgagtgcggcaattaaagactccaaggcagtacatgctgatatgggatattggattgaatctgagaagaatgaaacgtggaaactcgctagagctagctttattgaagttaaaacgtgtatttggccaaaatcgcatactctttggtctaatggggttttagaatcagaaatgattattccaaaaatatacggaggtccaatcagtcaacataattatagacctggctattttactcaaactgctggaccttggcatcttggcaaacttgaattagactttgatttatgcgaaggaaccaccgtggtagtagacgaacactgcggtaatcgtggaccgtcattgagaacaacaacagtaacaggcaaaataattcatgaatggtgttgccgatcttgtacgctgcctcctttacgatttcgcggagaagacggatgctggtacgggatggaaatccgacctgttaaggaaaaggaagaaaacttagtgaagtcaatggtgagcgccggaagtggagaggtcgattccttctctctcggtcttctatgtatatcaataatgattgaagaagtaatgcgaagtagatggtctcgtaaaatgttgatgacaggtacactagccgtattcttcctactcatcatgggacaacttacatggaacgatctaattagactatgcattatggtaggggctaatgcttccgacagaatgggaatgggcaccacttacctcgcattaatggcaacttttaaaatgagacccatgtttgctgttggtctccttttcaggagattaaccagtagagaggtacttttgctaacaatcgggctttctttagtagcttcggttgaactacccaacagcctcgaagaactgggagatgggctggcaatgggtatcatgatcttgaaacttttgacagattttcaaagccatcaactctgggcaacacttctttctctgacatttatcaagacaacatttagcctccactatgcctggaaaacaatggctatggtgttatccattgtcagtctttttcccttatgcctatctacaacctcacaaaagactacatggttaccagtacttttagggtcattggggtgcaagccgttaaccatgttccttattgctgaaaataaaatatggggtcgtagatcatggccgctgaatgaaggcataatggcagtcggtatagtaagcatattactctcatctctgctgaaaaatgatgtaccactagccggtccattaatcgctggaggtatgctaattgcatgttatgttatttctggatcatccgcagatctgtcattagaaaaagccgcggaagtctcatgggaagaagaagcggaacatagcggtgcctcacataacatactggtcgaagttcaagacgacgggactatgaaaataaaggatgaagaacgtgatgatacattaaccatattattgaaagctacacttctagcagttagtggggtatatccgcttagcattccagccacactctttgtgtggtacttttggcagaagaagaaacaacgctcaggggtgctatgggacacaccctctccacccgaagtagaacgtgcagtattagatgatgggatttatcggataatgcaaaggggtcttcttggtaggagccaggttggtgtaggagtatttcaagagaacgtgtttcacacgatgtggcacgtaacacgtggtgcagtgctgatgtatcagggtaaaagattagaaccgtcatgggcaagtgtaaagaaagatttaatttcctatggaggaggctggaggctgcaaggtagttggaacaccggcgaagaagtgcaggtaattgcagttgaacctggtaaaaatccgaaaaacgtccagactgcgcccgggacatttaagaccccggagggagaagtgggagccatagccttagatttcaagcctggaaccagtggctcgccgatagttaatcgtgaaggaaaaatagtaggtctttacggaaacggagtagttacaacctcagggacgtacgtaagtgcaatagcacaagcaaaggcaagccaagagggaccactaccagaaatagaagatgaggtttttcgaaaaagaaatcttacaattatggatttgcatccaggatctggaaaaacccgacgatatctccccgcaatagtcagagaagctattaagaggaaactcagaacactaatacttgcgcccactagagtagtcgcgagcgagatggctgaggctttaaagggaatgcctataagataccaaacaacagcggtcaaaagcgaacatactggaaaagaaattgtagacttgatgtgccacgcgacttttacaatgaggcttttatcaccggtaagagtaccaaactataacatgataattatggatgaagcgcattttacggatccttcatcaatcgccgcacgagggtacataagcacacgtgtaggaatgggggaagcagcagctatattcatgacagccaccccacctggatctgtagaggcattcccacaatcaaatgcagttatccaggacgaagagagagacatcccagaacgtagttggaactctggatatgaatggataacggattttccaggtaaaacagtgtggttcgttccgtccatcaagagcggtaatgatatcgcaaattgcttacgcaaaaacggtaagcgtgtcatacaattgtcgagaaaaacattcgatactgaataccaaaagaccaaaaataacgattgggactatgtagtaacaacagacatatcggaaatgggagcaaatttccgcgccgacagagtgatcgatccgcgacggtgcttaaaacctgtaatcttaaaagatggtcctgagcgcgtaatccttgcaggtcctatgcctgtaacggtcgcaagtgccgcacaacgacgaggtaggattggacgtaaccacaataaagaaggtgatcaatacatttatatgggacaaccgttgaacaacgacgaagaccatgcccattggacagaagcaaaaatgcttttggataatataaacacccctgagggaatcatacctgcactcttcgaaccagaacgagagaaatctgctgctatcgatggagagtatcgtttacgaggtgaggcacggaaaacttttgtagaattgatgcgacgtggtgatttgcccgtttggctaagttacaaagtcgcgtctgagggcttccaatattctgatagaagatggtgttttgatggcgaacgtaataatcaagtattagaggaaaatatggacgtagaaatttggacaaaagaaggtgaaaggaagaaattacgccctaggtggctggatgctaggacctacagcgatccactagcgcttagagaatttaaggaatttgccgccggtagacgaagtgtctcaggggacttgatattagaaattgggaagctaccccaacacctcactcaacgagcccaaaacgcattagataacctggtaatgttacataacagtgaacagggtggcagagcataccgccacgctatggaagaacttccagacacgatagaaactctaatgcttttagctcttatcgcagtactaactggcggagttaccttatttttcttgtcaggacgaggtctcggtaaaactagcataggtttattgtgcgttatggctagctctgtcctcctgtggatggcctcagttgaaccacattggatagcagcttcaatcattttagagttctttctaatggtcttattaataccagaacccgacaggcaacgtactccacaggacaatcagttagcatatgtagtcattgggttgctattcatgatactcactgtagccgcgaacgaaatgggattactcgaaaccacgaaaaaggatttaggtatcggtcacgtggcagtagagaatcatcaccacgcagctatgttagacgtagacctccatccagcatccgcatggaccctttatgccgtcgcaactactatcattacaccaatgatgcgccacaccatcgaaaatactacagcaaatatatcgttgaccgcaatagccaatcaagccgctatattaatgggattggataaggggtggcctatcagtaaaatggacataggtgttccgctacttgctcttgggtgctactcacaggtaaatccacttacgcttaccgccgcagttctaatgctagttgctcactacgccatcattggcccaggtctacaggccaaagcaacacgagaagcacagaaaagaacagcagcaggaataatgaaaaacccaactgtcgacggtattgttgctatcgatttagatccggtagtttacgatgccaagttcgagaagcagctcggacaaataatgcttttaatcctatgcacatcccagatcttactaatgagaacaacatgggcactctgtgaaagtataactttggcaacaggaccgttaaccacgctctgggaaggatcgcctggaaaattttggaatactacgatcgcagtatcaatggcgaatatattcagaggatcttatctagcaggggcgggcctcgctttttctctcatgaaaagcctaggaggaggacgacgtgggacaggcgcccaaggtgaaacacttggagaaaaatggaagagacaactaaatcaattatcaaaaagcgagttcaacacttataaacggtcaggtataatggaggtggatcgtagcgaggctaaagaaggtctaaagcgcggtgaaacaactaagcatgcagtatcaagaggaacggccaaacttcgatggtttgtagaaagaaatttagttaaaccagagggaaaagtcatagaccttggctgcggaagaggcgggtggagttattattgcgcaggacttaagaaagtaacggaggtaaaaggctatacgaaaggcggtccaggtcatgaagaaccaataccaatggcaacgtatggatggaacctagtaaaacttcatagtgggaaagatgtattctttattccacctgaaaagtgcgatacattattgtgtgacattggagaaagcagtccaaatccaaccatagaagaaggaagaacgttaagagtattaaaaatggtggaaccgtggttaaggggtaaccaattctgcattaaaattctaaatccctatatgcctagcgttgtcgaaacacttgaacagatgcaacggaaacacggtggcatgctagtgcgaaacccattatcaagaaactctacacacgagatgtactgggtatcttgtggaacaggcaatatcgtttcggccgtaaatatgacatcacgtatgctgctcaacagatttactatggcacacaggaaaccaacatatgaaagggatgtggatcttggagctgggactagacatgtagctgttgagccagaagtggcaaatctagatataattgggcaacgaattgagaacattaagcatgaacacaaatcaacctggcattatgacgaagataatccttataaaacatgggcttatcatggttcgtacgaagtaaaacccagcggcagtgcaagcagtatggtaaatggcgtagtcaaacttcttacgaaaccatgggacgttattcctatggtaacacaaattgcaatgacagatactacaccatttggacaacaacgagtattcaaagaaaaagttgacactagaacgccaaaagctaaacgtggtacagcacagatcatggaagtaacggccaagtggctgtggggtttcttatcgcgtaataagaaaccccgaatatgtaccagagaagaatttaccagaaaggtccgatccaacgctgcaatcggtgcggtcttcgttgacgaaaatcaatggaactcggctaaagaagcagtagaggacgaacgattctgggatctagtgcacagggaacgagaattgcataaacagggtaaatgtgctacatgtgtttataacatgatgggaaaaagggagaagaagttaggtgagttcgggaaggcaaagggaagtcgtgcaatttggtacatgtggcttggggctcgctttttagagttcgaggctctagggtttatgaatgaagaccattggttcagcagggagaactcactcagtggagttgaaggtgaaggactacacaaattagggtatatattaagagacatctcaaaaataccaggtggtaatatgtacgcagatgatacagcaggatgggatacaagaatcactgaagacgatctgcagaatgaagcaagaatcacagatataatggaacctgagcatgcactcttggccaaatccatctttaaactaacctatcaaaacaaagtcgtaagagtacagcgacctgccaaaaatggaacagtgatggacgtcatatcacgacgagatcaacggggatctggacaagttggtacgtacggcttaaacacatttacaaatatggaagcacaactgataagacagatggagtccgaaggaatattcagtcccagtgagctagaaacccccaacctcgctgagagagtcctagactggttggaaaaatacggagtagagagactcaaaaggatggcgatttctggtgatgactgcgtggttaaaccaattgatgaccgtttcgcgactgccttgacggctcttaacgatatgggcaaagtgcggaaagatataccacaatgggaaccgagtaaaggatggaatgattggcagcaagtacccttttgttcacaccattttcatcaattaattatgaaggatggacgggagattgtcgtaccttgtcgaaaccaagatgaactggtaggaagggcaagagtaagtcagggggcgggatggtcattaagggaaactgcgtgtttagggaagagttatgcccaaatgtggcagttaatgtattttcataggagagatttaaggttggcagctaatgccatctgcagtgcagtacctgttgactggatcccaacatcaaggacgacatggtcgatacatgcccatcatcagtggatgactacagaggatatgttgtcagtctggaatagagtatggatagaagaaaatccatggatggaggacaagacacacataagctcatggggagatgtaccttatcttgggaagagagaagaccaatggtgcggaagtttaattggcttaacagcgagggcaacctgggctactaacatccaagtggctataaatcaggttagacgacttataggtaatgagaattatcttgattacatgacatccatgaaacgttttaaaaacgaaggcgatccagagggtgcattgtggtga

SEQ ID NO: 21963 - RNA, 9879 nt, synthetic construct
  misc_feature 1..9879: note = derived and/or modified CDS sequence (opt6) from DENV-1__EU482531__SS-prME
  source 1..9879: mol_type = other RNA
tcagtaactatgctattaatgttaatgcctactgcactagcatttcatttaactacacgcggaggagaaccacatatgatcgtaaccaaacaagaacgcggtaaatctttgttattcaaaacaagtgcgggagttaacatgtgcacattaatagcaatggatttaggcgaattgtgcgaagatacaatgacctacaaatgcccaagaattacagaagctgaaccagatgatgtagattgctggtgcaatgctacagatacctgggtaacatatggtacctgttcccaaactggagaacacagacgagataaaagatcggtcgcactagcaccacacgttgggcttggtcttgagacaagaacggaaacttggatgagttccgaaggagcttggaaacaaatacaaagggtagaaacatgggctttacgccatccgggcttcactgtaattgctttatttttagcgcatgcaataggaacgagtattacccaaaaaggaatcatattcatattgctgatgttggttacaccatcaatggccatgcgctgtgtaggcatcggatctcgagattttgtagaagggttgagtggagcgacttgggtggatgtagtactagaacatggttcatgtgtaacaactatggcgaaagataaacccactcttgatatagaactactaaaaactgaagtaactaacccggcggtccttaggaaactctgcatcgaagcgaaaataagtaatacaacaactgactcacggtgtcctactcaaggagaagctacattaatggaagaacaagacgcaaacttcgtgtgtagacggacgtttgtagacagaggctggggaaatggatgtggtttgtttggtaaagggtcgttgatcacgtgcgccaaattcaaatgcgtaacgaaattggaaggtaaaattgtacaatatgaaaatctcaaatatagcgtaatagtaaccgtacacaccggggatcagcatcaagtcggtaatgaatctacagaacacggaacaacagccacgataacaccacaagctccgacttctgaaatacaattaacagattacggagcattgacactagactgttcaccccggacaggtttagattttaacgaaatggtgctcctcactatgaaagaaaagtcgtggctagtacataaacaatggtttctagatttgccattaccatggaccagcggcgctagcaccagtcaggaaacttggaacagacaagatttacttgttacattcaaaacggcccacgccaagaaacaggaagtggtggttcttggtagtcaagaaggcgccatgcatacagcactaacaggggcgactgagatacaaacaagtgggactaccacaatatttgcgggccatcttaaatgtaggctaaaaatggataaactaacgttaaaaggaatgtcatacgtgatgtgtacagggtctttcaaactagagaaggaggtagcagagacgcaacacggcacagttttagtacaaataaaatatgaagggaccgacgccccatgtaaaataccattttctacccaagatgagaaaggagtaatacaaaatggacgtcttatcacggctaatcccattgtcacggataaagaaaagccggtaaatatcgaggcagaaccaccattcggagaatcttatattgtaattggagttggggaaaaagcactcaaattaagttggtttaaaaaggggagctcgataggaaaaatgttcgaagccaccgccagaggagcccgtaggatggctattctaggagatacagcatgggatttcggctcaatcggaggagtatttacttccgtaggtaagttggttcatcaaattttcggaaccgcctatggcgtcttattctcaggagtcagctggacgatgaaaattggtataggggttctattgacttggctcggtctgaatagcagatcaacgtcattaagtatgacatgtattgctgtgggcttagtaacattataccttggtgtcatggtacaggccgatagtggttgtgtgataaactggaaaggacgagagctgaaatgtggttcaggaatattcgtaaccaatgaagtgcacacttggacggaacaatacaagtttcaggcggattctccgaaaaggctaagcgcagcaataggaaaagcctgggaagagggtgtctgcggaataagaagtgctactagacttgaaaacatcatgtggaaacagatttcgaatgagcttaatcatattcttcttgagaacgatatgaaatttaccgtagtagtaggggatgtcgtaggtatattggctcaaggtaagaaaatgatacgtccacaaccaatggaacataaatattcatggaaaagttggggaaaagcaaaaatcataggggcagacgtccaaaacacaacgttcataatagacggccctaatacacccgaatgtccaaacgaccagcgagcatggaatatatgggaagtagaggattatggttttggtatttttacaacgaatatatggctgaaacttagagatagctatactcaggcatgtgaccatcgactcatgtccgctgcgattaaggatagcaaggcggtacatgccgacatgggatactggatagaatctgagaaaaacgaaacatggaaactagctcgcgcttcatttatagaggttaaaacgtgtatatggcccaaaagccacacactttggagcaatggagtgttagagtcagagatggtaatcccaaagatctacgggggaccaataagtcaacataattatcgtcctggatactttacacaaacagctggcccatggcacttagggaaactcgaattagattttgatctttgtgagggtacgacagttgtcgtagatgagcattgcggtaaccgtggtccttctttaagaactactactgtgacaggaaaaattattcatgaatggtgttgtagaagttgtaccttaccacctttaagatttaaaggtgaagacggatgctggtatggaatggaaatacgaccagtcaaagaaaaagaggaaaatttggtgaaaagcatggtttctgcgggatccggagaagttgactccttctccctaggcctcctatgcatcagtataatgatcgaagaggtaatgcgaagcagatggtcgcgaaaaatgctgatgaccgggacattggcggtctttctcctgttgataatgggccaactcacatggaacgacttaataagactatgcataatggttggagccaacgcatcagatagaatgggtatgggaaccacatatttagcattaatggctacatttaaaatgagaccaatgttcgcagtcggcctcttattcaggaggttgacaagtagagaagttctgttgctaacgataggtctatctttagtagcttcagtagagttacctaattcgttggaagaactaggagacggcttagccatgggcataatgatactcaagctcctcacggattttcaatcccatcagttatgggcgactcttttgtctcttacgttcattaaaacaacgttatctttacactacgcctggaagactatggcaatggtattatccatcgtatctttgttccctttatgcttatcaactacgtcgcagaaaacgacgtggttacccgtactgttgggatctctcgggtgtaaacctcttacaatgttcctaatagcagaaaataaaatttggggccggaagtcctggcccctcaatgaaggaataatggcggtaggagtcgtatcaatattactatcttcactacttaaaaatgatgtaccattagcgggccccttgatagcaggaggaatgttgattgcatgttacgtcattagtgggagcagtgcagacctgtcgctggaaaaagcagcggaagtttcatgggaagaggaagctgaacattctggtgcaagtcacaatatcttagttgaagtacaagacgatggaacgatgaaaataaaagatgaagagagggatgatacattaactatattactaaaagccacattattggcagtctcaggagtatatccgttaagcatccccgctacactattcgtatggtatttttggcagaaaaagaaacagagatcaggggtactgtgggatacaccaagtccacccgaagtcgagagagcggttttagatgacggaatttacagaattatgcaaagaggtttactaggccgaagccaagttggtgttggtgtatttcaggaaaacgtattccatacaatgtggcatgtcacccgcggggccgtcctcatgtatcaaggtaaacgactcgaaccaagctgggcgtccgtcaagaaagatctaattagctacggaggcggttggagattacaaggatcgtggaatacaggtgaagaagttcaggtaatcgcggtagagccaggtaaaaaccctaaaaatgttcagacagcacccgggacctttaaaacaccagaaggggaagtaggagcaatagccctggactttaaacctggcacatcaggctcaccaatagtcaatcgagaaggaaaaattgtaggtctttatggaaatggagtggtaacaacatcaggaacttatgtatctgccatcgcacaagcaaaagccagtcaagaaggtccattgccagaaatagaagatgaagtttttagaaaacggaacttaacgattatggacctacatccgggtagtggtaaaactcgccgatacttacccgcgattgttcgagaagcgattaagagaaaattgaggacattgatactggcaccaaccagagtagttgcttcggagatggccgaagcattaaagggtatgccgattaggtaccaaaccactgcggttaaaagcgagcatacagggaaagaaatcgtggacctaatgtgccatgccacatttaccatgagattattatctccggttcgagttcccaattacaatatgataattatggacgaagctcacttcacagatccgtcatccattgctgcaagaggatacatatccacaagagtagggatgggcgaagcggcagccatatttatgaccgcaacaccacctggttccgtagaggctttccctcaatcaaatgcagtgatccaagatgaagagagagatattcccgaaaggtcctggaatagtggttacgaatggattaccgacttcccaggtaagaccgtatggttcgtcccaagcattaaaagcggtaacgacatagcaaattgtttacggaaaaatggaaagcgtgttatacaattaagccgcaagacctttgatacagaataccagaaaaccaagaacaacgactgggattacgtggtgacaacagacatcagtgagatgggtgcaaattttcgggcagatagagtaatagatccgcgccgctgcttaaaacctgtaatattaaaggacggacctgaacgggttatacttgcaggacccatgcctgtcactgtcgcatccgcagcccaacgacgaggcagaatcggacgaaatcataataaggaaggggaccaatatatttatatgggtcaaccactgaacaacgatgaagaccacgcgcattggacggaagctaagatgttactagataacataaacactccggaaggtattataccagcattgtttgagccagaaagggagaaaagcgcagccatagacggtgaatatcgtttacgaggagaagcaagaaagacgtttgtagaactcatgagacgtggggatttaccggtttggttatcgtacaaggttgcttctgaaggctttcaatactcggatagacgatggtgttttgatggagagagaaataatcaggttctagaagaaaatatggatgtcgagatatggacgaaagaaggggagaggaagaaattaagacctcgctggttggacgcaagaacatattcagatccactcgcgctaagagaatttaaagagttcgctgctggtcgtagatcggtaagcggcgacttaattctagaaatcgggaagctgccacaacacttaacacagcgagcacagaatgctctggataacctagtcatgcttcacaattccgaacagggaggtagggcataccggcacgcaatggaagaattacctgatacgatagaaacgctaatgttgctagcactcattgctgttttgacgggcggagtgactttattctttcttagcggcagaggattaggtaaaacctcaattggcttgttgtgcgttatggcaagtagtgtattactttggatggctagtgtggaaccgcattggatcgcagcgagtataatattagagttcttcctaatggttttactaataccagaacctgacagacagcgaactccgcaagataaccaattggcatatgtcgttattggactactcttcatgatcctaactgtcgctgcaaacgagatggggttgttggagacaactaaaaaggaccttggtatcggtcacgttgccgttgaaaaccaccatcatgcaaccatgttagatgtggatctacatcctgcctcagcttggacactctatgccgtagcaacgacgattataaccccaatgatgcgacacacgatagagaacaccaccgctaacataagtttaaccgcgatcgccaaccaagcggctatcttaatgggactagataaaggctggccgattagtaaaatggacataggagtacctctattggctcttggttgttactctcaagtcaatccgttgacattaacagcggccgttctaatgttagtggcccattacgccataattggaccaggattgcaagccaaggcaacaagagaggctcaaaaacgaacagcagccggaataatgaaaaacccaacagtcgatggtatagtcgccatagatttagatcccgtagtgtatgatgctaaatttgagaaacaactaggacaaattatgttactcatcttgtgcacctctcagatcttactaatgcgaaccacatgggccttatgtgaatccatcactttagctactggaccgttgacaacattatgggaaggaagtccaggaaaattttggaatacgaccatagccgtatccatggctaatattttccgtggtagttatcttgccggtgccgggctagcattcagtctcatgaaatctctgggtggaggacgaagaggtacaggagcacagggagaaacgctgggagaaaagtggaaaagacagctcaatcagcttagcaagtccgagttcaatatctataaacgatccggaataatggaagtagatagaagtgaagctaaagaaggtttaaagaggggagaaaccactcgacatgcagtttcgcgtgggactgctaaattgagatggtttgtggaaaggaatctggttaaacctgaaggtaaagtaattgatttaggctgtggacgaggaggatggtcgtactactgtgctggactaaagaaggtcaccgaagtaaaagggtatacaaaagggggtcctgggcatgaagaacctataccaatggcgacttatgggtggaacctcgtcaagttgcacagtggcaaagatgtatttttcaccccgccagaaaaatgtgatacgttattatgtgatataggagaatcttcaccaaatccaactatagaagaaggtcgaacgttacgagtgttaaaaatggtagaaccatggctacgtggcaaccaattctgcattaaaatattaaatccatatatgcctagtgtagtagaaactctcgagcagatgcaaagaaaacacggcggaatgcttgttcgaaatcccctatcgaggaacagtacacacgaaatgtattgggtgagttgtggaacgggaaatatcgttagtgctgttaatatgactagcagaatgctcctaaaccgattcactatggctcaccgtaagcctacctatgaacgagatgtagatctgggtgcagggaccagacacgtggccgttgaacctgaggtcgccaacctagacataattggacaaagaatagagaatatcaaacacgagcacaaaagtacttggcactatgatgaggacaatccgtataagacatgggcgtatcacggatcatacgaggtcaaaccttccggaagcgctagttctatggtgaacggtgtcgttaaactcttaacgaagccatgggatgtcatacccatggttacgcagatcgcaatgacagacactacaccattcggtcaacagcgagtatttaaagagaaagtcgacacaagaacacccaaagctaaaagaggaactgcccaaatcatggaggtaacagcccggtggctttggggatttttatcgagaaataagaagccgaggatatgcacgcgagaagagttcacgcgaaaagtacgatccaacgccgctataggggccgtatttgtcgacgaaaaccagtggaatagcgcgaaagaagccgtagaagacgaaagattttgggatctagtacaaaaagaaagagagctacacaagcaaggtaaatgtgcaacttgtgtgtataatatgatgggtaaacgagaaaagaaactaggtgaatttggaaaagcaaaaggtagtagagccatatggtacatgtggctcggggctagattcttagagttcgaggctttagggttcatgaatgaagaccactggtttagcagagaaaattcgctctcaggtgtagaaggcgaaggactacataaactaggatatattctccgggatatttcaaagatacctggtggcaatatgtacgctgacgataccgcaggttgggacacacgcataactgaagatgatctacaaaatgaagcgaaaataaccgacataatggaaccagagcatgcattactcgccaccagtatttttaaactaacgtatcaaaacaaagttgtgcgagttcagagaccagctaaaaacgggacagtaatggatgtaatctcaagaagagatcaacgcggaagcggccaagtgggaacttatggattaaatacattcacaaacatggaagcacagttaattaggcaaatggaatcagaaggaatattccttccttcagaattagagactccaaatctagcagagcgagttctagactggctcgaaaaacatggtgtagaacgcttaaaaaggatggcaatatcgggcgacgactgtgtagttaaaccgatcgatgatcgttttgccacggcattaacggcactaaacgacatgggtaaagttagaaaggatataccacaatgggagccaagtaagggatggaacgattggcagcaagttccgttctgcagtcatcatttccatcaattgatcatgaaagatggtagagaaattgttgtaccgtgccgaaatcaagacgaacttgtcggcagagcgagagtgtcacagggcgcaggatggtcgttgcgagagactgcatgtctaggcaagtcatatgcacagatgtggcaacttatgtactttcaccgaagagacctacggttagcagcgaatgcgatatgtagtgccgtgccagttgactgggttcctacaagtagaactacttggagcatacacgctcatcatcagtggatgacgacagaagacatgttaagtgtatggaatagagtttggatcgaagagaacccctggatggaagacaaaactcacgttagcagttggggtgacgtaccctacctaggaaagagagaggatcaatggtgcgggtcactgattggtttaactgcccgtgctacatgggcgagtaatatacaagtcgcgataaaccaagtaagaagactaatcggtaatgaaaattatcttgactatatgacgtcgatgaaacgttttaaaaacgaaggtgatccagaaggagcactctggtaa

SEQ ID NO: 21964 - RNA, 9879 nt, synthetic construct
  misc_feature 1..9879: note = derived and/or modified CDS sequence (opt6) from DENV-1__EU482532__SS-prME
  source 1..9879: mol_type = other RNA
tcagttactatgttactaatgctgatgcctactgcattagcattccacttgacgacacgcggtggggaaccgcacatgatagtaagtaaacaagaacgtggtaaatcattactatttaaaacgagtgcgggtgtaaatatgtgtacattgatagcaatggacttaggtgaattttgcgaagatacgatgacctataaatgcccacgtataactgaagcagaacctgatgatgtggattgctggtgtaatgctacagatacatgggtaacctatggtacctgttctcaaacgggagaacacaggcgtgataaacgaagcgtagcactcgccccacacgtgggacttggactcgaaacccgaacggagacctggatgagtagcgaaggtgcgtggaaacaaatacaaagagtagaaacatgggcgctgagacatcctggatttactgtaattgcattgttcttagcgcatgctataggaacttcgataactcagaagggtattatctttatactgttgatgctcgtgactccttcaatggccatgagatgtgtaggcatcggttctagagactttgtagaaggcttgagtggtgcaacatgggtcgatgtagtacttgaacatggctcgtgcgtaacgaccatggcaaaagataaacccacactagatatagagttgcttaaaacagaagttactaatcctgcagtcctaaggaaactgtgcatagaagctaaaataagtaatacaacgacagacagccgatgtcccacccaaggagaagcgactttagttgaagaacaagatgcaaatttcgtatgtcgaaggacttttgtggacagaggatgggggaatggatgcgggttatttggaaaaggaagtttaatcacatgcgcaaaattcaaatgcgtgacaaaattagagggaaaaattgtccaatacgaaaacctaaaatacagcgttattgtaactgtccatacgggcgaccagcaccaagttgggaatgaatccaccgaacatggtacgacagcaacaataacgccacaagcacccagtacagaaatacaactaaccgattacggtgcattaacgttagactgttcacctaggacagggttagactttaatgaaatggttttattgactatgaaagagaaaagttggttggtacataagcaatggttcctagatctacctttaccttggaccagtggggcttccactagccaggaaacttggaataggaaggatctattagttacgtttaagacagcccacgccaagaaacaggaagttgtcgtactgggttcgcaggagggagcaatgcataccgctttaaccggcgcaaccgagatacaaacaagtggtacaacaacaattttcgctggacatcttaagtgcagattgaaaatggacaaactaacattaaaaggaatgtcatacgtcatgtgtaccggatcttttaaattggaaaaagaggtcgctgagacccaacatgggacagtcctcgtccagataaaatacgaaggcacagatgcaccttgcaaaatacccttctcaacgcaagatgaaaaaggcgtaacgcaaaacggaaggcttataacagctaatcctattgtaacagacaaagaaaagccagtaaatatagaggctgagcctcccttcggagagtcttatatagtcataggggccggagagaaagccctaaaattaagctggtttaagaaaggaagttcaataggaaaaatgttcgaagcgaccgcaaggggagcacgcaggatggccatactcggagatacggcatgggattttgggtcaataggcggagtgtttacatcagtagggaagctagttcatcaaatatttggtacggcatacggagttctgttttctggagtaagctggacgatgaaaatagggatcggagtactgttgacttggttgggtctaaactctaggagtacatcactaagtatgacatgcatagccgtaggacttgtaacactttacttgggcgtaatggtacaagcggatagtggttgcgtaatcaattggaaagggcgcgaactaaaatgtggctctgggatctttgtcacaaatgaagtgcatacgtggacggaacagtacaagtttcaagccgactccccaaagcgactcagtgcggctattggtaaagcatgggaagagggggtgtgtggtatcagaagcacaacacgattggaaaatataatgtggaagcaaatttccaatgaactaaaccatatcctcctagaaaacgacatgaaatttacagtggttgttggagacgttgcagggatattagcccaaggtaagaaaatgatacgaccccagcctatggagtataagtattcatggaaatcatggggtaaagctaaaataattggcgcagatgtacagaacacgacatttataatagacggaccgaacacgcctgaatgcccggatgatcaacgagcgtggaatatctgggaagtagaggactatggatttgggatctttacaacaaatatttggttaaaactcagggacagtcacactcaagtttgtgaccacaggctaatgagcgcagctattaaagactcaaaagcagtccatgcggacatgggttactggatcgaatcagagaaaaatgaaacatggaaactcgcaagagctagttttatagaggtaaaaacttgtatatggccgaagtcacacacactctggtcaaacggggtacttgaaagcgaaatgataatacctaagatatatggaggacctataagccaacataactatcgatcaggatactttacacaaacagctggaccatggcatctaggaaaactcgaactagacttcgacctatgtgaggggaccacagtcgttgtagatgagcactgtggtaaccgagggccatcgttaagaaccacaacggtcacaggaaaaattattcatgagtggtgctgtcgtagttgtaccctaccccctttgagatttaaaggagaagatgggtgctggtatggaatggaaattcgtcccgtaaaagagaaagaagaaaacctagtgaaaagtatggtatcagcaggtagtggtgaagtagacagtttttcattgggattgttatgtatttcaataatgatagaagaggtaatgagatcacgatggagtcggaaaatgttaatgacaggaacgttagctgtattctttcttctaattatggggcaattaacctggaacgacctaattagactctgcataatggtgggagccaatgcctcagaccgaatgggtatgggcaccacatatttggccttgatggcgacattcaaaatgcgacccatgttcgcagttggtcttctattcagaaggcttacatctagagaggtcctgttattaacgatcggactaagtctagtagctagcgttgaattaccaaatagcctcgaggagctaggcgatggattggccatggggatcatgatacttaaacttttaacggactttcaaagtcatcaactctgggcaacacttttatccctgacatttataaaaacaacattcagtttacactacgcatggaagacaatggcaatggtattgagcatagtgtcattatttcctctttgtttaagtacgacctcgcagaaaacgacatggcttcctgtactacttggctcacttggctgtaaacccttaacaatgtttttaattgcagaaaataaaatttggggacgaaagtcttggccgcttaatgagggaattatggctgtgggcattgtgtcaatattactttcgtctttgttgaaaaatgacgtaccattggcgggtccccttattgcagggggcatgctcattgcatgctatgttataagtgggagtagtgccgacctttcactggagaaagccgctgaggtatcgtgggaagaggaagccgaacattccggagcctctcataacatcttagtagaagtgcaagatgatggcactatgaaaattaaagacgaagagagagatgatactttaaccattttattgaaagctacattgcttgcagtatcaggagtatatcctcttagcataccagcgacactatttgtatggtacttctggcagaaaaagaaacaaaggtcaggagtactatgggatacaccgagccctccagaagttgaacgcgccgttttagacgatggtatatatcgaatcatgcaaagaggtctattaggaagaagtcaagtcggcgtaggcgtatttcaggaaaacgtgtttcatacaatgtggcacgtaacaagaggggcggttctcatgtaccaaggcaaacgcctagaaccctcgtgggcatccgtaaagaaagatttgatttcctatggcggtggctggcgtctccagggtagctggaatacaggcgaggaggttcaagtaatcgcagtcgaacctgggaaaaatcccaaaaatgtccaaacagcaccgggaactttcaaaaccagtgagggtgaagttggtgcaatagcattagattttaaaccaggtacgtcgggatcacctatagtaaatcgagagggaaaaatagttggactttatggtaacggcgtagtaaccacaagtggaacttatgtctcggctatcgctcaagcaaaagcctcacaagaagggccactacctgaaatcgaggatgaagtatttcgtaaacgtaaccttactataatggatctgcatcctggaagtggaaaaacccggagataccttccagcgattgtccgggaggcaataaaaagaaaattacggacattaatcttagccccaacaagagtggttgcctcagagatggcagaggcgctgaagggtatgcctattcgctatcaaacgacagctgttaaaagtgaacatacagggaaagaaattgttgatctaatgtgccacgcgacgtttaccatgagattactatctcctgtacgagttcctaattacaatatgatcattatggacgaggcacacttcactgatccctcaagtattgccgcgcgcggatacatatcaacacgtgtgggaatgggcgaagcagcagccatatttatgactgctacacccccaggatcggttgaagcctttccacaatcaaacgccgtgatccaagatgaagaacgagacataccggagcgatcatggaacagtgggtacgaatggataacagactttccaggcaaaactgtatggtttgttccgagtataaaaagcggaaacgatatagcaaactgcttgaggaaaaacggcaagagagtcattcaactctccaggaagacgttcgatactgagtaccaaaagaccaaaaacaacgactgggattatgtggtcacaaccgatatatcagaaatgggcgcgaatttccgcgctgacagagtgatagatcccagaagatgtttaaagcctgtgatacttaaagatggtccagaacgagtaattctagctggaccaatgcccgtaactgtagcctcggcggcacaaaggagaggtagaatagggcgaaaccacaacaaagaaggtgatcaatatatttatatgggtcaacccctaaataatgatgaagatcatgcacactggactgaagcaaaaatgttacttgataatataaacactccggaaggaataattccagcgttattcgagcctgagagagagaagtcagcagcaatagatggtgagtatcggttaagaggtgaagcgagaaagacgtttgtcgaactcatgcgtcgaggagatctcccagtgtggttatcttacaaagtagcaagtgaaggatttcaatattcagatcggcgatggtgttttgacggagaaagaaacaaccaagtcctcgaggaaaacatggacgttgagatttggacaaaggagggtgaacgaaagaaattacgtcccagatggctagacgctcgaacttatagtgatcctctagccctaagagaatttaaggaatttgccgcagggagacgtagcgtcagtggggatctgatcttagaaatcggaaaacttccccaacaccttacacagagagcacaaaatgcacttgataatcttgttatgcttcataattccgaacagggcggcagagcatatcgacatgcgatggaagaattaccagacactatcgagacattaatgttgctagcgttaatagccgttttaacaggcggcgttacactatttttcctgtccggtagaggacttggaaaaacatccatcggcttgctctgtgtaatggcaagttcagtcctattatggatggcttctgtagagccacactggattgccgcgtccataatacttgagttctttctaatggtactcttaatacctgaaccagatcgacaaagaacaccacaagacaaccaattagcatacgtagtgataggccttttatttatgatcctaacggtcgcagcgaacgaaatgggtctactagaaactacgaagaaggacctaggaataggacacgtcgcagctgaaaaccatcatcatgctgctatgctagacgtagacttacaccctgcatcagcctggacactatacgcagtagcaaccacaatcataactcctatgatgagacacactatcgaaaatacaactgcaaatatttcacttactgccatagccaatcaagcagcaatattaatggggcttgacaaaggatggccaataagcaaaatggacatcggtgtccctctcttggcactaggatgttattcgcaagttaatccattgacgctaacggcagcggtcctaatgttagtcgcgcattacgctataattggccctggtttgcaagcgaaagcgacacgagaagcacagaaaagaactgccgccggtataatgaaaaaccccacggtagacggcatcgttgcaatagacttagaccccgttgtatacgacgcaaaattcgagaaacaactcggacaaattatgttactcattttatgtacatcgcaaatactattgatgaggactacttgggcactctgtgaatctataacccttgcaacgggacctttaacaacactttgggaaggaagccctgggaaattttggaataccactatagctgtgtcgatggccaacatttttcgcggaagctacttggcgggagcgggtttggcatttagcctcatgaagagtttagggggtggccgtagagggactggtgcgcaaggagaaaccctgggcgaaaaatggaagagacaattgaatcaattgagtaaatctgaatttaatacctacaaaagaagtggaataatggaagtcgaccgaagtgaagctaaagaaggtctaaaaagaggggaaaccaccaaacatgcagtaagtcgcggcacggctaaactaagatggtttgtagaaaggaatctagtgaaacccgaaggaaaagtaattgatctaggatgtggcaggggaggttggagttattactgtgctggtctgaagaaagtcacagaagtaaagggctacactaaaggaggtcctggacacgaagaaccaataccaatggcaacttatggatggaatctcgtgaagctacatagtggtaaggatgtattctttatcccaccagaaaaatgtgacacgttgctatgcgatataggggaaagctcgcctaatccgactattgaagaagggaggacattaagagttttaaagatggttgaaccgtggcttaggggtaaccaattttgtattaaaatactgaatccgtacatgccgagtgtagtagagactctagaacaaatgcagagaaaacatggaggaatgttagtgcgcaatcctctttctagaaattcgacacacgaaatgtactgggtatcctgtgggacaggaaatatagtatctgcagtaaatatgacctcaagaatgctattaaacaggtttacaatggcgcataggaaacctacgtacgagagagacgtcgatctaggggcaggaacgagacatgtagccgtcgagccagaggtagcgaatcttgatataattggtcagcgaatcgaaaacattaaacacgaacacaagagtacatggcattatgacgaagataacccttataaaacatgggcttaccatggatcatatgaagtaaaaccgtcaggatccgcatcaagtatggtcaacggtgtagtgaaactactgacaaaaccatgggatgtgataccgatggtcacacaaatcgcaatgactgatacaactccttttggtcaacaaagagtgtttaaagaaaaggtagacacccgtacaccaaaagcaaaaagaggaacagcacaaataatggaagtgactgcaaaatggttatggggttttcttagtagaaataaaaagcctaggatctgcacgcgagaagaatttacacgtaaagtacgtagtaacgcagctataggcgcagtatttgtcgatgagaaccaatggaactccgccaaggaagctgtcgaggacgaacgcttttgggatctcgtacatagggagagggaacttcataaacaaggtaaatgtgccacatgtgtatataatatgatggggaagcgagagaaaaagttgggagagttcgggaaagcaaagggatcccgggctatatggtatatgtggttaggagcgagatttttagaatttgaagcattaggattcatgaacgaagatcattggttcagtagagagaacagtctatctggcgtcgaaggtgagggactacataagctcggttatatacttcgtgacatcagtaaaataccaggagggaatatgtatgctgacgatactgccggatgggatactcgaataacagaagatgatcttcaaaatgaagcgaaaataactgacataatggaacctgaacacgctctattagccaaaagcatatttaaactaacatatcagaataaagtagtaagagtgcagaggcccgctaaaaacggtacggtaatggatgtaatctccagacgagaccaaagaggctctggtcaggtgggcacttacggtcttaatacatttacaaatatggaagcacagctaatccgacagatggaaagcgaaggaattttcagtccatccgaacttgaaacacctaacttagcgggcagagttttggactggttggaaaaacacggggtggaaagattaaaaaggatggctataagtggcgacgactgcgtggttaaacccatagacgatcggtttgcaacagcgctaaccgcattaaatgatatgggtaaagtgcggaaggatattccacaatgggagccatcgaaaggatggaatgattggcaacaagtaccattttgcagtcatcattttcatcaactgataatgaaggacggtcgagagattgtagtaccgtgccgcaatcaggatgagctagtagggcgcgcacgtgtatctcaaggcgctgggtggtcattgcgagaaacagcttgcctaggaaaatcttatgcccagatgtggcaactaatgtactttcataggagagatttaaggcttgcagcgaatgctatttgtagcgcagtcccagtcgattgggtcccaacatcaagaactacatggagcattcacgcccatcatcagtggatgactacagaggatatgttatccgtatggaaccgagtatggatagaagaaaacccgtggatggaagataaaactcacataagtagctggggagacgtgccttacttgggaaagagagaagaccagtggtgtggaagtctaatcgggctgactgccagggcgacctgggcaaccaacattcaggtggcaattaaccaagttagaagattaataggcaatgaaaattatctagattatatgacaagtatgaaacgttttaaaaatgaatcggaccctgagggagcattatggtaa

SEQ ID NO: 21965 - RNA, 9879 nt, synthetic construct
  misc_feature 1..9879: note = derived and/or modified CDS sequence (opt6) from DENV-1__EU482533__SS-prME
  source 1..9879: mol_type = other RNA
agcgttactatgctcttaatgttaatgcctacagctcttgcgttccacctaactacgcggggaggagaaccacacatgatagtatcaaaacaggaacgagggaaatcgttactgtttaaaacgtcagctggagtgaatatgtgtaccttgattgcaatggacttaggagaattttgcgaagacacaatgacatacaaatgccctcgaattactgaagcggaaccagacgacgttgattgctggtgtaatgccactgacacatgggtaacatatggaacctgttcgcaaactggagaacacagacgtgacaaacgatcagttgcacttgctccccatgtcggattaggcctcgagacgcgaaccgaaacgtggatgagtagcgagggtgcttggaaacaaattcaaagagtagaaacttgggctttacgacacccgggcttcactgtcatcgcattattcctagcccatgcaatcggaacgtcgatcacacagaaaggaataatcttcatactgctgatgctcgtgacaccgtccatggcaatgaggtgtgtcggtattggctcgagggattttgtagagggattaagcggcgcaacttgggtagatgtagtactggaacacggaagttgtgttacgactatggcaaaagataaaccaacgctggatatcgaactattaaaaacagaagtcaccaatccagctgttcttcgtaaactatgcatagaagctaaaatatcgaataccacaacggatagcagatgtccgacacaaggagaagccacgttagttgaagaacaagatgcaaactttgtttgcagacgtactttcgtagacagaggctggggtaatggctgcggacttttcggtaaaggatcactaatcacgtgtgcaaaatttaaatgcgttactaaactagaaggaaaaaccgtgcaatacgagaacctaaaatattcggtaattgtaaccgtacacacaggcgatcaacaccaagtagggaatgaaagcacagaacacggaacaacggcaacaataacaccccaagcaccgtcaacagaaatacaattaacagactatggcgcgttgacactcgactgtagcccaaggaccggcctcgattttaatgaaatggtactcctcacaatgaaggagaaatcatggttagttcacaagcaatggtttcttgatctaccattaccctggacaagtggagcaagtacgtcacaagaaacatggaataggaaagacctccttgtaacatttaaaacggcacatgctaagaagcaggaagtaattgtactaggatctcaagaaggagccatgcatacagcactaaccggtgctacagaaatacaaacgtcagggacaaccacaatctttgcgggacatctaaaatgtcggttaaaaatggataaacttactttaaaaggcatgtcctacgtcatgtgcacaggaagttttaaattagaaaaagaagtcgcagaaactcagcacggtacagtcctagtacaaataaaatatgaaggaacagatgcgccgtgtaaaataccctttagcacacaagatgaaaaaggagtgacccaaaacgggcggttaataaccgcaaatcctatcgtaactgataaagaaaaacccgttaatattgaagctgaaccaccatttggggagagttatatagttataggagcaggggaaaaagctctcaaattatcttggtttaagaaaggctcatcaataggtaagatgttcgaggctactgcacgtggagccagaagaatggctatactaggtgacaccgcatgggattttggcagtataggtggggtattcactagcgtaggaaaattagtacatcaaattttcggtactgcctacggagtactgttttccggagtctcatggacaatgaaaattggaattggagttctgttaacatggttgggattaaactctagaagtacaagtctttcgatgacatgtattgctgttggactggtgacactgtacctgggagttatggtacaggccgacagcggttgcgtcatcaattggaagggtagagagctaaaatgtggaagcggaatttttgtaacaaatgaagtgcacacttggactgaacaatacaaatttcaagcggattcgccaaagcgactatccgcagcaataggaaaggcttgggaagagggtgtgtgcggcatcaggagtgcaacaaggttagaaaacatcatgtggaaacaaatctcaaatgagttaaaccatatactattggaaaacgatatgaaatttaccgtggtcgtaggtgacgtggcgggaatactggctcaaggcaagaaaatgattcggccccaacctatggaatataagtactcttggaagtcgtggggcaaggcaaaaataatcggcgcagacgtacaaaacgctacttttataatagacggtccgaatactcctgagtgccccgatgaccaacgtgcatggaatatttgggaagtagaagattatggattcggaatatttacaacgaatatttggctaaaattacgggactcttatacgcaggtttgcgatcacaggctaatgtcggccgctatcaaagacagcaaggcagttcatgccgatatgggatattggatagaatcagaaaagaacgaaacatggaaactcgcacgtgcatcctttattgaagtaaagacctgcatatggcctaagagtcatactttgtggagtaacggcgtcttagaatccgaaatgataatccccaaaatatatggaggcccaatatctcagcacaattaccgccccggatacttcacacaaacagctggcccatggcacctaggcaaactggagttagactttgacctctgcgaaggaaccaccgtagtagtagacgaacactgcgggaatcgtgggccatcactcaggacgacaacagtaacaggaaaaataatccatgaatggtgttgtcggtcatgtactttacctccattaaggttcaaaggtgaagacgggtgttggtatggcatggaaattagaccagtgaaggagaaagaggagaatcttgtaaagagtatggtcagcgcaggctcaggagaggttgatagtttttcattaggtttactttgcatatcaataatgatcgaggaagtgatgagaagcagatggtcgaggaagatgctgatgacaggtacgctggccgtattctttttgctaataatgggtcaactaacgtggaacgacctaattcgattatgcataatggttggagctaatgccagtgacaggatgggtatgggtactacatatctagccttaatggcaacttttaaaatgcgaccgatgttcgcagtaggattactatttcgccgactaacaagccgcgaagtcttattattgactatcggactgtcactggtagcaagtgttgaactccccaatagcctggaggaactaggagatggactagcaatgggaattatgatccttaaattactgactgattttcaaagtcatcaactatgggcgacattactatcactgacattcataaaaacaaccttctcattacattacgcctggaagacaatggcaatggtactatcaatagttagcttattccctttatgtttatcaactacttcacagaaaactacgtggctgccggtcctactaggatcgctcggatgcaaaccactaacgatgtttttaattgccgaaaacaaaatatggggacgaaaaagttggcccttgaatgaaggaatcatggcagtcggtatagtttccatattgcttagcagcttacttaaaaacgatgtccccttagcaggtcctctgattgcaggaggaatgctaatagcatgttatgtaatatcaggatcatcggcggatttgtcattagaaaaagcagcagaagtcagttgggaagaggaggctgaacatagtggagctagccataatattcttgttgaagttcaagacgacggtacaatgaaaatcaaagacgaagaaagagacgacacgttgaccatactacttaaagcaaccctattagccgtcagtggtgtgtatcctctatcaataccggcaaccctttttgtatggtatttctggcagaagaagaaacaaaggagtggggtattgtgggatactcctagccctcccgaagtcgaacgagccgtgctagacgacggcatctataggattatgcagaggggattgttaggtaggtctcaagtaggtgttggagtctttcaagagaatgtattccacactatgtggcatgtaacgcgaggcgctgtactaatgtatcaaggtaaacgtctagaaccttcatgggcatctgtgaagaaagatttaatctcttatggcgggggttggaggttgcaggggtcttggaacacaggggaagaagtgcaagttatcgcagttgaacctggcaaaaatcccaagaatgtacaaaccgctcctggaactttcaaaacatctgaaggagaagttggagctatagcactagactttaaacccggaacatctggaagccccatagtcaatagagaaggaaaaatagtaggtctgtatggaaacggtgtggtaaccacgtcaggaacatacgtatcagcaatagcgcaagctaaagccagtcaagaggggccactacccgagatagaagatgaagttttccgtaaaaggaacctgactattatggacttgcacccaggctcgggtaagacaaggcggtatctaccggcaatcgtcagagaagcaataaaaagaaaactaagaactttaatattagcgccaactagagtagttgcctcagagatggccgaagccttaaaagggatgccaatccgataccaaaccacagcagtcaaaagtgagcacacaggtaaagaaattgtcgacctcatgtgccacgccacattcactatgagattgttgtccccggtaagagtacctaactacaatatgataataatggacgaggcacatttcacggatccatcgagcatagctgccagaggttacatatccacacgtgtaggaatgggagaagcggcggcgatttttatgacagctactccaccaggatcggtagaagcatttccacaatcgaatgccgtaatccaagacgaagaacgggacatacctgaacgctcttggaacagtggatacgaatggattacagattttccaggaaagacagtttggtttgtcccctcaataaagtccggcaacgacatcgcaaactgtctgaggaaaaatgggaaaagagttatccaactttcacgaaaaacatttgacaccgaatatcaaaagactaaaaataatgattgggactatgtggtaaccacagatatatcagagatgggagcaaactttcgcgcagatagagtaatagatccgagaagatgtctgaaacccgtcatattaaaagatggtccagaacgagtaatccttgccgggccaatgccagtaaccgtggcttccgccgcacagcgacggggaaggataggcaggaaccacaacaaggagggagatcaatatatttacatgggacagccactcaataatgatgaagaccatgcgcattggacggaagccaaaatgttgctcgataatataaacacacccgagggcattataccagcattatttgaaccagaacgtgagaaaagtgcagcgattgacggcgaatatcggctacgtggtgaggcaaggaaaacttttgttgaattaatgagacgaggagacttacctgtttggttaagctacaaagtggcaagcgaaggattccagtattctgatagacgctggtgctttgatggcgaaagaaataatcaagtactcgaggaaaacatggatgtggaaatctggaccaaggaaggagaaaggaagaaattaagaccacggtggttagatgcgcgaacatattcagatccactcgcgctgagagaatttaaagagtttgcggctggaagacggtcagtctcaggagatctaatattggagataggaaagctacctcagcacttgacacagagagcacaaaacgcgttagataatttagtgatgttgcataactctgaacagggcggtcgagcatataggcacgctatggaggaacttcctgacacaatagagacactaatgttgttagcattaatagctgtattaacaggtggagttactctgtttttcctgtcgggaagaggtttaggtaaaacaagtattgggcttttatgtgtgatggcatcgtcagtattattatggatggcttcggtagaaccccactggatagctgcatctatcatacttgagttctttctgatggtcttactaattcctgaacctgataggcagcgcactccacaagataaccaattagcttatgtagttataggtttactgtttatgatcttgaccgtcgccgccaacgagatgggcttacttgaaaccaccaagaaagacctagggataggccatgtcgcggtggaaaaccaccatcatgcggcgatgctagacgtcgatctccatccagcttcggcatggacactgtatgctgtagctacaactataataacacctatgatgagacatactatagaaaatacgacagccaacataagtttaacggcaatagcgaaccaagctgcaatattaatgggtttagataaaggttggccaatatctaagatggatataggagtcccattattagccctaggatgttacagccaagttaatcctttaacactaacagctgccgtgctaatgctagtagcacactacgctattattggtcctggattacaagccaaggccactagagaagcacaaaagcgaacagcagcaggaataatgaagaaccccacagtagacggaatagtcgcgatcgacctagaccctgtagtatatgacgcaaaatttgagaaacagttaggacaaataatgctactaattctttgtacatcccagatattgctgatgcgcacgacgtgggccctttgcgaatctatcacattagcaacaggtcccttaactaccctttgggaaggctcccccgggaaattctggaacactactatagcggtatcaatggctaatatatttcgcggcagttatttagcaggagctggtcttgcgtttagcttaatgaaaagtttgggaggcggtaggaggggtacaggtgcccagggggaaactctaggagaaaaatggaaacgacaactgaatcagctctcaaaaagcgaatttaatacatacaaaagatcaggaataatggaagtagacaggtctgaagctaaagaaggactgaaaagaggggaaactactaagcatgctgttagtagaggaactgcaaaattaaggtggttcgttgaaagaaacctagtcaaaccggaaggtaaagtgatagatctaggatgcggaaggggcggctggtcttactactgtgccggattaaagaaggtaacagaggtgaagggatacacgaaaggaggtccgggtcacgaagaaccaataccaatggcaacatacggatggaacctagtaaaattacactccggaaaagatgtattctttatccctccagaaaagtgtgacacactgttgtgtgatatcggagaatctagtcctaatccaacaatcgaagaaggccgtactctcagggtattaaagatggtggagccttggcttcgggggaaccagttttgtataaaaatacttaacccttatatgcctagtgttgttgaaacattagagcaaatgcaaaggaaacacggtggcatgcttgttagaaatcccctttcacgtaactcaacacatgaaatgtactgggtctcatgtggcacagggaacatagtttcagcagtgaacatgacaagtaggatgctcctaaacaggtttactatggcacatagaaagccaacatatgaaagagacgtagatttaggggcaggtacacgccatgtagctgtagaaccagaagtagctaacctcgacataatagggcaaagaattgaaaacattaagcacgaacataaatcgacctggcattatgacgaagacaatccttacaaaacatgggcgtatcatggatcatatgaagtaaaaccctcgggaagcgcgagtagcatggtaaatggggtagtaaaattattaacgaaaccatgggacgtaatcccaatggttacgcaaattgcgatgactgatacaacaccgttcgggcagcaaagagtattcaaagagaaagtggatactcgaacacctaaggctaaacgcgggacagcccagattatggaagttaccgcaaaatggctttggggattcctatcacgtaataaaaagccaagaatatgcacccgtgaagagttcactaggaaagtaaggagtaatgccgctattggagcagttttcgtagacgaaaaccaatggaactcagccaaagaagctgttgaagatgagagattttgggacctagtgcacagagagcgagagttgcacaagcagggaaaatgcgcaacatgtgtatataacatgatgggaaagcgagagaagaaattgggagaatttggaaaagctaaaggatctcgagcaatttggtacatgtggcttggagcaagatttttagagttcgaagctctaggctttatgaatgaagatcactggttttctcgtgaaaattcactcagtggcgttgaaggcgagggactacataagctaggttatatactcagggacataagtaaaatcccaggtggaaacatgtacgcagatgatacagcaggttgggatacaagaataacagaagacgatctacagaacgaagctaaaataacggatataatggaacccgaacatgcactccttgctaaatcgatatttaaattaacatatcaaaataaagtcgttcgtgttcaaaggccggcgaaaaatgggaccgtaatggacgttatctcacgccgcgatcaacgaggaagcggccaagttggaacatatggtcttaatacattcaccaatatggaagctcagttaatcaggcaaatggaaagtgaggggattttcagcccctccgaacttgaaacacccaatttagcaggaagagtacttgactggcttgaaaagcatggggtagaaagattaaaaagaatggcaatttccggcgatgattgtgttgtaaaacccatcgatgacaggttcgcaacagctttgaccgcactaaatgatatgggaaaagtaaggaaagatattccacaatgggaacctagtaaaggatggaatgattggcaacaggtccctttctgtagccaccattttcaccaattaataatgaaagatggacgagaaatagtcgtaccgtgtagaaaccaggatgaattagtgggtagagcccgagtaagtcaaggagcaggttggtctctgagggaaacagcttgtctgggaaaatcctacgcacaaatgtggcagctgatgtactttcatcgtagggacctccggctagcagcaaatgcgatatgtagtgccgtgcctgtagactgggtccccacctctcggacaacctggtctatccatgctcatcatcaatggatgactacagaggatatgctcagtgtatggaaccgcgtgtggatagaagaaaacccttggatggaagataaaactcatataagctcgtggggtgatgttccgtaccttggcaaaagagaggaccaatggtgtggctcattgattgggttgactgcgagagccacatgggcaacaaacattcaagtagctataaatcaagttagaagattaataggtaatgaaaactatcttgattatatgacctctatgaagcggttcaagaacgagagcgatccggaaggagctttgtggtaa

SEQ ID NO: 21966 - RNA, 9879 nt, synthetic construct
  misc_feature 1..9879: note = derived and/or modified CDS sequence (opt6) from DENV-1__EU482534__SS-prME
  source 1..9879: mol_type = other RNA
agtgtcacgatgttattaatgttaatgcccactgcattggcatttcatctaaccaccagaggaggtgaaccccatatgatagtgagtaaacaagaacgtggtaaaagtctactattcaaaacatctgcaggggtaaacatgtgcacactcatcgccatggacttaggagaattttgtgaagataccatgacgtacaaatgtccaagaataacagaagcagaaccagacgatgttgattgttggtgcaatgccacagatacctgggtaacgtatggaacttgttctcaaaccggcgaacacaggagggataaaagaagcgttgctcttgctccgcacgtgggactaggcttggaaactcgaacagaaacgtggatgtcaagcgaaggagcatggaaacaaatacaacgagtagaaacgtgggccttaagacacccagggttcacagtgatagcactatttcttgcacacgcaataggcacgtcgataacacaaaaaggtataatatttattcttctgatgttagttacaccaagtatggccatgcggtgtgtaggcataggcagcagagactttgttgaagggttgagcggtgctacgtgggttgatgtggtattggaacacggatcctgcgttactacaatggccaaagacaaacctactttagatattgaattattaaaaacagaagtcacaaacccggcagtacttcgcaaactttgtatagaagcgaaaattagtaacacaactacggactcccgatgcccaacacaaggcgaagccacgctggttgaagaacaagacgcaaatttcgtttgccgacgaacatttgtagatcgaggatggggaaacgggtgcggacttttcggcaaaggcagtcttattacttgtgcaaagtttaagtgtgttaccaaactagaagggaaaatagttcagtatgagaatttgaaatatagtgtaatagttacagttcatacgggcgatcaacaccaagtgggtaatgaatcgactgaacacggaactacagcaacaattacaccgcaggcacccagtactgaaattcaattaacggactatggtgctctcacccttgattgttcgccccgcactggactggacttcaatgaaatggttttattaactatgaaggaaaaatcttggctagttcacaagcagtggtttcttgatctcccactcccatggacatctggagcttctacatctcaggaaacatggaacagacaagatttgttagtcacatttaaaacggcccacgccaagaaacaagaggttgtcgtattgggttctcaagagggagctatgcacactgcgttaactggagccacagaaattcagacaagcggaacaaccacgatctttgccggtcatttaaagtgtcgactaaagatggacaaattaacactcaaaggcatgtcatacgtcatgtgcactgggtcttttaagctcgagaaagaagtagcagaaactcaacatgggacagtcttagttcaaataaaatatgagggcacagatgccccatgtaaaatcccattctcaacccaagatgagaaaggcgtcacacagaacggtagattaataactgccaatcctatcgtcactgataaagaaaaaccggtcaatatagaagcagagccaccctttggagaaagctacatagtgattggtgctggagaaaaagcactaaaattatcgtggttcaagaaaggatcgtctattggaaaaatgtttgaagcaaccgcaagaggagcaagacgaatggcaatcttgggagatactgcatgggattttggaagtatagggggtgtcttcacaagtgttgggaaactcgtacatcaaatatttgggacagcctatggcgtattatttagcggagtatcctggacgatgaagattggaataggcgttctcttaacctggcttggattaaattcgagatcaactagcctttcgatgacgtgcattgcagttgggctagtaactttatacctaggagtaatggtccaagcagatagtggctgtgtaataaattggaaaggcagagaactaaagtgtggatcaggtatcttcgtaacaaacgaagtacatacatggacggaacaatacaaattccaagccgacagtccaaaacgattatcagcagcaattgggaaagcatgggaagaaggagtgtgtgggattagatctgcaacaagactagaaaatattatgtggaaacaaatttcaaacgagcttaatcatatattgttagaaaacgacatgaaacttaccgttgttgtgggagacgtcgcaggtatattggcacaaggcaagaaaatgataagacctcaaccaatggaatacaaatactcctggaaatcgtgggggaaagcaaaaataataggagcagatgtccaaaatacaacctttataattgacggccctaatactcctgaatgtccagatgatcaacgtgcgtggaacatatgggaagtcgaagattatggattcggtatatttaccaccaatatttggctgaagctacgtgacagctatacgcaagtgtgcgatcataggctaatgtctgccgccattaaagattcaaaagcagtgcacgcagacatgggatactggatcgaaagcgagaaaaacgagacatggaaactagccagagcaagtttcatagaggttaaaacatgcatatggccaaaatcccacaccctttggagtaatggcgtgttagaaagtgaaatgataatccctaaaatttacggtggtccgatctcgcaacacaattaccgacctggatattttacacaaacagccggtccttggcatctaggaaaactagagctcgatttcgatctctgtgaaggtacgacggtagttgtagacgagcattgcggtaatcgaggtcctagcttgcgaactactactgtgaccggcaaaatcatccacgaatggtgctgtagaagttgtacacttccgccacttagatttaaaggagaagatggatgttggtatggcatggaaattcgaccagtaaaagagaaagaagaaaacttagtaaaatccatggtgagtgcaggttctggagaagttgacagctttagcctaggattactatgcatatcgataatgatagaagaggtaatgcgttcaaggtggtcaagaaagatgcttatgacgggcacattagctgtgtttttccttttaataatgggacaactaacttggaacgatctgattagactctgtatcatggttggtgccaacgcaagcgaccgaatgggtatgggaactacatatcttgcactgatggccacgtttaaaatgagacccatgtttgcggtaggattattgttccgtagactaacatctagagaagtattattactaacgattggcctttcattggtggccagtgttgaactccctaattccttagaagaattgggtgatggcctcgccatgggaattatgatactgaaactactaacagactttcaaagccatcaactttgggctacgctactttcactaacattcgtgagaacaacattcagtttacactacgcatggaaaactatggctatggtattaagcatagtgtccttgttccctctatgtctatcgaccacctctcagaaaaccacgtggttaccagttctgcttggcagccttggctgtaaaccacttacaatgttcctaatcgctgaaaataaaatctggggaagaaaatcatggcccttaaatgaaggtattatggcagtcggaatagtaagtattttactaagttcacttctcaaaaatgacgtgccattagctggaccactaatagccggagggatgcttattgcttgctacgtaatatcagggagcagtgccgatctatcgcttgaaaaagcagcagtagttagttgggaagaggaagctgaacactctggagcaagtcacaatatactcgtcgaagttcaggacgatggaaccatgaagataaaggatgaagaaagagatgacaccctaacaattttattaaaagccactctccttgcagtgagtggagtgtacccattgtcaataccagccacactattcgtttggtacttttggcagaaaaagaaacaacggagtggagtattatgggatacgcccagtccacctgaggtagagcgagcggtactagacgatggtatttataggataatgcaacgaggactactgggtagatcacaagttggggtaggcgtatttcaggaaaacgtgtttcacacaatgtggcatgtcacaagaggcgctgtgctgatgtatcagggtaaaagattagaaccctcatgggcttccgtcaagaaagacttaatctcatatggtggtgggtggcggttacaaggttcctggaacactggggaagaggtgcaagtaattgctgttgaaccaggaaagaaccccaaaaatgtacaaacagcccccggaacattcaagacatcagaaggggaggtaggtgctattgcgctagattttaaaccaggtacttcaggaagtccaatcgtaaatagggaagggaaaattgtcggtctctacggaaatggtgttgtaacaacatctggcacatacgtttccgctattgcgcaagcaaaggcttcacaagaaggaccactacctgaaatcgaagatgaagtcttcagaaaaagaaatctgacaataatggacttgcacccgggatctgggaaaacgcgaagatacttaccagcaattgtaagagaagcgataaagaggaaactaagaactctaatcctagccccaacaagggtagtggcatcagagatggctgaagcattaaaagggatgccaatcagataccagactacagccgtcaaatctgaacacactggaaaagaaatagtagatctaatgtgtcatgctacattcacgatgaggctattatcacccgttagggtacccaattataatatgattatcatggatgaggctcatttcacggatcctagcagcatagcagcaagaggatatatatcaactagagtcggaatgggggaagccgcagcaatttttatgacagcaacacccccagggtcggtagaagcgtttcctcaaagtaatgctgtaatacaggacgaagaaagggatataccagagcgtagttggaactcaggatacgaatggatcaccgactttccaggcaaaaccgtttggttcgttccatcaatcaaatcagggaatgacatcgcaaattgtttacgaaagaatggcaagagagtgatacaactttcaagaaaaacttttgatactgaatatcagaaaaccaaaaataatgattgggattatgtggttacaacagatattagtgagatgggcgcgaattttcgtgcagatcgagtcatcgatccaaggaggtgtctaaaaccggtaatactgaaagacggaccagaacgagtgattctagcaggacctatgccagtaacagtcgcaagtgctgcgcaaagaagagggagaatcgggagaaatcacaataaagaaggtgaccaatacatctatatgggtcagccactaaataacgacgaggaccatgctcattggacagaagcaaaaatgttattggataatattaacacccccgaaggaattattccggcactcttcgaacccgaacgagagaaaagcgcagccatagacggtgagtataggctacggggagaagcaaggaaaactttcgtagaacttatgcgaaggggcgatctaccggtttggttaagttataaagtggccagcgaaggatttcaatattcagatcggaggtggtgtttcgatggtgaaagaaataatcaagttttagaggagaacatggacgttgaaatttggacgaaagaaggggaaaggaagaaattgcgtcctcgatggctagacgctagaacgtacagcgatccccttgccttacgggaatttaaagaatttgctgccggtcgtagatcagtatcgggagacttgatacttgaaattggaaaacttccgcaacacttgacacaacgggcgcagaatgcactagacaacttggtaatgctacacaactctgaacagggtgggagagcgtatagacatgcaatggaagaacttcccgacactatcgaaactttgatgctgctagctctaattgccgttttgacaggaggtgttacgttattctttttaagtggaaggggactcggcaaaacatcgattggcctgttgtgcgtaatggctagctctgttcttttatggatggcatcagtagaaccacattggatagcggcatctataatattagagttctttttaatggtcctattaataccggaacctgaccgtcaaagaacaccgcaagataatcaacttgcatatgtggttataggactcttattcatgatactcacggtcgcagcaaatgaaatgggtctgttagaaacgaccaaaaaggacttggggattggtcacgttgcagttgaaaatcatcaccatgccgcaatgcttgatgtagacctacacccagctagtgcttggactctctacgccgtagcaacaacaattataacacccatgatgaggcataccatagaaaatacaaccgcaaacatatccctgactgcaattgctaatcaagcagctatactcatgggacttgataaaggatggccaataagtaagatggacattggagtaccacttctagctttgggttgctatagccaagtaaacccgctaacattgaccgccgcagtcttaatgcttgtggcgcattatgcgattatcggtccgggattgcaggcaaaggcgacaagagaggcgcagaaacgaacagccgcaggaattatgaaaaaccccactgtagatgggattgttgcaatcgatctagatcctgtagtttacgatgctaaatttgaaaaacaactaggtcaaataatgctacttatcttatgcacttctcagatattgcttatgcgaacaacctgggctttatgtgaaagtataacactcgcgacagggcctttaactacactgtgggaaggatcgcctggtaaattctggaatacaacgattgcagtaagtatggctaacatattccgaggctcatatctggccggagcaggattagcattttcgctaatgaaaagtcttggaggaggaagacggggtaccggggcacagggagaaacactgggtgaaaaatggaagagacaactaaaccaattaagtaaatcggaatttaacacgtacaaacgtagcggtataatggaggtagacagatcagaagccaaggaaggattaaaaagaggtgaaaccacgaaacatgccgtttcacgtggtacagctaagttaaggtggttcgtcgaacgaaacttagtgaaaccagaaggaaaagtaattgatctaggatgcggtcgaggagggtggtcctactattgcgcaggtctaaagaaagtcactgaggttaagggatatacgaaaggaggaccaggacatgaagaacccatccctatggctacctatggatggaacctagtaaaactgcactctggaaaagacgtcttctttataccaccagagaagtgtgatacactactatgtgatataggtgaaagcagtccaaatccaactattgaagagggacgcactttaagagtactcaaaatggtagagccgtggctccgggggaaccagttttgtataaaaatattaaatccatatatgccaagcgtagttgaaacattagaacagatgcagcggaaacatggaggcatgttagtccggaatcctttatccagaaattcaacgcatgaaatgtattgggtatcgtgtggtacaggcaatatcgtgagtgcagtgaatatgactagccgcatgctcttaaatagattcacaatggcacacagaaaacctacgtatgaaagggatgttgacttaggagctggtacaaggcacgtcgcggtggagccggaagtcgccaaccttgacattatcggtcagaggatcgaaaatataaaacatgagcacaaatccacatggcattatgatgaagacaatccatacaaaacatgggcttaccacggatcttacgaagtaaagccaagcggatctgcatcaagtatggtaaatggagtcgtaaagctactaaccaaaccttgggacgtgattccgatggtcacacaaatcgccatgacagatacgacgccattcgggcaacagcgcgtatttaaagagaaagtggatacaagaacgccgaaagctaaaagaggtactgctcaaattatggaagttacagctaaatggctatgggggttcctgagtagaaacaagaaacctcgaatatgtacccgagaggaatttacaaggaaagtgcgatcgaatgcggctataggagcagtattcgttgacgaaaatcaatggaactctgccaaagaagccgttgaagatgaaaggttttgggatctcgttcatcgggaacgagaactacacaaacagggaaagtgtgcaacatgtgtgtataatatgatgggaaaacgggagaagaaattgggcgagtttggaaaagcaaaaggctctagagcaatatggtacatgtggctcggcgcgagattcctggaatttgaagccttaggatttatgaacgaagatcactggtttagcagagaaaattctttgtctggagttgaaggagaaggtttgcataaacttggttacatcttaagggatattagcaaaataccaggaggcaatatgtatgcagatgacactgcgggttgggatacgcgaataactgaagatgacctacaaaatgaggctaaaataaccgatatcatggaaccggagcatgctttgttagcaaaaagtatttttaaattaacttaccaaaacaaagtcgtaagggttcagagaccggctaaaaatggcacggtaatggatgttatatccagaagagaccaaagaggctcggggcaagtaggcacatacggtttgaacacgtttacgaatatggaagctcaacttataaggcaaatggaatctgaaggcatatttagtccatcggagttagaaacccctaatttagcaggtcgagttctggactggctcgagaaacacggagttgaaagactcaaaaggatggccatatcaggagacgactgtgtggtaaaacctattgacgatcggtttgccacagctttgaccgctcttaatgatatgggcaaagtaagaaaagacattccccaatgggaaccatcaaaaggttggaatgattggcaacaagtacccttttgttcgcatcattttcaccaattgataatgaaagatggtagagaaattgtagtcccttgcagaaaccaagacgaacttgttggcagagcaagagtgagtcaaggcgctggttggagccttagggagaccgcgtgcttaggaaaaagttacgctcaaatgtggcaacttatgtattttcacagaagagatttacgtttagctgctaatgcaatatgctcagccgtaccagttgattgggtgcctaccagcaggacgacatggtcaatacacgcgcaccatcaatggatgacaaccgaagatatgcttagtgtttggaacagagtatggatagaggagaatccgtggatggaggacaaaacacatataagctcttggggagatgtaccgtatctaggtaaacgggaggaccagtggtgtggtagcttaataggtttaacagccagggctacatgggcaacaaatattcaagttgcaattaaccaagtcagacgactattaggaaatgaaaattacttagattatatgacaagtatgaaaagatttaagaacgagtcggatcctgaaggcgctttgtggtga

SEQ ID NO: 21967 - RNA, 9879 nt, synthetic construct
  misc_feature 1..9879: note = derived and/or modified CDS sequence (opt6) from DENV-1__EU482535__SS-prME
  source 1..9879: mol_type = other RNA
tcagttactatgttgcttatgcttatgcccacagcactagcatttcatttaaccacaagaggaggagaaccacacatgatagtgacaaaacaagaacgcggaaaaagtttgttatttaaaaccagcgctggagtaaatatgtgtacattaattgctatggatttaggagaactttgcgaagatactatgacttataaatgcccccgaattacagaagcagaaccagacgatgttgattgctggtgtaacgcaactgatacctgggtaacctatggaacttgcagtcaaacaggagaacatcgacgtgacaaaagatccgtcgcattggctcctcatgttggtctgggattagaaacgagaactgaaacatggatgagctcagaaggagcatggaaacaaatacaaagagtagaaacgtgggctttaagacaccctggttttacagtaatcgcattattcctagcacacgcaattgggacctctatcactcaaaaaggaattatattcatactattaatgctcgttactccctccatggccatgagatgtgtgggcattggatcgagagatttcgtggaaggtttgtcaggagccacatgggtagacgttgtcttagaacatggatcttgcgttacgacaatggcaaaagataaaccaaccttagacatagaattactaaaaacggaagtaacgaatccggctgtactacggaaattgtgcatcgaagcgaaaatatcaaacacgaccactgattcccgatgcccgacacaaggtgaagctactttaatggaagaacaggatgccaattttgtatgcagacgaactttcgttgacaggggctggggaaatggatgcggcttgtttggaaaaggcagtttaattacatgtgcaaaatttaaatgtgttactaaacttgaagggaaaatagtacagtatgaaaacctcaaatatagcgtaatagtaacagttcatactggggatcaacatcaagtcggtaacgaatcaaccgaacacggaactaccgcaaccattactcctcaagctcctacttcagaaatacaactgacagactatggcgctcttactttagactgctcaccaaggactggactcgatttcaatgaaatggtcctcctaaccatgaaggagaaaagttggttggtgcataaacagtggttcttagatctacctttgccttggacatcaggagcatcaacatctcaagaaacatggaatagacaagatctcttggtaacatttaagaccgcacacgctaagaaacaggaagtggtagtcctagggtcacaagaaggagcgatgcacactgcactgactggtgcgacagaaatacaaacatcaggaacaacaacaatattcgcaggacatctaaaatgtagactcaagatggataagttaactctgaaggggatgtcgtatgttatgtgcactggcagcttcaaactagagaaagaagtcgcagagacacaacatggaaccgtcttagtacaaatcaaatacgaaggaactgatgcaccgtgtaaaattccatttagcacccaagatgagaaaggcgtcacacaaaatggaagactgataactgctaacccaatcgtcacggataaagaaaaaccggttaatattgaagcggaaccccctttcggggaaagttatatagtcataggtgccggtgaaaaagcattaaaattaagctggttcaagaaaggcagtagcattggaaagatgtttgaagcaactgcgcgaggagcaagaagaatggctatccttggagatactgcatgggattttggctctattgggggagttttcacatcaatcggcaaactggtacaccaaatttttggcacagcttatggagtactattttcaggcgtatcttggacgatgaaaataggcatcggcgtactgttaacatggcttggacttaactcaaggagtaccagtcttagtatgacttgtatagcggttggtttagtaacactctaccttggtgtaatggtacaggctgattctggatgtgttataaattggaaaggtagagagctcaaatgcgggagcggaatctttgtaactaatgaggtacatacctggactgaacaatacaaatttcaagcagatagccctaaacgtttatcagcagcgataggtaaagcctgggaagaaggtgtctgtggtatcaggtccgccacaaggctagaaaacattatgtggaaacaaatcagtaatgagttaaaccatatattactcgaaaatgatatgaaattcacggttgtggtaggcgatgtcgtcggtatactggcacagggcaagaaaatgattcgtccgcaacctatggagcataaatacagctggaaatcctggggaaaagcaaaaataataggtgcggatgtacaaaatacgacatttataatagatgggccaaatacccctgagtgtcctgatgatcagcgcgcttggaatatatgggaagtagaagattacggttttggtatcttcaccactaatatttggctgaaaatgcgagattcatatacacaggtatgtgatcatagactaatgtcggcagcaattaaagacagtaaagcagtacacgctgatatgggttactggattgaatccgagaaaaatgaaacttggaaattagcaagggcctcgttcattgaggtcaagacttgtatttggcccaaaagtcatacgctctggtcaaatggagtgttagaatcagagatgatcattcctaaaatctatggtggacctatcagtcaacataattatcgcccaggctatttcacgcaaaccgcagggccttggcatttgggtaagttggaactggatttcgacctgtgtgaaggcacaacagttgtagtagacgaacactgcggaaataggggtccaagtcttaggacgacgaccgttactggaaaaatcattcacgagtggtgttgtagaagctgcactctacctccgctaagattcaagggagaggatggatgttggtatggaatggagataagacccgtaaaagaaaaggaagagaacttagtaaagagcatggtgtcagccggctctggtgaggtggatagtttctcgttagggctattatgcatctcgataatgatagaagaagtaatgagatcaaggtggtcaagaaagatgctaatgactggtaccctggccgtctttttgttactgataatgggacaactaacctggaacgatctgattcgattatgtattatggtcggcgcgaacgcatcagatagaatgggcatgggtacgacatatctggcactaatggctacgttcaagatgagacctatgttcgctgtaggactattatttagaagactaacgtcacgagaagtactattactaaccataggattatcattagttgcgtcagtagaactaccaaatagtcttgaggaactaggggacggactagcaatggggataatgatactcaaactactaactgattttcaaagtcatcaactttgggcaacacttctgagtctcaccttcattaagactaccctatctctacactatgcgtggaagacaatggctatggttctaagtatcgtatcattaatccctctgtgcttgtctacaacttcacagaaaacaacttggttaccagtactactaggcagccttggttgcaagcctctaacaatgttccttatagcagaaaacaaaatttggggaaggaaatcatggcctttaaatgaaggaatcatggcagtgggagttgtatcaatactactctccagtctgctcaaaaacgacgtaccgctagcagggcctcttatagcgggaggaatgctcattgcgtgttatgtgataagtggttcaagcgctgacttgtccttggaaaaggctgcggaagtatcttgggaagaggaggcggaacattctggagcgtcacacaatatcttagttgaagttcaagatgatggaacaatgaaaataaaagatgaagaacgagacgatacacttacaatactcttaaaagccactttattagccgtttctggagtatatccactgtccatacctgctaccctctttgtttggtatttttggcagaagaagaaacagagaagtggagtattatgggacactccaagcccacccgaagtcgagcgagccgtgttagatgatgggatatatagaattatgcaaaggggtttacttgggagatcccaagtaggagttggagtattccaagaaaacgtttttcacacgatgtggcacgtaacccgaggagctgttttaatgtatcaagggaaaaggttggaaccaagttgggcctcagtgaagaaagacctaatcagctacggcgggggatggagattacaaggcagttggaataccggggaagaagtccaggttatcgctgttgagccacgcaaaaaccccaaaaatgtccaaacggcccctggtacttttaaaactccggagggagaggtaggcgccatagcgttagattttaaaccaggaacgtctggaagtcctattgttaatagagaaggaaaaatagtcgggctatatggcaacggtgtggtaacaacatcaggcacatatgtgtccgccatagcgcaagctaaggcgagccaggagggacctttgcccgaaatcgaagatgaagtattcagaaaacgtaatctaacaataatggacctacatccaggctcagggaaaactcggcgttatttacctgcaatagtcagagaagcaattaaacgtaaacttcgaacccttatattagcccctactcgggtggtagcttccgaaatggctgaggccttaaaaggaatgcctataagatatcaaactacagccgtaaagtcagagcataccggcaaagaaatagtggatttgatgtgtcatgcaacctttacaatgcgtcttttaagtccggtaagagtgccgaattataacatgataattatggacgaagcgcactttacagacccttcatctatagcggcaagaggttacatttctaccagagtcggtatgggagaggccgcggcgatattcatgacggcaaccccacctggctctgtagaggctttccctcagagtaacgccgttattcaagacgaggagagagacataccggaaagaagctggaacagcgggtatgaatggataacagactttcctggtaaaacagtgtggtttgttccgtctattaaatcagggaacgatatcgccaattgtcttaggaaaaacggcaaaagggtaatacaactttcaagaaaaacattcgatacagaataccagaaaactaagaacaacgactgggattacgttgttacaacagatatttctgaaatgggagcaaacttccgcgcagatcgggtaatcgacccccgtcggtgtttaaagccagtcattttaaaagacggacctgaacgagtaatcttagcaggacctatgccagtaactgtcgctagtgcagcccagagacggggacgaataggtagaaatcacaataaagaaggagaccaatacatctacatggggcaacctttaaacaatgacgaagaccacgcacattggacagaggcaaagatgcttttagataacataaacactcctgaaggaataatcccggccctcttcgagcccgagagagagaaaagtgcggctattgacggtgaataccggttacgtggtgaggcaagaaaaacattcgtggaattaatgcggcgcggagacctcccggtatggttatcttataaagtagccagcgaaggttttcagtacagcgacagaagatggtgttttgatggagagcgaaataaccaagtattagaagaaaatatagatgtggaaatatggacgaaagaaggagaacgaaagaaattaagaccaaggtggctcgatgctcgaacatactctgatcccttagctctgagggagttcaaggagttcgcagctggaagaagatccgtatccggagatctaatacttgaaatcggtaagctgccacaacacctaacgcaacgggctcaaaatgctctagacaacctagtaatgcttcataattctgaacaaggtggacgagcatatcgacatgccatggaggaactaccagacacgatcgaaacattaatgctactagctctcattgcagtattaacaggaggagtaacacttttctttctatcaggtagaggtctcggtaaaacatccatcggtttactgtgtgtgatggcctcatctgtccttttatggatggcgagcgtggagccccattggatagcagctagtataatactagagttcttcttaatggtacttctcattccagaacctgacagacaaagaacaccgcaagacaaccaactagcatatgtggtcattggattattatttatgatacttactgttgcggctaatgagatgggactgctcgaaactaccaaaaaggatttaggaataggacatgcagcagtcgagaatcaccatcatgccactatgctagatgtagatttacaccctgctagtgcgtggaccctatatgccgtagctactaccataataacccccatgatgaggcatactattgaaaacacaacagcaaatatctcccttactgcaattgccaatcaagctgctatattaatggggttagataaaggttggccaataagtaagatggatattggcgttccgttattggccttaggatgttatagtcaagtaaatccacttacactaaccgctgcggtactaatgctagttgctcactatgctataatcggtcccggcctacaggccaaagcaacaagagaagcccaaaaacgaacggccgctggcataatgaagaatccaacagtagatggaatcgtggcaatagatttggatcccgtagtgtatgacgcaaaatttgagaaacaactgggccaaattatgttattgatactatgcacttctcaaatcctcttgatgaggacaacttgggctttgtgtgaaagtatcacacttgccacaggcccactcacaactctttgggagggcagcccaggtaaattttggaatacaactatagcggtttcaatggcaaacatttttcgcgggagttacctagctggtgccgggttagcattctcactcatgaagagtttagggggtggtcgcagagggacgggtgcacaaggagaaacattgggtgaaaaatggaaacgtcaactaaatcaactcagcaaatcagagttcaacatttataagagatcagggattatggaagtcgatagaagcgaagcaaaggaaggtcttaaacgtggggaaacgaccagacatgcagttagccgtggaactgcaaaattaaggtggtttgtagaacgtaatttggtaaagcccgaaggaaaagttatcgacctggggtgcggccgaggtggctggtcatattattgtgcaggcttgaagaaagtaacggaagtaaaaggctatacaaaaggcggccctggtcacgaggaacctatacctatggcaacatatggatggaatcttgtaaaactgcattcaggtaaagatgtcttctttacaccacccgagaaatgcgatactttattatgcgatataggcgagtcatccccgaatccaactatcgaggaggggaggacactccgagtgttgaaaatggtggaaccatggcttagaggtaatcaattttgtatcaaaatacttaatccgtacatgcccagtgttgtagaaaccctggaacaaatgcaaaggaagcatggaggaatgctcgtaaggaatccgctctcgagaaactcgacacacgaaatgtactgggttagttgcggcacaggaaacatagtaagtgctgtgaatatgacgtcgagaatgcttctaaatcgcttcaccatggcccacagaaaacctacttacgagaaagatgtcgatttaggagcaggaacaaggcatgttgcggtcgaaccagaggtagcaaatttggatatcataggacaacgtatcgaaaatataaagcacgagcataagtcaacatggcactatgacgaagacaacccatacaagacctgggcataccacggtagttatgaggtgaagccatccggatctgccagttccatggtgaatggtgtagtaaaactgctaactaaaccctgggatgtcatacccatggtaacacaaattgccatgactgatactacaccatttgggcaacaacgtgtgtttaaggaaaaagttgacaccagaaccccaaaagcaaagcggggaacagttcagataatggaagtaactgctagatggttatggggatttttgagcagaaataagaaacctaggatttgtacacgggaggagttcacgagaaaagtcagatcaaacgctgcaattggtgcagtatttgtagatgaaaaccaatggaactcagcaaaagaggctgtcgaagatgaaagattctgggatcttgtcaagaaagaacgtgagctccacaaacaaggaaagtgcgcaacatgcgtatacaatatgatgggaaaacgtgagaagaaactaggtgaatttggcaaagcaaaaggttctcgtgcaatatggtatatgtggttaggtgccagatttttagaatttgaggctttaggattcatgaatgaagatcattggttctcaagggaaaattctttaagtggcgtggaaggcgaaggacttcataaattgggttatattctcagggatataagtaaaatacctggaggaaatatgtacgcggacgatacggcaggctgggacactagaataacggaagatgatctgcaaaacgaagctaagatcaccgacatcatggaacctgaacatgctttgctagccacgtcgatatttaaactgacataccaaaataaagtagttcgggtccaacgaccagccaaaaacgggacagttatggacgtaataagcagacgagatcaacgagggagtggacaagtgggaacctacggcttgaatacattcaccaacatggaagcgcagttaataagacaaatggaatcggaaggcatattccttcctagcgaattagaaactccaaacttggcggagagagtgcttgactggttagaaaaatatggagttgagaggctaaaaagaatggcaataagtggagatgattgtgtggtaaagccaatcgacgatagatttgcaacagcattaacagcgcttaatgatatgggcaaagtccgaaaagatataccccaatgggaaccgagcaaaggatggaatgactggcaacaagtaccattttgctctcatcattttcatcagctaataatgaaagatggccgagagattgtagtgccatgccgcaaccaagatgagttggtaggtagagcaagggtatcacaaggggcgggatggtctttgagagagactgcatgcttaggcaagtcatacgcacagatgtggcaacttatgtattttcatagaagagatttgcgattggcagcaaacgccatatgtagcgcagtaccagtcaactgggtcccaacctctagaaccacctggtctatacatgcacaccaccaatggatgacgacagaggatatgctctcagtatggaacagggtctggatagaagaaaatccttggatggaggacaaaactcatgttagctcgtggggagatgtgccatatttaggcaaacgtgaagatcagtggtgcggttctttaatcggattaactgcaagggcgacgtgggcatcgaatatacaagtagctatcaatcaagttagaaggctcataggcaatgagaactatctggactacatgacatcgatgaagcgctttaaaaatgaaggagacccagaaggagcattgtggtaa

SEQ ID NO: 21968 - RNA, 9879 nt, synthetic construct
  misc_feature 1..9879: note = derived and/or modified CDS sequence (opt6) from DENV-1__EU482536__SS-prME
  source 1..9879: mol_type = other RNA
agtgttactatgctactaatgctcatgcctacagcattggcgtttcacttaacaacgcgcggaggggaaccgcatatgatcgtttcaaaacaagaacgtggaaagagcttattatttaaaacatcagctggagttaatatgtgcacgctaatagcaatggacctaggggaattttgcgaagatacaatgacctataaatgtccaagaataactgaagctgaaccggatgacgtagactgctggtgtaatgcaactgatacatgggtgacctacggtacatgtagtcaaacgggtgaacaccggcgcgataaaaggagcgtcgcattagcacctcatgtagggttgggtttagaaacacgaactgaaacttggatgtcatcagaaggtgcctggaaacaaattcaaagagttgaaacatgggctctcagacatccaggttttacggtgatcgcattatttctagctcatgctataggaacttccatcacacaaaaaggaatcatatttatattattaatgttggtaaccccctcgatggcgatgcgatgcgtagggataggatccagagactttgttgaaggactgagcggagctacgtgggtcgatgtagtacttgaacacggatcatgtgttactacaatggcaaaagataaaccaactttagacattgaactattgaaaacagaggttactaatccggctgtactaagaaaattatgcattgaagctaaaatatcgaatacaacaaccgattcaagatgtcccacccaaggagaagccacacttgtggaagaacaagatgctaactttgtatgccgaaggacctttgtggaccgaggatggggtaatggatgtgggctatttggaaaaggtagcttaataacttgtgcaaaattcaaatgtgtcaccaaactagaagggaaaatagtccaatatgagaatttaaaatacagtgtaatcgttacagtccacactggcgaccaacaccaagtgggtaacgaatctaccgagcatggaacaacagctacaataacaccacaagcacctagcacagaaattcagttaacggattatggagctttaaccctggactgctctccgcgaactggattggattttaatgaaatggtacttttgacaatgaaagaaaaatcgtggctagtacacaaacaatggtttttagatcttccgctaccgtggacgagcggagcatcgacttcacaggaaacgtggaatagacaggatctactcgtaaccttcaaaacggcccatgccaagaaacaagaagttgttgtgctgggtagtcaagaaggcgctatgcatacagcattaactggagcgacggaaattcaaacatcaggcacgactacgatatttgccggacatttaaaatgtcgactgaaaatggataaattgactctgaaaggaatgtcctacgtaatgtgtactggatcatttaaattagaaaaagaggttgcagaaacacagcatggcacagttctcgtgcaaataaaatacgaggggaccgatgctccttgcaaaataccattcagtacacaggatgagaaaggcgtaacacaaaacggacgtttaataaccgcaaatccgatagtaactgataaagagaaaccggtaaatatagaggcagaaccacctttcggagagagttatatagtaataggagcgggcgaaaaggctttaaaactttcatggtttaagaaaggatcgagcataggcaaaatgtttgaggcaacagcccgtggcgcaagacggatggcaatactcggcgatacagcatgggactttgggagcatcggcggagtatttacatcagtcggcaagttagtccatcaaatcttcgggactgcatatggagtcttattctccggcgtctcttggacaatgaagataggcataggggtactattaacgtggttaggattaaatagtaggagtacaagtcttagtatgacatgcatagcagtaggcctagttaccctatatttaggcgtgatggtgcaggccgactctggctgtgttataaattggaaaggcagagagttaaaatgcggatcggggatttttgttacgaatgaggtacatacatggactgagcaatataagtttcaggcagacagccccaaacgtctctcagcggcgataggaaaggcctgggaggaaggtgtatgcggtattaggtcagctactcgattagaaaatataatgtggaaacaaatttcgaacgaactcaatcatattctactcgagaatgatatgaaattaaccgtggttgtaggggacgttgctggaatactagcacaaggcaagaaaatgatccgcccccagcctatggaatacaagtattcctggaaatcttggggcaaggcaaaaataatcggtgcggacgtccaaaacactactttcataatagatggacctaatacacccgagtgtccagacgatcaaagggcatggaatatttgggaggtagaggattatggttttgggattttcactacaaacatatggctaaaactaagagattcatatacacaagtatgcgaccatcggttaatgtcagcagctataaaagattctaaggcagtacacgcggacatgggctattggattgaaagcgagaaaaatgaaacctggaagctagccagagcatcattcatcgaagttaaaacctgtatatggccgaaatcccataccttatggagtaatggggtcctagagagtgaaatgataattccaaaaatttacggtggccctatatcacaacataactatagaccaggatactttacacaaacagccggtccatggcacttaggcaaattagaattggactttgatttatgcgagggtacaactgtcgtggtcgatgagcattgtggaaatcgaggcccttccctacgaactactacagttaccggaaaaattattcacgaatggtgttgtaggtcttgtacactacccccgcttcgatttaaaggagaagacggttgttggtacggaatggaaattaggcctgtaaaggagaaagaagaaaatctggtcaaatcaatggttagcgcggggtcgggcgaagtagacagtttctccctcggattgctatgcatttcaatcatgatagaggaggtaatgcgtagtcgttggagtagaaaaatgctaatgacaggcaccttagccgtattctttttattaattatggggcagttaacatggaacgatctaattcgattatgtataatggtaggagcaaacgcatcagatagaatgggcatgggtactacatacttagctcttatggcgacctttaaaatgcgccccatgttcgcagtaggactactcttccgaagacttacatcaagagaagttctcttattaaccattggcctaagtttagtagcaagcgtggaattaccaaattcgctagaagaattaggggacgggcttgccatgggtataatgattttaaagctcttaacggattttcaatcacaccaattatgggccactcttctgagcttaacatttattcgaactaccttttcgcttcattacgcatggaaaacgatggctatggtattaagtatagtcagtctctttccactatgcctgagcacgacaagccagaaaactacatggctacccgtattattagggtcgttaggatgtaaaccattgaccatgtttttaatcgcagagaataaaatctgggggagaaaatcatggcctctaaatgaaggtattatggcagtagggattgttagtatactgctatcaagtttactaaagaacgacgtaccattagcaggcccactcatcgctggtggcatgcttatagcatgttacgtaatttctggttctagtgccgacttatcattagaaaaagctgcagaagtttcatgggaagaagaggcggaacactccggcgcaagtcataacattttagtcgaggtacaggacgacggtacaatgaaaataaaggacgaagagagggatgatatgttaacaattttattgaaagcgacacttctagcagttagtggagtgtatccgttaagcattccagccacattatttgtttggtacttttggcagaaaaagaagcaaagatcgggagttctatgggacacaccctcacctccggaggtggagcgagcagtgctggatgatggtatttatcgaatcatgcaacgaggactgttagggagatcacaagtcggtgtaggagtctttcaagaaaacgtcttccatacgatgtggcatgtaacacgtggcgcagtattaatgtatcaaggaaaaagacttgaaccttcatgggcttcagtgaagaaagatctaatatcatacgggggtggttggagacttcagggttcgtggaatacaggagaagaggtacaagttatagctgtagaaccaggcaaaaatcctaaaaatgtccaaaccgcacccggtaccttcaaaacttcagaaggggaagtaggagccatagctctcgacttcaagccgggtaccagtgggagtcccattgtcaatagggaaggtaaaatcgttggattgtacggtaatggagtagttacaaccagtggcacatatgtctccgcaatagcgcaagctaaggcgagtcaggagggaccgttaccagagatcgaagatgaagtgtttagaaaaagaaatttaacaatcatggatctccacccagggtctggtaaaactcgaaggtatcttcctgctatagtccgagaagcaataaaacgtcgtctcagaacgctcattctagcaccaaccagggtagttgcaagtgagatggctgaggctttaaaaggaatgccgatccgatatcaaactactgctgttaaaagtgaacatactggtaaagaaatagttgatttgatgtgtcacgcgacatttaccatgaggttgctttcaccagttcgagtccccaattataacatgataataatggatgaagctcatttcacagacccgtcaagcattgctgcaagaggttacatatccactcgagtaggtatgggagaagccgcagccatttttatgacagcaacaccacccggtagtgttgaggcgtttccccaatcaaatgcagtcatccaagacgaggaacgggatatcccagaaaggagttggaacagtggctatgagtggataacagattttcccggtaaaaccgtctggtttgtccctagtattaaatcgggaaatgatatagctaattgtttgcggaaaaatggaaaaagagtaatccagctatctagaaaaacattcgatacggaatatcaaaagacgaagaataacgactgggactacgtagtgacaactgatataagcgagatgggcgcgaatttccgtgcggatagagttatcgatccaagaagatgcttaaaacccgttatacttaaggatgggcccgaaagagtaattttagcaggaccaatgcctgtaaccgtggcgtccgcagcacaacgaagaggacgcatagggcggaaccataataaagaaggagatcaatacatttacatgggccaaccgctaaataatgacgaagatcacgcacactggacggaggcgaaaatgcttttggacaatataaacactcccgagggaataataccggcactcttcgaacctgaacgagaaaagagcgcagcgattgacggggaatacagacttagaggagaggcaaggaagacctttgtagaattaatgaggagaggagatttgccagtatggctgagctataaggtggcatctgaagggttccaatattcagatagacggtggtgtttcgatggtgaaagaaacaaccaggtactcgaagaaaacatggatgtagaaatatggacaaaagaaggtgagcgaaagaaattaagaccacgctggctcgatgcacggacatattcggatcccttggccttgcgcgagttcaaagaatttgccgcgggcagaaggagtgtttcaggtgaccttattttagaaatcggtaaattacctcagcatttaacacaacgcgcacaaaacgccctggataatttagttatgctccataattcagagcagggaggtagggcataccgtcatgcaatggaagaactcccagataccatagaaacccttatgttattggctttgatagctgttctaaccggaggagttaccctattctttttgagcgggagaggattaggtaagacttccataggactgctttgtgtaatggctagcagcgttctactatggatggctagcgttgaaccgcattggatagctgcctcaataatacttgaatttttccttatggtactacttatccctgagcccgaccgtcaaagaacacctcaggacaaccagctagcctacgtggttattggacttctcttcatgatactgacggtagcagctaatgaaatggggttgttagaaacaaccaagaaagacttaggaataggccacgtagcagtcgaaaatcatcaccacgctgcgatgcttgacgtagacctacatccagcgagcgcatggacattatacgccgtagctacaaccatcataactccaatgatgagacataccattgaaaacaccacagcaaatataagccttacagctatcgcaaaccaagcagcaatactaatgggtcttgataaaggctggcctattagtaagatggatattggtgtacctctattggcgttaggatgctacagtcaagtaaatcccctaactttaactgcggccgtactaatgctagtagctcattacgcaattattggaccaggcctacaagctaaggcaactcgagaagcgcagaaaagaactgcagctggaataatgaagaacccaactgtcgatggaatagttgccattgatctcgacccagttgtttacgatgcaaaattcgagaaacaacttggccaaattatgctacttatcctatgcacttcgcagattctattaatgagaactacttgggccctttgtgaatccattacccttgcaacgggaccgctaacaacactgtgggaaggcagcccgggaaaattttggaacaccactatcgctgtctctatggccaacatcttcagagggagttacttggctggtgcaggactggcattttcactaatgaaatctttaggtggaggacgaaggggtacaggtgcccagggagaaacactaggcgaaaaatggaaacggcagctcaaccaattgagtaaatcagaatttaatacttataagaggagcggcatcatggaagtcgatcgaagcgaagctaaggagggactaaaacgaggcgagacaactaaacatgcggtttctagaggtacagctaaacttaggtggtttgtagagagaaatcttgttaagccggagggcaaagtaatcgatctgggttgtggccgaggcggatggagttattactgtgcaggattgaagaaagttacggaggtgaaaggctataccaaaggtggcccgggtcatgaagaaccaattccaatggcaacttatggatggaatttagtcaaactacattcgggtaaagatgtattctttattcccccagaaaagtgtgatacattactttgcgatattggtgagagtagtcccaatcccacgatagaggaaggtagaaccctgcgtgtattaaaaatggttgaaccatggctcagaggaaaccaattttgcattaaaattttaaacccatacatgccgtcagtagttgaaacactagagcagatgcaaaggaaacatggaggaatgttagtaagaaatccattatcgcgaaactcaacacatgaaatgtactgggtttcttgtggaacgggaaatattgtgagtgcagttaacatgacgtcacgaatgttgttaaataggtttacaatggcccaccgcaaaccaacttatgaaagagatgtagatcttggggcgggaacgaggcatgtagctgttgaaccagaagtagctaacctagacataatcggccaacgtatcgaaaatattaaacatgaacataagtctacatggcactatgatgaggacaatccgtacaaaacttgggcatatcatggcagttatgaagtcaaaccttcggggagcgcaagtagcatggtcaatggggttgtaaaattactaacaaaaccatgggatgtgattcccatggtaacccaaatagcaatgacggacactacgccctttggacagcagcgtgtatttaaggagaaagtagatacacgaacccctaaagctaagcgcgggactgcacaaataatggaagttactgccaaatggttatggggtttcctaagtaggaataagaaaccaaggatctgcacacgagaagaatttacacgaaaagtaagaagtaacgcagctataggagcagtcttcgtggatgaaaatcagtggaacagtgcaaaagaagccgtagaggacgaacgattttgggacttagttcacagagaaagagagctacacaagcaaggaaagtgcgctacctgcgtgtacaacatgatggggaaaagagagaagaaattgggagaatttgggaaagcaaaagggtcccgtgcgatatggtacatgtggctaggagcaagatttttagagtttgaagcgctaggatttatgaatgaggaccattggttcagtagggaaaattcattgtctggagttgagggcgaaggtttacacaaactaggatatatcttaagagacatcagcaaaattccgggcggtaatatgtacgccgacgacacagcgggttgggacacacgtattacagaagatgatttgcaaaacgaagctaaaataactgacataatggagccggagcacgcccttctcgcaaaatcgatattcaaactcacttatcaaaataaagttgtaagagtacagcgcccagctaaaaatggtactgtaatggacgtgatcagtaggagagatcaaagaggtagtggacaagtaggcacatatggcttaaatacattcacaaatatggaagcacaactaattaggcaaatggaatcagaaggtatttttagccctagcgaattagaaacaccaaacctagcaggaagggtgctggattggcttgaaaaacatggtgttgaacgtctgaaaagaatggccataagcggagatgactgtgtcgtgaaaccaattgatgaccgcttcgccactgcactaactgcgttgaatgatatgggcaaggtccgtaaagatattccacagtgggagccctcgaagggatggaacgactggcaacaggtaccattttgttcgcaccactttcatcagctcataatgaaggacggacgagaaatagtcgtgccctgccgaaatcaagacgagctagttgggcgagcacgagtatcccaaggagccggctggtctttgagagaaaccgcttgcctaggtaaatcttatgcacaaatgtggcaactgatgtattttcatagaagagatttgagattagctgcaaatgcgatatgttcagctgtgccggtagattgggtgcccacaagtagaactacttggagcatccacgcacaccatcaatggatgacaacagaagatatgttgagcgtttggaatagggtatggatcgaagaaaacccttggatggaagacaaaacacatgttagcagttggggagatgtgccttacctaggcaaacgagaggatcaatggtgcggctcgttgatagggttgacagcgcgcgcaacatgggcaacaaacattcaagtagccatcaatcaggttcgaagactattggggaacgaaaactatctggactatatgacatcaatgaagaggtttaagaacgagtcagatccagagggcgccttgtggtaa

SEQ ID NO: 21969 - RNA, 9879 nt, synthetic construct
  misc_feature 1..9879: note = derived and/or modified CDS sequence (opt6) from DENV-1__EU482537__SS-prME
  source 1..9879: mol_type = other RNA
agtgtgactatgttacttatgttaatgcccacggctttagcctttcatctaacaacacgaggaggtgaaccccacatgattgttacaaaacaagaacgcggtaagagtttactcttcaaaacatccgccggtgtaaacatgtgcacactaatagcaatggatctgggtgagctttgtgaagatacaatgacctataaatgcccgagaattaccgaagcagaacctgacgatgtagattgttggtgcaacgctacagatacgtgggtcacatatggtacctgtagccaaaccggcgagcatagacgggataagcgaagtgtcgctcttgctccacatgtaggtttaggattagaaacaagaactgagacgtggatgtcaagtgagggcgcctggaaacaaatacaaagagtcgagacatgggccttacgacacccaggattcaccgtcatagccttgtttttggcacatgccattgggacaagtataactcaaaaaggtataatattcatcttattaatgttggtaacgccaagcatggcaatgagatgtgtaggtattggaagtagagattttgttgaggggttaagcggcgctacttgggtagatgtcgtattggaacatggtagttgtgtaacaactatggcaaaagataaaccaaccctagacattgagttattaaaaacagaagtaaccaacccagccgtattgcgaaagttatgtatagaggcgaagatcagtaatacaacaacagacagccgatgccctacacaaggggaggctacattgatggaagagcaagatgcaaactttgtatgtagaaggaccttcgttgatcgtgggtggggaaatggctgtggtctctttggaaagggttctctcattacatgtgcaaaattcaaatgtgtcaccaaactagagggtaaaatcgttcaatatgaaaacctgaaatactcagtaatcgtaacagttcacacaggagatcaacatcaagtcggaaatgaaagcactgaacacggaacaacagcaactatcacgcctcaagcacccacatccgagatccaactcactgattatggagcattgacattagactgttcccctaggacaggattagactttaatgaaatggtactattaactatgaaagaaaaatcttggttggtacataagcaatggtttcttgaccttccattaccctggacaagtggtgcaagtacttcgcaggagacttggaacagacaggatctgctagtgacttttaaaaccgcacatgctaaaaaacaagaagttgtagtgctcggttcgcaggaaggcgcgatgcatacggcacttactggcgctacagagatccaaacatcggggacaacaacgatattcgctggacatttaaagtgccgtcttaaaatggataagttgactttaaaaggtatgtcatatgtcatgtgcacggggtcatttaaattagaaaaggaggtagcagagacacaacatgggacagtcctggtacaaatcaaatatgagggtaccgatgcaccttgcaagattccctttagtacacaggatgaaaagggtgtaatccaaaatggtcgattaatcaccgcaaatcctattgtcactgataaagaaaaaccagtgaacattgaggctgagccgccatttggagagtcatacatcgttataggggtaggtgagaaagcgttgaaattatcctggttcaagaaaggatcttcaattggaaaaatgttcgaagcgacagcacgtggtgccagaaggatggcaatcttaggagatacagcttgggatttcggatctataggaggtgtttttacatcggttggaaaactagtacaccaaatcttcggaacggcatatggcgtgttatttagtggagtgagttggactatgaaaataggaataggggttcttcttacttggttgggacttaatagtagatcaacaagtttgtccatgacatgcattgcagtaggcttagtcactctctatttgggtgtaatggtgcaggcggattcaggatgtgttataaattggaaaggaagggaattaaaatgcggtagtggaatattcgttacgaacgaagttcatacatggaccgaacaatataagttccaggcagacagccccaaaagactttcggcagcaataggaaaggcatgggaagaaggagtatgtggaattcgaagtgcaactagattagaaaacataatgtggaaacaaatatccaacgagttgaatcatattctgctcgaaaacgatatgaaatttacggtagtcgtaggtgatgttgtaggaatcttagcccaaggaaaaaaaatgatacgtccccaaccgatggaacataaatactcttggaaatcgtgggggaaagcaaaaataattggtgctgacgtgcaaaatacgacattcataattgatggaccgaacactccagaatgtcctgacgaccaaagagcatggaatatatgggaagttgaagattatggtttcggtatattcacgacaaacatttggttaaaactacgcgatagctatacccaagcttgcgatcacagattaatgagtgccgcgattaaagatagcaaagcggtacatgcggacatgggttattggatagaatcagaaaaaaatgagacctggaaattagctcgggcaagttttatagaagttaaaacatgtatttggcctaaatcacacacactatggtccaacggcgtcttggagtcggagatggtaatacctaaaatatatggtggccctatcagtcagcacaactatagacccggctatttcacgcagacagccggtccatggcatctaggaaaattagaattagactttgacctttgtgaaggtacaaccgttgtggtcgatgaacactgtggtaatagaggtcctagtctaagaacaactactgtaacgggtaaaataattcacgaatggtgctgtcgaagttgcactctacccccccttagatttaaaggagaagatggttgttggtatggaatggagattagacctgtgaaagaaaaagaagaaaatttggtgaaaagtatggtttcagctggctcgggagaggtagactccttttcactaggactactatgtatatccattatgatagaagaagtaatgagaagtagatggtcccgaaaaatgctaatgacaggaacgttggctgtattcctgctactaataatggggcaactaacctggaatgacctaatcagattatgtatcatggtaggggccaatgcatccgatagaatgggaatggggactacttacttggccttaatggctacttttaagatgagacccatgtttgctgtaggactacttttcaggcggctcacgtcgagagaagtccttctgctgacgatcgggttatctcttgtcgcttcagtagaattacccaacagcttagaggaattaggtgatggattagctatgggtattatgattttaaaattacttacagatttccagtctcatcagctatgggccactctattatcgctaacattcattaaaacgactctctcattacattatgcatggaaaacaatggctatggtactctctatagtctccctgtttcctctttgtctcagcacgacatcacaaaaaactacatggcttccagtcctccttgggagtctgggctgcaaaccactaacgatgttcttgattgctgaaaataaaatctggggtcgtaaatcatggcccctaaatgaagggattatggccgttggagtcgtttcaatattgctaagcagtctactaaagaatgacgtgccattggccggaccattaatagccgggggaatgttaatcgcgtgttatgtgattagcggttccagcgccgatctttcgttggaaaaagccgcagaagtgtcatgggaagaagaagcagaacattctggtgcctcccacaatatacttgtagaagtccaagatgatggcacaatgaaaataaaagacgaagaacgagacgacacactgactatattgttaaaagcaaccctcctagcagtttcgggggtttacccgttgagcatacctgccacattgtttgtatggtacttttggcaaaagaagaaacaaagatctggagtattgtgggacacccctagtccacctgaagtagagcgagccgtattagacgatggaatttataggataatgcaaagggggttattaggaagatctcaagtaggtgtaggcgtatttcaagaaaacgtctttcacactatgtggcatgtcactcgtggcgcagtattgatgtatcaggggaagagattagaaccttcctgggcatctgttaaaaaagacctcataagttacggcgggggttggcgtctacaaggaagttggaataccggggaagaagttcaagtgatagcagtagagccaggcaaaaaccccaaaaatgtacaaacagcgcccggtacttttaaaacgcctgaaggagaagtaggcgccattgccctcgatttcaaaccaggtacttcaggtagcccaatagtgaatcgtgagggaaaaattgttggtttatacggaaatggggtagttactacatctggaacctacgtttcagcaatagcccaagcaaaggcttctcaagaaggacctttaccagaaatagaggatgaagtgttccggaaacgaaatctcacgataatggacttacatccaggttcaggaaaaacgcgtagatatttacctgcaattgttagagaagccatcaaacgaaaactaagaacactaatcctagctccaacaagagtagtagcgtctgagatggcagaagctctcaaaggaatgccaataagataccaaaccacagcggttaaatccgaacatacaggcaaggaaattgtagacttgatgtgccatgccacattcaccatgagacttcttagtccggtacgtgtacccaactacaacatgataatcatggatgaagcacattttacagaccctagttcaattgcggccagaggttatattagtacacgtgtaggtatgggagaagcagcagcaattttcatgacggctactccccctggctcagtagaagcgtttccacaatcaaacgcggtgatacaagatgaggagagagacattccagagagaagctggaacagcggctatgaatggattacagactttcccggaaaaactgtatggtttgtgccaagtataaagagtggaaatgatattgctaattgtttacggaaaaatggaaagagggtaatccagttatcgagaaaaacatttgacacggaatatcagaaaacgaagaacaatgattgggactacgtggtcactacggatattagcgaaatgggagcaaattttcgcgcagacagggtaatagacccgagaaggtgtttgaaacccgtcatactaaaagacggacccgaacgagtaattttggcgggacctatgccagtaacggtggcaagcgcggcacagcgaagaggcaggatagggaggaaccataacaaagagggggaccaatatatatacatgggtcagcctctcaataacgacgaagatcatgcacactggactgaagcaaagatgttattagacaatattaacacgcccgaaggtataatacctgcattgtttgaacctgaacgcgaaaagagtgcagcgattgacggtgaatatcgtctaagaggagaagctcgaaaaacatttgttgagttaatgaggagaggagatttaccagtatggctaagttataaagtagctagtgaaggtttccaatattcagaccgaagatggtgcttcgatggcgaaaggaacaatcaagtcctggaagaaaatatggatgtcgagatatggaccaaggagggggaaagaaaaaaactaagaccacgatggctagatgcgagaacatactccgatccgttagcattaagagaattcaaggaattcgcagctggcagaagatcagtatccggcgatttaatcctcgagataggaaaactaccacaacacttaacacagagagcccaaaacgcattagataaccttgtgatgctacataatagcgaacaaggtggacgagcatataggcatgcaatggaagaattacctgacacgatagaaactttaatgttactcgcattaatagccgtgttaactggtggtgtcacactattctttttgtcaggacgtggattggggaaaacttcgataggattattatgtgtgatggcatcaagcgtactcttatggatggcctcagttgagcctcactggatcgcagccagcataatcctagaatttttcttgatggtattattgatcccagaaccggaccgccagagaacgccacaagacaaccaactcgcatacgtagtaataggtctgcttttcatgatattaactgtggcagcaaatgaaatggggttattagaaacaacaaaaaaagatttggggataggtcatgtagcagtggaaaatcaccatcatgcaactatgcttgacgtagatttacatccggctagtgcctggaccttatacgcagtggcgacgacaataattacacctatgatgcgtcatacgatagaaaacacgacggccaatatatcgttaaccgcgatagcgaaccaggcagctattttaatgggattagataaagggtggccgatttcaaaaatggacattggggttccgctactagcattaggatgctactcacaagtaaatccactgaccctgaccgctgcagtgcttatgctagttgcacattatgcgataatagggccaggtttgcaagcaaaggcaacgagagaggcccaaaaaagaactgcagcggggattatgaaaaaccccactgtagatgggattgttgcgatagatctagaccccgtcgtatatgatgctaaattcgaaaaacagttaggtcaaataatgttattaatattatgcacttctcaaattctcttgatgaggacgacgtgggccctgtgtgaaagtataacactcgccacgggaccattaactaccttatgggagggttctccaggaaaattttggaatacgacaattgcagtatcaatggcgaatatttttcgaggaagctacctagcaggggccggattagccttttcactaatgaaaagtttaggtggggggagaagaggcacaggggcccaaggagaaacacttggagaaaaatggaagagacaactaaaccaattaagtaaatccgagtttaatatatacaaacgatcaggcattatggaggtcgatagaagtgaggcaaaagaaggccttaaaagaggggaaacaacccgacacgccgtatctcgcgggacggcaaaactacgctggttcgtagaaagaaacctggttaaaccggaaggcaaagtgatagatctaggttgtggcagaggtggatggtcatattattgtgctggattgaaaaaagtaacagaagtaaagggttacacaaaggggggtcccggtcacgaagaacctattcctatggcaacgtatggttggaacttggttaaattacacagtggcaaagacgtattttttacccctcctgaaaaatgcgacacattgctgtgtgatataggcgaaagctcccccaacccgacaattgaagaaggtagaactctgagggttcttaaaatggtcgaaccgtggcttagaggcaatcaattctgcataaagatattaaatccatatatgccgagtgtcgtagagactctcgaacaaatgcagagaaaacacggaggaatgttagtcaggaatcctttatcaagaaactctacgcatgaaatgtactgggtatcttgcggtacggggaatatagtatcggccgttaacatgacgtccaggatgttacttaaccgctttactatggctcaccgaaagccaacgtacgaaagagatgtagatctaggagcaggtacgagacatgttgccgtggaaccagaggttgctaatctagatataatcggccaacgtatagagaatataaagcacgaacataaatcaacttggcattacgatgaagacaacccatacaaaacttgggcgtatcacggaagctatgaagtgaaaccaagtggttctgctagttccatggtaaatggcgtcgtgaaattgcttacaaaaccatgggatgtaatacctatggtaacacaaatagccatgacagatacaacgccttttggacagcaaagagtgtttaaagaaaaagtagatacacggacaccaaaggccaagagaggaaccgcgcaaattatggaagtcacagctagatggttatggggatttttgtccagaaacaaaaaaccgagaatatgcacgcgtgaagaatttacaaggaaagtgaggtctaacgcagctataggagcagtcttcgttgatgagaaccaatggaatagtgctaaagaggcggtagaagatgagcgtttctgggacctagtacaaaaggaaagggaattacataagcaaggcaagtgtgccacttgcgtatacaatatgatgggaaaaagagagaaaaagttgggagaattcggaaaagcaaagggaagtcgagcgatatggtacatgtggttgggtgcaagatttctggaattcgaagctcttggtttcatgaatgaagatcattggttctcgagagaaaacagtcttagtggagttgaaggggaaggcctccataaattgggctatattcttagagatataagtaagataccagggggaaacatgtacgcggatgatacagctggctgggacactcgtataacagaagatgacttacaaaatgaggcgaaaattacagatataatggaacccgaacatgcactattagctacctcaatcttcaaattaacatatcaaaataaagtagtccgggtacagcgacccgcgaaaaatggaaccgtgatggacgtgatatcgcgaagagatcagaggggtagtggacaagttggcacatatggactaaatacattcactaatatggaagcccaactgataagacaaatggaatccgaagggatcttcctaccgtcagaattagaaacaccaaatcttgcagaacgggttttagattggctggaaaagcatggtgttgaacgtttaaaacgaatggcgatctcgggggacgactgtgttgtaaaaccgatagatgacagatttgctactgcactcacagctctgaatgatatgggaaaggtgaggaaggatataccacaatgggaaccttcaaaaggttggaacgactggcaacaagtaccgttctgttcgcaccattttcaccagttaatcatgaaagatggtcgtgaaatagttgtaccgtgccggaaccaagatgaactagtaggtagagctagagtaagccaaggtgctggctggtctctaagagaaacagcatgcctaggtaagtcttacgcacaaatgtggcaattgatgtattttcacagaagagacctaagattggcagcaaacgcgatctgcagcgcggtacccgtagattgggtaccgacctctaggacaacttggagtatacatgcgcaccatcagtggatgactactgaggatatgttatcagtatggaatcgagtatggatagaagagaacccttggatggaagacaagactcacgtatcatcttggggagacgtaccgtacttaggaaaaagagaagatcagtggtgtggatctctaataggactaactgctcgagcaacatgggcttcaaatatacaagtagccattaaccaagtacggcgtttgataggcaatgaaaactacctcgactatatgacaagtatgaagagattcaaaaatgagggggaccccgagggtgcattatggtag

SEQ ID NO: 21970 - RNA, 9879 nt, synthetic construct
  misc_feature 1..9879: note = derived and/or modified CDS sequence (opt6) from DENV-1__EU482538__SS-prME
  source 1..9879: mol_type = other RNA
agtgttacaatgttgttaatgttaatgcccacggctttagcgtttcatttgacaacacgtggtggggaaccgcacatgatagtatctaaacaagaaagaggaaaatcactgttatttaaaacatcagcaggcgtaaacatgtgcacattaatagctatggatttaggggaattttgcgaagatactatgacttataaatgcccgaggataacggaagcggaaccagacgatgttgactgttggtgtaatgcaacagacacgtgggtaacatatggaacttgtagccaaacaggagagcacagaagagataaacgctcggtcgctttagcaccacatgtgggattaggtcttgaaacaagaacggagacatggatgagttctgaaggggcctggaaacagatccagcgagtagaaacgtgggctttgaggcatccaggatttacagttatagctctattcctcgcacacgcaataggcacatccatcactcaaaaaggtattatatttatactgttaatgcttgtgacaccaagcatggctatgcggtgtgtaggtataggaagtagagattttgtagaaggattgtccggagctacgtgggtcgatgtggtactcgaacacggatcatgcgttacaactatggcaaaagataaacctacattggacatcgaactattaaaaaccgaagtcactaatccggctgttctgcggaaattgtgtatcgaagcgaaaatatcaaacactaccactgacagccggtgccctacgcaaggagaagctactcttgttgaagaacaagacgcaaacttcgtgtgcaggcgaacctttgtagatagaggctggggtaatggttgtgggctattcggcaaaggctcgttaattacgtgtgcgaaatttaaatgtgtaactaaactcgaaggaaaaatagttcaatacgagaatctaaaatatagcgtaatagttacagttcatacaggagatcaacatcaggtaggcaacgaatctacggaacacggtactacggcaactataacgccacaagcaccctcaaccgaaattcaactaacggattacggggccttaactctcgattgtagtcctagaacaggactggactttaatgaaatggtccttttgacgatgaaagagaaaagttggctggtacacaaacaatggtttcttgacctaccgcttccatggacatctggtgcatcaactagccaagagacgtggaatcgtcaagacctcttagtaacttttaaaaccgcgcatgccaagaaacaagaagtagttgtactaggctcacaagaaggagctatgcacactgcgttgacaggtgcaaccgaaattcaaacctcaggtaccacaacgattttcgcgggtcaccttaaatgtagactgaaaatggacaaattgacactcaaagggatgtcatatgtgatgtgtaccggatcttttaagttagaaaaagaagtagcagaaacgcaacatggaaccgtactcgtgcaaataaaatatgaagggaccgacgccccttgtaaaattcccttttcaacacaagatgaaaagggggtgacgcaaaatggacgtttaattacagcgaatccaattgtgacagaccgtgagaaaccagtaaacatcgaggcagagccgcccttcggcgaatcatatatagtaattggtgctggtgaaaaggctttaaaactttcctggttcaagaaaggatcttcgatcggtaaaatgtttgaagctacggcaagaggcgctagaagaatggccatcttaggtgatacagcttgggacttcggaagcattggcggagtttttacaagtgttggtaagctagtgcatcaaatattcggcacagcttatggtgtattattctcaggagtgtcatggactatgaaaatagggatcggcgtattgctaacatggctcggactgaacagtagatcgacgagtttatcgatgacttgtatcgctgttgggttagttactttatacttaggggtaatggtacaagctgacagtgggtgcgttattaattggaaagggagggagctaaaatgtgggagtggcatttttgtaacaaatgaagtacatacatggactgaacagtataaattccaggccgatagccctaaaaggctatcagctgcaataggaaaggcctgggaagagggggtatgtggcattcgatcggctacaaggttagaaaacatcatgtggaagcaaatttcgaatgagctaaaccacatactattggaaaatgacatgaaactcaccgtggtagttggtgatgtagccggtatattggcacaaggaaagaaaatgatacgaccacaacctatggaatataaatattcctggaaaagctgggggaaagctaagataattggagctgacgttcaaaatacgacttttatcatagacggaccgaacacgctggaatgtccagacgatcaacgtgcctggaatatatgggaggtagaagactatggattcggcatcttcactaccaatatatggctaaaactcagagatagctatacccaggtatgcgaccatagattaatgtcggccgcaataaaagatagtaaagcggtgcatgctgatatgggatactggatagaaagtgagaaaaacgagacatggaaattagccagggctagctttatagaggttaaaacgtgcatatggccaaagagtcatacactgtggagtaacggagtgcttgaatcagaaatgataataccaaagatatacggaggtcctatcagtcaacataactatcgccctggttactttacacagacagcgggaccctggcacttaggtaaattagaattagacttcgacttatgcgaaggcaccacggtggtggtagatgaacactgtggcaataggggaccatccctaagaactacaacagtcacaggtaaaataatacacgaatggtgttgtagatcctgcaccttgccgccactaagatttaaaggggaggacggatgctggtacggcatggaaattaggcccgtaaaagaaaaggaagaaaatttggtcaaaagtatggtatcagcgggatcaggagaagttgactcttttagtcttgggctattatgtattagtataatgatagaagaagtcatgaggtcaaggtggagtcggaaaatgctaatgacaggtaccttggcagtgttctttcttttaataatgggacagttgacatggaacgatttaatacgactatgcattatggtaggcgcaaatgcaagtgacagaatgggaatgggtacaacgtatcttgctctaatggcgacatttaaaatgagacccatgtttgcagtaggactattatttagaaggcttacttctcgagaagtgctacttctaaccataggtctcagcttggtagcatcagtcgagttaccgaacagtctcgaagaactcggtgatggattagctatgggaataatgatcttaaaattgttaacagacttccaatcgcatcagttgtgggcgactttactctccttgacatttatccgaactacgtttagtctccactacgcttggaaaacgatggccatggttctcagtatcgtatctctctttccattatgtctttcgactactagccagaaaactacctggctaccagtgctattaggttcactaggatgtaaaccactgacaatgttcttgatagcggaaaacaaaatttggggtaggaaaagctggccattaaacgagggaataatggctgtaggtattgtaagtatactattatcttctttactgaaaaacgatgtccctctagcaggacctctaatagccggaggtatgttaatagcgtgctacgtaataagtggctcctcagcagacttatcactcgaaaaagccgccgaagtaagctgggaggaggaagctgaacactctggcgcaagccataacatactggttgaagtacaagatgatggcacaatgaaaataaaagacgaggaaagagatgatacattgactatccttttaaaagctacgcttttagctgtgtcgggggtatacccacttagtataccggccacactatttgtctggtatttttggcaaaagaagaaacaaaggtcgggagttctatgggacacaccctcaccacctgaagtagaaagagctgtcttagacgatggaatctacagaattatgcagagaggactgctgggtcgatcacaagtcggagttggggtatttcaggaaaacgtattccatacaatgtggcacgttaccagaggagctgtcttgatgtaccaaggcaagagacttgaacctagttgggcaagcgttaagaaggatctaatcagttacggaggagggtggcgactacaagggtcgtggaacacgggtgaggaggtacaagtaatcgcagtcgaacctggcaaaaaccctaagaatgtccagacagcccctggaacatttaaaactagcgagggtgaagtgggagctatcgcgctagattttaaacccggtacaagcggatcacccatagtaaatagagaaggcaagatagttggactatacggaaacggcgttgtcaccacgtctggaacatatgtaagtgccatagcacaaacgaaggcttcacaggaagggccgctaccagagatagaagacgaagtcttcagaaaacgaaatcttacaattatggatttacatcccggatccggtaaaactaggagataccttcctgccatcgtgagggaagcgataaaaagacgattaagaactcttatactagcaccaacgcgagtagtcgcatccgaaatggcagaagccttgaaaggaatgccaattcgataccaaaccaccgctgtaaagagcgaacatactggcaaagagatagtagatctcatgtgtcatgctacatttacaatgcgactattatcacctgtcagagtaccaaattacaatatgattattatggacgaagcacatttcacagacccaagctccattgccgcgcgcggatacatatcaacaagggtaggtatgggtgaggcagctgcaatattcatgacagcgacaccacctgggagcgtcgaggcgtttccgcaaagtaacgccgtaatacaagacgaagaacgagacatacccgaacgtagttggaacagcggctacgagtggatcacagattttccaggcaaaacagtctggtttgtaccttcaataaagagtgggaacgacatagcaaactgccttaggaaaaacggtaagagagtcatacaattatctcgaaagaccttcgatacagaatatcagaaaaccaaaaacaatgattgggattatgttgtcactactgacatatccgagatgggagcaaactttcgggccgatcgtgtgatagaccctcgacggtgcttaaaaccagtcatactaaaggacggccctgagagagttatactcgcagggcccatgccagtcactgtagcctctgcagcgcaacggaggggcaggattggaaggaatcataacaaggagggagaccaatatatttatatgggtcaaccattaaacaatgatgaagaccacgcgcattggactgaagcaaaaatgcttttagacaatataaacacacccgaaggaataatccctgccttatttgagcctgagcgcgaaaagagcgcagcaatagatggcgaatacagacttcggggagaagcgagaaaaacatttgtagaattaatgagacgaggagatctacctgtttggttatcctataaagttgcaagtgaaggttttcaatattccgataggcgatggtgtttcgatggtgaacggaacaaccaagtcttagaggaaaatatggatgtcgaaatctggacaaaggaaggggaacgaaagaaactgaggccaagatggctcgatgcacgtacgtattctgatcccctagcactacgggaatttaaagaatttgccgcaggtcgccgatcagtttcaggggatcttatactggaaattggtaaactccctcaacatttaactcaaagggctcaaaacgccctagataaccttgttatgctacacaatagtgaacaaggcggacgtgcgtacaggcacgcaatggaagaacttcccgatactattgagacacttatgctgttagcactgatagcagtactaaccggcggagtcacactgttcttcctgagtggtcgggggttaggaaaaacgtcaataggattactctgtgtgatggctagttccgtactcctctggatggcatccgttgaaccacattggattgctgcaagcattatactggagttctttctaatggtattgctaattccagaaccagataggcaacgaactccacaggataatcaattagcatacgtggtaataggcctcctgtttatgattctgacagtcgcagcaaatgaaatgggattattagaaacaactaaaaaggatctaggcatcggacacgtagcagtggagaaccaccatcatgcagcaatgctagatgtcgatttacatcctgctagtgcatggacactatacgcagttgcaacaactatcattacaccaatgatgaggcatactatagaaaacacaactgcaaatatatcactaacagcaatcgccaaccaggcggcgatccttatgggattggacaaggggtggccgatttcgaagatggacattggtgtaccattactggcgttaggatgttatagccaagtaaatccattaacattaacggcagcagtcttaatgcttgtggctcactatgccataataggaccaggcctgcaagcaaaagcaacacgagaagctcaaaaacgaacagcagcaggcataatgaaaaacccaactgtagatgggatcgtggccatagaccttgatccagtagtttacgatgcaaaattcgaaaagcaactcgggcaaataatgttattaattctatgtacaagccaaattctattgatgcgaacaacatgggcactatgcgaaagtattacacttgctactggacctttaacaacactttgggaagggtctccggggaaattctggaataccacaattgctgtatccatggcgaatatatttcgaggcagctatttagccggagccggtttggccttttctttaatgaaatcactaggaggaggaaggcggggaaccggggcacaaggcgaaactctcggcgaaaaatggaaacggcagctaaatcagttatcaaaaagcgaatttaacacatataagaggagcggcatcatggaggtagacagaagcgaagcgaaagaagggctcaaaagaggtgagacaacaaagcacgctgtttcacggggaactgccaagttacgttggtttgtagatagaaacttagttaaacccgagggaaaagtcatagacctaggatgtggtagaggtggttggagttattattgtgcaggactcaagaaagtaacggaagtaaaggggtatacaaaaggtggaccaggacatgaggaacccatccctatggcgacatatggttggaatctggtgaaattacattcaggaaaagacgtattctttattccaccagagaaatgtgatactttactctgcgatatcggagagtcatctccgaatcctacaatagaggaaggtaggactctgagagtacttaagatggttgaaccctggctaagagggaatcaattctgtattaaaattttgaatccctacatgccttcagtcgttgagacactagaacaaatgcaacgtaagcacggaggaatgttagtacggaatccacttagcagaaatagtacgcacgaaatgtattgggtttcgtgtggtactggtaatattgtctcggccgttaacatgacaagtcggatgctactaaacagattcaccatggcacataggaagcccacgtatgaaagagatgtagacttaggggcaggaactagacatgttgcggtggaacccgaggtagccaatttagatattatcggccaacgaatcgaaaatatcaaacacgaacataagtctacctggcattacgatgaagacaacccatataagacgtgggcttatcacggatcttacgaagtaaaaccctctggaagtgcatcctcaatggtcaacggggtagtcaaacttttgactaaaccgtgggatgttatacccatggtaacccaaatagcaatgacagatacgacaccatttgggcaacaaagagtatttaaagaaaaagtagacacacgtacacctaaagcaaaaagaggaactgctcaaataatggaggtaactgcaaaatggctatgggggttcttatcacgaaataagaaaccaagaatttgcactcgagaagaatttacacgcaaagtaagatctaatgcagcaattggggcagtgtttgtcgacgaaaatcagtggaatagcgctaaggaagcagttgaggatgaaagattttgggatctagtccatcgggagagagaattgcacaagcaaggaaaatgtgcaacgtgtgtttataacatgatgggaaagcgagagaagaaattaggagaatttggtaaagccaaaggcagtagagccatatggtatatgtggctcggtgcacgattccttgagttcgaagctctaggatttatgaatgaggatcattggtttagtcgagagaacagtttgtccggggtcgaaggagaaggactacataaattaggttacatcttgcgtgatatttccaaaattccaggtggaaacatgtacgctgatgacactgctggatgggacaccagaataactgaagatgatctgcaaaatgaggcaaaaataacggatataatggaaccagaacacgctttgctggcaaaatctatattcaagttaacataccagaacaaagtagtaagggtccaacgtccagctaaaaacggaacagttatggacgttatctctcggagagaccaacgtggcagtggtcaggtaggcacatatggattgaatacgtttacaaatatggaagctcaattgatacgacaaatggaaagcgaaggcattttcagtccatcagaactagaaacacctaatctagcaggccgtgtactagactggctcgaaaagcatggtgtagaacgactaaaaaggatggctattagcggagatgattgtgtagtaaagccaatagatgatcgattcgccacagccttaaccgcacttaacgatatgggtaaagttcgaaaagatataccccaatgggaaccaagtaaaggatggaatgattggcaacaagtccccttttgctcacaccattttcatcagttaataatgaaagacggccgggaaatcgttgtcccatgccgcaatcaagatgaactcgttggcagagcgagagtttcacagggagccggatggtcgctacgtgaaacagcttgccttggcaagagttacgctcaaatgtggcaactcatgtattttcaccggcgtgacttaagactagcggcaaacgcaatatgctcggccgtcccagtagattgggttcctacttcccgcacaacttggagtattcacgctcaccatcaatggatgactacagaagatatgctctcggtttggaatagagtctggatagaggagaacccttggatggaagacaagacgcacgtaagtagctgggaggatgtaccctatctcggtaaacgagaagatcaatggtgtggaagtttaattggacttacagctcgagcaacatgggctacaaacatacaggtagccataaatcaggtacgaagattactaggcaatgaaaattatctagactacatgacgagtatgaagagatttaaaaacgagtcagaccctgaaggagcgttatggtaa

SEQ ID NO: 21971 - RNA, 9879 nt, synthetic construct
  misc_feature 1..9879: note = derived and/or modified CDS sequence (opt6) from DENV-1__EU482539__SS-prME
  source 1..9879: mol_type = other RNA
agcgtcactatgcttctaatgttgatgccaactgcgttggcattccacctaacgacaaggggaggagaaccacacatgatagttagcaaacaggaacgaggaaaatcactattatttaaaacaagtgcgggagtaaatatgtgcacgctaattgctatggacttgggagaattatgtgaagatacaatgacatataaatgtcctcggataaccgaaacagaacctgatgacgtagattgttggtgcaacgcaacagatacttgggttacatacggaacttgttcacaaacgggtgaacatagaagagataaaagatcagtagcactcgcaccacacgtaggtctcggattggaaacaagaacagaaacttggatgagtagcgagggtgcgtggaaacagatacaaagagtagaaacatgggcattaagacatccaggttttaccgtaattgccttattcctcgcgcatgcaattggtacaagtattacgcaaaaaggtatcatattcatccttcttatgttagtaactccgagcatggcgatgcgctgtgtaggaataggaagtagggacttcgtagaaggacttagtggtgcgacatgggtagatgtggtgctagaacatggcagttgtgttaccacgatggcaaaagacaaacccacattagacatcgagctgttgaaaaccgaagtaacaaatccagctgttttgaggaaattgtgtatcgaagcaaaaatttcgaatacaacaacagactcacgttgtccgacccagggtgaagccactctagtagaggaacaggatgcgaactttgtttgtcgacgaacctttgtagatcgagggtggggcaatggctgcgggctctttggtaaaggatctttaataacatgtgctaaatttaaatgtgttactaaattagaaggaaaaatagtacagtacgaaaacctgaaatatagcgtaatagtgacagtacatacaggggatcaacaccaagttggaaatgagtctactgagcatgggacaacggcgacaataacgcctcaagcgccaacaacagaaattcagctaacagattacggcgccttgactttggattgtagtccaagaactggcttagattttaatgagatggtccttttaacaatgaaagagaaaagctggttagtccacaaacaatggtttttggatctcccattgccatggacttctggggcaagtacaagtcaagaaacatggaatcgacaagatctgcttgtcacttttaaaacagctcacgctaagaaacaagaagtcgtcgtacttggtagtcaagaaggtgcaatgcataccgctttaacaggcgctacagaaattcagacatcaggaactacaacaatattcgcaggacacttgaaatgtagattgaaaatggacaaactgacattaaaaggaatgagttatgtgatgtgcacaggatcatttaaactcgaaaaagaagtagcagaaacacaacacggaacggtgctagttcagataaaatatgaaggaacagatgcaccctgcaaaataccgttttcaacacaagacgaaaaaggtgtaacacaaaacggaaggctcatcacggcaaatcctatagttactgataaagaaaagccagtcaatattgaagcggaacctccatttggcgaaagctatatagttataggggcaggcgagaaagccctgaaactctcgtggttcaagaaaggaagcagcatagggaaaatgtttgaggctacggcacgaggagcacgtcgtatggccatactcggagacacagcatgggactttggtagcataggaggcgtatttacatcagtcggaaagctcgtacatcaaatattcggaaccgcatatggagtgttattttctggggtatcctggacgatgaagataggtattggcgtattattgacttggttgggactgaatagtagatcaacatccttatcaatgacgtgcatcgcagtcggacttgttactctgtaccttggcgtgatggtacaagctgacagcggatgtgtaataaattggaaagggcgtgagttaaaatgcggtagtggtatttttgtaacgaatgaagtacatacgtggacagagcagtataaatttcaggctgacagcccaaaacgtctaagtgcggctattggcaaagcatgggaagagggtgtatgcgggataagaagcgccacaagattggagaatataatgtggaagcaaatctcgaatgaactaaatcatatactattagagaacgacatgaaattcaccgttgtagtcggcgatgtcgcggggattctagcgcagggaaagaaaatgatacggccccagcctatggaatataaatattcgtggaaaagctgggggaaagcaaaaatcataggtgcagatgtacaaaacacaacctttataatcgatggtccaaacacaccagaatgtcccgacgatcagcgtgcatggaacatatgggaagtagaagattatggatttggcatatttacgacgaacatatggctgaagttgagggacagttacactcaagtttgcgaccataggcttatgagcgctgcgattaaagatagcaaggcagtacacgcggacatgggttactggattgaatcagagaagaatgaaacgtggaaattagctcgagcttcatttatcgaagtcaaaacctgtatctggccaaagtcccatacactatggtctaatggtgtattagaaagcgaaatgattatccctaaaatatacggagggcctatatctcaacataattaccgaccaggatacttcacacaaactgccgggccatggcatctaggaaagttagagctagattttgatctttgtgaaggcaccaccgtagtcgtagacgaacattgtgggaaccgcgggccgagtttgcgaacaacaacagtaacaggtaagataatacatgaatggtgttgtagatcatgcacattgccacctctaaggtttagaggagaggatggctgctggtacggtatggaaataagacctgtaaaagaaaaagaagaaaacttagtaaaatcaatggtgagtgccggatctggtgaggtagacagtttttccctaggtcttctgtgcatcagtataatgatagaggaagtcatgagaagtaggtggagcaggaaaatgcttatgaccggcacacttgccgtctttttcttactaataatgggccaactaacatggaatgatctgatcagattatgtataatggtgggagctaatgcaagtgatcgcatgggcatgggaacaacctatttggcattaatggcaacatttaaaatgcgccccatgtttgctgttggcctattatttagaaggttaacaagtcgcgaagtcctccttctaacgataggcttgtctttggtagcttcggttgagttgccaaacagtctcgaagaattgggagatggtttagcaatgggtattatgattcttaaactattgactgattttcaatctcatcaactctgggcaacgcttctgtcacttacctttatcaaaacaactttttcactacactacgcttggaaaactatggccatggtattaagcatagtttccctttttcccctgtgcctgtctactacaagtcagaaaacgacatggctacccgtgttactcggtagcttaggttgtaagcctctgaccatgtttctgatagccgaaaataaaatatggggcagacggagctggcctctgaatgaagggatcatggctgtaggcatagtgtctatcttactttccagtttattgaaaaacgacgttccactagccggcccattgatcgcaggaggaatgcttattgcctgttatgtcatcagtggttctagcgccgatctctcgctagaaaaggccgcagaagtgagttgggaggaagaagctgaacacagtggggctagtcataacattctcgttgaagtccaagatgatggaacgatgaaaataaaagatgaagaacgagacgacacgttaacgatactattaaaagccaccctactggccgtatcaggcgtatatccattatctatccctgctactttgttcgtgtggtatttctggcaaaagaagaaacagcgtagcggggttctatgggatacaccaagccctccagaagtaggacgagctgtacttgacgatggtatatataggatcatgcagagaggtttgctaggcaggtcacaggtaggggttggcgtcttccaagagaatgtttttcacacaatgtggcatgtaaccagaggggctgtcttaatgtatcagggcaaacgtttagagccaagttgggcgagcgtgaaaaaggacttaataagttatggcgggggatggcgactacaaggttcttggaacactggggaagaagtacaggtcatagccgttgagccaggcaaaaatcctaaaaacgtacagacagctccgggcacctttaagacaccagagggtgaagtcggagccatagcattagactttaagcctggaacaagtggaagccccatagtcaacagagagggaaaaattgtgggattatatggcaacggagttgtcacaacatcaggaacatacgtttctgcgatcgcacaagcaaaagcgtcacaagaaggaccgttgccggaaattgaagatgaagttttccgtaaaagaaatctaacgataatggatctacatccaggtagtggaaaaactcgtcgttatttaccagcaatagtaagagaagcgataaaacgtaagttaaggacactcatactggccccaacaagggtcgtcgcttccgagatggctgaagcactaaagggtatgccaatacgatatcaaacaacagctgtaaaatcagaacacactggtaaagaaatcgtagatttaatgtgtcatgcaacatttactatgcggctacttagtccagttcgagttcctaattataacatgataataatggacgaagctcacttcacggaccctagtagtatcgcagcgcgaggatatattagcactagagtcggtatgggagaagcggcagctatattcatgacagcaaccccaccaggctcggtagaggcttttccgcagtcaaatgcagttattcaagatgaagaaagggacataccggagagatcgtggaactcgggctatgaatggataacagattttcctggtaaaacagtatggttcgtacctagcataaaatccggtaatgacatcgcgaactgtctacggaaaaacggaaagagagtaattcaattgagtagaaaaacgtttgatactgaatatcagaaaactaaaaataacgattgggattacgttgtaaccacggatatcagtgaaatgggagcaaatttcagggcagacagggtaatagatccgcgacgatgcttgaagcctgttattctaaaagacggacctgagcgagtgatattagccgggcccatgcctgtaacggttgcaagcgcagcacaacgacgaggacgaataggaagaaaccataataaagaaggtgatcaatatatttacatgggtcaaccacttaataacgacgaagatcatgcacattggaccgaggctaagatgttgcttgacaatataaacacacctgaaggcataattccggctctctttgaaccggaacgagaaaaatccgccgcaatagacggggaatatcgccttcgtggtgaagcaaggaaaacttttgttgagctaatgcgccgcggtgatttaccagtatggctttcatataaggttgcttcagagggttttcagtactcggataggagatggtgctttgacggggaaagaaacaatcaagtactagaagaaaatatggacgtggaaatctggacaaaagaaggtgaacgtaagaaattacgcccccgatggttggatgcacgaacatactcggatccacttgctttacgtgagttcaaggaatttgcagcaggaagaagaagtgtcagtggagatttaattcttgagattggtaagctacctcaacatctaacacaaagggcccaaaatgcacttgataatctagtaatgcttcataattctgaacaaggcgggcgtgcatacagacatgcgatggaggaattaccagatacgatagaaacgcttatgctattagctctcattgcagtgcttacgggaggagttactttgtttttcctaagcggtcggggattgggaaaaactagcataggtctcctttgtgtgatggctagcagtgtgttattgtggatggcctctgtagaaccacactggattgccgcatcgataattctagagttctttttaatggtcctactaataccagaacctgatcgacagcgtacccctcaagacaatcaacttgcgtatgtcgtaataggattacttttcatgattttaacggtcgcagcgaatgaaatgggactcttggaaactacaaagaaagacctcggtataggacacgtagcagtcgaaaatcatcatcatgctgcaatgctggatgtagatttacacccggcatccgcctggactctatacgcagtagcaactacaataataacgccaatgatgaggcatactattgaaaatacgacagctaacatatcgttgactgctatagcaaaccaagccgcaattttaatgggcttagacaaggggtggcctatatctaagatggacattggtgtgccacttttagctctagggtgctacagtcaggtaaacccactcaccttaacagcggcagtactaatgctagtagcacattatgcaatcatcggtcctgggttgcaagcaaaggctactcgcgaagcacaaaagagaacagcggcaggaatcatgaaaaatccaacagtggatggtatcgtagcgatagatctcgatcccgtagtgtatgatgccaaattcgaaaaacaacttggacagataatgttactaattttatgtacgctccaaatactgctaatgagaactacatgggcgctttgcgaaagcataaccttagcaactggaccacttacaacattatgggaaggaagcccaggtaaattctggaatacaacaatcgcagtaagtatggctaatattttcagaggctcatatttggcgggagcagggttggctttttctcttatgaagtcgctcggtggagggagacgtggtacgggtgcacaaggagaaacattgggcgagaagtggaaaaggcaattaaaccaactaagcaaaagcgagtttaatacctacaaacgttcgggcattatggaagtagacagatctgaagctaaagaagggctaaaacgcggtgaaacgacaaaacatgctgtaagccgagggacggctaaacttcgatggtttgtagaacgcaacctagtaaaacctgaaggaaaagtgatagacctgggttgcggcagaggcggctggagctactactgtgcaggactgaagaaagtaacagaagtaaaaggttacacaaaaggcggcccgggacatgaagaacctataccaatggcaacgtacggatggaatttagttaaactgcattctggaaaagatgtcttctttatacctccagaaaaatgtgataccctactttgcgacatcggagaatcatctcctaatcctactattgaagaaggacgtactcttagagttttaaagatggtagaaccatggctaaggggcaatcaattctgcatcaagatcctaaatccatatatgccatcggtcgtagagacgctggaacaaatgcaacgtaaacatggcggaatgttggtacgcaacccattatctcgaaactcaactcatgaaatgtattgggtttcttgtggtactggcaatatagtgtctgcagtcaatatgacttcaaggatgttgctaaatagatttacgatggcacaccgaaaacctacatatgaacgcgacgttgatttgggtgcgggaacacgccatgtagctgtagaacctgaagtagccaacttagatattatcggtcagagaatagaaaacataaaacatgaacataagagtacatggcattacgatgaagataatccttataaaacttgggcataccatggaagttatgaagtcaagccaagtggatccgcgtccagtatggttaacggcgtagtaaaattattgactaagccctgggacgtgattcctatggttactcagatagcaatgacagataccacgccgtttggtcaacaacgagtttttaaggaaaaggtggatactaggacacccaaagctaagcggggaactgctcaaataatggaagttactgcaaaatggctatggggattcttatcaagaaacaagaaacccagaatttgtacacgagaagaatttacaagaaaagtaaggtcaaacgccgcaattggtgcggtctttgtagacgagaaccaatggaactcagctaaagaagcggtggaagatgagcgattttgggatttagtacatagggagcgagagttacacaaacaaggtaaatgtgccacatgtgtttacaacatgatgggtaaacgtgagaagaaactcggtgaatttgggaaagcaaaaggttcgcgagcgatatggtacatgtggttaggggcacgattcctagaatttgaagctctaggattcatgaacgaagaccattggttctctagggaaaatagcttatcaggcgtagaaggagagggactacacaaattaggatacatactacgagatatctctaatataccgggagggaacatgtatgcagatgacacagccggttgggatacaaggatcacagaagacgacctccagaacgaagccaggataaccgacattatggaaccggaacatgctctcctagcaaaatcaatattcaaattaacctaccaaaacaaagtagttagagtacaaaggcctgccaaaaacggtaccgtaatggacgttataagccgtcgcgaccagagagggtcaggacaagtaggaacctatggactaaacactttcactaatatggaggctcagttgattaggcaaatggagtccgagggtatattttcacccagtgaattagaaactccgaatctcgctgaacgagtattagattggttggaaaaatatggagtcgagaggttaaaacggatggcgataagcggggacgattgcgtggttaagccgatcgacgatcgcttcgcaacagcactgactgccctcaatgatatgggcaaggtgagaaaagacataccccagtgggaacctagtaaagggtggaacgattggcaacaagtgccgttctgctcccatcacttccatcaactgattatgaaggacggaagagaaatagtggtaccatgtagaaatcaggacgaattagtagggcgagcaagagtctcacaaggagccggatggagtctacgagagacagcatgccttggaaaaagttatgcccaaatgtggcagttaatgtactttcacagaagagacctccgtctggcagcgaatgcgatatgcagtgcagtccctgttgactggattccgacttcaagaacaacatggtcaatacacgcccatcatcaatggatgactacggaagatatgttatcagtttggaatagggtctggatagaggaaaacccctggatggaggacaaaacccacatttcatcctggggagatgtaccttacctaggaaaaagagaagaccaatggtgcggctctttgataggtcttacagctcgcgcaacatgggcaacgaatattcaagtagctataaaccaggtaaggcgtctaattggcaatgagaactatttggactatatgacaagtatgaaacgatttaaaaatgaatctgaccccgaaggggctctatggtag

SEQ ID NO: 21972 - RNA, 9879 nt, synthetic construct
  misc_feature 1..9879: note = derived and/or modified CDS sequence (opt6) from DENV-1__KP188539__SS-prME
  source 1..9879: mol_type = other RNA
tcggtaacaatgttactaatgcttttacctacagcgttggcgtttcacttgactacgagaggaggtgagcctcacatgatagtatcgaaacaagaaagaggcaaatcgctgttgtttaaaacatcagtcggagtaaacatgtgtacattaattgcaatggatttgggtgaactctgtgaagatacgatgacatataaatgccctagaattactgaagcagaaccagacgatgtagattgctggtgcaatgcaacagatacatgggtcacatatggcacatgctctcaaactggagaacatagaagagacaaacggtcggttgctttagcaccacatgtaggcttagggctcgaaacacgaacagaaacgtggatgtcatcagaaggtgcatggaaacaaatacaaaaagttgaaacttgggccctgcgacatccaggctttactgttattgcactatttttggcccatgctattggaacgagtattacgcaaaaaggtataatttttatattgttaatgctagtcacaccaagtatggcgatgcggtgtgtcggaatcggaaatagggactttgttgagggactatctggagcaacttgggtagatgttgtactcgaacacgggtcgtgcgtgactacaatggccaaaaacaaaccaacactagacatcgagttgttaaaaacggaagtgactaacccagcagttcttagaaaattatgcatcgaagccaaaatcagtaacacgacaactgatagcagatgtccaactcaaggtgaggctaccttagtagaagaacaagacgcgaactttgtatgtaggcggacattcgttgatcgaggctggggaaacggatgtggacttttcggcaagggctctttattaacatgtgccaaattcaaatgtgttactaaattagagggaaaaatcgtccaatatgaaaatttaaaatatagcgtaattgttactgtccacacaggagaccaacaccaagtgggaaacgaaacgacggaacatggtacaatagcaattattacgccacaagcaccaacttctgaaatacaactaaccgattatggcgccttgaccttagactgtagcccaagaaccgggctggattttaatgagatggttttactcacgatgaaagaaaagagctggctagtacataagcaatggttccttgatctgcccttaccctggacttctggagcctcaaccagccaagagacctggaatagacaagacctattagttaccttcaagactgcccacgccaagaaacaggaagttgtcgttttaggatcacaagaaggagcaatgcacacagcactaacaggagctactgagattcagacttcaggtacgacaacgatatttgctggacatctaaaatgtcggttgaaaatggataaactgacccttaaaggaatgtcatacgtcatgtgcacaggatcatttaagctagaaaaggaggtagcagaaacccaacatggcacagtactggtacaagtaaaatatgaaggaactgatgcgccgtgtaaaatccctttcttgactcaggatgaaaaaggagtcacacaaaatggtagattaataacggcgaatccaatagtaactgataaggagaaacctgtaaacatcgaaacagaaccacctttcggcgagagttatatagtcgtaggtgcaggagaaaaagcgttaaaactaagttggtttaagaaaggaagtagtatcggaaaaatgtttgaggctaccgcaaggggagccagaagaatggccatattgggagacacagcttgggattttggcagcatcgggggcctcttcacatctgtaggtaagctaatacaccaagtatttgggactgcgtatggtgtcctatttagcggagttagctggactatgaagattggcattggtatactattgacatggctaggattgaactcaaggagcacaagtctcagtatgacttgtatagccgtaggaatggttacactatatctgggagtaatggtacaggcagactcaggatgcgtcattaattggaaaggacgtgaacttaaatgcggatcaggaatattcgtaacaaatgaggttcacacttggacggaacaatacaaatttcaagcggacagccctaaacgactgagtgcagcaatcggtaaagcctgggaagaaggggtgtgcggaatacgatcagcaactagactagaaaatatcatgtggaaacaaatcagcaatgaattgaattacatactactggagaacgatatgaaatttactgtagtcgtaggagacgttaacggtattctagctcagggaaagaaaatgataagaccacaacccatggaacataaatattcatggaaaagctggggaaaggcgaagataataggtgcagatattcaaaacaccacatttattatagatggtccggacacacctgagtgccctgacgaccagagggcatggaacatttgggaggtagaagattatggttttggtatatttacaacgaacatttggctaaaattacgagattcacacacacagatgtgtgaccacagactcatgtccgcagctattaaggattcaaaagccgtacacgccgacatgggatactggatagaaagtgagaagaatgaaacgtggaaattggctcgggcatcatttatagaagtaaaaacctgtatatggcccaagagtcacacgttatggagcaacggagtgcttgaatccgaaatggtaattccaaagatttacggaggaccaatctcacaacacaactacagaccaggctattttacccaaactgccggaccatggcatttaggcaaactagagttagatttcgacctatgcgaaggcaccacagtagtggttgacgagcactgtggctacagagggcccagtttaagaacaacaacagttactggaaaaatcatccacgaatggtgttgtcgttcatgcaccctcccaccattgcgctttcgaggagaggacggttgctggtatggcatggaaattaggccagtcaaggaaaaagaagaaaacttggttagatcgatggtgagcgctggttctggtgaaatggacagtttttcacttggaatcctctgtgtttcaatacttatagaagaagtgatgcgaagtaggtggtccaggaagatgctaatgacgggaacgctagcggtattcttactcctaataatgggacaattaacatggaacgatctgattcgtctctgcataatggtaggtgccaatgcatcagacagaatgggtatgggtacaacttacctagcattgatggctacgtttaagatgagaccaatgttcgctgtgggtcttctattccgtcgattaacctctcgtgaggtacttctcttgaccgtagggctatcattagtagcgagtgtggaattaccaaattcactagaggagttgggggacggactagcaatgggcatcatgatgttaaaattattgactgattttcagccgcatcagttatggactacgctactatcgcttacattcattagaacatctctctcactggactacgcatggaagacgatggccatggccttaagtatagtcagcttatttccattgtgcttaagcacaacgagccagaaaacgacatggctcccggtgcttctagggtcgtttggatgcaagcccttaactatgtttttgataactgaaaataaaatatggggcagaaaatcctggcctataaacgaaggtattatggccgtgggaatcgtgtcaatattgctatcttctctattaaaagatgacgtaccattggcgggaccgttaattgccgggggtatgttaattgcttgttatgtgatctcgggatcttccgcagatctgagtctagaaaaggcagcagaggtatcctgggaagaagaagctgagcactcaggaacaagtcataacatattagtagaagtacaggatgacggaactatgaagatcaaagacgaagaacgtgatgacacattaaccatactgttgaaggcaacgttattagccgtttcgggtgtatatccaatgagtattccagctactttgtttgtttggtatttttggcagaagaagaaacagcggtcgggagttctttgggatacaccctctcctccagaggtagaaagggcagtcttggatgatggtatctataggattctacagagaggattattaggacgatcacaggtaggtgttggtgtatttcaggatggagttttccacacaatgtggcatgttactagaggggccgttctcatgtaccaaggtaaaagattagaaccaagctgggcatccgtaaagaaagacttaatcagttatggcgggggttggcgatttcaaggctcttggaatacgggcgaagaagtacaagtaatagcagtggaaccaggcaaaaacccgaaaaatgttcaaaccacaccaggcacttttaaaaccccggaaggggaagttggcgcaattgcgttggactttaaacctggaacatccggctcccctattgtcaatagagaagggaaaattgtaggattatacggaaatggtgtagtcacaacttccggtacctatgtatcagctatagcacaagcaaaagcgacacaagaaggtccactaccagaaatagaggatgaagtgtttaaaaagagaaatttaacaataatggacttgcaccccggatcgggtaaaactagacgctacctaccagcgattgtacgagaggcaattaaaagaaaactgcgtaccctgatcttggcaccaacacgagtcgtagcatccgaaatggcagaggcgctgaaaggaatgccaatcagatatcagacaacggccgttaagtctgaacacacaggacgtgagattgttgatttgatgtgccatgcaacatttactatgcgactattaagccctgtacgagtccctaattataacatgatcataatggacgaagcacattttacagatccagcatctatagccgctcggggttatatctcgacacgagttggtatgggagaggcagcagctatatttatgacggctactcctcccggctcagtagaggctttcccacaatcaaatgcggtcatacaagacgaggaacgcgacataccagagcgatcttggaactcaggttatgactggattaccgactttccaggcaagactgtatggtttgttccatcaatcaaatctggaaatgatatagcaaattgccttaggaaaaatggcaagagagtaattcaattaagcagaaaaacatttgatacagaataccagaaaactaaaaacaacgactgggactatgtcgtgactactgatatatcagaaatgggggcaaattttagggctgacagagtaatagatccacgaagatgtttaaagccagttatattgaaagaaggccctgagagggtgattttagcaggtccaatgccggttacggtagcttcagcggcccagagacgcggcagaataggaaggaaccaaaataaagaaggggaccagtacatttatatgggccaaccgttgaacaatgacgaagatcacgcccattggacagaagcgaaaatgctactagacaatatcaatactcctgaaggcatcataccagcattgttcgaaccagaacgagaaaaatcagcggccatagatggggagtatagactccgaggagaagccaggaaaacatttgtcgaactcatgcggcgcggggatctccctgtatggctctcttataaagtagcatctgaaggatttcaatattcagaccgaagatggtgtttcgatggagaaaggaataaccaggttttggaagaaaatatggatgtagagatctggacgaaagaaggcgagcgaaagaaattacgaccgcgttggttagatgcgcggacatacagcgatccgctggcacttagggaatttaaagagtttgccgctggaaggcgaagtgtcagcagcgatctaatcttagaaataggaaaactaccacaacatctgacactacgcgcgcaaaacgcgttggacaacctagtaatgcttcataactccgaacagggaggtaaagcctatcgacacgcaatggaggaactaccagatacgatagagaccttaatgctattagcactaatagctgtactaactggaggagtaaccctatttttcttgtcaggaaaaggattgggaaagacctcgattggacttctttgcgtcatggctagtagtgcactactttggatggcttctgtagaaccccactggatagctgcctctataattcttgaatttttcttaatggtgctattaataccggaaccagatagacaacgaacaccacaggataatcaattagcatatgtcgtcataggtcttttattcatgatattaacggtagctgcaaacgaaatgggattactagagacaactaagaaagatctaggtatcggccacgtcgcagtcgagaatcaccatcatgctaccatgctagatgttgacctcaggccagcgtctgcatggactctttacgcagttgccaccacagttataacacccatgatgaggcacacaattgaaaataccacagcaaacatcagcttgaccgcaatcgccaatcaagcagcgatattaatgggtttagacaaaggatggccaatatcaaagatggatattggcgttcctctactagctttagggtgttattcacaagtaaacccactcaccttgaccgcagcagtactaatgttagttgcacattacgcaataataggacccggtttacaagctaaagctacacgcgaagctcaaaagcggaccgcagcgggaataatgaagaatcccacggttgatggaattgtgaccatcgaccttgatccagtcgtttacgacgcaaagttcgaaaaacagttggggcaaataatgctccttattctgtgtactagccaaattctgcttatgaggactacatgggcactatgtgaatcgataactctagcaactggccccctaacgacgctttgggagggttcccccgggaaattttggaacactacgatcgcggtaagtatggcaaacatttttcgtggcagttatctagccggtgctggactagcattttcgttaatgaaatcgctaggtggaggaagacgagggacaggagcccaaggagaaacgttaggtgaaaaatggaaacgacagttaaatcaactgtctaagtcagaatttaatacctataagaagtctggaataatggaagtagacagatctgaggctaaggaaggtttaaaaagaggagaaacaactaaacatgccgtaagtcgaggtacagccaagttacgatggttcgtggaaaggaatctagtaaaaccggagggaaaagtaatagacttgggatgcggccgaggaggatggagctattattgtgcaggactaaagaaagtaacagaagtcaaggggtataccaagggaggtcctggacacgaagaacctatcccaatggctacatatgggtggaatctggtgaaattacactccggaaaagatgtattctttactccaccggaaaaatgtgatactttactatgtgatataggagaatctagtccaaacccaacgatagaggaaggaaggacgctgagagtcttgaaaatggttgaaccctggcttagagggaaccagttctgtataaaaatattaaatccctatatgcctagtgtagttgaaactctagaacaaatgcaaagaaaacacggtggtatgctagtgaggaacccgttaagtaggaatagcacccacgaaatgtattgggtctcttgcggcacaggaaacattgtaagtgctgttaatatgacctctagaatgttactgaacagatttacaatggcacatcgaaaacctacatatgagcgcgacgtggatctcggtgcaggcacaagacatgtagcagtagaaccagaggtcgctaatctcgacataattggccaaagaatcgaaaatatcaaaaatgaacacaaaagtacttggcattacgacgaggataacccatataaaacatgggcgtaccacggctcatatgaagtaaaaccaagcggctctgcatcctccatggtaaacggggtagttaggttgttgaccaaaccatgggatgtaatccccatggtgacacaaatcgctatgacagacactacgccattcggccaacaaagggtctttaaagaaaaagtcgatacaaggacaccgcgtgctaaacgcggaactgcacaaataatggaagttacagcaaaatggttatggggtttcttaagccgtacgaagaaaccacgaatctgtacaagagaagaatttacaaggaaagtccgtagtaatgccgccataggtgcagtctttgtagacgaaaaccaatggaactcagcgaaagaagccgttgaagacgagagattctgggatctagtacatcgggaacgagagttacataaacagggtaaatgcgccacatgtgtttataacatgatgggaaaacgtgagaagaaactgggtgagtttgggaaagcaaaaggctcaagagcaatatggtacatgtggctcggggcaagatttcttgaatttgaggccctcgggttcatgaatgaagatcactggttttccagagaaaacagcttatcaggagtagagggagaagggctgcataaacttggatacatcctaagagatatatctaagatccccggcggaaatatgtatgccgacgatacagctggttgggacactagaataacggaggatgatctgcagaatgaggcgaagatcactgatataatggaaccagaacatgccctcttagcaacaagtatctttaaattaacataccagaacaaggtcgttcgagtacaacgacccgctaagtcaggcacagtaatggatgtgatttctagacgagaccagcgcggatcaggtcaggtaggtacctacggactcaatacattcacaaatatggaagttcagctaatcagacaaatggaatctgagggtatattttccccatcagaattagaaactcctaacctagccaagaaagtattggactggttagaaaaacatggcgcagaaagactcaaacgaatggcgataagtggagacgactgtgttgtcaagcctatagatgatcgctttgccacggcgttaactgctctcaacgacatgggaaaagtccggaaagacattccccaatgggaaccatctaaagggtggaatgattggcaacaagtccctttttgtagtcaccattttcaccagcttataatgaaagatgggcgggaaattgttgtcccttgtaggaaccaggacgaattagtaggccgggcccgagtttcccaaggagccggatggagcctaagggaaactgcttgcttaggcaaatcatacgcacaaatgtggcaactaatgtatttccacaggagggatcttaggttagccgccaacgctatttgcagtgcagtaccagtagattgggtcccgacatctagaacgacgtggagtattcacgcacatcatcaatggatgacaaccgaagacatgctttcggtgtggaatagagtgtggatagaagaaaacccctggatggaagacaaaactcacgttagttcttgggaggaagtaccataccttgggaagagggaagaccaatggtgtggttctttaatagggttaacagcacgagctacttgggccaccaacatacaagttgctataaaccaggtacggagactaataggtaatgagaattacctggattatatgactagcatgaaaagattcaaaaatgaatctgatcctgaaggagcattgtggtag

SEQ ID NO: 21973 - RNA, 9879 nt, synthetic construct
  misc_feature 1..9879: note = derived and/or modified CDS sequence (opt6) from DENV-1__KP188540__SS-prME
  source 1..9879: mol_type = other RNA
tcagttacaatgctactaatgcttctaccaacagcactagcctttcatctcacgactagaggaggggaacctcacatgatagtctccaagcaagaaagaggaaaatcgctgttgttcaagacatcagctggcgtcaacatgtgtactttaatagccatggacttaggagaattatgtgaagatactatgacttacaagtgtccacgtataacagaagcagaacctgacgatgtagattgttggtgcaacgctacagacacatgggtgacgtatggaacatgtagtcaaaccggtgaacatcgacgagaaaaaagaagtgtcgctctagcaccacatgtaggactaggacttgaaacccgaacggaaacttggatgtcttcagaaggagcgtggaaacaaattcaaagagttgaaacctgggcattaagacaccccgggttcacagttatagcattttttcttgctcatgcaattgggacttctataactcaaaagggaatcattttcattttactaatgcttgttacaccatcaatggcgatgaggtgtgttggtatcggaaacagggactttgttgaaggtttatccggcgcaacttgggtagatgtagtactcgagcatggcagctgcgtaacaacgatggccaaaaacaagccaaccctggacattgaactacttaaaacagaagtaacaaacccggctgtccttagaaagctttgtattgaagcaaagattagtaatactacaaccgattctagatgtcccactcaaggcgaggccaccttagtggaggaacaagacgccaatttcgtatgtcgccgcacgtttgttgatcgaggttggggaaacggttgtggattatttggaaaaggcagtcttttgacgtgtgcaaaatttaaatgtgtaacaaaactagaaggtaaaattgttcaatatgagaatctaaaatacagtgtcatcgtgactgttcatacaggagaccaacaccaagtgggaaacgagacaaccgaacacggaactattgcaaccataacaccgcaagcacccacttccgagatacaattaacggactatggagcgctgacactagactgttctccgagaacaggattagattttaacgagatggttttactaacaatgaaagaaaaatcttggctcgtgcataaacaatggttcctcgatttaccattgccgtggaccagcggggcctctacgtcacaagaaacctggaatcgtcaggatttattagtaactttcaagactgctcatgcaaaaaaacaggaagtcgtagtacttggtagtcaagagggagccatgcatactgctctaacaggcgcgacagaaattcaaacatccggcacaaccacaatttttgccgggcatctaaaatgtagacttaaaatggacaaactcactctaaaaggaatgtcatatgtcatgtgtacgggatcgtttaagttggaaaaggaagtagccgaaactcaacacggcactgtactagtacaagtaaaatatgaaggtacagacgcaccatgcaaaataccgtttagcacacaagatgaaaaaggcgtgactcaaaatggacgactaataactgcgaatccaatagttacagataaagaaaaaccagtaaatatcgaaaccgaaccacccttcggggaaagttatattgtagtcggagcaggggaaaaagcattgaagttaagctggttcaaaagaggaagctctatcgggaaaatgttcgaggcgaccgcacgcggagctagacggatggctatccttggagatacggcatgggatttcggaagtataggcggggtattcacttcagtagggaagttggtacaccaagtttttggtaccgcgtacggagtattgttcagcggcgtatcatggacaatgaaaattggtataggaattttattaacatggctcggattaaactcacgcagtacaagtctatccatgacatgcatagcagtgggcatggtaactttatatttaggggtcatggtgcaagcggacagtggatgtgtgattaactggaagggacgggaattaaaatgtggctcaggaatattcgtgacgaatgaagttcatacctggacagagcagtataaatttcaagcggattcacccaaacgattatctgcggcaataggcaaagcttgggaggaaggagtatgtggtattagaagtgcaacacgattagaaaatataatgtggaaacaaatatcaaatgagttaaaccatatcctacttgaaaacgacatgaaatttacagttgttgtaggcgatgcgaacggaattctcgcacaagggaaaaaaatgataagaccgcaaccgatggaacataaatatagttggaaatcttggggtaaagcaaaaatcataggggcggatatccagaacacaaccttcataatagacggacccgataccccagaatgcccagatgggcagagagcatggaacatatgggaggtagaagattatggattcggagtttttaccaccaacatctggttaaaattgcgagattcctacacccaaatgtgtgatcatcgtttgatgtcagcagcgataaaagattctaaagcggtacatgcagatatgggatattggatcgaaagcgaaaagaatgaaacgtggaagttagcccgggcttcctttatcgaagtaaagacatgtacctggcccaagtcacacacactatggtcaaacggtgtgctagaaagtgaaatgatcataccaaagatattcggtgggccaatatcacaacataattaccgaccgggatactttacacagacagcaggaccttggcatcttggaaagctagaattagatttcgacctctgtgaaggaactactgtagtagtagatgagcattgtggtaatcgtggaccctctctacgaacgaccactgttactggaaaaattatccatgagtggtgttgtagaagttgcactctgccgcccctcagattcagaggcgaagatgggtgttggtatggtatggagataagacctgttaaggagaaagaggaaaacttggtaagatccatggtgagtgctggcagtggagaagttgattcctttagtctgggtatgttgtgtgtatccataatgatcgaagaggtaatgaggtcccgatggtcaaggaaaatgctcatgacgggaaccctagcagttttcctactcctaatcatgggtcaactaacatggaatgatctaataaggctatgcataatggtaggagcgaacgcgagcgataggatgggtatgggtaccacgtaccttgcactcatggctacatttaaaatgcgtccaatgtttgcagtcggtttactttttcgccgtctcacaagccgcgaggtattgctcttgacaataggattgtcgttagtcgctagcgttgaattacctaattcgctagaagaattgggagatggacttgcaatgggaataatgatgttgaagttacttacagaattccaacctcatcaactatggactactctattaagtttaacattcgtcaaaaccactctatctttagattatgcatggaaaacaacagctatggtattgagtattgttagcctattccctttatgtttgagcacgacatctcaaaagacaacctggctcccggtacttcttggatcattcggatgcaaaccattaactatgtttttgataacagagaacaaaatttggggccgcaagagttggccactaaatgaagggataatggccattggcatagtatcgatactgctatcatcattattaaaaaacgatgttcctttagccggaccgctaatagcaggcggtatgttaattgcctgctacgtaatttcaggttcttccgccgatctgtccttagaaaaagcagccgaagtgagctgggagcaagaagctgagcatagcggagcatcacataacattttggtagaggttcaggacgatgggacaatgaaaataaaagacgaggaacgggatgatacattaaccatactgcttaaggcaacgctgttggcagtttcgggagtatacccaatgagcattcctgcaactctcttcgtttggtacttctggcaaaaaaaaaaacaacgatcgggagtattatgggacacacctagcccaccggaagttgaacgtgcagttctagacgacggtatatatagaatattacaacgtggcttactaggacgatctcaagtaggcgtcggggtttttcaagacggagtttttcacacgatgtggcatgtgacaagaggggctgtacttatgtatcaaggcaaaagactcgaaccttcatgggcatcagtcaaaaaagatttgatatcatatggcggtggttggagatttcaagggtcatggaatacaggtgaagaagttcaagtcatcgccgtagaacctgggaagaacccgaagaatgttcaaaccacaccggggacatttaaaacacctgaaggggaagtcggcgcgatagctctagactttaaaccaggtacttctggcagccccatcgtcaatagagaaggcaagatcgtcggcctgtacggcaacggtgtggttactacaagcggaacatacgtatcagcaatagcccaagctaaagcatcacaagaaggaccactccctgaaattgagaatgaagtatttaagaagcggaatctaacgatcatggacctacacccaggttcaggaaaaacacggcgatatttgcctgctattgtacgtgaagccataaaacggaaactccgcacattaatactagcccctacaagggtcgtcgccagtgaaatggctgaagcactaaaagggatgccaattagatatcagacgacagcagttaaaagcgaacacacaggtagagaaatagtggacttaatgtgccacgcgacttttactatgcgtcttttaagtcctgtaagggtaccgaattacaacatgataataatggacgaggcgcatttcactgaccccgcaagtatagcagcacgtggttacatttcaactagagttggtatgggagaggctgctgcaatctttatgactgctacaccccccggcagtgtagaggcattccctcagtcgaacgcagtgattcaagacgaagaaagggatattccagagagatcatggaatagtggatatgattggataactgatttcccaggcaaaacagtctggtttgtaccctcgattaaatcgggaaacgatatagctaactgtttacgaaaaaacggaaaaagagtaatccagttaagtagaaaaactttcgatacagaataccaaaagacaaaaaataacgactgggattatgtggtaacgaccgacatatctgaaatgggagctaactttagagcagatcgagtcatagacccccgtcgatgtttaaaaccagtaatactaaaggatggcccagaaagagttattctagcggggccaatgccagttacagttgctagtgcagcacagcgcaggggtcgaataggtagaaaccaaaataaagaaggagatcaatacgtttacatgggacagccgctaaacaacgatgaagatcatgcacactggacagaagctaagatgcttctagataacataaacacgccggaagggatcattcctgctcttttcgaacctgaacgtgaaaagtctgcagctatagatggcgaataccgcttgcgcggggaagcaagaaaaacgttcgtagaattaatgcgaaggggagatctaccggtgtggctcagttataaagttgcgtcggaagggtttcaatacagtgaccgtaggtggtgttttgacggagagagaaacaaccaagtattggaggaaaatatggacgtagaaatctggaccaaggagggcgaacgaaaaaaactcagacccagatggcttgatgcacgcacgtattcagacccattagctttaagggaatttaaggaatttgcagctggaagacgaagcgtgtctggtgacctaattttagaaatagggaaactaccacagcaccttactcttcgagcgcaaaatgctctagataatctcgtaatgctacataatagcgaacaaggtggcaaagcctatagacatgcaatggaggagttaccggatacgatagaaactctaatgcttctggcgctaatagcagtactaaccggaggtgctacactattttttttgagtggaaaaggattaggtaaaacctcgattggtttattatgtgtcaccgcatcttccgcattactgtggatggccagcgtagaaccccattggatagcagctagcatcattcttgaatttttcttaatggtactgttgatacctgagccagacagacaacgtactccacaagacaaccaacttgcatacgtcgtaattggattgttattcatgattctaactgtagcagccaacgaaatgggactcctagaaactaccaagaaagatctggggataggatacgtagcggctgaaaaccaccaacatgcaactatgctggacgtagacttacaccctgcgtctgcctggacactttacgcagtagcgacgacagtaataacaccaatgatgcgacacacaatagagaataccaccgctaatatatctctaaccgcaattgctaatcaagctgccattttaatgggattagataaaggatggccaatcagcaaaatggacataggagtaccactcctagctcttggctgctactcgcaagttaacccgttaaccttaactgcagccgtgttaatgctagttgcacactatgctattatcggaccgggactacaagcgaaagcaacacgagaggcccaaaaacgaaccgctgctggaatcatgaagaacccaactgttgatggtatagtggcaatcgatcttgatccggtagtctatgacgctaaattcgagaaacaactgggtcagataatgttgttaatcctgtgcacatcccaaatccttcttatgagaactacttgggccttatgcgagtcaataactttggctacaggaccattgacaactttgtgggagggatcacctggaaagttctggaataccaccatagcagtatctatggcgaacatattcagaggtagttacctagctggcgctggacttgcattttcgttaatgaagtccctaggcgggggccgaagaggaaccggcgcgcaaggtgaaacccttggtgagaaatggaaaagacaattgaaccagttatcaaaatcagagtttaacacgtataaacgcagtgggataatggaagtcgaccgaagtgaggccaaagaaggcctaaagagaggggagaccactaaacatgccgtaagtcgcggaactgcaaaactaaggtggttcgtagaacgaaacctagtcaagcctgaaggcaaagtaatagatttaggttgtggacgtggggggtggtcgtactattgtgcggggttgaaaaaggtcaccgaagtaaaaggatacaccaaaggagggccaggtcatgaggaaccaattccaatggcaacttatgggtggaatctagttaaactacattcaggcaaggatgtgtttttcatgccgcctgaaaaatgtgatacattactttgcgacataggtgaatcctctccgaatcccacaatagaggaaggcaggactctaagggtgcttaagatggtagagccgtggctaagaggcaatcaattctgtattaaaatcttaaacccttacatgccatcggtagttgaaacactagagcaaatgcaacgtaaacatggcggaatgctagttaggaatccattatcaagaaattcaacacacgagatgtactgggtctcgtgcgggacggggaacattgtgtcggcggtcaatatgaccagccgcatgttactcaatcgttttaccatggcccataggaaaccgacttacgaaagagatgtggacctaggtgccgggacgcgacatgtcgcggtagaacccgaagtagcaaacctagatataattgggcaaaggatcgaaaatataaaaaatgaacataaatcgacgtggcactatgacgaagataacccttacaaaacttgggcttatcatgggagttatgaagtcaaaccatctgggagcgcctcaagtatggtaaacggcgtggtacggttactaacgaagccgtgggatgttataccaatggtaacacaaatcgccatgacagataccacccccttcggccaacaacgagtctttaaggaaaaagttgacactcgaactccacgtgctaagcgaggtactacacaaattatggaagtaacagccaaatggttatggggcttcctgtcgagaaataagaaacccaggatttgtacaagagaagaatttacaagaaaggtcagatcaaacgcagccattggggctgtcttcgtagatgaaaatcaatggaattcggcaaaggaagcagtagaggatgaacgcttttgggacctagtacatcgagaaagggaattacataaacaaggaaaatgcgccacctgtgtctacaacatgatggggaaacgagaaaaaaaactgggagagttcggaaaagcaaaaggtagtagggcaatatggtatatgtggttaggggcaagattcttggagttcgaagcgctgggatttatgaacgaggatcactggttctcaagggaaaactcactgtccggcgttgagggggaaggtctacataaactaggatacatccttagagatataagcaaaataccaggcggaaatatgtatgcggatgacacagctggatgggacactaggataacggaagacgatttacagaacgaagcaaagataactgacattatggaacctgaacacgcactcttagctacatctatttttaaactaacataccaaaacaaagtagtgagagtacagagaccagcaaaaaacggcacggtaatggacgtaataagcagaagagatcagcggggtagtggacaagtaggaacatatgggctaaacacgttcacaaatatggaggtgcaattaataagacagatggaatcggagggcatttttctgccttcagaactagaaacacctaacttagccgaaagagctttagattggctagagaagcatggcgccgaacgactaaaaagaatggcaatctcaggagatgattgtgtagtgaaacctatcgacgatagatttgcaacagcactcacagccctaaatgatatgggaaaggttcggaaagacattccgcaatgggagccttcaaaaggatggaatgattggcaacaagtgcctttttgctcccatcacttccaccaacttataatgaaagatggcagagaaatagtagtaccatgccgtaatcaggatgagctggtaggacgggctcgcgtatcacaaggagctggatggtctttgagagaaacagcatgcttagggaaatcgtacgcacagatgtggcaactgatgtactttcatagaagagatttaaggttagccgcaaacgctatatgttcagcggttccggttgattgggtaccagcaagtagaacaacatggtcaattcatgcgcatcatcagtggatgacgactgaggatatgttatcggtatggaatcgagtctggatagaagagaacccatggatggaagacaagacacatgtctcctcgtgggaagaggtgccatatctcggcaaaagggaggaccaatggtgcggaagccttatagggttaacagcgagggcaacgtgggcgacaaacatacaggtagcgataaaccaggttcgtagactaattgggaatgaaaattatcttgattatatgacatcaatgaaacgttttaaaaatgaatccgatcctgagggagctttatggtaa

SEQ ID NO: 21974 - RNA, 9879 nt, synthetic construct
  misc_feature 1..9879: note = derived and/or modified CDS sequence (opt6) from DENV-1__KP188541__SS-prME
  source 1..9879: mol_type = other RNA
agcgtaacaatgcttctcatgcttttgccgactgcattagcttttcacttaacaactagaggaggagaaccccatatgatagtctccaaacaagaaaggggaaaatcactgctttttaaaaccagcgccggggttaatatgtgcacactaatagcaatggacctaggagaattatgtgaagacacaatgacatataaatgccccagaattacagaagcagaaccagatgacgtggattgttggtgtaatgcgacggatacgtgggttacatatggaacttgttcccaaaccggagaacacagaagggagaaaagaagtgtagcgctagcccctcacgtaggcctaggattagaaacgaggacagaaacgtggatgtcaagcgaaggagcatggaaacaaattcaacgggtcgaaacatgggcgttaagacacccagggtttaccgtaattgcgttctttctagcacatgctatcggcacgagcataacacaaaaagggattatttttatccttctcatgctagtcactccatcgatggcaatgcgctgcgttggcattggaaacagagatttcgtagaggggttaagcggtgctacatgggtcgacgttgtacttgaacatggatcgtgcgttaccaccatggctaaaaacaaaccaactctggatatagaattacttaaaacagaagtcactaatccagcagtattaaggaaattatgcatagaggcaaaaataagcaatactacaacggacagccggtgtccgactcaaggagaggcaactttggtagaagaacaagatgcaaattttgtctgcagaagaaccttcgtcgatcgaggatggggcaacggttgtggactgtttggcaaaggttctctacttacgtgcgcaaaattcaaatgcgtcacaaagttagaaggcaaaatagtacaatatgagaatctaaaatacagtgttatcgtgacagtccataccggggaccaacaccaggtggggaatgaaacgacggagcacggaactattgctacaataacaccacaagccccaacaagtgaaatccaattgacagattacggcgccttaacattagattgttctccaagaaccggtctggatttcaacgaaatggttcttctgaccatgaaagagaaatcttggcttgtccataaacaatggttcttagatctccctctcccgtggacaagtggggcgagtacgtctcaagaaacctggaaccggcaggatctgctagtaacatttaagactgcacatgccaagaaacaagaagtcgtggttctgggttcacaagaaggtgcaatgcataccgcactaaccggagctaccgaaatacagaccagtggaaccaccaccatattcgccggtcacttaaaatgtagattaaaaatggacaaactaacactaaaaggaatgtcatatgtaatgtgcacgggcagcttcaaattagaaaaagaagtagcagaaacacaacacggaacggtattggttcaagttaaatatgaaggaactgacgcaccttgtaaaataccattttcgacacaagatgaaaaaggagtgacgcagaatggccgacttattacggctaaccctattgttacggataaagaaaagcccgttaatatcgaaacagaaccgccatttggggaaagctacattgttgtcggggcgggtgagaaagcgctgaagttatcatggtttaagaggggatccagcataggaaaaatgtttgaagcaacagctagaggggcacggaggatggcaatccttggagacacagcctgggactttgggtctataggaggggtatttacaagcgtcggtaagctagtacatcaggtcttcggcaccgcgtacggggttttattttcaggagtttcttggacgatgaagataggaatcggtatcttactgacatggctgggtcttaatagccgctctacatcattaagtatgacatgtatagctgtagggatggtgactttgtatctcggagttatggtacaagctgactctggttgcgtaataaattggaagggacgcgaattaaaatgtggatcaggcatattcgttaccaatgaagtgcacacatggacagaacagtacaaatttcaagccgatagcccaaagaggttaagcgcagctatcggaaaagcatgggaggaaggtgtatgcggaattagatccgcaacaagattggaaaatattatgtggaaacaaatttccaacgaactaaatcatattctacttgaaaacgatatgaagtttacagttgtagtcggagacgccaacggaatattagcacagggcaagaaaatgatccgcccacaaccgatggaacataaatattcttggaaaagctggggaaaagcaaaaataataggtgcagacattcaaaacacaactttcataattgacggtccagacacgcccgaatgcccagacggccaacgagcctggaatatatgggaagttgaagattatggattcggagtattcacaacaaacatctggcttaaattgagggattcatatactcaaatgtgtgatcacaggttaatgtccgctgcaatcaaagacagcaaagccgtacacgctgacatgggttattggatcgaatcagagaaaaatgaaacatggaaattagcacgtgcatcatttattgaggttaaaacttgtacttggcccaaaagtcacacactatggtctaatggtgtattagaatccgagatgattattccaaaaatattcggaggaccgatttctcagcacaattatagaccaggctattttacacaaacagctgggccatggcaccttggtaaactagaattagattttgacttatgtgaaggtacgactgtagtcgtagatgaacactgcggtaatcgcgggccatcactacggacgacaactgtaacgggaaaaatcatacatgaatggtgctgccgaagctgtacgcttcccccattgcgattccgaggggaagacggatgttggtatggcatggaaatccggcccgtcaaggaaaaagaagagaatttggttagaagcatggtcagcgcaggctcaggggaagtcgatagttttagtctaggtatactatgtgtaagcatcatgatcgaagaagttatgcggtcaagatggagccggaaaatgttaatgacaggaacgctagcggtctttttacttctaataatgggacaactgacttggaatgacttaataagattatgtataatggtaggcgctaatgccagtgacagaatgggaatgggtactacatatctggctctaatggctaccttcaaaatgagacctatgtttgccgtcggccttctcttccgtcgtttgacttctagagaagtgctgttattgactatcggccttagtctcgtggctagcgttgaactcccaaattcgctagaagagttaggagatggtctagcaatgggaataatgatgctaaaattattaaccgaatttcaaccccaccaactttggacgactctattaagtctcactttcgtcaaaaccacgctctcattagactatgcatggaaaactacggccatggtcctgtcaattgtaagccttttccctctatgtttatcaactacgtcccaaaagaccacctggttaccagtactcctaggaagttttgggtgtaaaccattaacgatgttctttataacggaaaataagatttggggaagaaaatcttggccattaaatgagggaattatggcaatagggatagtgtctatactattatcctccttgttaaagaatgacgtaccgttggccggaccattgatagcaggagggatgttaattgcatgttatgttatatctggctcctcagccgatctttcgttagagaaagcagcagaggtgtcatgggaacaagaagcagaacatagtggtgcttcccataatatcctagttgaagtccaggacgatggtactatgaagataaaagacgaggaaagagatgacactttaacgatcttactgaaggcaacactactagctgtatctggggtgtacccaatgtctataccagcgacgttgtttgtttggtacttttggcagaagaagaaacaacgttcaggggtgttgtgggatacaccgtcaccaccagaagttgaacgagctgttcttgatgatggtatctacaggattttgcaacgtggattgcttggtcgcagtcaggtaggagttggagtcttccaagatggagtgtttcatactatgtggcacgtgactagaggtgcagtacttatgtatcaaggaaagagactagaaccatcttgggcttctgtaaagaaagatctaatttcttacggtggtggctggcggttccaagggtcttggaacacaggagaggaagtacaagtcatagcagtagaacccgggaaaaaccctaagaacgtccaaacgacaccaggaactttcaagacaccggaaggggaggtaggagccatagccctagactttaaaccagggacctctggaagtcccatcgttaatagagaaggcaagatagttggattatatgggaatggagtcgtaacaacaagtgggacatatgtctcagctatagcccaagcgaaagctagtcaagaaggtcctcttcctgaaatcgagaatgaagtttttaagaaaagaaatttaacaataatggaccttcatcctgggagtggtaagacaagacggtacttgccagccatagttcgagaagcaattaagcgtaagctcagaacattaattctcgctcccacacgagtagtggcctccgagatggccgaagcgcttaagggtatgcctatcaggtaccaaactacagctgtaaagtcagagcatactggaagagaaattgttgatttgatgtgccatgcaacattcacaatgcgccttctctcccccgttagagttccaaactacaacatgataatcatggacgaagcccactttactgatccggccagtatcgcagctaggggatacatatccactcgggtggggatgggagaagctgcagctattttcatgacagccactcctcccggatctgtagaagcgtttcctcaatcaaatgcagtaattcaagatgaagaaagagatatacctgagagatcatggaactcgggttacgattggatcactgacttcccgggtaaaactgtttggttcgtaccgtcaatcaaatcaggtaacgatatagcaaattgcctgaggaaaaatggtaaaagagtgattcaattgtcccgaaagaccttcgatacagaatatcagaaaactaaaaataatgattgggactatgtggtcaccactgatatatcagagatgggagccaattttcgagcagacagggtcatagatccacgacggtgtttaaagcccgttatacttaaagatggacccgaaagggtcatacttgcaggacctatgcccgtaactgtggcgtcagcagcacaacgtcgtggtaggatcggaagaaatcaaaacaaggaaggggatcaatacgtttatatgggtcaaccgttgaataatgatgaagatcatgctcactggactgaagcaaaaatgctattggataatataaacacaccagagggtataattccagcgttgttcgaacctgagagggaaaaatcagctgcaatcgatggagagtatcggctcagaggagaagcaagaaagacgttcgtcgaattaatgagacgtggtgacttacctgtgtggctctcttataaagttgctagtgaaggttttcaatattccgatagaaggtggtgttttgatggggaacgcaataaccaggtgttagaggaaaatatggatgtcgaaatctggacaaaagaaggagaaagaaagaaattaagacctagatggctagatgcaagaacatatagcgatcccctagctctacgagagtttaaagaatttgctgcgggtagacgttcagtatctggtgatttgattctggagataggcaaattaccgcaacacttaactttaagagctcaaaacgcactagataacctagtaatgttacataatagcgaacaaggtggtaaagcataccggcacgcggtagaagaattacccgacacgattgaaacattgatgttattagcattgatagcagtgctaacaggtggagtgactttattctttctcagtgggaaaggcttaggcaaaacgtcaataggtctgctctgtgttacggcctcctcagccctactatggatggcctctgtagaaccacattggatagccgcaagcataatcttagagttcttccttatggtgttgttaataccggagccagatagacagcggactccacaggataatcaattagcgtatgttgtcataggattgttgtttatgatcttaacagtggccgcaaacgaaatgggcctcttagaaacgactaaaaaggatttaggaatagggtacgtagctgccgaaaatcatcaacatgctaccatgctagatgttgaccttcaccccgccagtgcttggaccctctatgcagtagcaacaacggtcataacgcctatgatgagacatacaatagagaacacgaccgcaaatatatccctgacagctatagcaaaccaagcagcaatactcatgggacttgataaaggatggccaatcagtaagatggacataggcgtcccacttttagcacttggctgttactcgcaagtcaatcctttaacacttaccgctgcagtattaatgttagttgcacattatgctattattggccctgggctccaagcgaaagctaccagagaagctcagaaaagaaccgctgctggaataatgaaaaaccctaccgtagacggtattgtagccattgacttagacccagtagtttacgatgcaaagtttgaaaaacaactcgggcaaattatgctgttaattttatgcacctcgcaaattctattaatgagaaccacttgggctctatgtgaatcaatcacactagcgaccggcccattaacaacgctctgggaaggctcaccaggaaaattctggaatactacgattgctgtctctatggcaaatatatttcgaggtagttacttagctggagcaggattggctttcagtctgatgaaatctctcggaggaggacgacgaggtactggtgcacaaggggaaacattaggagaaaagtggaagcgccaattgaaccaactaagcaaatcagagttcaacacatataaaagaagcggtatcatggaagtagataggagtgaggctaaagaagggttaaagcgaggagaaacgaccaaacatgcggtctcccgcggtaccgcaaaactaagatggttcgtagaacgaaatttagtgaagccggaaggtaaggttattgacttgggttgcggccgcgggggatggagctactactgtgctggactaaagaaagtcacagaggttaaagggtacactaaaggcggaccaggacacgaggaacccataccgatggcaacatacggttggaacctagttaaattacattccggtaaagacgtatttttcatgccacccgaaaagtgtgacacactcttgtgtgacataggggaatcttccccaaacccaacgattgaagaggggaggacattgagagttctcaaaatggttgaaccttggttaagagggaatcagttttgtattaagattctcaacccttacatgccaagcgttgtagaaacacttgagcaaatgcagaggaagcacggagggatgctagtacgaaatccactatcccgcaatagcacacacgaaatgtattgggttagttgtggcactggcaatatagtctcagcggtgaatatgacttccaggatgttattaaatagatttacaatggctcatagaaaacctacctatgaaagagatgtagacttaggagccggaacaaggcatgtagctgtagagcctgaggtagctaatttagatataattggccagagaatcgaaaatattaagaatgaacataaaagcacttggcattatgacgaagataatccgtacaagacttgggcataccatggaagctacgaagttaagccctccggctcagctagttcaatggtaaatggtgtggtgcgattattgaccaaaccgtgggacgttataccgatggtcacgcaaatagcaatgacagacacaacacctttcgggcaacaacgagtgtttaaagaaaaagtagacacccgaaccccgagagcgaaacgcggaacaactcaaattatggaagtaactgctaaatggctatggggcttcctcagtagaaataagaaaccccgaatatgcacaagggaagaatttaccaggaaggtaaggtccaacgctgctataggggcggtctttgtagatgaaaatcaatggaactccgcaaaagaggcagtggaagacgagagattttgggacttggttcatcgtgaaagagagcttcataagcagggtaaatgtgcaacatgtgtttataatatgatgggtaaaagagaaaagaaattaggagaatttggaaaagccaaaggaagtcgggctatctggtacatgtggttgggcgcaaggtttttggagttcgaagcgttaggatttatgaatgaagaccattggttttcccgggaaaattcactttccggagtggaaggggaaggattgcataaactgggatatatacttcgggacatttcaaaaatccctggaggtaacatgtacgccgatgatacagcaggatgggatactagaataacagaagacgatttacaaaatgaggctaaaataaccgatataatggaaccagaacatgctttactagctacatcgatattcaaactaacttatcagaacaaagtggttagggtacagagaccagcgaaaaatggaacagtaatggacgtaatttcacgcagagatcaaaggggctccggccaagtcggaacgtacggtctgaatacgtttactaatatggaggtgcaattaatcagacaaatggaatccgagggaatatttttacctagtgaactggaaacacctaatctggctgaacgtgcgttagactggttagaaaaacatggtgccgaacggctaaagcgtatggcgatatccggagacgattgtgtggttaaacctatcgatgacaggtttgcgacagccctcaccgcactaaacgacatgggtaaggttcgcaaagatattccacaatgggagcctagtaagggttggaatgactggcaacaggtgccattttgctctcaccacttccatcaattaataatgaaggatggaagggaaatcgtggtcccctgcagaaatcaagatgaactcgttggtagagcacgagtcagtcagggagctggttggtcgttgagagaaacagcatgtttagggaaaagctatgctcaaatgtggcaactaatgtactttcatcgccgggatctacggttagcggcaaatgcgatctgttcagctgtacccgtggattgggtcccggcctcccgaacaacctggagtatacatgctcaccaccaatggatgacaacagaagatatgctgagtgtatggaatagagtttggatagaggaaaatccgtggatggaagataaaacgcatgtgtcatcttgggaggaagtcccctaccttggtaaacgcgaggaccaatggtgtggatcgttaattggtttgacagcaagagcaacatgggcgactaatattcaagtagcaattaatcaagtccgtcgactaatcggaaatgagaactatcttgattatatgacaagtatgaaacggtttaagaacgaatcagaccctgaaggagccttgtggtaa

SEQ ID NO: 21975 - RNA, 9879 nt, synthetic construct
  misc_feature 1..9879: note = derived and/or modified CDS sequence (opt6) from DENV-1__KP188543__SS-prME
  source 1..9879: mol_type = other RNA
tccgttaccatgttgttgatgctcctacctacagcactagcatttcatctaacaacacgaggaggtgaacctcatatgatagtttcaaaacaagaaagaggaaaatctttattatttaaaacttcagtcggagtcaatatgtgtaccttgatagctatggatctaggcgagttatgtgaagacaccatgacatataaatgccccagaataacagaagttgaaccagacgatgtagattgctggtgtaatgcaacagatacgtgggttacctacggcacatgttctcaaacaggtgaacatagaagagacaaaagatcagtcgcattagcaccgcacgttggactgggcttggaaacgcgcacagaaacatggatgtccagtgaaggggcgtggaaacaaatccaaaaagtagaaacatgggctttgagacacccgggcttcacggtgatcgcattatttttagcccatgcaataggaacatccataactcaaaaagggatcatattcatattattaatgttagtaaccccttcaatggcaatgcgctgcgtaggcattgggaatagggactttgtggaaggcctttctggagcaacttgggttgatgtcgtattagagcatggatcctgtgttaccactatggccaaaaataaaccaacgctggatattgagttgttaaaaacagaagtcactaacccagcagtcctaaggaaactatgcattgaagcgaaaatatcaaacacaactacagatagtagatgtccaacccaaggggaggcaactttggtggaagaacaagatgcaaactttgtgtgtcgtcgtacttttgtagatcgaggctggggaaacgggtgcggactattcggtaaagggtctttgcttacctgcgccaagtttaagtgcgtaaccaaattggaaggaaagattgtacaatatgaaaatttaaagtatagtgtgattgtaaccgtacatacaggtgaccaacatcaagtcggtaatgagaccactgaacatggtactattgccactataacacctcaagctcctactagcgaaattcagctaaccgactatggagcccttacattagattgttctccgagaaccggattagactttaacgaaatggtgttattaactatgaaagagaaaagctggttggtccataaacagtggttcctggatttacctttaccatggacgagcggagcatcgacttcgcaagagacttggaacagacaagatcttttagtcaccttcaagactgcccatgccaagaaacaagaagtcgttgtattagggtcgcaagaaggagcgatgcacacggcgcttacgggagcaaccgaaatccaaacgtcaggtacaacaactatatttgcagggcacctgaagtgccgactaaaaatggataaattgactctaaaaggaatgagctacgtaatgtgtactgggtcttttaaacttgaaaaggaagttgccgagacccaacacggtacggttttagttcaagtgaaatatgaaggaacagatgccccttgtaaaataccatttttgacacaagacgagaaaggagtgacgcagaatggaaggttaataacagcgaatccaatagtcacagataaggaaaaacccgttaacatcgaaacagaaccgccctttggagaaagttacattgtagtaggagctggtgagaaagcactaaaactctcatggttcaagaaaggctccagcataggaaagatgttcgaagccacggccagaggtgcacgcagaatggcaatactaggggatactgcatgggattttggatcaataggtggattgttcacgtccgtgggcaaactaatacatcaggtcttcgggacggcatacggtgttttatttagcggagtatcgtggaccatgaagatcggtataggcatattactcacttggttaggactaaatagtcgaagtacatctctgagtatgacatgcatagctgtcggaatggtaacactatatttaggagttatggtacaagccgactctggatgtgttataaactggaaaggcagggaactaaaatgtgggtctggaatctttgtaaccaatgaggtgcacacctggacagaacagtacaaatttcaggcagactccccaaaaagattatcagcggcaataggcaaggcatgggaagaaggtgtatgtggtataagaagtgcaacaagactagagaacataatgtggaaacagatatctaacgaactaaattatatacttctcgaaaatgacatgaagtttacagtcgtagtgggcgatgtaaacgggatactggctcaaggaaagaaaatgataagacctcaacctatggaacacaaatatagttggaaatcatggggaaaagcaaaaatcattggggctgacattcaaaatacaacattcattatcgatggtcctgacacacccgagtgcccagacgatcaacgagcttggaacatatgggaagtagaagactatggatttggaatttttactacaaatatctggctaaaactcagagactcgcacacccaaatgtgtgatcaccgcctgatgagtgcagcaattaaggattcaaaagcagtgcacgctgatatgggttattggattgaaagcgaaaagaatgaaacgtggaaattggcgagagcatcattcatagaagttaaaacatgcatttggcccaagtcccataccctttggtcaaatggagtgttggagagtgaaatggtaattcccaaaatatatggcggccctatatcacagcataattatagacctggatattttacacaaaccgcaggtccatggcacttaggaaaattggaactagactttgacttgtgtgaagggacaactgtagtagttgatgagcactgtggatatagaggacctagtttgaggaccacaacagtaactgggaagataatccatgaatggtgctgtaggtcatgcactttgcctccgttacgatttaggggtgaagacggctgttggtacggaatggaaatccgacccgtaaaggaaaaagaagagaacttagtacgctctatggtctcggcaggctcaggcgagatggatagtttttccctaggtattctttgtgtgtcgattttgattgaagaagttatgagatcacgatggagtcgtaaaatgctaatgacgggtacactagctgtgttccttttacttatcatgggacagttaacatggaatgacttgataagactatgcataatggttggtgctaatgcctcggataggatgggaatggggacaacctacctcgcgctcatggctaccttcaagatgcggccaatgtttgcagtaggactattatttagaagactaacatccagagaagtcttattattaacagtgggtcttagcttggtcgcatcagtagaactccccaacagtctagaagaattgggcgatggccttgcaatgggaataatgatgttaaagttgctaacagattttcaaccccatcaactatggacaacattattatcattaacctttattagaaccagtttgtcgcttgactacgcctggaaaacaatggcaatggccctatcaatagtctcgctctttccgttatgtctttctacaacttcgcagaaaacaacttggttaccagttctactgggatcttttggatgtaagccattaacaatgttcttaattaccgagaataaaatttgggggagaaagagttggccaataaatgagggaatcatggctgttggaattgttagtatactcttatcatcattacttaagaacgacgtaccattggccggacccttaattgccggtggaatgctcatagcttgttacgtaatctccggttcgagcgccgatctaagtttagaaaaagcagctgaagtctcatgggaggaagaagcagaacactccggaacgtcgcataatatcttagttgaagttcaagacgacgggacgatgaaaataaaggatgaagagagagatgatacactaacaatcctcttaaaagctaccttacttgctgtctctggagtttaccctatgtcaataccagccacattgtttgtttggtatttctggcagaagaagaaacaacgtagtggagtactgtgggacacaccaagtccaccagaagtagaaagagccgttttggatgacggaatatatagaatactccaaaggggcttattgggtcgctcgcaagtaggggtcggagtattccaagatggcgtatttcatacaatgtggcatgtcacacgaggagcagtcctaatgtatcagggaaagagattagagccctcttgggccagcgtgaagaaagacttaatatcgtacggaggaggttggagatttcaaggctcttggaatacaggtgaagaagtacaagtaattgctgtcgagcccggcaaaaatcctaaaaacgtacaaactactccagggacctttaagacaccagaaggcgaggttggagccatagcgctagatttcaaaccaggcacttcaggatcaccaatagtcaacagggaaggaaagattgttggtttgtacggtaatggtgtagtaacaacaagcggtacgtatgtatctgcgattgctcaagcaaaagctactcaagaaggacctctccctgaaatagaggatgaagtattcaaaaagaggaatttaactatcatggatttacatccaggtagcggtaaaacaagacgttatcttccggccatagttagagaagcaataaaaagaaaactcaggacgttgatattagcgcctacacgagtagtagcttcagaaatggcagaggccttaaaaggcatgcctataagataccagacaacagctgtcaagagcgagcatacagggcgagagatagtagacctaatgtgtcatgcgactttcacaatgagactactgtcacctgtaagggtacccaactacaatatgataattatggacgaagcccattttactgacccagcgagcattgcggcgcgaggttatatatcaacaagggtgggtatgggagaagccgcggccatatttatgacagcaacaccacctggctcagtagaagcgtttccgcaatctaatgcagtgatacaagacgaagagagggatataccagagcgatcttggaatagtggttatgattggattactgattttccaggcaaaacagtatggttcgttccctccatcaaaagtggaaatgatatagccaactgccttaggaaaaatggtaaaagagttatacaactaagtagaaaaactttcgacacagaatatcaaaagaccaaaaataatgactgggattatgttgtgacaacagatatttcagaaatgggtgcaaatttcagagcagacagagtcattgatccaagaagatgtttaaaaccagtcatactaaaagagggaccagaaagagtaatattagcgggtccgatgccagttactgtggcaagcgccgcacagagaagagggagaattggacgaaaccaaaacaaagaaggcgaccaatacatctacatgggtcaacccttaaataacgacgaagatcacgcgcattggactgaggctaagatgctgttagataatattaatacacctgaaggtataattccagccttatttgagccagaaagagagaaatcagctgcaattgacggagaataccgactacggggagaagctagaaagaccttcgtcgagcttatgcggaggggagacctcccggtatggctatcgtataaagtagcaagtgagggttttcagtattccgaccgaaggtggtgctttgacggcgagcgaaataaccaggtcttagaggaaaacatggatgtcgagatatggacaaaggagggagaaagaaagaaattgagaccaagatggcttgatgcaaggacatattctgatccgcttgcgttacgggaatttaaagaatttgcagctggaagacgttctgtatcaggagacctgatattggagataggtaaactacctcaacacctaacgctcagggcacaaaacgccctagataatcttgtcatgctacataattctgaacaagggggaaaagcgtacagacacgctatggaagaattaccagacacgatagaaacgttaatgctcctcgccctaatagctgttttgactggtggagtaaccctgttctttctatctggaaagggtttaggtaagacttccataggtctattgtgtgtgatggcgagtagtgctctcttatggatggcgtctgttgaaccacattggatagcagctagcatcattctggagttctttttgatggttctattaataccagaaccggacaggcaacgaacgccacaggacaaccaattggcttatgttgtaataggtttgctgtttatgattcttaccgtagctgcgaacgaaatggggttacttgaaacgacaaagaaagatcttggaatagggcacgtagcagtagaaaaccaccatcacgcaactatgttagacgtggatttgagacccgcgtcagcctggacactgtacgccgttgccacaaccgttattaccccaatgatgcgacatacaattgaaaatacaacggcaaacattagcttaactgctatagctaaccaagcagcaatcctaatgggcttggacaaaggttggccaatatctaagatggacattggtgttccattactggcactaggttgctattcccaagtaaatcctcttacattaacagctgctgtcctgatgcttgtggctcattatgcaattataggacctggcttacaggcaaaagccacgcgagaagcacagaaaagaacagcggctggaattatgaaaaatccgaccgtagacggaatagttacaattgatttagaccccgtagtgtacgatgcgaaattcgaaaaacaattggggcaaattatgttacttatattatgtacctctcaaatcctactcatgagaacaacctgggcgttatgcgaatctataactcttgcaactgggccactcacaacgctctgggagggatccccagggaaattttggaacacaactatagcagtaagcatggcaaacatattcagaggctcatatcttgcaggagcaggactcgcgttttcgcttatgaaaagtttaggcggaggacggagaggtactggggctcaaggggagacattgggcgaaaagtggaaaaggcaattaaaccaattgtccaaaagtgagtttaatacatataagaaatccggcataatggaagtcgacagatctgaggcaaaggaaggattaaaacgaggtgaaacaacaaaacatgcggtatcgagaggaactgccaaattgcgttggttcgtagaaaggaatctggtcaaaccagaaggaaaagtggtggacttgggatgtggaagaggtgggtggtcatattattgtgcaggactaaagaaagttactgaagtaaaagggtacaccaaaggtggaccaggacatgaagaacctattcctatggcaacgtatggatggaacctagtgaaactacatagtgggaaagacgtattctttacgccgccagagaagtgcgatacccttttatgcgacataggggagtcttcccctaatccgacaatagaagagggtcgaacgttgcgtgtgcttaagatggttgagccgtggctgcgaggcaaccaattctgcataaagatcttgaacccgtacatgcctagcgtagtcgaaactctagaacaaatgcaacgtaaacatggaggaatgttagtaaggaatccacttagcaggaatagcacccatgaaatgtactgggtatcttgtggaacagggaatatagtaagcgcagtgaatatgacatcacgtatgttactaaatagatttacgatggcgcatcgaaaacctacgtatgaaagggatgtggatttgggcgcaggaacccgtcacgttgcagttgagccggaagttgcaaatttggatatcatagggcaacgtatagagaacatcaaaaatgaacacaaatcaacctggcactacgacgaggataacccttacaagacatgggcgtatcacggttcttatgaagtcaaacctagcggttccgccagttcaatggtgaatggagtcgttaggttattgactaaaccatgggatgtaatacccatggtaacacagatagccatgactgatactaccccttttggtcaacaaagagtctttaaagaaaaagtagacacacgaacaccaagagcaaaacgtggaaccgcacaaatcatggaagtaaccgctaaatggctgtggggtttccttagtaggaacaaaaagcccagaatatgtacaagagaggagttcaccagaaaagttaggtctaatgctgcaataggagcggtgttcgttgatgaaaaccaatggaactcggctaaagaagcggttgaagatgaaagattttgggacttagttcacagggagagggagttgcataaacaaggaaaatgtgctacctgtgtatacaatatgatgggaaaacgtgagaagaaattaggtgaatttggcaaagctaaaggatccagagcgatttggtatatgtggttaggggcgcgatttttagaatttgaggcgttgggattcatgaatgaagaccattggtttagtagggaaaactcactttcaggtgtagaaggtgagggtttacataaactaggatatatcctacgtgacattagcaaaataccaggaggtaacatgtacgccgatgacactgctgggtgggatactcgtatcacagaagatgatttacaaaatgaagcaaaaataactgatattatggaaccagaacatgcgttattagctacaagtattttcaaattaacatatcaaaataaggttgtacgtgtccaaagaccagcaaaatcaggaacagtcatggacgtaattagcagacgggatcaacgcggaagtggtcaggttggtacatacgggctgaatacattcacgaacatggaagtacagttaattagacagatggaatcagaaggaatctttagtccaagtgaactagaaactccgaatcttgccaagaaagttctggattggctcgaaaaacacggagcggaacggctaaaacggatggcaataagtggggatgactgtgtggtaaaaccaattgacgacagattcgctaccgctctcactgcattgaacgatatggggaaagttcgaaaagacatacctcagtgggaaccctcaaaagggtggaacgattggcaacaagttccattctgttcacatcattttcaccagcttataatgaaggatggcagggagatagtggttccgtgtaggaaccaggatgagttggtaggcagagcacgagtatcacaaggagcaggttggtcgttaagagaaacagcatgcctaggtaaatcatacgcccaaatgtggcaactaatgtacttccatcggagggatttacgtctagcggcgaatgctatatgttctgcggtacctgtagactgggtaccgacatcgagaacaacgtggtcaatccatgcacatcaccaatggatgacgacggaagatatgctatctgtatggaaccgtgtctggattgaagaaaatccctggatggaaaataaaacgcacgtatcgagttgggaagaagttccctatttaggcaaaagggaagaccaatggtgcggatctctaataggacttacagccagagcaacatgggcaactaacattcaggtagctatcaatcaagtcaggagacttattggtaatgaaaattatttggactatatgacctcaatgaagcgtttcaaaaatgagtcagacccagaaggcgccttgtggtga

SEQ ID NO: 21976 - RNA, 9879 nt, synthetic construct
  misc_feature 1..9879: note = derived and/or modified CDS sequence (opt6) from DENV-1__KP188544__SS-prME
  source 1..9879: mol_type = other RNA
tcagtgacaatgctacttatgcttttacctacagcattagcattccacttaactacaaggggaggagaaccacatatgatagtgagtaaacaagaaagaggaaaaagtttattatttaaaacgagtgtgggagtaaatatgtgcactcttatagcaatggacctaggcgaattatgcgaagatactatgacctataaatgtccacgtattactgaggcagaaccagatgacgtcgactgctggtgtaatgcaacagacacttgggttacatacggtacatgtagtcaaacaggtgaacatagaagagataaacgatcagttgcgttagctccacacgtaggtctcggattagaaacaaggacagaaacatggatgtcaagtgaaggcgcatggaaacaaatacaaaaagtggaaacttgggcattacgtcatccgggatttacagtcattgcactctttctagcacatgctataggtacatcaataactcaaaaaggaataatatttatccttctaatgcttgtaacaccaagcatggcgatgagatgtgtcggtatcggaaatcgtgatttcgtcgaaggcttaagtggagcaacctgggtggacgtggtcttagaacatgggtcttgtgtcacaacgatggctaaaaataaacctacactcgatatcgaactactaaaaacagaagtgacaaatccggctgtgttgcgaaaactttgtattgaggcaaaaatctctaatactacaacagatagcagatgtccaacacaaggtgaggcaaccctggtagaagaacaagatgccaactttgtttgcaggcgcacatttgttgacaggggatggggaaatggatgtggtctatttggaaaaggctcacttctaacgtgcgcgaaatttaagtgcgtaactaagttagaaggaaagattgtccaatatgagaatcttaagtattctgttatagtaacagtacacaccggagaccaacaccaagtcggcaatgaaacaacagaacatggaactatcgcgacaattactcctcaagcccctacctccgagatacaactaactgactatggagctcttacattggactgttctccgagaacgggtctcgatttcaacgagatggtactacttacaatgaaagagaaatcgtggttagtccataagcaatggtttttagatttaccactaccctggaccagtggcgcctcaacatcgcaagagacatggaacagacaagatctattggtaactttcaaaactgcacatgcgaaaaagcaagaagtggtagtactaggatctcaagaaggggcaatgcatacagcgctaacaggtgctacagaaatacaaacttctggaacaacaacaatttttgcgggacaccttaaatgcaggctaaaaatggataaattaacattaaaagggatgtcatatgtaatgtgtacaggatcgttcaaattagagaaagaagtggccgaaacacaacacggtactgttctagtccaagtaaaatacgagggaacagacgcaccctgcaaaataccgttcttaacgcaagatgaaaagggtgtgacacaaaatggtcgtttgattactgcgaacccaatagtaacagataaggaaaaaccagtaaacatagaaaccgaaccaccatttggtgaaagttatatagttgtaggagcgggagaaaaagccttaaaactgtcatggtttaaaaagggaagctctattggaaaaatgtttgaagccacagcgcgaggtgctcggcgtatggctatattaggggatacagcatgggattttgggtctataggagggctatttacatctgtaggaaaactaatacatcaagtattcggtacagcgtatggcgtactattttccggtgtgagctggaccatgaaaataggaattggtatattgctaacttggctggggctcaacagcaggtcaacgtcgctttcaatgacttgtattgcggtcgggatggttacattgtacctaggcgtgatggtccaagcggatagcggttgcgtaataaactggaaaggaagagaattaaaatgtgggtctggaatatttgtaaccaacgaagtacatacatggacagagcaatataaatttcaagccgatagtccgaagcgtctatctgccgcaataggtaaggcatgggaagagggagtctgtggtattagatccgcgaccagattagaaaacattatgtggaaacaaatctctaatgagttaaattatatattacttgaaaatgatatgaaatttaccgttgtggtcggagatgtcaacggtatattagctcaagggaagaaaatgataagacctcaacccatggaacataaatattcatggaaatcatggggaaaggcaaaaataatcggtgcggatattcaaaatacaacattcataatagatggacctgataccccagagtgcccggatgaccagagagcatggaatatctgggaagtcgaggattatggattcggcatctttacgactaacatatggttgaagttaagggacagtcacacgcaaatgtgcgatcacaggttaatgtctgcggcgataaaggactctaaagcggttcatgcagacatgggttattggatagaaagcgagaaaaatgagacatggaaactagcaagggcttcatttatagaagttaaaacgtgtatatggcccaaatcacacacgctatggagcaatggtgtacttgaatcagaaatggttatacctaaaatatatgggggtccaatttcacaacataattatcggccagggtacttcactcaaacagctggaccatggcatctcggtaaattggaattagacttcgatctatgcgaaggaaccacagtcgtggttgacgaacattgtgggtacagaggtcctagtttgagaacaacaactgtcactgggaaaataattcacgaatggtgctgtcgatcttgtacgttaccaccattaagattccgaggagaagacggctgctggtatggtatggaaattcgtcctgtaaaagaaaaagaagaaaacctcgtgagatcaatggtctccgcaggctccggcgaagtagacagcttttcactcggtatactctgcgtatccatacttattgaagaagttatgcgatctcgctggagcaggaaaatgctcatgactggtacgcttgctgtgttcttattactaataatgggtcagttaacttggaatgatttaatacgcctttgcattatggtaggtgctaatgcttctgatagaatgggcatgggaactacctacttagcgttaatggctacttttaaaatgcggcctatgtttgcggtaggtttactattcagaagactgacctgtcgagaagtgctcctcttgacagttggtttgagtcttgtggcgtcagtcgaacttcctaatagtctggaagaactaggggacggactcgcaatgggaatcatgatgctaaaacttctcactgatttccaaccacaccagctctggacaacacttcttagcctcactttcataagaacttcactttcacttgattatgcgtggaagaccatggccatggccctcagtatcgtcagcctattcccattgtgcctgtcaacaacgagccagaaaactacctggttacccgtgttactaggttcatttggatgtaaacctttaacaatgtttttaattactgaaaacaagatatggggacgaaaatcatggcctataaacgaagggattatggcagtaggcatagtatcgattcttctctcatccctactgaagaacgatgttccattagctggccctttaatagccggaggcatgttaatagcatgctacgtcatttcaggatcttccgcagacttatcactcgaaaaagctgcggaagtgagttgggaagaagaagccgagcattcggggactagccataacattttagtagaagtacaagacgacggaacaatgaagatcaaagatgaagaaagagacgatacgcttactatcctactaaaagctaccttattggcagtgtccggtgtatatccaatgtctattcctgccactttatttgtgtggtatttttggcagaagaagaaacagagaagcggagtactatgggatactccaagtccacccgaggtagagcgagcagtactcgatgatggcatatatcggattctacagagaggattactaggacgcagccaagttggtgtcggcgtatttcaggatggagtattccacactatgtggcatgtaaccagaggtgcagtattaatgcatcaaggcaaaaggctggaacctagctgggctagcgtgaagaaagatcttatctcttatgggggcggatggcgatttcaaggcagttggaatactggagaagaagtccaagtaatagctgtcgaaccaggtaaaaaccctaaaaatgttcaaaccaccccaggaacattcaaaactccagaaggtgaggttggagctattgctctagattttaaacccggtacgtcagggagtcctattgtaaatagggaaggtaaaatagtagggttatatggtaacggagttgtcaccacatcgggcacatatgtttcggctattgcccaggctaaagcaacacaggaaggtccgctcccagaaattgaagacgaagtgttcaagaaacgaaacctgactatcatggatttgcatcccggtagcggtaaaactagaagataccttcccgcaatagtcagggaagccattaaaagaaaattacgcacattgatactcgcgcccactagagttgttgcttcagaaatggctgaggcactcaaaggtatgcctatcagatatcaaaccacagctgtcaaaagtgaacataccggaagagagatagttgacttaatgtgccatgcaacattcactatgagactactttcgccggtacgtgttccaaactataacatgataatcatggacgaagcgcactttacagatccagcatcaattgcagcaagagggtatattagcacacgagtaggaatgggggaagcggcagctatatttatgactgcaacacctccaggctctgtcgaagcatttcctcagagtaatgccgtcatacaagacgaagaaagagacatccccgagaggagttggaactcaggatacgattggattacagatttccctggtaaaacggtctggtttgtaccgagtataaagagcgggaacgatatagcaaactgcttaaggaaaaatggtaaaagagtcatacagctcagcagaaagacatttgacactgaatatcagaaaacgaagaacaacgattgggactacgtcgttaccacggatataagcgaaatgggtgcgaacttccgggcagaccgtgtaatagatccgagacgatgcttaaaacccgtaatattaaaagaagggcccgaaagggtaatattagcaggtccaatgccagttacagtagcatccgcagctcaaaggcgcggccgcattggcagaaatcaaaacaaagaaggagatcagtatatatatatgggtcaacccctaaataatgatgaagatcacgcacattggaccgaagcgaagatgctacttgacaatataaatacccccgagggtataattcctgcgttattcgagcccgagagagagaaaagcgcagcaatagatggggaatatagactaagaggggaagctcgaaaaacgtttgtagaacttatgagaaggggagaccttccagtatggttatcctacaaagttgcatccgagggttttcaatattcggacaggaggtggtgctttgatggggaacgaaataatcaagtactagaagaaaacatggacgtcgagatatggacaaaagaaggagagaggaaaaagctcagacccagatggttagatgctagaacttactccgatcctctagcactgagagaatttaaagagtttgccgctggccgaagatcagtctcaggagacctcattttagagatagggaaattaccacaacatctaaccctacgagcacaaaacgcactcgacaatctagtaatgttacataacagtgaacaaggaggcaaggcttaccgacatgcaatggaagaattaccagacacaatcgagacattaatgctattagcgcttattgcagtgttgacaggaggagtcacactatttttcttatcgggtaaaggtctaggaaaaacttctataggactcttatgtgtaatggctagcagtgcattattatggatggcgagtgtggaaccacattggatagcggcctcgattatactcgagttctttctcatggttctgttaataccagaaccggatagacaaagaacccctcaagacaaccaattggcttacgttgttataggacttttatttatgatcttgacagtagccgctaatgaaatgggcttactagaaacaacaaagaaagaccttggtataggacatgtagccgtggaaaaccatcaccacgcaacgatgcttgacgtagatctaaggccagcatccgcctggacgttatatgctgtcgccacgactgttataaccccaatgatgcggcacacaatagaaaataccacagcaaacataagtcttacagctattgctaaccaggctgccatattgatgggcttagataaaggatggccaatatcgaaaatggatattggtgtacctttgctagcgcttggatgctattcacaagtaaaccccctgacattaacagcggcggtattaatgctagtagcacactacgcaataatagggccaggactacaggcaaaggccacacgagaggcccagaaaaggaccgcagccggtataatgaaaaacccaacggtggacggaatagtgactattgatttggacccagtagtatatgacgcaaaatttgagaagcagttaggacaaattatgttactgatcttgtgcacaagccaaatactactaatgcggaccacctgggcattatgtgaaagtataactctggctaccggtccgctcactactttatgggaaggatcaccaggaaaattttggaataccactatagctgtcagtatggccaacatattcaggggaagctatcttgccggtgctggcttagcattcagtttaatgaagtcactagggggcggccggcgtggtacgggggcgcaaggggaaacactaggagaaaaatggaaacgacaattaaaccagttgagtaagtcagaatttaatacttacaaaaagagtggaataatggaagtagaccgatcagaagcaaaagaaggacttaaaagaggggaaacaacaaaacacgcggtctcgagagggacagcgaaattaagatggttcgtagaaaggaatttggttaaaccagagggaaaagtgattgacctgggctgcggcagagggggttggtcatattattgcgccgggttaaagaaagtcacggaagtaaaaggctacacaaaaggcggaccaggacacgaggaacctatcccaatggccacttatgggtggaatttagtcaaactccacagtggaaaagatgtattctttactccgccggaaaaatgcgacacactattatgtgacattggagagagttccccgaaccctactattgaagaaggccgtaccctcagggtactaaaaatggtggagccctggctcagagggaaccaattttgtataaaaatactaaacccatatatgccgtcagtagtcgaaacgttggaacaaatgcaaaggaagcatggtgggatgttggtcagaaaccctttgtccagaaatagtacacacgaaatgtactgggtatcatgcggtaccggtaatattgtgagcgcagtcaatatgacatcgcggatgcttctaaatcgtttcacgatggcacacagaaaacccacctatgaacgagatgtggacttgggtgcgggtacccgacatgtggcagtcgaaccagaagtagccaacttagatattataggtcaacgaatcgaaaacatcaaaaatgagcataaaagcacttggcatcatgacgaggacaatccatacaaaacatgggcatatcatgggagctacgaagtgaaacccagtggtagtgccagttcaatggtcaatggagtagtgcgacttctaactaagccatgggatgtcattccaatggttacacagatagcaatgactgatactactccgtttggccaacagcgagtcttcaaagaaaaagtggatacaagaactcctcgagcaaaaagggggacagcccaaataatggaagtaacggcgaagtggctctggggtttcctatctagaaataagaaacctagaatatgtacacgagaagagtttaccaggaaggttagatctaacgccgctataggtgcagtatttgtagatgaaaatcagtggaactcagcaaaagaagctgtcgaagatgaaagattttgggatttagtgcatagggaaagggaactacataaacagggtaagtgtgcaacatgcgtatacaacatgatgggtaaaagagagaagaaattgggggagttcggaaaagctaaaggatctagggcaatatggtacatgtggctaggagcgaggtttttagagtttgaagctcttggcttcatgaacgaagatcattggttctcacgagaaaacagtcttagcggagtagaaggagaaggcttgcacaaattggggtacatccttagggacatatctaaaataccgggaggaaatatgtacgcagacgacacagctggttgggatactagaataacagaggatgatttacaaaatgaagcgaaaatcactgatataatggaaccagaacatgcattactcgcgacttctatatttaaactcacatatcaaaacaaagtggtaagggtccaaagacccgccaaatctggaacagtaatggatgtaatttctcgtagagatcaaagaggatctggtcaggtcgggacatatggcctcaacactttcacgaacatggaagtacaattaattcgacagatggaatctgagggaatatttagtccgtccgaattagaaacgcccaacttagccaagaaagtgctagactggcttgaaaaacatggagcagaaagattaaaacgtatggctatctctggtgacgattgcgtagtaaaacctattgatgataggtttgcaaccgctttaacggctcttaatgatatgggaaaggtacgtaaagatataccacaatgggaaccaagcaaaggttggaacgactggcagcaagttcccttttgtagccatcattttcatcaattaattatgaaagatgggagggaaatagtagtaccttgccgtaatcaggacgaattagtagggcgtgctagagtttcacaaggagccgggtggtcattacgagaaactgcatgcctcggaaagtcatacgcgcaaatgtggcaactgatgtatttccatcggagagatttaagattagcggcaaatgcaatatgttccgcagtacctgtggactgggtccctacatcacggacaacgtggagtatccacgcacaccatcagtggatgaccacagaagacatgctgagcgtctggaatcgagtgtggattgaagaaaacccgtggatggaggataaaactcatgtcagttcttgggaggaagtgccatatttaggcaaaagagaagaccagtggtgcggatccctaatagggttgacagcaagggcaacttgggcaacaaacatacaggtggctataaatcaagtacgacgattaattggtaacgaaaactaccttgattacatgacatccatgaagcgatttaaaaacgaatcggacccagaaggagcattatggtag

SEQ ID NO: 21977 - RNA, 9879 nt, synthetic construct
  misc_feature 1..9879: note = derived and/or modified CDS sequence (opt6) from DENV-1__KP188547__SS-prME
  source 1..9879: mol_type = other RNA
tcagttacaatgctgctaatgttattacccacagcactcgcttttcaccttacgactagaggaggggaaccgcacatgattgtttctaaacaagaaagaggaaaatcattactttttaaaacttcagtaggagtgaatatgtgtacactaatcgctatggacctcggggaactatgcgaagacacgatgacttacaaatgcccaaggataacagaagcagaacccgatgatgtcgattgttggtgtaacgcgactgacacgtgggtcacttatggaacatgttcgcaaacgggagaacatcgccgagataaacggtcggtggctttagctccccatgttggtctaggtctagaaacaagaacagaaacttggatgagttcagaaggtgcatggaaacaaatccaaaaagtggaaacttgggcgttacggcacccaggttttactgttatcgcattattccttgcacatgcaataggaacgagcataacacaaaaaggaattattttcattttattaatgcttgtcaccccgagcatggctatgagatgtgtgggtatcggaaatcgagactttgttgaaggcctctcaggcgcaacttgggtagacgtggtgttggaacatggaagttgcgtaactacgatggcgaaaaataaacctacactcgacatagaattgttaaaaaccgaagtgacaaatcccgcaattttacgtaaattatgcattgaagccaaaatatcaaatactacaactgatagccgatgtccaacacaaggtgaagcgaccttagtcgaggaacaagatgcaaattttgtctgtaggcgtacattcgttgatagaggatgggggaacgggtgcggattgtttgggaaaggaagtctactgacatgtgctaaatttaaatgtgtgaccaaactggaaggcaaaatagtacaatacgagaatctgaaatactcagttatagttactgtccatacaggcgatcaacaccaagtagggaacgaaacgacagaacacggaacaattgctacaatcactccgcaagctccgacttctgagatacaattaacagattatggagcattaactctggattgtagcccaagaacaggcttagacttcaatgaaatggtattactaacaatgaaagaaaaatcatggttagtgcataaacaatggtttctggatttaccactaccctggacgagcggtgcaagtacttctcaggaaacatggaataggcaggatttattagtcacattcaaaactgcacatgccaagaaacaagaagttgtagtgctaggttctcaggaaggagccatgcatactgcattaacaggagcgacagagatacaaacatcaggtacaaccacgatttttgcaggacacttaaaatgtaggctcaagatggacaaattaacgttaaaaggtatgagttatgtcatgtgtacagggtcattcaaattagaaaaagaagtcgcagagacgcaacatggtaccgtactcgttcaggtcaaatacgaaggtactgacgctccttgcaaaataccattcttgactcaggatgaaaaaggagtaacacaaaatggtcgccttattactgcgaacccaatagttacagacaaggaaaaacctgtgaacattgagaccgaaccgccatttggtgagtcatatattgtggtaggcgctggcgaaaaagctctaaaactaagttggtttaagaaaggaagctccataggtaaaatgtttgaagctacagcccgtggagctcgtcgtatggcaattttgggagacacagcttgggattttggttccattggtggcttatttacaagtgtcggaaaactgattcatcaagtttttggcactgcatacggagtactattctccggagtgtcatggacaatgaagataggcattggaatactattaacatggctaggtttgaatagcaggtcgacatcgctatcaatgacatgcatagcggtgggcatggtgactttatatttgggagtaatggtgcaagcagatagtggatgcgtcattaattggaaaggtagggaactaaagtgcggaagcggaatatttgtgacaaatgaagtacatacgtggactgagcagtataaatttcaggcagatagtcccaaaagactgtcagccgcaattggtaaagcatgggaagagggagtctgcggcattcgatctgccacacgtctagaaaatataatgtggaagcagatttctaatgagttgaattatatcttactagagaacgacatgaaatttacagtggttgttggtgacgtaaatgggatacttgcacaaggaaagaaaatgattaaaccgcaacctatggaacataaatattcatggaaaagttggggtaaggccaaaataataggagcagacatccaaaacactacattcattatcgatgggcctgatacgcccgagtgccccgacgatcaaagggcatggaatatatgggaagtagaagattatggattcggcatatttactacaaatatctggctaaaattacgagattcgcacacacaaatgtgtgatcatagactaatgagcgccgcgataaaagattccaaagcagtacatgctgatatgggttattggatagaaagtgagaaaaatgaaacttggaaacttgctcgagccagtttcattgaagtaaagacatgcatatggcccaagtcacatactttgtggtcgaacggagtgcttgaaagtgagatggtgattcctaaaatatacggaggcccaatatcacagcacaattatcgccccggatattttacccaaacagctggtccatggcatctaggaaaattggagttggattttgatttatgtgaggggacaacggtagtagttgacgaacattgtggataccgaggtccgtcactacgcacaactacggtaacaggtaaaataatacacgaatggtgttgtagatcatgtacactcccaccattaaggtttcgtggtgaagacggatgttggtatgggatggaaataagacctgtcaaagaaaaagaagagaatcttgttcgcagcatggtttctgcaggaagtggagaagtcgattcattttctttggggatcttatgtgtctctatactcattgaagaagtgatgagaagtcgatggtccagaaaaatgttaatgactggaacactagccgttttcttgttactaataatggggcaacttacttggaatgatttgataagattatgtataatggtcggcgccaatgcgctagacagaatgggaatgggtacaacctatttagctttaatggctactttcaagatgagaccgatgttcgctgtgggattactgttccgaagactaacatctcgagaagttctattgttaacagttggcttaagccttgtcgcctcagttgagcttccgtcgagtttggaagaactaggtgacggtcttgctatgggaattatgatgttaaaattattaacagactttcaaccacatcaattatggacaacacttttatctttaacatttataaggacgagcctttcgttagattatgcatggaagacaatggcaatggcattatcgattgtttcgctctttccgttatgtcttagtacgacatctcagaaaactacttggctcccggtgttgttaggatcttttgggtgtaaaccgcttaccatgtttctaataaccgagaataagatatggggtaggaaatcttggccgattaatgagggaattatggcagttgggatagtgtcaatattgttgagtagcttgctcaaaaatgacgttccgctagcaggcccattgatagcaggagggatgctaatagcatgttatgtaatatccggtagctctgcagacctttcactcgaaaaagctgccgaagtctcatgggaggaagaagcagaacacagcggaacttcacataatatcttagtagaggtccaagacgatgggaccatgaaaattaaagacgaagaaagagacgacacactaacgatcctactaaaagcgaccttattagcagtgagcggtgtctacccaatgagcataccggcaacgttgtttgtttggtacttttggcaaaagaagaaacaacgaagcggtgttttgtgggacaccccatcacctccggaagtagagagagcggtgctagatgatggcatatatcggatcctacaaagaggattactaggccgttcacaagtcggggtaggtgtcttccaagatggggtttttcatacaatgtggcatgtcacgagaggggcagtactcatgtaccaaggtaagcgtctagaaccttcctgggcgtcagttaagaaagacttaatatcatatggtggtggttggcgatttcagggatcttggaacacaggcgaagaggtccaagtcattgctgtagaacccggcaaaaaccccaaaaacgtacaaacaacaccaggcacctttaaaacgccagaaggtgaggttggagccattgcgctggacttcaaacccggaacttcgggatcgccaatagtaaacagagaaggaaaaatagttggcttgtatggaaatggagtagtaacaacaagtggtacgtatgtgagcgccattgctcaagcaaaagcaacacaagaagggacattgcctgagatagaagatgaagtatttaaaaagcgcaatttgacaatcatggacttacatccagggtctggcaaaacacgaagatacttgccagctattgttagagaggcaataaagcgaaagttacgaacactaattcttgcgcccacacgagtagtagccagcgaaatggcggaagcattaaaagggatgcccattagatatcaaacaaccgcagttaaatctgagcatactgggagggaaatagttgatctaatgtgccatgcaacattcactatgcgtttgctatcacccgtaagagtacctaattacaacatgataataatggatgaagcccactttacagatcccgcctcaattgctgctagagggtatatatcaaccagagtcggaatgggggaagctgcagccatctttatgaccgctactccacccggctcagtcgaagcatttcctcagtcaaatgcagttatacaagatgaggaacgggatatacctgaaagatcatggaatagtggatatgattggataaccgactttccgggcaaaacagtctggtttgtaccttcaataaaatccggcaatgacattgcaaattgtctaaggaaaaatggcaaaagagttatccaattaagtagaaagacctttgacacagaataccagaaaacaaagaacaatgattgggactacgtcgtaacaactgatatctccgaaatgggagctaactttcgagctgacagggtcattgatcctaggaggtgtctaaaaccagttattctcaaggaaggtcctgagagagtgatattagctggacctatgccagtaacagtagcctcagcagctcaacgtcgaggtaggataggtcgcaaccagaacaaagaaggcgaccaatatatatacatgggccaaccactaaacaatgacgaagatcatgcccattggacagaagcgaaaatgctactggataacatcaatacaccagaaggaataattcctgctttgttcgaacctgaaagagagaaaagcgcagcaattgatggagagtataggttgcgaggagaagcccgaaaaacatttgtagaattaatgagaaggggagatctccctgtttggttgtcatataaggttgcttccgagggatttcaatacagcgataggcgatggtgttttgatggggaaagaaacaatcaagtactggaggagaacatggacgtagaaatatggacaaaggaaggcgagcgtaagaaattgcgaccccgttggttagatgcaagaacttattctgacccccttgccctccgcgagttcaaagaatttgcagccggtcgacggtccgtctccggcgacttgatattagaaataggtaagctaccacaacaccttaccctccgcgctcagaatgcactcgacaatttagttatgttacacaattcggagcagggagggaaggcttatagacatgcaatggaagaactacctgatacgatcgaaacactaatgttattagcgttaattgcagtattaactggaggagtaaccctatttttcttgtctggcaagggactcgggaaaactagcataggtctcttatgcgtgatggcctcatccgcgttgctgtggatggcttccgtggaacctcactggattgcagccagtataattttagagttcttcctaatggtcttattaatcccagaacccgataggcaaagaacacctcaggataatcagctagcgtatgtggtaattggactgctatttatgatactaactgtagctgcaaacgaaatgggtctgcttgagacaaccaagaaagacttagggataggtcatgtagctgttgaaaatcatcatcacgcgacgatgttagatgtggatctaaggccagcgtcagcgtggacactctatgcagtggccactactgtcattactcccatgatgaggcatacaatagaaaatacgactgcaaacattagtttgaccgctatagcgaatcaggcagctatcctaatgggactcgacaaaggatggcctataagcaaaatggacataggagtacctttattagcccttggctgttatagccaagtaaatcctctgaccttaactgcagcagtcctaatgttagttgctcactatgccataatcggtccgggtttacaagcaaaggcaacaagagaagctcaaaagcgaaccgcggcaggaataatgaaaaaccccaccgtcgatggcatagtaacaattgacttagatcctgtagtgtatgatgctaaatttgagaaacaacttgggcaaataatgcttttaatactgtgtacgagtcaaattctactaatgcggacaacttgggcactgtgcgaatcaataactttggctacggggcccctaacgaccctttgggagggatcaccaggaaaattttggaacaccacaatagcggtaagtatggctaatatattccgtggatcttatctagctggagcaggcctagcatttagtcttatgaagtcactaggaggaggtagaagagggaccggagcacagggagaaacactgggggaaaaatggaaacgtcaactaaaccaattaagtaaatctgaatttaatacatacaagaaaagtggtataatggaggtagatagatcagaagctaaggaaggattaaaaagaggagaaacaactaaacatgccgtaagccgtggaactgcgaaactccgttggtttgtcgagcgcaatttagtaaaaccagaaggaaaagttatagacttaggatgtggaagaggcggctggagttactattgcgctggactaaagaaagtcacagaagtaaaaggatacacgaaaggagggcctggacatgaagaaccaattccgatggcaacgtatggttggaatctggtaaaacttcacagtggaaaagacgtatttttcactccacctgagaaatgtgacactttattatgcgacataggagaatctagtcccaaccctacaatcgaggaaggtaggacgctaagagtattaaaaatggttgaaccctggctgagagggaaccaattttgtataaaaatcctaaatccgtacatgcctagtgtcgtcgagactctcgaacaaatgcaacggaaacatggcggaatgctagtacgtaatcctttatcacgaaactcgacgcatgagatgtattgggtttcttgcggcactggtaatatagtgtcagcggtaaatatgacaagtagaatgttgttgaatagatttactatggcacaccgtaagcccacttatgaaagggacgttgatttaggagctgggaccaggcacgtagctgttgaaccagaggtagcgaacctcgacataattggacagcggatcgaaaatattaaaaatgaacataagagtacatggcattatgatgaagacaatccctataagacatgggcctatcacgggtcatacgaggtgaaacccagcggaagtgctagctctatggtaaatggagtagtacgtctgttaaccaaaccctgggacgtaataccaatggttactcaaattgctatgaccgatacaacaccattcgggcaacagcgagtttttaaagaaaaagtcgatacaaggaccccacgcgccaaacgaggaactgcacaaataatggaggtaacagcaaaatggctttgggggtttctaagcagaaacaagaaaccacgtatatgtacacgtgaagagttcacaaggaaagtgagaagtaatgccgccataggtgccgtttttgtcgacgaaaatcaatggaactctgctaaggaagcggtggaagacgaaaggttctgggatcttgtacatcgagaaagagagttacataaacagggaaaatgtgccacatgcgtatataatatgatgggcaagcgtgaaaagaaacttggtgagttcggcaaagcgaagggatcacgggcaatttggtatatgtggctaggagctcgattcctagagttcgaagcacttgggtttatgaatgaggaccattggttcagtagagaaaatagtttaagtggagtcgaaggagagggacttcacaaactagggtacattttacgtgacatctccaaaataccagggggtaacatgtatgcagacgatactgctggatgggatactagaataacagaagatgacttacagaatgaagccaaaatcacagacataatggagccagaacacgccttattagctaccagtatatttaagctcacataccaaaacaaagtggtgcgcgtccaacgaccggcgaaatcaggtaccgtaatggacgtaatttcacgaagagatcaaagaggaagtggacaagtcggaacctacggactaaacacctttactaatatggaagtacaattaattcgacaaatggagagcgaaggtatattttcaccatccgaactagaaacgccaaatttagcgaagaaagttctagattggttagaaaagcacggcgctgaaagattgaagagaatggcaatatcgggtgacgactgtgtcgtaaaacctatagatgaccgatttgcgacagccttgacagcgttaaatgatatgggaaaggttaggaaagatattcctcagtgggaaccttcgaaaggatggaacgactggcagcaggtaccattttgttcccatcacttccatcaattaatcatgaaagacgggagagaaatagtggtaccatgccgtaaccaagatgaacttgtcggaagggcaagagtatcacaaggagcaggttggagcttaagggaaaccgcctgtttgggtaaatcatatgcacaaatgtggcaactaatgtacttccatcgtcgagatctcagactagcagcgaatgctatctgctcagccgtacccgtagactgggtccctacatccagaactacctggagcattcacgcgcatcaccagtggatgacgactgaagatatgttgagtgtgtggaaccgtgtatggattgaggaaaatccttggatggaagacaaaacacatgtatcctcgtgggaagaagttccataccttgggaaaagagaagatcaatggtgcggctcacttatagggttgacggcaagagctacctgggcaactaatatccaagtagccataaaccaagttagaagattaatcggtaacgaaaattatttagattatatgacctcgatgaaacggttcaagaatgaatctgatccagaaggagctctctggtga

SEQ ID NO: 21978 - RNA, 9879 nt, synthetic construct
  misc_feature 1..9879: note = derived and/or modified CDS sequence (opt6) from DENV-1__KP723473__SS-prME
  source 1..9879: mol_type = other RNA
tccgtaacaatgcttctaatgttgttgccgactgcacttgcattccatctgacgacacgaggtggagaacctcatatgatagtaagtaaacaagaaaggggcaaatcattattatttaaaacgagcgcgggggtaaacatgtgtaccttaatagccatggacttaggtgaactgtgcgaagatacaatgacttataaatgtccgagaattaccgaagctgaacccgatgatgttgattgctggtgtaacgctactgatacttgggtgacttacggaacctgctcacaaacaggtgaacacagacgagacaaaaggagtgtagcattagccccgcatgtgggattaggtctggaaacaagaacagaaacttggatgtctagcgaaggtgcctggcgacagatacaaaaagttgagacatgggcactgcggcacccagggtttacagtaatagcactatttctagcgcatgcgattggtaccagcattactcagaaagggattattttcatacttttaatgctagttacgcctagtatggccatgagatgtgtaggtatcggcaatagagatttcgtggaaggactttctggcgcgacatgggtagacgtcgtgctagagcatggatcatgcgtaacgactatggctaaaaataaacccaccttggatatagagttacttaaaacagaagttacgaacccagcagtacttcgaaaattatgcatagaagcaaaaataagtaataccacaacggacagtcgttgcccaacccaaggtgaagctacattagttgaagaacaagatgcaaatttcgtatgccggcgtacatttgtagatagggggtggggcaatggttgtggattattcggaaaaggttcattgctcacttgtgcaaaatttaaatgcgtaacaaaattagaagggaaaatcgttcagtatgagaatctgaaatactccgtgatcgttactgtacatacgggtgaccaacaccaggttggaaacgagacaacagagcacggaacaatagcaaccatcactccacaagcaccaacaagtgaaattcaactaaccgattacggggcattgacactagactgctctccccgaaccggcttggactttaatgaaatggtacttctgactatgaaagagaaaagttggctagtccataaacaatggtttcttgatctaccgctgccatggacgtcaggcgcaagtacaagccaagaaacctggaaccgccaggatctgcttgtaacttttaaaacagctcatgctaagaaacaggaagttgtcgtacttggcagccaggagggtgcaatgcatacagcacttacaggagcgacagagatccaaacctccggcacgactacgatattcgctggtcacttgaaatgcaggctaaaaatggataaactcacactcaaaggtgtttcatatgttatgtgcacaggttcctttaaattagaaaaagaagtggcagaaacacagcatggcacggttttagtacaagtgaaatacgaagggactgacgctccctgcaaaataccgattagtacccaagatgagaaaggcgtgacccaaaatgggagactcataacagcaaatccaattgtaaccgataaagagaaacctgttaacatagaaacagagccccctttcggcgaatcctacattgtaattggagctggcgaaaaagcattaaaactatcatggtttaagaaaggatcttcaataggtaaaatgtttgaggcgactgctagaggagcacgtcgcatggctattttaggcgacaccgcttgggatttcggatcaatcggaggcgtctttacaagcgtaggcaagctagtgcatcaggtttttggaacggcatacggagttctgttcagcggagtctcatggacaatgaaaatcggtattgggatattgttaacctggttgggtctgaatagtcgaagtacttcattatccatgacatgcattgcagtaggaatggtaactttatatctgggcgtcatggtgcaggctgacagtgggtgcgtaatcaattggaaaggccgagaattgaaatgcggttcgggaatatttgtaaccaatgaagttcatacttggacagaacaatacaaattccaggcagattcaccaaagcgtctaagtgcagcaataggtaaagcatgggaggaaggtgtgtgtggtatccgctcagctactaggctagaaaatataatgtggaaacaaatttcgaatgaattaaaccatattttattagaaaacgatatgaaattcacagtggtagtcggggatgctaatggtattttaacccaaggtaagaaaatgatacgacctcaaccaatggagcacaaatattcttggaaaagctggggaaaagccaaaataattggcgccgacactcaaaacacgacgtttattatagatggtccagatactccagagtgcccagacgatcaaagagcctggaacatatgggaagtggaggactatggattcggagtctttaccacaaacatttggctaaaactaagagattcatatactcagatgtgcgatcatagattaatgtccgccgcaataaaagatagcaaagctgttcatgcggatatgggttactggatagaaagtgagaaaaatgagacgtggaaactagcaagagcatcatttatagaagtaaagacttgcatttggccgcgcagtcatacgctatggagcaatggggtacttgagtcagaaatgattatacctaaaatttatggcggtccaatctctcaacataattaccgtcccggatacttcactcaaacggccggtccttggcacctaggaaaattagaattagattttaatttatgcgaaggtacaacggtagttgtagatgaacattgcggtaaccgtgggccaagccttaggactacaactgtaacaggaaagataatacacgagtggtgctgcagaagctgcacactacctccattaagattccgaggggaagatgggtgctggtatggtatggaaattcgaccagtaaaagaaaaagaagagaaccttgtcagaagcatggtcagtgccggatcaggagaagttgattcattctcattggggttgctctgcgtaagcataatgatagaagaggtgatgcgatctagatggagtagaaaaatgttaatgactggtactttggctgtattcttcctactaattatgggtcaactcacatggaatgatttaataagactttgtatcatggtgggagcaaatgttagcgacagaatgggaatgggtacgacttacctggcgctaatggcaacgtttaaaatgagaccaatgtttgcagtaggattactctttagacgacttactagccgagaggtattattattaacgataggcttgtcactggtggcctctgttgaattacctaattctttagaagaactaggcgacggattagccatgggaataatgatgttaaaattgttaactgatttccagtcacaccaactatggacgacactactatcattaactttcatcaaaacgacactgtctttagactatgcttggaaaaccatggcaatggttctatcgatagtttcactattccctctttgcctgtcgactacttcccagaaaacgacctggcttcctgtattattaggaagtttcggctgcaaacctctaacgatgttcctcatcacagaaaacaaaatctggggacgaaagtcctggcctctaaatgagggaatcatggcagtaggaattgtaagtattctgctaagctccttactcaagaacgacgtccctttggctggcccattaatagcaggaggtatgctaatagcatgttacgtaatttcgggttcatctgctgatcttagtttggagagggcagccgaagtaagttgggaagaggaagctgagcattcgggcgcatcgcacaatatattggtagaagtccaggacgatggtaccatgaaaatcaaagatgaggaacgcgatgatacattgaccattcttttaaaagcaacgctccttgccgtctcgggcgtatatcctatgtcaataccggccacattgttcgtatggtatttctggcagaagaagaaacagcgatctggtgtactatgggatacaccaagtcccccagaggtcgaaagagcggtgttagatgatggtatatacaggattttacaaagaggattgttgggccgtagccaagtcggcgtaggagtattccaggacggtgtattccatacaatgtggcacgtgacaagaggcgctgttttgatgtatcaagggaagagactggaaccatcttgggcttcggtaaagaaagatttaatatcatatgggggagggtggagattccaaggttcatggaatacgggtgaagaggttcaggtcatcgcagtcgaaccgggtaaaaatccaaagaacgtgcagacaacgccggggacatttaaaacgcctgagggtgaagtaggagcaatagcattagactttaaacccggaacatcaggaagtcccatcgtgaatcgagaaggtaaaatcgtgggtctatatggtaacggcgtagtaactacgtcaggaacatacgtctcagccatcgcgcaagcaaaggcctctcaagaaggccctttaccagagattgaagatgaagtatttaagaaaaggaacctaacgataatggacctgcatccagggagcggcaagactagacgttacttacccgcaatagtgagagaagcaataaagaggaaattacgaacgcttattttggccccaaccagagtagtcgcttcagagatggcggaggctctaaaaggaatgcctataagatatcaaacaacagctgtcaaaagcgaacatacagggaaagagatagttgatttgatgtgtcacgcaacattcaccatgagactattaagtccggtgagggtgcccaattacaacatgataataatggacgaagcacatttcacagacccggcttcgatcgctgcgagaggctacataagcacgcgcgttgggatgggtgaggccgcagccatctttatgacagcaacgccccctggtagcgtggaagcatttccacaaagcaacgcggttatccaagacgaagaacgagatataccggaacgatcgtggaactcaggttatgattggatcactgacttcccgggtaaaacagtatggtttgtcccaagcataaaaagtggtaatgatatagcaaattgtctaagaaagaacggaaaacgagtgatccagttaagcaggaaaacgttcgataccgaatatcagaaaaccaaaaataatgattgggattatgtagtaactacggatatctcagaaatgggagcgaatttccgcgcagatcgtgtaatagatccacgcagatgtttaaaaccagtaatcctgaaagacgggccagagcgcgtaattctagcaggacccatgcccgttacagcagcatcagccgcacagcgcaggggtagaatagggagaaatcaaaacaaagaaggtgatcaatacatctacatgggccagcccttgaataacgatgaggaccacgcgcactggacggaggctaaaatgttgcttgataacatcaatactccagaaggcataataccagcattgtttgaaccagaaagagaaaagagtgccgcaatagatggcgaatatcgattgagaggggaagcacgaaagacatttgtcgaactgatgcgacgaggagatctaccagtatggttatcctataaggtagcaagtgagggattccaatatagtgataggcgatggtgctttgacggagagagaaataatcaagttttggaagagaatatggacgtcgaaatttggacaaaggaaggtgaacgaaagaaatgtgatagtcgatggctcgatgcgagaacgtatagcgaccccttggctctacgcgagtttaaagaatttgcagccggtcgacgctcggtatcaggagaccttatattagaaatagggaaattaccacaacatctgacattaagagctcaaaacgcattggacaatctagtaatgctccataattcagagcaaggtggaaaggcttatcgccatgcaatggaggagctgccagacacaatagaaacattgatgttactagccttaattgcagtactaacagggggagtaacactctttttcctatctggtaaaggattagggaaaacttctataggcctattatgtgtgatggcctcatctgtattactatggatggcatctgtagaaccacattggattgctgcgagtattatcctagaatttttcttaatggtcttgctaataccagagcccgatagacaaagaacgccacaagataaccaattggcttatgttgtaattggtttattatttatgatactgacagtcgcagctaacgagatgggactcttagaaactactaaaaaggatcttggaattgggcatgtagtggcagaaaatcaccaccacgcaacaatgttggatatagacctccatccggccagtgcctggactttatacgcagttgcgacaactataataacgccgatgatgaggcataccatagaaaatacgacggctaatattagtttaactgccatagcaaaccaagcagctatattgatgggactagacaaaggctggcctatcagtaaaatggatattggagtaccacttttagctcttggctgctacagccaggtaaatccattaacactgactgccgcagtattaatgttagtagcacattacgctattattgggcctggattgcaagctaaagcaactcgtgaggcacaaaaacgtactgcggctggtataatgaaaaacccaacggtcgatggcatcgtggctatagacttggaccccgttgtatatgatgcaaagtttgagaaacaactgggacaaataatgttactcattctatgtacgtcacaaatcttattaatgagaacaacctgggcactttgcgaaagcataacattagcaacaggaccattaacaactttgtgggaaggatctcctggtaagttctggaacactactatagctgtttccatggccaatatttttagggggagctatttagctggagcgggattagcttttagtctaatgaaaagcctcgggggcggacgacgtggaaccggggcgcagggtgagacactaggggagaaatggaagaggcaattgaaccagctttcaaagtcagagtttaatacgtataaaagaagtggaattatggaggttgaccggagcgaagcgaaagagggattgaaaagaggagaaacaacaaaacatgcggtatctagagggacggcgaaactgcgctggtttgtcgagcgaaacttggttaaaccagaaggaaaggtaatcgacctaggatgtggcagaggaggttggagttattattgtgccgggctcaagaaagtaactgaagtaaaaggctacacgaaaggaggaccaggccacgaggagcctatacctatggcaacatacggctggaacatagtgaaattacatagtggacgggatgtgttcttcacaccaccagaaaagtgtgatacattattatgtgacataggtgaatcatcgccgaaccccactatcgaagaaggaagaactctaagagttctgaagatggttgaaccatggctacgtggtattcaattttgtattaagatattaaacccatacatgccatctgtcgtagagacgttggaacaaatgcagcgaaaacatgggggtatgcttgttcgaaatcctttgtcgaggaacagtacacatgagatgtattgggtaagttgcggtactgggaatattgtatcagcagttaatatgacttctaggatgctcctcaacagattcacaatggcgcatcgaaaaccaacatacgaacgggatgtagacctgggcgcgggaacaagacatgtagctgtagaaccagagattgctaatttagatataattgggcaaagaatcgaaaacattaaaaatgagcataagtcaacttggcattatgatgaggacaacccatacaagacatgggcttaccatggatcctatgaagtcaaaccgtcgggaacagcaagttcaatggtaaatggagtggtacgactcttgacaaaaccatgggacgtaattcctatggtgacccaaattgcgatgacggatacaacgccatttggccagcaaagagttttcaaagagaaagtagacacaagaactcccagaccaaaaagagggactgcacaaattatggaagtcactgcgaaatggctatggggatttttgagcaggaataagaaacctagaatatgcacacgagaggagttcacgagaaaagttagaagcaatgcagccataggtgcggtatttgtcgatgaaaatcagtggaacagcgcgaaagaagcagtggaagacgaaagattctgggacttggtacatagagaaagagaactacataaacagggaaaatgtgcgacttgtgtatataatatgatgggcaaacgtgagaagaaattaggagaatttggcaaagctaaaggatcaagagctatatggtacatgtggttaggtgctagattccttgagttcgaagcattaggattcatgaacgaagaccactggttttccagagaaaattcactctctggagttgaaggggagggattgcacaaactaggctacattctacgagatatatctaagatacctggaggaaacatgtatgcggatgatacagcaggatgggatactcgaattactgaagatgacctacaaaacgaggcgaagataactgatattatggagccagagcacgcccttttagcgacatcgatttttaagctgacgtaccaaaataaggttgtgcgggtccagagaccagcaaagtctggtacagtcatggatgtcatcagtagaagagaccagaggggaagcggacaggtaggtacctacgggctgaacacttttacaaatatggaagtgcaactaataagacaaatggagtctgaaggaatattttcaccctccgaactagaaaattccaatctagctgaacgagttttagattggttggagaagcatggcgtagaaagattgaaacgcatggcaataagtggtgacgattgcgtagtaaaaccgaccgacgaccgattcgctacagccctaactgcattaaatgacatgggtaaggtacgaaaggatattccacaatgggaaccgtcaaagggatggaatgattggcagcaggtacccttttgttcacatcatttccaccaactaatcatgaaggatggacgggagatcgtagtgccatgtcggaatcaggatgaattagtaggcagagccagagtatcgcaaggcgctggatggtcactacgtgaaactgcctgtttggggaaaagttacgcgcaaatgtggcaattaatgtacttccatcgtagagatttgcgactagcagctaacgccatatgctcagctgtacccgttaactgggtgcctacatctcgaacaacttggtcaatacatgctcatcatcaatggatgacaaccgaagatatgctatccgtctggaatagagtttggatagaggagaacccgtggatggaggataaaacacatgtctcaagttgggaagatgtaccatatctaggaaaacgtgaagaccagtggtgtggctcgctaataggtttgacggctagggctacttgggctacgaatatacaggtcgctataaatcaagtgcgtagactaataggtaacgagaattatttggactatatgacaagcatgaaacgtttcaaaaacgaatccgatccagagggcgcgttatggtaa

SEQ ID NO: 21979 - RNA, 9879 nt, synthetic construct
  misc_feature 1..9879: note = derived and/or modified CDS sequence (opt6) from DENV-1__KT187564__SS-prME
  source 1..9879: mol_type = other RNA
tcagtaacaatgctactgatgttgatgccaaccgcattggcatttcatttaaccactaggggcggagaaccacacatgatggtcagtaaacaagaaaggggaaaaagtttattatttaaaaccagcgcgggtgttaatatgtgcacactcatagcgatggacttaggtgaactatgcgaagatactatgacctataaatgcccacgaatcacagaagcagaaccggatgacgtagattgttggtgtaatgcaacagacacttgggtgacatatggcacgtgctcccaaaccggcgaacataggagggacaaaaggagcgtagcattagcaccccatgtaggtctaggtttggaaacaagaacagagacttggatgagctcagaaggggcatggaaacaaatacagagagtcgaaacatgggcgctacgacatccaggttttacagttattgcactattcctagcacacgcaataggaacctcaataactcaaaaaggtattatatttatccttcttatgttggttacgcccagcatggcaatgcgatgtgtaggaataggctcacgagatttcgtcgagggattgagcggagcaacgtgggttgatgtggtgttggaacatggcagttgcgtgaccacaatggcaaaagacaaaccaactttggacatagagctgttaaaaacagaagtaactaatccagctgtactaagaaaattatgtatcgaggcgaaaataagcaatacaacgacagactcacgttgtccgacccaaggagaagcaacgttagtggaggagcaggatgctaacttcgtttgcaggcgaacatttgtagatagaggatgggggaatggttgcggtctttttggtaaaggatcattaattacttgtgctaagtttaaatgcgttacgaaactggagggaaagatcgtgcagtatgaaaatttgaaatattcggttatagtaacagtacatacaggtgatcaacatcaagtgggtaatgaatctacggagcatggtacgaccgcaacgattacaccccaagcaccaaccaccgagattcaattgacggattatggagctctaacacttgactgttctccgaggacaggtctcgactttaacgaaatggtacttttaacaatgaagggaaagagttggttggtacacaaacaatggtttttagatttaccactgccatggacgagtggtgcgtcaacgtctcaagaaacatggaaccgtcaagatttgttagttacgttcaaaacagcgcatgccaagaaacaagaagtagttgtactgggtagtcaagaaggtgcaatgcatacggcattaacaggtgcaacagagattcagacaagtggtactaccaccatatttgctgggcatctaaaatgtcgcttaaaaatggacaaacttacgctgaaagggatgtcatatgtcatgtgcacgggcagttttaaactagagaaggaggtggcagaaacccagcatggtacagttctagtgcaaataaagtacgaaggtaccgatgcgccgtgtaaaataccattttccacacaagatgaaaaaggggtcacgcaaaacggaagacttatcaccgctaatcctatcgtcactgataaagaaaagcctgtaaacatcgaggcagagcctccatttggagaatcgtatatcgtaataggtgccggagagaaagcgctgaaactctcgtggttcaaaaagggatcttcgataggaaagatgtttgaagctacagcaaggggtgcccgtagaatggctatactaggagatactgcatgggatttcggtagcatagggggtgtatttacaagtgttggtaaattggtccatcaaatattcggtactgcatatggcgtgctattctctggtgtatcttggacgatgaaaatcggaataggtgtgttattaacgtggttaggactaaattcacgatcaacgagtctttcaatgacgtgtatcgctgtgggcctagtaacgctttacttaggggttatggtgcaagctgactctgggtgcgtgataaattggaaaggtcgtgaattaaaatgtggctcaggaatattcgtgacaaacgaagtgcacacatggacagaacaatataaatttcaggcggattcgccgaagagattatcggctgcaatcgggaaagcatgggaagagggtgtgtgcggtatacgttctgccacccgcctcgaaaatataatgtggaagcagatttccaacgaactaaatcatatactcttagagaatgatatgaaatttaccgtcgtggtaggagacgtagcgggaatattggcccaaggcaagaaaatgatccgcccacaaccgatggaatacaaatatagctggaaaagctggggtaaggcaaaaattataggggcagacgtgcaaaatactacattcataattgatggcccgaacactccggagtgcccagatgaccaacgagcttggaacatttgggaggtcgaagattacggttttggaatatttaccacaaatatatggttaaagctacgcgacagttatacccaagtgtgtgatcatcgactaatgagtgctgcaataaaagattccaaagcagttcatgcagatatgggttactggatagaaagtgagaaaaacgaaacttggaaacttgccagggcatccttcatagaagtgaaaacttgcatatggccgaaaagccataccctttggtccaacggcgtactagaaagtgaaatgattattcctaaaatctatggaggtcctattagtcaacataattacaggccaggctatttcactcaaacagcgggtccatggcatctgggaaaattggagctagactttgatttatgtgaaggtacgacggtggtagtcgatgaacattgtggaaacagaggtccgtcattacggacgacaaccgtaacagggaagatcatacatgaatggtgttgcaggagctgtacgctgccaccattaagattccggggagaagacggttgttggtatgggatggagataaggccggttaaagaaaaggaggaaaacctagtgaaaagtatggttagcgctggaagtggagaagtagattcattttcattaggattattatgcatctcgatcatgatcgaggaagttatgcgatcgagatggtcgagaaaaatgctaatgataggaacgcttgccgttttctttttactaattatgggacagttaacctggaacgatcttatacgattatgtatcatggtgggtgctaacgcaagtgataggatgggtatgggcacgacttatctagcactaatggctacatttaaaatgaggcccatgttcgcagtaggccttctatttcgtcgcctcacatcacgagaagttctattgttgacaatagggcttagcctggtagcatcggcagaattaccaaatagtctagaggaattaggcgacggcttagcgatgggtataatgatactaaaattattgacagactttcagagtcaccaattatgggccactctattaagcctaacctttattaaaactacctttagtttacactacgcttggaagactatggctatggtcctttcaatcgtgtcattgtttccgctatgtttatctaccacgtctcaaaagacaacttggctcccagtactcttaggaagcctaggatgtaaaccacttaccatgtttttaattgcagagaacaagatatgggggagaaaatcttggccactgaacgaggggatcatggctgtcggaatcgtaagtatacttttaagcagtttacttaaaaatgatgttccactagccggacccttaattgcgggaggaatgctgatagcttgctatgtaatctctggttcatccgccgatctttctctagaaaaagccgctgaagttagttgggaagaagaggcagaacacagtggagctagtcacaacatcttagtagaggtacaagatgacggaaccatgaagataaaagacgaagaaagagatgacacattaaccatactgcttaaggctacgttacttgcggtgagcggggtctttcccttatcaataccggcgacgttattcgtatggtacttttggcagaagaagaaacagagatcaggagtattgtgggacactcctagccctccagaggttgaacgagccgtcttagacgatggaatttatagaattatgcaaagaggactattgggaagatctcaagtaggagtcggagtctttcaagaaaatgtatttcatacaatgtggcacgttacgagaggagcggtattaatgtaccaaggaaaaaggctggaaccttcatgggcctcagtaaagaaagatttaataagttacggcggaggatggcgcttacagggttcatggaataccggtgaggaagtacaggtcatcgctgtagagccaggcaaaaatcccaaaaacgttcagacagcgccagggacatttaaaacacctgaaggagaagttggagcaatagccttagatttcaaacctggaacaagcggaagtccgatcgttaaccgcgaaggtaagatcgttggactatacgggaatggcgttgtcacgacaagcggaacatatgtatcagctattgctcaagctaaggcttcgcaagaaggcccattgccagaaatcgaggacgaggtattccggaaaagaaatctaactataatggatttacacccaggttctgggaagacaagaagatacctgccagctatagtgcgagaggctatcaaaaggaaactgcgaacattaatactagctccaacaagagtagtagcatctgagatggccgaagcactaaaaggaatgccaatacgatatcagaccaccgccgtgaaaagtgaacatacaggtaaagaaatagtggatttaatgtgccatgcaaccttcacgatgcgactgcttagtcctgtgcgtgtaccgaattacaatatgataattatggatgaagcacatttcacagacccgagctctatagctgcgcgtggttacattagtacaagagtaggaatgggagaagccgcggccatattcatgacagctactccaccaggaagtgtagaggcttttccacagtcaaacgccgtaattcaagacgaagaacgcgacattcctgaaaggagctggaactcaggctacgaatggattactgattttcctgggaaaaccgtatggttcgttccttcaattaaatcaggtaacgatatagcaaattgcttgcgaaagaatggaaaaagagtcatacaactatcccgcaaaacattcgataccgaatatcagaaaactaaaaacaacgattgggattacgttgtcacgacagatatatcagaaatgggagctaactttcgtgctgacagagtaatagatcctaggagatgtttaaaaccagtcattttaaaagatggacctgaacgagtcatacttgctggtcctatgcctgtaacagttgcctccgctgcacaacgtcgcggccgtattggtagaaatcataataaagagggtgaccaatacatctacatgggtcaacctctcaacaacgatgaggaccatgcacattggacagaagcaaaaatgcttttagataatataaacactcctgaaggaattatacccgcattattcgaacccgaaagggaaaagagtgcagcaattgatggagaatataggctaaggggcgaagcaagaaagacctttgttgagctgatgagaagaggggatttaccagtttggctcagttataaagtggctagcgaaggattccagtattctgaccgccgctggtgtttcgacggagagcgaaacaatcaagttctagaggaaaacatggacgtagagatttggacaaaagaaggggaaagaaagaaactacgtccccgttggttggatgcgagaacttatagcgacccacttgcgttacgcgagtttaaagaatttgcagctggaagacgctcggtttcgggggacctaatactagaaataggaaaattaccacaacacctcacacaacgagcccaaaatgcgttggataacctcgtgatgttacataattcagaacaaggaggacgggcgtatcgtcacgccatggaggagctcccagatacaattgaaacactaatgttattagctctcatagcggttttaacaggtggagttactctattctttcttagcggacgagggttaggtaaaaccagcatcggcttactgtgtgtaatggcgtcttctgttttactttggatggccagtgtagaaccacattggattgcagccagcattatacttgagttctttttaatggtattacttattccggaacctgaccgtcaaaggacaccccaagacaatcaacttgcatacgtagtgatcggattactattcatgatactcacagtggctgctaatgagatgggtttactagaaacgactaagaaagatctaggcatcggacacgttgctgttgagaaccaccatcatgcagcaatgctagatgtagacttacatccagctagcgcatggacattatatgctgttgcaaccacaataataacgcctatgatgcgccacacaattgaaaatacaacggcgaacatttcgctcacagctatagcaaatcaagccgcaatcttaatgggccttgacaaaggttggcctatttcaaaaatggatatcggtgttcccctgttggcactgggatgttattcgcaagttaatcctttaacattaaccgcggcggtattaatgttagttgctcactacgcaataatcggaccgggactacaagccaaagcgacgagagaagcacagaaacgtacggctgcagggattatgaaaaatcccaccgtcgatggtatagttgcgatagatctcgatccggtagtatacgatgcaaaatttgaaaagcaactgggacaaataatgctactcatactatgcacatcccagattcttctaatgagaaccacatgggcattgtgtgaaagcatcacactagctacgggtccactaacaacgctatgggaagggagccccggaaagttttggaacacaactatagccgtttcaatggccaatattttcagagggtcctatttggctggagcaggcttagcattttccctaatgaaatcattgggtggagggcgaagaggaaccggagctcaaggtgaaactctcggtgaaaaatggaaaaggaggctgaaccaactatctaagagcgagttcaatacatataaacgatcaggtataatggaagttgacagatccgaagctaaggagggtttaaagcgaggtgagactacaaaacatgctgtaagcagaggaaccgctaagttaagatggttcgttgaaaggaatctggtaaaaccggaaggcaaagtaatagatcttggatgcggaaggggaggatggagctactactgtgctggtcttaagaaagtaacagaagtcaaagggtatacgaaaggaggaccgggacatgaagaaccaattcccatggctacttatggctggaatttagtaaaactgcactcaggaaaagatgtatttttcatcccacccgagaaatgcgataccctcctatgcgacattggagaaagtagtccaaaccctacaatagaagaaggcagaactcttcgagttttgaaaatggtcgaaccatggctaagaggcaaccaattttgtattaagattttaaatccgtacatgccatcggtagtagaaacactggaacaaatgcagaggaaacatgggggaatgcttgttagaaaccccttaagtagaaattcgacgcatgagatgtattgggtatcttgcggtacgggcaatatagtaagtgccgtgaacatgacgagtaggatgcttttgaacaggtttaccatggcgcacaggaaacctacatatgaaagagatgtagacctaggtgcaggtactagacacgtagccgttgaaccagaagtggcaaacttagacataataggtcaacgcatagaaaatataaaacacgagcataaaagtacgtggcactacgatgaagataatccatacaaaacctgggcttaccatggatcgtatgaagtcaaaccatcaggttcagcatctagtatggtaaacggcgttgtaaagttgctcactaaaccctgggatgttattcctatggttacccaaatcgccatgacagacacaacgccatttggtcagcaaagggtttttaaggaaaaagtagatacacgcacaccaaaagcgaaacgaggaacagctcaaattatggaggtaacagcaagatggctatggggattcttatcaaggaacaagaaaccaagaatatgtactagagaagaatttacaaggaaagtccgttcaaacgcagcaattggcgcggtatttatagatgaaaaccaatggaactcagctaaagaagctgttgaggacgaaagattttgggatctggttcatcgagaaagggaacttcacaaacaaggtaaatgcgctacttgtgtatataatatgatgggtaaacgagagaagaaacttggtgagtttggaaaagccaaaggtagtcgagcaatttggtacatgtggttaggtgcgcggtttttggaatttgaagctctgggattcatgaatgaggatcactggttttccagagaaaattcattatcgggggtagaaggtgagggattacataagctaggttatatattgagagatatttctaaaatacctgggggaaacatgtacgccgacgatacagcgggatgggatactagaataacggaagacgatttacagaatgaagccaaaataacagatataatggaaccggaacatgccttactagcaaaagctatttttaaactaacgtatcaaaataaggtagtaagagttcaaagaccagccaaaaatggaaccgtcatggatgtcataagcagaagagatcaaagaggaagcggccaagtaggaacttacggccttaatacgtttactaacatggaggcacaactaataagacagatggaaagtgagggaatattcagcccaagtgaactagagacacctaacttagccgaacgggtcctagattggctcgggaaatatggagtcgaaagattaaaacgaatggcgattagtggggatgattgcgtagtcaaaccaattgatgaccgcttcgcgacagctctaacagcattaaacgacatgggtaaagttcgtaaagatattccacaatgggagcctagcaagggatggaatgactggcaacaagtcccattttgttcacaccactttcatcaattaataatgaaggacggaagagaaatcgttgttccgtgcaggaaccaagatgagctagttgggcgagcccgggtttctcaaggagctggatggtctctaagagaaacggcatgtttagggaaaagttacgcccaaatgtggcagctcatgtattttcatcgtcgagacctccgcctagccgctaatgctatatgtagcgcagttccggtcgactgggtaccgacttcgcggacaacatggagtatccacgcccaccaccaatggatgacgacagaagatatgctctctgtgtggaatcgagtatggatagaggaaaacccatggatggaagacaagactcacattagtaactgggaagacgtgccttacttaggaaaacgagaagaccagtggtgcggatcattgataggtcttaccgcaagagccacttgggcaacaaacattcaagttgcgataaatcaagtgagacgtctaattgggaatgaaaattacttagattacatgacatcaatgaagcggtttaaaaatgaatcggacccagagggagccttgtggtaa

SEQ ID NO: 21980 - RNA, 9879 nt, synthetic construct
  misc_feature 1..9879: note = derived and/or modified CDS sequence (opt6) from DENV-1__KT187560__SS-prME
  source 1..9879: mol_type = other RNA
tcagttacgatgttactaatgctactaccaacggcattagcttttcatctcactacgaggggaggcgaacctcacatgattgtaagtaaacaagaacgaggaaaatctttgctctttaaaacaagcgcgggcgtaaacatgtgtactttaattgctatggatctcggagaattatgcgaagacacaatgacgtataaatgccctagaattactgaagccgaacctgacgatgtggattgttggtgtaacgcaacagatacttgggtaacttacggaacttgttctcaaacaggagaacatagacgtgataagcgaagtgtcgccttggcacctcatgtaggtcttggcctagaaacacgtacagaaacatggatgagttcagaaggggcatggcgacaaatacaaaaagttgaaacttgggcattaagacaccctggtttcacagttatcgccttatttctagcgcatgcgatagggacttcaatcactcaaaaaggaatcatattcatacttttgatgttggtgacaccttcaatggctatgcgatgtgtaggtataggtaacagagacttcgtcgaaggtttatcaggagctacatgggtcgatgttgtattagaacacggatcatgtgttactaccatggccaaaaacaaacctactttggatatcgaattattaaaaactgaagtcaccaacccggcagtcctccgaaaactgtgtatagaagctaaaataagtaacaccacgacagacagcagatgtcctacgcaaggagaagctacattagtagaagaacaagatgccaattttgtttgtagacgtacattcgtagaccggggttggggaaacggatgtggactttttggcaaaggttcattattgacatgtgcgaaatttaaatgcgtgacaaaactcgaaggcaaaatcgttcaatacgaaaacttaaaatattcagtaatagtcacagtgcataccggagatcagcatcaagtaggcaatgaaacgacagaacatggcacaatagctacgataacaccacaagcaccaacttcggaaattcaattaacggattacggcgctttaacacttgattgctcacctaggactggtctagattttaacgaaatggtccttttaaccatgaaagagaaaagttggttagttcacaaacagtggttcttagatctaccgctaccttggacttcaggggcatcaacaagtcaggagacgtggaatcgtcaagacctcctcgtaacatttaaaaccgcgcacgccaagaaacaagaagtagtcgttctgggatcacaagaaggagcgatgcatactgcactgacaggagcaaccgagattcaaaccagtggaacaacaacaatattcgcaggacatttgaaatgcaggttgaaaatggacaaattaacactgaaaggtgtttcgtatgttatgtgtactggaagtttcaaactcgaaaaagaggtagctgaaacacaacatggaacagtcctcgtccaagtaaaatatgaaggaaccgacgccccgtgtaaaattccaatatcgactcaagacgaaaaaggggtaacacaaaatggtcgcctgataactgcaaacccaatcgttaccgacaaagaaaaacctgtgaacatagaaaccgaaccaccgttcggggagagctacatagttatcggcgccggtgaaaaagcacttaagctatcttggttcaagaaaggaagctcaatcggaaagatgtttgaggccacagctaggggtgctcgacgtatggcaattcttggagatacagcatgggattttgggtctataggcggtgtttttacaagtgtaggcaagctggttcaccaagtatttggcactgcatatggagtactctttagcggcgtgagttggaccatgaagattggaataggaattttgttgacatggctcggtcttaattctagatctacatcactatcaatgacctgtatagcggtaggaatggttacattgtatttaggagtgatggtccaagcagattccggatgcgtaataaactggaagggaagagagctaaaatgcggtagtggaatattcgttacgaacgaagttcacacatggactgagcaatataaattccaagcagattcaccaaagcgattaagtgcagcaatcggaaaagcatgggaggagggagtttgtggtatacgatcagcaactcgactagaaaatattatgtggaaacagatctctaatgagcttaatcatatcctattagaaaacgacatgaagttcactgtcgttgtcggtgatgccaacggaatactaactcaaggtaaaaagatgataaggccccaacctatggaacataaatatagctggaagtcatggggcaaggctaagataataggggcggatacgcaaaatactacatttatcattgatggtcctgatacacccgagtgccctgatgatcaacgagcatggaatatttgggaagtagaagattacggtttcggggttttcactacaaacatatggttaaaactgcgcgacagttatacacaaatgtgtgatcaccgattaatgagcgctgctataaaagattcgaaggctgtacatgcagacatgggatactggattgagtcagagaaaaatgaaacctggaaactcgctagagctagtttcattgaagttaaaacgtgtatatggcccaggtcgcatacgttgtggtcaaacggagttttggagtcggaaatgattatacccaaaatatatggaggacctataagtcagcataactatagaccaggatattttacacaaacagcaggaccctggcacctgggtaagttggaattggactttaacttatgcgagggtactaccgtcgtagtcgatgaacattgtggtaacagaggccctagtctaaggacaactacagtcacaggaaagataatacacgagtggtgttgtagaagctgcacattgcccccgttgagatttcgaggggaggacggatgttggtatggaatggaaataagaccagtaaaggaaaaagaagaaaacctagtacgctccatggtcagtgctggaagtggggaagtcgattccttctcgttaggattactctgtgtatcaatcatgattgaagaggtgatgagaagtagatggtctagaaagatgttaatgaccgggacactagcagtatttttccttttgattatgggtcaacttacatggaatgatctgattcgtttgtgtatcatggtcggagctaatgtatcagatcgaatgggcatggggaccacatatctagcgcttatggcaactttcaaaatgagaccaatgttcgcagtaggacttttgtttcgaagactcacgtccagagaggtcttactgttaactataggactatcattggttgctagtgtagaattgcccaattctttagaagaacttggtgatggtcttgctatgggtataatgatgttaaagttattaactgatttccaatcacaccaactctggacaacactactttcgcttaccttcataaagactactctatctcttgattatgcttggaaaactatggcaatggttttatctatagtaagtttattccctttgtgcctatccaccacaagtcagaaaactacctggttacctgtactattgggaagtttggggtgtaagcccttaactatgtttttaataaccgagaacaaaatttggggtagaaaaagttggccattaaacgaaggaataatggctgtagggattgtatccattcttctctcaagcctcctcaaaaatgatgttccattagctggtcccctcatcgctggcggtatgttgatcgcttgctatgtcatctcaggaagttctgcggatttaagcctagaaagggcggccgaagtatcctgggaagaagaggctgaacacagcggtgcgagtcataacatccttgttgaggtacaagatgatggtacaatgaaaataaaagacgaagaacgtgatgatacattgactattcttctgaaagcaacccttctggcggtatcaggtgtttatcctatgtctattccagcaacgctatttgtatggtacttttggcagaagaagaaacagcgctcaggagttttatgggatacaccatcgccacctgaggtcgaacgtgccgttttagacgatgggatttaccgcatacttcagaggggcctgctcggacgcagtcaggtaggggttggagtattccaggatggtgtcttccatacaatgtggcatgtcacgaggggtgcagtactaatgtatcagggaaaaaggttggaaccatcctgggcaagcgtcaagaaagatcttatatcatacggaggtggctggagatttcagggatcatggaatactggagaagaggtacaagtaatagccgttgaacctgggaagaaccccaaaaatgtccaaacgacacccggaaccttcaaaacccccgaaggagaggtaggtgcaatagctctggactttaaaccaggtacttcgggaagccccatagtcaatcgggaaggtaaaattgtagggttatatggaaatggggtagtcactacaagcgggacctacgtatcggcaatagcacaagcaaaagccagtcaggagggcccattaccagaaatagaagacgaagtatttaagaaacgaaatttgacgatcatggatttacatccgggtagcggtaaaacacgtaggtacctaccagctattgtcagggaggcaatcaaacgaaaattaagaacactcatcttagctcccaccagagtcgtagctagcgaaatggccgaggcacttaaaggaatgcctatacgatatcaaacgacagcagtgaaatcagaacatactggtaaggagattgtggatttaatgtgtcacgccacttttactatgcgcctactatcaccagtaagagtacccaactataatatgataataatggacgaggcgcattttacagaccccgcatcaatagccgctcgaggatatatttctacgcgggttggaatgggagaggcagcagcgatattcatgacagccacaccaccaggctccgtcgaggcttttccacaatcaaacgcagtgatacaggatgaagaacgcgacattccggagcgaagttggaacagtggatacgattggattactgatttccccggaaaaaccgtatggttcgtgccctcaataaagtctggcaatgatattgcaaactgccttagaaagaacggtaaacgagttatccaactatctagaaaaacttttgatacagaataccagaaaaccaaaaacaatgactgggattacgtcgttacaactgatatctccgaaatgggtgcgaattttcgagctgatcgagtaatagatcctagaagatgtctcaaacctgttatccttaaagatggacctgaacgtgtgatcttagcaggacctatgccagtaacagcagcttcagccgcacaaagaagagggagaataggtcggaaccaaaacaaggaaggagatcaatatatctacatgggccagcccctcaacaacgatgaagaccatgcccattggacggaagcaaaaatgttactcgataatataaacacgccagaaggtattatacctgcgctctttgaacctgaacgagagaaaagcgcagcgattgacggagaatatcgtttacgtggtgaagcgaggaaaacttttgttgaattaatgagaagaggggatttacccgtatggttaagctataaagtcgcatctgaaggctttcaatacagcgatcgcagatggtgcttcgacggtgaacgtaataatcaagtacttgaagaaaacatggatgtagagatctggactaaggaaggggaaagaaagaaactaagacctcgatggctagatgcaaggacatacagcgacccactggcacttagagagtttaaagagttcgctgcgggacgtaggtcggtaagcggcgatttaatattagagataggaaagctaccacaacacttgacactacgtgcgcagaatgcgcttgacaacctggttatgttacataatagtgaacagggtggtaaagcgtacagacacgctatggaagaattaccagacacaattgaaaccttaatgcttctagccttaatcgccgtgttaacaggaggggttacgctattctttctgtcagggaagggactaggtaagacatcaatcggtttactctgcgttatggcaagttctgttcttctttggatggcttcagtagaaccacactggattgctgcttctatcattctcgaatttttcttgatggttttattaataccagaaccagacagacaaagaactcctcaagataatcaactcgcatatgttgttataggtcttctcttcatgattttaacagtcgcagcaaatgaaatgggactattggaaacaaccaagaaggacttgggtataggtcatgtcgtagccgaaaatcaccaccatgcaactatgcttgatattgatctgcacccggcctcagcctggacgttatatgctgtagcaaccaccattataacacctatgatgcgacacacaatagaaaacacaacagcaaatatctcacttactgcaatagcaaaccaagccgcgatacttatggggctagacaaaggctggccaataagtaaaatggatattggagtaccattactggcattaggctgttactcacaagtgaaccctttgacgttaactgcagcagtcctaatgctagtagcacactatgcgataatcggcccaggacttcaagcaaaagctacaagagaggctcaaaaacgaaccgctgccgggattatgaagaaccctactgtggatggtatagtagcaatagacttagatccagttgtttacgatgctaaattcgaaaagcagctaggtcagataatgctacttatactttgcaccagccaaatactactaatgagaacaacgtgggcactatgtgagtcgattacgctcgccactggacctttaacaaccctttgggaaggtagccctggcaagttttggaacacaaccattgcggttagcatggccaacatcttccgtggatcctacctggctggcgcggggttagcattttcgctgatgaaatcactgggtggcggaagacgcggaacgggggcacaaggtgaaactttaggagaaaagtggaagaggcaactcaatcaattgtcaaaaagtgaatttaacacctacaagcgatctggtattatggaagtcgacagatcagaggcaaaggaaggtctcaaacgcggagaaacaacaaaacatgcggtttccaggggaacggcaaaattaagatggttcgtcgaaaggaatttggtcaaaccagaaggcaaggtaattgacttgggttgcggtagaggcggctggtcatattactgtgctggcttgaagaaggtgactgaagtgaaaggctataccaaagggggaccgggtcatgaggaacctatcccaatggcaacttatggttggaatatcgttaaattgcactccgggagagacgtattctttacgcctccagagaaatgtgataccttgttgtgtgacattggtgagtcaagtccaaatcctacaatagaagaagggaggacattgagagtacttaaaatggttgaaccctggctaaggggaaatcaattttgcattaaaatacttaacccttacatgccaagtgtggtggaaacattggagcaaatgcaacgaaaacacggaggaatgttagtaaggaacccactttcaagaaattccacacacgaaatgtactgggtgtcctgcggaactgggaacatcgtaagcgcagttaacatgaccagtagaatgttgttaaacagatttactatggctcacagaaaacccacttatgaacgagacgtagacttaggagctggaacaagacatgtcgctgtggaacccgaaatagctaatttagacataataggtcaaagaattgaaaacatcaaaaatgaacataaatcaacctggcattatgatgaagataacccatacaaaacatgggcatatcacggaagctatgaagtaaagcccagcgggtctgccagttcaatggttaacggcgtagtccgcttactcacaaaaccttgggatgttatacctatggtaactcaaattgcgatgacagataccacgccttttggccaacagagagtttttaaggaaaaagtagacacgaggacacctcgaccaaagagaggaactgcacaaattatggaagttaccgcgaaatggctgtggggttttctttccagaaacaagaagcctagaatttgtacgagggaagagtttacaagaaaagtgagaagtaatgcagcaatcggagcggtatttgtggacgaaaatcagtggaacagtgcaaaggaagcggtggaggacgagcgtttctgggacttagttcatagagaacgggagttacacaaacaaggtaagtgtgcaacctgcgtttacaacatgatgggtaaaagggagaagaaacttggggaatttggcaaagcaaaaggtagtagggcgatatggtacatgtggttgggagcgcggttcctggagttcgaggcgttgggctttatgaatgaagaccactggttttctcgcgaaaactcgttatcaggtgtagaaggagaaggattacacaagttaggctatatactgcgcgatattagtaagattccaggcggtaatatgtacgcagacgacaccgcaggctgggacacacggataacagaagacgatttgcagaatgaggcgaaaattacggatatcatggagccggagcatgctttattagcaacctcaatttttaaattaacatatcaaaataaggtagtacgagtacaaagaccagctaaatctggaactgtcatggatgtgataagtcgacgcgatcaaaggggctcagggcaagttggcacttatggactaaatacctttacaaatatggaagttcagttaattaggcaaatggaatcggaggggatattttccccatcagagttagaaaatagtaacctagcggagagagtacttgactggctcgagaaacatggtgtcgaaaggctaaaaagaatggcaatctcaggagatgattgcgtagttaaaccaacagacgataggtttgcaacagcattgacagcattaaatgatatgggaaaggtccgaaaagacataccccagtgggagccatccaaaggttggaatgattggcaacaagttccattttgttctcaccactttcatcagttaataatgaaggacgggcgggaaatcgtagtgccctgcagaaatcaagacgaactggtgggacgagctagagttagccaaggtgcaggatggagcctacgagaaacggcatgtctggggaagtcatatgcacagatgtggcaattaatgtattttcatagaagagatttacgtctagcagcgaatgcgatatgctcggcagtaccggtaaattgggtccccacttctagaactacatggagtattcacgctcaccatcaatggatgaccacagaagatatgctgagtgtttggaaccgcgtttggatagaagaaaatccgtggatggaggataagacacatgtgtcaagttgggaagatgtcccctacttaggaaaaagagaggatcaatggtgcggctctctcatcggtcttacagcaagggcaacatgggcgaccaatatacaagtagcgataaatcaggtacgtagattgataggtaatgaaaactatctagattacatgacgagtatgaagagatttaagaatgagagtgatcctgaaggagcactatggtga

SEQ ID NO: 21981 - RNA, 9879 nt, synthetic construct
  misc_feature 1..9879: note = derived and/or modified CDS sequence (opt6) from DENV-1__KT187561__SS-prME
  source 1..9879: mol_type = other RNA
tcagttactatgttattaatgttactgccaactgcactagcatttcatcttacaactcgaggaggtgaaccacatatgatagtgtcaaaacaagaaagagggaaatccttgctatttaaaacgtcagctggcgtgaatatgtgcactcttatagctatggatctaggggaactctgtgaagacaccatgacttacaaatgcccacgaatcacggaagcagaaccagatgatgttgactgttggtgtaatgcaaccgacacatgggttacctatggtacatgtagtcaaactggggaacaccgtcgagacaaaagatctgtagcactagcgccacatgttgggttgggactcgagactcggactgaaacatggatgagtagtgagggtgcgtggcgtcaaatacaaaaagtggaaacttgggcgcttcgacaccctggttttactgtcattgcgttctttttagcgcacgccattggaacaagtattacacaaaaaggaataatatttatattacttatgttagttacaccatctatggcgatgcgctgcgttggtataggtaacagagactttgtagagggtttaagtggcgctacatgggttgacgttgttttagaacatggttcatgtgtgacaactatggccaaaaataaacctacgttagatattgaattacttaaaacagaagttacaaacccggcggttttaagaaaattatgtatagaggcaaaaatctcaaatacgacaacagactcccgctgccctacacaaggcgaggccactttagtagaagaacaagatgctaattttgtatgcagacgtacctttgtagacagaggatggggaaatgggtgtggtctatttggtaaaggttccctcctgacctgcgcaaaatttaaatgcgtaacaaaactagagggtaaaatcgtccaatacgagaacctcaaatactcggtcatcgtaactgtgcataccggcgatcaacatcaagttggaaatgaaactacagagcatggtacgatagcaaccataacgccacaagctcctacttcagagatacaacttaccgattatggggccctcactctagactgctcaccacgcaccggtcttgactttaatgaaatggttctcctcactatgaaagaaaaatcatggctcgtacacaaacaatggttcctagatctacctctaccgtggaccagtggcgccagcacatctcaagaaacgtggaatcgacaggatttactcgtaacttttaaaactgctcacgcgaagaaacaagaagtagttgttctgggaagccaggaaggggcaatgcatacggcgttaacaggcgctacggaaatacaaacaagtgggacaaccacgattttcgctggacacctaaaatgtagattaaaaatggacaagttaacattaaaaggagtcagttacgtaatgtgtacaggcagctttaaattagaaaaagaagttgccgaaacccaacacggaacagtcctggtccaagtaaaatacgagggtactgacgcaccatgcaaaataccgataagcacacaggacgaaaaaggcgtcacccaaaatggtcgcttgattactgcaaacccgatagtaacagataaagaaaaacccgtaaatatagagacggaacctccctttggagaaagttatatagtcataggagccggtgaaaaagcactcaaactctcttggttcaagaaaggctcaagcatcggaaaaatgtttgaagcgactgcaagaggagctaggcgtatggccatacttggtgacacggcctgggattttggttcaataggtggggtattcacaagtgtaggtaaattagttcatcaagtgtttggcactgcatacggagttctatttagtggagtaagctggactatgaaaattggcatcggcattcttttaacatggttaggattgaatagccggtctacttctctatccatgacatgcattgcagtaggtatggtaaccttatatttaggtgtgatggttcaagctgattcaggttgcgtgataaattggaaagggagagaactaaaatgcggatctggaatattcgtaacaaatgaagtacatacctggacagagcagtacaagtttcaggccgattcccccaagaggttgtctgccgccataggaaaagcctgggaggaaggtgtctgtggtataagatctgccactagacttgagaacataatgtggaagcagatttctaacgagcttaatcacatcctattagaaaatgacatgaagttcacagttgttgtgggtgacgccaacggtatacttacacaaggtaaaaagatgatacgtcctcaacctatggaacacaagtattcatggaaaagctgggggaaagcaaaaataataggggcagacacccaaaatactacgttcattatagacgggcctgatacaccagaatgtcccgacgaccaacgggcttggaatatatgggaagtcgaggattacggcttcggagtctttacaacgaatatatggctaaaactaagagactcttatactcaaatgtgcgatcatcgacttatgtcagcagctataaaagattctaaagctgttcacgctgatatgggatattggatagaaagtgagaagaacgaaacctggaagctagcacgtgccagttttatagaagtaaaaacatgcatatggcctcgatcacacactttatggtcgaacggagtattagaatctgaaatgataatccccaaaatatatggaggaccgatatctcaacataattaccgacccgggtactttactcaaactgctggcccatggcacttggggaaattggaactagattttaatctatgtgagggaaccacggttgtagtggatgaacactgcggaaatagaggcccctctttaagaacgactaccgttacgggaaaaataatccatgagtggtgttgtagatcgtgtactcttccccctttaaggtttcgtggggaggatgggtgttggtacggaatggaaataagacctgtaaaagaaaaagaagaaaatctggtacgtagtatggtttctgctggaagcggcgaagtggactcattctcactaggtctcttgtgtgtctcaataatgatagaagaagtaatgcgttctagatggtcacgtaaaatgttaatgacgggtaccctagctgtattctttctcctaataatgggtcaactcacatggaacgaccttataaggttatgcataatggtaggagccaatgtgagcgaccggatgggcatggggaccacatacctagcactaatggctactttcaagatgagaccaatgttcgcggtaggattactcttcagaagactaacatctagagaagtacttctattaaccattggtctatcgctagttgctagtgtggaattacctaattcattggaagaactaggagatggcttagccatgggaataatgatgttaaaactactgacagatttccaaagccatcagttatggaccacattactgtctctaacatttataaagaccacactcagcttagattatgcatggaaaacgatggctatggttctatcaattgtcagcttatttcccctttgtttaagcaccacatcgcagaaaaccacatggctccctgtattgcttggatcatttggttgtaaaccgttaacaatgtttttaataactgagaataaaatatggggaagaaagagttggccacttaatgaaggaattatggcagtcggaatagtttcaatactcctttcgtctttactcaagaacgacgttccattagctggcccattaatagcaggaggtatgctaatagcttgctacgtcatctcaggatcttcagctgacctatcattagaaagggccgctgaagtgagctgggaagaggaggccgaacacagtggagcttcacataatatcctagtagaggttcaagacgacggaaccatgaaaataaaggatgaagaacgggatgacactcttacaattttacttaaagcaacccttttagcagtaagcggtgtatatccaatgtcaataccggcaaccctattcgtttggtatttctggcagaaaaagaaacaaaggagtggcgttctatgggacactccaagtcctccagaagtggaacgagcagtcctagacgacgggatttacagaatactccaacgtggattattaggtagatctcaagttggagtaggagtgttccaagatggcgttttccataccatgtggcatgtaactagaggcgccgttttaatgtaccaaggaaaaagattagaaccttcttgggcatctgtcaagaaagatctgatttcgtacggaggtgggtggaggttccagggttcatggaacacaggagaagaggtccaagtaattgcggtggaaccggggaagaatcccaaaaacgtccaaacaacgccgggaacatttaagacacccgagggagaagtaggtgcaattgcgttggatttcaagccaggtacgtcgggttcaccaatagtaaatcgtgaaggtaaaatcgtgggactatacggcaacggagtggtaacaacgagcggcacttacgtatcagctatagcacaagcaaaagcaagtcaggaaggtccacttcctgaaatagaggatgaagtattcaagaaaagaaacttaacaataatggatttacatccaggctctggaaaaacaagaagatacttaccagctattgtgagagaagctatcaaacgcaagttaagaactttaatattggcaccgacacgggtagtagctagtgaaatggctgaagcgttgaaaggcatgcccatacgttatcagacgacagctgttaaatccgaacatacaggaaaggaaatcgtagacctaatgtgtcatgcgacatttacaatgcgattgctatctcccgtccgagttcctaactacaatatgataattatggatgaggcacactttacagatccggctagcattgctgctagaggatatatttcgactagagtggggatgggtgaagctgctgcgatctttatgaccgctaccccgcccgggagtgtagaagcattcccgcagagtaacgcagtaatacaggatgaagaaagagatattccggaaagatcatggaatagcggttacgattggataactgattttccgggcaaaaccgtatggtttgtccctagcattaaatccggaaacgatattgctaattgtttgcggaaaaacggaaaacgagtcatacaactatcaagaaaaacatttgatacagagtatcagaaaacgaaaaacaatgattgggactacgtcgtaacaacagacatatcggaaatgggggcaaacttccgagctgaccgagtaatcgatcctaggagatgtttaaaaccagttatattgaaagacgggccagaacgggtaatactggcgggacccatgcccgttacagcagcatcagccgcacaaagacgcgggagaataggcagaaatcaaaacaaagagggcgaccagtacatctacatgggacaacctctgaataatgacgaggaccacgcacactggactgaggctaagatgttactcgataatatcaacacaccggaaggcattatacctgcactatttgaaccggaacgtgaaaaatccgccgcaatcgacggagaatatagattaaggggtgaagctcgcaaaacatttgtagaattaatgcggagaggagatttaccagtatggttgtcatacaaagtggcttctgaaggatttcagtattcagatcgccgatggtgtttcgatggtgaaagaaacaatcaagtattagaagaaaatatggacgtagagatctggacgaaagaaggcgaaaggaagaaactccgtcctagatggttggacgcaagaacatatagcgaccctttggcactcagggagtttaaagagtttgcagccggtagaagatcggtatctggggatttgattttagaaattggaaaactcccgcaacacttaacattacgagcacagaatgcattagataacctagttatgctacataactccgaacaaggtggaaaggcgtataggcacgccatggaggagttgccagatacgatagagacgttgatgctgcttgcgttgattgccgtccttaccgggggcgtaactcttttctttcttagcggtaaaggtcttggaaaaacaagtatcgggttgttatgtgtgatggcatcatccgtcttactatggatggcttctgttgagccacactggattgcggcttcaataatcttagagttctttctcatggttctgctaataccagaaccggatcggcaaaggacaccgcaagataatcaattagcatacgttgttattggtctgttgtttcttatcttaacagttgcggccaatgaaatgggtttattagaaacgacgaagaaagatctgggaataggtcatgttgtggcggagaatcaccatcatgcgaccatgctcgacatagacctacatcctgctagtgcatggacactatatgccgtggctactacaattataacgcctatgatgcgacatacaatagagaacactacagcaaacattagtctcacagctatcgctaatcaggcagctattttaatgggactggacaaaggatggccaatctctaaaatggatataggtgttcccctgttagcccttggttgctatagtcaagtaaatccattaaccctaacggcagccgtattaatgctggttgctcattatgctataattggccctggtctacaggccaaagcaacaagagaagcacaaaaacgaaccgccgcaggaattatgaaaaacccaaccgttgatggaatcgttgccatagacttagaccccgttgtatacgatgcaaagtttgaaaaacagctcggacaaataatgctgttgattctgtgtacaagtcaaatattattaatgcgaacaacgtgggctctttgtgagtcgataacattagccacaggtccactaacgactctctgggaagggtctcctgggaaattctggaacacgaccatcgcagtaagtatggcgaacatatttcgtgggtcgtatcttgctggtgcaggacttgcatttagtctaatgaaaagtcttggaggtggtagacgaggaactggagcccagggcgaaaccttgggagaaaaatggaaacgacagttaaaccaacttagcaaatccgagtttaatacttacaagagatccggtataatggaagtagatcgatctgaggccaaagaaggtctaaaacgaggagaaacgacaaaacatgcagtgagcagaggaacagcaaaactcagatggttcgtcgaacgaaatttagtaaaacctgaggggaaagtaatagacctaggatgcggacgaggagggtggtcctactactgtgcaggcctcaagaaagttactgaagtaaaagggtatactaagggcggacctggccacgaagaaccaataccaatggctacatatggctggaatatcgttaaattacacagcggacgtgatgtatttttcactcctccagaaaaatgcgatacgctactatgtgacataggtgagagctctccgaacccaactatagaagaagggcgaacgcttcgagttttaaaaatggtagaaccctggctacgaggaaaccaattttgtatcaaaatactgaatccttatatgccgtcagtagtggagactttagaacaaatgcagcgaaaacatggtgggatgttagtaagaaatccactaagtagaaatagtacccacgaaatgtattgggtaagttgcggaacgggtaatatagtttcggctgtaaacatgacatcccgtatgttgcttaacagatttacaatggcgcataggaaaccgacctatgaaagagatgtagatctgggtgcaggaacaagacatgtggctgtagagccagagatagccaacctagatataatagggcaaagaattgaaaacatcaaaaatgaacacaagtctacgtggcattatgatgaggacaatccgtataaaacctgggcttatcacggtagctacgaggtaaaaccatcagggtcagccagcagtatggtcaatggagtagttcgtctattaacaaaaccatgggatgtcattcccatggtaacacagatagcaatgacagatacaacgcctttcggtcaacaacgcgtatttaaagaaaaagtagatacacgtactccaagaccgaaaagagggacagcacagataatggaggtaactgctaaatggttatgggggttcctatcccgcaacaaaaagccacgcatatgtacaagagaagagttcacacgcaaagtaaggtcaaacgccgctataggcgcagtatttgtagacgaaaaccaatggaactcagcaaaagaggcggttgaagatgagagattttgggatttagtccatagggaaagggaacttcataaacaaggaaaatgcgcaacatgtgtttacaacatgatgggtaaacgcgagaagaaattgggagaatttggaaaagcaaagggaagtagagcaatatggtacatgtggcttggcgcaaggttcttagaatttgaagctctgggttttatgaatgaggatcattggttctctagagaaaattcactgagtggggtagaaggtgaaggattacataaactaggatatatacttcgcgatatttctaaaatcccaggaggaaatatgtacgccgacgataccgcaggatgggacacacgcatcaccgaagatgatttacaaaacgaggctaaaattacggacataatggaaccagagcatgccttactagcaacttccatcttcaagttaacataccaaaataaagttgtcagagtacagagacctgcaaagagcggaacagtcatggacgtcatatctcgtcgggatcaaagaggcagcggtcaagttggaacttatggactgaataccttcacaaacatggaagtacaattgattagacagatggagtccgagggaatattctctccttcagaactagaaaatagtaatctagcagaacgcgtcttggattggctagagaaacacggagtcgagagactcaaacgcatggcgatctctggagacgactgcgtagtgaaacccacagatgatcggtttgcgacagcacttacagcattaaatgacatgggaaaagtccgaaaagatatcccacaatgggaaccaagtaaaggatggaatgactggcaacaagtaccattctgttcgcatcatttccatcaactaataatgaaggacgggagggaaatagtggttccatgccgaaaccaagatgaacttgtaggacgagccagagttagccaaggggccggatggtctttgagagaaacagcatgcttaggcaaatcctacgctcaaatgtggcaactgatgtatttccaccgaagggacctcagattagcagcaaatgctatttgcagcgccgtacctgtaaactgggtccccacaagcaggacgacgtggtcaatacatgctcatcatcaatggatgactacggaagacatgctatccgtatggaatagagtatggatagaagagaatccatggatggaagataaaacccatgtgtcttcttgggaagacgtgccgtatttgggaaagagagaggatcagtggtgtggaagtctaattggactaactgctcgagcaacctgggccaccaatatacaagtggcaataaaccaggttagacgactaattggaaacgaaaattacctcgattatatgacatcaatgaaacgattcaagaacgagtcagatcctgagggagccctatggtaa

SEQ ID NO: 21982 - RNA, 9879 nt, synthetic construct
  misc_feature 1..9879: note = derived and/or modified CDS sequence (opt6) from DENV-1__KT187562__SS-prME
  source 1..9879: mol_type = other RNA
tctgtaactatgttattaatgctattaccaaccgctttagcatttcatctaactactcgaggaggtgaaccacatatgattgtatcgaaacaagagagggggaaatcattacttttcaaaacttctgctggggttaatatgtgtacattaatagcaatggatttaggtgagctttgtgaggacactatgacatataaatgcccgaggataaccgaagcagaaccagatgatgttgattgttggtgcaacgcaaccgatacatgggtcacatacggtacttgctctcaaaccggcgaacaccgaagggataaacgatcagttgctttagcaccgcatgtaggactaggtttggaaacccgaacagaaacatggatgtcttccgagggagcctggcgtcaaatccaaaaagtagagacatgggcacttcgtcaccccggttttacagtgatagcacttttcctagcacatgcgataggaacctcgataacacagaagggaataatattcatattgctaatgttagtaacaccgagcatggcaatgagatgtgtcggaattggtaatcgtgacttcgtggaaggcctgagcggggcaacatgggtagatgtagtcctagagcacggatcgtgcgtaacaacaatggccaagaataagccaacactagacatagagctcctgaaaacagaagtcaccaatccggccgtgctaaggaaactatgcattgaagctaagatctccaatacaactacagatagcagatgtcccacacaaggagaggcgacgttagtcgaggaacaagatgcaaactttgtgtgccgtaggacttttgtagatcgaggttggggcaacggatgtggactttttgggaaaggctctctgcttacttgtgcgaaatttaaatgtgttacgaagctagaagggaagatcgtccaatatgagaatttaaaatactctgttattgtgacagttcacacgggagatcaacatcaagtaggcaatgaaactacagaacatgggacaatagcgacaattactcctcaagctccaacttcagagatacaattaacagattatggtgcactgactcttgactgttcgcccagaacaggcttagatttcaatgaaatggtcttgctaacaatgaaagaaaaatcatggcttgtacacaaacagtggtttctagatttgccactcccgtggacaagtggggcttccacatcacaagaaacttggaatcgacaagacctactcgtcacgttcaagaccgcacacgccaagaaacaagaagtagttgttttgggaagccaagaaggtgctatgcacaccgcattaacaggagcaactgaaatacaaacgagtggcaccacaacaattttcgcaggccacttgaagtgcagattaaagatggataaacttacgttaaaaggtgtttcatatgttatgtgtactggttcatttaaactagaaaaagaagtagcagaaacacaacatggtacagttttagtacaggttaaatacgaagggactgatgctccttgcaagattccaatctcaacgcaagacgaaaaaggggtcacgcaaaacggcagactgatcactgccaatccaattgttaccgataaagaaaagcctgttaatatcgaaaccgaacctccatttggagaaagctacattgtaatcggagccggcgaaaagacattaaaactctcttggttcaagaaaggaagtagtataggtaagatgtttgaagccacagcaagaggagctagacgaatggcaatcttgggagatacagcatgggacttcggatcgatcggtggagtattcacaagtgtagggaagctagtacatcaagtcttcggaaccgcttatggtgtactttttagcggcgtatcgtggactatgaaaataggcattggcatactattaacgtggctaggattaaactcacgatcgactagcttgagtatgacttgtattgcagtcggaatggtaactttatacttaggagtcatggtccaggcggacagtggatgcgtaataaattggaaaggacgagaactaaaatgcggatcaggaatttttgtaaccaacgaagttcatacgtggaccgagcaatataaattccaagcagactcgccgaaacggttgtctgctgcgataggcaaggcatgggaagaaggggtctgtggtatacgatcagctacacgactcgaaaacatcatgtggaagcagatatcaaatgaactaaatcacatcttgttagagaacgatatgaagttcaccgtcgtggtgggcgatgcaaacggtatacttacacaaggaaagaaaatgataaggccccaacccatggaacataaatactcctggaaatcctggggcaaagctaaaatcataggagcagatacacaaaatacgacatttataatagatgggccagacactccagaatgtccagacgatcaaagggcatggaacatttgggaagtcgaagactatggtttcggagtttttacaacaaacatttggctaaaattaagagatagttatactcagatgtgtgaccaccgactcatgtcagctgctattaaagactcaaaagcggtacatgcagacatgggatattggatagaaagtgaaaagaatgaaacttggaaacttgcacgagcgtctttcatcgaagtaaaaacgtgtatctggccccgcagccacacgttatggagtaatggtgttttagaatcggagatgatcataccgaaaatatatggcggtcccataagtcaacataattatagaccaggatatttcacccaaacagctggtccatggcatttgggaaaattagagctggactttaatttgtgcgaaggtacaactgtggtcgtagatgaacactgcggaaatagaggaccatcattaagaacaactacagttacaggcaagatcatacatgagtggtgttgtcgctcatgtactctcccaccgctgagatttcgaggagaggatggctgctggtatggcatggagattaggccagtaaaggaaaaggaggaaaacttggtcagaagtatggtatcagctggaagtggagaagtggatagcttcagccttggtctactctgcgtttcaattatgattgaggaagtaatgcgctcaagatggagtagaaagatgttaatgacagggacactagcagtcttctttctattaatcatgggacaattaacctggaatgatttgataagattatgcattatggtaggcgcgaatgtcagcgatagaatggggatgggaacaacatatctcgcacttatggcaacttttaaaatgagacctatgttcgctgtgggacttttgtttagaagattgacgagtagggaggtattattgctaactataggactatcgttagtggcctctgttgaattaccgaatagtctagaagaattaggagacggacttgcaatgggaataatgatgttaaaactattaactgatttccaaagccaccaactttggaccacattactatccttaacttttattaaaaccacactaagtctagattatgcttggaagactatggccatggtactatctatagtttccctctttcctttatgtcttagcacaacatctcagaaaaccacttggttgcccgtattacttgggtcttttggctgtaaaccactaacaatgttcctaataacggaaaataaaatttggggcagaaagtcatggcccttaaatgagggaataatggccgtgggaatagtcagcatattactttcttcgttacttaaaaacgatgttccgttagctggtccactgatagcaggagggatgctaattgcatgttacgtaatatctggatcaagtgctgatttgtcattagaacgcgccgctgaagtatcctgggaagaagaggccgaacattcaggggcttcacacaacattctggtagaagtacaagatgacggaaccatgaaaataaaagatgaggaaagggatgatacgttaacaattcttttaaaagctacactcctcgcagtgagcggcgtatacccaatgtctattccggctactctcttcgtgtggtatttctggcagaagaagaaacagaggagcggggtcctttgggacactccatctccacctgaagtggagagagccgtgctcgatgacggcatctacagaatactgcagagaggattacttggtcgatcgcaagtaggagtgggcgttttccaagatggtgtatttcacactatgtggcacgtaaccagaggggcagtgttgatgtaccaaggaaaacgcttagaaccttcctgggcgtctgtcaagaaagatctcatatcttatggaggtggatggagattccaaggttcgtggaatactggtgaggaagtacaagttatcgctgttgaaccagggaagaacccaaagaatgtacaaaccacaccaggcacttttaagacaccagagggagaagtcggcgcaatagcattggacttcaaaccaggaacatctggatcgccaattgtgaatagagaaggcaagattgtaggcttatatggtaacggcgtagttactacaagtggtacttacgtcagtgcaatcgcacaggctaaagcatcacaggaaggtcctctgccggagatagaagatgaagtgtttaaaaagagaaacctaactataatggatctccatccaggttctggaaaaaccaggagatatcttccagctatagtaagagaagctataaaaagaaaactacgtacacttatcttagcacctacaagagtcgttgcatcagaaatggcagaagcgttaaagggcatgcccataagatatcaaacgacagctgtaaaatcagaacacaccggtaaagaaattgtagatctaatgtgccatgcgacatttacgatgagacttttaagcccagtacgagttccaaactacaatatgattatcatggacgaagcccatttcaccgaccccgcaagcatagcggcgagaggctacatctctacacgcgtcgggatgggtgaagcggcagctatttttatgactgcaactccgccaggctctgtagaggcattcccacaatccaatgccgtaatacaagacgaagagagagacatcccggaacgaagctggaatagcgggtatgattggataaccgattttccaggaaaaacggtttggttcgtaccttccataaaatccgggaacgacatagctaactgtcttaggaaaaatggaaaacgggttattcagcttagtcggaagacgtttgacactgaataccagaaaacgaaaaacaatgattgggattacgtcgtaacgaccgatatttcagaaatgggagcgaactttagagccgaccgagtgatagatcctagaaggtgtctaaaaccagttattctaaaggatggacctgaaagggtaatactagcgggaccgatgccggttactgcagcaagtgcagcgcaaagacgcggacgcatcggtcgcaaccagaataaggaaggcgaccaatatatatacatgggccaacctttgaataacgacgaagatcacgcgcattggactgaagcgaagatgttgttagataatattaacacacctgaaggaataatacctgcgttgttcgaaccagagcgagagaaaagtgcagcaatagacggtgaatacagactgcgaggggaagcacgaaaaaccttcgtcgagcttatgcggagaggggatctaccagtgtggttatcgtataaagtagccagtgaagggtttcagtactccgatagaagatggtgtttcgacggcgaacgaaataaccaggttctagaagaaaatatggacgtagaaatctggacaaaggaaggagaaagaaagaaactaaggcccagatggctagacgccaggacatacagtgatcctcttgcattacgagaatttaaagaatttgcagcaggtagaaggagtgtatcaggagacctgattcttgaaattggaaaattaccacaacacctgacactacgtgctcagaacgcattggacaacctcgttatgttgcataattcagaacagggaggtaaagcatatagacatgctatggaagaattacccgatacaattgagactttgatgttactagcgctgattgcagtattaacaggtggagtcactttattctttctcagcggtaagggacttggaaaaacttcaatagggctcttatgcgtaatggcctcgtccgtactcctgtggatggcaagcgtagaaccgcattggattgcagcatccattattctagagttctttcttatggttttattgatacccgaaccagatcgtcaaagaaccccgcaggataaccaattagcatacgtagttattggtttgttgttcatgatactaacagtagctgcaaacgaaatgggactattggaaacaacaaagaaagacttaggaataggccatgtggttgctgaaaatcaccaccatgctacaatgctagatatagacttgcatcccgcatcagcctggaccctatacgctgttgctacgactataataactccgatgatgcgccacacaatcgagaataccacagccaacattagcctaacggccatcgctaatcaagccgcgatattaatgggtttagataaagggtggcccatttcgaaaatggatatcggcgtcccgctgctcgctttgggatgctatagtcaagtgaatccactaacgttaactgcagctgtccttatgttagtagcacattatgccattataggaccgggtttacaagcaaaggccacaagggaggcccaaaagcgaactgcagcaggcattatgaaaaacccaactgtggacggcatagttgcaatagatttggacccggtcgtatacgacgctaaattcgaaaaacaactaggccagataatgctactgatactttgcacatctcaaatattacttatgagaacgacctgggcattatgtgaatcaataacgctagctacagggcctttaacaaccctatgggaaggaagcccggggaaattttggaatacaaccatagcggtatcgatggccaacatattcagaggctcatacctcgctggagctggattagccttcagtctaatgaagtccctcggcggaggacgaagaggtactggagcacaaggagaaacattgggagagaaatggaaaagacaacttaatcagttatcaaaatcagagttcaatacttataagcgatctggaataatggaagtcgatcgatcagaagccaaagaaggtttaaaaagaggggaaacaacaaagcatgctgttagtagaggtacagcaaaacttcgatggtttgttgaaagaaatttagtgaaaccggaagggaaggtcatagatttgggatgtggaagaggagggtggtcatactattgtgctggcctgaagaaagttaccgaagtgaaaggatatacaaaaggtggaccaggacacgaggaacctatcccaatggccacatacggttggaacatagtaaagttacattcgggcagggatgtattctttacaccgccagaaaaatgcgatacgttattgtgcgatataggcgaatcaagccccaatcctactatagaagagggtcgaacactacgggtcttaaaaatggttgaaccctggctgagaggcaaccaattctgcattaaaatactgaatccttatatgccaagtgtagtcgaaactttagaacagatgcaacgcaaacacggagggatgttagtacggaaccccttgtccagaaacagtacgcatgaaatgtactgggtgtcgtgtgggactggaaatatagtatctgcagtaaatatgacctcgaggatgctactcaacagatttacaatggctcaccggaaacccacgtatgagagagacgttgaccttggggctgggacaagacatgtagctgtagagccagaaatcgccaatctcgatataatcggtcaaagaatagaaaatataaagaatgaacataaaagtacatggcattatgatgaagataatccatataagacatgggcgtatcacggaagctacgaagtcaagccgtccggatccgcatcttcgatggtaaatggagtggtccgattattgactaaaccttgggatgtaatccctatggtcacacagatcgcaatgacggacaccaccccttttggtcaacaaagagtttttaaggaaaaagtagatactcgcacacctagacccaagagaggcaccgctcaaataatggaagtaactgcaaaatggctatggggtttcttgtcacgaaacaagaaacctagaatctgtactcgagaagagtttactaggaaagtacgcagtaatgctgctatcggtgcggtattcgttgatgaaaaccaatggaactcagccaaagaggccgtagaagacgagcgattttgggatctagtgcacagggaaagagagctccataaacagggaaaatgcgcgacctgcgtatacaatatgatgggaaaaagagaaaagaaattaggggaatttgggaaggcaaaaggatcgcgagctatctggtatatgtggctaggcgcaaggtttttagagtttgaggccttaggattcatgaacgaagatcactggttctcaagggaaaattctctgtccggtgtcgaaggtgaaggcctccacaaacttgggtacattttaagagatattagcaagatccccggcggaaacatgtacgcagatgatacagccggctgggatacgaggattactgaggacgatctacaaaatgaagctaagataaccgatatcatggaacctgaacatgcattattagctacatcgatatttaaactaacttaccaaaataaggtggttagagtacaaaggccagcaaagagtgggacagtcatggatgtaataagtcgaagagaccaaagaggttcgggacaagtaggtacctatggcctcaacacattcactaacatggaagtacagttgatacgccagatggaaagcgaaggaatattttcaccatctgaactagagaatagtaatcttgcagaacgagtcctagattggctcgaaaagcacggtgtcgaaagactcaaaagaatggcaatttcgggtgacgattgcgtggtgaaacctacagacgatagattcgccacagctttgactgcgcttaacgatatgggcaaagtacgcaaagacatacctcagtgggaaccatcgaaaggatggaatgattggcaacaagtcccgttttgcagtcatcattttcatcaactaattatgaaggatggtagggaaatagttgtaccttgtcgtaatcaggacgaattagttgggagagcacgtgtatctcaaggcgcagggtggagcctccgtgaaacagcttgtctcggaaaatcttatgctcagatgtggcaactaatgtactttcatagacgtgacttacgattagcagcaaacgctatatgcagtgccgtacctgtgaattgggttccaacctctagaacgacttggtcaattcatgcacaccaccagtggatgacaacagaagatatgttgtcagtatggaatcgagtttggattgaagaaaatccctggatggaggataagacgcacgtatcgagctgggaagatgttccgtatttgggtaagagagaggatcagtggtgtggctctttaatagggttaacagcacgagcgacttgggccacaaacattcaagttgcaataaaccaagtcagaagactgataggcaacgagaactacctggattatatgacaagtatgaaaagattcaaaaatgaaagcgatccagaaggagctctatggtag

SEQ ID NO: 21983 - RNA, 9879 nt, synthetic construct
  misc_feature 1..9879: note = derived and/or modified CDS sequence (opt6) from DENV-1__JQ045628__SS-prME
  source 1..9879: mol_type = other RNA
agtgtgactatgctcttgatgctgatgcccacggccctggcgttccacttaacaacaaggggaggagaaccacacatgatagtatccaagcaagaaaggggaaagagtttactttttaaaacatctgctggtgttaacatgtgtacacttattgcgatggatctaggtgaactttgtgaggatacaatgacatacaagtgtccgcggattacagaaacggaacctgacgatgttgattgttggtgcaacgctacagatacgtgggtaacgtatggtacatgctcgcaaacgggagaacaccgacgagataaaagaagtgtagcactagcaccccatgtcggtctaggtttagagacgcgtacggaaacgtggatgtcaagtgagggagcttggaaacagattcaacgggtagagacatgggccttaaggcacccgggtttcactgtcatagccttctttctagctcacgccattggaacaagcataacacaaaagggaataatttttatacttttaatgttagtaaccccgtcaatggctatgcggtgtgtggggatcgggtcccgagacttcgttgaaggtctgagtggggcaacttgggtagacgtagtattggagcacggtagttgtgttaccacaatggcaaaggacaaacctaccttggacatagagttattaaaaacggaagtcacaaatcctgcgatattacgcaaactttgtatagaggcaaagatttcgaatactacgacagatagtaggtgtcctacacaaggcgaagctaccctagtagaagaacaagacgccaacttcgtgtgtaggcgtacgttcgtagacagagggtgggggaacggatgtggattgtttgggaaaggatcacttatcacatgcgcaaaatttaaatgcgtcaccaagttagaaggtaaaatagtacaatacgaaaatttaaaatattctgtaattgtaacagttcatacaggtgaccaacaccaggttggtaatgagtccacggaacacgggaccacagcaacaattacgccacaagcaccaaccacagaaatacagctgaccgattatggagccctaactctagattgtagtcctcgaactggtctcgatttcaatgagatggtcttgctaactatgaaggagaaaagctggttagttcataagcagtggtttttagacttaccacttccttggacatcaggagcctcaacaagtcaggaaacctggaatcgtcaagatttgctagttacttttaaaacggcacacgcgaagaaacaggaagtagtagttctcggatcacaagaaggcgcgatgcacacagcactcacaggagctacagagattcaaacttcgggtactactaccatatttgcaggacatttgaaatgcaggctgaaaatggataaattaacactgaagggaatgagttatgtaatgtgtacaggctcattcaaactggaaaaagaagtcgcggaaactcaacatggaaccgtcctagttcaaattaaatatgagggcactgatgctccttgcaaaattccattcagcactcaggatgaaaaaggcgttacccaaaacggaagactcataacggcaaatccaattgtaacagataaggaaaagcccgtgaacatagaggctgaaccaccatttggagagtcatatatagtaataggagcaggcgaaaaagcacttaagctctcctggtttaaaaagggaagcagcattggaaaaatgttcgaggcgaccgcaagaggggcgcgaaggatggcaatattaggagatacagcttgggatttcgggtcaattggaggggtctttacgtcggtaggtaaattagtccatcaaatcttcgggactgcatatggcgtattattctcaggagtaagctggacaatgaaaatagggataggtgtcttattaacttggctaggactaaattcaagatcaacttctctaagtatgacctgtatcgcagtcgggctagttacactatacttgggggttatggtacaagcagatagtggatgtgtgatcaactggaaaggcagagaattaaaatgcggatcagggatattcgtgaccaatgaagtacatacttggacagagcaatacaagtttcaggccgatagtccaaaacgtctgtcagcagctataggcaaagcgtgggaggaaggtgtatgtgggatcaggtccgcaacacgactagagaatattatgtggaaacagatatctaacgaactgaatcacatcttactagagaatgacatgaagttcacagtagttgttggcgatgtagctggaattttagcacaaggtaagaaaatgattagaccccagccgatggaatataaatacagttggaaatcctggggcaaagctaaaataataggcgcagacgtccaaaatactacattcattattgacggaccaaatactcctgaatgtcctgatgatcaacgcgcatggaacatttgggaagtagaagattatggctttggtatttttaccacgaacatatggttaaaacttagagattcctacactcaggtctgcgaccatcgacttatgagtgccgcgataaaagatagtaaagctgtacatgcggacatgggctattggattgaaagtgagaagaacgaaacatggaaactggctcgagcaagtttcattgaagtcaagacatgtatctggccgaaatcccacacgttatggtcaaatggagtgttagagtctgaaatgatcattccgaaaatttacggcggaccgataagccagcataattatagaccgggatattttacacaaactgcaggtccatggcaccttggaaaattagagctggatttcgatctatgcgaggggactacggtagttgttgacgaacattgcggaaatagaggccctagtttacgaactactactgtaacaggtaaaattatacatgagtggtgttgcaggtcttgtactctgcccccactaaggttcagaggggaagacgggtgttggtacggaatggaaatacgacctgttaaggaaaaggaggaaaacttagtcaaaagcatggtttccgccggttctggagaagtagactccttctcattagggcttctctgcataagtataatgatagaagaagtaatgaggtctagatggtcaaggaaaatgttaatgaccggaacactcgccgtattcttattattaatcatgggacaattaacgtggaatgatctaatcagattatgtatcatggtaggcgctaatgccagtgacaggatgggaatgggtacaacatatctcgcgctaatggcaacatttaaaatgagaccgatgtttgctgttggacttcttttcagaaggctaacatctagggaagtattgctactaacgataggtttgagtctagtggcttcagtagaattacctaatagtttagaagaattaggagatggcttagcaatgggaataatgatacttaaactattgacagatttccagtcacaccaactatgggcaactctcctttccctaacgttcattaaaacaacattttccttacattacgcttggaaaactatggctatggttttatcaattgtaagtctatttccgttatgcctaagcacgacttcacaaaagactacctggttaccagttctattgggatcacttggttgtaaaccattaacgatgttcctaatagcggaaaataaaatatggggtcgacgatcttggcccttaaatgaaggaataatggcagttggaatagtaagcatcctactgtccagcctgctcaaaaatgacgttccactggcaggtcccctaattgcgggaggtatgcttatcgcatgctatgttataagtggaagctcagctgatctgtcgctagaaaaagcggcggaggtttcctgggaagaggaagcagaacattcgggagcatctcataatatactggttgaagtgcaagacgacggaaccatgaaaattaaagatgaagaaagagacgatacattaactatattgttaaaagcaactttacttgcagttagcggagtttatccattaagtataccagcaacattattcgtgtggtatttctggcagaaaaagaaacagaggtctggagttttgtgggacactccgagcccaccagaagttgagcgtgctgtcctagatgatggaatatatcgaataatgcagcgtggtttattaggccgatcacaagtcggcgtgggagttttccaggaaaacgtattccacacaatgtggcacgttaccaggggtgctgtcttaatgtatcaaggaaaacgccttgaaccatcatgggctagcgtcaagaaagacctaatctcttacgggggaggttggagattacaaggtagttggaataccggggaagaagtacaagtaatagccgtggaacctgggaaaaaccctaaaaatgttcaaactactcctggaacattcaagaccttagaaggggaggtgggtgcaattgctttagattttaaacctggcacttcaggttcacctattgtgaatcgagaaggtaagatagtgggactctatggaaatggcgttgtgacaacctcagggacatacgtgagtgctatagcgcaggcaaaagcaagccaagaagggccgttgccagaaattgaggatgaagtatttcgtaaaagaaatctgactatcatggatcttcacccaggcagtggcaaaacgaggaggtatcttccagcaatcgttagagaggcaataaagcggaaattacgaacgttaattctagctccaacacgtgtggtggcctcagaaatggcagaagctctaaagggaatgccaataaggtaccagacaaccgcggtcaaaagcgaacataccggaaaggagattgtagacttaatgtgtcacgcgacatttacaatgcgtcttctcagccctgttagagtgcccaattataatatgataattatggatgaagcccactttactgacccatcttctattgcagcaagaggatatatctcaacacgtgtgggcatgggtgaagcagccgctatttttatgacagcaactcccccaggatccgttgaggcattcccgcaaagtaacgcagtcatacaagacgaggaaagagatatcccagaacgatcatggaatagtgggtatgaatggataacagattttccaggaaagactgtttggttcgtgccgtcgataaaatcggggaatgatattgcaaactgtcttcggaaaaacggaaagagagtcatccagttatcaagaaaaacctttgatacagagtatcagaaaaccaaaaacaatgactgggattatgtagttactaccgacatatcggaaatgggagctaatttcagagccgatagagtaatagatcctcgaagatgtctcaagccagtaattttaaaagatggtccggaaagggttatactagcagggcccatgcctgtaacagttgcctctgcagcacaaaggaggggacgcataggaagaaatcacaacaaggaaggagaccaatatatctacatgggacaacccctaaacaatgatgaagatcacgctcactggacagaagcgaaaatgttgctagataatataaacacacccgaaggcattataccggcgctctttgaaccggagcgagaaaaatctgctgcaatagatggagaatatagattgaggggagaggctagaaaaacatttgtagaattaatgcgcagaggagatcttccagtatggttgagttacaaagtagcaagcgaaggttttcagtacagtgatcgtagatggtgttttgatggggaaagaaataatcaagttctggaagaaaatatggatgtagaaatatggacaaaggaaggagaacgcaaaaagttacgcccaagatggctggatgcaagaacatattccgacccactagctttgcgggagttcaaagagtttgccgctggacgccgttcagttagtggagatctcattctagaaatcgggaaactacctcagcacctaacacagagagctcaaaatgcgttagataacttggttatgcttcataattcagagcaaggtggccgtgcttatcgccacgctatggaagaactaccggatacaatagagacacttatgctcttagcacttattgcagtattaaccgggggagtaactctcttctttctatcgggtagaggtctgggaaaaaccagcattgggttattatgtgtaatcgcatcttcggtcttactgtggatggccagcgtagaaccccactggattgccgcttcaattatcttagaatttttcctcatggtgctcttaataccagagccagatcgacaacgcacaccgcaggataaccaattagcgtatgtcgtaatcggcttattatttatgatattaacagttgctgcaaatgaaatgggcttactagaaacaacgaagaaagatcttggtataggtcatgttgcagtgggaaatcatcatcatgccgcaatgctagacgttgaccttcaccccgcgtctgcgtggactctttacgcagttgctacaaccataataacacccatgatgcgtcacacgattgaaaatacaacggcaaatatatcattgacagcaatcgcgaatcaagccgcaatattgatggggttggacaaggggtggccgattagtaagatggatatcggagtccctttgctcgccttagggtgctattcgcaagttaatccgctaacattaaccgccgcagtactaatgctagtagcacactatgctatcattgggccaggactacaagccaaagcaacccgtgaagcacaaaaacgaaccgccgctggcatcatgaagaacccaacagttgatggaattgtcgcgatcgacttagacccagtggtttacgacgcaaaatttgagaaacaactaggacaaataatgttattaatattgtgtacgtctcaaatactacttatgagaacaacctgggctctttgcgaatcgataactcttgcaacaggtccattgactaccctatgggagggcagcccagggaaattttggaatacgactatagctgtaagtatggctaatatatttcgtggatcatatttagcaggagccggtctggcattttccttaatgaaatcactaggtgggggccggcgtggaaccggggcacaaggagagacacttggagaaaaatggaagcgacaactaaaccagttgagtaagagcgaatttaatacatataaaagatccggcataatggaggttgacaggtctgaagccaaggaagggcttaaacgaggcgaaaccacaaagcatgcagtaagtcgtggtacagcaaagctaaggtggttcgttgaaaggaacctagttaaacccgaaggaaaagtaatagaccttggatgtggtcgaggaggttggagttactattgcgcaggactaaagaaagtgaccgaggtaaagggatatacaaaaggtggacccggacacgaagaaccaatacctatggccacctacggatggaaccttgttaaattacactctggcaaggatgtgttctttattccacccgaaaaatgcgacacccttttatgtgatataggagaatcatcaccaaaccccaccatagaggaaggacgaacattacgagtgttgaaaatggtagaaccctggctgagaggaaatcaattttgcataaaaattttgaatccttacatgccaagcgtcgttgaaacactagagcagatgcagagaaaacatggaggtatgttggttagaaatccactatcgcgaaactctacacacgagatgtactgggtcagttgtggcacaggaaatattgtaagtgcagtaaatatgacatcaagaatgctgttaaataggtttaccatggctcacaggaagccaacgtatgaaagggacgtggatttaggcgcaggcacgcgccatgtagctgtagaaccggaggtagctaatttagatattatcgggcaaagaattgagaatataaaacacgaacataaaagcacatggcactatgacgaggataacccatacaaaacgtgggcataccacggatcttatgaagtaaaacctagtggctccgctagcagcatggtgaatggcgttgttaagttattaaccaagccatgggacgttataccaatggttactcagattgcaatgaccgatacgaccccatttggtcaacaacgtgtttttaaagaaaaggttgacactcgaacacctaaggctaagcgaggtacagcacaaattatggaggtcactgcaaaatggttatggggattcctatcacgtaacaaaaagccaaggatttgtacaagagaagagttcactaggaaagtacgcagtaatgctgctattggagcagtattcgttgatgaaaatcaatggaactcagctaaggaagcagtagaggacgaaagattctgggacctggtacacagagaacgagagctccataaacagggaaaatgtgccacatgtgtgtataacatgatgggaaaaagggagaagaaacttggagaatttgggaaagcaaaaggtagcagagcaatttggtacatgtggctgggtgcacgattcctagaatttgaagcactgggttttatgaatgaagatcattggttcagtagagaaaattccctttccggcgtcgaaggagaggggcttcataaattggggtacattctacgcgatatatcaaaaataccgggaggtaacatgtacgcagatgatacagccgggtgggatactaggataacggaagatgacctacaaaatgaagccaggatcacagacataatggagccagaacatgcattgttagctaaatcaatttttaaattgacataccaaaataaggtggtccgtgttcaaagaccagccaaaaatggaaccgttatggatgtaatctcccgtagggatcaaagaggatcaggacaagtcggcacatacggcttaaacacatttaccaacatggaagcgcaattaatccgacaaatggaatctgaaggcatattctcgccttcagaactggaaacacccaaccttgcagaacgagtgttagactggttagaaaaatatggtgttgaacggttaaaaaggatggccatatcaggtgacgactgtgttgttaagcctatcgacgatcgttttgcaaccgctcttacagctttaaatgatatggggaaggtacgtaaagacataccacagtgggaaccatcgaaaggatggaacgactggcaacaagtaccgttttgctcccatcatttccatcaattgataatgaaagatggacgtgaaatcgtcgttccttgcagaaaccaagatgagctcgtaggccgtgcaagggtctctcaaggagcaggatggtcacttcgagaaactgcatgcctcgggaaaagctacgcacaaatgtggcagttaatgtatttccatcgccgggatctaaggctcgcagcgaatgcaatatgctccgcagttcctgtagattggatcccaacatcacgcaccacatggagtatacacgcgcatcatcaatggatgacaaccgaagacatgctgtcggtatggaatagggtttggattgaagagaatccatggatggaggataagacacatatatcgtcttggggcgatgttccttatttgggaaaaagagaggaccagtggtgcgggtcattaatcggtttaactgcaagagcaacttgggcgacaaatattcaagtcgccattaatcaagtacggcgactaatcggtaatgaaaattatcttgattatatgacttctatgaaacgattcaaaaatgaatctgatcccgaaggagcgctatggtaa

SEQ ID NO: 21984 - RNA, 9879 nt, synthetic construct
  misc_feature 1..9879: note = derived and/or modified CDS sequence (opt6) from DENV-1__JQ045629__SS-prME
  source 1..9879: mol_type = other RNA
tctgtaaccatgttactaatgctgatgccgactgcattagccttccacttaactaccaggggaggtgaaccgcatatgatggtttcaaaacaagaacgcggcaaaagtctactcttcaaaacgtcagcaggagtaaatatgtgcacattaattgctatggatctcggtgaactttgcgaagacacaatgacttacaaatgcccgcggatcaccgaaacggagccagacgatgttgattgctggtgtaatgctaccgacacatgggtaacatacgggacctgcagccagacgggtgaacaccgacgagacaaacgatcggtcgcactagcaccacatgtgggactaggacttgagacacgaacagaaacctggatgtcgagcgaaggtgcgtggaaacaaatccagagagtcgaaacgtgggcactccgtcatcctgggtttacagtaatcgccttatttttagcgcacgccataggaacaagtattacacaaaaaggaataatttttatactgttaatgctagtaacaccaagtatggccatgagatgtgtgggtattggctctagagattttgttgagggactaagcggagccacgtgggtcgatgtggtgctcgaacatggttcttgtgtcacaactatggcgaaagataaaccaactctggatatagaattattaaagaccgaggtcactaatccggcagtcttacgtaaactgtgcatcgaagcaaagattagcaacactacaacggatagtaggtgcccaacacaaggagaagcaactttagtagaggagcaagacgctaatttcgtgtgtagaaggacatttgtagatcggggttggggcaatggttgcggacttttcggtaaagggagtcttataacatgtgcgaaattcaaatgtgtaacaaaattggaaggtaaaattgtacaatatgagaacctaaaatattccgtaatcgttacggtgcacactggagatcaacatcaggtaggcaatgaatcaacagagcatgggacgacagctacgataacaccccaagccccaactacggaaatacagttaacggactatggcgccctaacgttagattgcagtcctaggaccgggcttgattttaatgagatggtacttctcacaatgaaggaaaagagttggctggttcacaaacagtggttcctagatctacccctaccttggacatctggggcatcaacaagtcaggaaacctggaatagacaggatctactcgtgaccttcaagactgcacacgcgaagaagcaagaagtggttgtcctcggcagtcaggaaggagcaatgcacacggccctaacaggagcaacggaaatacagacatcaggaaccactacaatttttgcaggacacttaaagtgtagacttaaaatggataagttaacacttaaaggtatgtcctacgtaatgtgcacgggatctttcaagctagaaaaggagttagcggaaactcaacatggtacagttctcgttcaaataaaatatgaagggaccgacgctccatgcaaaattccttttagtacccaagatgaaaaaggtgtcacccaaaacggaaggttaatcactgccaatcctatcgtcacagataaagagaaacccgtgaatatcgaagcagaacctcctttcggcgagagttatatagttattggagctggtgaaaaagcactaaaactaagctggtttaagaaaggttcatcaattgggaagatgttcgaggcaactgcaagaggtgcgaggcgtatggctatacttggggacaccgcttgggatttcggatcaatcggcggagtatttacttcggtcgggaagctcgtacaccagatctttggcacggcatacggtgtactatttagtggtgtctcatggaccatgaaaatcggtataggagtcctattgacgtggttgggtttaaactcaaggagtacaagtctttcgatgacatgcattgctgtggggctagtaactttgtatcttggagtaatggtccaagccgatagcggatgtgtaatcaactggaagggtagagaactaaaatgtggctccggtattttcgtaactaatgaggttcatacttggacggaacaatacaaatttcaggcagattcgcctaaaaggttatcagcagcgatagggaaggcttgggaagaaggagtatgtgggataaggtctgctactaggttagaaaatattatgtggaaacaaatttcaaatgagttaaatcatatcctcttggaaaacgatatgaagtttactgtcgttgtgggcgatgttgcaggtatattagcgcagggaaagaaaatgatacgcccacaaccaatggagtacaaatattcatggaaaagttggggaaaagccaagataataggcgcggatgtacaaaatacgacgttcattatagatggaccaaataccccagaatgtccagacgaccaaagagcttggaatatatgggaagttgaggactatgggtttgggatctttacaactaatatttggttaaaactgcgagattcacatacccaagtatgtgatcatagactgatgtctgcagccataaaagacagtaaagcggttcatgcggacatgggatattggatagagtctgagaaaaacgaaacatggaaacttgcaagagcgtcttttattgaagttaaaacctgtatttggcccaaatcacataccctttggtctaacggagtactagaatcagaaatgataataccaaaaatctacggcggtccgatttcccaacacaattatcgtccgggatattttactcagacagctggaccctggcatctaggcaaacttgaacttgatttcgacctctgtgaaggaaccactgttgtagtcgacgaacattgtggcaataggggtccttcattacgaacaactaccgtgacaggtaaaatcattcacgaatggtgttgtcggagttgtacattaccaccactcaggtttcgaggggaggacgggtgctggtacggcatggaaattaggccagttaaagagaaggaagaaaacctcgtgaaatcaatggtcagtgctggatccggcgaggttgattctttctcgctcggtctcttatgtataagtataatgattgaggaagtaatgagaagcagatggtctcgaaaaatgttaatgactggcacgttagcggtattctttctattaattatgggacaattaacctggaatgacctgatacgtctttgcataatggtaggggcgaatgcttctgatagaatgggcatggggacaacttacttagctctcatggcaacatttaaaatgcgcccaatgtttgcggtaggcctactattcagacgtcttacttccagggaagttcttcttttaactataggattaagtctagtagccagtgttgaactgcctaattcactagaggaattaggagacggactagcgatgggcataatgatattgaaattactcactgacttccaatcgcatcagctgtgggcaactttactcagtctaacctttataaaaacaacattctcattacattacgcttggaaaacaatggcaatggtactcagcatcgtaagtctattcccactctgcctcagtacaacttctcagaaaacgacctggctcccagtcctcttgggatcattaggatgtaagccattaacgatgtttctaatagcggaaaacaaaatttgggggcggagatcatggccattaaatgaaggaataatggcggtcggcatagtctcaatattactttcaagtcttcttaagaatgatgttcctttagcaggcccattaatcgctgggggaatgctaattgcatgctatgtaatttcagggtcaagcgcggacctgtccctcgaaaaggcagcagaagtttcatgggaagaggaagcggagcattcaggagcatcacataacattcttgttgaagtgcaagatgatggaacgatgaagataaaagatgaggagagagatgatacactcacaatcctactaaaagccacattattggctgtatctggagtatatccgctcagtatacccgctacgctgtttgtatggtatttttggcagaagaagaaacagagaagcggcgtattatgggacacgccctctcccccagaagttgaaagagcggtattagatgatggcatctatagaatcatgcagagagggctactcggaaggtcacaggtaggagtaggagtctttcaagaaaacgtttttcacactatgtggcatgtgaccagaggagcagttctcatgtatcagggaaaacgattagagcccagctgggcttccgtaaagaaagatttaatatcttacggaggcggatggcgacttcaaggtagttggaatactggagaagaagttcaggttatagcagtcgaacctggtaaaaaccctaaaaacgttcaaacggcgccaggaacctttaagacaccagagggcgaagtaggggctattgctctagactttaaacctggaacaagcggttcccccattgttaaccgagagggcaaaatagtgggattgtacggaaacggagtagttactacatcagggacatatgtgagcgctatagcacaagctaaagcaagccaagaaggaccgctcccagaaattgaagacgaagtattcagaaaacgaaaccttactatcatggatttgcaccctgggtcggggaaaacccgtcgctaccttccggcgattgtaagggaagctataaagcggaaactacgaacactcatccttgcaccaacacgtgttgttgcgtccgaaatggcagaagcgctcaaagggatgccaattagatatcaaactacagcagtaaaaagcgaacatacgggtaaagaaattgtagatttaatgtgtcacgcgacctttacgatgaggctactatcgcctgtgagagtacctaattataatatgataataatggacgaagcacattttaccgatccatcatctatagctgcgcgaggatatatttcaacccgagttggcatgggcgaggccgccgcaatattcatgacggcaactccacctggtagcgtggaagcgttccctcaatccaatgccgtaattcaagatgaagaacgtgatataccggaaagaagttggaatagcggttacgaatggatcaccgacttccctggaaaaacagtatggttcgtgccttctataaaatcgggaaatgacattgcaaactgtctaaggaaaaacgggaaaagagtgattcaactttcaagaaaaacgtttgatacagaataccagaagactaaaaataatgactgggattatgtagtcacaaccgacatatcagaaatgggcgccaactttagagctgacagagtcatcgatccaagacgatgcctaaaacctgtaatccttaaggatgggccggagagagtaatcctagcgggtcccatgccagttaccgtagcatcggccgcacaaaggcgggggcgaataggacgaaatcacaacaaggaaggcgaccaatacatttacatgggacaaccattgaacaacgatgaagatcatgcgcattggacggaagcgaaaatgctgctagataacattaatactccggaaggcataatcccagcgctctttgaacccgaacgagaaaagagtgcagctatagatggagaatacagactaagaggggaggctcgaaaaacttttgttgaattaatgagacgtggagacctaccggtgtggctgagctacaaagtcgctagcgaaggtttccaatattccgacagaagatggtgctttgacggagagcgtaataaccaggtgttagaagagaatatggatgtagaaatatggactaaagaaggagaaaggaagaaactaagacccaggtggttggatgcgagaacctacagcgatccactggccctaagagaatttaaagaatttgcggctggacgcagaagtgtaagtggcgatttaattttagagataggcaaactgccacaacatttaactcaaagggcacagaatgccttggacaacttagttatgctccataattcagaacagggaggtcgggcataccgacatgcaatggaggagttgcccgataccattgaaaccctcatgcttttggctctaattgcggttctgacaggtggtgttactctatttttcttatccggaagaggattaggaaaaacatcgattggactattatgcgttatggcatcatcagttctactatggatggcaagtgtagaacctcattggatagctgcatccatcatactcgagtttttcttgatggttcttttgataccagaaccagacagacagagaactccacaggacaaccaattagcttatgtagtaataggtctactatttatgattctaaccgttgcagcaaatgaaatggggctattagaaactacaaagaaggatcttggaataggacacgttgctgtcgaaaaccatcaccatgcagctatgctcgatgtagacctacacccagcttcggcctggactttatatgccgttgcgacaactataattactcccatgatgcgccatacaatagaaaatacaaccgctaatatatcgctcacagctatagcaaaccaagcggccatcttaatgggattagataaaggctggccaatcagtaaaatggacataggagtcccgttattagctttgggttgttattcacaggtcaaccccctcacattgacggcagcagtattaatgttggtcgcgcattatgctataatcggcccaggccttcaagctaaggcgacccgagaagctcaaaaacgaaccgcagccggaatcatgaaaaatcctacggtagacggcatcgtagccatcgatctcgatcctgtggtatatgatgccaagttcgaaaagcaactaggtcagataatgctactaatactgtgtacatcacaaatactactaatgagaactacatgggctctatgcgaatcgatcacgctggcgactgggcctctaacaactctttgggagggaagcccaggcaaattttggaacactacgatagcagtgtcaatggcaaatattttcaggggatcatatctagccggtgctggattagcattctctctaatgaaaagcctaggcggaggccgcagaggaacaggagcacaaggtgaaacattaggagagaagtggaaaagacaactaaatcaactatcaaaaagtgaatttaacacctataaacggtcaggaataatggaagttgatcgaagcgaagccaaagaaggcctaaaaagaggcgaaaccacaaaacatgctgtaagtcgtggaacagctaaattaagatggtttgtagaacgaaacttagtaaaacctgagggtaaggttatcgatctaggatgtggccgtggtggctggagttactattgcgcaggtttgaagaaggtaacagaagtcaagggttataccaaaggaggtccgggacatgaagaacccatacctatggctacatacggatggaatctcgtaaaactccatagtggcaaagatgtcttctttataccccctgaaaaatgtgacacattactctgtgacattggagaaagttcacccaacccaacaatagaagaaggtagaaccctaagagtgcttaagatggtagagccatggcttaggggaaaccaattttgcataaaaatactaaacccatatatgccttcggtggttgaaaccctagaacaaatgcaacgtaaacacggaggtatgctagtaagaaaccctctaagtaggaactcgactcacgaaatgtattgggtatcatgtggtacgggaaacatagtttcggcagtaaatatgacaagccgcatgcttctcaatagatttacgatggctcacagaaaacccacatatgaacgagacgttgacttgggcgcgggaacaaggcacgtagcagtcgagccagaagttgctaacctcgatataattggtcaaagaatagaaaatatcaaacatgagcacaagtcaacgtggcattacgacgaagataatccctacaaaacttgggcttaccacggttcttatgaagtcaagccttcagggtcagcttcatctatggtaaatggtgtagtgaaattattaacgaaaccctgggacgtcatccctatggtaacccaaatcgccatgacggatacaacacccttcggtcaacaaagggtatttaaggaaaaagtcgacaccagaacgccaaaagctaagcgaggaaccgcacaaataatggaggtcactgcaaagtggttgtgggggtttttatcaagaaataagaagccgcgaatatgcaccagagaagaatttacccgaaaagtacgatcaaatgcagcaattggtgcggtatttgttgacgagaatcagtggaacagcgccaaggaagcagttgaagacgaacgattttgggatttagtacatagagagcgggaattacataagcagggaaaatgcgcaacctgcgtatataatatgatggggaaacgggagaagaaattaggtgaatttggtaaagccaaaggatcaagagcaatatggtatatgtggctgggcgctcggtttttggaatttgaagctctaggtttcatgaatgaagatcactggttttctcgagaaaacagcttatcgggcgtcgaaggagaaggtctccacaaattaggatacatactaagagatatcagtaaaatcccaggtggcaatatgtacgcagacgatacagccggttgggatacccgaataactgaagacgacctccagaacgaagcacggataactgacataatggagccagaacacgccttattagcaaaatcaattttcaagttaacatatcaaaataaggttgttcgagttcaaagacctgctaaaaacggaactgttatggatgtaatatcacgtagagatcaaagagggtcaggacaggtgggcacttatgggctaaatacattcaccaatatggaagctcagttaatacggcagatggaatcagaaggaatattctctccgagtgaattagaaacgcccaatttagcagagcgagttctggattggcttgaaaagtatggtgttgaaagattgaaacggatggcgataagtggagatgactgcgtagtgaaaccaattgatgaccgttttgcgaccgcactgactgctttgaatgatatgggaaaagttagaaaagatatcccacaatgggagccttccaagggatggaatgactggcaacaagttcctttttgtagtcaccattttcatcaattaataatgaaagacggaagagagatcgttgtaccttgccgcaatcaagatgaattggtaggaagggccagagtgagtcaaggtgccgggtggtctcttcgtgaaaccgcttgcttaggaaaatcttacgcacaaatgtggcaactaatgtattttcatagaagagatctgcgcttagcagctaatgcaatttgtagtgccgttccggtagactggatacccacaagtcgaactacctggtcaatccatgctcaccaccaatggatgacaacagaggatatgctgagcgtatggaatagggtttggatcgaagaaaatccttggatggaagataaaacgcatataagttcatggggagacgtaccttatctcggaaagagagaagaccaatggtgcggaagtttaataggactcaccgcgcgagctacatgggcgacaaacatccaagttgctatcaatcaggtcagaagattgataggtaatgaaaattacttggattatatgacaagtatgaaaagatttaagaatgaaagcgatccagaaggcgcgttatggtag

SEQ ID NO: 21985 - RNA, 9879 nt, synthetic construct
  misc_feature 1..9879: note = derived and/or modified CDS sequence (opt6) from DENV-1__JQ045630__SS-prME
  source 1..9879: mol_type = other RNA
tctgtcacaatgttgctaatgctcatgccaacagcgcttgcttttcacttgactactcggggaggagaaccacacatgatcgtctctaaacaagaaagagggaaatccttattatttaaaactagcgcaggggtaaatatgtgtactttgatagctatggacctaggtgaattatgtgaagatactatgacttataaatgtcctagaataacggagactgaacctgacgatgttgactgctggtgcaatgctactgatacttgggttacatacggtacgtgcagtcaaactggagaacaccggagagataaaagaagtgttgcattggcgccccatgttgggttaggcctagaaacacgaacggaaacttggatgtcatctgaaggcgcgtggaaacaaatccaacgcgttgaaacctgggccctcagacacccaggatttactgttatagctctattccttgcgcatgcaatcggaacttcaataactcaaaaaggaatcatatttatattattaatgttagtaaccccttccatggcaatgagatgtgttggcattggatctcgagactttgtagaaggactctctggagccacttgggtcgatgtagttttggagcatggatcatgtgtcactacaatggcaaaagataaacccacattagatatagaattattaaaaactgaagtgaccaacccagcgatactacgaaaactatgtattgaagctaaaattagcaacaccacaacggacagcagatgtcctacacaaggcgaggcaacattggttgaagaacaagatgcaaacttcgtgtgcagaagaacgttcgtcgatagaggctggggaaatggatgcggtttgtttggcaaaggctcacttataacctgcgcgaaatttaaatgtgttacgaaactcgaaggaaaaattgtacagtacgagaatctgaaatacagcgtgatcgttacagtgcacaccggagaccaacatcaagtcggaaacgaatcaacggaacatgggactacagcaacaataaccccacaagctccaacgactgaaatacaattgacagactatggtgctttaacgcttgactgttcaccgagaactggattagatttcaacgaaatggtgttactaacaatgaaagagaaaagctggttagtacataaacagtggttcttagacctgccattaccatggactagcggagcatccacttcgcaggaaacttggaaccgacaagatctacttgtaacattcaaaacagcgcacgctaagaaacaagaagtagttgtgctgggttctcaagagggcgctatgcataccgcattaacgggtgcaacagaaatccaaacctcagggacgacgaccatctttgccggtcatctgaaatgccgactaaaaatggataaactaactttaaaaggtatgtcttatgtaatgtgcacaggctcgtttaaacttgaaaaagaagtagcagaaacgcaacatgggacggtcttggtacagataaaatatgaagggacagacgccccttgtaagattcccttttcgacacaagacgagaaaggtgtaacacagaatgggagactaatcacggccaatcccatagttactgacaaagaaaagcctgtaaatattgaagccgaacctccgtttggcgaaagttacattgtaattggtgctggtgaaaaggcactcaaattatcatggttcaaaaagggaagttctattggtaaaatgttcgaggcaactgcgagaggcgcccgtagaatggcaattcttggggacacagcttgggacttcggttcgataggtggcgtgtttacatcagttggaaagttagtacatcagattttcgggactgcttatggagttttattctcaggggtctcctggacgatgaaaatcggtataggtgtactattaacatggcttggcctaaattcccggagtacttctttatcaatgacatgtattgcggtagggttagtaaccctttacttaggagtaatggtgcaagcagactcgggatgtgttataaattggaagggccgagaactcaaatgtgggtcgggaatattcgttactaatgaagtgcacacttggaccgaacaatacaaattccaagccgattctccgaaacgactcagcgcagctataggaaaagcctgggaggaaggagtctgtggaatacgtagcgcaacccgcttagaaaatataatgtggaaacagatatccaatgaactaaatcacatattactagaaaatgacatgaaatttaccgttgtggttggagatgtcgccggcatccttgctcaaggcaagaaaatgatacgaccacagccaatggaatataaatattcttggaaatcatggggaaaagctaaaatcattggtgcggatgttcaaaatacaacttttatcatagacgggccaaacacaccggaatgtcctgacgaccagcgagcatggaacatttgggaagtggaagattatggttttgggatattcaccacaaacatttggttaaaactgagagattcttatacccaagtctgtgaccatagacttatgtcagctgctattaaagacagcaaagctgtccatgccgatatgggttattggatcgaatccgagaaaaatgaaacttggaaattagcaagagcatcatttatagaagtgaaaacttgcatatggcctaaatcccacaccctttggagtaacggtgtgcttgaatcagaaatgataattcccaagatttacggtggtcccatctcacaacataactatcgtcccggatactttactcagactgcgggaccttggcatctgggaaaattagaattagattttgatctgtgtgaaggaaccacagtagtagttgatgaacattgcggaaaccgggggccgagtctgcgaacgaccacagttacagggaaaattatccatgaatggtgttgtagaagttgtacgctgccaccacttagatttagaggcgaagatggttgctggtacggaatggaaatccggccagttaaagagaaagaagagaatctcgtaaaatcaatggtatcagcagggtccggagaagtcgatagtttttcgctgggtttgttgtgtatatcgataatgatagaagaagtaatgcgatcacggtggtccaggaaaatgcttatgacaggaacactagctgtctttctattgcttattatgggccaactaacttggaatgacctaataagactgtgcataatggtcggggcaaatgcgtctgatagaatgggaatgggaacgacctatttagccctaatggcaacattcaagatgcgtcccatgtttgctgtaggattattgtttagaagacttacgagccgagaggtactgctgttaactatcggactaagtctcgttgcatcagttgagctccctaattcgttagaagaactgggagacggcttggcgatgggaataatgatcctcaaactacttactgattttcaaagccaccagctatgggcgacattgttatctttgactttcattaagacgacctttagtctgcattatgcatggaaaactatggcaatggtattgagcatcgtgtcactattccccttatgtctatcgaccacgagtcagaaaacaacatggctaccagtactcttagggagtttgggctgtaaaccactaacaatgtttttgatagcggagaacaaaatatggggacgcagatcctggcccttaaacgaaggaataatggctgttggaatagtctcaatactattgtcgtctcttttgaagaacgatgtcccgctagcgggccctctaatcgccggaggtatgttaatcgcatgctatgttatttcaggtagttccgcagaccttagcttagaaaaagccgcggaagtgagttgggaagaagaagcagagcatagcggcgctagtcacaatattctggtagaggtgcaagatgatggaactatgaaaatcaaagacgaagaacgcgacgatacgttaactattttattaaaggcaactttactagcagtgtcaggggtatatcccctaagcattccagctacattattcgtatggtacttttggcagaagaagaaacagagatcaggggtattgtgggatacaccctcaccaccggaagtagagagagctgtactcgatgatggaatttatagaataatgcaaagaggcctgttgggcagatctcaggtcggtgtgggagtatttcaggaaaatgtattccacactatgtggcacgtaacaaggggagcggtactgatgtaccaaggaaaaagacttgaaccttcctgggccagcgtcaagaaagatttaatatcttatgggggtggatggagactacaggggagctggaacacaggtgaggaggtccaagtaatcgcagtcgagccaggaaagaatcccaaaaatgtacaaaccacacccggtactttcaagacccctgaaggtgaggtaggtgcgatagccctagatttcaaaccgggaacgtcaggctcccctattgtaaatcgcgaagggaaaatagtaggtctttacggtaatggtgttgtgacaactagcggaacctatgtttcggcaatagcacaagccaaggcttcacaggaaggacctctcccagaaatagaagatgaagtatttaggaagagaaatcttacaataatggatcttcatccaggatcggggaaaacaagacgctatttaccagctatcgttcgagaggctatcaaacgaaaattaaggacgcttatactagcccccaccagagttgtagcgtcagaaatggctgaagcactaaaaggaatgcccatccgataccagactacagcagttaaatcagaacataccggaaaagaaatcgtagatctgatgtgtcatgccactttcaccatgagattgctatcgccagtaagagtaccaaattacaatatgataataatggatgaggctcattttactgatccttctagtatagcggcacgtgggtacatctcaacaagagttggtatgggcgaagctgctgcaatatttatgacagcaacgccaccgggtagcgttgaggcttttccacaatctaacgcggtgattcaagatgaagaaagagatatacctgaaaggagttggaactcaggttatgaatggataactgacttcccaggaaagacagtctggtttgttccatcaataaaaagtggcaatgatattgcgaattgcttgaggaaaaacggaaaacgggtaatacaactgtcaagaaaaacatttgatacagaatatcagaagaccaaaaacaatgactgggactatgtagttactacagacattagtgagatgggtgcaaatttccgagctgaccgagtaatcgatcccagacgatgcctaaaacctgtcattctaaaagatggcccagaacgcgtaattctcgcgggacctatgcctgtaacagtagccagtgcagcccagagaagaggacgaattgggaggaaccataataaggagggtgaccaatacatctatatgggacaacctctgaataacgatgaagaccatgcgcactggacagaggcgaaaatgctcttagataacataaatacaccagaaggtattatacctgcattgttcgaaccggaacgggaaaagagcgcagccattgatggagagtataggcttaggggagaagccaggaaaacgttcgttgaactaatgcgtcgaggtgatctccccgtgtggttatcgtacaaagtagcatcagaaggatttcaatattctgatcgtcgttggtgcttcgacggagaacgaaacaaccaggtactagaagagaacatggacgtagaaatatggacaaaggaaggagaaaggaagaaactacgtcctaggtggttggacgcgagaacctattcagacccattagcactacgagaatttaaggaatttgctgctggacgtagaagcgttagtggtgacctcattttggaaattgggaagctcccacagcatctcacacaacgggctcagaacgcacttgataacctcgtaatgttacataattcagagcaaggagggagagcatatcgacatgcaatggaggagttaccggatacaatagaaacattaatgctattagccttaatagctgtgcttacaggaggtgtaaccctatttttcttatctggccgtggcttaggaaagacatcaatcggccttttatgcgtaatagcaagttccgtattgttgtggatggcttcagtcgaaccacactggatcgcggcctctataatactggagttctttctaatggttctcttgataccagaacctgaccggcaacgaacaccccaggataaccaattagcatacgtagtaatcggactcttattcatgatattaacagtagccgcgaatgaaatgggactgttagaaacaaccaaaaaggatctcggtatcgggcacgtcgcggtcggtaaccaccatcatgcggcgatgttggatgtcgacctacatcccgcgtctgcatggactttgtatgcagtagcaaccactatcataaccccaatgatgcgccatacgatagagaatactactgccaatatcagtctaacagctatcgctaaccaggctgctatacttatgggacttgataaagggtggccaatatctaagatggacatcggggtaccattactcgctctgggttgttactcccaggtcaatcctctaacgctaacagcagcggtattaatgttagtagcgcactatgcgatcattggcccgggtttacaagcaaaagccacccgtgaagcccagaaaagaacagctgcgggtatcatgaaaaatcccacagtagacggaatagttgcaatagatctcgatcccgtagtctatgatgctaaatttgaaaaacaactcggacaaataatgttgctgatactctgtacgtctcaaatactactcatgcgcacaacatgggccctatgcgaaagtataacccttgctaccgggcccctaactaccctatgggaaggctcccctggaaaattttggaatacaacaatagcagtcagcatggctaacatttttcgaggttcctatttagcaggagcggggctcgcattttcgcttatgaaatcgttaggagggggtcggagagggactggtgcacaaggtgaaactttaggagagaagtggaaacgtcagcttaatcaattaagtaagagtgagtttaatacatataaacgttcaggaattatggaagtagaccgctcagaggctaaagaggggctcaaaaggggtgaaacgactaaacacgctgtatcacgtggtacagcaaagttacgctggtttgtggaaagaaatttagtcaaacccgaaggaaaagtaatagatttgggatgcggcagaggaggctggagctactattgcgcaggactcaagaaagtaacagaggtgaaagggtacacgaaagggggtccaggtcatgaagaaccaattccaatggccacttatgggtggaatcttgttaaacttcactcgggaaaagatgtcttctttatccctccagagaagtgcgatacactactctgcgacataggtgaatcatcacctaacccaacgattgaagaagggcgcacacttcgagtactaaagatggttgaaccatggctcaggggtaaccaattctgtataaaaatcctaaatccatatatgccttctgtagtcgaaactttagaacaaatgcaaaggaaacacgggggtatgcttgtccggaacccattatcgagaaactctacgcatgagatgtattgggttagttgtggaacaggtaatatagtatctgcagtcaatatgacttcccgaatgctattaaatcgatttactatggcacaccgcaaaccaacatatgagagagacgtagacctcggagcaggaacacgtcatgtagcagtcgagccagaagtggcaaatctagacattatagggcagcgtatcgaaaatatcaaacatgagcataaatcaacgtggcactatgatgaagataacccgtataagacttgggcatatcatggaagctatgaagtaaagccgtcgggttcagcaagctctatggtaaatggagtagtaaagctattaactaagccatgggatgtgatacccatggtcacgcaaatcgcaatgaccgatacaacccctttcgggcaacaaagagttttcaaagaaaaagtcgacacaagaaccccaaaggcaaaaagagggacagcgcaaataatggaagtgacggcaaaatggctatggggatttctttcaagaaataagaaaccgagaatatgtacaagagaagagtttacgagaaaggttcgatcaaacgcagcgataggtgcagtattcgttgatgagaatcaatggaactcagcgaaagaagccgtggaggatgaaagattttgggacctagtacatagagaacgagagctacataaacaaggaaaatgtgcgacatgtgtatataatatgatgggcaaaagggagaagaaattaggagagttcggaaaggctaaaggcagtagagcaatttggtacatgtggttaggagcaagatttttagaatttgaggcactcggttttatgaatgaagatcactggttctcacgtgaaaacagtttatcaggtgtcgagggagagggtttgcataagctaggctacatattacgagatataagtaagataccgggagggaatatgtacgcagatgatacagcaggatgggatacaagaataacagaagatgatttacagaacgaagcacgtataactgatatcatggaacctgaacatgcattacttgcaaaatccatattcaaattgacgtatcagaataaagtagttagagttcagagacccgccaaaaatggcaccgtaatggatgtgatatcgcgaagagaccagcgtgggtcaggtcaagttgggacatacggattaaacacgttcacaaacatggaagctcaactcatcagacagatggaaagtgaaggaatattttcaccttcggaactggagacaccaaatctggcagaaagggtcttagattggctagaaaaatatggcgtagaaagactaaaaagaatggctatatcaggagatgattgcgttgttaaaccgatagatgatcgatttgcaactgcattaacggcattaaacgatatgggtaaagttcgtaaggatataccacaatgggaaccatcaaaaggttggaacgactggcaacaggttccattttgttcccatcacttccaccagttgatcatgaaggatggaagggaaatagtcgtaccttgccgcaaccaagacgaattggtcggccgagcaagagtttcacaaggagcgggatggagcttaagagaaacagcctgcctgggaaaatcatatgcacaaatgtggcaattgatgtactttcacagacgagatctgagacttgcagcgaacgcaatatgtagtgctgtaccagttgattggatcccaacttcacgaacgacatggtcaattcatgctcatcaccaatggatgacgacagaagatatgctgagcgtctggaatcgagtttggattgaagaaaacccatggatggaagacaaaacacacatatcatcttggggagatgttccgtatcttggaaaacgagaagatcagtggtgcggcagtttgataggtttaacggcaagagcaacatgggctacaaacatacaagttgcaattaatcaggttagacgcctaatcgggaacgagaactacttagactatatgactagcatgaagcgctttaaaaacgagagtgatcccgaaggggctttatggtaa

SEQ ID NO: 21986 - RNA, 9879 nt, synthetic construct
  misc_feature 1..9879: note = derived and/or modified CDS sequence (opt6) from DENV-1__JQ045632__SS-prME
  source 1..9879: mol_type = other RNA
tctgtgactatgctcctaatgctcatgccaactgcactagcatttcatttaactacacgtggcggggaaccgcatatgatagtttccaaacaagaaaggggcaaatctctattatttaaaacatcagcgggggtaaatatgtgtactctaattgcaatggatctaggggaattatgtgaagacacgatgacgtacaaatgtcctcgcataacagaaaccgaaccagatgacgtcgattgctggtgtaatgctacagacacgtgggtaacgtacggcacatgctcgcagacgggagagcatagacgagataaacgttctgtcgctctagcacctcatgtaggcttaggactagaaaccaggacagaaacatggatgagtagcgaaggcgcgtggaaacaaattcagcgagtagagacatgggcattacgccacccggggtttactgttatagctctcttcttagctcatgccataggaactagcataacacaaaaaggaataattttcatcctgcttatgttagtcacaccttcaatggcaatgcggtgcgtcggcattggtagcagggattttgtagaaggcctatcaggggctacttgggttgatgtggtattagaacacggatcatgtgttacaactatggcaaaagacaaacccacacttgatatagagctattgaaaaccgaagtgactaatcctgccgttttaagaaaattatgtatcgaagcaaaaatctcaaatacaacgactgattctcgatgtcccacacagggtgaagccaccctagtagaagaacaagacgccaacttcgtatgtcgaagaactttcgtcgatagaggatggggaaacggttgtggtttatttggtaaaggatcactaataacgtgtgcgaaattcaaatgcgttacaaaattagaagggaaaatagtccaatatgagaacttaaaatatagcgtcatagtaactgtacacaccggagatcagcaccaagtaggtaatgagtcgacagaacacggtacgacagcgacaataactccacaagcacctactacagaaattcaactcactgattacggcgcattaacattagattgttccccgaggactggtctggatttcaacgaaatggtactactaacaatgaaagagaaaagttggcttgttcacaagcaatggtttcttgatcttcctctaccatggacttcgggggccagtacatcgcaagaaacgtggaataggcaagacctactcgttacatttaaaaccgctcatgccaagaaacaggaagtagtagtgcttggaagtcaagaaggtgcaatgcataccgctttaaccggagcaacggaaattcaaacttcaggtacgacaactatattcgcggggcatctaaaatgtagattaaaaatggataagttaacactaaaaggaatgagctacgtaatgtgtaccggatcatttaaactagaaaaagagttggctgaaacacaacatggtaccgtattagtccaaattaaatatgaggggaccgacgcaccgtgtaaaataccattcctaacacaagatgaaaaaggcgtcactcaaaacggaagactcatcaccgctaatcctattgtcactgataaagagaagcctgtaaatatcgaagcagaaccaccattcggagaatcatacatcgtaattggcgccggcgaaaaggcactaaagttatcttggttcaaaaagggcagttctataggcaaaatgttcgaggcaactgctcgaggtgcaaggaggatggcgatccttggtgatactgcctgggatttcggatcaattggaggggtctttacctcaataggtaaacttgtgcatcaaatttttggtactgcatatggagtactctttagcggcgtatcatggacaatgaaaataggtataggggtactcctgacatggcttggactcaatagccggtctacctctctcagtatgacatgtattgcagtcggactggttactctatacttaggagttatggttcaggccgattcaggctgcgttattaactggaaaggtagagaattgaaatgcggatctggaatattcgttacgaacgaggtccacacttggactgaacaatacaaattccaggcagattctccaaaacgactgagcgccgcaattggaaaagcatgggaagaaggggtttgtgggatacgatctgctaccagattagaaaatattatgtggaaacaaatatccaatgaattaaaccatatcctcctagaaaacgatatgaaattcacagtcgttgttggagatgtggctggtatacttgcgcaagggaagaaaatgatcagaccacaaccaatggaacataaatattcttggaaatcgtggggaaaggcaaaaataattggcgcagatgttcaaaataccacattcataatagatggcccaaatacgcccgaatgtcccgatgatcaacgagcttggaatatatgggaagtagaggattacggattcggaattttcactaccaacatctggttaaaattgagagactcgtacacccaagtatgtgaccatagactgatgtcagctgcaatcaaagactcgaaagcagtacatgcggacatgggatattggatagaatcggagaagaacgaaacgtggaaattagctcgcgcgagcttcatagaggtcaagacctgcatttggccaaaaagccacaccttgtggagcaacggtgtgctagaatccgaaatgatcattccgaaaatttatggaggtcctattagccagcataattatcgcccaggttatttcactcaaaccgcaggaccttggcatctaggtaaattggaactcgacttcgatctgtgtgaaggtaccaccgtagttgttgacgaacactgtggaaatagaggaccatcattacgaacaacaacagttactggtaaaattattcacgagtggtgttgtagatcttgcacattgccgcccctgcggttccgaggcgaagacggctgttggtatggtatggaaattaggcccgttaaagagaaggaagaaaatttggtaaaaagcatggtgtcagcaggatcaggtgaagtagatagctttagtttggggctattatgcattagtatcatgatcgaggaagttatgcgctccagatggagtagaaagatgcttatgacggggaccttggcggtcttctttttactaatcatgggacaattaacctggaacgatctaatacgtctatgtatcatggtcggggccaatgcatccgaccgaatgggaatgggaacaacttatttggcgctgatggctacattcaaaatgagacctatgtttgcagttggtctattatttagacgcttaaccagtcgtgaagttttgttgttaacgatcggattgtcacttgtagcctcggttgaactacctaattctctcgaagaacttggcgatgggttagccatgggaattatgattctaaaactattaacagattttcaatcccatcaattatgggccaccctcttatcactaacatttattaaaacaacgtttagtttacattatgcttggaaaactatggcgatggtcctaagcatcgtttctctcttcccgctctgcctctccacaacaagtcagaaaacaacatggctgccagtcttgttaggaagccttggatgtaagccacttacgatgttcttaatagcagaaaacaaaatatgggggcgcagaagctggcctctaaacgaaggaatcatggcagtagggattgtatcgatattactcagctctctccttaagaatgatgtaccattggcgggacctttaatagcgggaggtatgttaattgcttgttatgtaataagtggatcaagcgcagacttatcattggaaaaagctgcagaggtaagttgggaagaggaagcagaacacagcggcgcgtcccacaatatattggtagaagtacaagatgatggaacaatgaaaattaaagatgaggaaagagacgacactcttacgattctgctaaaagccacgttgctggctgtatcgggggtctacccattgtccataccagcgacattattcgtatggtatttctggcaaaagaagaaacaacggtcgggagtgttgtgggataccccttctccgccagaggtagaaagagcagttcttgatgatggcatatacagaatcatgcaacgaggattgctagggcggagtcaggttggagtcggagtattccaagagaatgtcttccacactatgtggcacgtaacccgaggcgcagtacttatgtaccaaggaaagagactcgaaccttcatgggcaagtgtgaagaaagatttaatatcatatggtgggggatggaggttacaagggtcgtggaatacgggagaggaagtacaggttatagccgtagaaccgggcaaaaatcccaaaaatgttcaaactgctccagggacgttcaagacaccagagggagaagtcggagcgatagcattagacttcaaacccggtacttcaggttcccccatagttaatagggaagggaaaattgtaggactatatggaaacggagtagttaccactagcggtacgtacgtaagcgctattgcacaggcgaaggcaagccaggagggtccactcccagaaattgaagatgaggtcttcaggaaacgtaaccttacaattatggacctacatcctggaagcggcaaaacgagaagatacttgccagcgatagtgagagaagccataaaacgtaaactacgcacactaatcttggcaccaacacgggttgtggcgagcgagatggccgaagcactcaagggaatgccaataagataccaaacgacagccgtaaaatctgaacatactggtaaagaaatagtggatttgatgtgtcacgcgacttttacaatgagattgttaagccccgtacgtgtaccaaactataatatgattattatggatgaagcacatttcacggaccctagttcgatagctgctcgtgggtatatttctactagagtaggaatgggtgaggccgctgcgatatttatgaccgctacaccgccagggtcggtagaagccttcccacaatccaatgcagtaatacaggacgaggaaagagatatacctgagagaagctggaactcaggatatgaatggataactgattttccgggtaaaacagtgtggtttgtaccgagtataaaatcaggaaatgatatagctaactgcttgaagaaaaatggaaaacgagtcatacagttatcaagaaaaacgttcgataccgaataccagaaaacgaaaaacaatgactgggattatgtcgtaacaactgacatctctgaaatgggtgcaaacttcagagcagatagggtgatagatccaaggaggtgccttaagccagtaatacttaaagatggtcctgagcgtgtaatcttagccggtccgatgccggtgaccgtggctagcgcagcgcaacggagaggaaggatcgggagaaaccacaataaagagggagatcaatatatatacatgggtcaaccacttaacaatgatgaagatcatgctcactggacagaggcaaaaatgttattggacaacataaatactcctgaaggtataattccagctttgttcgaacccgaaagggaaaaatctgcagctatcgatggagagtaccgacttagaggcgaagcgagaaaaacatttgttgaactcatgagacgaggagatctcccggtgtggctaagctataaggtggcttcggaaggctttcagtattctgatagacggtggtgcttcgatggtgagaggaataatcaagtactagaagagaacatggacgtggaaatttggactaaagaaggtgagaggaagaaactacgaccacggtggctagatgcaagaacctatagcgatccgctagcgttaagagaatttaaagagttcgctgcaggtagacgtagtgtaagcggtgatcttattctagaaattggaaagctgccacaacatttgacacaaagagcacaaaatgctctagataatctcgtaatgttgcacaatagtgaacaaggtgggagagcatatagacatgcgatggaagagttacctgatacgatagagacattaatattactcgcattaattgcagtattgaccggtggcgtaactttgttctttctaagtggaaggggcttaggaaagacatctattggtttattatgtgtaatggccagttccgtattgttatggatggcaagcgttgaaccccactggatagcggcatcaattattcttgagttctttttaatggtcctcctaattccagaaccagaccgccaaaggactccacaggataaccaattggcctacgtagtaatagggttactattcatgattctcactgtagctgcgaatgaaatgggattacttgaaacaactaagaaagacctaggaatcggacatgtagcggtagaaaatcatcaccacgcagcaatgttagatgtagatcttcatcctgccagcgcatggacattatatgcagtagcgacaacaataatcacacccatgatgagacatacaatagaaaacacaactgccaatattagcctgactgcaatcgctaatcaagcggccattttaatgggtttagataagggatggccaataagtaagatggacataggcgtacctctgctagctcttggatgttactcacaggtcaacccactcacacttacagcagcggtactgatgttggtagcacactatgccatcataggccctggcctccaagccaaagcaactagagaagctcagaaaagaacagcagcgggaataatgaaaaatccaacagtagacggcatagtagcaattgacctagacccggtagtatatgacgccaagtttgaaaaacaattaggacaaattatgctactaatcttatgtacgtctcaaattctcttaatgagaaccacttgggcattatgtgaatcaataacactcgccaccggacctctaacaactctatgggaaggatcccctggtaaattttggaatacaaccatagcagtttcgatggcaaacatatttagaggttcctacctagccggagcaggacttgcattttcattaatgaagtcgttaggaggtggtaggagaggtacgggagctcaaggggaaactttaggtgaaaaatggaagagacaacttaatcagctcagcaaaagcgagttcaatacatacaagcgaagcggaataatggaagtagacagatcagaagctaaagaaggccttaagagaggcgagactaccaaacatgccgtgtccagaggaacagccaagctcaggtggtttgtagaaagaaatttggtaaagccagaggggaaagttattgaccttggctgcggtagagggggttggtcctattattgtgctggcctcaagaaagtaactgaagtgaaaggatatactaagggaggtcccggtcatgaagaaccaattcccatggcaacctatggctggaatttagtaaagctccattcaggaaaagacgtgtttttcattccaccggaaaaatgtgacacattgttgtgcgatataggcgaaagcagtcctaatcctacaatagaagaaggaagaacacttagggtgttgaagatggtcgagccatggttacgtggaaatcagttttgtataaaagtattaaatccatatatgccttcagtggttgaaacattagaacagatgcagagaaaacacgggggaatgttggttagaaacccactatctcgaaattctacgcatgaaatgtactgggtgagttgcggcacagggaatatcgtgagtgcagtgaatatgacaagtaggatgttgttaaatagatttacaatggcacatcgaaaacctacctacgaacgcgatgttgatttaggagcaggaaccagacacgtcgctgtagaaccagaggttgcgaatttagatataattggccaaagaatcgagaatatcaaacatgagcacaaatccacttggcattatgatgaggacaatccatataaaacatgggcctatcatggtagttatgaagtaaagccaagtggatcggccagctctatggtaaacggtgtagtgaagctacttacaaagccatgggatgtcatcccaatggtgactcagatcgctatgacggatacaactccattcggccagcaaagagtattcaaagaaaaggtagatacgcggacgccgaaggcgaaaagaggcacagcccaaattatggaagtaacagccaaatggctgtgggggtttttatctcgaaataagaaaccacgtatttgtactagagaagagtttacaaggaaagtgcgttcgaatgcagctataggtgccgtgtttgttgacgagaatcaatggaactccgcgaaggaagcagtagaggacgaacggttctgggacctcgtccaccgggagagggaattgcacaaacaaggcaaatgtgctacttgtgtatataacatgatgggaaaaagagagaagaaactaggtgagttcggtaaagcgaagggctcacgtgcaatatggtacatgtggttgggagctagatttttagaatttgaggctttgggattcatgaatgaagatcattggtttagtcgagaaaattccctgtcaggtgtagaaggtgaggggcttcataagttgggttatatattgcgagacattagtaaaataccagggggaaatatgtacgcagatgacactgcaggatgggacacacgtattaccgaagacgatctgcaaaacgaagcacgaataaccgacattatggaacctgaacatgccctattagccaaatccatattcaaacttacttatcaaaataaagtagtaagagtgcagcgtccagctaaaaatggtaccgtgatggatgtaatctcaagaagagatcaaaggggaagtggccaagtgggcacttatggcctaaatacgtttaccaacatggaagcacaattaatcagacaaatggaatctgaaggtatattttctccaagcgaactcgagacacccaacctagctgaacgagttttagattggcttgaaaaatacggagtagagagattgaaacggatggcgattagtggcgatgactgtgtggtaaagcccattgatgatcgatttgctactgcattaacagcattaaatgacatgggtaaagtgagaaaagacataccccaatgggaacctagcaaaggctggaatgattggcagcaagtccccttttgttcacatcattttcatcaattaataatgaaggatggccgagaaatagtcgtcccatgtagaaaccaggacgagctggtcggccgagcgagggtatcacaaggtgctggatggtcattacgggagaccgcatgtctaggaaaatcatatgcacaaatgtggcaattaatgtattttcatcgtagggatttacgtcttgctgcaaatgcgatatgttctgccgtcccggtagattggataccaacaagcagaacgacatggagcattcacgcgcatcaccaatggatgacaacagaagatatgctcagcgtatggaatcgagtctggatagaggaaaatccgtggatggaagataaaacacatatttcttcatggggagatgttccatatttaggaaaacgggaagatcagtggtgcggttccttaatcggcttaacagctcgagccacctgggctacgaatatccaagtagcaattaaccaagtgcggaggctaatcggtaacgaaaattatctcgactatatgacaagcatgaaaagattcaaaaatgagagtgacccggagggtgctttatggtaa

SEQ ID NO: 21987 - RNA, 9879 nt, synthetic construct
  misc_feature 1..9879: note = derived and/or modified CDS sequence (opt6) from DENV-1__JQ045633__SS-prME
  source 1..9879: mol_type = other RNA
tctgttactatgttgctaatgctaatgcccaccgctcttgcatttcaccttacaacgagaggtggtgaaccacatatgattgtctcaaaacaagaacgaggaaaatcactgttgttcaaaacaagtgctggtgtaaatatgtgtaccttaatagctatggatttaggagaattgtgcgaagacactatgacttacaaatgcccgaggattactgaaacggagcccgacgatgtagattgttggtgtaatgctactgatacatgggttacatatggaacctgcagccaaacaggcgaacaccggagagacaaacgatcggtggcactagcgcctcatgtagggctagggttggagacaagaaccgaaacatggatgagtagcgaaggtgcctggaaacaaatacaaagagtagaaacatgggcacttcgccatcccggcttcaccgtaattgcattgttccttgctcatgccataggaacatcgataacgcaaaaaggtattatctttatcttgcttatgttagttaccccaagcatggccatgagatgcgtaggtataggaagtcgagatttcgttgaaggattatccggggctacctgggtggatgtcgttcttgaacacggaagctgcgtaacaacaatggcaaaagataaacccacattggatatagaactattaaaaacagaagtcacgaatccagcggtacttaggaaattatgtatcgaagccaaaataagtaatactactactgattcacgatgtcccacacaaggtgaagctactttagtagaagaacaagatgcgaattttgtgtgtagacgaacttttgtagatcgtggttggggaaatggttgtggacttttcggcaaagggtcattgattacgtgcgcaaaatttaaatgcgtaacaaaactagaaggcaaaattgttcaatatgaaaatttgaaatatagcgtaatcgtaacagtacatacaggtgatcaacaccaagtcggtaatgaaagtactgagcatggaactacggctacaataacgccacaagcaccaacaactgaaatccaattagcagactatggcgcactcacattagattgttcaccgagaaccggactggactttaacgaaatggtcctgttaactatgaaggaaaagtcatggctagtacacaaacaatggtttctagatctgccattaccatggacaagcggagcatcaacgtcgcaagagacatggaatagacaggatctcctagtcacattcaaaacggctcatgccaagaaacaagaggtcgtagtcctgggctcacaagaaggagccatgcacacggcacttactggtgcgacagagatacaaacctccggtacaacaacaatatttgcaggccacttaaaatgtcgactaaaaatggataaacttacattgaaaggtatgtcctatgttatgtgcacaggcagctttaaacttgaaaaagagctcgcagaaacacaacatggtactgttctagtgcaaatcaaatacgaaggaacagacgctccttgcaaaatcccattttcaacgcaggatgaaaagggggtcacacaaaatggccgcttgatcacggcgaatccaatagtaacagacaaagagaaaccggtcaacatagaggcagaaccaccgtttggggaaagctacatagtaataggtgctggggaaaaggctttaaagttatcatggttcaagaaagggtcttccattggaaagatgtttgaagcaacggcccgaggagcacgaaggatggccatcttaggggacacagcatgggattttggttcgataggaggcgtatttacaagtgtgggaaagttggtacaccagatatttggtgccgcatacggggtgttatttagtggtgtatcttggaccatgaaaattggtataggagtcttactaacttggttaggattaaattcaagatcaacaagtctttctatgacctgtattgctgtaggtttagttacactctacttaggcgtcatggttcaggccgattcgggttgtgtaataaattggaaaggtagagaactcaaatgcggcagcggaatattcgtcacaaacgaagtacatacatggaccgaacaatataaatttcaagcagacagccctaaacgactgagtgccgctataggaaaagcatgggaagaaggtgtgtgtggtataagaagcgcgactcggctagaaaatattatgtggaaacaaatatcaaacgaactaaatcatatcctccttgaaaacgacatgaaattcacagtcgtagtaggggatgttgcaggaatcctcgctcaagggaaaaagatgattaggccgcaaccgatggaatacaaatactcatggaaatcttggggaaaagcgaagataatcggggcagatgtacaaaatacgaccttcattatagacggtcaaaacacaccagagtgcccggatgatcaaagggcctggaatatatgggaagttgaagactatggattcggcatatttactacaaatatctggcttaaactaagggactcgtatacacaggtctgtgaccatagattaatgtctgcagcaataaaagacagcaaggcagtccacgccgacatgggatactggatagagtctgagaaaaatgagacttggaagttagctagagcatcatttatagaagtcaaaacatgtatctggcccaaatcacatacactttggtctaatggcgtcttggaatctgagatgattataccaaagatatacggtgggccaatttcacaacataattacagaccaggatattttacccagacggcgggtccctggcacttaggaaagttagaactggactttgacctctgtgagggaaccactgttgtagtagatgaacattgtggtaatcgtggtccgtcgcttagaacaacaacggtaaccggcaaaatcatacatgagtggtgttgtcggtcatgcaccctcccaccacttcgatttcgaggagaagatggatgttggtacggcatggaaataaggccggtaaaggaaaaagaggagaacctggtaaagtctatggtatccgcaggtagcggggaagttgatagtttctcattaggactgttatgcattagcatcatgatagaggaagttatgaggtctcgatggtcaagaaagatgctcatgactggaactttggcagttttcttacttttgatcatgggccaactcacctggaacgatttaattaggctctgcataatggtaggagcaaacgcgagtgatagaatgggcatggggacgacgtatttagcattaatggcaaccttcaaaatgagacctatgtttgccgttggattattattcagacgattaacctcaagagaagtactgttactaacaattggattaagcctagtggcaagcgtagaactgccaaatagcctagaggaactgggggatgggttagcgatgggtattatgattcttaaacttctaaccgatttccaatcccatcaattatgggcaaccctcctttcactaacattcataaaaaccactttcagtttgcattatgcttggaagacaatggccatggtactaagtattgtgagcttatttcctctttgtttgtcaactacaagtcagaaaaccacgtggttacccgtactattgggatcattaggatgcaagcctttaacgatgttcttgatagctgaaaataaaatatggggtagacgatcatggcctctgaacgagggcattatggctgttggaatagtgagtatattattatcttcgttactgaagaatgatgtcccgcttgcgggtcctcttatagcaggaggcatgttaatagcatgttatgttatatccggttcatccgccgatctatcactcgagaaggctgcagaggtcagttgggaggaagaagccgaacattcaggggcgagtcataatattctagtagaagtccaagatgatggaactatgaagattaaggatgaagaacgggatgatacactaactatcttactgaaagcaacattactagctgtaagcggcgtttatccgctcagtatccctgcgactctatttgtatggtatttttggcagaagaagaaacaaaggtccggtgttctatgggatacaccctcaccccctgaagtcgagcgtgcagtgttagatgacgggatctatcggattatgcaaaggggcctattaggacgttcgcaggtaggtgttggggtctttcaagaaaatgtttttcacaccatgtggcacgtcacaagaggggcagtgttaatgtatcagggcaaacgattagaaccatcatgggcatcggtcaagaaagatttaatatcgtacggaggaggatggagattgcaaggctcatggaacacaggagaagaggtacaagtaatagcagttgaacctggtaaaaatcccaaaaatgtccaaactgcacctggaacattcaagacccctgaaggtgaagtgggagctatagcactagattttaagcctggcacttccggatcgccaatcgtaaatagagaagggaaaatagttggactgtatggaaatggtgttgttacgacttcgggcacatatgtatcagcaatagcacaagcaaaagtgtcacaagaagggccactacctgaaattgaggatgaagttttccgcaagcgtaatctgacgattatggacttacatccaggctcaggcaaaactagacgctatttaccagcgatagtgagagaggccataaaacgaaaattgcggacactaatcttagcaccaacgagagtagtagcaagtgaaatggccgaagcccttaaaggtatgccaataagataccaaacaaccgcagtcaagagcgaacatacaggaaaagagatagtggatttgatgtgtcatgctactttcacgatgagactactttctcccgttagggtacctaactataatatgataattatggacgaagcacacttcacagacccaagtagcatcgcagcgcgtggttatatttccactagggttggaatgggcgaagcagctgctatcttcatgaccgccacgccaccgggatcagtagaagcgtttcctcaatcaaacgcggtgatacaagacgaagagagagacatccctgaaaggagctggaacagcggttatgaatggattacagattttcctggtaaaacggtgtggtttgtgccatcaataaaatccggtaatgatatagcaaactgcctacgcaaaaatggtaagagagtgattcaattaagccgaaagacttttgatacagaatatcagaaaactaaaaacaatgattgggattacgtcgttactacggatatttcggaaatgggtgcaaacttcagagctgatcgcgttatagatccaagacgatgcctgaagccagttattcttaaagacgggcctgagcgtgtaattttggcgggacctatgcctgtcacagtagcaagcgccgcacaaagacgaggaagaataggaagaaatcacaataaagaaggtgatcagtacatatatatgggacaaccccttaacaacgatgaagatcacgcacattggacagaagcaaaaatgctactggataacataaataccccagaaggaataataccagccttgtttgaaccggaaagagaaaaatcggctgcaattgatggagaatatagacttagaggtgaagcacgaaaaactttcgtagagcttatgaggcgtggcgaccttcctgtatggttatcctataaggtagcttccgaaggatttcagtatagtgacaggagatggtgcttcgatggtgaaagaaataatcaagtacttgaggaaaatatggatgtagaaatctggactaaagagggagaacgtaaaaagctccgtccacgatggttagacgcccgtacgtacagcgatccgttagcattacgtgaatttaaggaatttgcagctggacgtagatctgttagtggcgacctaattttagaaattggtaaactcccacagcatttgacacaaagagcacagaatgccttggataacttggttatgctacataattcagaacaagggggtagagcctatcgccacgctatggaagaactcccagatacgatagaaactttaatgcttctagcactcatagccgtactaacaggaggggttacattattctttttatcaggcagaggccttggcaaaacatcaataggattgttatgcgttatggcttccagtgtcctgctatggatggctagcgtagaaccacattggatagcagcttccatcatcttagaatttttcttaatggtacttttgattcctgagcctgatagacagcgcacacctcaggataatcaacttgcttatgtagttataggcctactttttatgatcttaacagtagcagcaaatgaaatgggtcttctagaaaccactaagaaagacctaggtataggccacgtagcagtagaaaatcaccatcacgcagccatgttagatgtagatttgcatcctgcaagcgcatggaccttatacgcagtggctacaacaatcattacccctatgatgagacataccatagaaaatacaacggccaacatatcattaactgcaattgcaaatcaagccgcaatattgatgggattggataaagggtggcctatatcgaaaatggatataggagtgccactactagcgcttggatgctatagtcaagtgaatccacttacactcaccgcagccgttttaatgttagttgcacattatgctatcataggccctggtctacaagccaaggccaccagagaggcgcagaaaaggacggcagcaggcataatgaaaaacccaaccgtagatggaatcgttgcaattgacttggatccagtagtttacgacgcaaaatttgaaaaacaattaggtcaaattatgcttctcatcctttgcacaagtcagatcctactaatgcgtacgacttgggcgctctgtgaatcgataacattagcaacaggaccattgacgacgttgtgggaaggctcaccagggaaattttggaatactaccatagccgtatccatggctaacatatttcgaggaagttacctagcaggagcaggattagcgttttctttaatgaaaagtctaggtggaggtcggcgtggaactggcgcacagggagaaaccttaggagaaaaatggaaaaggcaattaaatcaactatctaaaagtgaatttaacacttataagagaagcggcataatggaagtagaccggtcagaggcaaaagaaggcttaaaacgaggggagaccacgaaatatgcggtctcgcgtggaacagctaaactccgatggttcgtcgaacgaaatttagttaaacccgagggaaaagtgattgatctcgggtgcgggcgcggtggttggtcatactactgcgctggccttaagaaagtcacggaagtgaaaggttatacaaaaggaggaccgggtcatgaggaaccaataccaatggccacatacgggtggaatcttgttaaattacatagtggtaaagatgtgttctttgtaccccctgagaaatgtgatacattattatgtgatataggagaaagtagccctaaccccacaatcgaggagggaagaacattacgagttctaaaaatggttgagccgtggctacgaggaaaccagttttgcataaagatactaaatccctatatgcccagcgtggtagaaactctagaacagatgcaacgcaaacatggaggaatgttagtaagaaatccgctaagcagaaattcaacacatgaaatgtattgggtaagttgcgggactggcaatatagtatcggccgtcaacatgacttcaagaatgttacttaatcgattcactatggcccatcgaaaacctacatatgaaagagatgttgacttaggagccgggactagacacgttgcggtagagccagaagtagcaaatctagacattataggacagagaatagaaaacattaagcacgaacacaagagcacttggcactatgacgaagataacccttacaagacttgggcttatcacggttcttatgaggtaaaaccgtcagggtcagcatcgagtatggtgaacggggtcgtaaaattgctgacaaagccgtgggacgttatcccaatggttacacaaattgcaatgactgacacaacgccattcggacagcaaagagtattcaaagaaaaagtggacacaagaacccctaaggcaaaaaggggaacagctcagataatggaagttacggctaaatggctgtggggtttcttaagtcgaaacaagaaaccacggatatgtaccagggaggagttcacacgaaaagttcgatctaatgccgccattggagcagtttttgtagacgaaaaccaatggaactctgcaaaagaggcagtagaagacgaaagattctgggacttagtccacagggaaagagaacttcataaacaaggtaaatgcgcaacatgtgtttataacatgatgggaaaacgggagaagaaacttggagaatttggtaaagcaaaaggttcaagggctatttggtatatgtggctaggggcgagatttctagaatttgaagctctggggtttatgaacgaagatcattggtttagtagagaaaattcacttagtggagttgaaggagaaggtttacataaactaggctatatactaagagacatttccaaaattcccggtggcaacatgtacgctgatgacaccgcaggatgggatacccgaataactgaggacgacttacaaaatgaggcacggataacagacataatggaaccagaacatgcgctacttgcgaaatcgatatttaaactcacatatcaaaacaaggtggtacgcgtacagcggccagccaaaaacggtacggtgatggatgtcataagtcgacgagatcagagaggtagcggacaagtcggaacatatggattaaacacgtttacaaatatggaggcgcaacttatcaggcagatggaaagtgaggggatattttcaccctccgaacttgaaacaccgaatttggccgaaagagtactagactggttagaaaagtatggagtagaaagactaaaacgaatggcgataagtggggatgattgcgtagttaagccgattgacgataggttcgcaacagctttgacggctctaaatgacatgggtaaagttaggaaagatataccacagtgggagccatcgaagggatggaatgattggcaacaggttcccttctgttcacatcattttcatcaacttatcatgaaagatggtcgagaaatagtagtgccttgccgtaaccaagatgagcttgttggacgagctcgagtatcccaaggtgcgggctggtcgttaagagaaacagcatgcttaggaaaaagttacgcacaaatgtggcagttgatgtactttcatagacgagacttacgtttagcggctaacgcaatatgttccgcggtgccggtcgattggattcccactagccgaacaacgtggagcattcacgcccatcatcaatggatgacaactgaagatatgctttcagtttggaatcgagtttggatagaagagaatccctggatggaagacaaaactcatatatcaagttggggtgatgtaccatatctaggcaaacgggaagatcagtggtgtgggagcttaattggtcttacagcccgtgcgacgtgggcgaccaatatacaggtcgcaatcaaccaagtgaggcgtcttattgggaacgaaaactatctagactatatgactagcatgaaacgatttaaaaacgaaagcgatccagaaggagcattatggtga

SEQ ID NO: 21988 - RNA, 9879 nt, synthetic construct
  misc_feature 1..9879: note = derived and/or modified CDS sequence (opt6) from DENV-1__JQ045634__SS-prME
  source 1..9879: mol_type = other RNA
tcagtgacaatgcttcttatgttaatgccaacggccttggcattccatttaacaacaagaggtggagaaccgcatatgattgtcagtaaacaagaaagaggaaaatctttattattcaaaacttccgctggagtcaacatgtgtactctaatagcaatggatttgggtgaactttgcgaagatacaatgacctacaaatgccctagaatcaccgaaacggaaccagatgatgtcgattgttggtgcaacgctacagatacctgggtcacatatggtacctgctctcaaacaggagaacatcgcagagacaaacgatctgtagcattggccccacacgtcggattaggtcttgaaactagaacggaaacatggatgtcgtcagaaggtgcatggaaacaaattcaacgcgtcgaaacatgggccttaagacatccaggtttcacagttatcgctctttttctcgcccatgccatagggacaagcattacacaaaaaggaataatttttatcctactaatgcttgttacaccatctatggctatgcgatgcgttgggattgggtcacgggattttgtggagggactcagcggggcaacgtgggtcgacgtagtacttgaacacggatcatgtgtaacaacaatggcaaaagacaaaccaactctagatatcgaactcttgaaaacagaagttacaaatccagcagttcttagaaaactttgcattgaagcaaaaatatctaatacaacgacagattctcgctgtccaactcaaggagaggcgacgttggtagaagaacaagatgcaaattttgtatgtcgtaggacgtttgtagacagagggtggggaaacggatgtggactatttggaaaaggttcattaattacatgcgcaaaattcaagtgtgtaacaaaacttgaagggaagatcgtacaatacgaaaacctcaaatatagtgtaattgttacagtccacactggagatcaacatcaagtagggaatgaatctacagaacatggaacaacagctacaattaccccacaagcgcctacgacggaaatacaacttgcggattatggagctttgacgcttgattgttcacctagaactggattagatttcaacgagatggtactgttaacaatgaaagagaaaagctggttggtgcataaacaatggtttctagatctgcccttaccatggaccagtggggctagtacctcacaggaaacatggaacagacaagacttattagtaactttcaagactgctcatgcaaagaaacaggaagtggtggtattaggatcccaagaaggtgctatgcacacagcactaactggggcaaccgagatacagacgagcggtacaaccacaattttcgcaggacatttaaaatgtcgattgaaaatggataaactaacactcaaaggtatgagttatgttatgtgcaccgggtcattcaagttagagaaagaattggccgagacgcaacacggaaccgttcttgtgcaaattaaatacgagggcactgatgcaccttgtaagataccgttttcaactcaagatgaaaaaggggttacccaaaatgggagattaattacagcaaatccgattgtaacagataaagaaaaaccagtgaatatagaagctgaaccaccattcggagaaagttacattgtaataggtgcgggtgaaaaagcccttaaactatcatggttcaagaaaggttcgagcatcggaaaaatgttcgaagctactgccagaggcgctagaagaatggccattcttggggacacggcgtgggactttggatctatcggaggagtcttcacttccgtgggcaaattagtgcatcaaatttttggtgctgcctacggtgtgctgttcagtggcgtatcttggactatgaaaatagggataggcgtcttattaacatggttgggactaaattctaggtcgacatctctatctatgacttgtatcgctgtcggtctagtgacattgtaccttggtgtaatggtacaagccgattcgggctgtgtcataaactggaaaggccgagaacttaaatgtggctcagggatattcgtaacgaatgaagtgcatacatggacagaacaatataaatttcaagccgacagtcccaaaaggttatctgcggctataggaaaagcgtgggaagaaggtgtatgtggcatccgatcagccacaagactagagaatattatgtggaaacaaatatccaacgaattgaaccatattttacttgaaaacgatatgaagtttacagtggttgtaggcgatgtggctggtatattggcccaaggcaagaaaatgattcgtccacaaccaatggaatataaatacagttggaaaagctggggaaaagccaaaataatcggagcagatgtccaaaatacaacctttataattgatggacagaatacaccagagtgtcctgatgatcagcgtgcatggaacatatgggaggtcgaggactatggattcggaatctttacgacgaatatatggttaaaattgcgagatagctacactcaggtatgtgaccatcgcctaatgtcagcagcaataaaagacagtaaagcagtccacgcagatatgggatattggatagagtctgagaagaatgagacctggaagttagctcgggcatcattcattgaggtaaaaacatgtatatggccaaagtcacataccttatggtcaaacggtgtcctcgaaagtgaaatgataattcccaaaatatatggaggaccaatcagccaacataactatagaccaggatatttcacacagacagcaggcccatggcacttaggaaaacttgaactagactttgatttgtgtgagggcacgacggtagtagtagacgaacattgcggaaatagaggaccatcactacgaacgacgactgttacgggtaaaatcatccacgaatggtgctgcagatcatgtacattaccaccactaagattcagaggggaagatggatgctggtatggaatggagattagacccgtaaaagagaaagaagagaatttagtcaaaagcatggtatcggcaggaagcggagaggtagatagtttcagtctgggcctactctgcataagtataatgattgaagaggtcatgcggtcaaggtggagtcgtaaaatgttaatgaccggtactttagctgtgtttttgctattaattatgggccaactaacatggaatgacctgatccgattgtgcatcatggtaggagcaaatgcaagcgacaggatgggaatggggacaacttatctagcgctaatggcgacctttaagatgagaccaatgtttgcagtaggattgctttttcggcggctgacctccagagaagtattactactgactatagggctgagtctagtagcatcggtcgaattaccaaattcactagaggaattaggagatgggttggcaatgggcataatgattttaaaacttcttaccgattttcaaagccatcaactctgggctacactgcttagtttaacttttataaagactacgttcagcttacattatgcctggaaaacaatggcgatggtgcttagcatagttagtctatttccactatgtctgtctactacatcccagaaaacgacgtggctcccagtattattaggatcccttggatgcaaacctcttactatgttcctgatagctgaaaataaaatatggggccgacgatcctggccgcttaatgagggaattatggcagttggaatagtgagtatactacttagctctctacttaaaaatgatgttccactagccggaccattgatcgctggaggaatgttgatcgcgtgttacgtgattagtggatccagtgcagatctctcgctcgagaaagctgctgaagtatcatgggaggaagaggcagaacacagtggtgcttctcataatatcctcgtagaagtacaggatgatggtacaatgaaaataaaagacgaagaaagggacgatacattgactatattgctaaaagccacattattagcagtgagtggtgtatacccgctgtccatcccggcaaccctttttgtttggtatttttggcagaagaagaaacaaagaagtggtgttctttgggatactccttccccgccagaagtagaaagagccgttctagatgatggaatatatcgaataatgcaaagaggactattggggcggagtcaagttggagtaggtgtattccaggaaaacgtttttcatacaatgtggcatgtcacgagaggagccgttctgatgtatcagggaaaacggctggaaccatcatgggcatcagtcaagaaagacttaatatcatacggtgggggttggagattacagggatcatggaacacgggagaagaagttcaggtaattgcagttgaaccaggtaaaaatcccaagaatgttcagaccgcaccaggcacttttaaaacccctgaaggcgaagtcggcgcaatcgccctagattttaaacctggtacgtcgggcagtccaatagtgaatagggaagggaagatagtgggtttgtatggcaatggggtcgttacaacgtcggggacgtatgtgtcagcgattgctcaggctaaagtatcacaagagggaccattgccggaaatagaagatgaggtttttagaaaaagaaacttgaccatcatggacttgcatccaggatccggaaaaactagaagatatttacctgcaatagtacgtgaggcgataaaaagaaaattgagaaccctgatcctggctccaactagagtagtggcgtcagaaatggcggaagccttgaaagggatgccaattcgttaccaaacgacagcagtcaaaagtgaacacacaggtaaagaaatagttgacttaatgtgtcatgctacatttacaatgagattgttaagtcctgtccgcgtcccaaattacaacatgataataatggacgaggcccacttcactgatccaagctcaattgcggctcgcggctatattagcacacgagtaggtatgggtgaagcagcagctatttttatgactgcgacaccaccaggtagcgtggaagcatttccgcagagtaacgcggtaattcaggacgaggaacgggatataccggaaagatcttggaatagtgggtatgaatggataacagattttccaggaaaaactgtttggttcgttccgtctataaaaagcggtaacgatatagcaaattgcttacgtaagaacggtaaaagggtaatacaattatccagaaaaacatttgacacggaatatcaaaagacgaaaaacaatgattgggattatgtagtaacgacagatattagtgaaatgggtgccaatttcagagcggaccgggtcatcgatccgcgaaggtgcttaaaacctgtgatccttaaagatggcccagaacgcgtcatacttgcgggcccaatgcccgtaacggtagcaagtgctgcgcaacgcagagggcgtatcggtcgaaatcataataaagagggtgatcaatatatttacatgggacaaccacttaacaatgacgaggatcatgctcattggaccgaggctaaaatgttattggacaatataaacacgccagaaggcataataccagcactatttgagcctgaacgtgagaaatcagccgctattgacggagagtaccgattaagaggggaggcaagaaagaccttcgtggaactaatgagacgcggcgatttaccagtatggctcagttataaagtagcctcagaagggttccaatactctgatagaagatggtgtttcgatggcgaaaggaataatcaggtgctagaagagaacatggatgtagaaatttggaccaaagagggagagagaaagaaactaagaccgagatggttagatgcaagaacgtactctgatccactagcactccgggaatttaaagaatttgcggccgggagaaggagcgtatcgggagacttgatattggagattgggaaactaccgcagcatttgactcaacgcgcccaaaacgcattagataacttagtaatgctacataactcagagcaaggcggacgagcttatcgtcatgctatggaagaactaccagatactatagaaacacttatgttattagcacttattgcagtattaacaggaggtgtgacactattctttctaagtggtagagggttaggtaaaacgtctataggtctactttgtgtcatggctagtagtgtattattatggatggcatctgtggagccgcattggatagcagctagcatcattttagaatttttcctaatggtcttgttgatacccgagcctgataggcagcgaacaccgcaagacaatcagctggcatatgtagtaatcggtctcttatttatgatcttaaccgtggcagcaaacgaaatgggattactagagaccacgaaaaaggatttggggattgggcatgtcgcagttgaaaaccatcaccatgccgcaatgctggatgtagatttgcatccagcgtcagcatggacattatatgcggtggcgactacaattataacgccaatgatgaggcataccatagagaatactacggcaaatatcagcctgacagcaatcgcaaatcaagcagcgatattgatgggcttggataaaggttggccaataagtaaaatggatattggtgttccactactcgctttgggttgctatagccaagtcaacccgctaacgttaaccgccgcggtccttatgttagtggcccactatgccataatagggcctggactacaggctaaagccactagggaagcccagaaaagaacagcggccgggatcatgaaaaatccaacggttgatgggatcgtagcaatagatctagatcctgtggtatatgatgcaaaatttgaaaaacaactcggtcaaattatgcttttgatattgtgcacttcacagatattgctaatgcgcactacatgggcactatgtgagtccatcacacttgctacagggccattaacaaccttgtgggaaggatcacctggaaagttttggaatacaacaatagcagtaagtatggcgaatatatttaggggttcctacttagctggtgctggcctagcgttctccttaatgaaatcgctaggtggaggaaggcgtggtacgggagcacaaggagagacattaggagagaaatggaagagacaactaaatcaattgtccaagtccgaatttaatacttataaacgcagtgggataatggaggtagacaggtcggaagccaaggagggtttaaaacgaggcgaaacaacaaaatatgctgttagtcggggtacagcaaaacttagatggtttgtagagcgaaatttagtaaagccagaaggtaaagtgatagacttaggatgtggacggggaggatgggcttattattgtgccggcctcaagaaagtgacggaagttaaaggatatacgaagggaggcccagggcacgaagaaccgataccaatggccacctatggatggaatcttgtaaagttacatagcggaaaagacgtcttctttgtcccgccggaaaaatgcgatacactcttatgtgacatcggagagagttcaccaaacccaacaatagaagaaggaaggactttaagagtccttaaaatggtagaaccttggttacgaggtaatcaattctgtattaaaattctaaatccatatatgccttctgtagttgagacactcgaacaaatgcaaagaaaacatggtggaatgctagtaagaaatccattatcacgaaattcgacgcatgagatgtactgggtctcctgtggcactgggaacatcgtgagcgccgtcaatatgaccagcagaatgctactcaataggtttacaatggcacatagaaagccaacttatgaaagagatgttgacttaggcgctggaacacgacacgttgcagtcgaaccagaggtagcgaatttggatattatcggacaaagaattgaaaatattaagcatgaacataaatctacctggcattatgatgaagacaatccatataaaacgtgggcatatcatggttcgtacgaggttaaaccgtcgggatcggcctcatccatggtgaacggtgtagtaaaattactgactaaaccatgggatgtgatccccatggttacacaaatagccatgaccgacacaacaccatttggacaacaacgagttttcaaggaaaaagtcgacacccgaactcccaaagcaaaacgaggtaccgcgcagataatggaggtaaccgcaaaatggctatggggattcctctcacgcaacaagaaaccacgaatttgtactcgagaggagttcacaagaaaagttcgttcaaatgcggcgataggtgctgtttttgtcgatgagaatcaatggaatagcgcaaaggaagctgtggaagacgagagattctgggacctcgttcatcgagaaagggaattacacaaacaaggaaaatgcgctacatgcgtttacaatatgatggggaaaagagaaaagaaactaggggagtttggcaaagcaaaaggaagtcgcgcaatatggtatatgtggttaggtgcgcgattcttggagtttgaagcccttggatttatgaacgaagaccactggttcagccgagaaaatagtttatcaggcgttgaaggtgaagggcttcataaactggggtatatattaagagatatatcgaagataccaggaggaaacatgtacgccgacgacacagcaggttgggatacaagaataaccgaagatgacttacaaaacgaagcaagaataacagatataatggagccagagcatgccttattagcaaaatctatcttcaaactaacataccaaaacaaggttgtcagagtacaaagaccagccaaaaacggaacggtcatggatgttataagcaggagagaccagcgaggctctggtcaagtaggtacttacggattaaatacctttacaaacatggaggcacaattaattaggcaaatggaatctgaaggtatattttcacctagtgaactagaaacaccaaatctggcagagagagtattggattggttggaaaagtatggagtagagagattgaaacgaatggcaataagtggtgacgattgtgttgttaaacctattgacgaccgttttgctacggcactcactgccctaaatgatatgggaaaggttagaaaagatatcccacaatgggaaccatctaaaggttggaacgactggcaacaagtgccattttgctctcaccatttccatcagctgatcatgaaagatgggagagaaatagtcgtgccatgtagaaatcaagatgaacttgtaggcagagcacgtgtctcacaaggcgcaggatggtcacttagagaaaccgcatgtctaggtaaaagctatgcgcagatgtggcagctaatgtatttccacagacgcgacctcagattggcggcaaacgctatttgtagtgctgtcccagttgactggataccaacatctaggacaacttggtcaatacatgctcatcatcaatggatgactactgaggatatgctatcagtctggaatagggtgtggatagaggaaaatccatggatggaggataaaacacacatttcgagttggggtgacgtgccttacttgggcaaacgagaagatcaatggtgtgggtcattaatcggtttaactgcccgagcaacttgggcgaccaatatacaagtagccattaaccaagttcgtagactaatcggaaacgaaaattacctcgattatatgacgtcaatgaaaagatttaagaatgaaagcgatcccgaaggtgcactctggtaa

SEQ ID NO: 21989 - RNA, 9879 nt, synthetic construct
  misc_feature 1..9879: note = derived and/or modified CDS sequence (opt6) from DENV-1__JQ045636__SS-prME
  source 1..9879: mol_type = other RNA
tcggtaacaatgttattaatgctaatgcccactgcattagcatttcatttaacaactcgcgggggtgaaccccatatgatagttagcaaacaggaaagaggcaaatcactattgtttaagacaagtgcaggagtgaatatgtgtacattgatagctatggacctgggagaattttgcgaagacacaatgacttacaaatgccccagaattacggaggcagaaccagacgacgtggactgttggtgcaacgccactgatacctgggttacatatggtacgtgcagtcaaacaggcgaacatagaagagataaacgttccgtcgctttagctccacacgtaggactgggactggagacaaggacggaaacatggatgagcagtgaaggggcgtggaaacaaatacaacgtgttgaaacttgggcgctaagacatccggggttcactgtgatagcattgttcttggcccacgccattgggacaagtattactcaaaaaggaataatatttatacttcttatgttagtgacgccatccatggctatgaggtgcgtaggaataggtagcagagattttgtcgagggcctgagcggtgcaacatgggttgacgtcgttctggagcatggctcatgcgtgacaactatggccaaggataaaccgacgttggatatagaacttctaaaaactgaggtgacaaatccagctgtcttacggaaactttgcattgaggcgaaaattagcaacacaacaactgacagcagatgtccgacacagggagaggctaccctcgtcgaagaacaggatgccaatttcgtgtgcaggagaacgttcgttgatagaggatgggggaacggctgcggactttttggaaagggcagcctcataacatgcgcaaagtttaaatgtgttacaaaattagaaggtaaaatcgtacaatacgaaaatctgaaatattccgtgatagttaccgtgcataccggagatcaacatcaagtgggtaacgaatctacagagcatggtacgatagcaacaataacaccacaggcaccatcaacagaaattcagttaacagattacggggcattaacactggattgctccccgcgcacgggattagatttcaatgaaatggttttgttaacaatgaaggaaaaatcatggctcgtacacaaacagtggtttttagatttacccctaccctggacaagtggtgcttcaactagtcaggagacctggaatcgacaagatctactagttacgttcaaaactgcacatgcgaagaagcaagaagttgtagtgctcggatcacaagaaggtgcaatgcacacagctctcacaggagcgacggaaattcaaacttcaggcacaacaacaatttttgcaggccatctgaaatgtaggctaaaaatggataagttaacactaaaaggtatgagctacgtcatgtgcacagggagttttaagttagaaaaggaagtcgcagaaacacaacacggtacagttctagtccaaataaaatacgagggaacagatgcaccgtgcaaaattcctttttcgacccaagatgagaaaggagcgactcaaaatggcagattaataacggcgaacccgatcgtaacagataaggaaaaaccagtgaatattgaagccgagccaccattcggagaaagctacattgtaataggtgctggggaaaaagcgttaaaactgagttggtttaagaaaggctcctctataggaaaaatgtttgaggcaacagcgcgcggagctcgtagaatggcaatcctgggtgataccgcgtgggactttggaagcatcggaggagtctttacttcagttggaaaacttgtacatcaaatcttcggaacagcatatggggtacttttttctggtgtaagttggacgatgaaaataggtatcggagtactactcacctggttgggtttaaactctcgctcaacaagccttagcatgacttgcatagcagtaggactggtcaccctatatctaggagttatggttcaagctgacagtggctgcgttataaactggaaaggcagagaattaaaatgcgggtcaggtatctttgttacaaatgaagtacacacttggactgaacagtataaatttcaggcagatagtcctaagcgattaagcgcagctatcggtaaagcctgggaagaaggcgtatgtggcataagatcagcaacaagactagaaaatataatgtggaaacaaatcagcaatgaacttaaccatatattattagaaaatgatatgaaattaacagttgttgtaggagatgttgctggaatattagcacagggcaaaaagatgataagaccacagccaatggagtacaagtattcatggaagtcgtggggaaaagcaaaaataataggagctgatgtacaaaatacaactttcataatagatggtcccaatacaccagaatgtccagatgaccagagagcatggaacatatgggaagtcgaagactatgggttcggtattttcacaacaaatatatggctaaaactaagagattcatatacccaagtttgcgatcatagactaatgagcgctgcaattaaagactcaaaagcagttcacgcagacatgggttactggatcgaaagcgaaaaaaatgagacctggaaactagcacgtgccagttttattgaggtaaaaacatgtatctggcctaaatctcacacattatggagtaatggggtactagaaagtgaaatgataataccgaagatctatggtggtccgatctcgcagcacaattatcgaccgggatattttacgcaaacggcgggtccttggcatctcggcaagttagaattagattttgatctttgcgaaggaacaacagtcgtagttgacgagcattgtggaaacagaggaccttcgttaagaacaaccacagtgacgggaaaaatcatacacgaatggtgttgcaggtcttgtacgttgcccccattgagatttaaaggcgaagatggatgttggtatggaatggagataagacctgtgaaagaaaaggaagagaatttagtaaaatcaatggttagtgccggatccggcgaagttgactcgttcagcttaggattactctgtatttcaatcatgatagaagaagtaatgagatcaagatggtcaagaaaaatgctaatgactggcaccctcgcagttttttttttattaataatggggcaactaacctggaatgatctaataagattgtgtataatggtgggagctgatgcgtcggatagaatgggaatgggcacaacctacctcgccctgatggcaacattcaaaatgcgcccaatgtttgcggtaggtttattgttcagaaggttgacaagcagagaggtcttgttacttacgattggcttaagtttagtagctagcgtagaattacctaacagcttggaagaactgggagatgggttagctatggggataatgatactaaaattactaactgactttcaatcccatcagctatgggctacactactcagtttgacatttataaggaccaccttttcattacactatgcatggaagaccatggcaatggtattatcgatagtttcattgttcccattgtgcttaagcaccacatcgcaaaagacaacgtggttaccagtcctgctaggaagtctcggctgtaaaccattaacaatgtttcttattgctgaaaataaaatctgggggcgaaagtcttggccacttaatgagggtataatggcagtcgggatcgtgtctatactgctaagttctttactgaagaatgatgtcccgctagctggtcccttaatagcaggcggaatgctcatagcatgttatgtaattagtggatcttctgcagatttaagtctagagaaagcagccgtagtgagctgggaagaggaagctgagcattcaggtgcatcgcataacatattggtagaagtgcaagatgatggaacaatgaagataaaagacgaagaaagagatgacacactaaccattctcctcaaagctacactactagccgtaagtggagtgtatccgttaagtatccctgcaaccctatttgtatggtatttctggcagaagaaaaagcaacgctcaggcgtcctttgggacacaccatcaccaccggaagttgagagagccgtattagacgatggtatttatagaataatgcaacgggggttgcttggacgaagtcaagtaggtgtcggtgtttttcaagaaaatgtatttcacacgatgtggcacgtaacaagaggagcagtactcatgtaccaaggaaaaagactagagccttcgtgggcatctgtaaaaaaagatctaatttcttatggtggaggttggaggcttcaaggttcttggaatacgggagaagaagtgcaggtaatcgccgttgagcccggaaaaaatcctaagaatgttcaaacagcgcctggaaccttcaaaaccagtgaaggagaagttggagcaatcgcattggattttaaacccggaacgagcggctcacctatagtaaatcgagaaggaaaaatagtaggcctctatggaaatggtgtagtaaccacttccggaacatatgtaagcgccatagcacaagcgaaagctagtcaggaagggcccttaccagaaatcgaggacgaggtatttcgtaaacgtaacctcacaataatggatttacacccaggaagcgggaaaacacgacgatacctacctgcaatagtgcgcgaagctatcaaacgtaagttgagaacattaatattggctccgaccagagttgttgcaagcgaaatggcagaagctttgaaaggtatgcctataagatatcaaacaacagcagttaaatcggaacacacgggaaaggaaatagtagatctaatgtgccacgcaacttttactatgcgattattaagtcccgtacgggttccgaattataacatgattataatggatgaagcgcatttcaccgacccaagttccatcgctgctagagggtatatctccacacgtgttggaatgggtgaggcagctgcaatcttcatgacagctacaccaccgggttcagtggaagcctttccacaaagcaatgctgtaatacaggatgaagaacgcgacattcccgaacgctcttggaattccggttacgaatggataacagattttccgggaaaaacggtgtggttcgttccctcaataaagtctggaaatgacatagcaaattgcttacgtaagaacggaaaaagggtaatacagctatccagaaaaactttcgacacggaatatcagaagacaaaaaacaatgattgggattacgtcgtgacaacagatatatctgagatgggtgctaattttagggcagatcgtgttatcgaccctcgacgctgcttgaaaccggtaattctaaaagatggaccggagcgagtgattttagctggaccaatgccagtaaccgtggcatcggcggcgcaacgaagaggacgaatagggaggaaccataataaagaaggggaccagtacatatatatgggacaaccacttaacaacgacgaggatcatgcgcattggacggaagccaagatgcttctggataacataaatactccggaaggaattattccggcactattcgatccagagagggaaaaaagtgctgcaatcgatggcgaatatagattgagaggtgaagcgcgcaagacatttgttgaattaatgaggaggggagatttacctgtttggctcagctacaaagtagcatcagaaggttttcagtacagcgataggagatggtgctttgacggtgagagaaataatcaggtcttagaggaaaacatggacgttgaaatatggaccaaagaaggagagcggaaaaagttgagaccaagatggcttgatgcaagaacatattccgaccctctagctttaagggaattcaaagaatttgcggctgggcggagaagtgtgtcaggagatctcattctggagattggcaagctaccgcaacatcttacacagagggcgcaaaacgctcttgataatcttgtcatgctccataactcagagcaaggcggacgagcataccgacatgccatggaagaattaccggatacaatagaaacgcttatgttactggctttaatagctgtattaacaggaggagttaccctatttttcctatcagggcggggtcttggaaaaactagtataggtctactatgtgtaatggcaagctcagttctactgtggatggctagcgtagaaccccactggatcgcagcctcaatcatattagaatttttcttaatggtactactaatcccagaacctgatcgacaaaggaccccgcaagataatcaactagcatatgtagtaataggattattatttatgattttaacagtggcagcaaatgaaatgggtttgctggaaacgactaaaaaagatctgggcataggccacgtggccgtagagaaccaccaccatgcagcaatgctagacgtagatcttcatcccgcatcagcctggacactatatgccgtcgcgacaactatcatcacgcctatgatgagacataccatagagaacaccacagccaacataagtctaacagcgattgctaaccaggccgcaattcttatgggtttagacaaaggatggcctatttctaaaatggatatcggggtacccctactggcgctgggctgttactcacaagttaatccattaacactcacggccgcggtcttaatgttggtcgctcattatgctataataggacccggtttgcaagctaaggcaactcgcgaagctcaaaagagaactgcagcagggataatgaaaaaccctactgtcgacggtatcgtggcaattgacttagatcccgtagtctacgacgcaaaatttgaaaaacaactagggcaaataatgttacttattttatgtacaagtcaaatactattaatgcgaaccacatgggctttatgtgaaagtatcactctagctacaggtccactcaccactctgtgggagggctctccaggtaagttctggaacacaactatagcagtttctatggccaatattttcagaggcagttatctagctggggctgggctggcgtttagcttaatgaaatcattgggaggagggcgaagagggactggcgcacaaggcgaaacattaggggaaaaatggaaacgtcagcttaatcaacttagtaaatcggaatttaacacatacaaacgatcgggaataatggaagtagatagatcggaagctaaagaggggttaaaaagaggtgagacaacaaagcacgccgtatcaagaggaactgctaaattacgatggtttgtagagcgaaatttggtaaaaccggaagggaaggttatagacctaggctgtggaagaggaggatggagttactactgcgcagggctaaaaaaagtaactgaggtaaaagggtacaccaaaggtggaccaggacatgaggagccgatacctatggcaacgtatggttggaacttagtaaaactacactcaggaaaagatgtcttctttatacctccagagaaatgcgacacgctgttatgcgatattggagaatcttcgcctaatcctacaatcgaagaagggcgaactcttagagttcttaaaatggtggaaccatggttacgtggcaaccaattttgcattaaaatcttgaatccgtacatgcctagcgtcgttgaaacactagaacagatgcaaagaaaacatggagggatgctggtacgcaatcctttatcaagaaactccactcatgagatgtattgggtaagttgtggtacaggtaacatcgtctcagcagttaatatgacgagtaggatgttactcaatcgctttacgatggcgcaccgaaagcctacttatgaaagagatgtagaccttggagcgggaactcggcatgtagcggttgaacctgaagtagctaatctagatatcataggtcaaaggattgagaatattaaacacgaacataagtcaacgtggcactatgatgaagacaacccttataagacttgggcttaccacggtagttacgaagtgaaaccctctgggtccgcgagttccatggtgaacggagttgttaaattattgacgaaaccatgggacgtgattcctatggttactcaaatcgcaatgacagatacaacaccatttggacaacaacgagtttttaaagagaaagtggacacgcgaaccccaaaagccaaaagaggaactgcacaaataatggaggtaacagccaagtggctgtggggatttctaagtagaaataaaaaacctcggatatgtacaagagaagaatttacaagaaaagttaggagcaacgccgcgataggcgcagtatttgttgacgaaaatcaatggaactctgctaaggaagccgtcgaagacgaacgtttctgggatcttgtacatcgtgaacgggaactgcataaacaggggaaatgtgccacgtgtgtttacaacatgatggggaaaagagaaaaaaaattgggagagtttggcaaggccaagggaagtagagcgatatggtatatgtggttaggagcgcgttttcttgaatttgaggcgcttggttttatgaacgaagaccactggttctctagagaaaactccttatctggagtagaaggagaaggtttgcacaagttaggttatatactccgggacatatcaaaaataccgggagggaacatgtatgctgacgatactgcgggttgggatacgcgaataaccgaagacgatttacaaaatgaggcgaagataacagatattatggagcctgaacacgcgctactagccaaatcaatcttcaaattgacataccaaaataaagtcgtgagagttcaaagaccagcaaaaaatggaacagtaatggacgtaatcagtaggagagatcaaaggggtagcggtcaagtaggaacatatgggctaaatacatttaccaatatggaagcgcaactaatacgacaaatggaatcagaaggaatattctcaccaagtgagttagagactccaaacttagcaggaagagtacttgattggttggaaaagcatggagtcgaaagactgaaacgaatggcaatctcgggtgatgattgcgtggtcaagcctatagacgaccgattcgctacagcactaacggcattaaatgatatgggtaaagttaggaaggacataccacaatgggaaccctcaaaaggttggaacgattggcagcaagtccctttctgttcacatcattttcaccaattaataatgaaagatggaagagaaatagtagtcccatgcagaaaccaagacgaacttgtaggaagggcacgcgtcagccagggagcaggatggtctctacgggaaacagcgtgtctaggaaagtcttatgcccaaatgtggcaattgatgtacttccatcggcgagatttaagactagctgccaacgccatttgtagtgcagtcccggtagactgggtaccaacgtcacgcactacctggagcatacatgcccatcatcagtggatgacaactgaggatatgctgtcagtatggaaccgagtatggattgaagagaacccttggatggaagataaaacccatatatctagctggggggatgttccataccttgggaaaagggaagaccagtggtgtggaagcttaattggtctaaccgcaagagccacatgggctaccaatatccaggttgcaataaatcaagtcaggagactactgggaaatgagaactacctcgattatatgacatcaatgaagcgattcaaaaatgagagcgatccagaaggtgcattatggtag

SEQ ID NO: 21990 - RNA, 9879 nt, synthetic construct
  misc_feature 1..9879: note = derived and/or modified CDS sequence (opt6) from DENV-1__JQ045635__SS-prME
  source 1..9879: mol_type = other RNA
tcggttactatgctattaatgctgatgccaactgcgctcgcattccatttaacaactagaggaggggaaccgcatatgattgtatcgaaacaagaaagaggaaaatcactattgttcaaaacatcagctggtgttaatatgtgcacgttaattgcaatggatcttggggaattttgtgaagatactatgacctacaaatgccctagaataacagaagcagaaccggatgatgttgattgctggtgtaatgcaacagatacgtgggtcacatatggaacatgtagtcaaacgggggaacatcgtagggacaaacgaagtgtagctcttgcaccacatgtgggattgggcctcgaaacaagaacagaaacttggatgagtagcgaaggcgcatggaaacaaatacaaagggttgaaacctgggcactccgtcatccaggttttactgttatagcgctattcctcgctcatgcaataggaacgtcgataacacaaaaaggaataatatttatactactgatgttagtaacaccatcaatggcgatgcgatgtgtaggcatcgggagtagagattttgtagaagggttatctggagcgacttgggtagatgtagtattagaacacgggagttgtgtaactacgatggcgaaagacaaaccaactttagatattgaattacttaaaacagaagtaacgaacccagcagtattaagaaaattatgcattgaagcaaaaataagtaacacaactacagatagtcgttgtcctacacaaggggaagctactttagtcgaagaacaggatgcaaattttgtctgtcgacgaactttcgtcgaccgcggatggggaaacggatgcggtctcttcggaaaaggttcattaattacatgtgcaaaatttaaatgcgtgactaaactagaaggtaaaattgtacaatatgaaaacctaaaatactctgtaattgtaaccgttcacacgggcgaccaacaccaagtcgggaatgaaagcactgaacacggaacaatcgccactataacgcctcaagcgccgtcaacagaaatacaactgacagactatggcgcattaactctggactgcagtccgaggacaggcttagactttaatgaaatggtgctattaaccatgaaagagaaaagttggcttgttcataaacaatggtttctggatcttcctttgccttggacctcgggggccagtacaagtcaagagacctggaacagacaggacctcttagtgaccttcaaaacagcacatgccaagaaacaagaggtagttgttctaggctcccaggaaggcgccatgcacactgctctcacaggcgccacagaaatccaaacgtccggaactacaacaatttttgcaggacacctgaaatgtagattaaaaatggacaaacttaccctaaaaggtatgtcctatgttatgtgcacgggcagttttaaactagaaaaagaagtcgctgaaacccaacacggaactgtattagtccagataaaatatgaaggaactgacgcaccttgcaaaataccttttagcacacaagatgagaaaggagctacccaaaatggacgtttaataactgccaatcccatagtaacagataaagaaaagcctgtcaacatcgaagcagaaccaccattcggtgaatcttatatcgttataggggccggtgaaaaagcattaaaacttagttggtttaagaaaggtagttctattggaaaaatgttcgaagcaaccgcgcgtggcgccagacggatggcaatacttggcgataccgcatgggacttcggtagcattggcggagtttttacgtctgtaggaaaacttgttcatcagatatttggaacagcgtacggggtactttttagtggggtatcgtggacaatgaaaatcggtattggcgtactattaacgtggctcggtctaaattcacggagcacctccttaagtatgacgtgtatagctgtaggattagttacattatatcttggtgtgatggtacaagctgactctggatgtgttataaattggaaaggaagggagcttaaatgtggcagtggtatctttgtgacaaatgaagtacatacctggacagaacaatacaaatttcaagccgattcgccgaaaagacttagcgcggctatagggaaagcctgggaagagggagtatgcgggatacgatctgcgaccaggttagaaaacattatgtggaaacaaatatctaacgagttgaatcacatcttattagaaaacgatatgaaattgactgtcgtggtcggcgatgtagctggaattttggctcaaggtaagaagatgattagacctcaaccaatggaatacaaatatagctggaaatcttggggcaaagcaaaaatcataggtgcagatgtacagaacactacgtttattatagacggaccgaatactcccgaatgtccagacgatcagcgtgcctggaacatatgggaagtagaagattatggatttggaatcttcaccacgaacatatggttaaaactgagggattcctatacccaagtgtgcgaccatcgtttgatgtcggcggcaataaaagatagtaaggccgtacacgccgatatgggatattggatcgagtcagagaaaaatgaaacatggaagttggctagagctagttttatagaggtgaagacctgtatctggcccaagtcccatacgctgtggtcaaacggggtactcgaatcagagatgattattcctaagatatatggtggccccataagtcaacataattataggcctggttactttacacaaacagccggaccatggcatttaggcaaattagagttagatttcgatttatgcgagggaacaacagtagtggtcgacgagcactgcggaaatagaggaccgagtctgcgaacaactacagtcacaggaaaaataatccatgagtggtgctgtcgtagttgcactctgccaccccttcgatttaaaggggaggatggatgttggtacggaatggaaataaggcctgttaaggaaaaagaagaaaatctggtcaagtccatggtttcagctggcagtggtgaagttgactccttctctttagggcttctgtgtatttccataatgattgaagaggtaatgcgatctcggtggagccggaaaatgttaatgacgggcaccttagccgtattctttctattgataatggggcaattaacttggaatgacctcataagactctgtattatggttggagccgacgcatcagacagaatggggatgggcactacttatttggccctcatggcaacgtttaaaatgcgaccgatgtttgcagttggattattattcaggcgacttacatctcgtgaagtcttacttctcactattggacttagcctggttgccagcgttgaattgcctaactcactagaggaactgggagatggcttggctatgggaataatgattttaaaacttctaacagactttcaaagccaccaattatgggctacacttctttcattgacatttatcaggacgacatttagcttgcattatgcatggaagacaatggccatggtcctgtcaattgtttcactatttccattatgcctctctaccacatcgcaaaagacgacatggctgcctgtactactcggaagtctaggttgcaaacctttgacgatgtttttgatcgcagaaaacaaaatatggggtagaaaatcatggccattaaacgaaggaataatggcagtcggaatcgtatcaatcctattaagtagtctacttaagaatgatgtgcccctagccgggccacttattgctgggggtatgctaattgcgtgttatgtaataagcgggtcctccgctgatttatcgcttgagaaggcggcagtagtatcatgggaagaggaggcagaacatagtggtgcatcacataatatattagtcgaagtacaggatgacggtactatgaaaattaaggatgaagagagagacgatacattgacaattttacttaaagccacattactcgcggtatccggagtatatcctcttagcataccggcaacacttttcgtctggtacttctggcagaagaaaaagcagagaagcggagtgttatgggatacaccatcgcccccagaggttgaaagagctgttttagatgatggtatttatcggataatgcagaggggattattaggtaggagtcaagtaggagttggagtttttcaagagaatgtattccacacaatgtggcacgtaacaagaggagccgtcctcatgtatcaggggaaacgactcgaaccaagctgggcaagcgtcaagaaagacttaattagctatggcggtggctggcgactgcaaggcagttggaacacaggtgaagaagtacaagttattgccgttgaaccaggtaaaaatcccaaaaatgtgcaaacagctcctggaacattcaaaacaagtgagggagaagttggagcgatagccttagatttcaagccaggcacatctggttcccctatcgtaaaccgagaaggaaaaatagtaggcctttacggaaatggcgtagtaacaacatctggcacttatgtatctgccatcgcacaggccaaagcatcacaagaaggacccttgccagaaatcgaagatgaagtatttagaaaaaggaatttaacaataatggatttacaccccggctccggaaaaacaaggcggtacctgcccgctatagtgagagaagcgattaaacggaagctgaggacccttatactagcaccaaccagggtagttgcttcagaaatggcagaagcgttaaaaggcatgccaattaggtatcagacaacagcagtcaaaagcgaacatacaggaaaagaaatcgtagatttgatgtgtcacgctactttcacaatgcgactgctgagtccagtaagggttccaaattataacatgattataatggacgaggcacatttcacagacccatcaagtatagcggcaagaggatatattagcacgcgtgtaggaatgggggaggcagcagccatttttatgactgccactccgccaggaagtgttgaggctttcccacaatcgaatgcagttatacaggatgaggaacgggatatcccagagagaagctggaactcgggttacgaatggataacagattttccaggtaagaccgtatggttcgtaccttcgataaagtcaggaaatgatattgcaaattgcttacgcaaaaatggaaagcgcgtgatccagctatcgcgaaagacatttgatacagagtaccaaaagactaaaaacaatgattgggactacgtagtgactacagatatttcagagatgggagcaaatttcagagctgatagagtgatagatcctagaagatgtttaaaacctgtgattctgaaggacggccccgaaagggttattctcgctggcccgatgcctgtaactgtggcttcagctgctcagagacgggggcgaatcggaaggaaccataacaaagaaggagatcaatatatatacatggggcaaccattgaacaatgatgaagatcacgcccattggactgaagctaaaatgctactcgacaacataaatacaccggagggcataattcccgcactattcgatccagaacgagagaaaagcgcggccatagatggcgagtacagattaaggggtgaagcgagaaaaacttttgtcgagctcatgcgacgtggcgatttaccagtttggttatcctacaaagttgcaagcgaaggttttcaatactcagacaggcgatggtgctttgatggagaaagaaacaatcaagtattagaagaaaacatggacgtggagatatggactaaagagggagagcgtaagaaacttagaccgcgttggctagatgcccgcacgtattctgatccgttggccctaagagaatttaaagagttcgcagcaggaagaaggtcagtatctggtgatcttattcttgaaatagggaaactaccacaacatttgacccaacgagcacagaatgctttagataatttggtcatgctacataattcagaacaaggaggcagagcatatagacacgccatggaggaactgccggacacgatcgagacacttatgttacttgctttaatagccgttttgacgggcggggtaactcttttctttttgtccggcagaggcctaggaaaaacatcaattggtttactatgtgtaatggcctcgagcgtgcttttatggatggcaagtgttgaacctcattggatagctgcaagtatcatattagagtttttcttaatggttcttttaattccagaaccagatcgtcaacgaacgccacaagataatcaattagcatatgtagtaatcggcttattatttatgattttaaccgtcgccgcgaatgagatgggacttttagaaacgaccaagaaagatttgggaattggtcatgtagcagtagaaaaccaccatcacgcggcgatgttagacgtggatctacatccagcatccgcatggactctatatgctgtcgcaacgacaataatcactccaatgatgagacacacaatagagaatacaactgccaatatttctcttaccgctattgctaatcaagcagctattctaatgggtttagataaggggtggccaatatcaaaaatggacattggcgtccccctactagcactaggatgttactcccaggttaatccattaacacttacagcagcggttctgatgcttgtcgctcactatgcgatcataggcccaggcttacaggctaaggctacccgagaagcccagaaaaggacagcagcagggataatgaaaaatcccactgtagatggaatagttgcgattgatcttgatcccgtagtatatgatgcgaaattcgaaaaacaactcggccagataatgcttcttattctgtgtacgagtcaaattttattgatgcgaacaacatgggccttatgcgaatcaataacccttgcaaccggaccactcaccaccttatgggaaggatccccaggtaagttctggaatacaactatcgctgttagcatggctaacatattcagggggagttacctcgcaggagccggtttagctttctcattaatgaaatcactagggggtgggagaagaggcactggagcgcaaggagaaacactcggagaaaaatggaaaagacaactcaatcaattgtccaaatcggagttcaacacgtataaaaggagcggaataatggaagttgatcggtcagaagctaaggaaggtctaaaaagaggagaaacaacaaaacacgcggtatcacgtgggacagctaaattaagatggttcgtagaaagaaatttagttaaacctgagggcaaagtaatagatttaggttgcggacgtggaggttgggcatattattgtgcaggacttaagaaagttacagaagtcaagggatacacaaaaggaggtcctggccacgaggaacccataccgatggctacctatgggtggaatctagtcaaactgcattctgggaaagacgttttctttattcctccagaaaaatgcgatacacttctatgtgatatcggggagtcaagtccgaatcctactatcgaggagggacgcactttaagagtcctaaaaatggtagagccatggcttagagggaatcaattttgtatcaaaatcttaaacccatacatgccgtcagtagtcgaaacacttgagcaaatgcagcgaaagcacggtggtatgctagtcagaaatcctttaagtagaaattcaacgcatgaaatgtactgggtaagttgcggtacgggcaacatagtctctgcggtaaacatgacttcgcgcatgctactgaatcgatttacaatggcacaccgtaaacctacctacgagagagatgtagatttaggggccggtacgcgacatgtagcagtggaacctgaagtagcaaacctagatataatcggccaacgaattgaaaacatcaaacacgaacacaagagcacttggcattatgatgaggataatccctacaaaacatgggcataccacggatcctatgaagtaaagccaagtggatcagctagttcaatggtcaacggagttgtaaaattgttaactaagccatgggatgtaatacctatggtcacacagatagcaatgaccgacacaaccccgtttgggcagcaacgggttttcaaagaaaaagtggacacgagaacaccaaaggctaagagagggactgcacaaattatggaagtaactgctaaatggttatggggctttctttccagaaataagaaaccaaggatatgtactagagaggagtttacaagaaaagtacgctcgaatgcagccatcggagctgtttttgtcgatgaaaatcaatggaacagtgctaaagaagcggttgaggatgagcgtttctgggatctagtacatagggagagagaactacataaacaaggaaagtgtgcaacatgcgtttataatatgatgggaaaaagagagaagaaacttggtgaatttggaaaagcaaaaggcagtcgagcaatatggtacatgtggttaggcgcacgatttctggagttcgaagcattgggattcatgaacgaggatcattggttttcaagagaaaactcgttaagcggtgtagagggcgaggggttacacaaattgggctatatcctgagagatatatctaaaattccgggagggaatatgtacgcggacgatacagcagggtgggatactagaataaccgaagacgacttacaaaatgaagcaaaaataaccgatattatggaacccgaacacgcactgttagcgaagagtatattcaaactaacttaccaaaataaagtggttagagtacaacgtcccgccaaaaatggaacggtaatggatgtaatatcgagaagagaccaaagggggagtggacaggtaggtacatatggtctaaatacatttacaaacatggaagctcaactgattagacaaatggaatccgaggggatattttcacccagtgaactagagacgccgaacttggccggcagggttttagattggttagaaaaacatggagtcgaaagactaaaaagaatggcgataagtggtgatgattgtgttgtaaaaccgattgatgatcgatttgctactgcacttaccgcattgaatgatatgggcaaagtaagaaaagacataccacaatgggagccaagtaaagggtggaacgattggcaacaagtacctttttgctcacaccattttcaccagttaatcatgaaagatggtcgtgaaattgtagtaccttgtcgcaatcaagacgaactggtaggaagggcaagagtcagtcagggagcagggtggagccttcgagaaaccgcctgtctaggaaaatcatatgctcaaatgtggcaattaatgtattttcacagaagagacctcagactagcagctaatgcaatctgttccgcagtacccgtagactgggttcctacgtcaagaaccacttggagcatacacgctcaccatcaatggatgaccactgaagatatgctatcagtttggaaccgagtctggatcgaagaaaacccttggatggaggataaaactcatatctcgagttggggtgatgttccctaccttggaaaacgagaagaccaatggtgcggaagtttgatcgggctcacggctcgtgccacatgggctacgaatatacaggtcgccattaaccaggtaagaaggctcttaggaaacgaaaactatctagattatatgacttcgatgaaacgatttaaaaatgaatcagacccagaaggagctctttggtag

SEQ ID NO: 21991 - RNA, 9879 nt, synthetic construct
  misc_feature 1..9879: note = derived and/or modified CDS sequence (opt6) from DENV-1__JQ045637__SS-prME
  source 1..9879: mol_type = other RNA
tcagtaacaatgttactgatgttaatgccaacggcactagcttttcatctaacgacgaggggtggggaaccacatatgatagtcagcaaacaagaacgaggaaaaagcctattatttaaaaccagcgccggtgtgaatatgtgcactttgatagctatggacttgggagaattatgcgaagacactatgacgtacaaatgcccgagaataacagaaactgaaccggatgatgtcgattgctggtgcaatgcaacagatacgtgggtaacatatggaacttgttcacaaactggagaacacagacgtgataaacggagtgtagcgttggcaccacatgttggtctcggattagaaactcgaacagagacgtggatgagctcagagggagcgtggaaacaaatacaaagagtagaaacttgggcactaagacatccaggttttacagtaattgcgctctttctagctcacgctataggtacgagcattactcagaaaggaataatatttattctgcttatgttagtaacaccttctatggctatgaggtgtgtaggtattggcagtagagacttcgtagaaggactttcaggagctacatgggtagatgtggtgctagaacatggatcatgtgtaacaactatggcaaaagacaaaccgactttagatatcgaacttttaaaaacggaagtgacaaatccagcagttttacgtaaattgtgtatagaagcaaaaataagcaatacaactactgattcccgatgtccaactcaaggagaagccacgttagtagaagaacaggatgcaaattttgtatgtcggagaacatttgtagatcgaggatgggggaacggatgtggattattcgggaaaggatcgctaattacgtgtgcaaaattcaaatgtgttacaaaactagaaggcaaaattgttcaatacgaaaatctgaaatactctgtaatagtaactgtacatacaggcgatcagcatcaggtcggaaatgagagtacagagcatggcacaaccgcgaccataacccctcaagcacctacaacagaaattcagttaaccgactatggcgccttgacattagactgtagcccaagaacaggacttgatttcaatgagatggtcttactaacaatgaaagagaaaagctggctagtccacaaacaatggttccttgatctgccgctcccttggacttctggagcatctacatcccaagagacttggaaccgtcaagatttattagtaacatttaaaactgcacatgccaagaaacaagaagtcgtggtcttaggaagtcaggagggtgcgatgcatacagcccttactggagcaacagaaatccaaatgagcggaacaactacgatttttgctggacacttaaaatgcagattaaaaatggacaaacttactttaaaaggaatgagctatgtaatgtgtactggttcgtttaaattagaaaaagaagtggcagaaacccaacacggtactgtacttgtacaaatcaaatatgaaggaacggatgctccatgcaaaatcccatttagtacgcaagacgaaaagggtgttactcaaaatggaagactaattacagctaaccctatagtgacggataaagagaaaccagtgaatatagaagctgaaccaccctttggagagagttatatagtaattggggccggggaaaaagcactgaaactatcgtggtttaagaaaggaagctcaataggtaaaatgtttgaggcaacagcgagaggtgcgagaagaatggcaatattaggtgacacagcatgggatttcggctcgataggcggggtatttaccagtgtaggaaaactcgttcaccaaatatttggcactgcgtatggcgtactcttctctggggttagctggaccatgaaaattggtataggagtattactgacctggctaggattaaatagcagaagtacaagtttgtcaatgacatgcatagcggttggcctagttacattatatctgggcgtaatggtacaagcggacagtggctgtgtcattaactggaaagggcgtgaactaaaatgcggctcaggtatttttgtgacgaatgaagttcatacctggacggagcagtacaaattccaagcagattcccctaagcgattatcggctgcaattgggaaggcttgggaagaaggagtatgcgggataaggtctgcaactaggttagaaaatataatgtggaaacaaatatcgaatgaattaaatcatattctactagaaaacgatatgaagttcacagtggtggtcggagacgtagcaggcatcttggcccaaggaaagaagatgatcagaccacaaccaatggaatataaatattcatggaaatcatggggtaaagcgaaaataataggtgcagacgttcaaaatactacgttcataatcgatggaccaaatacacctgagtgtccagatgatcaacgagcttggaacatctgggaggtggaggattatggtttcggaatttttactacgaacatatggctaaagttaagagactcatacacccaagtatgtgatcatagacttatgagcgcagcaattaaggattccaaagcggtacatgctgacatgggctattggatcgaaagtgagaaaaatgaaacttggaaactagcaagagcctcatttatagaggtaaaaacatgtatatggccgaaatctcatacactctggtcaaatggggtactggaatctgaaatgattattcccaaaatatatggcggaccaataagtcaacacaattatagaccaggttatttcacgcaaacagctggtccgtggcacctaggtaaattagaacttgattttgacttgtgcgaaggaacaactgttgtagtcgatgaacattgcggttctcggggccccagcttgaggacaacaactgtaactggtaaaatcatacatgaatggtgttgtcgatcttgtacactacctccactaaggtttagaggggaagatggttgctggtacggaatggagattaggccagttaaagaaaaagaggaaaatttggttaaatctatggtaagcgctggaagcggagaagtggattcactcagcttaggcttgctatgtatatctataatgattgaggaagtcatgcgctcaagatggtcaagaaaaatgttgatgactggcaccctagctgtattctttctactaatcatggggcagcttacctggaacgatctaataaggttatgtattatggttggggctaatgcgtctgatcgaatgggtatgggtactacatatctcgcattgatggctgcattcaaaatgcgtcccatgttcgctgtaggcttgctttttaggagactgacgtcccgtgaagtgctccttttaaccattggactgagcctagtggcttccgttgaattgcctaactcattagaggagctaggtgatggattagcaatgggaattatgattctgaagctcttaacggattttcagagccaccaactttgggcaacattactcagtttaacatttataaaaactacattttcactgcattatgcctggaagacgatggcaatggtactcagcattgtgtctttatttcccctctgcctaagtacgacaagtcagaaaaccacttggctaccagtgttgctcggatctttaggttgcaaacccctaacaatgtttttgatcgcagagaacaaaatatggggaagaagaagttggccattaaatgaaggaattatggcggtaggaattgttagtatacttttatcaagtttactaaagaacgacgtgccgctcgcgggacctcttatagcgggcggtatgttgattgcctgttacgtgatttccggaagtagcgcagatctatctcttgaaaaggcggctgaggtttcttgggaagaggaagcggaacactctggggcttcacataatatcttagtggaagttcaagatgatggaactatgaaaatcaaagatgaggagagggacgacaccctgactattctattaaaagcaacattgctagcagttagtggagtttaccccctctcaatcccagctacactatttgtttggtatttctggcaaaagaagaaacagaggagcggtgtactatgggatactccaagccctccagaagtagaaagagcagtactagatgatggaatatatcggataatgcagagaggcctactgggtcgttcacaggtgggtgtaggtgtattccaagaaaatgtcttccacacaatgtggcatgtcacgcgcggggcagtgctaatgtaccaaggaaagagactagaaccaagttgggcatctgtaaagaaagatttgatatcatatggaggaggatggaggctacaaggtagttggaacacaggcgaagaagttcaagttatcgccgtggaaccggggaagaatcccaaaaacgttcaaacagcaccaggtacgttcaagacaccggaaggtgaagttggggctattgctttggactttaaacctggtacgtctggatcacccatagtgaatagggaaggaaaaatcgtaggtctttacggaaatggggttgtgacaacctcagggacatacgtcagtgcaatagcgcaggcgaaggcttcgcaagaagggccactgcctgaaatagaggatgaagtatttcgtaaaagaaatcttacaataatggaccttcatccaggaagtggaaaaacacgccgatatttgccagcgatagtcagggaggctattaaacgtaaactcaggacattgattcttgccccaactagagttgtagcaagtgaaatggcagaagccttaaaaggaatgcccattagatatcaaacgacagccgtaaaaagtgagcatactggaaaggaaatagtagatctaatgtgccatgcgacattcactatgagattgctatcaccagtcagagtgcccaactacaacatgataatcatggatgaggcacattttacagatcctagctctatcgcagcacgaggatatataagtactcgagtaggtatgggtgaagcagccgcgatctttatgacagctactcccccaggatctgtagaggcgtttcctcaatcaaatgcagttattcaggatgaagaaagagatattccggaacgcagttggaactctggttacgaatggataactgatttcccaggaaaaacggtatggttcgttccaagcataaagtcaggcaatgacattgctaattgccttcgcaaaaatggaaaaagagttatacaactaagtcgaaaaacttttgatactgagtaccagaaaactaaaaataatgattgggactacgtggtaaccacggatatcagtgaaatgggcgcaaattttcgcgctgatagagttatagatccccgtagatgcttaaaaccagtaattttaaaggacgggccagaacgagtaatcctggcaggaccaatgcccgtcactgtagcatcagccgctcaaagacgcgggagaattggaaggaatcataataaggagggcgaccaatatatttacatgggacaacctttaaataacgacgaagatcatgctcattggaccgaagcaaaaatgctactggataatataaataccccggaaggaattatccctgcattatttgaacccgaacgagaaaaatcggctgctatagatggagaataccgtcttagaggcgaagcaagaaagacatttgtagaattaatgagaagaggggatcttccagtatggctttcatataaagtagcttcggaggggttccaatattcagataggagatggtgtttcgatggagaacgcaacaatcaagtactggaagaaaacatggatgtagaaatatggacaaaagaaggagaacgtaagaaactacgaccaaggtggctagacgcgaggacgtattcagatcctctagcattaagagagttcaaagaatttgctgccggtaggcgttcggtctcaggggatctaattctagaaattgggaaactgccacaacatctaacacaaagggctcagaatgcattggacaacttagtgatgctacacaattcggaacaaggcggcagagcttataggcacgcgatagaggaactgccagacacaatagaaaccttgatgttgttagcactaatagccgtgttaacaggaggtgttacacttttctttctttccggtcgaggtcttggcaaaacttctattggcctgctatgtgtaatggcatcctcagtcttactatggatggcaagcgttgaacctcactggatcgcagcttccataatcctcgagttctttctaatggttctattaattcctgagcctgatcggcaaagaacaccacaggacaaccaactagcctatgtggttattggactcctttttatgatcctcaccgtagctgctaacgaaatgggattattggagaccaccaaaaaggaccttggaataggtcatgttgccgttgagaaccatcatcatgctgctatgcttgacgtggatctccaccccgcgagtgcgtggacattatacgcggtagccacaacgatcataacgccaatgatgcgtcatactatcgaaaataccacagcaaatatttctctcactgcaatagcaaatcaagcggccattttaatgggtcttgataaaggatggccgatttctaaaatggacattggagtaccactactagccctaggctgttattcacaagtgaatccattaacgttaactgctgctgtattaatgctggttgcccattatgctattatcggacccggactacaagctaaagctacgagagaagcgcagaaaaggaccgcagcaggtataatgaaaaacccaactgttgacggaattgtagcaatagatttagatccagtagtttatgatgcaaaattcgaaaaacagttgggccaaataatgctattgattttgtgcacatcccagattctattgatgagaactacatgggctctttgtgagagtatcactttagcgacgggaccactaacaacgctctgggaaggctcacccggaaagttctggaatactacaatagctgtatctatggctaatatttttcgaggttcctatcttgctggagctggacttgccttctcgttaatgaaatcattgggaggtggaagaagaggtactggtgcccagggcgaaactcttggcgaaaaatggaaacggcaactaaatcaattgagcaagagcgagtttaacacatacaagagaagcggcattatggaggttgacagatcggaagctaaagaggggctaaaaagaggagaaacaactaagcatgccgtttcaaggggtacggcaaagctcagatggttcgttgaaagaaaccttgtcaaacctgaaggcaaagttatcgatctagggtgcggcagagggggatggtcttattactgtgctggactgaagaaagttactgaggtgaaggggtacactaaaggaggaccaggtcatgaggaaccaatacctatggcaacatacggatggaatctagttaaattacattccgggaaagacgtcttctttataccgcccgaaaaatgtgatacactattatgtgatattggcgaaagttcgccaaacccaaccatcgaagaaggccgtactttaagagtactaaaaatggttgagccatggttaagagggaatcaattttgtataaaaatacttaacccatatatgccatctgtagtggaaactttggaacagatgcaaaggaaacacggaggtatgctggtaagaaaccctctatcaagaaatagcacgcacgaaatgtactgggtcagttgcggaactggtaatatcgtaagcgcagtgaatatgacgagtcgtatgttattaaatagattcaccatggcacatagaaaaccaacctatgaaagagatgtagatcttggggccggtacgcgacatgtagcagtcgaacccgaagtagctaacttggatataataggccaaagaatcgaaaatataaaacacgaacataaaagcacctggcattatgatgaggataacccttataagacctgggcctatcacggatcttacgaggtaaaaccatccggttcagcttcttcaatggtaaatggagtagtcaaactgctcacaaaaccgtgggatgtgatacctatggtaacccaaattgccatgacggatacaaccccctttggtcagcaacgagttttcaaagagaaggttgatacacggacaccgaaggctaaacgagggacagcacaaattatggaggtgacggctaaatggctttggggattcctgtcaagaaataagaaacctagaatatgcacgagagaagagttcactcgcaaggtgcgatcaaacgcggcaatcggagcggtgttcgttgatgagaaccaatggaactcagcaaaagaagcagtagaagatgaaaggttttgggatttagttcacagagaaagagaactacataaacaaggaaaatgcgcaacatgtgtgtacaatatgatgggaaaaagggagaagaaattaggggaatttggaaaagcaaagggaagtcgtgctatctggtacatgtggctcggggcacgattcttagagtttgaggctttgggatttatgaacgaggaccattggtttagcagagaaaatagcttaagcggagtagagggcgaaggtttgcataagttaggatatatattacgcgatatatccaagattcccggtgggaatatgtatgcagacgatacagcaggatgggacacaagaataacggaagatgacctccaaaatgaagccagaataactgatattatggaaccagaacatgccctattggcgcgttctatattcaaactgacatatcaaaataaggttgttagagtacagagacccgccaaaaacggaaccgtaatggatgttatatcgcgtagggaccagagaggaagcggccaagtgggaacatatggactaaatacatttaccaatatggaagcccaattaataagacaaatggaatctgaaggcatatttagtccatccgaattagaaactcccaacttggcagaacgagttctagactggttggaaaaatatggagtagaaagattaaagaggatggccattagtggtgatgactgcgttgttaaacccatcgacgatagattcgctactgctttaacagcgttaaacgatatgggtaaagtaagaaaggatataccccaatgggagccgtctaaaggttggaacgattggcaacaagtccctttttgctctcatcacttccatcaattaataatgaaagatggtagagaaatagtagttccttgcaggaatcaggacgaactggtaggacgtgcgagggtaagccaaggagcggggtggtcattaagggaaaccgcatgcttaggtaaaagttatgcacaaatgtggcaacttatgtattttcatagacgcgatctacgtctagccgcaaatgcaatatgttccgcggtgcctgtcgattggattccgacatctaggactacatggtcaatacatgcccatcatcaatggatgacaactgaggatatgctttctgtatggaaccgagtgtggattgaagaaaacccttggatggaagacaaaactcatatctcatcatggggtgatgtaccgtacttagggaagcgcgaagatcaatggtgcggttcattaataggattaacggctcgagccacttgggcaactaacattcaagtagcgataaaccaagttagaagattaattggcaacgaaaattatttagattatatgacgagcatgaaaagatttaaaaacgaatcggatccggaaggagcactatggtaa

SEQ ID NO: 21992 - RNA, 9879 nt, synthetic construct
  misc_feature 1..9879: note = derived and/or modified CDS sequence (opt6) from DENV-1__JQ045638__SS-prME
  source 1..9879: mol_type = other RNA
agtgttactatgttgttgatgctgatgcccacagccttagcatttcatctgacaacaaggggtggggaacctcatatgattgtttccaaacaagaaagaggaaaaagccttctattcaaaacaagcgcaggggtaaacatgtgtactctcatcgcaatggacttaggcgaattgtgtgaagacacaatgacttacaaatgtccaagaatcacagaaacagaaccagacgatgttgattgctggtgtaatgcgactgacacctgggtcacttacgggacttgtagtcaaactggggaacacaggcgtgataaacgcagtgtagccctggctccccacgtaggtttaggtttagaaacaagaacagaaacttggatgtcgtcggaaggtgcatggaaacaaatacaaagggtggaaacgtgggcattaagacaccctggattcacagtcattgcactatttctggcacacgcaatagggacaagtattacacaaaaaggaattattttcatactactaatgctcgtcacgccctctatggctatgaggtgtgtcggaataggctccagagattttgtcgaaggactatccggtgcaacatgggtagatgtagtactcgaacatggttcttgcgtaaccactatggctaaagataaacccacactagatattgaactcctgaaaacagaagttacaaatcctgcagtattgcgtaaattgtgcatagaagctaaaatttcaaatacgacaacagactcaagatgtcccacccaaggcgaagcaactcttgtagaagaacaggatgctaattttgtttgtagaagaacgtttgtggatcgaggatggggcaatggctgcggactctttgggaagggttctcttattacttgtgcaaaatttaaatgcgtgacaaaattagaaggaaaaatagtacagtatgaaaatctaaaatactctgtgattgttacagtccatacgggcgatcagcaccaagtaggcaatgaaagtacggaacatggaaccacagcgacaataacaccgcaagcccccacaacagaaattcagctaactgattacggagctttaacgctagattgttccccaagaacgggattagacttcaacgagatggttctactaactatgaaagaaaagagctggcttgtccacaaacaatggttcttagacttacccttaccctggacttcaggggcgagtacaagccaagagacttggaatagacaagacttattagtaacgtttaagacggcccacgctaaaaagcaagaagtcgtagttctgggatcgcaagaaggtgccatgcatacagcattgactggcgctacggagatacaaatgtcgggaaccactacaatattcgccggtcatttaaaatgtaggctaaaaatggataaattaacactgaaaggaatgagttatgttatgtgtacaggaagttttaaattagaaaaagaagtcgcagagactcagcacggcactgtactcgttcagataaaatatgagggcacagacgctccttgtaaaatccctttcagcacgcaagatgaaaagggagtaacacaaaacggaagattgataacagctaatccaattgtcacagacaaagaaaaaccagtaaatatagaagctgaaccaccatttggtgagtcttacatcgtgatcggggctggagaaaaggccttaaaactgtcttggtttaagaaaggttcaagtattggcaaaatgtttgaagccacagcaagaggagccagacgtatggctatattaggagacacagcatgggatttcggaagtataggtggggtctttacgtcggtaggtaaactcgtacatcaaatatttggaacagcatatggagtactatttagtggggtaagttggactatgaaaattggcattggcgtactattaacctggctcggacttaactcaagaagtacatccctgagtatgacgtgtatagccgtcgggttggttaccctatatcttggagtgatggtacaagccgattcggggtgcgttatcaattggaaaggaagggagcttaagtgtggctctggaatatttgtcactaacgaagtgcacacatggacagagcaatataagtttcaagcagattcacctaaaagattaagtgctgccattggcaaggcttgggaagaaggcgtttgcggaatacgttctgcaacacgtcttgagaacatcatgtggaaacagatctcgaacgaattgaatcatatacttctagaaaacgacatgaagttcaccgtagtcgtcggcgatgttgctggaattttggcacaaggcaagaaaatgatcaggccacaaccgatggaatataaatattcatggaaatcttggggcaaagcaaagatcataggagctgacgtacaaaatacaaccttcataattgatggaccgaacacaccagaatgccccgatgatcaacgagcgtggaacatctgggaagtagaagattatggatttggtattttcacaacaaatatatggttgaaactccgagatagttatacgcaggtatgcgatcaccgactgatgagcgcggcaattaaggatagtaaggctgtgcatgcggatatgggatattggatagaaagcgagaaaaatgaaacgtggaaattggcacgcgctagtttcatagaagttaaaacttgtatatggccaaaaagtcacacattatggagtaatggagtcctcgaatctgagatgatcatccccaaaatatatggcggaccaatatcccaacataattatcgcccaggctactttactcaaacagctggaccctggcatcttggcaaacttgaattagatttcgatctctgtgaaggtaccacagtcgtagtggacgaacactgtgggagcagaggaccttccttaagaaccactactgtcactggtaaaattatccacgaatggtgttgtaggagctgtaccctaccgccactacgttttagaggcgaagatggttgctggtatggaatggaaatacgacccgtcaaagaaaaagaagagaacctcgttaaatcgatggtttcagcgggtagcggtgaagtcgattccttgtctttaggtctgctatgcatttcgattatgatagaagaagttatgcgaagccgctggtcaaggaagatgctaatgacaggtacattagcagtattctttctattaattatgggccagctaacatggaacgacctaattcgactgtgtataatggtaggtgcgaacgcatcggatagaatgggcatgggcacaacatatctagcattaatggccgcatttaagatgaggccgatgtttgcagtaggactattgtttaggcgtctgactagcagagaagtcctgctgctaacgatcggtctcagcttagttgccagtgtggaattacctaactcgctagaagagttaggagacggactcgctatgggaatcatgatactaaaactattgacagattttcaaagccatcaactgtgggcaacattattatccctgacattcattaagacaacattttccctgcactatgcttggaagacgatggcgatggtattgagtattgtttctttattcccgttgtgtcttagtactacgagccagaagactacctggcttcctgtcctactaggaagcctgggttgtaaacctcttaccatgttcctaattgctgagaataaaatttggggtaggcgaagttggcccttaaacgaaggtataatggctgtgggaattgtatcaatcttactaagttcattgctcaaaaatgacgtcccactagcaggtccattgatagcaggagggatgttgatagcttgttacgtaattagtggaagtagtgccgatctgtcgttagaaaaagcagctgaggtatcttgggaagaagaagcagaacattccggtgcttctcacaatatcctcgtagaggttcaagacgatgggacaatgaagattaaggacgaagagagagacgatacgttaactatactactaaaagctacattactagccgtctcaggggtataccctctctcgataccggctactttattcgtttggtatttctggcagaagaagaaacagaggtctggagtattgtgggacactccatctcctccagaggtagaacgggctgtgttggatgatgggatatatagaataatgcagcgaggtctactaggcaggagtcaggtaggcgtgggtgtctttcaggaaaatgtatttcataccatgtggcacgttactagaggagcagttttgatgtatcagggaaaaaggctagaaccatcatgggccagtgtcaagaaagatctcatatcatatggaggagggtggcgactgcaaggttcgtggaataccggggaagaagtacaagtaatcgcagtggaaccgggcaaaaatccaaagaatgtccaaacagcaccgggaacattcaaaacgcctgaaggagaagtgggcgccatcgcattagatttcaaacctggaacatcaggaagccctatagtaaacagagaggggaagatagttgggctgtacggcaacggcgtggtcacaacgtctggtacttatgtaagcgcaattgcacaagcaaaagcaagtcaagaaggaccactacctgaaattgaagatgaagtgtttaggaaacgcaacttgactataatggacctacatcccggcagtggaaaaaccagaagatatcttccggcaatagtacgagaagcgatcaaacgcaaattgagaacactcatacttgctcctactcgagtcgtggcatccgaaatggctgaagccttgaaaggaatgccgataaggtaccagaccacagcagttaaatcagagcacactggtaaggaaatcgtcgacttaatgtgccacgctacctttacaatgaggctgttatctcctgttagggtgcctaactataatatgataattatggatgaggcccattttaccgatccgtcctcaatcgcggcacgaggttatataagcaccagagtaggaatgggagaagcggcagcaatttttatgaccgcgacaccgccgggttcagttgaggcttttccacaatctaacgcagtaatccaggatgaagaaagagacataccagaacggagttggaatagcggatacgaatggatcactgattttcccgggaaaacggtgtggttcgtaccgagcatcaaaagcggaaatgatatagcgaactgcctacgtaaaaacggtaaacgggtaatccaattatctagaaaaacgttcgacacagaatatcagaaaactaaaaacaatgattgggactatgtagtgactactgacatatctgaaatgggtgccaacttcagagcagatcgtgtcatagatccaagaagatgtctgaagccggtaatactcaaagacggtcctgaaagagtaattctagccggccccatgcccgtgactgtagcatctgctgcacaaagacgaggccgtattggtagaaaccataataaagaaggagaccaatatatatatatgggacaaccactcaataacgacgaagatcacgcgcattggacagaagcaaagatgttgctcgacaatatcaatacgccagaaggaataatacccgccttgtttgaaccggagagggagaaatccgctgccatagacggggaataccgattgaggggtgaggccaggaaaactttcgttgaactcatgagaagaggagacctaccagtatggctatcctataaggtcgcatcggagggttttcaatactccgaccgaagatggtgcttcgatggtgaacgaaacaaccaagtcctagaggaaaatatggacgtagaaatatggacaaaggaaggagaaaggaagaagttaagaccgcgctggctagacgcccgtacgtatagcgatccactagctctgcgagagttcaaagaatttgcggcagggagacgaagcgtcagtggagatttaatactcgaaataggaaaacttccacaacatttaacacaaagggcgcaaaacgcgcttgacaatttggtaatgttacataatagtgaacaaggtgggcgggcgtatcggcatgcaattgaagaacttccggatacgatagaaacattaatgcttttagcccttatagcagtgctcactgggggagttacactatttttcttatcagggagaggtcttggaaaaacaagcattggattgttatgtgtaatggcttccagtgtattactgtggatggcctcggtggagccacattggattgcagcctcaataatccttgagttctttctaatggtactacttatacctgaaccagatcgacaacgcactccacaagataatcaactcgcttacgtagtaataggattgctatttatgatattaacagttgctgcaaatgaaatgggtttactagaaaccaccaagaaagatttgggcattgggcatgtcgctgtagaaaaccaccatcacgcagcaatgctagatgtggatctacaccctgcgtcagcatggacactctatgctgtcgcgacaactataattaccccaatgatgagacacacgatagaaaatacaacagcaaatatcagtttaactgctatcgccaaccaagcagcgattttgatggggttagacaaaggctggcccatttcaaaaatggatataggggtaccgctactggctcttggatgctatagccaagtaaaccccttaacgctaacagccgctgtactaatgctagtagcacattatgcgataataggacctggcttacaagcaaaggcgacaagagaagctcagaaacggacagcagcgggcattatgaagaatccaacggtcgacggtatagtggcaatagacttagatccagtagtatacgatgcaaaatttgagaagcaattgggtcaaataatgttgttaatattatgcacatctcaaatcctactaatgcgcactacttgggcactatgcgagagtataaccctagcaacaggcccattaactaccctgtgggaaggcagccctggaaagttttggaatactacgattgcggtaagcatggcaaatatctttagggggtcctatctagctggggcaggtttagcattcagtttgatgaaatctctaggaggaggtagaaggggcaccggagcgcaaggtgagacactaggggaaaagtggaaaaggcaacttaaccaattatctaaaagtgagttcaacacatataaacggtccggaattatggaagttgacagatctgaagcaaaagaagggctcaaaagaggcgaaactactaagcatgcagtatcacgcggtacagcaaagctcagatggttcgttgaaagaaatttagtcaaaccagagggtaaggtaattgacttggggtgtggaagagggggatgggcatattattgtgcaggcctaaagaaagttactgaggtaaaaggttatacaaaaggtggtccaggacatgaagaacctattccaatggctacatatggatggaatttggtgaagttgcacagcggtaaagacgtatttttcattcccccagaaaaatgcgatacactattgtgcgacattggagagagtagtccaaatcccaccattgaagaagggagaacgttaagagtattaaaaatggtagaaccctggctaagaggaaaccaattttgcattaaaatattaaatccatatatgccttcagtggttgagacattagaacaaatgcaaaggaaacacggtggcatgctagtgagaaatcctctcagccgtaactctacacatgaaatgtattgggtttcttgtggtacaggaaacattgtaagcgcagtaaacatgacatcacgaatgctcttgaacagattcaccatggctcacagaaaaccaacatatgaacgagacgttgatttaggagccggtacccgtcatgtagcggttgaacctgaagtcgctaatcttgatatcataggccaaaggatagaaaatattaaacacgaacacaaaagtacctggcattatgatgaagataatccatataaaacctgggcataccatggtagctacgaagtaaaaccctctggttcagccagctccatggttaacggagtagttaaactcttgacgaaaccatgggacgtaatacccatggttacacagatagccatgactgacaccacaccctttggtcagcaacgtgtatttaaagagaaggtagatactaggactccaaaagccaaacgcggtactgcacaaattatggaagtgacagcgaaatggctgtggggcttcttgagtagaaataagaaacctaggatatgcacgagagaagaatttactcgcaaggtaagaagcaatgccgcaattggagcggtattcgtcgacgaaaatcaatggaatagtgcaaaagaagctgtcgaggatgaaagattctgggatctggtccaccgtgaacgagaactacataaacaaggaaaatgtgcaacatgtgtctataacatgatgggcaagagagagaagaaactaggtgagttcggtaaagcaaaaggcagtagggccatatggtacatgtggctaggcgcaagattcctggagttcgaagcactaggctttatgaatgaagatcactggttctccagggagaatagcctaagtggggtcgaaggtgagggactacataaattaggatacattttaagagatattagcaaaattccaggcggtaatatgtatgctgatgacacggctggatgggacactagaataaccgaagatgatctacaaaacgaagcgcggatcactgatataatggaacccgaacatgccctattggcacgatcaatatttaaactaacgtatcaaaataaagtagttagagtccaaagaccagcgaaaaatggaaccgtaatggatgtcatcagtcgcagagaccaacgagggagcggacaggttggaacatatggattaaacacattcacaaatatggaagctcaattaatacgtcagatggaatcagaaggcatattttccccctcagagttggaaacaccgaacttagccgagagagtattagattggttagagaaatatggcgttgaaagactcaaaagaatggctatatcgggagacgactgtgtagtcaaacccatagatgatagatttgccaccgcactaacagctctaaacgatatggggaaagtccgaaaagatattccacaatgggaaccctctaaaggatggaacgattggcagcaagtacccttttgttcacatcacttccaccaacttataatgaaagacggtagggaaatagtcgttccttgtcgaaaccaagacgaattagtgggccgagcaagagtgtcccaaggagcgggttggagtctaagagaaactgcctgtctaggaaaatcatatgcacaaatgtggcaacttatgtacttccatagacgcgatttaagattagcagccaatgcgatttgctcagcagttccagtagattggataccgacaagtagaacaacatggtctatacatgcgcaccaccaatggatgacaacggaagatatgttaagtgtctggaatcgggtatggatcgaagaaaatccttggatggaagataaaacccatatttcatcatggggtgacgttccatatctaggcaaaagggaagaccaatggtgtgggtccctaattggactaaccgcaagagccacatgggctacaaacatacaagtagccatcaaccaagttcgcaggttgattggaaatgaaaattatttagattatatgacatctatgaaacgatttaaaaatgagagtgacccggagggtgccctatggtga

SEQ ID NO: 21993 - RNA, 9879 nt, synthetic construct
  misc_feature 1..9879: note = derived and/or modified CDS sequence (opt6) from DENV-1__JQ045639__SS-prME
  source 1..9879: mol_type = other RNA
agcgtaactatgtttctaatgttaatgcccactgcgcttgctttccacctaactacgagaggtggggaacctcacatgatagtcagtaaacaagaacgtgggaaaagcctactatttaaaacgagtgccggggtaaacatgtgcactttaattgcgatggatctcggtgaactatgtgaagacactatgacgtataaatgccctcgcataactgaaacagaaccagacgatgttgattgttggtgtaatgccactgatacatgggtaacatatgggacctgctcccaaacgggggaacatcgcagagataaacggagcgtagcgcttgctccacatgtggggcttggtctcgaaaccagaacagaaacatggatgagttcagaaggagcatggaaacaaatacaacgtgtagaaacatgggcgcttagacatccaggttttacggtaattgccttattcctggcccacgccatagggactagcataacgcaaaaaggaataatattcatcttgcttatgctagttacgccatcaatggcaatgcgctgcgtaggtattgggtcccgagatttcgtggaaggtttatctggagccacatgggtagatgtggtgctcgaacacggaagttgcgtaactacaatggcaaaagataaaccaactctagacatagaactactcaaaactgaagttacgaatccagctgtactaagaaaattatgcatcgaggcaaaaatcagcaacacgaccacagactcaagatgtccaacccaaggtgaagcgacattagtggaggaacaagatgcgaatttcgtttgtagacgaacatttgtagatcggggttgggggaatggatgcggactatttgggaagggtagtttaattacatgcgcaaaattcaagtgtgtaaccaaactagaagggaaaattgtacagtatgaaaaccttaaatattcggtaatagtcactgtacacacgggtgatcaacaccaagtggggaacgaatctacagagcatggcacaactgcaacgattactccgcaagcgccgactacggaaatacagttaacagactacggggcattaacactcgactgttcgccgagaaccggtcttgatttcaacgaaatggtgctcttaacaatgaaggaaaagagttggctcgttcataagcaatggttcctcgatctaccactaccatggacctccggagccagtacaagtcaggaaacatggaaccgacaagatctgcttgttacattcaaaacagcccacgcaaagaagcaggaggtggttgttttgggatctcaagaaggagcaatgcacaccgctttaactggcgcaactgaaatacagacaagtggcacaactactatatttgctggacacctgaagtgcagactaaaaatggacaaactaacattaaaggggatgagttatgtaatgtgtacaggttcgttcaaattagagaaagagttagcagagacgcaacatggtaccgtgcttgttcagataaagtatgagggaacagatgcaccttgcaaaatacccttcagtactcaagatgagaagggagtaacacaaaatgggagattaattactgctaacccaatagtgaccgacaaagaaaaaccagtaaatatcgaggctgaacccccatttggagaatcatacatagtcataggtgctggcgaaaaagcactgaaactctcttggtttaagaaaggatccagcattggcaaaatgtttgaagccaccgcaagaggagcgcgaagaatggcaatactaggtgatacagcatgggacttcggaagtataggtggtgtctttacaagtgtgggaaagctagtacatcaaatatttggtaccgcatacggtgttctattctcaggcgtttcctggactatgaaaattggcataggagtactgctcacatggctaggattgaactcacgaagtacgagtctttcaatgacgtgtatcgccgtcggattagtaacactgtatctaggagttatggtccaagctgattcaggatgtgttattaattggaaaggaagagaacttaaatgcgggagtggaattttcgtaactaacgaagtacatacgtggacggaacaatacaagtttcaagcagattcaccaaaaaggctgtcggctgctattggcaaagcatgggaagagggtgtgtgtggaattagaagcgctacacgcttagaaaacattatgtggaaacaaattagcaatgagttaaaccacattttattagaaaatgacatgaaatttactgtcgtcgtaggggatgtggctggcatcttagcacaaggcaagaaaatgatccgtccacaacccatggaatataaatatagttggaaatcctggggcaaagcgaagataattggagccgacgttcagaacacaacgttcataattgatgggccaaatactcccgagtgccctgacgaccaaagagcgtggaacatatgggaagttgaagactatggcttcgggatatttacaacaaacatatggttgaaactacgagattcatacactcaggtttgcgaccatcgtcttatgtcggcagcgataaaggacagtaaagcagttcacgcagacatgggatattggatcgaatctgagaaaaatgagacgtggaagttagcacgagcaagtttcatcgaagtgaaaacttgtatctggccaaagtcacatactttatggagtaatggcgttctggagtcagaaatgattattccaaaaatttacgggggcccgatttctcaacataattatcgaccaggatactttacgcaaacagcagggccatggcacttaggaaaacttgaattggacttcgacttgtgcgaagggactacagtcgttgttgacgaacactgtggaaatagaggccctagcttaaggactacaacagttaccggaaaaatcatacatgaatggtgctgtcgtagttgcacactaccacctctcagattcagaggagaggacggatgctggtacggaatggaaatccgacccgtaaaagagaaagaagaaaacctcgtgaaatcgatggtatccgcaggttcgggagaagtggatagtttctcactgggcttgttatgtatatcgataatgatcgaagaggtaatgcgtagcagatggtcaaggaaaatgctcatgacaggaacgctggcagtatttttcctattaataatggggcaacttacttggaacgatttaattcgactatgcatcatggtaggtgcgaacgcatctgacagaatgggaatgggtacgacttacttggcccttatggcaacgtttaagatgagaccaatgtttgcggtaggcttgctctttagacggttaacatccagagaagtgttattactgacgatcggattgagcctagtagcgtctgtcgagttacccaactcgctcgaggaattaggagatggtctggccatgggaataatgatattgaaacttctgaccgactttcaaagccaccaattgtgggcaacattactatcacttacttttataaagactacattctccttacattacgcatggaagactatggcaatggtactgtcgatagtctccttgttcccgttatgtctctctacaacaagtcagaaaacaacctggctaccggtactcttaggtagcttgggctgtaagccgctcacgatgtttctgattgcggaaaacaaaatctggggtcgacgatcatggccactcaatgaaggaattatggcggtcggcattgtatcaatattactgtccagcctactcaaaaacgatgtcccactagcaggaccattaattgcaggaggaatgttgatcgcatgctacgttataagcgggtccagcgcggacctgtcactagaaaaagcagcagaagtatcatgggaagaagaagcggaacactccggggcttcacataatatattagtagaagtgcaagatgacgggacaatgaaaattaaggacgaagagagagatgatactctaactatcctattgaaagcgacacttttagcggtctcaggggtatatccactctctattcccgccacactatttgtttggcacttttggcaaaagaagaaacagagatctggagttctctgggataccccttcaccaccagaggtcgaaagagcagtgttagatgacggaatctatcgtataatgcaaaggggcttgctaggtcggagtcaagtcggtgtaggtgtatttcaagaaaacgtcttccatacaatgtggcatgtaaccagaggtgccgtactaatgtaccagggaaaaagactagaaccctcctgggcttcagttaagaaagatttaatatcctatggaggagggtggagattacaaggtagttggaacactggagaagaggtacaggttattgcagtagaaccgggcaaaaaccctaagaacgtacaaacagcacccggaactttcaaaacaccagaaggagaagttggagcgatagctcttgattttaaaccaggaaccagtggaagccccatagtcaatagagaaggaaaaatcgtagggttatacggaaacggcgtagtcacaacgagtgggacctatgtaagtgcaatcgcacaagcccgagcgtcacaagaaggccctttacctgaaatagaggatgaagtatttcgaaaaagaaatctcacgatcatggatctacatcctggatccgggaaaacaaggcgataccttcccgcgattgttcgtgaggccataaaaagaaaattaaggacactaatcttagctccaactagagtagttgcgtcagagatggccgaagctctaaaaggaatgcctataagataccaaacgaccgctgttaagtcagaacacacaggaaaagagatagttgatctcatgtgccacgcaacgtttaccatgagacttttgtcgccagtaagagtaccaaattataacatgataattatggatgaagctcactttacagatccatcgtctattgctgcaagaggttacatttcaactcgtgtaggaatgggagaagcagctgcgatcttcatgacggctacgcccccaggaagcgtagaggcatttccacagtcaaatgctgttatacaggatgaagaaagggacatacccgagcgctcatggaactcaggttacgagtggattaccgattttcccggcaagacggtttggtttgtaccatcgattaaaagtggtaacgacatcgcaaactgtctcagaaagaacgggaaaagagtaatccagctcagtagaaaaacctttgatactgaatatcagaaaactaaaaataacgattgggattacgtagtaactacagatatctcagaaatgggtgctaacttccgggctgatcgtgtaatagaccccagacgttgtcttaagccagtgatactcaaagatggccctgaaagagttattttggcaggtcctatgccagtaacagtcgcatcggctgcacaaaggagaggaagaattggacgaaatcataacaaagaaggggatcaatacatctacatggggcaacctctcaataacgatgaagaccatgcacactggacagaggcaaaaatgctcttagacaatatcaatactcccgagggaattattccagcactattcgagccagaaagagaaaaatcagctgcgatcgacggtgaatataggttaagaggagaggcacgaaaaacgtttgttgagctaatgcggagaggagatttaccagtctggctgtcttataaagtcgcatcagaaggatttcaatactcggacagaagatggtgttttgatggggaacggaataaccaagtcctagaagaaaatatggacgtagagatttggacgaaggaaggtgaaaggaagaaactcagaccaaggtggttagacgcaagaacgtacagtgatccgcttgcattacgtgaatttaaagagtttgcggcaggcagaaggtcagtgtcaggagatctcatattagaaattggtaaattaccacaacatttaacacaaagagcacaaaatgccctagataatcttgttatgctacataatagcgaacagggaggcagggcataccggcacgcaatggaagagttaccggacacaattgaaactctaatgctacttgctctaatcgcagttttgactggtggggtaacgcttttcttccttagtggcagaggattggggaaaacaagcattggtttgctttgcgttatggcttcgtctgcactcctctggatggcgagtgtggaaccgcattggatagccgctagtattattttggagttctttttaatggtgctcttaattcctgaaccagaccgacaaagaacacctcaggacaaccaactagcgtatgttgttatcggattactgttcatgatacttaccgttgcagctaatgaaatgggtttgctagagaccacaaagaaagatctaggaataggtcatgccgccgtagagaatcatcaccatgcggcaatgttagatgtagaccttcatccagcatccgcatggacactgtacgcagtagccacaacaattatcacacctatgatgagacacaccatagaaaatacaacggcaaacatatccctgactgcaattgcaaatcaggcggcaatcttaatgggtttggacaaaggatggccgataagtaagatggacattggtgtgccgctactggccctggggtgctactcccaagtaaacccactgacattaacagcagctgtgttaatgttagtagctcattatgcaataattgggccgggtttacaagcaaaagctactagggaagcccagaagaggacagcagcaggtattatgaaaaacccaacagtagatgggattgtggcaatcgatcttgatccagttgtttatgatgcaaaattcgaaaaacaattaggacaaataatgcttcttatactgtgtacctcccaaatacttttaatgagaactacttgggcattatgcgaatcaataacacttgccaccgggccgttaactacactgtgggaaggatcacccggaaagttctggaatacgaccatagcggttagcatggcgaatatctttagaggaagctacctagccggtgctggtttggcgttttcattaatgaaatcattaggaggaggtaggaggggtaccggagcgcaaggtgaaactttaggggagaaatggaaaagacaacttaatcaattatccaagtctgaatttaatacatataaaagatcaggaattatggaggttgacagatcggaagccaaagaaggactaaaacgaggcgaaacaactaaacacgctgtatcaaggggaactgctaaattacgttggtttgttgagagaaacctagtaaaaccagaaggaaaagtaatagatttaggatgtggccgaggtggatggtcatattattgcgccggattaaagaaggtcaccgaagtaaaaggctatactaaaggcggtccaggccatgaggagccgatcccaatggcaacatacgggtggaatttggtaaaactacattcaggcaaagatgtattcttcataccaccagaaaaatgcgatactttactttgtgacattggagaatcaagcccaaacccgacaattgaggaagggcgcacgctaagggttcttaaaatggtagagccatggttacgtggaaatcagttctgtattaaaatcttaaacccttatatgccctctgtcgtagaaactttagaacagatgcaaagaaagcacggagggatgctagtacgtaacccactcagtagaaactctacacacgaaatgtattgggtcagttgtggaactggtaatattgtttctgccgttaacatgactagccgcatgctcctgaataggttcacgatggcacataggaaaccgacatatgaaagagatgtagacttaggggcgggaacacggcatgttgcagtcgaaccagaggtcgctaatttggatataatcggacaaagaatagagaacattaagcatgaacacaaatcaacctggcattatgacgaggataatccctataagacatgggcataccacggatcttacgaagtaaaaccaagcggaagcgcttcatctatggtcaatggagttgtaaaattattaacaaaaccctgggacgtaatacccatggttactcaaatcgctatgacagatactactccattcggtcaacaacgagtattcaaggaaaaagtagacaccagaactccaaaggcaaagcgtgggacagcccaaataatggaagtaacggctaaatggctatggggtttcttatcaagaaacaaaaagccgcgtatctgtacccgagaagaatttacacgaaaggtacgctcgaatgcagcaataggcgcagtatttgtagacgagaaccagtggaactcagcaaaggaggctgtagaggacgaaaggttctgggacttagtacatagggaaagggaattacataagcaaggtaggtgcgcaacatgcgtttacaacatgatgggaaagcgggagaagaaattaggagaatttggtaaagcaaagggtagtagagcaatatggtacatgtggctaggggcgcgctttttagagttcgaagcattaggatttatgaacgaagatcattggttttcgcgggaaaatagcttaagcggcgttgaaggtgaaggattacataaactaggctacatcttacgcgacatttctaaaataccaggcggaaatatgtacgctgatgatacagcggggtgggatactagaataacagaagacgatttacaaaacgaagcaagaatcactgatataatggaacctgaacatgccttgcttgccaaaagtatttttaaactgacttaccaaaataaggtggtaagagtccagagaccagctaaaaatggcacagtaatggacgtaataagtagaagagaccaacgtggatcaggtcaagtaggaacttatggcctaaatacgtttacaaatatggaagcacaattaattaggcaaatggaatccgaaggaatttttagtccaagtgaattagaaacacccaacctagctgagagagtacttgattggttggaaaagtatggagtagaacgacttaaacgtatggccatatcgggagacgactgtgtagtaaaaccaatagacgatcgattcgcaactgctttgaccgcacttaatgacatggggaaagtaagaaaagacataccccaatgggaaccaagtaaaggatggaacgattggcaacaagttccgttctgcagtcatcacttccatcaattaattatgaaggatggtagagaaattgtggtaccgtgccggaatcaagacgagctagtggggcgagctcgcgtttcacaaggagcaggatggtcactacgagagactgcatgcttgggtaaatcttacgcacaaatgtggcagctcatgtattttcatcgacgtgacttaagacttgcagctaatgcgatttgttcagccgtcccggtcgactggataccaacaagccggactacttggagtatacatgcccaccatcaatggatgaccaccgaggatatgctctcggtttggaatcgagtttggatagaggagaatccgtggatggaagataaaacgcatatatcaagttgggaagatgtaccatatttagggaagcgcgaagaccaatggtgcggaagcctaatagggctgacagccagagccacgtgggcaaccaacattcaagtagcgattaatcaagtcagaaggcttattggcaatgaaaactatctagattatatgacatcaatgaaacgatttaaaaatgagtctgatccggaaggagccttatggtag

SEQ ID NO: 21994 - RNA, 9879 nt, synthetic construct
  misc_feature 1..9879: note = derived and/or modified CDS sequence (opt6) from DENV-1__JQ045641__SS-prME
  source 1..9879: mol_type = other RNA
tcagtaactatgttactaatgcttatgcctacagcgcttgcttttcatttaaccacccgtgggggagaaccacatatgatagtatctaaacaagaacgtggtaaatcgttactatttaaaacatccgcaggagtaaacatgtgtactttaattgccatggatcttggtgaactctgcgaagataccatgacttataaatgtcctcgtataacagaaactgaaccagatgatgtagattgctggtgtaacgccactgatacttgggtaacctatggaacgtgctcccaaactggagaacacaggagagacaaacgatcagtggcactcgccccacatgtagggctaggattagaaaccagaacagaaacatggatgtcctcagaaggggcttggaaacaaatacaaagagttgaaacgtgggcacttcgacatccaggattcacagtaatagcgctattcctagcacatgcaatagggacaagtatcacacaaaaaggaataatttttatattacttatgctagttacaccaagtatggctatgaggtgcgtaggaattggaagcagggactttgtagaaggactttcaggtgctacttgggtagacgtagtcttggaacacgggagctgtgtaacaactatggcaaaagataaacctacactagacattgaactactaaaaacagaagtcacaaaccctgcagtattaagaaaactctgtatagaagcgaaaattagcaatacgacgactgacagtcgatgtccaacccaaggcgaagctaccttagttgaagaacaagatgcaaattttgtctgcaggcggacttttgtagatcgtggttggggaaatggctgtggcttattcggaaaaggttcattgattacttgcgcaaaatttaaatgcgtaacaaaattagaaggtaaaatagttcaatacgaaaatttaaaatattcggttatcgttacagtacacacaggcgaccaacatcaagtaggaaatgaaagtactgaacacggaactacagcgacgataactccccaagcaccaacaacggaaatacaattaacagattatggtgcattaacactcgattgcagtccccgcactggactggatttcaacgagatggtactcctcacaatgaaggagaaaagctggctcgtacacaaacaatggtttttggatttaccattaccatggacatcaggagcatctacaagtcaagaaacatggaatcgccaagacttgttagtcaccttcaagacagcacatgccaagaaacaagaggtagtagtgctgggtagccaggagggagctatgcacactgcactcaccggtgcaactgaaattcaaacttccggaactaccactatcttcgcgggtcacctaaaatgtagattaaaaatggacaaattaacactcaaaggaatgagctatgtgatgtgtactgggagcttcaaattggaaaaagaacttgcagaaacacaacatggtaccgtcttagtacagataaagtatgaagggactgacgctccgtgcaaaatccctttctcaactcaagatgaaaaaggtgttgcccaaaatggaagacttataactgcgaacccaatagtcacggataaagaaaaacctgtaaatatcgaagccgaacccccttttggcgaaagttatatagtcataggggcaggcgaaaaagcgctcaaacttagctggttcaagaaaggttccagtataggtaaaatgtttgaagccacagcaagaggtgcaaggagaatggcaattctcggagatactgcgtgggacttcggttctataggaggggtgttcaccagcgttggcaaattagtccatcaaatttttgggacagcatacggagtgttatttagcggcgtatcatggacaatgaagatagggataggggtcttattaacgtggttaggattaaactctaggtctacaagtttaagtatgacttgcatcgcggtaggacttgttacgctatacctgggagttatggtgcaagcagacagcggctgcgtgatcaactggaaaggcagagaactaaaatgcggaagcggcatctttgttacgaacgaagttcatacatggaccgaacaatataaattccaagctgatagcccgaaaagactaagtgcagcgataggaaaggcttgggaagagggagtatgtgggattaggtctgccactaggttagaaaacataatgtggaaacaaatttcgaacgagttaaatcatatactcctggaaaacgacatgaaatttactgtggtggtaggcgacgtcgcagggattctagcacagggcaagaaaatgatacgacctcagccgatggagtacaaatattcatggaaaagctggggaaaagctaaaattataggagcggatgtccagaatactacattcataatagacggtcctaacacgccagaatgccccgatgaccagcgtgcatggaacatatgggaagttgaagattatggatttggaatatttacaactaatatatggctcaaattacgagactcttatacacaagtatgcgaccaccgattaatgagtgccgcgatcaaagacagcaaggcagttcatgcagatatgggctattggatagaatccgaaaagaatgaaacatggaaacttgcaagagcgtctttcattgaagtaaaaacatgtatttggccgaagtctcacacgctgtggagtaatggcgtacttgaaagtgaaatgatcattcctaaaatatacggaggtccaatatctcagcataactataggcccggctactttactcaaactgcaggtccctggcacctaggaaaactagaattagattttgatctctgtgaaggtactacagtagtggttgatgaacactgtggaaaccgtggtcccagcttgagaactacaactgtgacaggcaaaataatacatgagtggtgctgtagaagctgtacgttgccaccacttagattcagaggagaagacgggtgctggtatgggatggaaattaggccagtgaaagaaaaagaagagaacctagtaaaatctatggtatctgccggatcgggcgaagtagattcctttagcttaggcctcctctgtatctctataatgatagaagaggtaatgagatcaagatggtctagaaaaatgttaatgacaggcacactagctgtcttcttcctgttgattatgggacagttaacatggaacgacctaattaggctctgcataatggtaggcgcgaatgcgagtgacagaatgggaatgggtacaacgtatttagcgttaatggccaccttcaaaatgcgacccatgtttgcagtaggtctattattcaggcgcttaacctccagagaggtgttactactaacaatcggcctatcattagtcgcgagtgttgaacttccaaacagcctcgaggaattgggagatggactagctatggggattatgatcctaaaattattaacagattttcagtcacaccaattatgggcaacactgttatcattgacatttattaagacgacgttgagcctacactacgcatggaaaacaatggccatggtcctgagtatagtaagtttattccctttgtgtttatctaccaccagtcagaaaacaacatggcttcccgtgctactaggaagccttggttgtaagcctttaacaatgtttttaatcgcagaaaataagatatgggggagaagaagttggcctcttaatgaaggtataatggccgttggaattgtatcaattctcctgagttctctattgaagaatgatgtcccattagccggtccattgatagctggcggaatgctaatagcttgctatgtcatctcaggtagttctgcggatctatctttagaaaaagcggcagaagttagttgggaagaagaggcggaacacagtggtgcatctcacaatatcctagtagaagtacaagatgacggaactatgaaaatcaaagacgaggaaagagacgatacattaacgatattgctaaaagctacacttctagccgtttcgggagtatacccgctatcaataccagctaccttattcgtctggtatttttggcaaaagaagaaacaaagatcaggtgtgttatgggacactccatcgcctcctgaagtggagagagcggtattggatgacgggatctacaggattatgcaaagaggattacttggacgatcacaagttggagtgggagtattccaagaaaatgtgtttcacaccatgtggcacgttacaagaggagctgtccttatgtatcagggaaaaaggctagaaccatcctgggcctcagtcaaaaaggacctaatatcgtatggagggggttggcgattacaaggttcttggaataccggagaagaggttcaagtcatagccgtggaaccaggcaaaaatcctaaaaacgtccagactgctcctggcaccttcaaaacccccgaaggcgaagtaggagccattgcattagatttcaaacctggaacctctggatcacccatagtcaatcgagaagggaagattgtaggactttacgggaatggcgtggtcactacatcaggaacatacgtttcagctatagcacaggctaaagctagtcaagagggacctctgcccgaaattgaagatgaagtctttcgtaaacgaaacctaaccatcatggatttacatccaggcagtggaaaaacacgtagatacctaccagcaatcgtgcgagaggcaataaaacgaaaacttagaaccctgatactggcaccaacgagggttgtagcaagtgaaatggcagaagcactaaaaggaatgccaattcgataccaaacgaccgccgtaaagtcagaacacacgggtaaggagatcgtagatcttatgtgtcacacaacttttactatgcggttgctttcacccgttcgagtaccaaactacaatatgattattatggatgaagcacacttcactgatcccagttcaatagcggctagagggtatataagtaccagagtggggatgggcgaagcggcagcaatatttatgacggcgacacccccgggatcagttgaagcatttccccaatcgaatgctgtaatacaagatgaagaaagagatatcccagagcgttcatggaatagcggatacgaatggattacagattttccaggaaaaacggtatggtttgtcccaagtataaaatctggaaatgatatagcaaattgcctaagaaagaacggtaaaagagtgatacagctgagcaggaaaacattcgatacagagtatcagaaaacgaagaacaatgactgggactacgtagttaccacagacattagtgaaatgggagcaaacttccgtgcggatagggtgatcgaccctaggcggtgtctgaaacctgttatactgaaagatgggcccgaacgcgtaatcttagccggtcctatgccggtcacggtcgcaagtgcggcacagagacgcggccgtataggcagaaatcataataaggaaggagaccagtatatctacatgggtcaaccccttaacaatgatgaagatcacgcacactggacagaagcaaaaatgctcttggacaatatcaatactcctgagggtatcataccagcgctgtttgagccagaacgcgagaaaagcgctgccatcgacggagaatatcgactacgaggtgaagcacggaagacatttgtagaattaatgaggaggggagatctacctgtatggctatcatataaagtcgcgtctgaaggattccaatacagtgatagacgctggtgtttcgacggcgaaaggaacaaccaagttttagaagaaaacatggacgtggaaatttggacgaaagaaggggaacgcaagaaacttagaccacgttggttggacgcacgaacttacagtgacccattggctttaagagagttcaaagagttcgctgccggaagacgatcagtgtcgggggacctgatacttgagataggaaagttaccccaacacctaacacagcgggcacaaaacgcactggataaccttgtaatgttgcataatagtgagcaaggtggaagggcatacagacacgcaatggaagaacttccggatacaatcgaaactctaatgcttctagctttgatcgcagtactgacgggaggagtcacattattctttttatcaggacgtggtcttggtaaaacgagtataggtttactctgtgtaatggccagttcagtgttactttggatggcaagtgttgaaccccactggatcgccgcatcaattatattagagttcttccttatggtcctacttattcccgaaccggatcggcaacgaacaccacaagataatcaattagcttatgttgttatagggttgctattcatgatacttacagtagccgcaaatgaaatgggattactagaaactactaagaaagacttaggaatagggcacgtggctgttgaaaatcaccatcatgcagctatgctcgatgttgatcttcaccctgcgagcgcgtggacgttatacgcagtagcaacaactattataacaccgatgatgagacacaccatagagaacacaactgccaatatatcactgacagcaattgcgaatcaggccgccatactcatgggacttgacaaaggctggccaattagcaaaatggatataggtgtacctttattggcactgggatgttattcacaggttaatcccttgacgctaacggcagcagtcttaatgctagttgcgcattatgcaataattggcccaggactgcaggcgaaagccactagagaggcgcagaaaagaactgcagcaggaatcatgaaaaatccgacagttgacggcatcgtagctatagatctcgatccagtcgtatacgatgcaaagttcgaaaaacaacttggtcaaatcatgttactaatattatgtacctctcaaatattactgatgcgtacaacctgggctttatgcgaaagtataaccctagcaaccggacctcttacaaccctttgggaaggtagtccaggaaaattttggaatacaacaatcgcggtgtcaatggccaacatttttcggggaagttacctagccggagcaggcctagcattttccctcatgaaatcactcggaggagggagacgaggaacaggcgcccaaggagaaacgctaggagaaaaatggaagcgacagttaaatcaattgagcaaaagcgaatttaatacatataaaagaagtgggataatggaagtagacagaagtgaagcaaaagaaggacttaagagaggcgagacaactaagcacgctgtatcacgtgggacagcaaaactgagatggtttgtcgaaaggaatcttgtaaaacctgaaggtaaagtcattgatcttggttgcggaagaggagggtggagctactattgcgcaggtctcaagaaagtaacagaggtaaaaggatatacgaaagggggcccgggccacgaagaaccaatacccatggcgacgtacggctggaatttagtgaagctacattctggaaaagacgttttctttatccctccggagaaatgtgacacacttttatgcgacatcggcgagtcctcgccgaacccaactattgaagaaggaagaacgttaagggtgttaaaaatggttgaaccatggctccgcggtaaccaattctgtataaaaattctaaacccttatatgccatccgtagttgaaactcttgaacaaatgcaaagaaaacatggtggtatgttggtccgaaacccactaagtcgaaactcaacgcacgaaatgtattgggtgagctgtggaacgggtaatatagtctcagcggttaacatgactagccgaatgttactcaatcggtttacaatggctcatagaaagccgacctatgagagagatgttgaccttggggcgggcacccgtcatgtcgccgtagagccggaagtagcaaatcttgacataattggacagagaatagaaaacataaagcatgaacacaaaagtacctggcattatgacgaagacaatccatacaaaacatgggcatatcatggtagttatgaagtgaaaccctctggctcagcaagttctatggtaaatggagtagtaaaactcctgacgaagccctgggacgtaataccaatggtcacacaaatagccatgactgatactacaccatttggtcagcaacgtgtatttaaagagaaggtagacacgcgtacaccgaaggctaaaagaggaaccgcacaaataatggaggtaactgccaagtggttatggggctttctatctcgcaataagaaacccagaatatgtacaagagaggagttcactagaaaagttaggtccaatgccgctattggcgcagtcttcgtagatgaaaatcaatggaatagtgcgaaagaagcagtcgaagatgaacggttttgggatttggtacatagagaaagggaactgcacaaacaaggaaaatgcgctacctgtgtatataacatgatgggaaaacgagagaagaaactaggggagtttggaaaagcaaaagggagtcgtgcgatctggtatatgtggttaggagcccgattcctagagttcgaggcattggggtttatgaacgaagatcactggtttagcagggaaaactcactctccggggtagaaggtgaaggattacacaaacttggctacatattacgagatataagtaaaataccgggcggtaatatgtatgcagatgataccgcaggatgggacactagaattacagaagacgacttacaaaacgaagctagaataacggatatcatggaaccagagcatgcacttcttgctaaatcaatattcaaattaacctaccaaaataaagtagtaagagtacaacgaccggcaaagaacggcactgtgatggatgtaatatcaagaagagaccaaaggggaagtggacaagtaggaacgtacggattgaatacatttaccaatatggaagctcaattaatcagacaaatggaatcagaaggtatttttagcccgtcggaattggaaacgccgaatctggcggaacgggtactagattggttagaaaaatacggagtagaaaggctcaaaaggatggctatttctggagacgattgtgtagttaaaccaattgatgatcgattcgcaacagctttaacggcattaaacgacatgggaaaagtcagaaaggatatacctcagtgggagccaagcaaaggttggaacgattggcaacaggtcccattttgcagccaccatttccatcaactcattatgaaagatggacgcgaaatagtggttccctgccgcaatcaagacgaactcgtgggcagagccagagtatctcagggagcaggttggtcattaagggaaacagcatgcctaggcaaatcttatgcgcagatgtggcaactaatgtattttcacagaagagatctgcgattggcagcgaatgcaatttgcagtgcggtacctgtcgattggataccaacatctcgcacgacctggagcatccacgctcaccaccaatggatgacaacagaggatatgctgagtgtctggaatagggtatggattgaagaaaatccgtggatggaagataaaacccatatctcttcgtggggagacgtcccgtacttaggtaaaagagaagaccaatggtgtgggtccttgattgggctcacagcccgggccacctgggccacaaatattcaggtagctattaatcaagtccgccgtttgatagggaacgaaaactatttagactacatgacatcgatgaagagatttaagaacgaaagtgatcccgaaggagcactttggtaa

SEQ ID NO: 21995 - RNA, 9879 nt, synthetic construct
  misc_feature 1..9879: note = derived and/or modified CDS sequence (opt6) from DENV-1__JQ045642__SS-prME
  source 1..9879: mol_type = other RNA
tcagtcacgatgttgctcatgttgatgccgactgctttagcatttcatttaacgacaagaggtggcgaaccccatatgatagtcagcaaacaagagcgaggcaaatcgctcttatttaaaacctcagcaggggtaaacatgtgtacgttgatagcaatggacctcggtgaattatgtgaagacacaatgacgtacaaatgccccagaataacggagacggagccagacgatgttgattgttggtgtaatgctacagacacgtgggtcacatatgggacctgtagccaaacgggcgaacaccgccgcgataaaagatctgtcgcattagcgcctcatgttgggctgggtctagaaacccgcacagaaacgtggatgtcatctgaaggggcttggaaacaaatacaacgtgtggaaacgtgggctctacggcatccgggatttacagtaatagcactatttctagcacacgcgatagggacaagtataacgcaaaaaggaataatctttatacttctaatgctggttacaccgagtatggccatgcgttgtgtagggataggatcacgggattttgtcgagggtctgtcaggagcaacatgggttgacgtggtactggagcatggatcatgtgtaactacaatggcaaaagataaacccacattagatattgaattattaaaaacagaagtgacaaatcctgccgtcctccggaaactgtgcattgaggcaaaaatctcaaacaccacaacggatagtaggtgtccaacacaaggcgaggcaactttagtggaagaacaagatgcaaattttgtgtgtcgtagaacgtttgtggacagaggctggggtaatggttgtggactcttcggcaaaggcagtcttattacgtgcgcaaaatttaaatgtgtcacaaaattagaaggaaaaatagttcagtgcgagaacttaaaatattccgtgatagtaacagtacacactggtgaccaacatcaagtagggaatgaatcaacagaacacggtaccaccgcaaccattactcctcaagctccaactacggaaatacaactaaccgactacggcgccctaactttagattgctctccgcggactggcctagatttcaatgagatggttttattaactatgaaagaaaaatcatggctagtacacaaacaatggtttctagatcttccactaccatggacatcaggcgcttctacatcacaggaaacttggaaccgacaggatctcttggtaactttcaaaacagcacacgctaagaaacaagaggtcgtagtactaggcagtcaagaaggagcaatgcacaccgctttaacgggcgctacagaaatacaaacttccgggacaactacaatatttgcaggacatctcaaatgtcgcttaaaaatggataaactaaccttaaaaggtatgtcatatgtgatgtgcaccggttcgttcaaattagagaaggaggtggcagaaacacaacatggaacggtgttagtgcaaatcaaatacgaaggaacggacgcaccatgtaagattccattcagcacgcaagatgaaaaaggggtgacacaaaacggtaggttgattacagcaaatccgattgtaacggacaaggaaaaacctgtcaacatagaggcggaaccaccattcggcgaaagctacatcgttatcggagccggggaaaaagcattaaaattaagctggtttaagaaaggaagttctatcggaaaaatgtttgaagcaaccgcaagaggtgctcgaagaatggctatacttggcgatactgcatgggattttggctctatcggtggtgtctttacaagcgtggggaaactggtacaccagatattcggaactgcctacggagtgctttttagtggagtatcttggacaatgaaaataggaataggagtattgttaacttggttggggcttaactccaggtctacttcactttcgatgacatgtatagctgtaggtctggtgactttatatcttggagtgatggtacaagcggattcaggatgtgttataaattggaaaggaagagaacttaaatgcgggagcggtatcttcgtaactaatgaagtacatacttggactgaacaatacaaatttcaggctgatagccccaaacggctatcagctgcgattggcaaagcctgggaagaaggcgtatgtggcatacgtagtgcaactaggttagaaaacataatgtggaaacagattagcaacgaactcaatcatattctacttgagaatgatatgaaatttactgtggtcgttggtgatgtcgcgggcatacttgcccaaggaaagaagatgatccggccgcaacctatggagtacaaatattcatggaaaagctggggaaaggccaaaataataggtgctgacgtccaaaacaccacattcattatagacggtccaaatacgccagagtgtccagatgaccaaagagcctggaacatatgggaagttgaagactacggttttggtatttttactactaatatttggctgaagctacgagactcttacacacaagtttgcgaccaccgtttaatgagtgcagctatcaaagactcaaaggcagtgcatgccgacatgggatactggatagagagtgaaaagaatgaaacttggaaattagctagagccagttttatagaagtaaaaacttgtatatggccaaaatcacatacgctatggtccaatggcgtactagagtccgagatgataatacccaagatttacgggggaccaataagtcaacacaattaccgaccaggctattttactcagactgcagggccatggcatttagggaaattagaattagatttcgacctttgtgaaggcacgacagtagttgttgatgaacactgtggaaatagagggccatctttacgaaccacgaccgtcacgggtaaaatcatacatgaatggtgttgcaggtcctgtacactcccacctctaaggttcagaggagaggatggttgttggtacggcatggaaattagacctgtaaaagaaaaagaagaaaatcttgttaagagcatggtctcagccgggtctggggaggttgactctttcagtctaggattattatgtatttccatcatgattgaagaagtgatgcgctctcggtggtcgagaaaaatgttaatgacaggcaccctagccgtattctttctcttaattatgggtcaacttacgtggaatgatttaataaggctatgtattatggtgggtgctaacgcaagtgaccgtatgggtatgggaacaacatatttggcactcatggctacgtttaagatgaggcccatgttcgcagtaggattattgttccgaaggttgacatctcgagaggtattacttttaacaatcggattaagcctagtagccagtgtagaattaccaaatagcctagaagagttaggagatggcttagcgatgggaatcatgatactaaaacttcttacagattttcagtctcatcaattatgggcaacattattaagcctaacttttataaaaacgacattctcactacactacgcgtggaaaaccatggcgatggtattaagcatagtgagtcttttcccattatgcctgtcgacaaccagccagaaaactacctggttaccagtcctcttaggatccctgggctgcaaacccttaacaatgtttctaatcgccgaaaataaaatatgggggagaagatcttggccacttaatgaaggtattatggcggtaggaatagtttctatacttttgagttcgctcctgaagaacgatgtaccactagctggaccactaatcgcaggaggaatgttaattgcatgttacgtaatttcaggaagttcagcagatttatctttagaaaaagcagcagaagtaagctgggaagaagaggctgagcattcaggcgcaagtcacaatattttagttgaggtgcaagatgatggaacaatgaaaataaaagacgaagagagagatgacacgctaaccattctccttaaagcaacgttattagccgtctcaggagtttaccctttaagtataccggcgacattatttgtctggtacttctggcagaaaaagaaacaaagatcaggagttttgtgggacactccctcaccacccgaggtggggcgcgcagtcttagatgatggcatctaccgaataatgcaacgaggactacttggacgtagtcaagtaggtgtgggcgtgtttcaagaaaacgtgttccacaccatgtggcatgtaactcgtggggccgttctaatgtatcaaggaaaacgcttagaaccatcgtgggcctcagtcaagaaagaccttattagttacggaggtggttggagactccagggatcatggaataccggggaagaagttcaagttattgcggtagaaccagggaaaaacccaaagaatgtccagaccgcgccggggactttcaaaacacctgaaggagaagtaggggctattgcgttagattttaagcccggaacatcaggttctccaatagtaaacagagaaggtaagatagtagggttatacggcaatggagtagttacaacctctggcacctacgtctcagcaatcgcacaggcaaaagccagccaagaaggtcccttaccagaaatagaggacgaagttttcagaaagagaaatttgactataatggacttgcacccaggttcgggcaaaacaagaagatatctacccgcaatagtaagggaagcgattaaaagaaaactaagaactcttatcctagccccgacacgggtagttgcaagcgaaatggctgaagcgttaaaaggaatgccaattaggtatcagacaacggcagtaaaatcggagcatacgggaaaagaaatagtggatctaatgtgccacgctaccttcactatgaggctgctcagcccggtcagagtgcctaactataatatgattattatggatgaagctcactttactgatccttcgtcaatcgccgcacgaggatatatatcaactagagtgggaatgggggaagctgccgcgatctttatgactgcaacacctccaggttcggttgaggcatttcctcaatccaacgcggtaatacaggatgaagaacgggatattccagaacgatcctggaacagtggctatgaatggataactgattttccaggaaaaacagtgtggtttgttccaagcataaaatctggtaatgatattgcaaactgcctccgaaagaatggaaaacgtgtaatccaattgtccaggaagacatttgacacggaataccagaaaactaagaataatgattgggattatgtggtaacgactgatatttcagaaatgggtgccaactttcgagctgatcgcgtaattgatcctagaagatgtctcaagcctgtaatattaaaagatggtcctgaaagagttatacttgcaggaccaatgccagtaactgtagcttctgcggcacaacgaagaggtagaataggtagaaaccacaataaagaaggagaccagtacatatacatgggtcagccgctaaataatgacgaggatcatgcacactggactgaagcaaaaatgttactagataacataaatacaccggaggggataatcccggccttatttgagcccgaacgagagaaaagtgcagctatagacggtgaataccgattgcgaggagaagctcgaaagacatttgtagaattaatgagaagaggagacctcccagtttggctttcgtataaagttgcaagcgaagggtttcaatacagtgaccgacggtggtgctttgatggcgagcgtaacaatcaagtgttggaggaaaacatggatgtcgaaatttggacaaaggaaggagaaaggaagaaactcagaccacgatggcttgacgcgcgtacgtatagcgatccattagcgttacgggaatttaaggagttcgccgcaggtagacggtcagtatctggcgacctcatattagaaattggaaaactaccccaacatctaacgcaaagagcacaaaatgctttagataacttagtaatgttgcacaacagtgaacagggagggagagcgtacaggcatgcgatggaggaactgccagacactatagaaacattgatgctactagcattaatcgcggtattgaccgggggcgtcaccttattcttcctatcaggacgtgggctaggcaagacgtcaataggattactgtgtgttatggccagttcggtgttactgtggatggcatccgtggaaccccattggatcgcagcaagtataatcttggaatttttcctgatggtattattaattccagaacccgataggcaacggacacctcaggataatcaattggcatatgttgtaatcggcctgctatttatgatactaacagttgccgcaaacgaaatgggactattggagacgactaagaaagacttaggaatcgggcatgtagccgtagaaaaccatcaccatgctgctatgctagacgtagatttacatcctgcatcagcctggacactgtatgctgtggcaactactattattacacccatgatgagacatacaatagaaaacactacagcaaatataagtcttaccgccatcgcgaaccaagcagctatactaatgggattagataaagggtggccgataagtaaaatggacattggagtccctctacttgcattaggctgctatagtcaagtaaatccgctaacactaacagccgcggttctaatgttggtagctcattacgcgataataggaccaggcttacaagcaaaggctacgagagaagcacagaaaagaacagccgcaggaatcatgaaaaatcctactgtggatggaatcgtagccattgatctagatcctgttgtctatgatgctaaattcgagaaacaattaggacagataatgttactaattctttgtacaagtcaaatattgctaatgagaacgacatgggctttatgtgaaagcatcacactagcaacaggcccactaacaactctatgggagggcagtccaggaaaattctggaatacaacaatcgcagtaagcatggcaaatatttttcgaggaagttatctagcaggagctggattagcctttagtcttatgaagtctcttggagggggacggagaggtacaggcgcacagggagaaaccttgggggaaaagtggaaacgacaattgaaccaattgtcaaaatcagaatttaatacatataaaagaagtggtattatggaagtagatagatcggaagcgaaagaaggattaaaacgcggagaaacaaccaaacacgcggtgagccgggggactgccaaattacggtggtttgtggaaagaaatttggtcaaacctgaaggcaaagtaatagatttaggttgcggtcgaggtggctggtcatattactgcgcaggactaaagaaggtcacagaagtaaaaggatacacgaagggaggtccaggacatgaagaacccatcccaatggctacgtacggctggaatcttgtaaagctccattctggaaaagatgtattctttatacctccagagaaatgtgatacattgctatgtgacataggcgaatcttctcctaatccaacaatcgaagaaggcaggacactacgcgtgctaaagatggtagagccatggttaagaggcaaccaattttgcataaaaatactaaacccgtacatgccgagtgtagtcgagacattagagcagatgcaacgaaaacacggaggtatgctcgttcggaacccccttagcaggaactctacacacgagatgtattgggtgtcgtgcggcactggaaatatagtgtcagcggtcaatatgacatcccgcatgctcttaaacagatttacgatggcccatagaaagccaacatatgaaagagatgtagatttaggtgcaggcacacgacacgtagcagttgaaccagaagttgcgaacctagacataataggacaacggatagaaaacataaaacatgagcataaaagcacctggcattatgatgaggacaatccatacaaaacttgggcgtatcacggctcgtacgaggttaagccatcagggagtgcgagttcgatggtaaacggagttgtgaagttgctcacaaaaccctgggacgtaataccaatggtaacgcagatagccatgacggatacgactccgtttggtcaacaaagggtatttaaagagaaagtcgacactcgcacacctaaagcaaaacggggcactgcacaaataatggaagtgacggcgaaatggctatggggttttctaagcagaaacaagaaaccaaggatttgtacacgcgaagagttcactcgaaaagtacgatcaaacgcggcaattggagcagtctttgttgatgaaaaccaatggaatagtgcaaaggaagccgttgaggatgaaagattttgggatttggtacacagagaacgagaactacataagcaaggaaagtgtgcaacatgtgtttacaacatgatgggaaaaagagagaagaaacttggtgagtttggcaaagccaaaggctcaagggctatatggtacatgtggttaggggcaagatttttagaatttgaggctctaggattcatgaacgaagaccactggttttctagagagaactcgctatcaggagttgaaggtgaaggtctgcacaaactaggttacatcttacgtgatatcagcaaaataccaggtggaaacatgtatgcggatgacacagctggctgggatactcgaataaccgaagatgatttacagaatgaagctagaatcacagacataatggaacctgaacacgcactattggcaaaaagcatttttaagttaacgtatcaaaataaagtggtaagggtccagaggcctgcgaaaaatggaactgtgatggatgtaattagccgtcgtgatcaacgaggatcaggccaagttggaacgtatggactgaatacgttcacgaacatggaagcacagttaatacgtcagatggaatccgagggtatattcagcccatctgagttagaaacaccgaacttagctgagagagtactagattggctagaaaaatacggtgtagaacggctaaaacgaatggcgattagtggagatgattgtgttgttaaacctatagatgatagatttgccactgcactgactgcacttaatgatatgggcaaagttagaaaagatataccacaatgggaaccatcaaaaggttggaacgactggcaacaagtgccgttttgctcacatcatttccatcagctaataatgaaagatggtagagaaatagtggtcccctgtcgtaaccaagacgagcttgtggggcgggctcgagtaagtcagggagccggttggagcctacgtgagacagcttgtttaggaaagagttatgctcagatgtggcaactcatgtacttccacaggcgagatttaagactagccgccaacgcgatatgttctgctgtaccagtagattggatccccacttctcgaactacatggtcgatacacgcacatcatcaatggatgacaacagaggatatgttgtcagtctggaatagagtttggattgaggaaaatccatggatggaggacaaaactcatatctcatcctggggagacgtaccttacttgggtaaaagagaagaccaatggtgcggctctcttataggcttaacagctagagcaacctgggcaacaaacatccaagtagcaattaatcaagtgagaagattaataggaaatgaaaactatttagattacatgacttcgatgaaacgtttcaagaacgaatccgatcccgagggcgccttgtggtaa

SEQ ID NO: 21996 - RNA, 9879 nt, synthetic construct
  misc_feature 1..9879: note = derived and/or modified CDS sequence (opt6) from DENV-1__JQ045644__SS-prME
  source 1..9879: mol_type = other RNA
tcagttactatgcttttaatgctaatgcctacggcattagcatttcatcttaccacgcgtgggggtgaaccgcatatgattgtatcaaaacaagaaaggggaaaatctctattgtttaaaacttcagctggtgtaaatatgtgtactttaatagcaatggatttgggagaactatgtgaagataccatgacttacaaatgtccgcgaataacagaaacagaacccgacgacgtagactgttggtgcaatgcaacggacacatgggtaacctatggaacttgttctcaaacaggggaacatagacgagataaaagatcggtcgcactcgcaccccacgtaggattgggacttgaaaccaggactgaaacctggatgtcatcggaaggtgcgtggaaacaaattcaaagggtggaaacatgggcactaaggcacccaggctttacagtaattgccctatttcttgcccacgcgatcggaacaagcattacccaaaaaggtataatatttatcctattgatgctagtaacgccgtcaatggcaatgagatgcgttggtataggatccagagattttgttgagggtttatcaggtgctacgtgggtagatgttgttttagaacatggcagctgcgtaactactatggcaaaagacaaaccaacattagatattgaactgcttaaaactgaagtcaccaatcccgcggtacttagaaaattatgtatcgaagcaaaaatcagcaataccacgactgacagtcgatgtccaactcaaggagaagctacccttgttgaggaacaggacgctaatttcgtttgtcgtcgaacttttgtagatagaggatggggaaatggatgtggtcttttcggtaaaggttcacttattacatgtgcaaaatttaaatgtgttacaaaactagaaggtaaaatcgtgcaatatgaaaatttaaaatattccgtcatagtgacagtacatacgggagaccagcatcaagtaggtaatgaatccacagaacatggtacaactgcaacaataacaccacaagctcctaccacagagattcaacttacagactacggtgctttaacattggactgcagtccgagaacaggacttgattttaatgaaatggtgctgctcactatgaaagagaaaagttggttagtccacaaacagtggttcttggatttaccattaccatggacatccggtgcaagcacttcacaagaaacatggaatagacaggatctactcgttacattcaaaaccgctcatgccaagaaacaagaagtagtggtacttgggagtcaagaaggcgcaatgcatacggccctcactggggcgacagaaatccaaacgtcaggcactacaacgattttcgctggacatttaaaatgtagattgaaaatggataaacttactttgaaaggaatgagctacgtgatgtgcacgggatcgtttaaattagaaaaagaagtagcagaaacgcaacatggtacggtactggtgcagattaagtatgaaggaactgacgcgccttgtaagattccctttagtacccaggatgaaaaaggcgtaactcaaaatggtcgactcataaccgcgaatcctattgtcacagataaagaaaaacccgtaaacattgaagctgaaccaccctttggggaatcatatatagtgataggagccggtgaaaaggccctcaaactatcatggttcaagaaaggttcaagtattggaaaaatgtttgaagctacagccagaggagctagaagaatggccattttaggagacacagcatgggattttggatctatcggaggggtattcacaagtgttggaaaattagtccatcaaatatttggtacggcatacggtgtactattttcaggtgtatcgtggacaatgaaaattggcatcggagtcttgttaacgtggcttggattaaattctagatcaacatccttaagcatgacttgcattgcagtcggcctagtgacactctatttaggtgttatggtgcaagcagattcggggtgtgtcatcaactggaagggtcgagaactaaaatgtgggtccggaatctttgttactaacgaagtccacacctggacggaacaatacaaatttcaagcggattctccaaaacgacttagcgcggcaatcggaaaggcttgggaagaaggtgtgtgtggcataagatcagcaacaagattagaaaatataatgtggaaacagatatcaaatgagctcaatcacattttgttagaaaatgacatgaaattcactgtcgttgtaggagatgtcgccggtatactcgctcaagggaagaaaatgataagaccgcaaccaatggagtacaaatatagttggaaatcttggggaaaagcgaaaatcataggagctgacgttcaaaacacgacatttatcatcgacggcccgaacacaccagaatgtccagacgaccagagagcttggaatatttgggaagtcgaagactacggctttgggatattcactacaaacatttggctaaagttgagagacagttatacacaggtatgtgatcaccgactgatgtccgctgcaataaaagactcaaaagcagtacacgccgacatgggatattggatagagtcagaaaagaatgaaacttggaaattggccagagcgtcctttattgaagttaaaacttgcatctggcccaaaagtcatacattatggtccaacggcgtattggaatctgaaatgattatacctaagatatatggtggaccaatttctcaacataattatcgaccaggctatttcacacaaacggcaggaccatggcatctcgggaaattagaattagacttcgatttatgtgaaggtacgactgtagtggttgatgaacactgtggcaatagaggtccatctttgcgaacaaccactgttacgggaaagataattcatgaatggtgctgtagatcgtgtacgctgccaccactcaggttcagaggagaggacggctgttggtatggaatggaaatacgaccagtaaaagagaaagaggaaaacctggtaaaatcaatggtatccgctgggagcggagaggtagacagtttttcactcggactactttgtatatcaattatgatcgaagaggtaatgcgaagtaggtggtcacgaaaaatgctgatgacaggaaccctcgcagtattctttcttctaataatggggcaattaacatggaacgacctcatacgactgtgcattatggtcggggctaatgcttcagataggatgggaatgggaaccacttacctcgccctaatggcagctttcaaaatgagaccaatgtttgcagttggattgcttttcagacgactgacatcacgcgaggtcctgctactaacaattggattaagcctagtggcctcggttgaactacctaactcactcgaagaacttggagatggacttgcaatgggcattatgatactgaaattattaacagactttcaaagtcatcaactctgggcgactctgttaagtttaacatttattaaaaccacattcagtctccactatgcatggaaaacaatggcgatggttctttctattgtatcattattcccactatgtttgtcaacaacttcacaaaagacaacatggctacccgtattattaggaagccttggttgcaagccattgactatgttcttaatagcagagaacaaaatttggggacgtagatcttggcctttaaatgaaggcataatggccgtgggaatagtaagtattctactcagctccttactcaaaaatgatgtacctttagccggaccactaatagctggtggcatgctgatcgcatgttatgtaataagcggatcctccgcagatttgtctctggagaaagcggctgaagtgtcttgggaagaagaggccgaacacagtggtgcaagccacaacatacttgtagaagtccaagatgatgggacgatgaaaataaaagacgaagaacgagacgacacgttaacgattttactaaaagctactctcttagcggtatcaggcgtataccccctatcaattccagctacattattcgtatggtatttttggcagaagaagaaacaaagatcaggggtgctctgggatactccttcaccacctgaagtggaaagagccgtattagatgacggtatatatcggatcatgcagaggggtctactggggaggtcacaagtaggagttggcgtattccaagagaatgtgtttcataccatgtggcacgttacacgaggtgcagttttgatgtatcagggtaaacgactggaaccatcatgggctagtgtcaagaaagacctaatatcctacggaggcggatggcgtctacaaggatcatggaatacgggcgaagaagtccaagtgatagcggtggaacccggcaaaaatcccaaaaatgtacaaacggcacctggaacctttaaaacgcccgaaggagaggtgggtgctatcgctctagacttcaagcccggaacgagtggaagtccaatcgttaacagggaaggtaagatagtcggactctatggaaacggtgttgtaactacatcaggtacatatgtgtcggctatagctcaagcaaaggcgtcacaagaagggccactccctgagatagaggatgaggtattcaggaaacgcaacctgaccattatggatcttcatccgggctccgggaaaaccagacgatatttacctgctatcgtcagagaggctattaaacgaaaactgcgaactttaatattggccccaactagagtagtggcgtcagagatggcagaggctttaaaaggtatgccaatcagatatcagacaacagcagtaaaaagcgaacatactggaaaagaaatagtagacttaatgtgtcacgcaaccttcactatgcgactgttatcacctgtgcgagtccctaactacaacatgattataatggacgaagcacactttacagatccatcaagtatagctgcccgaggttatatttcaacaagggttggaatgggagaggcagcagcaatttttatgacagctacaccacccggaagtgttgaggccttccctcaaagcaatgcagtaatacaagacgaagaacgtgatatacctgagaggagctggaactcaggttatgaatggataactgacttccctggaaaaacagtttggtttgtacccagtattaaatccggaaatgacatagctaattgccttaggaaaaatggaaaaagagttatccaattatcaaggaaaacgtttgatacagaatatcagaaaacgaaaaataatgactgggattatgtcgtgactactgacatctcggaaatgggtgcaaatttcagagcagatcgtgtcatcgatcccagacgatgcttgaaacctgtcatattgaaagatggacctgaacgcgtaatcttagcaggaccaatgccagtaacagtcgcatcagctgcgcaacgtaggggccgtatcggccgtaatcataacaaagaaggagatcaatatatttacatgggtcaaccactaaacaatgacgaagaccatgctcactggacagaggccaaaatgttactggacaatattaatactccagaagggattataccggctttgttcgagccggaaagagagaaatctgcggccatagacggggagtaccgcctccggggagaggctagaaaaacatttgttgagcttatgcgcaggggagaccttccagtctggttgagctataaggttgcttcagaggggttccaatatagtgatagacggtggtgtttcgacggtgaacgcaataaccaagtattagaagaaaatatggatgtcgaaatatggaccaaggaaggagaaagaaagaaactaagaccgcgttggctagatgctagaacttactctgaccccctggcgttacgggaatttaaagagttcgcagcaggaaggcgtagtgtaagtggagacttgatactggagatcggaaagttaccacaacatcttacgcagagagctcaaaatgcacttgacaatttagtaatgctacataatagtgaacagggaggccgtgcatatcgacacgctatggaagaactcccagatacgatagaaacattaatgttgttggcactcatagcggtcctgacaggaggggttaccttattcttcctatccggtcgaggcttaggaaaaacatcaatagggctactttgtgtcatggcaagctccgttctgttatggatggcttcggtggaacctcattggatcgctgcttcaatcatattggagttctttcttatggttctattgataccggaaccagacaggcagagaacccctcaagataaccaattagcgtatgtagtcataggtttactatttatgatattgacagtcgcggcaaatgaaatgggcctcttggagacaaccaaaaaggatctagggattggacacgttgctgtggagaatcatcaccatgcagctatgctcgatgtggacttacatcctgcgagcgcttggacactttatgctgttgcgacaacaataattacacctatgatgaggcatactatagaaaataccacagctaatatttcattaactgcgattgccaatcaagcggctatacttatggggcttgacaaaggatggcctattagcaagatggatatcggggtacctcttctggcgctaggttgttatagccaagtaaacccactgaccctaactgccgctgtacttatgctagttgcacactacgcgattattggtccaggactacaagcaaaagcaacacgcgaggcacagaaaagaacagcagcaggtattatgaaaaacccaacagtagatggcatcgtggccatcgaccttgacccggttgtctatgacgctaaatttgaaaaacaactaggacagataatgttattaatactatgtacaagccagatattactaatgagaaccacatgggcattatgcgagagcataacgttagcgacagggccattaacgacactctgggaagggagtcctggaaaattttggaacacaactattgctgtgagtatggctaatatattccgtggatcatatctggctggggcgggactagccttttctcttatgaaatcactaggtggcggaagacggggcactggtgcacaaggcgaaactttaggagaaaagtggaaaagacaattaaaccaactatcaaaatcagaatttaatacctataaaaggtccgggataatggaggtggatagaagcgaggctaaagaggggttgaaaaggggagaaaccacaaaacacgcggtatcacgtggcacggcaaagttgcgatggtttgttgaacgtaatttagtcaaaccagagggaaaagtaattgatctaggatgtgggcgcggaggttggtcatactattgcgcgggtctaaagaaagtgacagaggtaaaagggtacaccaaagggggaccaggtcacgaagaaccaattcctatggcaacttatggatggaacttagtgaaacttcacagcggaaaagacgtgttctttataccacccgaaaaatgtgatacgctgctctgtgacattggagaatcttcacccaacccgactattgaagaaggtaggacactacgagtgttaaaaatggtagaaccatggctgaggggtaatcaattttgcataaagatactcaacccatacatgccttcagtggttgaaactttggaacaaatgcagagaaaacacggaggcatgctagtgcggaatccgttatcccgtaactctactcatgaaatgtactgggtgagctgcgggacggggaacattgtatcagcagtaaatatgacttcccgaatgctattaaatagattcacaatggcacataggaaacctacttatgaacgtgacgttgatcttggggcgggcacccggcatgtggcggtagaaccagaagtagcgaatctagatattattgggcagcgcatcgaaaatataaaacacgaacataaatctacgtggcattatgacgaagacaacccctataagacatgggcttatcacgggtcatatgaggtaaaaccttccggttctgcaagcagtatggttaatggagtggtaaagctcctcaccaaaccatgggatgtaatacctatggtaacccaaatcgctatgactgacacaactccatttggacaacaaagagttttcaaggagaaagtagacactagaacgcctaaagctaaaaggggaacggcacaaatcatggaagtaaccgccaaatggttatggggattcctcagtcgaaacaagaaaccacgcatatgcacacgagaggaatttacacgaaaagtaaggtctaacgcggctatcggggcagtctttgtagatgaaaaccaatggaactcggcaaaagaagccgttgaagatgaacgtttctgggatctagtacatagagagagagaactacacaaacagggaaaatgcgcgacgtgtgtgtataatatgatgggaaaaagagagaagaaactcggagaatttgggaaagcaaaaggttcacgggccatatggtacatgtggttgggcgcaagattccttgagttcgaggctttgggatttatgaacgaggatcattggttctcgagagaaaatagcctttccggggtagaaggagaaggattacacaagttgggatacattcttagagacatctcaaaaattccgggcggtaacatgtatgcagacgatacagcgggctgggacactagaatcacagaagacgatcttcaaaatgaagcaaggatcaccgacattatggaacctgaacacgctctattagctcgtagtatctttaaactgacataccaaaataaagttgttcgtgtacaacgacccgctaaaaacggtactgtaatggacgtaattagtagaagagaccaaaggggttcaggtcaagtaggtacatatggacttaacacttttactaatatggaagcccagttaattagacagatggaaagcgagggaatcttctctccttctgagttagagactccaaaccttgcggaacgagttttggattggttggaaaaatatggagtcgagcggttaaaacgaatggctatctccggagatgactgcgtcgttaagccaattgatgacaggttcgcaactgccttaacagcattaaatgacatgggcaaggtccgaaaagacataccacaatgggaaccttctaaagggtggaatgattggcagcaagtgccattctgtagtcaccacttccaccaattgatcatgaaagatggtagggaaatcgtcgttccatgtcgcaatcaagatgagctagtaggacgagctagggtaagtcaaggtgcagggtggagtttgagggaaacagcatgtttagggaaaagctacgcgcagatgtggcaattaatgtacttccaccgaagagatctacgactagccgcaaatgctatttgcagtgccgtgcctgtagactggataccgacaagtcgaactacttggagtatacatgcgcatcatcaatggatgacgacagaagacatgttatcagtctggaaccgcgtctggatagaagaaaatccttggatggaagataagacacacattagttcatggggagatgtaccgtatctaggcaaaagagaagaccaatggtgcggttcccttataggattaacggctcgagcaacatgggcaacaaacatacaagtcgctataaatcaagttaggcgactaatagggaatgaaaattatttagattacatgacttcaatgaaacgttttaagaatgagtcagatccggaaggagctttgtggtaa

SEQ ID NO: 21997 - RNA, 9879 nt, synthetic construct
  misc_feature 1..9879: note = derived and/or modified CDS sequence (opt6) from DENV-1__JQ045648__SS-prME
  source 1..9879: mol_type = other RNA
tctgtgactatgctattaatgcttatgcccactgcattggcatttcatttaactactagaggcggcgaaccgcacatgatcgtctctaaacaagaaaggggcaaatcactattgtttaaaacaagtgcaggggtaaatatgtgtactttaatagcaatggacctaggtgaactatgtgaagatactatgacatataaatgtccaagaataacagaaactgaacccgatgatgtcgattgttggtgcaatgctacagacacgtgggtgacttatgggacttgttcccaaacaggagaacaccggagggataaaagatctgtagccctagccccacacgtgggactgggattggagacgcgcacagaaacatggatgagttcggaaggcgcttggaaacaaatccagcgagtagagacatgggctttacgacatccaggatttaccgttatagcattatttcttgcgcacgcaataggcacaagtataacgcaaaaaggaataatttttattttactcatgctagtgacccctagtatggcaatgagatgcgtaggtatcggtagtagagacttcgttgaaggattaagcggagcaacttgggtggacgttgtcctggaacatggaagttgtgtaacaacgatggctaaagataaaccaacattagacatagaacttctgaaaactgaggtcacaaatccagctgttttacggaaactatgcatagaggctaaaataagtaatacgaccacagattctcgatgtcctacacaaggagaagctacacttgtggaggagcaggacgcaaatttcgtatgtaggagaacttttgtggacagaggatggggtaatggatgcgggttgtttggtaaaggatcgctgataacgtgtgcgaaattcaaatgcgttactaaacttgaaggtaaaatagtacaatatgaaaatttaaaatatagtgttatagtcacagttcacaccggagaccaacatcaagtggggaatgagtcaactgagcatggtacaaccgctacaataactcctcaggcccctaccaccgaaatacaactaacagattacggcgcattaactttagactgctcaccccggaccgggttggatttcaacgaaatggtcctccttacaatgaaagaaaaatcatggttagttcacaaacaatggttcctagatttaccactcccatggaccagcggagcaagcacgagtcaagagacttggaaccgtcaagatctcttagtaaccttcaaaacagctcatgcgaagaaacaagaagtagtagtattgggaagtcaagaaggggccatgcacacagcacttacaggggccacagagattcaaacatcaggcacaaccacaattttcgcaggacatctaaaatgtcggttaaaaatggataaattaacccttaaaggcatgtcttatgtcatgtgtacaggatcatttaaattggagaaggaacttgctgaaactcaacatggaacagtattggttcaaatcaagtacgagggaacggacgcaccgtgcaaaatcccatttagcacccaagatgagaaaggagtcgctcaaaacggaagactgataactgcaaatccaatagtaactgacaaagaaaaacctgtgaatatagaagcagaaccacccttcggtgaaagctatatagtgataggagccggggagaaagccctaaaactctcatggtttaagaaaggttcgtccattgggaagatgtttgaggcgacagcacgtggtgcgcgtcgaatggcaattctaggggatacagcttgggactttggttccattggaggagtattcacgagtgttgggaagctagtccaccaaatctttggtacggcatatggagtactattttctggtgtatcctggacaatgaaaatagggataggagtgcttttaacttggttaggactcaattctagatcgacttctctttcaatgacctgtatcgcggtaggattagttactttatatttgggcgtaatggtacaggctgattcgggctgcgttattaactggaaaggacgagaactcaaatgcggatctgggatattcgtaaccaatgaggttcacacatggactgaacaatataagtttcaagcagattcacctaagaggttatctgctgcaatcgggaaagcctgggaggaaggagtttgtggtatcagaagtgcaacacgacttgagaatatcatgtggaaacaaatatctaatgaattgaatcacatactattggaaaatgatatgaagttcacagtagtcgtaggcgacgttgctggaatcttggcgcaaggtaagaaaatgatacgacctcaaccaatggaatacaaatattcctggaaatcatggggtaaagctaaaataattggggctgatgtgcaaaacactacctttatcattgacggaccaaatacgcccgaatgccctgacgatcaacgcgcttggaatatttgggaagtcgaggattacggtttcggaatatttacaacaaacatttggctaaaattaagggactcctatacacaagtttgtgatcatcgattgatgagtgcagcaataaaagattcaaaagctgttcatgctgatatgggatattggatagaatccgagaaaaatgagacgtggaaactggccagagccagctttattgaagtaaaaacatgcatttggccaaaaagccatacactatggagtaatggggttttggagtcagaaatgattatcccgaaaatctacggcggaccgatatctcaacataattaccgcccgggttacttcactcaaacggcaggtccatggcatctaggaaaactcgagcttgactttgatttatgcgaaggaacaaccgtagttgttgatgagcattgtggcaatcgtggaccctccctaagaactacgactgttacaggaaaaatcatacatgaatggtgctgcagatcttgcacactaccaccattacgatttcgaggtgaagacggatgttggtatggtatggaaatccgacctgtaaaagaaaaagaagaaaatttagtgaaatccatggtatccgctgggtctggagaggtcgactcatttagtctagggctcctatgtataagtatcatgattgaagaagtaatgagaagtcgttggagcagaaaaatgctaatgacaggaacgttagcagtcttctttttattgataatgggacaattaacctggaatgacttaatacgactttgtatcatggttggggcgaacgcttcggacagaatggggatgggaactacataccttgcattaatggcaacatttaaaatgcgcccaatgtttgcagtgggactcttatttagaaggttgacgagtcgagaagttctactgctcacaatcggtttatctcttgttgcaagtgttgaattacctaattcactggaagaattgggtgatggtcttgctatgggaattatgattttaaaactactaacagactttcaatcccatcaactatgggctactcttctatccctgacattcatcaaaacgaccctgtcattacactacgcatggaagacgatggcaatggtattatcaattgtttcactatttccactttgcttgtctaccacaagtcagaaaactacttggctcccagtcctgttaggaagtttaggatgcaaacctctgacaatgtttctaatcgcagagaataagatatgggggaggcgaagctggccactaaacgaagggatcatggcggttggtattgtctccatcctactcagttccttactcaaaaacgatgtacccctcgctggcccactcatcgccggaggtatgctgatagcatgttatgtaattagtggatcttcagctgatttgagtcttgaaaaagccgcagaagtcagctgggaagaagaggccgagcatagcggagccagtcacaatatactggttgaagtacaagacgacggaacaatgaagattaaagatgaagaaagagacgacacactaaccattctgttgaaagctacgttactcgcagtcagtggagtctatccattaagtatacctgctacgctatttgtttggtacttttggcaaaagaagaaacaaagaagcggggttctatgggacactccaagtcctccagaagtcgaaagagctgttttggacgatggaatttatagaataatgcaaagaggactcttaggtcgaagtcaagtgggagtaggagtcttccaagaaaatgtatttcacacaatgtggcacgtaaccagaggagccgtcctaatgtaccaaggaaaaagactagagccctcatgggcatcagtgaagaaagatctaataagttatggaggtggctggagactacaaggaagctggaatacaggagaggaagttcaggtcattgcagttgaaccgggcaaaaacccgaaaaatgtacaaactgctccaggaacgtttaaaacaccagagggtgaagttggagcaatagccttagactttaaaccaggaacttcaggatcccctattgtcaatagagaaggaaaaatcgtaggcctttatggaaacggggtagtgacgacaagtggcacatatgtttccgcaattgctcaagccaaagctagccaggaggggccgctgccggagatagaagacgaagtattcagaaaaagaaacctcaccatcatggacttacatcccggttctggtaaaacaagacgatacctgcctgctattgtacgagaagctattaagcgaaagttaagaactcttatactagccccgacacgagtagtcgcatcggagatggcggaggctctgaaaggcatgcctatccgctatcaaactacagccgtaaagtcagaacataccggtaaagaaattgtcgacttaatgtgccataccacattcacaatgcgtttactaagccctgtgcgtgtcccgaactataacatgattatcatggatgaggcccactttacagatccatcatccatagctgctcggggctacatctcaacacgcgtcggaatgggagaggcagcagcaatatttatgactgcgactccgcctggtagtgtcgaggcatttccacaatctaatgccgtaatccaagacgaggaacgagatatccccgaacgatcttggaactcaggctacgaatggatcacagatttcccaggaaaaacagtttggtttgtaccaagcataaagtcaggaaacgatattgcgaactgtctaagaaagaatggcaaacgtgtcattcaattatctagaaagacatttgacacagagtaccagaaaaccaaaaataatgactgggactatgttgttaccaccgacattagtgaaatgggagcgaacttccgggcagatagggttattgatccacgtaggtgtctaaaacccgtgattctaaaagatggaccggaacgggtcatcttagcaggaccaatgcctgttaccgtggcatccgcagcccaacgtcggggtcgtataggcagaaatcacaataaggaaggggaccagtacatatatatgggccagcctcttaataatgatgaagaccatgcacactggacagaagccaaaatgcttttagataatataaacacacctgaaggtatcattcccgcacttttcgaaccagaaagggaaaagtctgcggcgatagacggggaatacaggttacggggagaagcaaggaaaacctttgtagaattaatgaggcgcggggacttacctgtatggctttcttacaaggtagcatcggagggttttcaatacagcgacaggcgatggtgctttgatggtgaaagaaataatcaagtactagaggagaacatggacgtagaaatttggaccaaagagggagaacgtaagaaattaaggccaaggtggttagacgcacgaacgtattcggacccattagcactaagagaatttaaagaatttgcagcagggcgacgaagtgtttcaggagatttaatactcgagattgggaagttaccgcagcatttaacacaacgtgcccaaaacgccctagacaatctcgtaatgctccataacagcgaacaaggtggacgcgcttacaggcatgcgatggaagaattaccagatacaattgaaaccttaatgctgctagctctgattgccgtgctgactgggggtgtaaccttgttcttcctctccggtcgaggactcgggaaaacctcgataggtttactttgtgtaatggccagtagtgtacttctatggatggcctctgtagaacctcattggatcgcggcgtccataatattagagttctttctaatggtattactaataccagaaccggatcgtcagaggacaccccaagataatcaacttgcctatgtagtcattggattactctttatgatccttacagtagcagccaatgaaatgggtttacttgaaactactaagaaagacctgggcataggccatgtagcagtagaaaaccaccaccacgccgcgatgttagacgtggacttacatcctgccagtgcatggacattatacgcggttgcaacgacgataataaccccaatgatgagacatactatagaaaacacaacagcaaacatcagcctaacagctatagcaaatcaagctgcgatcttaatggggcttgacaaaggctggcccattagtaaaatggatatcggagtaccgttattagcattgggttgctacagtcaagtaaatccattaacactcaccgctgcagttctgatgttagtagcccactacgcaattatcggcccgggtctgcaagctaaggctacacgcgaagcacaaaaacgaacagccgcaggaataatgaaaaacccaactgtagacggaatagtcgcgattgacttagaccctgtagtatatgatgcgaaatttgaaaaacaactcggacaaatcatgttactaatattgtgcacatctcaaatcttactcatgcgaacaacgtgggctctatgtgaatcaatcacgttggctactggtccactaacaacattatgggaaggatccccgggtaagttttggaatacgaccatagcggtttcaatggctaatatatttagagggtcgtacctggcaggggccggattagcattctccctaatgaaaagtttaggaggcggacgacggggtaccggtgcgcagggagaaacactaggagaaaaatggaaaaggcaattaaaccaactaagtaaaagcgaatttaatacgtataaacgatcaggcataatggaagtagacagaagcgaagctaaggaaggtttaaaaagaggagaaactacaaagcatgcagtatcccgcggaacagcaaagctaaggtggttcgttgaacgtaatttagtcaaacctgaaggtaaagtgatcgacctagggtgtggaagaggaggatggagttactactgcgcaggactaaagaaagttacagaggtcaaaggatataccaaaggtggtccgggacatgaagaaccaattccgatggcaacttacggttggaatttggttaaacttcactcaggtaaagacgtattcttcatacccccagaaaaatgcgacacacttctatgtgatataggagagagtagtccgaatccgactatagaggaagggcgcacccttagagttctaaagatggtcgaaccgtggctaagaggaaatcaattttgtataaaaatcctcaacccatacatgccgtcggtcgtcgaaaccttagagcaaatgcaaaggaagcatggcggaatgctagtgaggaatccattgtcgagaaactcaacgcatgaaatgtattgggtatcttgtgggacaggtaacattgtaagtgctgtaaatatgacctcacgaatgctactaaaccgattcaccatggcacatagaaaacccacatatgaacgtgacgtggaccttggcgcgggaacgcgacatgttgccgtagaaccagaagttgcaaacctcgacatcataggacaacgaattgagaacataaaacacgagcataagtctacatggcactatgatgaagataacccctataaaacctgggcataccatggatcctatgaggtaaaaccttcggggagcgcatcatctatggtcaacggggtagtaaagttactgactaaaccatgggacgtcattcccatggtaacgcaaattgcaatgactgatacaacaccatttgggcaacagcgtgttttcaaagagaaagtggataccagaacccctaaagcaaaacgtggcactgcacagataatggaggttactgcaaagtggttatggggatttttgtcacgaaacaagaaaccaagaatttgtacaagagaggagtttacgagaaaagttagatcaaatgcagcgattggcgctgtatttgtcgacgaaaatcaatggaactcagcgaaagaagctgtggaagatgaaaggttctgggatctagtccatagagaaagagaactacataaacaaggaaaatgcgcaacatgcgtttataatatgatgggcaaaagggagaagaaactcggtgagttcggaaaggcgaaaggatcaagggctatatggtatatgtggctaggggctcgatttctcgaatttgaggctttgggttttatgaacgaagatcattggtttagtcgagaaaatagtttatcaggtgttgaaggagagggactccacaaacttggatatatactacgagacataagtaaaatacctggcgggaatatgtacgcagatgacaccgcaggctgggacactcgaattacagaagatgatctacaaaatgaagctcgaataaccgacatcatggaacccgaacacgctctattggcaaaaagtatatttaaattaacttatcaaaacaaagtagtcagagtacaaagaccggcgaaaaatggaacagtaatggatgtgatatcccgaagagatcaaagagggagcggacaggttggtacttacggacttaacacatttaccaacatggaagctcaattgattagacaaatggaatcagaagggatattcagccctagtgagctcgaaacacctaatttagcagaacgcgtattagactggttagaaaagtacggtgtcgaaagattgaaacgcatggccataagtggagatgattgcgtagtgaaaccaatagatgatagatttgcaactgcattaactgccttaaatgatatgggaaaggtccggaaagatattccacaatgggaaccatcaaaaggatggaatgactggcaacaagtgccgttttgttcccaccactttcaccaacttattatgaaagacggccgagaaatagtggtaccctgtagaaatcaggacgagctagtaggtagggctcgagtatcacaaggtgcaggttggtcccttcgagaaacagcctgcttaggaaaatcatacgctcaaatgtggcaattaatgtacttccataggcgggacttaagactagccgcaaatgccatatgctccgctgttccggtcgattggataccaaccacatgtacgacatggtccatccacgcacatcatcaatggatgactacagaagacatgttaagtgtatggaatagagtatggatagaagaaaatccttggatggaggataagacgcatatatcatcttggggagatgttccttacctgggtaaaagggaagaccagtggtgcggatcacttataggactaacggcgcgagccacatgggctactaatatccaggtggcaataaatcaagttcgaagattaatcggcaatgaaaactacctagattacatgacgtcgatgaaacgattcaaaaacgaatccgatccagaaggagcattgtggtag

SEQ ID NO: 21998 - RNA, 9879 nt, synthetic construct
  misc_feature 1..9879: note = derived and/or modified CDS sequence (opt6) from DENV-1__JQ045649__SS-prME
  source 1..9879: mol_type = other RNA
tcagtcacgatgcttttaatgttaatgcccactgctttagcttttcacttaacaacacgcggaggtgaaccccacatgatcgtcagcaaacaagaacgaggtaaaagtctgttatttaaaacatcggcaggcgtcaatatgtgtaccctaatcgcgatggacctaggagaactatgcgaagatacaatgacttacaaatgtcctcgaataacagaaaccgaaccggatgacgtagattgttggtgcaatgctactgatacttgggttacctatgggacgtgtagtcaaaccggtgaacatagaagagataaaaggtcagttgccctagcgccacacgttgggttgggcttagaaacgcggacggagacgtggatgtcatccgaaggtgcttggaaacaaatacaaagagtcgaaacatgggctctgcgacatccaggctttacagtgatagcgctatttttagcacacgctatcggtacttcaataactcaaaaaggaattatatttatattattaatgctagttacaccatccatggctatgagatgcgttggaatagggtccagggacttcgttgaaggattaagtggagctacatgggtcgatgtggtgcttgaacatggcagttgtgttactacgatggcaaaagataaacctactctagatatagaattattaaaaactgaagtaacgaacccagccgttctacgaaaattgtgtattgaagcaaaaatatcaaacactacaacggacagtagatgccctacccagggagaagcaacgttagttgaggaacaagatgcaaacttcgtttgcagaaggacttttgtggatcgaggatggggtaacgggtgcggtttgtttggtaaagggtcgcttattacatgcgcaaaattcaaatgcgttacaaaattggaaggaaaaattgtccaatacgagaacttaaaatattctgtaatagtaacagtacacactggggaccagcaccaagtcgggaatgagagtacagaacatggaaccactgctacgattacaccccaagcaccaactacggaaatccaactcaccgattatggtgcactaactcttgactgtagccctaggaccggactagacttcaacgaaatggtcctgctaacaatgaaagagaaaagctggctagttcacaaacaatggtttctcgatctaccactgccatggacaagcggtgccagtacttcacaagaaacgtggaatagacaagatttgctggttacattcaaaactgctcacgcaaagaaacaggaagtagtggtactaggaagtcaagaaggtgcgatgcatactgccctaactggcgcaactgagatacaaacgtctggcacgacaaccatctttgctggtcacttaaaatgtagactcaaaatggataaattaacattgaaagggatgagttacgttatgtgtacaggatccttcaaacttgagaaagaagtcgcagaaacgcaacacggtacagtgcttgttcaaataaaatacgaaggaacagatgcaccttgcaagataccattcagcactcaggatgaaaaaggagtaacccaaaacgggcgcttaattacggccaacccgatcgtgacggataaggagaaaccagtaaatatcgaagctgagccaccatttggtgaatcgtatatagttataggagctggagaaaaagcgttaaaattatcatggtttaaaaagggttcatctattgggaagatgtttgaggcaacggcgcgcggtgccagaagaatggcaatcttaggcgataccgcatgggatttcggtagtataggcggcgtttttacctcagtcggcaagctcgtacatcaaatattcggaactgcatatggggtgctatttagcggtgttagttggacaatgaaaatcggaataggggtgcttttaacatggcttggtttgaacagccggtcgaccagcctgtccatgacatgtatcgccgtaggattagtgacactgtatctaggagttatggtacaggcagatagcggatgcgtcataaactggaaaggaagagaactaaagtgtggtagcgggatattcgttactaacgaagttcacacatggacagagcagtacaagtttcaagccgattcgccaaagagactcagtgctgctatcgggaaggcatgggaggaaggagtatgcggaataaggagcgcgacgagactagagaatattatgtggaaacaaatatccaacgagttaaaccacatattattagaaaacgatatgaagttcacggtagtagtgggggacgtcgcaggtatactagctcagggcaagaaaatgattaggccgcaacctatggaacacaaatattcatggaaatcttggggtaaagccaaaatcattggggcggatgtgcaaaataccacctttataatcgatggaccaaatactcccgagtgtccagatgaccaaagagcatggaatatatgggaggtggaagattacggttttggaatatttacaacaaatatatggctaaaactacgcgattcgtatacgcaggtttgtgatcatcgcttaatgagtgcagcaataaaagactcaaaggcagttcatgccgatatgggttattggatagaatcagagaaaaatgagacatggaaattggcacgtgctagcttcatcgaagttaaaacatgcatctggccaaaaagccatacactatggtctaatggcgtattagaaagtgagatgataatcccaaagatatacggaggacctatttcacaacacaactaccgtcccggatatttcactcagacagcgggaccttggcacttagggaaattagaacttgactttgatttatgcgagggaactactgtggtcgtcgatgaacactgcggaaacagaggacctagtctaagaacaacaacggtaacgggaaagataatacatgaatggtgttgcagaagttgcaccttgcctccccttaggtttagaggcgaggacggatgctggtacgggatggaaatacgaccagtgcgtgaaaaagaggaaaatttagtgaaatcgatggtaagtgccgggtctggtgaagtagactccttttccctaggactcttgtgcatatcaataatgatagaagaggtaatgcgtagccgatggagccgtaaaatgcttatgacagggactttggccgtatttttccttctcatagtaggtcaactaacatggaacgacttaatacgtttatgtattatggttggggcgaatgcttcagatagaatgggtatgggcaccacatatttagcattaatggcgaccttcaaaatgagaccgatgtttgcagttgggctactatttcgaaggctaacaagtagagaagtactactattaaccataggcctttccttggtagcgtctgtagaattaccaaacagtttagaagaacttggagacggattagctatggggataatgattttaaaacttttgaccgattttcaatcgcaccaactttgggcgtctctattatccctaacgttcattaaaacgacattctcactccactatgcatggaaaacaatggctatggttctgtcagtcgttagcctctttcccctatgcttatcaacgacgagccagaaaactacttggctaccggtactcctaggatccttaggatgtaagcctctgacaatgttcttgatcgcggaaaacaaaatttggggtcgcagaagctggcctttaaacgaaggtataatggcagtaggaattgtatctatattactttctagtctgctcaaaaacgatgtccccctcgccggtccattaatagccggtggaatgttaatagcgtgttatgtaataagtggctcgagtgcagatctctcactggaaaaggcagcagaagtgagttgggaagaagaagcagaacactctggagcatctcacaacattctcgtagaagtacaagatgatgggacaatgaagataaaagatgaagaaagagacgatacattaacaatactattaaaagcaactttattggcggtgagcggggtttatccactatcgattcctgctacattattcgtatggtacttctggcaaaagaagaaacaacgatccggcgtcttgtgggatacacctagtccacctgaagtagaacgagcggttcttgatgatggtatatataggataatgcagcgaggtttacttggcagatcacaggtaggagtaggggtttttcaagaaaatgtattccacactatgtggcatgtaacaaggggagctgttttaatgtatcaaggcaaacgcttagaacctagctgggctagtgtaaagaaagatcttattagctacggaggaggatggcggctacaaggcagctggaatacgggcgaagaggtacaagtcatagccgtggaacctggtaaaaatcccaaaaatgtccaaacagcacctggtacattcaagacaccagaaggagaggtaggggctatagcattagattttaaacccggtacatccggctcaccgatcgttaatagagaaggaaaaatagtaggtttatatggaaacggagtagtcaccacaagtggaacatatgttagcgcaatagcacaagcaaaggcatcacaagaaggacccctgcctgaaattgaagacgaagtttttcggaagagaaaccttacaattatggatttacatcctgggtcaggaaaaacaaggcgatacctgccagcaatagtaagagaagccattaagagaaaactaagaacactgatcctcgctccaacacgagttgtagcgagtgaaatggcggaagcattaaaaggaatgccaataagatatcaaactactgcagttaaaagcgaacacactggcaaagaaattgtagatctaatgtgccatgccacattcacaatgagactgctcagtccggtcagggttccaaactacaatatgattataatggatgaagcacacttcactgatccgagctcgatagccgcacgagggtatatttctacacgggtaggaatgggcgaagcagctgcaatatttatgacagcaactccacctggctctgtcgaggcctttccacaatccaatgctgtcatacaagacgaagaaagagatataccggagcgatcctggaactctggatatgaatggataacagactttccaggtaaaacagtatggtttgtaccaagtatcaaaagcggtaacgacatcgcaaattgtctccgtaaaaatggaaaaagagtcatacagctatctagaaagacatttgatacagaataccagaaaaccaagaataatgactgggattatgtcgtcaccactgacatatctgaaatgggagctaacttccgggcagatagagtaatagatcctcgaagatgtttgaaacccgtaatattaaaggacggacctgaaagagtaatactggcaggtccaatgccggttacggtagcgtccgcagcgcaacgtcggggtaggataggacggaatcataataaagaaggagatcagtacatatatatgggtcagcctttaaacaatgacgaagatcatgcgcattggacagaagctaagatgttactagacaacataaatactccagaaggtataattcccgcattgtttgaaccagagagggaaaagtcagcagctattgacggagaatacaggctacgcggagaagctcgtaaaacttttgtagaacttatgagacgtggcgatctacccgtctggctgagctataaagtggcctctgaagggttccagtactcagaccgaaggtggtgctttgatggagagcgcaacaatcaagtcctcgaagagaacatggatgtagaaatatggactaaggaaggtgaaaggaagaaacttcgaccaagatggctagacgctcgaacatatagcgatccactagctctaagggaatttaaagagtttgccgcggggcgtagaagtgtgagcggcgaccttatattagagataggcaaattgccacagcatttaacacaaagggcgcaaaatgccctggacaaccttgttatgctacataactctgagcaaggaggacgcgcctatagacatgccatggaagaattacccgacacgatagaaacattgatgctattagcactcatagcagtgctaacaggaggagtgacccttttctttcttagcggacgtggactaggaaaaacctcaatagggcttctatgcgtgatggccagctcagttctactatggatggcatcagtagaaccacactggatagctgcatcaataattttggaatttttcctaatggtgcttttaatacctgaaccagatcggcaacgaaccccgcaagataatcagctggcgtatgtggtgatcggactactttttatgattctaacggtcgctgctaacgaaatgggtcttttagaaacaactaagaaagacctgggtattgggcatgttgctgttgaaaatcatcatcatgctgcaatgttagacgttgatctccatccggcatcggcatggacgctttatgcagttgcaaccacgataataacaccaatgatgcgccatacaatcgagaacaccacagctaatatcagtttaacagcaatagcaaatcaagcagccatacttatgggacttgataaaggatggcctatctcgaaaatggatatcggggtgccccttcttgcattaggttgttattcacaggtgaatccattgacgttgactgcggcggtcctaatgctagtagctcactacgccattataggacctggattgcaagcaaaggcaactcgcgaagcccagaaacgtactgctgcgggtataatgaaaaaccccacggttgacggcatagtagctatcgatctcgacccggtagtatacgacgcgaagttcgaaaaacaactcggacaaataatgctactaatattgtgtacctcgcagatcttattgatgagaactacgtgggccctctgtgaatcaatcacgttggccaccggacctctaacaacactatgggaaggctcgcctggaaagttctggaatacaactatagcagtttcgatggccaacattttcagaggctcatatcttgccggtgcgggattggcatttagcttaatgaaatctctcggtggaggccggagaggaacaggcgcacaaggcgaaaccttaggagaaaaatggaaacgtcaattaaatcaactgagcaaatctgagttcaacacttacaaaagaagcggaataatggaagtagacaggtccgaagcaaaagaaggtctaaaacggggtgaaacgacaaagcatgcagtaagtaggggtactgcgaagttacgttggtttgtcgagaggaatctagtaaagcccgaaggaaaagttatagatcttggatgcggaagaggtggatggtcatattactgcgcaggactaaagaaagtaactgaagttaaaggatataccaaaggaggacccgggcatgaggagcctatcccaatggcaacgtacgggtggaatctcgttaaattgcacagtggaaaagacgtatttttcatccctccagagaaatgcgataccctactatgcgatatcggagagtcgtcgccaaatccaactatagaagaaggtcgaactctcagagtacttaaaatggtcgaaccatggcttcggggaaatcaattctgcataaaaatcctaaatccatatatgccgagtgttgtcgagactttagaacaaatgcaacgaaaacatggtgggatgctagtaagaaatccattatcaagaaacagtacgcatgagatgtattgggtatcctgtggaacaggaaatatagtttcagcagtaaatatgacctcaaggatgttgttaaacagatttacgatggcccataggaagccaacttatgagagagatgtcgatttaggagctggtactagacacgtcgcagtggaacccgaagtcgcgaacttagacataataggacaaagaatcgagaatattaagcatgaacataaaagcacttggcattacgacgaggataacccctacaaaacgtgggcctatcatggatcctacgaagtaaaaccgagtggctccgcatccagtatggtaaacggggtagtaaaattactaacgaagccctgggatgtcattccaatggtcacgcaaatagctatgacggacactacgccttttggacagcaaagagttttcaaggaaaaagtagatacaagaacaccaaaagcaaagagaggaacggcacaaataatggaggtaaccgctaaatggttatggggctttttgtcaagaaataagaaaccgagaatatgcacccgtgaggagtttacaagaaaggtgagatccaatgcggccataggagcagtattcgttgatgaaaatcagtggaacagtgcaaaagaagcggttgaagatgaacgtttttgggacttggtccacagggagagagagctacacaaacaaggaaaatgtgcaacatgtgtttataatatgatgggaaaaagggagaagaaactcggagaatttggaaaagctaaaggaagtcgcgctatctggtatatgtggcttggtgcacggttccttgaatttgaagccctagggtttatgaacgaggatcattggttctcacgagaaaactcattatccggtgtcgagggtgaaggattacacaaattaggttacattctacgtgacattagcaaaataccaggtgggaatatgtatgctgatgacacagctggttgggatactaggatcactgaagacgacctgaaaaatgaagcacgtataactgacattatggaaccagagcacgctctactagccaagagtatttttaaattaacataccaaaacaaggttgtacgcgtgcaacgcccagcaaagaatgggacagtaatggatgtaattagccgacgtgatcaaagagggtccggccaagttggcacctacggtttaaatactttcactaatatggaggctcaattgattagacaaatggaatccgaaggtatattttcacctagcgagctagagaccccgaatctggcagagagagtgctacactggttagaaaaatatggagtagagagactgaaaagaatggctatatcaggagatgactgtgtagtgaaacctatagacgacagatttgcaaccgcattaacagcattgaatgatatgggtaaagtacgtaaagatataccacagtgggaaccgtcgaaaggatggaacgattggcaacaggttcctttttgtagtcaccattttcatcaactgataatgaaagatggacgagaaatagtggttccttgtcgaaatcaagatgaattggttgggcgagcaagagtatcccaaggagcggggtggtctctgagggaaaccgcttgcctcggaaagagttacgcgcaaatgtggcaactgatgtacttccaccgcagagacttaaggctggcagcgaacgcgatttgtagtgctgttccagtagactggattcccacaagcagaacaacgtggagtattcacgcacatcaccaatggatgacaaccgaggatatgttaagcgtgtggaatagagtctggattgaagaaaatccgtggatggaagataagactcacatatcatcgtggggtgacgtaccatatctaggtaagagagaggatcaatggtgtggctcacttattggcttaactgcaagagctacctgggcaacaaacatacaagtagcgattaaccaagtgagacgcttgattggcaacgagaattacttggattacatgacatcaatgaaaagattcaagaatgaatccgacccagagggagcgctttggtaa

SEQ ID NO: 21999 - RNA, 9879 nt, synthetic construct
  misc_feature 1..9879: note = derived and/or modified CDS sequence (opt6) from DENV-1__JQ045650__SS-prME
  source 1..9879: mol_type = other RNA
tctgtaacgatgttgcttatgttgatgcccacagcgttggcgtttcatttaactacgagaggtggagaacctcacatgatagtatcaaaacaagaacgaggaaaaagccttctgttcaaaacttcggccggtgttaatatgtgcacattaatagcaatggatctaggtgaattgtgcgaagacacaatgacatacaaatgccctcgaataacagaaactgaaccagacgacgtcgactgctggtgtaatgctacggatacgtgggtgacttatgggacgtgtagtcaaaccggtgaacatcgtcgtgataaacgatcagttgcactagctcctcacgtcggacttggcctagagaccagaacggaaacatggatgtcatctgaaggagcatggaaacagatacaaagagtagagacatgggcattgaggcacccgggttttacggtcatagccttatttttagcacacgcaattggcacatccattacacaaaaagggataatctttatattgttaatgttagtaacaccatctatggcgatgaggtgtgttggaatcgggtcccgcgatttcgtggaaggtttgagtggggcgacttgggttgacgtagttctagaacacggctcatgcgtgacaacgatggccaaagataaacctacgcttgacatcgaattgcttaaaacggaggttactaaccccgcggtgcttagaaaactatgcatcgaggccaaaatttccaatacaaccacagattcaagatgtcctactcaaggtgaggcgacattggttgaagaacaagacgctaacttcgtttgtcgaagaacctttgtcgatagaggctgggggaatggctgcggactattcggaaaaggatcactcataacttgcgccaaatttaaatgcgttacgaaattagaaggcaagatcgttcaatatgaaaatttaaaatatagcgtaatcgttacagttcatacgggcgatcagcaccaggtcggaaacgaaagtacggaacatggtactacggcaaccataacacctcaggctccaacgacagaaattcaacttacagattacggcgctcttactttagattgctctccaaggacgggattggatttcaatgaaatggttttattaaccatgaaggagaaaagctggctagtacataaacaatggtttctagacttacctctaccttggacctcaggcgcttcaacgagccaagagacctggaacagacaagacttactggttacattcaagacggcccacgccaaaaagcaagaagtggttgtgttaggaagtcaagagggggcaatgcatacagctctcactggagcgacagaaatacaaacaagtggaacaactacaatatttgcaggtcacctcaaatgtaggctaaaaatggataagttaactctcaagggcatgtcctacgtaatgtgcactggctcatttaaattagaaaaagagcttgctgagacgcagcatggaactgtcttagtacagatcaaatacgagggaaccgatgctccatgtaaaatcccgtttagcacacaagacgaaaagggcgttacccaaaatggccgattgattactgccaaccccatagtaactgataaagaaaaacccgtaaatattgaggctgaacccccgtttggagagtcctatattgtaataggagctggtgagaaagcgttaaaacttagctggtttaagaaaggaagttcaataggaaaaatgttcgaagcgacagctcgaggcgcccgaagaatggcaatactgggggatactgcatgggatttcggaagcataggaggagtattcacaagcgtcggaaagctcgtacatcaaatatttggaacagcgtatggggtcttattctctggagtttcctggaccatgaaaataggaatcggagtcctcttaacatggctcggtctaaattcgaggtccacaagtttatcaatgacctgcattgcagtagggctagtgacattgtatttaggcgtcatggtacaggccgattcaggttgcgtaataaactggaaaggaagagaactcaaatgcggatcgggcatatttgttactaatgaagtgcatacatggacagaacaatataaatttcaagctgattctccaaagcgattatcggctgcaattggaaaggcttgggaggaaggagtatgtggtataagaagcgccacgagactagagaacattatgtggaaacaaatatctaatgaacttaaccacatattacttgaaaacgatatgaagtttactgtggtcgtgggagatgtggcaggcatactcgcacagggaaagaagatgatacgaccacaaccgatggaacataaatactcctggaaaagctggggcaaagccaaaatcatcggcgctgacgtacaaaatacaacatttataatcgacggaccgaatacgcctgaatgtcctgacgaccaaagagcttggaacatatgggaagtcgaggactacggctttggtattttcacgacaaatatatggctaaaattgagggatagctatacccaagtatgtgatcatcgtttgatgtctgcagctataaaagacagtaaggctgtgcatgctgatatgggttattggatcgaatccgaaaagaatgaaacatggaaattagccagagcatcttttatagaggtcaaaacttgcatatggccaaaatcacacacactatggagtaatggcgtattagaatcagagatgataattccaaagatttacggaggaccaatttctcaacataattatagacccggatactttactcaaaccgctggtccttggcacctaggaaaacttgaactagattttgacttgtgcgagggaaccacggttgtagtggatgaacattgtggcaatcggggccccagtttacgcacaacaacggttactggaaagattatacatgagtggtgttgccgatcctgtacgttgcctccattgcgattcaggggagaagatgggtgctggtacgggatggagatccgaccggtaagagagaaagaggaaaatttggtaaaaagtatggtttcagcaggaagcggggaagtcgactcgttctcgttaggattgttatgtataagcatcatgatcgaggaagtaatgagatctagatggtcgcgcaagatgctaatgacaggtacgcttgcagttttcttcttactaatagtcgggcaacttacgtggaatgatttaataagactatgcatcatggtaggagctaatgcatcagaccgtatgggaatgggaaccacttacttggcattaatggcgacatttaagatgagacccatgttcgcggtcggcttactattccggcgcttaacatccagggaagttctgttattaacaattgggctgtctttagtagcctcagttgagcttccaaattctttagaggaactaggagatggattggctatgggaataatgattctgaagttactaacagattttcagtctcatcaactatgggcaagtctactaagtttgactttcataaaaaccactttctcactgcactacgcttggaaaacaatggcaatggtattatcggtagtaagtctgtttccattatgcttatcaacgactagccagaaaactacatggttaccagtactcttaggttcattaggttgcaaaccactaacaatgtttctaattgcagaaaataaaatatgggggcgccgttcctggccccttaatgagggaataatggcagttggtatagttagtatactattgagctcattgctaaagaatgacgtacccttagcaggccctctaattgccggtgggatgctgatagcatgctatgttatatccggttcatctgccgatttgtcattagagaaagcagcagaagtctcatgggaagaagaagcggagcatagcggagcaagtcataatatacttgtagaagtgcaagacgatggcactatgaaaataaaagatgaagagagagacgacacattaactatactgttgaaagctaccctcctggccgttagtggagtgtatccgctatcaatccccgcaactttgtttgtgtggtatttctggcagaagaagaaacaaagatctggtgtattgtgggacactccatctccacctgaggtagaacgcgcagtgttagatgatggaatttacaggattatgcagagaggtttattgggtcgatctcaagtgggagtcggggtattccaagaaaatgttttccatacaatgtggcacgtcactagaggagctgtattaatgtatcaaggcaagaggttagaaccatcgtgggcatccgttaagaaagacctaatcagttacggtggaggatggcgacttcaaggaagctggaatacaggagaagaagtacaggtgatagccgttgaaccgggcaaaaaccccaaaaatgttcaaactgcgcccggaactttcaaaacaccagagggagaggttggagcaatcgcactcgactttaagcctggcacgtctggtagcccaatagtaaatcgagaagggaagattgttggcttgtacgggaacggagttgtgacaacatcaggtacatacgtaagtgctattgcacaagccaaagcctcacaagaagggccactgccagaaatagaagatgaagtctttcgcaaaagaaatttgacaataatggacttgcatccaggtagtggaaaaacccgtaggtatttgcccgcaatcgtacgagaagccataaaaagaaaacttaggacattaatactagcacccacaagggtagttgcttctgagatggcagaagcacttaaaggtatgccaatacgatatcaaactacagcagtcaagagtgaacatacagggaaagaaatagtcgacctaatgtgccatgcaacatttaccatgagactattatcgcccgtgagggtcccgaattataacatgattataatggatgaagcacactttacagatccgtctagtatcgccgcaaggggttacatatcgacaagagttggtatgggtgaagctgcagcaatattcatgacggctactccacctggtagcgtagaggcttttccccaatctaatgctgtaatccaggatgaggaacgtgatataccagaacgaagctggaacagcggctatgagtggataacggactttccaggaaaaacggtgtggttcgtcccatccattaaatcgggaaatgatatagcaaattgcttaaggaaaaatggcaagcgtgtaattcaattgtctcggaaaactttcgacactgaatatcagaaaaccaaaaacaatgattgggattacgtggttacaaccgatataagtgaaatgggcgccaacttcagggccgacagagtgattgatccacggcgatgccttaaaccggtaattttgaaagatggtccagagagagttatactggcagggccaatgccggttactgttgcatctgctgcacagcgaagaggtagaattggcagaaaccataacaaagagggggatcaatatatctatatgggacagccgctaaacaatgacgaggatcatgctcactggactgaggcgaaaatgctgttagataatattaataccccagaagggattattcccgccttgtttgaaccagaaagagaaaaatctgcggcaatagatggagaatatcgattacggggagaagcaagaaagacgtttgtagaacttatgcggagaggagacctaccagtttggcttagctataaagtagcaagtgaaggattccagtatagcgaccgaagatggtgttttgatggtgaaaggaataatcaagtgctcgaagaaaatatggacgttgagatatggacgaaagaaggagagcgtaagaaactccgtccgcgttggttagacgctagaacttatagtgatccacttgcattaagagaatttaaagaatttgctgcgggtaggagatctgtcagcggagacttaatactcgaaataggaaagctaccccagcatcttactcaacgtgcacaaaatgcactggataatttagtcatgctacataattcagaacaaggaggacgcgcctatagacatgctatggaagaactgccagatacaatagagacattaatgctactggcattgatagccgtactaacgggaggagtaacactcttctttctatcaggtaggggactaggcaaaacttccattggtttactatgcgttatggcaagtagcgtgctattgtggatggcgagtgtagaacctcactggatagccgcgtcaataatactggagttctttctaatggttctactaataccggaaccagaccgacaacggacaccacaagataaccagctcgcatatgtagtaataggattgttatttatgatccttactgtcgcagctaatgaaatggggttattagagaccaccaagaaagatttagggattggccatgtagctgtagaaaaccatcaccacgctgcgatgcttgatgttgacttacaccctgcatcagcctggacactttacgcagtagctacaactatcataactcccatgatgcgccacactatagaaaacacaacagcaaatatatcattaactgccattgcaaaccaagctgctatcttaatggggctcgacaagggttggccaatatcaaagatggacattggcgtccccctattagcattaggatgctattcccaagtaaacccattaacattaactgccgctgtattgatgttagtagcacattatgccataataggaccaggactacaagccaaagctacccgggaggcacaaaaacgaaccgctgctggtataatgaaaaacccaaccgtcgatgggatcgtagcaatagacttagatccggttgtctatgatgcgaaatttgagaaacagttaggtcaaataatgttactcatattgtgcacttcacaaatcttgttgatgcgcacgacttgggcattgtgtgaatctattacattagcaactggcccattgacgacgctttgggaggggtcaccagggaaattttggaataccacaattgcagttagtatggctaacatatttagaggaagttacctagctggtgccgggcttgctttcagcctaatgaaaagtttaggcggagggcgaagagggacgggcgcgcagggagaaacactgggggaaaaatggaaacgacagttgaaccaactctctaagtcagagttcaatacgtataaaagatcaggaattatggaagtagatagatcagaagccaaagaaggactcaaacgaggagaaacaacaaaacatgcagtttcgagaggaacggcaaagctgcgctggtttgtggagcgcaacttggttaagccagaaggtaaagtaatcgatttaggttgtggtagaggaggatgggcttattattgtgcaggcttaaagaaagttacagaggtgaaaggatatacaaaaggtggtccaggccatgaagaaccaataccgatggcaacctacggatggaacttagtaaaactgcattcgggaaaagacgtatttttcataccacccgaaaagtgtgatacgctgctgtgcgatattggcgaatctagccccaacccgacgatagaagaagggagaactttaagagtacttaagatggtagagccatggctacgcggaaaccaattctgtataaaaatactgaacccttatatgcctagtgttgttgagacattggaacaaatgcaacgcaaacacggtggaatgttagtaagaaaccccttgtctagaaactctacacatgagatgtattgggtaagctgtggcacggggaacatcgtaagtgccgtaaacatgacctcgagaatgttattgaatagattcactatggcccatagaaaaccaacatacgaaagagatgttgatctcggagcgggaacacgccacgttgcagtagagcccgaagtagcaaatcttgacataattggacaaagaatcgaaaacataaaacatgagcataaaagcacctggcattacgacgaagataacccgtacaaaacttgggcttatcacggttcatatgaagtaaagcctagtggcagcgcatcttctatggtaaatggtgtagtaaagctgctaaccaaaccatgggatgtgataccaatggttacccagatagcgatgactgatactacgccattcgggcaacaaagagtattcaaagaaaaagttgataccagaactcctaaggcaaaaagggggactgcccaaataatggaggtcacagccaagtggctatggggatttttgtcaaggaataagaaaccaagaatctgtacgcgagaggaatttacaaggaaagttcgatcaaatgccgcaataggagcggtgtttgtagacgagaatcaatggaactcagctaaagaggctgtggaagacgagcgattttgggacttggttcacagagagcgcgagctacataaacaaggtaagtgtgcaacttgtgtctataatatgatgggcaaaagagaaaagaaactgggagaatttggtaaggcgaagggtagtagagccatttggtatatgtggctcggagcaaggtttttagagtttgaagcattgggttttatgaatgaagatcattggtttagtagagaaaacagcttgagtggggtagaaggtgaaggacttcataaactaggatacatcttaagagatattagtaaaatcccaggaggaaacatgtacgcagatgatactgcaggatgggataccagaattactgaagatgatcttaaaaacgaagcgagaatcacagacataatggagccggagcatgctctattagcaaaaagcatcttcaaactgacatatcagaataaggtcgtaagagtacaaagaccggcaaagaatggaacagtaatggatgtaatatctaggcgagatcaacgcggttcaggtcaggtcggcacatacgggcttaacacattcacaaatatggaagcgcaacttatcagacagatggagtcagaggggatattttctccgtccgagctagagacaccaaaccttgcagagcgagtactccattggttagaaaagtatggagtagagagactaaaaagaatggcaatatccggtgacgactgcgtagtcaaaccaatagacgacagatttgcgaccgcattaaccgcgttaaatgatatgggcaaagtaagaaaagacatcccgcaatgggaaccaagtaaaggatggaacgattggcaacaggttccattttgctcacaccattttcaccaattaataatgaaagatggaagagaaattgtcgttccttgtaggaaccaagatgagcttgtagggagagcgagggttagtcagggtgccggatggagcctacgtgaaaccgcatgtttaggtaaatcttatgcacaaatgtggcaattaatgtattttcaccgtagggatctccgactagcagcaaatgcgatatgttcagcagttcccgtcgattggatacctacctctcggaccacctggtcgatccacgcccatcatcagtggatgacaaccgaagacatgttatcagtatggaacagagtatggatagaagagaacccttggatggaagataaaactcacatttcttcatggggagacgtaccatatctaggcaaaagagaggatcagtggtgtggtagtttaatcggtttgacagctagagctacgtgggcaacaaacattcaggtcgccataaaccaagtaaggagactcataggaaatgaaaattatttagattatatgactagcatgaagcgattcaagaatgaaagtgatccagaaggagcactttggtaa

SEQ ID NO: 22000 - RNA, 9879 nt, synthetic construct
  misc_feature 1..9879: note = derived and/or modified CDS sequence (opt6) from DENV-1__JQ045651__SS-prME
  source 1..9879: mol_type = other RNA
agcgtgacaatgttactaatgttgatgccaactgcactagcgtttcacttaacaacgagagggggagagccacacatgatagttagtaaacaagaacgaggtaaatcactgttgtttaaaacaagtgctggagttaatatgtgtacacttatagcgatggatctaggcgaattatgcgaagacactatgacttataaatgtccaaggatcacagagaccgagccagatgatgtggactgttggtgcaatgctacagacacatgggtaacctacggaacctgttcgcaaacgggggaacataggagggataaacggtctgtagccctggcgccacatgtggggttaggattagaaacacgtacagaaacttggatgtcatcggaaggagcgtggaaacaaattcaaagggtcgaaacatgggcactacgccacccaggattcaccgtgatagccctgttcctagcacacgcaataggaacgtcgattactcaaaaaggaataatttttattctactaatgctagttacgccttccatggccatgaggtgcgtcgggataggatcacgtgactttgtagaaggattaagtggagcaacatgggtagacgtggtattagaacatggttcctgtgttacaactatggctaaagataaaccaacattggacatcgaattgctgaaaaccgaagtgactaatccagcagtgttacgaaaactgtgtatagaggctaaaataagtaatactacaacagatagtcgttgcccaacacaaggcgaggcaactctagtggaagaacaggacgcaaatttcgtatgtaggagaacatttgtagacagagggtggggcaatggctgtggactctttggaaaaggatcccttataacctgcgctaagttcaaatgtgtgacgaaactggaggggaagatagtacaatatgaaaatttaaagtattctgtgattgttacagtacacactggtgaccaacatcaggtaggcaatgaatcaaccgaacacggaactacagcaacgatcacaccacaagcacccacaacggaaatacaactaactgattatggtgcattaacattagattgctctccaaggacaggattggacttcaatgaaatggtacttcttaccatgaaagaaaagtcgtggctagtacacaaacaatggttccttgatttaccgctgccgtggacctcaggggcttcaacctcgcaagagacttggaatcgtcaggatttgttggttacttttaagacagctcatgccaagaaacaagaggtcgtagttttaggatcacaggaaggggccatgcacaccgcactgacaggagctactgaaattcaaacgtcaggaacaacaaccatctttgcaggacacttaaaatgtcgactcaaaatggataaattaactttgaaaggaatgtcctatgtaatgtgcacaggaagttttaaattagaaaaggagttagccgaaacgcaacacggaaccgtacttgtacaaatcaaatacgaaggtacggacgcaccgtgcaaaattccatttagtacacaagacgaaaaaggagtaacacaaaacggccgcctgataacggccaatcccatagttacagataaagaaaaacccgttaacatagaagcagagccaccttttggagaaagctatatagtcatcggggctggtgaaaaggcattgaagctaagttggtttaagaaaggcagcagtattggtaaaatgttcgaagccacggcacgaggagcccgtcgcatggccattctgggagatactgcctgggatttcggatcgattggcggagttttcacgtcggtgggcaagctagtacatcagatatttggaaccgcatacggagtcctattttctggagtatcgtggaccatgaaaatagggatcggtgtattactaacctggttgggattaaatagccgatctactagcttaagtatgacttgtattgctgtgggcctagtcactctatatctaggggttatggtacaagctgattcaggttgtgtcattaattggaaagggagagaactaaaatgtggatcagggatttttgttacaaacgaggtgcatacttggactgagcaatataaatttcaagcagactccccaaaaagactatcagccgcaattggaaaagcgtgggaagaaggggtttgtggaatacgaagcgccacaagactagaaaacatcatgtggaaacaaatatctaatgaattgaaccatatattattagaaaatgatatgaaattcactgttgtagtcggcgatgtagcaggaatactagcacaaggcaagaaaatgatccgcccacaaccaatggaatataaatactcctggaaatcctggggcaaagcaaaaattattggagcagacgttcagaacacaactttcattattgatgggccgaacacaccggaatgccccgatgatcaaagggcatggaatatatgggaagtagaagattacggctttggaatatttactactaatatttggttaaaattgagagattcttacacgcaagtatgtgatcatagactaatgtcggcagcaataaaagatagcaaagctgttcatgcggatatgggttactggatagaaagcgaaaagaacgaaacatggaaactcgcaagggcaagttttatagaagtaaaaacgtgcatttggccgaaatcgcacactttgtggagcaatggcgtactcgaatcggaaatgatcataccaaaaatatatggcgggccaatcagtcaacataattatcgacctggatactttacgcaaacagcaggaccatggcacctaggaaagttagagctagacttcgacttatgtgaaggaacaacagtcgtagtagatgaacactgcggcaacagaggtccttctttacgaacgacaactgtcactggtaagattatacacgagtggtgttgcagatcatgcacactccctcctctacgatttagaggagaagacggttgctggtatggaatggagattagaccggtaaaggaaaaggaggaaaatcttgtaaaaagcatggtaagtgccggctcaggagaagtagattcatttagtttaggccttctatgtatctcaataatgatagaagaagttatgagatctcgatggtcaagaaagatgttaatgactggaacgctagcggttttcttcctactcatcatgggacagttaacttggaatgatttaatcagactatgtatcatggtcggagccaacgcatcagacagaatgggaatgggaaccacatacctagctttaatggcaacgttcaaaatgagaccaatgttcgcagttggattacttttccgaagactaacatcaagagaagtcctcctattgaccataggtttaagtctagtcgcaagcgtcgaactaccaaacagtctagaagagttaggcgacggattagccatgggaatcatgattttaaaattattgactgatttccagtctcatcaactgtgggcaactttattgagtttgactttcattaagaccacgtttagtttacactacgcctggaaaacaatggccatggtactatctattgtatcgctatttccactgtgcttaagtacaacctcacaaaagactacatggctaccggttttattgggatccctaggctgtaaaccattgacaatgttcctcatagccgagaataaaatttggggtagaaggtcgtggcccttaaacgaaggaattatggctgtgggtattgttagtattttgttatcgtcactattgaaaaacgacgtgccgttagcggggcctctcatcgcaggaggtatgttaatagcatgctatgtaatttccggtagttcagctgacctatcactagagaaagcagctgaagtgagctgggaagaagaagccgagcacagtggtgcctctcacaacatcctagtagaagttcaagacgatggaacaatgaagattaaagatgaagaacgtgatgatacactaacaatattattgaaagccacattgttagctgtgtcaggagtatatccgctaagtataccagcaacactatttgtatggtacttttggcagaaaaagaaacaacggtcaggcgtattgtgggatactccatccccgccagaagttgaaagggcggttcttgatgatgggatctatcgaatcatgcaaagaggattactagggcggtcccaagtgggcgtaggggtgtttcaagagaatgtcttccacactatgtggcacgtaacaaggggagcggtattgatgtatcaaggtaaaagactagagccttcatgggcaagtgtcaagaaagacttaatctcatacggcggaggatggagacttcaggggagttggaataccggagaagaagttcaagttattgccgtagagccaggcaaaaatcccaaaaatgtgcaaacagcacctggtactttcaaaacaccagaaggtgaagtgggagcaattgcgctagacttcaaacctgggacaagtggatcacctatagtcaatcgggagggaaaaattgttggcttatatggaaacggagtcgttacaacgagtggaacctatgtatcggctatagcgcaagcaaaagcaagccaagagggacccttaccggagatagaggacgaagtctttagaaaacgtaatctgactatcatggacttacatcccggatcaggcaagacgcgcaggtacttacccgccatagttagagaagcaataaaaagaaagttacgaacattaattctggctcctacaagagtggttgcgtcagaaatggcagaagcattaaaaggaatgccaatcagataccagacaaccgcggtaaagtccgaacacacgggaaaagagatagtcgacctcatgtgtcatgctacttttactatgcggctgttgagccctgtgagggtgcccaactacaatatgataatcatggacgaagctcattttactgatccttcttcaatagctgcccgaggttatatttcaacaagagtaggtatgggggaagcggccgctatatttatgacagctaccccacccggttccgttgaggcctttccacaaagcaacgccgtaatccaagatgaggaacgagatatacccgaaaggtcctggaatagtggatatgaatggataacagactttcctggcaaaacagtatggttcgtaccttctataaaatcaggcaatgatatcgcgaattgtctccgtaaaaatggtaaaagagtaatacagttaagcagaaaaacctttgatacagaatatcaaaagactaaaaataacgattgggactatgtcgtaaccacagacatatcagaaatgggggcgaattttagagctgatagagttatagatccaagaagatgcctaaaaccagtgattctcaaagacggaccagagagggtaatccttgctggcccaatgcctgtaacagttgcaagtgcagctcagcgacgcggccgtattggaagaaaccacaataaagaaggagatcaatatatctacatgggtcagcccctaaataatgacgaggatcacgcacattggactgaagccaaaatgcttttagataatattaatacccccgaaggcattatacctgctttgtttgaaccagaaagggaaaaatcagccgcaattgatggagaatatcgcttacgaggtgaagcaagaaagacattcgttgaacttatgcgcaggggcgatttacctgtttggctatcctacaaagtggcatcagaaggattccagtatagtgatagaaggtggtgtttcgatggagaacgaaataatcaagtattggaagaaaatatggacgtcgaaatctggacaaaagaaggagaaaggaaaaagctacggccgagatggctagacgcgagaacatactccgatccgttggcccttagagagttcaaggaatttgctgccgggagacgttcagtttccggcgatttgatattagaaattgggaaattgcctcaacacttaacacaacgcgcacaaaacgccctcgacaacctagttatgttgcataattcagaacagggtggcagagcgtatagacatgctatggaagaactgcctgatactattgagactcttatgttacttgcactgatagcagtgcttaccggaggagttacactcttctttttaagtggacgaggattgggtaaaactagcattggattattatgcgttatggcttcaagtgttcttctctggatggcaagtgttgagccacactggattgcagcatcgattatactagagttctttcttatggtattactaatacccgaaccggatcggcaaagaaccccgcaagataatcaattggcgtacgtcgtcataggcttgctctttatgatcttgaccgtcgcagcaaatgaaatgggtttgctcgaaaccacgaaaaaggatctaggaatcggtcacgtagccgttgaaaaccaccaccatgcagcgatgttagacgttgacctgcatccggcttcggcttggacgttatacgcagtcgccacaactattattactccaatgatgcgccacacaattgaaaacactacggcgaacatatccctaactgctattgctaatcaagcagcaatcttaatgggcttagataaaggttggccgataagtaaaatggatattggtgtaccattactagctttaggttgttacagtcaagtcaatcccctaacactaacagcagcagtacttatgttagtagcacattacgcaataataggaccaggtttgcaagcaaaagcgactcgcgaagcgcagaaacgaacggcggcaggaattatgaaaaacccaacggtagatggtattgtcgctattgacttggatccagtggtatacgacgctaaattcgaaaaacaattaggacaaataatgttacttatactgtgtacatcccaaattctactgatgcgtacaacatgggcgctatgcgaaagtatcaccttggccacgggcccccttacaacactatgggaaggcagtccaggcaaattctggaatacgaccatagcagtgagcatggcgaatatatttcgaggttcttacctggctggagctgggttagcattctcattaatgaagtccttgggcggcggacggcgtggaaccggagcgcaaggcgagactttgggagaaaagtggaagagacagttaaatcaactaagtaagagtgaatttaatacttacaaaagaagcggcattatggaagtagatcgcagtgaagcaaaagagggtctaaaaagaggggaaactaccaaatacgcagtatctcgcggtacggcgaaactaagatggttcgtcgaacgaaacttggtaaaaccggaaggaaaagtaatcgacttaggttgtggtcgaggaggctggtcctattattgcgcaggattaaagaaagttacagaagttaaaggatacaccaaaggtggaccgggtcacgaggaacccatcccaatggcaacctacggatggaacctagttaaactacacagtggcaaggatgtattctttgtgccaccagagaaatgtgatacgttattatgtgatataggagaaagttcgccgaacccaacgatagaagaaggcaggactttgcgagtgttaaaaatggtcgagccttggttaagaggtaatcaattttgtataaaaattcttaatccatatatgcctagtgtagtagagactctcgagcaaatgcaaagaaaacacggaggaatgcttgttcggaacccattgtcaagaaacagtactcatgagatgtactgggtatcatgtgggacagggaacatagtatctgcagttaacatgaccagtcgaatgttactaaaccgatttaccatggcacatcggaaacccacctatgaacgcgacgtcgatttaggagccggaacccgtcatgttgctgtggaacctgaggtggccaacctagacattatagggcagaggatcgaaaacataaaacacgaacacaaaagtacttggcactatgatgaggataacccatataaaacttgggcttatcatggctcttatgaagttaaacctagtgggagcgcgtccagcatggtcaacggggtagtcaaacttttaaccaaaccatgggatgtcatccctatggtaacgcaaattgcgatgacggacaccaccccatttggtcaacaacgagtattcaaagaaaaagtggacacaagaacacccaaagcaaaacgaggtacagctcaaattatggaggtaacagcgaagtggctatgggggtttctaagtcgaaataagaaaccgcgaatatgcactcgagaggaatttacgaggaaggttcgatcaaatgccgcaataggggcagttttcgtggatgaaaaccagtggaactccgcgaaggaggctgtagaagatgaaagattttgggatctggtacacagagaaagggaactgcataagcaggggaaatgtgcaacctgcgtatataatatgatgggaaaaagagagaagaaactaggggaatttggaaaagctaaaggctccagggcaatatggtacatgtggcttggagcacgatttctagagttcgaagcgctaggctttatgaacgaagaccattggttttcaagagaaaattcactttcaggtgtcgaaggtgaaggactacataaactagggtatatattacgggacattagtaaaatccctggtggaaacatgtatgctgacgacactgcgggatgggatacaaggattacagaagacgatttgcaaaatgaggcccgaataacggatattatggaacctgaacatgccctattggcaaaatctatttttaaattaacttaccaaaataaagtggtccgagttcaacggcccgccaaaaacggaactgtaatggatgtcatttctagacgagatcagagaggatctggtcaagtcgggacctacggactcaacacgtttactaatatggaagcccagctgatccgccaaatggagtcggaaggaatctttagtccaagtgagttagagacccctaaccttgcagagagagtattagactggttggaaaaatatggggtagaacgcttaaaaaggatggctatatctggtgatgattgtgtagtcaaaccaatagacgatcgatttgcaacagccctaacagcgttaaacgatatgggaaaagtaagaaaagatatcccacaatgggaaccaagtaaaggttggaacgattggcagcaagtaccgttttgctcacaccatttccatcagttaattatgaaagatggacgtgaaatcgtagttccctgtaggaatcaagatgagctagttggtcgcgccagagtatctcagggggctgggtggtctttaagagaaacggcatgtctcggaaagtcttacgctcaaatgtggcaactaatgtactttcacagacgggatttacgattagctgcgaacgcgatatgttcagcggttccagtagattggattccaactagcagaacaacgtggagcatacatgcacatcatcaatggatgaccactgaggatatgctatccgtatggaatagagtatggattgaagaaaacccttggatggaagacaaaacacatataagctcatgggaagatgttccctatttagggaaaagagaggatcagtggtgtgggagtctgataggtttaaccgccagagcaacttgggccacaaatatacaagtagcaataaatcaagttagacggctgataggaaatgaaaattatctcgattatatgacaagtatgaagaggtttaaaaatgaaagtgatccggaaggtgccctttggtaa

SEQ ID NO: 22001 - RNA, 9879 nt, synthetic construct
  misc_feature 1..9879: note = derived and/or modified CDS sequence (opt6) from DENV-1__JQ045652__SS-prME
  source 1..9879: mol_type = other RNA
tccgttacgatgctactcatgttgatgccaactgctttagcatttcatctaacgacgcgaggaggagaacctcatatgattgtatctaaacaagaacgaggaaaaagccttctgtttaaaaccagcgcaggcgtcaatatgtgcacattgatcgccatggatttgggcgaactgtgcgaagatactatgacctataaatgtcctcgtataacagaaaccgaaccagatgacgtcgactgctggtgtaatgctactgacacttgggtaacatatggaacatgttcgcaaaccggtgaacatagaagagataaacgaagtgttgcactagctccgcacgtaggcctaggactcgaaacgcgaactgaaacgtggatgtcatcggaaggggcctggaaacaaatacagagagtagaaacctgggccctaagacatcccgggtttacagtaattgctctgttcctagctcatgcaataggtacctctataacacaaaaaggcattatttttattcttcttatgctggtaaccccgtcgatggccatgagatgcgtaggaataggatccagagactttgtagagggtctaagtggagcaacctgggtcgatgtggttctagaacatggaagctgtgtcacgacaatggctaaagacaaaccgaccctcgacatagaattgttaaagaccgaagtaactaacccggcagtcttgagaaaattatgcatagaagcgaaaataagtaatacaacgactgattctaggtgtcccacccaaggagaggcgaccttagttgaagaacaagacgctaactttgtttgtagaagaacattcgtagatcgaggatgggggaatggatgtgggctgttcggtaaaggctcattaataacttgtgccaaattcaagtgtgttacaaaattagagggaaaaattgtgcaatatgagaacctcaaatactcagtcatcgtaactgttcacaccggtgaccagcaccaggttggtaatgaaagtacagagcatggcacgaccgctactataacacctcaggcaccaaccacagaaattcagttgacagactacggagcactaacactggattgcagccccagaacgggactagattttaacgaaatggtactattgacaatgaaagaaaaatcctggttagtccacaaacaatggtttttagatttgcctttgccctggacgtcaggtgcatcaacttcacaagaaacttggaatcgtcaagatcttttggtaacattcaagacggcacatgcgaaaaagcaagaagtcgtagtactcgggtcgcaagaaggtgccatgcacactgcactaacgggtgccacggagatccaaacaagtggcaccaccaccatttttgccggccacttaaagtgccgcctaaaaatggataaattaacgctaaaagggatgagctatgtgatgtgcacagggagctttaaattagaaaaagagttagcagaaacccaacatggcaccgtgctagttcaaattaaatacgaagggacggatgccccctgcaagatcccgttctcgacacaggatgaaaagggcgtaactcaaaacggtaggctcataaccgctaatccaatagtaaccgacaaggaaaagccagtaaatatagaagcagagccaccgtttggagagtcctatattgtgattggagcaggggaaaaagctctcaaattgtcgtggttcaagaaaggaagcagtatcgggaaaatgtttgaagctactgctcggggagccagaagaatggccatcttaggagacacagcatgggactttggatcaatcggaggggtattcacatcggtaggcaaacttgttcaccaaatttttggtactgcttacggagttctattttcaggagtatcatggaccatgaaaatcggaataggagttttattaacatggcttggactaaattcgaggagcacctctctaagtatgacctgtatagctgttggacttgtaactttgtatttgggcgtcatggtgcaagcggattccggatgtgtaataaattggaagggacgtgagctgaagtgcggctcaggaatattcgtaacaaatgaggttcatacgtggacagagcagtacaaatttcaagcagactcacctaaacgattatctgctgcaattggcaaggcctgggaggagggggtatgtggaatacgtagcgctacaagactagagaacatcatgtggaaacaaataagcaatgaattgaatcacatattattagaaaatgacatgaaattcacagtcgtagtaggagacgtggccggaattttagcccaggggaagaagatgataaggccacaaccgatggagtataaatattcatggaagtcttggggtaaagcaaaaataataggagcagatgtccagaacactacttttattatcgatggaccaaatacccccgaatgcccagatgaccaacgggcttggaacatctgggaagtagaagattatggattcggaattttcactacaaatatttggcttaaattaagggattcatatacacaagtatgtgaccaccgactaatgtctgctgcaataaaagattcaaaagctgttcatgcagatatgggttattggatagaaagcgagaaaaacgagacttggaagttagccagagcatcatttatcgaagtcaaaacatgcatatggccaaaaagtcacaccctgtggagcaatggagtcttagagtctgaaatgataatacctaagatatacggtggtccaatatcacagcataactatcgaccgggttattttacacagacagctggtccgtggcatcttggtaagttagaactagatttcgacctttgtgaaggtaccactgttgtagtggatgaacattgcggaaacaggggtccgtcattgcgaacaactactgtaaccggcaagataatacacgaatggtgctgcagatcatgcactctcccaccgctaaggtttagaggagaagatggatgttggtacggtatggagatcagacccgtcaaagaaaaggaagaaaacctagtaaaatccatggtatcagctggaagtggagaagtagattcgtttagtttaggccttctttgcataagcatcatgatagaagaagtaatgcgaagtagatggtctagaaaaatgttaatgactgggactctggcggtctttttcctactcattatgggacagttaacatggaatgatctaattcgtctttgtattatggttggagcaaatgcgagcgatcgaatggggatgggaacaacctatttagcattaatggcgacgtttaaaatgcgacctatgttcgcagttggtcttttattccgaagactgacatctagagaggtacttctcttaactatcggactgtcgttagttgcgagtgtggaattacccaacagcttagaagaattaggtgacgggttagcaatgggaataatgatattaaaactattaaccgatttccaatcacatcaactttgggcaacacttttatctttaacattcataaaaacaacgttttcgctacactatgcctggaaaaccatggcgatggtcttatctatagtgagcttatttccactttgcttaagtaccacttcacagaaaactacctggctgccggtgctcttaggatcacttggatgcaaacctctcacaatgtttttaatagctgaaaacaagatatggggtagacgctcatggcctctgaacgaaggtatcatggccgtaggtatcgtcagtattcttttatcgtctctcctaaagaatgatgttccccttgcaggcccactcattgctggaggtatgctgatagcctgttatgtaatatctggtagttccgccgatctttcgctagaaaaagctgccgaagttagctgggaagaagaagcagaacatagtggagcaagtcacaacattctagtagaggtgcaagacgacggaactatgaaaattaaagatgaagaaagagacgatacactcacgatcttactgaaagcaaccctgttagcggtctcgggagtttaccctttgtcgatccccgctacattattcgtgtggtacttctggcaaaagaagaaacagaggtctggagtcctttgggatacgccctcgcctccagaggtagagcgtgcggttcttgacgacggaatatacagaatcatgcaaagaggacttctaggtagatctcaggtgggggtaggtgttttccaagaaaatgtattccatacaatgtggcatgttaccaggggagcagtcctaatgtaccagggaaaacgtctagaaccaagttgggccagtgtaaagaaggatttaatatcatatggtggaggatggaggttacaaggcagctggaataccggtgaggaagtgcaagtcatcgcagtagagccaggcaaaaatcctaaaaatgtacaaacagcgccaggtactttcaaaacaccagaaggagaagtaggtgcaatcgcacttgattttaaacctggaacgtcagggagtcctatcgtaaacagagaaggaaaaattgtaggtttatacggtaacggcgtagtcacgacgagcggaacatacgtgagcgctatcgcccaagccaaggcttcccaagagggaccgttaccagaaatagaagatgaagtgtttcgcaaacggaatttgaccattatggatctacaccccggatcaggaaaaacaagacggtatttacctgcaatagtcagggaagcaatcaaaagaaaattgagaaccctaatcctagctccaacccgagttgtagcctcagaaatggcggaagccttaaaaggcatgccgattcggtatcaaactaccgccgtcaaaagtgaacacactggtaaggaaatagtagaccttatgtgccatgcgacgttcacaatgagacttttatcacctgtacgtgtacctaactataatatgatcattatggatgaagcacacttcaccgacccaagttctattgccgcgagaggatacattagtacaagggtcggaatgggagaagcagcagccatatttatgacagctacacctccaggaagtgtagaggccttcccacaaagtaatgcggtaatacaagacgaagaacgcgacataccagaaagatcctggaatagtgggtatgaatggattaccgactttccaggcaaaactgtgtggttcgtaccttctataaaatccggaaatgatattgctaactgcctaaggaaaaacggaaagcgagtgattcaactaagcagaaagacattcgatactgaataccaaaagaccaaaaacaatgattgggactacgtagtaactacagacatatcagagatgggagctaattttagagcagaccgtgtgatcgatcctcgtagatgtttaaaaccagtcattctaaaagatggaccagagcgggtgatcctagccggtccgatgcccgtgacggtggcttccgcagcacaaaggcgcggaaggataggccgtaaccataataaagaaggtgatcagtatatatatatgggacaaccacttaataatgacgaggatcatgcccactggaccgaagcaaaaatgcttttagataatattaacactcctgagggaataataccagcattatttgaaccggagagagagaaaagcgcagctatcgacggcgaatatagattaaggggtgaagcgagaaaaactttcgtggaattaatgcgacgcggtgatctacccgtttggctttcttataaagtggcgagtgaaggcttccaatatagtgacagacgatggtgctttgacggagaacgtaataaccaagtactagaagagaatatggatgtagaaatctggactaaagaaggagagagaaagaaacttcgtccccggtggctggatgctaggacttattctgatccactagcattaagggagttcaaagaatttgccgctggaagacgaagtgtatctggtgacttaattttggaaatcgggaaactgccgcaacatttaacgcaaagagctcaaaacgcattagataatttggttatgcttcataattctgaacaaggcggccgcgcctatcgacatgcaatggaagaattacctgacactattgagaccttgatgcttctagcattgatagcagtactaacaggcggcgtaacattgttctttctatcgggacgaggactgggtaaaacaagtattggattactgtgtgtaatggcatcatcagtgctcttgtggatggcaagtgtagagccgcactggatcgcggcttcaataatactagagttctttctaatggtattactgatcccagaaccagacagacaaagaactcctcaagataaccaactagcatacgtagtaatcggtttactattcatgatactcacagtagccgccaacgaaatgggtttgctcgaaacgactaagaaagatctaggtatcggccatgtggccgtagaaaaccatcatcacgcagcaatgctcgacgttgacttacatcctgcatccgcttggaccttatacgcggtagctacaaccataataacaccgatgatgaggcatacaatagaaaacacaacagctaatattagcctaacggcaatcgcaaaccaggcagcgattctcatggggttagacaaaggatggccaatcagcaaaatggacattggagttccgctgctagccttgggttgctactcacaagtaaacccactaaccctgacagcagcagtattgatgctcgtggcccactatgcgatcatcggtcctggtcttcaagctaaagccacaagagaagcacagaaacgtactgccgcaggcataatgaaaaatcctacagtggatggtatcgtggccattgaccttgaccctgtagtgtatgatgctaaatttgaaaagcagctcggacaaataatgcttcttatactgtgcacaagtcaaattcttctaatgagaacaacatgggcactgtgcgagtccataactctagcaaccggaccattaacaacattgtgggaaggttcccccggaaaattttggaatacaactattgcggtctcgatggccaacatatttagaggaagctatctagctggtgccggtcttgcctttagtttaatgaaatcactaggaggcgggagaagaggaactggtgcacagggagagaccttaggagaaaaatggaaaagacaattgaaccaactcagcaaatctgaatttaatacatataaaaggagtggaattatggaagtagatcgttctgaggccaaagaaggacttaaacgaggagaaactacgaagtacgcagtaagcagagggaccgctaaattaagatggtttgtagaacgaaatttagttaaaccagaggggaaagtaattgatttagggtgtggtcgaggtggatggagctattattgcgctggcttaaagaaggttacggaagtcaaaggatatacgaaaggtggaccgggccatgaggaacctatccccatggcgacttacgggtggaacctcgtaaaacttcactcgggcaaagatgttttctttgtcccaccggaaaaatgtgacacgctattatgcgacataggtgaaagttcaccaaatccaacaatagaagaaggtagaaccctcagagtactcaaaatggtcgaaccctggctaaggggaaatcagttttgtataaaaatattgaatccatacatgccgtcagtcgtggaaactttagagcagatgcaacggaaacacggtggcatgcttgtgcgaaacccattgtcaagaaatagtacacatgaaatgtattgggtatcctgtggaacaggaaatatcgtgagtgctgtaaatatgacctcaagaatgctactaaacagattcactatggctcatagaaagcctacatatgaaagagacgtcgatctaggagcaggcacgaggcatgtggctgtagaaccggaggtagccaatttagatataataggacaacgtattgagaacattaaacatgaacacaaaagtacctggcactacgatgaagacaacccatacaaaacctgggcttatcacgggagttacgaggtcaaaccgtcaggctctgcgagctctatggtaaacggagttgtcaaactgcttacaaaaccctgggacgttattccaatggtcacgcaaatagcgatgacagatacaacaccattcggccaacaaagagtgtttaaggaaaaagtagacacacgaactcctaaagcaaagcggggcacggctcaaattatggaagtaacggcaaaatggctctggggatttttgtctcggaacaagaaaccacgtatctgcacaagagaagagttcacacggaaagtaagaagcaatgctgcaatcggagccgtgtttgtagacgaaaatcaatggaacagtgcaaaagaagcagtagaggatgaaagattttgggatttggtccatagggaaagagaattacataagcagggaaaatgtgcaacctgcgtctataatatgatgggcaaacgagagaagaaattaggagaatttggcaaagctaagggctcgagggctatttggtatatgtggctgggagcaaggtttctggaatttgaagctctaggttttatgaatgaagaccactggtttagcagagagaactccttaagcggcgtcgaaggcgaggggctacataaattaggttacatccttcgggatatatcaaaaatacctggaggcaacatgtatgcggatgacacagccggatgggatactaggattacagaagatgacctacagaatgaggcacgcatcacagatataatggaaccagagcatgcactcttggcaaaatctatattcaaactaacatatcaaaacaaagtagtgagggtccagaggcccgccaaaaacggaacagtaatggatgtaatctcaagacgcgaccaaagaggatcaggacaggtggggacctatgggttaaacacatttacgaatatggaggctcaattaataagacagatggaatctgagggcatattttcgccaagtgaactagagacgcctaatctagcagaaagagtactcgactggctagaaaaatatggcgtagaaagactaaaaagaatggccataagtggggatgattgcgtcgtcaaaccaatagacgataggtttgcgacagcacttacagccctgaacgatatgggaaaggtgcggaaagatattccgcagtgggaaccatccaaaggatggaacgactggcaacaagtaccattttgttcacaccatttccatcaattaataatgaaggatggaagagagattgtggtaccttgtagaaatcaagatgagttagttggtagggctagagtaagtcagggtgcagggtggagtcttagggaaaccgcatgcctcggaaaaagttacgcgcaaatgtggcaattaatgtatttccatagaagggatctaagactagcagccaacgcaatatgctccgctgtaccagttgactggataccgacatcgaggacaacatggtcgatccatgcccatcatcaatggatgacgactgaagacatgctatcagtatggaacagggtatggatagaagagaatccgtggatggaagacaagacacatatatcttcttggggcgacgtaccgtacctaggaaaaagagaagaccaatggtgtggaagccttattggattgactgcgagagcaacctgggcgacaaatattcaagtagcgataaatcaggttagaagattaatcggaaatgagaactacttagactacatgacaagtatgaagagatttaaaaacgaatcggatcctgaaggagctttatggtaa

SEQ ID NO: 22002 - RNA, 9879 nt, synthetic construct
  misc_feature 1..9879: note = derived and/or modified CDS sequence (opt6) from DENV-1__JQ045653__SS-prME
  source 1..9879: mol_type = other RNA
agtgtgacaatgttattaatgctcatgcccacagcactagcgtttcacttaacaacacgtggtggtgagccacacatgatagtgagtaaacaagagcggggaaaaagccttctatttaaaacaagtgccggtgtgaacatgtgtactcttatcgccatggacttaggagaattatgtgaagatacaatgacctataaatgcccgcgtataactgaaacagagccagatgacgttgattgttggtgtaacgcaacagacacttgggtaacttacggaacatgttctcaaactggcgagcatcgtagggacaaacgctctgtagcgttagcaccccatgtaggactgggacttgagactcgaaccgagacctggatgtcaagcgaaggtgcttggaaacagattcaacgcgtagaaacatgggctctcaggcatcctggctttacggtaatagctctatttttagcgcacgctatcggaacctctataactcagaaaggaataatatttatactacttatgctcgttaccccaagtatggctatgaggtgtgtaggaataggtagcagagattttgtcgaagggcttagtggagcgacctgggtagatgtggtgctagagcacggcagttgtgtcactaccatggctaaagataaaccgacactcgatatagaattgctaaaaacagaagtaactaatccagcagttttgcgcaaattatgcattgaagcaaaaataagcaacacaacaactgatagccgatgtccaacacaaggtgaagctaccttagttgaggaacaagacgcaaattttgtctgtcgacgaacgcttgttgaccgtggatggggtaacggttgcggcttattcggaaaagggtcattgataacctgtgcaaaatttaaatgtgtcacaaaactcgaaggaaaaattgtacaatatgaaaatctaaaatactcggtaattgtcacagtacataccggggatcaacatcaagtgggaaacgagagcacagagcatggaaccactgctactataacacctcaagcaccaaccacagagatacaattaactgattatggcgctctgacgctagattgctcaccgagaacaggactcgattttaatgaaatggtcctactaacgatgaaagaaaaatcgtggctggtacataaacaatggttcttagatttacccctcccatggaccagcggtgcgagtacgtcccaagaaacatggaataggcaagatctattggtaacctttaaaactgcccatgcgaagaaacaagaagtcgtagttttagggtcacaagaaggagccatgcatactgctctaaccggcgcaacagaaattcagacgtctggaactacgacaatatttgctggacaccttaaatgtagactgaaaatggacaaactgacgcttaaaggaatgtcttatgttatgtgtactggttcatttaagttggaaaaggaactagctgaaactcagcatggaactgtattagtccaaataaaatatgagggaacggacgctccctgcaagatacccttctcgactcaagacgaaaaaggagtcactcagaacggacgactcataacggctaatccaattgtgacagacaaagaaaaaccagtgaacatagaggctgagccaccctttggagaaagctacatagtcataggggccggtgaaaaagcgctaaaattgagttggttcaaaaagggaagtagtattggaaagatgtttgaagcaacggctcgaggtgcaaggcgaatggcaatactgggcgacacagcatgggacttcggaagtattggaggtgtttttacatcagtcgggaaacttgtacatcaaatctttggtacagcgtacggagtcttatttagcggagttagttggactatgaaaataggtatcggagtccttttaacttggttgggactaaattcaagatcaaccagtttaagtatgacatgtatagcagtaggcctggtgacgttatacttaggagtaatggtacaagcagactcgggttgtgtaatcaattggaagggcagggaattaaagtgcggctcagggatattcgttaccaatgaagtacacacgtggaccgagcaatacaaattccaagcggacagcccaaaaagattgagtgcagcaattggaaaagcctgggaagaaggggtttgcggtataagaagcgccacgagactagaaaatataatgtggaaacagatatcaaatgaattaaatcatattttgctcgaaaatgatatgaaattcacagtcgtagtaggagatgtggctggaatcctagcacaaggcaagaaaatgatcagacctcaaccaatggagtataaatactcttggaaaagttggggaaaagccaaaataataggtgcagatgtacaaaatactacatttataattgacggtcctaacacaccggaatgtccagatgaccaacgtgcttggaatatctgggaagtagaagattatggattcgggatattcacaactaacatctggcttaaattgcgggattcatacactcaggtctgtgaccatagattaatgagcgctgcgattaaagactcgaaagcagtccatgccgatatggggtattggatagaaagtgaaaagaatgagacatggaagctcgcaagagcgtcctttatcgaagtaaagacatgtatatggccccgatcacatactctttggagtaatggagtcctcgaatcggaaatgatcataccaaagatttacggaggaccaataagccagcataattatagaccgggatattttacacagactgcgggaccttggcatttaggaaaattggaattagatttcgatctgtgtgaagggacgacagttgtggtagacgaacactgcggaaatagaggcccctccttacgtacgactactgtaaccggaaaaatcatccatgaatggtgttgtcgttcgtgtacactaccgcctcttaggtttagaggggaagacggttgttggtacggaatggagattcgaccagttaaagaaaaagaggaaaacttagtaaagagcatggtaagtgcaggtagtggggaagtagatagcttctctctcggtttgttatgcatttcaatcatgatagaagaagtgatgagatcgagatggtccaagaaaatgctcatgacaggtacacttgcagtattctttttactaataatgggtcaacttacatggaatgacctaattaggttatgtataatggtaggagcaaatgcaagtgatcgtatggggatgggtaccacgtatcttgcattaatggctacattcaaaatgcgcccaatgttcgccgttggattactatttaggagattaactagcagggaagtgttattgttaacaattggcttatccttagttgcaagtgtggagctacctaactcactagaggagttgggagacggacttgcaatgggcataatgatcttaaaattattgaccgattttcagtcccatcaactctgggccactctgctcagcttaaccttcattaagaccacattctctctacactgtgcatggaagactatggcgatgatattaagcattgtgtccctattccctctatgcctttcaacaacaagtcagaaaacgacgtggctcccagtattgctgggtagtctaggatgcaaacccttgacgatgtttctgattgcagaaaataaaatatggggaaggcgttcctggccattgaacgaaggaataatggcagttggtatagtttctattctcttatctagtttgttgaaaaacgatgtacctctagctggccctctaattgctgggggtatgttaatagcttgctatgtaataagtggttctagcgcagatttgtcacttgaaaaagccgcagaagtatcctgggaagaagaggccgaacattctggtgcgagccataatattctagtagaggttcaagacgatggcacgatgaagataaaagacgaagaacgagatgacaccctaaccatattattaaaggcaacattacttgcggtttctggagtgtatcccctatccattcccgctacattgtttgtgtggtatttttggcagaagaagaaacagcgaagtggagtactgtgggatactccttcacctccagaggtagaaagagctgttctcgatgatggaatatatcggattatgcaaagaggactgttaggaagaagtcaggtaggggtgggtgtatttcaagaagatgtatttcatactatgtggcatgtgacaaggggcgcggtattaatgtaccaaggaaaacgattagaacccagctgggcatcagttaagaaagatttaatatcatatggaggtggatggaggttacaaggttcttggaatacaggggaagaggtacaagttatagctgtagaacccggcaaaaatccaaagaacgtacagactgctccgggcactttcaaaacaccggaaggtgaagtcggtgcaatagctcttgactttaaaccgggcacatccgggagtccaatcgttaaccgagaaggaaaaatcgtgggattatatgggaacggagtcgtcactacgtccgggacttatgtttcagcaatagcgcaagctaaagcctctcaagaagggcctttgccagagatcgaagatgaggtgtttcgaaaaagaaacctaaccataatggatctccatccgggttcaggaaagacaagacgttatttaccagcaatagtgcgggaggccataaaaagaaagttgagaacgctaatcttagctccgactagagttgtagcttcagagatggcggaggccttaaaaggaatgccgattagatatcaaacgacagcagtaaaatccgagcatactggaaaagagattgtagaccttatgtgtcatgcgacatttacaatgagactgttaagtccagtgagggttcctaattacaatatgataattatggacgaagctcattttacagaccccagttctatcgctgcgcgaggatacatttcaacaagagtgggtatgggtgaggccgcagctatttttatgactgcgacaccgccaggaagtgtggaggcctttccacaaagtaacgcagttattcaagacgaagaaagagatataccggaaagatcatggaactctgggtatgaatggatcactgatttcccagggaaaacggtttggtttgtccctagtataaaatccggcaacgacatcgctaactgcttacgtaaaaatggaaagcgagttatacaactcagtagaaaaacatttgatactgaatatcagaaaactaagaataacgattgggactatgtagtaactacagacattagtgaaatgggggcaaactttagagctgatcgagtaatagatccaagacgttgtctaaagcctgttattttgaaagacggaccagaaagagtaatactagcagggccgatgccggtgacagtggcatcggccgctcaacgcagagggaggataggacgtaatcataacaaagaaggagatcaatacatctacatggggcaaccattaaataatgacgaggatcatgctcattggacagaagcaaagatgctattagataacatcaacacacccgaaggtataattcccgcgctatttgaaccagaaagagaaaaatctgctgcaattgacggagaatatcgccttagaggagaagccagaaagaccttcgtagaactgatgagaagaggggatctgccggtctggttatcatataaggttgcgtcagagggatttcaatattcggataggcgatggtgtttcgatggtgaacgtaacaatcaagttctggaagaaaacatggatgtagaaatatggacaaaagaaggcgaacggaagaaacttcgaccaagatggctcgacgcacgaacatacagtgaccctctagctttacgagaatttaaagaatttgcagctgggcggagaagtgttagtggagatctaatattggagataggaaaactcccccaacacctaacccaacgcgcccaaaatgctttggacaatttagttatgttacacaactcagagcagggaggaagggcatatcgacatgcaatggaagaactccccgacacgatcgaaacacttatgctactagccttaatcgcagtgctaacaggtggtgttacattattctttttgtcaggccgtggattaggcaaaacaagtattggacttctatgtgtcatggcgagttcggtacttctctggatggcatcagtggaaccgcattggatcgccgcaagtattatactcgagttctttttaatggtactgctaatacctgaaccagatcggcaaagaaccccacaagataaccagttagcttatgttgtgattggattgttatttatgattttaacggtagccgcaaacgaaatgggtctccttgaaaccacgaagaaggatttaggaatcgggcatgttgctgtagaaaatcaccatcatgcagctatgcttgatgttgatttgcaccctgcgagtgcttggaccctttatgctgtcgcgaccactatcataactcctatgatgcgtcacacaattgaaaatacaacagctaatatttcattaacggctatagcaaaccaagctgctatattgatggggctggataaaggctggcccatatctaagatggatataggtgttccactactagcacttggatgctatagtcaagttaatcccttgacgctaacggctgcagtattaatgctcgtcgctcattacgccataatcggcccaggattgcaagctaaagcaacgagagaggcgcaaaaacgcacagctgctggcatcatgaagaatcctacagttgacggaattgttgcgattgatttagatccggtagtttacgacgccaaatttgaaaaacaactcggtcaaataatgctactgattctatgcacaagtcaaatccttctaatgagaactacttgggctttgtgtgaaagtatcacgctcgccactggacccctaacaacactctgggaagggtctccagggaagttctggaacactacaatcgccgtaagcatggcaaatatctttcggggctcctacttagccggtgctggcttagcgttttctctaatgaaatctttaggtgggggccgaagaggtactggagcccaaggagagacgttaggagaaaaatggaaaagacaactaaaccaactgagcaaaagtgaatttaatacatacaaaagatccggtatcatggaagtcgaccggtccgaagcaaaagaaggcctcaagcgaggcgaaaccacaaaacatgcagtgagtagaggaactgcaaaactaaggtggttcgtagaaaggaacttggttaaaccagaaggaaaagtaatcgatcttggctgcggacgcggcggttggtcctattattgcgccggattaaagaaagtaacagaggtaaaaggatacactaaaggagggcctggacacgaggaaccgatcccaatggccacatatggatggaatttagtcaagttacactcgggcaaagatgtattctttataccgcccgaaaaatgtgataccctcctatgcgatattggcgaaagttcacccaatccaaccatagaagagggtcgaacattacgtgttctaaaaatggttgaaccatggctaagaggaaatcagttttgtataaaaattttaaacccgtatatgccgtctgtggtagaaacgctagaacaaatgcaacgaaaacatggtgggatgttagtcagaaatccattgtctagaaattccactcatgaaatgtattgggttagttgtggaacgggtaacattgtttcggccgtcaacatgacatctagaatgctactaaaccgtttcacaatggcgcataggaagccaacctatgaaagagacgttgacttaggtgcagggactcgtcacgtagctgttgaaccagaagtcgctaacctcgatattattgggcagagaatagaaaatataaagcacgagcataaatcaacatggcactatgatgaagataacccatataagacttgggcttatcacggtagctacgaggttaaaccaagcggaagtgcgtcatcaatggtgaatggtgtggtaaaattgttaacaaaaccatgggacgtaatccccatggtaactcaaattgcaatgacagatactacaccatttggtcaacaaagagttttcaaagaaaaagtagatacacgaacacctaaagccaagagaggcacggcacagataatggaagtaaccgcgaagtggttatggggcttcctttctaggaacaagaaaccccgaatttgcacacgggaggagttcacccgaaaggttcgatcgaacgctgcaataggagcagtctttgtcgatgaaaatcaatggaacagtgctaaagaagctgtagaggatgagaggttctgggacttagtgcatagggagagggagcttcacaaacaaggtaaatgtgcaacatgtgtgtacaacatgatggggaaaagggaaaagaagctgggagaatttgggaaggctaaaggctcgagagcaatatggtacatgtggttgggggctagattcttggagttcgaagcgcttggatttatgaacgaagatcattggttctcaagagaaaattcattatcaggtgttgaaggggagggactacataagctaggatatatacttagagatataagcaagatcccaggtggaaatatgtacgcagacgacacagcaggctgggatactcgaattactgaggatgacctccaaaacgaagctagaataacagatatcatggaaccagaacacgcattattagctaagagtatattcaaactaacctatcagaacaaagtggttagagtacaacgcccagctaaaaatggcacagtcatggatgtcatcagtcgaagggaccagagaggatcaggacaagttggaacatatggcttgaatacattcacaaatatggaagcacaacttattaggcaaatggaatctgaaggtatatttagtccatctgagttggaaacaccgaacttagcagaaagggttctagactggttagaaaaatacggcgtcgaacggcttaaaaggatggcgatatctggcgacgactgcgtagttaagccaattgacgatcgatttgccactgctctaaccgctttgaatgatatgggaaaagtacgaaaagacattcctcaatgggaaccttcaaaaggatggaacgattggcaacaagtacctttttgttcgcatcacttccatcagttaataatgaaagatggaagggaaatagttgtcccatgccgaaatcaggatgaactcgtaggcagggcacgtgtttcccaaggggccggatggtcactgcgtgagaccgcatgtctgggtaaaagttacgcacaaatgtggcaacttatgtactttcatcgaagagatttacgactcgctgcgaatgctatatgctcagcagtcccagtagattggattccgactagcagaaccacctggagcattcatgctcatcatcaatggatgaccacggaagatatgctctccgtttggaacagggtctggatcgaggaaaatccctggatggaagataagactcacattagttcctggggagatgtcccatacctaggtaagagagaagaccaatggtgcggcagtctaatagggttaacagccagggctacctgggccacaaacatccaagtggctattaatcaagtcagaagattaataggtaatgagaattatctagactatatgacgtctatgaaaagatttaagaacgagtcagaccctgaaggagctctatggtga

SEQ ID NO: 22003 - RNA, 9879 nt, synthetic construct
  misc_feature 1..9879: note = derived and/or modified CDS sequence (opt6) from DENV-1__JQ045657__SS-prME
  source 1..9879: mol_type = other RNA
tctgttactatgttacttatgctaatgcctacagctttggcattccacctaactactagaggaggagaaccgcatatgatcgtgtccaaacaagaaagaggaaaatccttattattcaaaactagcgcaggagtaaacatgtgtaccttaattgcaatggacttaggagagttctgtgaagatacaatgacttataaatgtccgagaataacagaagcagaaccagacgatgttgattgttggtgtaatgctactgacacatgggtaacctatggtacctgttctcaaacgggagaacataggagggacaaacggagtgttgccttagcgcctcatgtaggtctgggtctagagacacgtacagaaacttggatgtcttcagagggtgcatggaagcaaatacagagggtagaaacgtgggcactaagacatccagggttcacagtaatagcactctttctagcccacgcaatcggtacttctattacgcaaaaaggaattatattcatactgctcatgttagtcacaccttcaatggccatgagatgcgtaggaattgggagtagagatttcgtggaaggactaagcggagccacctgggtagatgtagtcctagaacatggaagttgcgtgactactatggctaaagataaaccaacactcgatattgaattattaaagaccgaggtaacaaatcctgctgtacttcgaaaactgtgtatagaagcaaagatatcaaacactactaccgatagtcgatgcccgacccaaggtgaagcaaccttagtcgaggaacaagacgcaaactttgtgtgtagaagaacatttgtagacagaggttggggaaacgggtgtggacttttcggaaagggaagcctaattacttgcgcgaagttcaaatgcgttacaaagttagaaggaaaaatagttcaatacgaaaacctgaaatactccgtcatcgtaacagtccacacgggagaccagcaccaagtgggaaacgaatcaacagaacacggaacaactgccaccattacacctcaagctccgtccacggaaatacaactaaccgactatggtgctctaacactagattgtagtcctagaaccggactagatttcaatgaaatggtccttttaacaatgaaagagaaaagctggttggttcataaacaatggtttttagatcttccattaccatggacatcgggtgcctcgacctcccaagaaacctggaaccgtaaggatttgctagtaacatttaaaacagcccatgccaagaaacaagaggttgttgtcctaggatctcaggagggtgcaatgcacacggcattaacaggagcaacagaaatacagacaagcggtacgacaaccatctttgcgggacacttaaaatgtaggttgaaaatggacaaattaacccttaaaggtatgtcgtatgtaatgtgtacggggtcctttaaacttgaaaaagaagtagcagaaacacagcacggtactgtactggtacaaatcaaatatgaaggaaccgatgccccatgtaaaatccctttcagcacccaagatgagaaaggtgtcactcaaaatggtcggttaatcactgcgaatccaatagtaacagacaaggaaaaaccggtcaatatagaagcagagccaccattcggagaatcatacatagtaattggagcaggagaaaaagccttaaaactctcctggttcaagaaaggaagttcaattggaaagatgtttgaagcaactgcgagaggggcgcgaagaatggcaatattaggagatacagcctgggattttggatctataggaggggtatttacaagtgtgggcaaattagtacatcaaatttttggaactgcctacggagtactattttctggcgtaagctggacaatgaaaatcggaattggggtactactcacgtggcttggacttaactctaggagcactagcctatcaatgacctgtatagcagtcggacttgtgacattatacttaggagtaatggtacaagccgacagtggatgtgttataaattggaaaggacgggaactaaaatgtggatcaggaatatttgttacaaatgaagttcatacttggacagaacaatataaatttcaagcagactcaccgaagaggctatcggcagctattgggaaagcatgggaagaaggtgtttgcggcattcgaagtacaaccagactagaaaatataatgtggaagcaaataagtaatgaattaaaccatatacttctagagaatgacatgaaattcaccgttgtagttggggacgtagcgggcattctagctcaaggaaagaaaatgatcaggccccaaccgatggaatataaatattcatggaagtcctggggaaaagccaagataataggcgccgatgtacagaatacaacctttattatagacggacccaatactccggaatgccctgacgaccagagggcatggaacatctgggaagttgaagactatggatttgggatttttacaaccaatatatggttaaaacttcgtgatagctacacgcaagtttgtgatcacaggttgatgagtgcagctattaaagatagtaaagctgttcacgcagacatgggatactggatcgagtccgagaaaaacgaaacatggaaactagctagggcatcttttattgaagtaaaaacgtgtatatggccgaaaagccatactttgtggtcaaacggagtgttggagagtgaaatgatcataccgaaaatatatggcggtcctatttcgcagcataactatcgaccagggtatttcacacaaactgctggcccgtggcatttaggcaaattagaattggacttcgatttatgcgaaggaactaccgtagtcgtagacgaacattgtggcaataggggacccagcttacgtacgactacagtaaccggcaagataattcacgaatggtgctgtcgctcatgtacattaccacctctccgatttaaaggcgaagatggctgctggtacggaatggaaattagaccggtcaaagagaaagaagagaatctagtaaaatccatggtttctgcaggaagtggagaggtagatagcttttcccttggtctcttgtgtattagtattatgatagaggaggtaatgaggagtcgatggtctagaaaaatgctaatgacaggaaccctagccgtattctttctattaatcatgggccaacttacctggaacgacctaatcaggctatgtataatggtaggtgctaacgcatcagatagaatgggtatggggacaacatacttagccttaatggcaacctttaaaatgagaccaatgtttgccgtaggactcctatttaggcgactcacgtcacgggaagttttactcttgacgataggtttgtctttagtcgccagtgttgaactgccaaacagccttgaagaattgggtgacggtttagcaatgggaattatgatattaaaactactaacagactttcaatcgcaccaactttgggcaacattattatcactaacctttataaaaacaacattcagtctccattacgcatggaaaacaatggcaatggtattatcgattgtcagcttgttcccattatgtttaagcacaacttcacaaaagacaacatggcttcctgtgttgttaggtagtttaggatgcaaaccgttaacaatgttcttgatagcagagaacaaaatctggggacggaaatcatggccactcaacgagggtatcatggccgttggcatcgtttcaatacttttatcaagtcttttaaagaatgatgttccattggcaggcccactcatcgcaggaggcatgttaattgcctgttatgtcataagcgggtccagcgcagatttatcattggaaaaagcagcagaggtgtcgtgggaagaggaagccgagcattcgggagcttcacataatatcttagtagaggtccaagatgacggtacaatgaaaataaaagatgaggaacgcgacgatacattaacaatactactgaaagcaacattgcttgctgtgtccggcgtgtatcctctcagcatcccggcaactctattcgtttggtatttttggcagaaaaagaaacaaaggtcaggcgtattgtgggacacaccaagcccgcctgaagttgaacgggccgttttagatgatggaatttaccgtattatgcagagaggtctgctaggcaggagtcaggttggtgttggcgtttttcaagaaaacgtttttcacactatgtggcatgtgacacggggagctgtattaatgtatcagggtaaacggcttgagccatcatgggcctcggtcaagaaagatctaatctcctacggcggaggatggcgattacaaggatcttggaatacaggagaggaagttcaagtgattgcagttgaaccaggcaaaaatcctaaaaacgttcaaactgcccctggaacattcaaaacttcagaaggtgaagtcggcgctatcgcactcgatttcaaacctggaacctcaggtagtccaattgtaaatagggagggcaaaatagttggcctgtatggaaatggtgttgtaaccacatccggtacgtatgtctctgcaatagcccaagcaaaagcctcacaagagggccctttaccggaaattgaagatgaagtattccgtaaaagaaacctcacaattatggatctacacccaggaagtggcaaaacgcgacgatacttacccgccatagtaagagaagccattaaacgaaaactgcgaacactgatactagcaccaactagggtagttgcatccgaaatggcagaagcattgaagggaatgccaattagatatcagacaacagcagtaaaatcagagcatactggaaaggaaatcgttgatttgatgtgtcacgcgacgttcacaatgaggttgctatcgcccgttagagttcctaactataatatgattataatggacgaagcacactttacagacccctcatctatagcagcacggggctatataagcacacgtgtaggtatgggtgaggctgctgctatatttatgacagctaccccaccaggatccgttgaagcctttccccaaagcaatgctgtaattcaagatgaggaaagagacattcctgagcgtagctggaactcgggatatgaatggataactgactttcctggcaagactgtctggtttgtaccatcaattaaatccggtaatgacatcgcaaactgtttaaggaaaaacggaaaaagggtaattcagttatctagaaaaaccttcgatacagaataccaaaagaccaaaaataatgactgggattatgtagtgacgacggatatttcagagatgggagcaaacttcagggcggatcgtgtcatagatccgagaaggtgcctgaaacctgtaatattaaaagatggtcctgaaagggtaatactcgcaggccctatgccggtcactgtagctagcgccgctcaacgacgtggccgaatcggtcgcaatcataataaggaaggagatcaatacatttacatggggcaacctttaaataatgacgaagaccacgcgcattggacagaagctaagatgctattggataatataaatactcccgaaggaataatcccagcccttttcgagccagagagagaaaaatcagcagctatcgatggggaatatcgattacgaggtgaagcaagaaaaacctttgtagaactaatgcgacgaggcgacctgccggtatggctcagttataaggttgctagtgaagggtttcaatacagcgacagaagatggtgcttcgatggagagaggaacaatcaggtgttagaagagaatatggatgttgagatctggactaaggaaggtgaaaggaagaaattgcggccacgctggttggatgcaagaacctattcagacccactagcgttgagagagtttaaagaatttgcggcaggacggaggagcgtgtccggcgacttgattctggaaattggtaagctcccacaacaccttacacagagagcacaaaatgctctagataacttggtcatgttacacaattccgagcaaggaggaagggcatatcgtcacgcaatggaggaactacctgatactatagagacgctaatgttattagctttaatcgcagtacttacaggcggagttacactattctttctttctggacggggtcttggtaaaacttctataggtttattatgcgtcatggcatcatccgttttattatggatggcgtcagttgaaccccactggatagcagcaagtatcattcttgagttctttctgatggtgctacttattccggaaccagatcgccaaaggacaccgcaagataaccaattagcatacgtagtaattggattgttattcatgatattaacagttgcggcaaatgaaatgggcctattagaaaccacgaagaaagatttagggataggacacgttgccgcagaaaaccatcaccacgctgctatgttagacgtcgatctgcatcccgcttctgcatggacgttgtacgcagtcgcaacgacgataatcacccctatgatgcgacatacgatagaaaatactacagctaacatatccttaacagccatagcgaaccaagccgcgatattaatgggtcttgacaaaggctggccaatttcgaaaatggacataggagtaccgctgttagcgctaggttgttatagtcaagttaatcctcttactttaacagcagctgttctcatgcttgtagcccactatgcaatcattggccctggattacaggcaaaagcaaccagagaggcgcaaaagagaactgcagcagggataatgaaaaacccaactgtggatggaatagtagctatagatctagatccagtcgtatatgatgcgaaatttgaaaaacaattgggtcaaataatgctactaattctatgtacatcgcaaattcttctgatgcgtacaacatgggctttatgtgaatctatcacgttagctacaggaccactaaccacactatgggagggatcaccgggaaagttctggaacacaaccatagcagtatctatggcaaacatattccgaggaagttacctagcaggcgcaggactggctttcagtttaatgaaaagccttggaggagggagaaggggcacgggcgcacagggagaaactttaggagagaagtggaaacgccaacttaatcaactatcaaaaagtgaatttaatacatataagcgttccggcataatggaggttgacagaagtgaagctaaggagggattgaaacgaggggaaacgactaaacatgcagtgagtagaggtactgcaaaactaaggtggtttgtggaaagaaatctagtcaaaccagaaggcaaggtaatagacctaggttgcggccgaggtggatggtcatactattgtgctggcctaaagaaagttacagaggttaagggctatactaaaggaggtccaggacatgaagaaccaataccaatggccacttacggttggaacctagtaaaacttcatagcggcaaggatgtcttctttgtaccaccggaaaaatgtgatacgctcttgtgcgatattggagaaagctcacctaatcctacaattgaagaaggaaggacacttagagtattaaaaatggtcgaaccatggctgcgtggaaaccaattttgtataaaaatcctgaatccctatatgccttccgtagtggaaacattagaacagatgcaaagaaaacacggtggtatgctcgtaagaaatccactatctcgaaattcaacccatgagatgtactgggtatcatgtggaactggtaacattgtatcagcagtaaatatgaccagtcgaatgctccttaataggttcacaatggctcaccgaaaacctacttatgaaagagatgtagatcttggtgcgggaacgcgccatgtcgctgtagaacctgaagtagcgaatctagacataattgggcaaagaatcgagaacattaaacacgaacataaatcaacatggcattatgatgaagataatccctataagacatgggcctaccatggcagctatgaagtgaaaccatctggtagtgctagcagtatggtcaacggcgttgtcaagctattgactaagccttgggatgtcataccaatggttacgcaaatagccatgacagacacgacaccatttggacaacaaagggttttcaaagaaaaggttgacacacgaacgcccaaagctaaaaggggaacagcacagataatggaagtaacggcgaaatggttgtggggatttctaagcaggaacaagaaacccagaatatgtactagagaagagttcacgaggaaagtaagatccaatgctgccataggggcagttttcgtcgacgaaaatcagtggaactccgccaaagaagccgttgaagatgaaaggttttgggacttagtacatagagaacgagaattacataagcaaggcaaatgtgccacttgtgtgtataacatgatgggtaaacgggagaagaaattgggagaatttggcaaggcgaaaggctcacgggcaatttggtatatgtggctcggagccaggttcctagagttcgaagcactaggcttcatgaatgaagatcattggttttcaagagaaaactctttatctggtgttgaaggtgaaggactgcataaattaggatatatcttgcgggatatcagtaaaatcccaggcgggaatatgtatgcagacgatacagctgggtgggacacaagaatcacagaagatgacctgcagaacgaggctcggataactgacattatggagccagaacatgcactgttggctaaatcaatttttaaacttacatatcaaaataaagtcgtgagagttcaaagaccggccaaaaatggaacagtaatggatgtaatatctagacgcgatcagcgaggatcggggcaggtaggtacatacggtctgaatacctttaccaacatggaagcacaactaattagacaaatggaaagcgaagaaatattctcaccgtcggaattagaaacacctaatcttgcgggaagagtattagattggctagaaaaacatggtgtagaaaggctaaagaggatggccattagcggagatgattgtgtcgttaaacccattgatgatcggtttgctactgcactaactgcactaaatgacatgggaaaggttagaaaggatataccgcagtgggaaccctcaaagggttggaatgactggcaacaagtgccgttttgttctcaccactttcatcaattaattatgaaggatggtagagagatagtagtgccatgtcgaaaccaggacgagctagttggccgcgccagggtaagtcaaggagcaggttggtctctgagagaaactgcctgtctagggaaatcatacgcacagatgtggcaattgatgtactttcacagaagagacctaaggttggcagccaatgctatttgtagcgcagttccagttgactgggtcccaacaagtcggacgacatggagcatacatgctcaccatcaatggatgactacagaggatatgctgagtgtgtggaatcgagtttggatagaagaaaatccgtggatggaggacaagacacatatatcatcatggggtgacgtgccatatttaggcaaaagagaggaccaatggtgtggatctttaataggcctaactgcgcgagctacatgggcaactaatatacaagtcgcaattaaccaagttagaagacttataggaaatgaaaattatttagattacatgacctcaatgaagcgtttcaaaaatgaatctgacccggagggtgcgctatggtaa

SEQ ID NO: 22004 - RNA, 9879 nt, synthetic construct
  misc_feature 1..9879: note = derived and/or modified CDS sequence (opt6) from DENV-1__JQ045659__SS-prME
  source 1..9879: mol_type = other RNA
tcagtaactatgttattaatgttgatgccaacagcattagcatttcatctcacaactagaggcggagaaccccatatgatagtatccaaacaagaacgaggtaaatccttattgttcaaaacaagcgctggtgtaaatatgtgcacgttaatcgcaatggatttaggtgaattatgcgaagatacaatgacatacaaatgtccaagaattacagaaacggaacccgatgatgtagactgttggtgtaatgcaactgacacatgggttacctacggaacctgctctcaaacaggggaacaccgcagagataaaagatcagttgcactagctccgcatgtaggtctcgggctagaaacaagaaccgaaacgtggatgtcatcagagggagcctggaaacaaattcaaagagtggaaacctgggcacttagacatcctggatttactgtaatagctctgtttctagcccatgcaataggaacgagtattacacaaaaaggaataatatttattcttttaatgttggtaaccccaagcatggcgatgagatgtgtaggaatcggatcgagagactttgtagaaggtttgtcaggcgctacgtgggtagatgtcgttctagaacacggaagctgcgtgacgactatggccaaagacaaacccacgttagacatagaattactaaaaacagaggttaccaatccagcagtacttagaaaattatgcattgaagcaaaaataagtaacacaactaccgactcacgttgccctactcaaggagaagcaacattggtagaagaacaagacgcgaacttcgtttgtcgacgaacttttgttgatcgaggatggggcaatggatgtggtttattcggaaaaggctccttgattacgtgcgctaaatttaaatgcgttacgaaattagaagggaaaattgtacagtatgaaaaccttaaatactctgttattgtaacagttcatacaggagaccaacatcaagtgggtaatgaatccacggaacatggaacgacagcaacaataacaccacaggcacccacaacagagatccagcttacagactatggggctttaactctagactgctcgcctagaacaggattagacttcaacgaaatggtcttgcttactatgaaagagaaaagctggcttgtccacaaacaatggtttttggatctacctctcccctggacctcgggagcatcgacgtctcaagaaacgtggaatcgtcaagatctgctagtaacatttaaaacggctcatgccaagaaacaagaagttgttgttctaggatcacaagaaggagctatgcataccgctttgacaggagctacagaaattcaaacatcagggactacgacgatctttgccggacatctaaaatgtcgactaaaaatggataaattaacactcaaaggaatgtcctacgtaatgtgtactggttcttttaaattggaaaaagaagttgctgaaactcagcacggaactgtcctggtacaaataaaatatgaaggtacggacgccccatgcaaaatacccttctcaacgcaagatgaaaaaggtgcgactcaaaacggtcgactaataacagcaaatccaattgtgactgataaagagaaaccggtaaatatagaagctgaacctccatttggggaaagctatatagtcataggagcgggcgaaaaagccctaaaattatcctggttcaagaaaggatcaagcattgggaaaatgtttgaagcaacggccaggggcgctagaagaatggccatactcggcgacacagcctgggattttggatcaatcggaggggtatttacatccgtcggcaagttagtacaccagatatttgggacagcatacggagtacttttcagtggagtatcatggacaatgaaaatagggataggtgtattactgacttggttgggactgaactcaagaagcacatccctttctatgacatgtatcgctgtcggcctagtaactttgtatctgggggtgatggtacaagcagacagtggatgcgtaataaattggaaaggtcgcgagctaaaatgtggctcaggaattttcgttacaaatgaagtacatacatggactgaacaatataaattccaggcagacagccctaaaaggctatccgcggctatagggaaagcctgggaggaaggtgtatgtggcatcagatcggcgacccgattggagaatattatgtggaagcagatatcaaacgaattaaatcacatattgttagagaacgatatgaagttcactgtcgttgtaggagacgtaacaggaatattggcgcaaggcaagaaaatgataagaccacagcctatggaatataaatactcgtggaaatcatggggaaaagcaaaaattatcggtgccgatgtccagaataccaccttcataatcgacggtccaaacacgcctgaatgcccggatgatcaaagagcctggaatatttgggaggtggaagattatgggttcggaatattcacaacgaatatttggttaaaactaagagatagtcatacccaagtttgcgatcacagactgatgtcagctgctataaaggattctaaagccgtacacgccgacatgggttattggattgaatccgagaaaaatgaaacgtggaagctagctagagcgtcctttatagaagttaaaacatgcatctggccaaaatctcatacattatggagcaatggggtacttgaatctgaaatgataattccaaagatatacggtgggccaataagtcagcataattataggccaggatacttcactcaaaccgcagggccttggcacttaggtaaactagaattagactttgatctatgtgaaggcacaacagtcgcagttgacgagcactgtggaaatcgtggaccatccctgcgaaccaccacagtcacaggaaaaattatccacgagtggtgctgtcggtcctgtactcttccgcccctacgatttagaggtgaagatggttgctggtatggaatggaaattcggcccgttaaagaaaaagaggaaaatcttgtaaaatcaatggtatctgccggaagtggggaagtagactctttctcactcggtttactatgtatatcgatcatgatagaggaagtaatgagaagtcgatggtctagaaaaatgctaatgactggtacacttgccgtattctttcttctaattatgggacaattgacatggaatgacctaattagattatgtattatggtaggtgctaatgcatcagaccgaatggggatggggacaacatacttggctttaatggcaacttttaagatgagaccaatgtttgccgttggtctactttttcgtcgtttaacgtcacgcgaagtacttctcttaaccataggacttagcttagtcgcctcaatggaattaccaaattcgttagaagaactaggtgacgggctggcgatggggatcatgattctcaaactattaacggatttccaatcgcaccaactttgggctacgctattgagtcttactttcatcaagactacattttcattacattacgcatggaagactatggctatggtcctatctattgtaagcctattcccactatgcttaagtactacttcacagaaaactacatggttgcctgtccttttgggctcacttggatgtaagccattgaccatgtttctaatagcagagaataaaatatgggggagaagatcttggccattaaatgagggaattatggctgttggtatagtctcaatattattgtcatcacttcttaaaaacgatgtacccctagcaggtcctcttattgcaggcggcatgcttatagcgtgttatgtaatatcaggatcaagtgctgacctatcgctagaaaaagctgctgaagtgagttgggaaaaggaagctgaacactctggagccagtcataatatcttagtagaagtccaagatgatggtacaatgaaaataaaagatgaagaacgagacgatacattaacaattttactaaaggcaacactcctcgcggtttctggcgtgtatccactttcaataccggcgacattattcgtttggtatttctggcaaaagaagaaacaaagatcaggagtgttgtgggatacaccatcaccgccggaagtagggcgagcagtattagatgacggaatttatcgaattatgcaaaggggactattggggagatcacaggtaggtgtgggagttttccaagaaaatgtctttcacactatgtggcatgttacccgcggggccgtattaatgtatcaagggaaaaggctagagccctcatgggcaagtgtcaagaaagatttaatatcatatggcggagggtggagactacagggcagctggaataccggagaagaagtccaagttatagcagtagagccaggtaaaaatcccaaaaacgtccaaacagcaccgggaacatttaaaactccagaaggtgaagttggcgcaatagcattagattttaagcccggtacaagtggatccccgatcgtgaatcgtgaaggaaaaatagtagggctttacggtaatggagtagttacgacctctggtacgtatgtatccgccatagctcaagcaaaggcttctcaggaaggtcctttgccggagatagaagacgaagtattcagaaaaagaaacttaaccataatggatctccaccccggctcaggcaagacacgtcgttacttaccagctatagtgagggaagctataaaaagaaaattacgcacgcttatcttagctcctacacgtgtcgtcgcatccgaaatggccgaagcacttaaaggaatgccaatccgataccagactacagcggtcaaaagcgagcacacaggaaaggagattgtcgatctaatgtgtcacgcaacattcacaatgcgactacttagcccagtaagagtgccaaattataatatgattataatggacgaagctcactttactgatccttcatccatagcagcccggggatatatatctacgagagtaggtatgggagaagcagcagccatatttatgacagccacaccccctggatccgtagaagcattcccgcaatcgaacgcggtcatacaagacgaagaaagagatataccggaaagaagttggaactctgggtatgaatggattacagactttcccggcaaaacggtgtggttcgttccaagtataaagtctggtaatgatatagcaaattgcctacgtaaaaacggaaaacgagtaatccaattaagcagaaaaactttcgacacagaataccagaaaactaaaaacaatgactgggactatgttgtaaccacagatatttccgagatgggggcaaactttcgggctgacagggttattgacccccgccgatgtttaaaacccgtgatattgaaagatgggccagaacgagttattctcgcaggacctatgccagttactgtagcatcagctgcacaaaggcgtggccgtattggccgcaatcataacaaggagggagaccagtatatttacatgggacaacccttgaacaacgacgaagaccacgctcactggaccgaggctaaaatgctactcgataacatcaacacacctgaaggcataattcccgctctttttgagcccgaacgtgagaaaagtgctgcaattgacggtgaataccgacttcgtggtgaagcacgcaaaactttcgttgaactaatgagaagaggagatttaccagtttggctgagttataaggtagccagtgaaggtttccaatatagtgacaggcgctggtgtttcgatggagaaaggaacaaccaagtattggaagaaaatatggatgttgagatatggactaaagaaggagaacggaagaaattacgaccccgttggctagatgcgcgtacctattctgacccgttggccctcagggagttcaaagaatttgccgcaggaaggagaagcgtctcgggcgacttaattttagaaataggcaaattaccacagcatttgacccaacgagcccaaaatgccctagacaacttagtcatgctccacaactcggaacagggtggccgggcttatcgccacgcaatggaagaattaccagacacgattgaaacgcttatgctcctagctcttatagcagtgctcaccggtggcgtaactctcttctttctatctggaaggggcttggggaaaacctcaataggactactatgtgtaatggcatcgtctgttttactctggatggcaagtgtcgaacctcactggatagcagcctcaatcatactcgaatttttcctcatggtcctattaattccagaacctgatcgccaaagaacaccgcaagataatcaattagcatatgtagtaatcggactcctgtttatgatactaacagttgctgctaatgaaatgggcctattagaaacaactaagaaagatctaggaatagggcacgtggcagtagaaaatcaccatcacgcggctatgctagatgtagacttacatccagcttcagcttggacactatatgctgttgctacaacaataattacaccgatgatgcgacatacaatcgaaaacaccacggcaaatatctcacttacagctattgcaaatcaggccgcaatattaatggggcttgacaagggctggcccatttcgaaaatggatataggtgtgccattgctcgcactcggatgttactctcaagtaaaccctctaacacttacagcagcggttttaatgcttgttgctcattacgcaattatagggcctggtctacaggcaaaagcaactcgcgaagcacaaaagcgtactgccgctggtattatgaaaaacccaactgtagacggcattgttgccatcgatctagaccctgtagtttacgatgccaaatttgagaaacaacttggccaaataatgctacttattttatgtaccagtcaaatactattaatgagaaccacttgggcgttatgcgaatctattacactagcaacaggaccactaactactttatgggagggttcaccaggaaaattttggaatactaccatagctgtctctatggccaatattttcagaggtagttatctagccggtgctgggttagctttcagcctaatgaaaagtctagggggaggtagaagaggtactggagcacaaggcgaaaccctaggtgaaaaatggaaaaggcagttgaaccagttatcaaaatcggagttcaatacgtataaaaggagcgggataatggaagttgatcgaagtgaggccaaagaaggtttaaaaaggggagagactactaagcatgccgtttctaggggtaccgcaaaactaagatggttcgtcgaaaggaacttagttaaacctgaggggaaagtaatagatcttggatgcggaagaggcggttggagttattattgcgcgggactgaagaaagtcaccgaagtgaaggggtatacgaagggaggtcctggtcacgaagaacccataccgatggccacatatggatggaatcttgtaaagctccattctggaaaggacgtgtttttcatccctccagaaaagtgtgatactctactgtgtgatataggagagtcaagtccaaacccaactattgaggaaggtaggactcttcgtgtcctcaaaatggtggagccttggttaagaggaaatcaattttgcataaaaatattaaatccatacatgcctagcgtagttgaaacattagaacaaatgcaacgaaaacacgggggtatgttagtaagaaacccgttatctagaaattcaacacatgaaatgtactgggtaagctgtgggactggcaatatagtgagtgcagtaaacatgaccagcagaatgctgctaaataggttcacgatggcacataggaagccaacttacgaaagggatgttgatttaggcgcaggcactcgtcatgtagctgttgaacctgaggtggcaaatttagatataataggtcaaagaatagaaaacataaaacatgaacataagtcaacgtggcactatgacgaggacaacccatataagacatgggcataccacggaagttatgaagttaaaccttcaggatccgcatcgagtatggtaaacggtgtagtcaagctcctcaccaagccttgggacgtcatacctatggttactcaaattgcaatgaccgacacgactccatttggacaacaacgagtcttcaaagaaaaagtagatacaagaacgccaaaggcaaagcgcggcaccgctcagatcatggaagtaaccgctaaatggctctgggggttcctgtcgagaaacaagagacctcgtatttgcacgcgagaagaatttacacgtaaagtgagatcaaatgcagccattggtgctgtcttcgtagacgaaaatcagtggaactctgcaaaagaagcagtagaagacgaaagattctgggacctggtacatagggaacgagaattacacaagcaaggaaaatgtgcaacttgtgtctacaatatgatgggaaaacgagagaagaaacttggcgagtttgggaaagcaaaaggatcaagagcaatatggtacatgtggttaggtgccaggtttctagagttcgaggcattaggctttatgaacgaagatcattggttttccagggaaaacagtctaagcggcgttgaaggagaaggcctacacaagttaggatatatattacgcgacatatcgaagatacccggaggtaacatgtatgccgacgatacggcgggttgggataccagaatcacagaggatgacttgcaaaatgaagcaagaataactgacatcatggaaccggagcatgctctccttgcgaaatcaatattcaaattgacttaccaaaacaaggtcgtaagagtacagaggccagccaaaaatggaactgtaatggacgtaatttcaagacgagatcaaagaggaagcggtcaagtcggcacatacggactaaatacatttactaacatggaagctcaactaatacgtcagatggaatctgagggaattttctcgccatcagaattggaaactccaaacttagcggaacgtgtattagattggttagaaaagtatggggtcgagagactaaagagaatggctatctcgggagatgactgcgttgtaaagcctattgatgaccgtttcgcaactgcgctgacagcgctcaatgatatgggtaaagttagaaaagatatacctcagtgggagcccagcaaaggatggaacgactggcaacaagtaccattttgcagccatcattttcatcaattaataatgaaagacggaagagagattgttgttccatgccgaaaccaagacgaactggttgggagagcacgcgtatctcaaggcgcgggctggtcacttagagaaacggcatgcctcggaaaatcatacgctcaaatgtggcaattaatgtattttcatcggcgcgatttaagattagccgccaacgcaatctgttctgcagtacctgtggattggatccccacaagcaggactacatggtcaattcatgcacatcatcagtggatgacaacagaagatatgctgtcagtatggaacagggtatggatagaggaaaatccttggatggaagataaaactcacatctcgtcttggggagatgtgccctacttaggcaaacgagaagatcaatggtgcggtagcctaattggtctaactgctagggcaacttgggctacaaatatacaagtagccataaatcaagtaagacgattaattggaaacgagaattatctagactacatgacaagtatgaagagatttaagaatgagtccgatcccgaaggggcactgtggtaa

SEQ ID NO: 22005 - RNA, 9879 nt, synthetic construct
  misc_feature 1..9879: note = derived and/or modified CDS sequence (opt6) from DENV-1__JQ045661__SS-prME
  source 1..9879: mol_type = other RNA
tccgtaactatgttgctgatgctcatgccaacagctttggcatttcatcttactaccaggggtggagagccccatatgatagtgagcaaacaagaaaggggaaaaagccttctctttaaaacgtcagctggtgttaatatgtgtacccttatagcaatggatctaggagagctgtgtgaagacacaatgacatataaatgcccccgcattacagaaactgaaccagacgacgttgattgttggtgcaatgccacggacacatgggtaacctatggaacatgcagccaaacgggggaacatcgaagggataaaagatccgtagcattggcaccacacgtagggttgggactagagacaaggacggagacttggatgtcgtcggaaggagcctggaaacaaatacaacgcgttgaaacttgggctcttagacaccctgggtttactgtgatagcactatttttagcacacgcaataggtacttcaataacacaaaaaggaataatatttattctactaatgcttgtaactcccagtatggcaatgaggtgcgtgggcataggatcacgcgactttgtagaaggtctgtctggagcgacctgggttgacgtagtcctagaacacggttcctgcgtaacgacgatggccaaagacaaaccgacactagatatagagcttctaaaaacggaagtaacaaaccccgctgtgttgagaaaattatgtattgaggctaaaatctccaatactacaacggatagtcgttgcccaacacaaggcgaggcgacattggttgaagaacaagatgcaaactttgtctgcaggcgtaccttcgtcgatcgagggtggggtaacggatgcggactatttggtaagggatctttgataacttgtgcgaaatttaaatgtgtaacaaaacttgaagggaagatagttcaatacgaaaatttaaaatatagcgtcattgttaccgtgcacacaggcgatcaacaccaagtaggcaatgagtccactgaacacggaacaacggcgacgatcacacctcaagcgcctacaactgaaattcaactaactgattatggcgccttgacactcgattgttcaccccgtacgggtctcgactttaatgaaatggtgttgctaaccatgaaagagaaaagctggctagtacacaaacaatggtttctagatttaccattaccatggacctcaggcgcaagcacctcccaagaaacttggaataggcaagatttactggtcactttcaaaacagctcacgcaaagaaacaagaagtggtagtacttggatctcaagaaggagccatgcacacagctctcacaggtgcaacggaaattcaaacatcagggactacgacaattttcgccggacatctaaaatgtcgcttaaaaatggataaactaaccttaaaaggcatgtcttacgtgatgtgcacaggatcttttaaacttgagaaagaattagctgagacacagcacggaacggtcctcgttcagataaaatacgaaggaacagacgccccatgcaaaatcccgttcagtacccaagacgaaaaaggtgtaactcaaaatggtcgtcttataacagcgaacccaatagtaactgataaagaaaagcctgtaaatatagaagcagaaccgcctttcggagagtcatatatcgtcattggggccggagaaaaagcccttaaattgagttggtttaagaaagggtcatccatcggtaaaatgtttgaagcaactgcccgaggtgctagacgcatggccattctaggagatactgcatgggacttcggttcaatcggaggagtatttacaagcgtcggtaagctagtgcaccaaatcttcggaacagcttatggcgttctcttcagtggagtgtcctggacgatgaaaataggaattggagtcctgttaacttggctaggattaaacagtagaagtaccagcttaagtatgacttgtatcgcagtcggtctggtgacactatacttaggagtgatggtacaagcagattcaggttgcgtgattaactggaagggaagagaacttaaatgtggatctggaatcttcgtgactaatgaagtacacacttggaccgaacagtataagttccaagcagattcaccaaaaaggttatccgccgcgataggcaaggcatgggaagaaggagtttgtggtattagatccgctacgagactggagaatatcatgtggaagcagataagcaacgaattaaatcatattttattggagaatgatatgaagtttacagtggttgtaggggacgtagccgggattctagcacaaggcaagaaaatgattcgaccacaaccaatggaacacaagtactcgtggaaaagttggggtaaggcaaagatcataggggccgacgttcagaatacaacttttatcatcgatggacctaacactccagaatgtccggatgaccaaagagcatggaatatatgggaagttgaggattatggatttggtatttttaccacaaatatctggttaaaattaagagacagctacacacaagtttgcgaccatcgcctaatgtcagcagctattaaagatagtaaggctgttcacgccgacatggggtactggattgagtcagaaaagaacgagacatggaaattagcacgagctagctttatagaggttaagacttgtacatggccgaagagtcacacattgtggtcaaatggcgttttagaaagtgaaatgataattccgaagatttacggtggcccgatatcccaacacaattatagaccagggtacttcacccaaacagcaggtccgtggcatttaggaaagttagaactcgacttcgatttgtgtgaaggtacaactgtagtggtggacgaacactgtggaaatagaggaccgagtttaagaactacaacagtcactggcaagattatccatgaatggtgttgtagatcgtgtacactaccaccactaagatttagaggggaggacggctgttggtatggaatggaaattcgtcctgttaaagaaaaagaagaaaatttagttaagagtatggtaagcgctgggtctggcgaagtagattcgtttagcctaggtctcttatgtatatctataatgattgaagaagttatgagatcccggtggagtagaaaaatgctaatgacaggtacactagcagtgttctttcttttgattgtgggacaactcacgtggaatgatcttatcagattatgcataatgatcggcgctaatgcgagtgatcgtatgggtatgggcacaacgtacctagcactaatggctacgttcaaaatgaggcctatgtttgccgtaggtttactatttcgacgactgacgagtagagaggtcctattactcacgataggtctatcgctcgtggcctcagtagagttacctaacagccttgaagaacttggagacggcttagcaatgggtattatgattctcaagttattaactgattttcagagtcatcaactgtgggctaccttgttatcattaacattcataaagacaacgttctctttacactacgcgtggaagaccatggccatggtcctaagcgtagtttctctttttcccctatgtttgtcgaccactagccagaagacgacttggcttccagttctacttgggagtttaggatgtaaaccacttactatgtttctaatagcagaaaataaaatttgggggagaaggagttggccattaaatgaaggtataatggccgtaggtatagtaagcatactattatcttcactgttaaagaacgacgtaccgcttgcaggaccactaatagctggtggaatgctgatagcatgttacgtaatatctggatcatccgcagatttatcccttgaaaaggcagcagaggtaagttgggaagaagaggccgaacacagtggcgcatctcacaatatactggtagaagtacaagacgacggtaccatgaaaatcaaggacgaagaaagagatgatactttaacaatacttctaaaagcaacactactggcagtaagcggcgtataccctctttccattccagcaaccctattcgtctggtacttctggcagaagaagaaacaacggtccggagtactgtgggacaccccgagtccgccagaggtggaaagagcggttctagacgacggcatatatcgtattatgcaacgaggacttctcggacggtcacaggttggtgttggggtctttcaggaaaatgttttccataccatgtggcatgtaacgcgcggtgcagtacttatgtaccaagggaaaagactcgaaccctcctgggcaagtgttaaaaaggatttaatatcatacggaggtgggtggagactacaaggatcatggaatacgggagaagaagttcaagtaattgctgtggaaccagggaaaaacccaaagaacgtacaaacagcaccaggtacatttaaaaccccagaaggcgaagtgggcgcaattgcattggacttcaaaccgggaactagcgggagccctatagtaaatagagaaggaaaaatagttggactatacggaaacggagtagtaaccacatcaggtacctatgtatctgccattgcacaagcaaaggcttcacaagaaggaccgcttccggaaattgaagacgaggtttttcggaaaagaaacctaacaatcatggacctacatcctggatccggtaaaactaggcggtaccttccagctatcgttcgagaagcaataaagcgaaagctgagaactttaatcctggctccaactcgggtggtagcaagtgagatggcagaggcgctaaaaggaatgccaatcaggtatcaaacaactgctgtcaagagtgaacacacggggaaagaaattgtagatttaatgtgtcacgcaacattcacaatgcgtttattatcaccagtacgagtccctaactacaatatgataatcatggacgaagcacacttcaccgacccttctagcatagcagcaagaggttatataagcacacgggtcggtatgggtgaagcggcagccatattcatgactgcgacaccccctggaagcgtagaagcatttccacagtcaaacgcggtaatacaagacgaagaacgcgacatcccagagcgttcttggaactctggatatgaatggataacagactttcccggcaaaacggtatggtttgtcccatctataaagtcaggtaatgatatagcaaattgcctaaggaaaaatggaaagagagtaatacaactatcaaggaagacattcgacacagagtaccagaaaacaaagaataatgattgggactatgtagtaacaacggatatatcggagatgggggcaaatttccgagctgatagagtgattgatcctagacgatgtttaaaaccagtcattttgaaggatggtcctgaaagagttattctggcaggcccaatgccggtcacggtcgcttcagctgcccaaagaagaggacgaataggaagaaaccacaacaaggaaggagatcagtatatatacatggggcaaccacttaataatgacgaagatcatgctcactggacagaagctaaaatgttattggacaacattaacacacctgagggcattatacccgcactatttgaaccagaaagagagaaaagcgctgcaattgacggagagtatagactgcgcggagaggcaagaaaaacatttgtcgaacttatgagacgaggcgacctaccggtatggttatcatacaaggtcgctagtgaagggttccagtattctgaccgaagatggtgttttgatggagagagaaataatcaggtattagaggaaaatatggatgtagaaatctggaccaaagaaggtgagcgtaagaaattacgaccacgatggctggacgcacgtacatatagcgatcccctagctctaagagagttcaaagaatttgccgctggacggagatctgtaagtggcgatctcatcttagaaataggaaaattacctcaacatttgactcaaagagcccaaaacgccttagataatcttgttatgttgcataattcagagcaaggcggacgagcatatagacacgcgatggaagaacttcccgatacgatcgaaactctcatgctcttagctctcatagcggtattaactggtggtgtcacattattctttctgtctggacgagggttagggaaaacatctataggattattgtgtgttatggcctctagcgtcttattatggatggcaagtgtggaaccacattggatcgctgcatcaatcattttagagttctttctcatggtattactaatacctgaacctgataggcagagaaccccacaagataaccaattagcatatgtcgtgattggcctactttttatgatactaaccgtcgctgcaaatgagatgggattgcttgagacaaccaagaaagatcttgggataggtcatgtagctgtagaaaatcaccatcatgcggccatgttagatgtagacttgcacccagcctcggcttggacattatatgcggtagcaaccactataataacaccaatgatgcgacataccatagaaaatactacggccaatatttcgttaacagctatagccaaccaggctgccatactcatgggcttagacaaaggatggccgatatcaaaaatggacattggggttcccctattagctcttggatgttattctcaagtcaatccgcttactcttacagccgcagttttaatgttagtagctcactacgctattattggtccaggccttcaagccaaagcaacaagagaggcacagaaaagaacggctgcaggcatcatgaaaaaccctacagttgacggaattgttgccatagatttagacccagttgtgtacgatgctaaatttgaaaaacaacttggacaaatcatgttactgatactatgtacatcacagatattactaatgcgaactacatgggcattatgtgaaagcataactttagcaacaggaccattaacgacattatgggaaggtagcccaggaaaattttggaatacgaccatagcggtatctatggcgaacatattcagaggttcgtatttagcaggagccggcctcgcattttcacttatgaaatctctaggagggggtagaagagggacaggcgctcaaggagagacgttaggagaaaaatggaaaaggcagctaaatcaactctccaagtcagagtttaatacatataaacgttccggaatcatggaagtagatagatcagaagctaaagaaggtctaaaaaggggagagacgacgaaatacgcagtttctagaggtacggctaaactaagatggttcgtcgaaaggaacttggttaaacctgaagggaaggtcattgatctcgggtgtggacgaggcggatggtcctactactgtgccggtttaaagaaagtaacagaagtaaaaggatacactaaaggaggtcctggacacgaggaacctattccaatggctacatacggttggaatcttgtaaaattacattcgggcaaagacgtattctttattcccccagaaaaatgtgataccttattgtgtgacataggagagagctcgccaaatccgactatcgaagagggccgtactctccgtgtattgaaaatggtggaaccttggcttagaggtaatcaattctgcatcaaaatacttaatccgtatatgccctctgtagtagaaaccctagagcaaatgcaaaggaaacatggaggcatgttagttcggaatcctttgagtagaaatagcacccatgaaatgtattgggtgtcatgtggaactggtaatatagtttctgctgtaaacatgacttcaaggatgttactcaatagattcacgatggcacacagaaaacccacatatgaaagagatgtggacttgggtgcaggcacccgtcatgttgctgtcgaacctgaagtcgccaatctagacattatcgggcagagaatagagaatatcaaacatgaacataaaagtacttggcactatgatgaagacaatccgtacaaaacatgggcttaccacggcagctatgaagtaaaaccgagtggatcagcctcgtctatggtaaacggtgttgtaaaattgctcaccaaaccttgggatgtcataccaatggttactcagatagcgatgacagacaccacaccatttggacaacagcgcgtcttcaaagaaaaagtagatacaagaacgcccaaagcgaaacgtggtaccgctcaaataatggaagtaactgcgaaatggttgtggggattcctttcgagaaataagaaaccccgtatttgtacgcgagaggaatttacacgtaaggtccgctcgaatgctgctataggggcagtattcgtcgacgagaatcaatggaactcggccaaagaagcagtcgaagatgaacgattttgggacttagtccatcgggaacgtgaactgcacaaacaggggaaatgcgcaacatgtgtctacaacatgatgggtaagagagagaagaaactaggcgaatttggtaaagcaaagggtagtcgtgcgatatggtatatgtggcttggtgcacgatttctcgaatttgaggctctcggcttcatgaatgaagatcattggttctcaagggaaaattcgctaagcggcgtagagggagagggtctccataagttaggatatatactcagagatatatcaaaaatacccggtggaaatatgtatgcagatgataccgcgggatgggatacaagaattacggaggatgatttacagaacgaagcacggatcaccgacatcatggagccagaacacgcccttctcgctaaatctatattcaaactaacctaccaaaacaaggtagttcgagtccagaggcctgccaaaaacggaacagtaatggatgtgatctcaagacgcgatcagcgcggaagtggacaagtgggcacgtacggactaaatacattcacgaatatggaagcacagttgattaggcaaatggaaagcgagggaatcttcagtccatcagaacttgaaacgccaaaccttgcagaaagagtattagattggctcgaaaaatatggagttgagagattgaaacgaatggcgatttcaggcgacgattgtgttgttaagcccattgatgacagattcgcaaccgctttaacagccctcaacgatatggggaaagtaagaaaagatattccccaatgggaaccttcgaagggatggaatgattggcagcaagtacctttctgtagccaccattttcatcagttgataatgaaagatgggcgggaaatagtggtaccatgccgaaatcaagacgaactcgtagggcgtgcaagagtgtcacaaggagcgggctggagtttaagagaaactgcatgcttaggcaaatcgtacgctcagatgtggcaactaatgtatttccataggagggatttaaggttagcagcaaatgctatatgttcagcagtcccggtcgactggatacccacctctaggactacatggagcatccacgctcatcatcaatggatgacaacagaggatatgttaagcgtatggaatcgagtatggatagaagaaaatccttggatggaagataaaacccatatctcatcatggggagacgtaccatatttgggcaaaagagaagaccaatggtgcggatcactcatagggcttacagctagagcaacatgggccaccaacatacaagtcgcaattaatcaagtccgtagactaattggaaatgaaaactacctagactatatgacctccatgaaacgcttcaaaaatgaaagcgatccggaaggggcgttatggtaa

SEQ ID NO: 22006 - RNA, 9879 nt, synthetic construct
  misc_feature 1..9879: note = derived and/or modified CDS sequence (opt6) from DENV-1__JQ045663__SS-prME
  source 1..9879: mol_type = other RNA
tctgtaactatgctattgatgttaatgcctacagccctggcttttcatctcacgacaagaggaggagagccacacatgattgtatccaaacaagagagaggaaaatcattattattcaaaacatcggcaggagtaaacatgtgcactttaattgcgatggatttaggagaattgtgtgaggacactatgacttataaatgcccaagaattactgaaacggaaccagacgatgtagattgttggtgcaatgcaactgatacatgggtaacatacggaacatgtagtcaaacaggggaacaccgtcgtgataaaagaagtgtagctctagcgccgcatgttggacttggacttgaaacaaggacggaaacatggatgtcatcagagggagcctggaaacaaatccaacgtgtcgagacatgggctttaagacatcccggattcacagtcatagccttgtttctggcccatgcaatcggaacgtccattacccaaaaaggtatcatctttatcttgttgatgttagttactccgtctatggccatgcgatgtgtaggaataggcagccgcgattttgtagaggggctatcgggggcgacatgggtggacgtggtactcgaacacgggagctgtgtaacaactatggcaaaagataaaccaacactagatattgaactccttaaaacagaggtaacaaaccctgccgtcttaagaaaattatgtatagaagcgaaaattagtaacaccactacagacagtcgttgtccaactcaaggtgaggcaacgttagttgaggaacaagacgcgaatttcgtctgtcgcagaacgttcgtggatcgtggctgggggaatgggtgcggattgtttggcaaaggaagtcttatcacatgcgcaaaatttaaatgcgtaacaaagttggagggaaaaattgttcagtatgagaacctgaaatatagtgttattgtcaccgttcatacgggtgatcaacaccaagtaggtaatgaaagtacagagcatggaactacagcaacaattacaccgcaagcaccgaccactgagatacaactgacagactacggggcattaacgttagactgctcaccccgcactggtctagattttaacgagatggttctgctgacgatgaaagaaaaatcatggttagtacataaacaatggtttctcgatctgccacttccgtggacgagtggtgcaagtacgtcacaggaaacctggaatcgacaagatttacttgttacgttcaaaaccgcacacgcgaagaaacaggaggtagtagtcttgggaagccaggaaggagcgatgcatacagctctgacaggcgcgactgaaattcagacttctggcacaaccactatatttgcggggcacttgaaatgccggctaaaaatggacaaactgaccttaaagggaatgagttatgtcatgtgcactggatcttttaagctcgaaaaagagttagcggaaactcaacacggaacagtcctggtacaaataaaatatgaaggaacggatgcaccttgtaaaataccattttctacacaagacgaaaaaggggtaacacaaaatggacgcctaataacggcaaatccgattgtcactgataaagaaaaaccggtcaatatagaagctgaacccccatttggggaatcgtatattgtcataggcgctggggaaaaagcgcttaagttatcttggtttaagaaaggttcctcaataggaaaaatgttcgaggctacggctcgtggtgcccgtaggatggcgattcttggggacactgcgtgggactttgggtcaataggtggtgtgtttactagcgtgggcaagctagtccaccaaatttttggcacggcgtacggggtattgttttccggcgtgtcatggacaatgaaaattggtataggagttctattgacctggcttggtcttaatagtcgaagcacgtctctgagcatgacctgcattgccgtcggattagttacgttatatctcggagtaatggtacaggcggatagcggatgtgtgataaactggaaaggacgagaactaaaatgtggaagtggtatatttgtgaccaacgaagttcatacgtggacagaacagtataagttccaagcggacagcccaaaaaggctgtcagctgcaataggaaaggcttgggaagaaggggtttgcggaatcagatcagcaacacgattagaaaacataatgtggaaacaaatttcaaatgaattaaatcatatactattagaaaatgatatgaaattaactgttgtagttggagatgtagctggcatcttagctcaaggcaagaaaatgattaggccacaaccaatggagtataagtattcatggaagtcgtggggtaaagcaaaaataataggcgctgacgtccaaaacacaacgttcataatcgacggcccaagtacaccagaatgtcctgacgatcaaagagcttggaatatttgggaagtcgaagactatggcttcgggatctttaccacaaacatatggcttaaactaagggacagccatactcaagtatgtgatcaccggctcatgtcagcggccataaaggacagtaaagcggttcacgcagacatggggtattggatagagagtgaaaagaatgaaacgtggaaattagctagggcctcatttatagaagtaaagacatgtatttggccaaaatcacatactttatggagtaatggggtactcgagagcgaaatgattataccaaaaatatacggagggccgattagtcaacacaattatagacctggttacttcacacaaacggctgggccatggcatctaggaaaattagagctagattttgatttgtgtgaaggaactactgttgtggttgacgaacattgtggaaacagaggtcctagtctaagaacaacaacagtaacaggtaaaataattcacgaatggtgctgccgatcatgtactctcccaccactgaggtttcgaggagaggatggatgttggtatggtatggaaattcggccagttaaagaaaaggaggagaacttagtgaaatcaatggttagcgcaggtagtggagaagtagactcattttctcttggattactatgtatatccattatgatagaagaggtaatgaggtcgaggtggtctcgaaaaatgcttatgacaggaacactcgcggtctttttcttattaataatgggacaattgacatggaacgatctgattcgtttatgtataatggtcggagcaaatgcttcagaccgaatgggaatgggaacgacctatttagctttaatggctacttttaagatgcgacccatgttcgctgtgggccttttgttcagaaggctcacctcacgtgaagtcctactattaactataggactgagtttagtcgcatcagtcgaacttcccaacagtcttgaagaattaggagatggattagccatgggaattatgatcttaaaactgttaacagactttcaatcacaccagttgtgggcaactctgttatcattgacctttataaaaacaacttttagtttacactatgcttggaaaaccatggcgatggtgctaagtatagttagtctgttcccgttatgtttatcaacgacatcccagaaaacgacttggctaccagtccttcttggttctttaggatgtaaacctttaactatgttcctaatagcggaaaacaaaatttggggacgacgatcatggccactcaatgaaggtatcatggccgtgggaatcgtatcaatcttgttgtcatcgttactcaaaaacgatgtacctttggcgggaccattaatagccggaggcatgctcatagcatgttatgtaataagtggaagtagtgctgacctgtcgctggaaaaagccgctgaagtaagctgggaggaagaagcagaacacagtggggcatcccataatatattggtagaggtacaagatgacggaaccatgaagatcaaagatgaagaacgcgacgatactctaacgatattacttaaagcgactttattggctgtaagtggtgtttatcccctaagtatccctgcgaccctattcgtatggtacttctggcaaaagaaaaagcagaggtcaggagttttgtgggacacgccgtcaccaccggaagttgaacgtgctgtgttggatgatggaatatatagaataatgcaacgtggtttattaggaagatcgcaagtaggtgtcggggtatttcaagagaatgtgtttcacactatgtggcatgtaactaggggagcggttttaatgtatcaaggaaagcgattagaacctagctgggcttcagtcaagaaagatctcatatcttatggaggaggctggcggcttcagggctcatggaatacgggagaagaagtacaagtaattgcagttgagcccggtaaaaacagcaaaaatgttcagactgcacctggcacatttaaaacaccagaaggtgaagttggtgctatagctctagacttcaaacccgggacaagtggaagtccgatagtcaacagggaaggcaaaattgtgggactttacggcaatggggtggtaacaacatcagggacgtatgtatcggcaattgctcaagcgaaggcatctcaggaagggcctctgccagagatagaggatgaagtatttaggaaaagaaatttaacgataatggatttacaccccggctctggcaaaacgcgaagatacctcccagcgattgtcagagaagctattaaaagaaaattacgaacgctaatcttggcaccaacgagagtggtagcaagtgaaatggcggaggcgttaaagggaatgccaatacgctatcaaacgacagcagtaaaaagtgaacacacaggaaaagaaatcgtagatttaatgtgccatgcgacatttacgatgagattactatctccagtaagggttccgaactataatatgatcataatggatgaagcacactttacagatccttcatcaatagctgcgagaggctatatatctactcgagttggtatgggcgaggcagcggctatctttatgacagctaccccaccaggtagtgtggaagcatttcctcaatcaaatgctgttattcaagatgaagaaagggatatacccgagaggtcatggaactccgggtatgaatggataacagattttccaggaaaaacggtgtggtttgtaccaagcattaagtctgggaatgatatagccaactgcctccgcaaaaatggcaaaagagttatccaactctctagaaaaacatttgacactgagtaccagaaaaccaagaataatgattgggactacgttgtaacaacggacatatctgaaatgggagcaaatttcagagcagatagagtcatcgaccctcgtagatgtctaaagccagttatattaaaagatggaccagagagagttatacttgcaggcccaatgcccgtaactgtggccagtgccgcacaacgtaggggtcgaataggacgcaatcataataaggagggagatcagtatatctatatgggtcagccattaaacaatgacgaggatcatgctcactggacggaggcaaaaatgttattagataatataaacaccccagaaggcattataccagcactgttcgaaccagaaagagaaaaatctgcagcgatcgacggagagtatcgtttacgcggagaagcaagaaaaacattcgtagagttaatgaggcgcggagacctaccagtttggctgagctataaagtagcatctgaaggattccaatattccgaccgtaggtggtgttttgacggagagagaaataaccaagtactagaagaaaacatggatgttgaaatttggacgaaagaaggagaaaggaagaaacttaggccaaggtggctcgacgcacggacatacagcgacccacttgcattacgcgaatttaaagagttcgcggctggccgaaggtcggtatcaggagatctcattttagagattggaaaattgcctcagcacttgacacaacgagctcaaaatgctttagataacttggtcatgttacacaatagcgaacaaggcggtagagcttatagacatgctatggaagagttacccgatacaatagaaaccctaatgttattagctttaattgcggtactaacaggcggtgttacattatttctattgagcggtagaggattaggtaaaacgagcatagggttgttatgtgtcatggcctcatcagtcttactttggatggccagtgtagaaccacactggatagctgcctctataatattggagttctttttaatggtgcttttaattcccgaacccgatagacaacgaaccccacaagacaatcagcttgcgtacgtagtaattggtctattattcatgatattaacagtcgcagcaaacgaaatgggactattagaaacaaccaagaaagatctagggatagggcatgtagcagtagaaaatcatcatcacgccgcaatgctagatgtcgatcttcacccggcaagcgcttggaccttatatgcagtagcaacgaccattatcacgcctatgatgcgtcatacgattgaaaacaccaccgcgaatatttcactaacagctattgcaaatcaagctgctatactaatgggtttagataaaggctggccgatatcaaaaatggacattggcgtcccgttgcttgcattaggctgttatagtcaagttaacccattaactctcacggcagcagtgttgatgctcgtggctcactatgccataatcgggcctggcctgcaagcaaaagcgacacgagaagcacaaaaacgaactgctgctggtatcatgaagaacccaacagtcgacggaatagtagcaattgaccttgatccggtagtttatgacgctaaattcgaaaaacaattgggacagataatgcttctgatattatgtacaagccagatattattgatgagaactacatgggcattatgtgaatccatcactctggcaaccggtccactaactaccctctgggaagggtctcccggtaaattttggaacactacgatcgcagtatcaatggcgaacatctttagaggttcatacttggccggtgcaggactagccttctctctaatgaaatcactaggcggagggcgacgcggaacaggagctcaaggagaaacattgggtgagaaatggaaacgacaactcaaccaactctctaaatcagagtttaacacatataaacggtctggcatcatggaagttgatcggtctgaggcaaaagaaggactcaagagaggtgaaactacaaaacacgccgtaagtagaggtacggcaaaactacgctggttcgtagaacgtaatcttgttaagcccgaaggaaaggtaatagatctgggctgtggaaggggaggatggtcgtattattgtgcaggccttaagaaagtgaccgaagtcaaaggttatactaaaggtgggccgggacatgaggaacctatccccatggctacctacggttggaatttagtcaaattacactctggaaaagatgtattcttcattccgccagaaaaatgcgacacactgttgtgtgatataggcgaatcatcaccaaatccaactatagaggagggtagaacacttcgagtactcaaaatggtcgaaccatggttaagaggtaaccaattttgcataaaaatattgaatccttacatgccaagtgtggttgaaaccttggagcaaatgcagaggaaacacggagggatgcttgtcagaaatccattatcaaggaatagcacccacgaaatgtactgggtttcatgcggaacaggaaatattgtgagtgctgttaatatgacatcaagaatgttattaaataggtttacgatggcgcatcgtaagcctacgtatgaacgcgatgtagatctaggagctggtacgagacatgtagcagttgaaccagaagtagcaaatttagatattataggacagagaatagaaaacattaaacacgaacacaaatcaacatggcactatgacgaggacaatccttacaagacctgggcataccatggtagctacgaagtaaagccttcagggtcagcgtctagcatggtaaacggggtggtgaaattattaacgaagccttgggacgtgattccaatggttactcaaatagcaatgaccgacactacacccttcggtcaacaaagagtttttaaagaaaaagtggatacgcggacacccaaggctaaacgtggaacagcccaaattatggaggtcaccgctaaatggctatggggattccttagcagaaataaaaagcccagaatatgtacaagggaagaatttaccaggaaggtaagatcaaacgcagctataggggcggtttttgtagacgaaaaccagtggaatagcgcaaaggaagctgttgaagatgagcgtttctgggatcttgttcaccgcgaacgtgaattgcataagcagggaaaatgcgcgacctgtgtctataatatgatgggaaaaagggagaagaaattaggggaatttgggaaagcaaaagggtcaagggctatatggtacatgtggctaggtgctagatttctagagttcgaagcattgggctttatgaatgaagatcattggttcagtcgtgaaaattcattgagcggtgtcgaaggagaaggactacacaagctaggttatatacttcgggatatatctaaaataccaggtgggaacatgtatgcagatgacactgctgggtgggacacaagaattactgaagacgatctccaaaatgaagcacgtataacggacataatggagccagaacacgcgctgttagccaaaagtattttcaagctaacctaccaaaacaaggtcgtccgtgtgcaaagaccggcgaagaatggaacggtaatggatgttataagtagaagagaccagagagggtcagggcaagtaggaacatatggactgaatacgttcacaaatatggaagctcagttgatacgtcaaatggagagcgaaggtatattttcaccatcagaactggagacaccgaatttagcggaaagagtgttagattggttagagaaatatggggtcgaacgtttaaaacgaatggcaatatctggtgatgattgtgtggttaaacctatagatgatcggtttgcaactgcacttaccgccttaaatgatatgggtaaggtaagaaaggatatcccacaatgggaaccaagtaaaggttggaacgactggcaacaggtaccattctgttctcatcatttccatcaattaataatgaaagacggaagagaaattgtagtaccgtgcagaaatcaagatgaacttgtaggtagggcaagggtaagccaaggtgcgggatggtcactacgtgaaacggcatgcttgggaaaaagttatgctcaaatgtggcaattaatgtactttcatagacgcgacctaagactagctgctaacgcaatatgttcagcagtgccagtggattggattccaacaagccgaacgacctggagtatacatgcacaccatcaatggatgaccacagaagatatgctgtcagtatggaacagggtttggatagaagaaaatccctggatggaggacaaaacgcatattagctcttggggagatgtaccatacctagggaaaagagaggaccaatggtgtggctccctcataggcttaaccgcccgagcaacctgggcaacgaacatccaagtggctattaatcaggtgcggagattaatcgggaacgaaaactacttggattacatgaccagtatgaaaagatttaaaaacgagagcgacccagaaggagcgctgtggtag

SEQ ID NO: 22007 - RNA, 9879 nt, synthetic construct
  misc_feature 1..9879: note = derived and/or modified CDS sequence (opt6) from DENV-1__JQ045665__SS-prME
  source 1..9879: mol_type = other RNA
tcagtgactatgctcttgatgctaatgccaacggctctcgcctttcacctaacagcccggggaggagaaccacacatgatagtatcgaaacaagaaagaggaaaatccctcttattcaaaacaagtgcaggagttaacatgtgcacgcttatagcaatggatttaggggaactctgtgaagacaccatgacctacaaatgtccaagaattacagagacagaacccgatgacgtcgattgttggtgcaacgcgaccgatacatgggtaacttacggtacctgttcacaaacgggagaacaccgaagggacaaaagatcagtagctttagccccacatgtcggcctggggctcgaaacacgaacagaaacatggatgtcatcagaaggagcatggaaacaaatacaaagagttgaaacctgggctttacgccatcctggcttcacagtgatagcactattcctcgcgcatgctataggaacaagcatcacacaaaaaggtataatatttatactcctgatgttagtaaccccgtctatggccatgcggtgtgtgggaatcggatccagggacttcgtagagggcctctccggcgccacttgggtagacgttgtactagagcacggttcctgtgtaacaacaatggccaaagataaaccaacattagacatagaacttttgaaaacagaagttacgaaccctgcagtactaagaaaattgtgtattgaagcaaagatctcaaatactacgacagatagccgctgcccgacccaaggagaagctacattagttgaagaacaagatgcaaatttcgtgtgccgtcgaacatttgtagaccgtggatggggaaacggatgtggattgttcggtaagggtagcttaattacgtgtgcgaaatttaaatgcgtcacaaaactagaaggaaaaattgttcaatatgaaaatttaaagtacagtgtaatagttacggtacatacaggcgatcagcatcaagtcggtaacgagagtacagaacatgggactaccgcaacaataacgccacaggctcctacgacggagattcaacttactgactatggagcccttacattagattgttccccgagaacaggacttgacttcaatgagatggtattactgaccatgaaggagaaatcatggctagtacacaagcaatggtttttggatttaccattaccctggacttcaggcgcatctacgagccaagaaacttggaatcgacaagacttgctcgtcacctttaaaacggctcatgcaaagaaacaggaagtggtcgtattaggctcacaagaaggggcaatgcatacagccttgacaggtgccactgaaatacaaacctccggaactacaactatattcgcaggccatctaaaatgcaggttaaagatggacaaattaacgttaaaggggatgtcatatgtaatgtgcactggtagctttaaattagaaaaggaacttgcagaaacacaacatggtacagtattagtacaaattaaatatgaagggacggacgctccgtgtaagataccattcagtacacaggacgagaaaggagcgacgcagaatggaagactgataaccgcgaatcctatcgtaactgacaaagaaaaacctgtaaacatagaagcagaacctccttttggtgagtcatacattgttattggagcaggggaaaaagctctgaaactttcgtggttcaagaaaggtagttccattggtaagatgttcgaggcgacggctaggggcgcaaggcgtatggcaatactgggtgacacagcgtgggattttggatcaataggtggggtatttacttctgtaggaaaacttgtacaccaaatttttggaacagcttatggggtcctattttctggagtatcttggacaatgaagatcggaataggagttttattgacatggttaggcctaaacagtcgaagcacatcgttaagtatgacctgtattgcggttggactggttacgctatatttaggtgtaatggtacaagcagacagcggttgtgtaattaattggaaaggtagagaactaaaatgtggtagtggtatcttcgtaacaaatgaagtgcacacctggactgagcaatacaagttccaagctgatagccctaaaagactatctgcggctattggaaaggcctgggaagagggcgtttgcggcatccgaagtgcaacccgattagaaaacataatgtggaagcagatctctaatgaacttaaccacattttattagagaacgatatgaaattcacggtcgttgttggagatgtcgcaggcatactagcacagggcaagaaaatgatacgcccacaaccaatggaatacaagtatagttggaaatcatggggaaaagctaagataataggcgcagatgttcaaaacacaacattcattatagatggccctaatactccagagtgtccggatgatcaaagagcatggaacatctgggaagttgaagactacggttttggaattttcacaactaacatttggttgaaattaagagatagctatacccaggtgtgtgaccatcggttaatgtctgcagcaattaaagattctaaggcagtccatgctgacatgggctattggatagagagtgagaaaaacgaaacctggaaattagcaagggcgtcatttatagaagtcaaaacatgcatctggccaaagtcgcataccttgtggagtaatggggtattggaaagtgagatgataattccaaaaatatatggtggacctatttcgcaacataactataggcccggatactttacacagacggctggaccatggcaccttggcaaactagaactcgatttcgatttatgtgaaggaacaacagtggtagttaacgagcattgcggtaatcgaggaccaagtttgcgcacaactactgtaacgggtaaaataatacatgaatggtgctgtaggagttgtactttaccacctttaaggttccgaggagaagatgggtgttggtatggtatggaaataagaccagtaaaagaaaaggaagaaaacctcgtaaaaagtatggtatcggctggaagcggcgaagtagatagtttttcgttaggactattatgcataagtattatgatagaagaggtaatgcggtcaagactttcgcgtaagatgctgatgactggcactttagccgtattcttcctgctcataatgggacaattaacttggaatgatctcatccgtctctgtatcatggtaggtgcaaatgcatcagataggatgggtatgggtacgacttatctggctttgatggccacatttaagatgcgaccaatgtttgcggtaggactattatttcgccgtcttacatctcgtgaggtgctattgttaactataggtttatccttagtagcaagtgttgagctcccaaattcgttagaagaactgggggatggactagctatgggaataatgatattaaaacttctgacagactttcagtcccatcaactatgggcaactctccttagtttaacattcattaagactacattttcactccaccatgcttggaagacaatggcaatgatcctcagtattgtaagtttatttccattgtgcttatctaccacttcacagaaaactacatggctaccagttttattagggagcttaggatgtaaacctctgacgatgtttttgatcgcagaaaataaaatatgggggagacggtcatggcctctcaacgagggaatcatggcggtaggcatagtaagcattctgctttccagtcttcttaaaaacgacgttccattagccggacctttaattgcgggagggatgctgatagcgtgttatgtaatttcaggaagttcagctgatttgtcactagaaaaagctgcggaagtttcatgggaggaagaagcggaacattccggagcatctcataacatactcgtggaagtacaagacgacggaacaatgaagattaaagatgaagaacgtgatgatacattaacaattttactaaaagctacacttttagccgtcagcggggtataccctctatctattcctgccacactgtttgtttggtacttttggcaaaagaagaaacagcggagtggagtactttgggacacacctagtccacctgaagtagaaagagcagtactagatgatggcatatatcgtataatgcaaaggggtctgttaggtcgaagtcaagtaggagtaggagtttttcaagaaaatgtttttcatactatgtggcacgtaactcggggtgcagtattaatgtaccaaggtaagagactagaaccgtcgtgggcttcggtcaagaaagacctaatatcctacggtggtggatggcgattgcagggttcatggaacacaggcgaagaggttcaggtaattgccgtcgagccaggtaaaaaccctaagaacgttcaaacagcaccaggcacgtttaaaacccctgaaggggaagtaggggccattgcgctagattttaaacctgggacatctggctctcctatagtaaaccgcgaaggcaagattgtaggactatacggtaatggtgtcgtcactacaagcggaacttatgtatccgccatagcccaagcaaaggcgtcgcaggaaggtccactacccgaaatagaggacgaagtgtttcggaaacgtaacttaacgataatggacttgcacccaggctccggaaaaacaagacgatatcttccagccattgtcagagaagccataaaaagaaaattgcgaacattgatactcgctccgacacgtgtcgtcgccagcgagatggccgaagctctcaaaggaatgcctataaggtatcaaactacagctgtgaaatcggaacatacgggaaaagaaattgtagacttaatgtgtcacgcaacattcacgatgagacttttatcaccagtacgagtacccaattataatatgataataatggatgaggcacattttacggacccttcctcgatagcggcaagaggatacatatccacaagagttggaatgggggaagcggccgcaatctttatgacagctactccacctggctctgtagaagcattccctcaaagtaatgcagttattcaggacgaggaaagagatataccagagcgttcatggaactctggatatgaatggattacagattttcccggtaaaactgtatggtttgtcccatctatcaaatccgggaatgacattgcaaattgcctgcgaaagaacggaaaaagagtaattcaactgtcccgtaaaacgttcgatactgaatatcagaaaactaaaaataatgactgggactatgttgtcacaacggatatctcagaaatgggagctaattttagagctgaccgagttatagacccacgtcggtgtctgaagccggtaatacttaaagacggtccagaaagggtcattttggcgggaccgatgcctgtaaccgtagcaagtgcagcacagagacgaggccgaattggacgaaaccataacaaagaaggtgaccaatacatttatatgggccagcccctaaataacgatgaagatcatgcacattggacagaggcaaaaatgttactcgataatataaatacacctgaaggaataataccggcgcttttcgaacccgaaagagaaaagagtgcagcaatagatggggaatatagactgagaggggaagctagaaagtcatttgtagaattgatgagaaggggcgacttgcctgtatggttgagctataaggtagctagtgaaggtttccagtattctgaccgaagatggtgctttgatggagaacgaaataaccaagtgcttgaagagaatatggacgtggaaatatggaccaaagaaggggaaagaaagaaacttagacctcgatggcttgatgcgagaacatattcagaccctttagcattgagagaatttaaagagttcgctgcagggcgacggtcagtaagtggcgacctaatattggaaattggaaaacttccacaacatctgacacagcgtgcccaaaacgcactcgataacttagtaatgttgcacaactcagagcaaggaggcagagcttatagacatgccatggaggagctacccgatacaattgagaccctaatgttactagcactaattgcagtactaaccggaggagtaactctgtttttcttgtctgggaggggactagggaagactagcattggactcctttgtgtcatggcctcatcagtactcctatggatggccagcgtagagccacactggatagcggcaagcattattctagagttctttttaatggtactattaattccggaaccggatagacagaggacacctcaagataaccaattggcctacgtggttatagggctcttattcatgatattaacggttgcagcaaatgaaatgggacttctagaaacaaccaagaaagacctaggaattggtcacgtagcggttgaaaatcaccatcatgccgctatgttagatgtcgatttacaccccgcctccgcctggacactatacgccgtagcaactaccataattactccaatgatgcgtcatacaatagagaacaccacagccaatatctcattaacggccatcgctaatcaagctgctatactaatgggactagataagggatggcctatctcaaaaatggacataggtgtaccgttgttagcactaggctgctactcgcaagttaatccgttgactcttacagccgctgtcctcatgttagtggctcattatgctattatcggacctggtctgcaagctaaagcaacaagagaagcccaaaagagaactgctgcaggaattatgaaaaaccctacagtagatggcatagtagcaatagatttagatccagttgtatatgacgccaagtttgaaaaacaattaggacaaattatgctattaatcctatgtacttctcagatactgttgatgcgaactacgtgggctttatgtgaatccatcacacttgcaacaggaccgttaaccacgttatgggaaggttcaccgggcaagttttggaacacaacaattgcagtttcaatggcgaatattttcagaggctcttatctagccggagccggattggctttctcgcttatgaaatcactaggcggaggacgaagaggcacaggtgcccaaggagagacactaggcgagaagtggaaacgacagctaaaccagctaagcaaaagtgaatttaacacatataaacgaagtggaataatggaagtagaccggtcagaagcaaaagaagggcttaaacgcggagaaactacaaagcatgcggtgagccgtggtactgcgaaactgcgttggtttgtcgaaagaaatttagtaaaacctgaaggaaaagtaatagacctagggtgcggacgtggagggtggtcttactactgtgcaggtttaaagaaagtaactgaagtaaaaggctacactaaaggcggacctggacacgaagaacctatacctatggcgacttatggttggaatttggtaaaattacactcaggtaaggatgtattctttattcctccagaaaaatgcgatacattactttgcgacataggtgaatcgagtcctaaccctacaatagaagaaggacgaacactaagagtactaaaaatggttgaaccatggctaagaggcaatcaattctgtattaaaattctgaatccctatatgccatcggttgtagaaacactagaacagatgcaaagaaggcatggagggatgctagtgcgaaatccgctgagcagaaattcgacccacgaaatgtattgggtttcttgcggtactggtaatatagtatcagcagtgaatatgacaagcagaatgcttttaaacaggttcacaatggcacaccgtaaaccaacgtatgaaagagacgttgacttaggtgcaggtacaagacacgtagccgtcgaaccagaagtagctaatttagatatcatcgggcaaagaatcgaaaacataaaacacgagcacaaaagtacatggcattacgacgaagataatccatacaaaacttgggcatatcatggttcctatgaagtgaaaccatcaggatctgcatcttcaatggttaatggagtagtgaaactattgacaaaaccctgggacgtcatccctatggttacacagatagctatgacggacacgacaccgttcgggcaacaaagagtgttcaaagaaaaagttgatacaagaacgcctaaggctaaaaggggaacagcacagatcatggaagttaccgctaaatggttgtggggatttttatccagaaataaaaagccacgcatttgcactagagaagaatttacaagaaaggtcagatctaatgcagcgataggcgctgtttttgtcgacgaaaaccaatggaacagcgcaaaagaagccgtcgaggacgaaaggttttgggacttggttcaccgtgagcgtgaactacacaaacaaggcaaatgcgcaacgtgtgtttacaacatgatgggaaaaagagagaagaaattaggtgagttcggtaaagccaaaggctcaagagccatctggtatatgtggttaggcgcccgcttccttgagttcgaagccttaggatttatgaatgaagatcactggttttcaagagaaaacagtcttagtggtgtagaaggggaaggtcttcacaaactaggatacattttaagggatattagtaagataccaggaggaaatatgtatgcggatgataccgcaggatgggatacgagaattactgaagatgatttgcaaaacgaggcgcgcatcacagacataatggagccagaacacgcgttgcttgcaaaatccattttcaagctaacatatcaaaacaaagtcgtgagagtccagagacctgccaaaaacgggacagtcatggatgtaatatctaggcgcgatcaaagaggctcaggacaggtagggacatatggtctcaatacctttacaaacatggaagctcaattaatacgacagatggaatcagaaggaattttctctccgtcagaactggaaactcctaacttagcagaaagagtactagattggcttgagaagtatggggtcgagaggcttaaaagaatggcaatatctggagacgattgtgtcgtgaagccaatcgatgataggtttgcaaccgccctaactgcacttaatgacatggggaaagtaagaaaagacattcctcaatgggaaccttcaaaaggatggaacgactggcaacaggttccattttgtagtcatcatttccaccaattaattatgaaagacggacgtgaaatagtcgtgccttgtcgaaaccaagacgaattggtgggacgagcccgcgtttcacaaggagctgggtggtctttacgagaaacggcatgtctaggtaagtcatatgcccaaatgtggcaactaatgtattttcatagaagagatttaagattggcagctaacgcaatatgttcagctgtgccagtagattggataccaacaacgtgtacaacttggtcaatacacgcacatcatcaatggatgactactgaagacatgttatcggtgtggaatagagtatggatagaagaaaatccttggatggaggacaaaactcatatcagctcctggggcgacgtaccttacttaggtaagcgtgaagatcaatggtgtgggtcactaatagggttaactgcaagagcaacgtgggctaccaatatacaggttgctatcaatcaagtaaggcggttaatcggcaacgagaattatttggattatatgacatcaatgaagagatttaagaacgagagtgatcctgaaggagccttatggtaa

SEQ ID NO: 22008 - RNA, 9879 nt, synthetic construct
  misc_feature 1..9879: note = derived and/or modified CDS sequence (opt6) from DENV-1__JQ045666__SS-prME
  source 1..9879: mol_type = other RNA
agcgtgactatgcttttgatgctaatgccaacggctctagcattccacttgactgcacgcggtggtgaaccgcatatgattgtatcgaaacaagaaagagggaaaagtttattatttaaaacatctgcgggagtaaatatgtgcacattaatagcgatggatctaggagaactatgtgaagacacaatgacttacaaatgtccacgaatcactgaaaccgaacctgatgatgttgattgttggtgcaatgcaacagacacgtgggtaacctacgggacatgttctcaaacgggtgaacatagaagagataaacgcagtgttgccctagcacctcatgttggtttggggctagaaacaagaacagaaacatggatgtcttccgaaggtgcgtggaaacaaatacaaagggtagaaacatgggctttgaggcatccaggatttacagtaattgcattattcctagcccatgcaattggcacctctattacacaaaaaggaattatattcatactattgatgttggtcactccgtctatggccatgagatgcgtgggaataggaagtagggattttgtagaaggactgagtggggcgacatgggtagatgtcgtactagaacatggttcatgtgtaacaaccatggcaaaagacaaacctacattagacatagaactgttaaaaacagaagttaccaatccagcagttttaagaaaactatgtatagaagctaaaatcagcaataccactacagactcacgttgtccaacacaaggagaagcaacattagtcgaagaacaagatgctaacttcgtatgtagaagaacatttgtggatagaggatggggtaacggttgtggattatttggcaaaggttcactcataacatgcgcaaaatttaaatgtgtaacaaaactggaaggaaaaatagttcaatatgaaaatctgaaatattctgtcatcgtaacggtacatacaggcgatcaacatcaagtagggaatgaatctacggaacatgggactaccgctactattaccccgcaagcgccaacaacagaaatacaattaacggattacggagctttaaccttagattgttcaccaagaacaggattagattttaacgaaatggtactactgaccatgaaagagaaaagttggctagtgcacaaacaatggtttttggacttaccgctaccatggacttcgggtgcctcgaccagccaggaaacgtggaatcgacaagaccttcttgtgactttcaaaactgcccacgcaaagaaacaggaagtagttgtactaggatcacaagaaggagctatgcacactgcattaacgggtgctactgaaatacagacatcaggtacaaccaccatatttgcggggcaccttaaatgcagattaaaaatggataaactcacattgaaggggatgtcgtatgtgatgtgcacagggagctttaaactagaaaaagagttagccgaaacccaacacggaacagttctagtacagataaaatacgaaggaactgacgcaccctgcaagatcccctttagcacacaagatgaaaaaggagcaacacagaacggacggttgataactgcgaatcccatagttacagataaagaaaagccagtaaatattgaagctgaaccaccctttggggagagttatattgttataggagcaggagagaaagcattgaaattgtcatggttcaagaaaggatcttctatcggtaaaatgtttgaagctacagctagaggagcgagaagaatggcgatactgggagacacagcatgggactttggatctatcggcggtgtcttcacatcagtcggaaagttagtccaccaaatatttggtactgcatatggcgtcttattttcgggtgtcagttggacaatgaaaatagggataggagttttattaacctggttgggattaaacagcaggtcaacgtcacttagtatgacatgcatagcagtgggactggtaacactttatttaggtgtaatggtacaagcagatagtgggtgcgttataaactggaaaggtagggagctaaaatgcggctcaggaatatttgtaacaaatgaagtacatacgtggactgaacaatataagtttcaagccgattctccaaaaaggctatcggccgcaatcggaaaggcatgggaggaaggtgtatgcgggattaggagtgcaacccgcctggagaacataatgtggaagcaaataagcaacgaactcaaccacatcctattggaaaatgacatgaaattcactgtagtggttggggatgtagcaggaatacttgcacaaggcaagaaaatgatccgcccccaaccaatggaatacaagtactcatggaagtcgtggggaaaagccaaaataataggagccgacgtccaaaataccacttttataatagacggaccaaacacgccagagtgtcccgatgatcaacgagcatggaatatatgggaagtggaagattatggctttggaatctttactacaaacatctggttaaaactgagggattcatatacccaagtatgtgatcaccggttaatgtcagctgcaatcaaagatagcaaagccgtgcatgctgatatgggttattggattgagtccgagaaaaatgaaacttggaaattggcacgagcatcattcatagaagtaaagacatgtatttggccaaaatcgcatacattatggtctaatggagtcctggagtcagaaatgataattccaaaaatatatggagggccaatatcacaacataactaccgacctgggtactttacacaaacggccggaccttggcacctaggaaaattagaattagatttcgacctgtgcgaagggactactgtagtagtgaacgaacattgcggcaacagggggccttcgctaaggacgaccaccgtaacaggcaaaataatacacgagtggtgttgtcgcagctgcacccttcccccacttagatttagaggtgaagacggatgctggtatggaatggagatcagaccagtgaaggagaaggaggaaaaccttgtaaaatcaatggtatcagccggttctggggaagtagacagctttagtttaggcttattgtgtatctccattatgatcgaagaagtgatgagaagtcgtttaagcagaaaaatgttaatgactggaaccttagcagtcttctttcttctaatcatgggccaactgacttggaatgacctcataaggctgtgcatcatggtcggagctaacgcaagcgatagaatgggtatgggaactacgtacttggccttgatggcaaccttcaagatgcgtcctatgtttgcagtcggactattatttagacggttgacttccagagaggttctgttgcttacgattggactttctcttgttgccagtgttgagcttcctaatagcttagaagaattaggtgacgggttggcgatggggataatgatactaaaattattaactgacttccaatcacatcaactatgggctactctattaagtctaacattcataaaaaccacattttccttacatcatgcctggaagacaatggcaatgatactatccattgtatccttattcccattatgtctctctaccacatcccaaaagaccacatggctacctgtgctattaggtagtttaggatgtaaaccattgacgatgtttttaattgcagaaaacaaaatttggggccgtaggtcatggcctttaaatgaagggataatggctgtgggtattgtaagcatattattgagtagcttgctaaagaatgacgtaccgttagctggtccactaattgcgggtggaatgctcatagcatgttacgtaataagcggtagctccgctgatttatcactagaaaaagctgctgaagtctcatgggaagaggaggctgaacatagtggagcaagtcacaacatcctagtagaagtccaggacgatggcaccatgaaaataaaagacgaagaaagggatgataccctaaccattctacttaaagccaccttattagcagttagcggtgtatatccattaagcataccggccactttatttgtctggtacttttggcagaaaaagaaacagaggtcgggagtattatgggatactccctctccgccggaagttgaacgcgccgtccttgatgatggaatttatcgcattatgcaacgcggtctattaggaaggagtcaagtaggtgtcggtgtttttcaagagaatgttttccacaccatgtggcacgtaacaagaggagccgtattaatgtatcagggaaaaagactggagccatcttgggcatcagtaaagaaagacctgatcagctacgggggaggttggcggctacagggaagctggaacacgggtgaggaggttcaggtaattgcagtggaacctggtaaaaacccaaagaatgtacagactgctccaggaacattcaagacgccagaaggtgaagttggtgctatagctctagactttaaacctgggacatcaggtagtcccatagtaaatagggagggtaaaatagttgggctgtatggaaacggtgtggttacaacttcaggcacttacgtttctgcaattgcacaggcaaaggcttcacaagaagggccgctacccgaaatagaagatgaagttttccgaaagcggaacttaacaattatggacctacatccgggttcggggaagacgaggaggtatttgccagctattgttagggaagcaataaaaaggaaattaaggacgcttatcttagctcccactagagtcgttgcatctgagatggcagaagcacttaagggcatgccgattaggtaccaaaccaccgctgtgaaatcagaacatacaggaaaagaaatagttgacctcatgtgtcatgcaacattcacgatgaggctattaagtccagtgagggtaccaaattacaacatgataattatggacgaggcacattttacggacccaagttcgatagcggctagaggttacataagcactcgggtcggaatgggggaagctgccgctatattcatgaccgctactcctccaggaagtgtagaggcttttccacaatcaaacgcggtcattcaggatgaagaaagagatatacctgaacgtagctggaatagtggatacgagtggataactgatttcccgggaaagacagtatggtttgtgccatcaataaaatcaggtaacgacatcgccaactgcttgaggaaaaatggaaagcgagtaatacaattatctcgtaaaaccttcgatacggaatatcagaaaacgaaaaacaatgattgggactatgtagtaacaaccgacatctctgagatgggagctaactttcgggcggaccgggttatagatcctagacggtgtctaaaacctgtgatattaaaggacggacctgaaagggtgatattagcaggcccgatgccggtaactgtcgcgagtgccgctcaaagaaggggaaggattggacgtaatcataataaagagggtgatcaatatatttatatgggacagcctttaaataatgacgaggaccacgctcattggaccgaagctaaaatgttactagacaatattaacacaccagaaggtattatacctgcactatttgagcccgagagagagaaaagtgccgcaatagacggggaatataggctaagaggggaagctcgaaagagctttgttgagctaatgcgtagaggagacttaccggtgtggttatcatacaaagtagctagtgaaggttttcaatacagtgaccgtagatggtgttttgatggagaaagaaataatcaagtattagaagaaaatatggatgtcgaaatatggacaaaagaaggtgagaggaagaaactcagaccgaggtggctagacgcacgaacttacagcgatcccctcgcgttgcgtgagtttaaagagttcgcagcaggaagaagaagcgtatcgggagacttaatattagaaattggcaaattacctcaacatttgacacaaagagcccaaaatgccctagataatctagttatgttacataattcagaacaaggaggacgtgcgtatagacacgcgatggaagaactgccagacacaatagaaactcttatgctcttagcactaatagcggtactgacgggtggggtaacattatttttcctatcgggaagaggcttaggcaaaacttcaatagggctcctttgtgtaatggcttcaagtgtccttttgtggatggctagtgtcgaaccacactggatagctgcgtctatcatcttggagttctttcttatggtacttctaatccctgaacctgatcgacaacgtactccacaagataatcaactggcgtatgtggtcattggactactgttcatgatactgacagttgctgcaaatgaaatgggactattggaaacgactaagaaagatttaggaatagggcatgtggcggtagagaatcatcatcacgccgctatgcttgacgttgacctccaccccgcctcagcatggacattgtatgctgtggctacaactatcatcacaccgatgatgcgtcatactatcgaaaatacaaccgcaaatatatcattaacggcaatagcaaatcaagcagcaatactaatgggactggacaagggttggcctatatcaaaaatggacatcggtgtacctctattagcacttggttgctatagtcaagtaaatccattgacactaactgctgctgtattaatgctcgtagcgcactatgcgatcattggccctggtctccaagctaaggctacaagggaagctcagaaaagaactgctgcagggatcatgaagaatcccactgtggacgggattgtcgcaatagatcttgatcccgtagtctatgatgcaaaatttgaaaaacaattagggcagattatgctcttgatactttgcacgagtcaaatactattgatgcgcactacctgggccctatgcgagtctattacactagcaacagggccactaactactctgtgggaaggatctcctggtaaattttggaacacgactatagcagtgtccatggcaaatatattcaggggctcgtatttggcaggagctggcctggcattttcactgatgaagtcgttaggcggcgggagacgcggcacaggagcgcagggagaaactctaggcgaaaaatggaaacgtcaattgaatcaacttagcaagtcggagttcaatacttataagagaagtggaattatggaagttgatcgctcagaggctaaagaaggactgaagcgcggtgaaacgacaaagcatgcagtatcacgtggtacagccaaattaaggtggttcgtcgagagaaatttagtaaaaccagaaggaaaagtaattgatctagggtgtggaagaggaggttggagttattactgcgccggtctaaagaaagtgacagaggtgaaaggatacacgaaaggaggtccaggccatgaggagcctatacctatggctacatatggatggaatctagtaaaactacacagtggtaaggacgtattcttcattcctcccgaaaaatgcgataccttattgtgtgacattggcgaaagcagtcctaacccaacgatagaagaaggtcgaaccctccgggtattaaaaatggtggaaccctggctcagaggaaaccaattttgtataaagatacttaacccatacatgcctagcgtagtagagaccttagaacagatgcaacgtcgtcatgggggaatgctggtccgaaatcccctatcccgaaattctacgcacgagatgtattgggtaagctgtgggacaggtaatattgtctcagcagtaaatatgacgagcagaatgctacttaacagatttacaatggcccaccgtaagccaacatatgaaagagatgtcgatcttggagcgggaactcgtcacgttgctgtggagcctgaagtagctaaccttgatattatcggacaacgaattgagaatattaaacatgagcataaaagcacttggcattacgatgaagataacccgtacaaaacgtgggcttaccacgggtcttacgaagtaaaaccttctggatcagcatcaagcatggtgaacggtgtcgtaaaattactgaccaaaccatgggacgtcatacctatggtaacacaaattgcgatgacagataccacaccatttggacagcaaagggtttttaaagagaaggtggataccaggactcccaaggcgaaacgtgggaccgcccaaataatggaagtgacagcgaaatggttatggggttttctaagtcgaaacaagaaacctcgtatatgcactcgcgaagagttcacgagaaaggttagatcgaatgcagcaataggggctgtttttgtagatgaaaaccaatggaactcagccaaagaagccgtagaagacgaacgattttgggatttagtacacagagaaagagaactacataaacaaggaaaatgtgctacatgtgtatacaatatgatggggaagagggagaagaaattaggcgagttcggaaaggcaaagggttcaagagctatatggtatatgtggctgggagcgcggtttctggagtttgaggctttagggttcatgaacgaggatcactggtttagtagagaaaatagtctttcaggcgtggaaggagaaggactgcacaaactaggctacattctaagagacattagcaagatcccaggagggaatatgtacgcagatgatactgcgggttgggacacaagaattacggaggatgatctacaaaacgaagcgagaataactgatataatggaacccgagcatgcgctcttagctaaatccatttttaagctcacgtatcaaaacaaagtagttagagtacaacgacccgcgaaaaatggcaccgtaatggatgtgatcagcaggcgagatcagagagggtcgggacaagtaggtacatatggcttgaacacattcactaacatggaggcacagctcattaggcaaatggaaagcgaaggcattttcagtccatccgaattagaaacacccaatctcgctgaacgagtcctagattggttggaaaaatacggagtagaaagattgaaaaggatggctatttctggcgatgactgcgtagtaaaaccgatagatgatagatttgcgacagctcttacagctcttaatgatatgggcaaagtcagaaaagacattcctcaatgggaaccgagcaagggatggaatgactggcaacaagtcccattttgtagtcatcacttccatcaattgattatgaaagacggtcgcgaaattgtggtgccatgtcgaaaccaagacgagctagttggcagggcacgagtttctcaaggcgcaggctggtctttaagggaaacagcctgccttggaaaatcatatgcgcaaatgtggcaactcatgtactttcacagacgagacctacgactagcagcaaatgcaatttgtagcgcggtacccgttgattggataccaacatcacgaacaacctggtctatacacgcccatcaccaatggatgaccacggaagatatgctctcagtgtggaatagagtatggatagaagaaaatccctggatggaagataaaacacacatcagctcgtggggtgacgtcccatacttaggaaaaagagaagatcaatggtgtggatctctaatcgggttgactgcacgagcaacctgggcaacaaacatccaagttgctataaatcaggtcaggagactcatcgggaacgagaattacctagattacatgacatcgatgaagagattcaaaaatgaatctgacccggaaggggcattatggtaa

SEQ ID NO: 22009 - RNA, 9879 nt, synthetic construct
  misc_feature 1..9879: note = derived and/or modified CDS sequence (opt6) from DENV-1__JQ045667__SS-prME
  source 1..9879: mol_type = other RNA
tcagtaactatgcttttaatgctgatgcctactgctctagcttttcatctgacgactcggggaggtgaacctcatatgatagtcagtaaacaagaaaggggaaaaagcctattatttaaaaccagcgcgggcgtgaacatgtgtacattaatagccatggatctgggtgaattatgtgaagataccatgacatacaaatgtccgcgtattaccgagaccgaaccggacgatgtagattgttggtgtaacgcgacagacacgtgggtaacttatggaacttgcagtcaaacgggggaacatagaagagataaacgttctgtagctttggctcctcacgtaggtttaggattagaaacaagaaccgaaacatggatgagtagcgaaggcgcttggaaacaaatccaacgcgttgaaacctgggcacttagacatcccggctttacagtgatagctttatttttagctcacgcgatcggtacatctatcacacagaaaggcattatattcatactactcatgttggtgaccccatcaatggcaatgcgatgtgtaggtatagggtctagggatttcgttgaaggactatcaggtgccacttgggtagacgtcgttttagaacatggttcttgcgtgacaacaatggctaaagataaaccaacgctcgatatagaacttttgaaaacggaagtaacaaatcccgcaatattaagaaaattatgtatagaagcgaaaataagtaacacgactacaaattcaaggtgccctacacaaggtgaagcaactctagtagaagaacaagatgctaattttgtttgcagacgcacattcgtagaccgcggttggggaaatgggtgtggcctatttggaaaaggaagtttaataacatgtgcaaaatttaaatgcgttactaaactggaggggaaaattgtgcaatacgagaacttaaaatactcagtgattgtgacggtccacacaggagatcaacatcaagtaggaaacgaatcgacggagcatggcactacagccactatcacgccccaagctccaacaacagaaatacaactaactgattatggcgccttaacacttgattgctcacctagaactggtttggattttaacgagatggtgctacttactatgaaaggtaaatcttggttagtccacaaacaatggttcctcgatctccctctaccatggacaagtggcgcttccacttcacaagaaacttggaacagacaagatcttctagtgacatttaaaactgctcatgcgaagaaacaagaggttgtcgtactaggatcacaagaaggtgcaatgcatacggcgcttacgggcgcaaccgaaatacaaacatcgggcacaaccacaatttttgctggtcatttaaaatgtagactaaaaatggacaaattaacactaaaaggtatgtcatacgtaatgtgcactgggagctttaaactggaaaaagaggttgctgaaacccaacacggtacggtacttgtgcaaattaagtatgaaggtaccgacgctccatgcaagatcccttttagtactcaagatgagaagggtgtaactcagaatggtcgattaattacagctaaccctatcgttacggacaaagaaaaaccagtaaatatagaggctgaaccaccattcggtgaaagttacattgtaataggagcgggagaaaaagcacttaaattaagctggttcaagaaaggctctagtatcgggaaaatgttcgaagcgactgctagaggtgcacgaagaatggcaattttgggggatacagcatgggattttggatctatcggcggcgtatttacatcagtgggcaaactggtacatcaaatttttggtacagcgtacggagttctcttcagcggcgtaagctggactatgaaaataggtataggggtcctactaacatggttgggtctaaattcacgctcaacaagtttgtctatgacatgtatcgctgtgggacttgttacattgtatctcggagtaatggtacaggcagacagcggttgcgttattaattggaaaggtagagaactaaaatgtggctctggcatatttgtcacaaatgaagtacatacatggacagaacaatacaaatttcaagcagactcccctaaacggttgagcgcagcaataggtaaagcatgggaagaaggagtttgtggaatcagatccgcaacacgtttggaaaatataatgtggaaacaaataagtaacgagcttaatcatatacttttagaaaacgacatgaaattcaccgtcgtagttggtgatgtcgctggtattctagcccagggtaagaaaatgatacgaccccaaccaatggagtataagtattcctggaaatcatgggggaaagcaaagataataggtgctgatgttcaaaatactacatttataatagacggcccaaataccccagaatgtccagatgatcaaagagcctggaacatttgggaggttgaagattatggctttggaatcttcacaactaacatatggttaaagctcagagactcgtatacacaagtttgtgaccatagattaatgagcgctgctatcaaagattcaaaagcagtacacgcagatatgggatactggattgaatccgagaaaaatgagacttggaaactcgcaagggcgtccttcatcgaagtaaagacatgcatatggcctaaatcgcatactttatggtcgaacggggttctcgagtcggaaatgattattcctaaaatttacggtggccctattagtcaacataattaccgaccggggtactttacgcagactgcgggaccgtggcacctagggaaattagagcttgatttcgatttatgcgaaggaactactgttgttgtagatgaacactgcggaaataggggcccttcattaagaactacaaccgttaccggcaaaatcattcatgaatggtgttgtagaagttgtacactcccgccactacggttcagaggcgaagacggttgctggtacggaatggagatccgtcctgtaaaagagaaagaagaaaaccttgtaaaatcaatggtatccgcgggatcaggtgaggtagactcatttagtttagggctcttatgcatctcaataatgatcgaagaagttatgagaagccgttggtcacgaaaaatgttgatgactggaactttagctgtgttcttcttgttaataatggggcaattaacatggaatgatcttatacgcttatgcataatggtaggcgcaaacgcgtcggataggatgggtatggggaccacctacttagcattaatggcgacttttaagatgaggccaatgtttgcagtgggcttattatttcgtagattaacttcacgtgaagttctattacttaccataggactcagcttagtagcatctgtagaacttccaaattccttagaagaattgggtgatggtctagcaatgggaataatgatcctaaaacttctaacagatttccaaagctatcagctgtgggccacgttattatctctaacatttattaaaacaactttcagtcttcattatgcatggaaaacaatggctatggtattatcaatagtctctctattccctctttgtttaagcacaacctcccagaaaacgacatggttaccagtccttttaggatcgttgggttgtaaacccctaactatgtttttaatagcggaaaataagatctggggacgaaggtcttggcccttgaatgaaggaattatggcggtggggatagtctcaattttactttccagccttctcaaaaatgacgtgcctctcgcagggccactcatagccgggggaatgctcatggcttgttacgttattagcggatcgagcgctgatttaagtttagaaaaagccgcggaggtctcctgggaagaagaggcagaacattctggagccagtcataacatcctagtcgaagtacaaggtgacggaacgatgaaaattaaagatgaagaaagggatgacactttgactattctcctgaaagccactttattggcagtttctggtgtatacccattaagtattccagcaacactatttgtatggtatttttggcagaagaagaaacaacggtctggggtgttatgggatacaccaagtccaccggaagtagggagagcagtactcgatgacggaatctacagaataatgcaacgaggtttgttagggagaagtcaagtcggcgtcggcgtatttcaagaaaatgtctttcacactatgtggcatgtaacgcgaggagcagttcttatgtatcaaggtaagagacttgaacccagctgggcttctgtcaaaaaggatttgatatcatatggtggaggttggagattacaaggaagctggaacactggggaagaagtccaagttatagccgtagaacccggcaaaaatcctaagaacgtccaaacagcgccaggcacctttaaaactccggagggagaagttggcgcgattgcactagatttcaaacccggtacatcaggttcgccaatagttaaccgagaaggtaaaatagtaggactctacggaaacggcgtcgtaacaacaagtgggacatatgtaagtgccatagcccaagccaaagcatcccaagaaggtccgctccctgaaatcgaagatgaagtcttcaggaaacgtaatttaacaatcatggacctacatcctgggtctgggaaaactcgccggtatctccccgcaatagtccgcgaagcaataaaaagaaaactaagaacattgatactggccccaaccagagtggtggcctcagaaatggccgaagctctaaaaggaatgcctataagatatcagaccaccgcagttaaatctgaacacacaggtaaggaaatagtagacttgatgtgtcacgcaacttttacaatgcgactgttgtctccggtgcgtgtgccaaattataatatgattattatggatgaagctcatttcactgatccatcatcaattgcagctcgtggttacatatcaacgagagtcgggatgggagaggctgccgccatcttcatgaccgcgaccccaccaggtagcgttgaggctttcccacaaagcaacgccgtcattcaggatgaagagagagatattccagaaagatcatggaatagtggttacgaatggataaccgatttcccagggaaaacagtatggtttgttccatcaataaaatccggaaatgatattgccaattgtcttcgaaagaatggaaagagggtaatccaactatctcgtaaaacctttgacacagagtatcagaaaactaagaacaacgattgggattacgtagtgacaactgatattagcgaaatgggggctaactttcgtgcagaccgagtcatagatccacggcgatgtctaaaaccagtaattttaaaggatggtccggaacgcgttattctagcggggccaatgccagtaacggtggcatcagccgcgcagagacgaggccgaataggacgaaatcataataaagaaggggatcaatacatttacatgggacaacctctaaataacgacgaagatcacgcccattggacagaagccaagatgctactggataacataaatacacctgaggggatcatcccggctctgtttgaaccagagagagagaaaagcgcggccatagacggtgaatatcgattaagaggagaagccagaaaaacttttgtcgaactaatgcgccgaggggatcttccggtttggttatcttacaaggtagcgtcggaagggtttcaatatagcgacagaagatggtgttttgacggagaaagaaacaatcaagtattagaagaaaacatggacgtcgaaatttggacaaaagaaggggaaagaaagaaattacgaccaaggtggcttgatgctcggacttattcggacccgttggctcttagagaatttaaagaatttgcggctggtagacgctccgtatctggcgatctaatactcgaaattgggaaactaccacaacacttgacgcaacgcgcacagaatgctttagataatttagtaatgttacataacagtgaacagggcggacgagcatacagacacgccatggaagaattgccagataccatagagacactcatgctgttagcactaattgcagtcttaactggaggagtcacgctattctttctatccggaagaggtttaggtaagacatccataggattactttgtgtaatggcatcttccgttctactatggatggcatcggtcgagccccattggatagccgcatcgataatcctagagttcttcttgatggtccttctcattccagaacccgatagacaaagaacacctcaagataaccaattagcttacgttgtgattggccttttattcatgatcttaacagtagcagcgaacgaaatgggcttgctggaaactaccaagaaagatcttggaataggccacgtagccgttgaaaaccatcaccatgcagcaatgctcgacgttgacttacatcctgcatccgcatggacactttatgctgttgcaacaacaatcattacgcctatgatgcgacacaccattgaaaatacgactgctaatatctcgttaacagcaattgctaaccaagcagcaatactaatgggactagataagggatggccaataagcaaaatggacataggcgtcccattactagcgctaggttgctattctcaagtcaacccactaaccctaacagcagcagtgctaatgcttgtggcacattatgctatcattggaccagggttgcaagcgaaggcgacaagagaggcacaaaaacgaacagccgcaggaataatgaaaaatccaacagttgatggtatcgtagccattgacttagatcctgtagtttatgatgctaaatttgagaagcaactcggacaaattatgctattaatactatgtacgagtcaaatattgctgatgagaacaacttgggccctatgcgaatcaattacactagcaacaggtcctcttactaccctgtgggaaggatcaccagggaaattctggaacactacaatcgcagttagtatggccaatatattccgaggaagttatcttgcaggcgcaggactagcgtttagtttgatgaaatcactgggtggagggagacgtggcacaggtgctcaaggagaaaccttaggtgaaaagtggaaacggcaattaaaccaattgtctaaatctgagttcaatatatacaaaaggagtggaataatggaagtggacagatcagaggcaaaagaaggtctgaaacgtggcgagactacgaaacacgccgtgtccaggggaaccgccaaactacgatggttcgtggaacgaaatttagttaagcccgaaggaaaagtaatagatctaggctgtggacgtggcggttggtcatattactgcgctggattaaagaaagttacagaagtgaaaggatatacgaagggtggcccaggacatgaagaaccaataccgatggctacgtacggctggaatctggtaaaattacatagcggtaaagacgtatttttcatacccccagaaaaatgcgatactctcctctgtgacattggcgaatccagcccaaacccaacaatagaagagggacgaaccttacgtgttctcaaaatggtcgagccatggctgcgaggcaatcaattttgcataaaaatattaaatccttatatgccatcagtagttgaaactcttgaacaaatgcaaagaaaacatggtggtatgctagtaaggaatccacttagtcggaacagcacccatgagatgtattgggtttcatgtggtactggaaatatagtgtcagcggtaaacatgacatctcgaatgttgcttaatagatttacaatggcccacagaaaacctacctacgagcgtgatgtagatctaggagctggaacacgccacgtagcagtcgaacccgaagtcgccaaccttgatataataggacaaagaatagagaacataaaacatgaacataaatcaacttggcactacgacgaagataacccatacaaaacatgggcctatcatggaagctacgaagtaaagccgtcgggatcggcaagctccatggtcaatggggtagtgaaattactaactaaaccttgggatgtgatacccatggttacacaaattgctatgacagacactacgccgtttggacaacaaagagtattcaaggaaaaagttgatacgcgcactcctaaagccaaaaggggaacgattcaaataatggaagtaacagccaagtggttatgggggtttttatcgagaaataagaaaccaagaatatgcacacgagaagaatttacacgcaaagtgaggtcgaatgcagcaataggcgcggttttcgtagatgagaatcagtggaactctgccaaggaggcggtagaagacgaaaggttctgggatttagttcatagggaacgcgagttacacaaacaaggaaaatgcgcaacatgcgtatataacatgatgggtaagcgagagaagaaactaggcgaatttggtaaagctaaaggtagtagggcaatatggtatatgtggctgggagcgagatttcttgaatttgaggcgcttggatttatgaatgaagaccactggttcagtagggagaatagccttagcggcgtggaaggggaaggtcttcacaaactcggttatattcttagggacatttctaaaattcctggcggaaacatgtatgcagacgatacagccgggtgggatacgagaataaccgaagatgaccttcagaacgaggccaggataacagatattatggaacctgaacacgcattacttgctaaaagtatatttaaattaacatatcaaaacaaagtagttagagttcaaagaccagctaagaatggaactgtaatggatgtaataagtcgcagagatcaaagaggatccggtcaagtgggtacatatggtctgaacacattcacaaacatggaagcacaattgatacgacaaatggaaagcgaaggaattttctcaccatctgaacttgaaacacccaatctcgcagaaagggtccttgactggttggaaaaatatggagtggaaagactcaaaagaatggccatatccggagatgattgcgtagtaaagcctatagatgatcgatttgcaaccgctcttaccgcactaaacgatatggggaaagtcagaaaggatatcccacaatgggaaccatcaaaaggatggaatgattggcaacaggtccctttctgcagtcatcacttccatcagctaataatgaaagacgggagggaaatagttgtaccatgtcgcaaccaggacgagttagttgggagagcgcgggtttctcaaggggccggttggtcattacgtgagactgcatgtttaggaaaaagctatgcgcagatgtggcaactcatgtatttccatcgaagagatttaagactagccgcaaacgcaatttgctccgcagtacccgttgattggataccgacctcccggacaacctggagcatccatgcacaccaccaatggatgacgactgaagacatgttgtctgtatggaaccgagtatggatcgaagaaaacccatggatggaggataaaacacacattagctcatggggagatgtcccatatttaggcaaaagggaagatcaatggtgtggcagcttaattggacttacagcacgggcaacttgggcaactaacattcaagtagcgattaatcaagttagacgcttgattggtaacgaaaattatttagattacatgactagcatgaaacgattcaagaatgagtcagacccagaaggagcattatggtga

SEQ ID NO: 22010 - RNA, 9879 nt, synthetic construct
  misc_feature 1..9879: note = derived and/or modified CDS sequence (opt6) from DENV-1__KU094071__SS-prME
  source 1..9879: mol_type = other RNA
agcgtaacgatgttgttaatgttgttaccaactgcattagcatttcacctaaccactcgcggaggagaaccccatatgattgtctctaaacaagagagaggaaaatcattgttatttaaaacaagtgccggtgttaatatgtgtactctcattgccatggacctaggggaattatgcgaagacacaatgacttacaaatgtccacgtataaccaaagcagagcccgacgacgtagactgctggtgtaacgctaccgacacttgggtaacatatggtacatgcagccaaacgggggaacacagacgtgataaaagatcagtagccctagctccccacgtaggactcggccttgaaacacgtgccgagacttggatgtcatcagaaggagcctggaaacaaatacaaaaagtggagacctgggcattacgacatcctggattcacggttattgcactatttcttgctcatgctataggtacgagcataacgcagaaaggaataatctttattctcctaatgctggtaaccccgagcatggcaatgagatgcgtaggaataggaaacagggatttcgttgagggactgagcggcgggacatgggtagatgtcgtattagaacatggtagctgtgtaaccacaatggccaaagacaaaccgacattagatatcgaacttctaaaaactgaagtaacaaatccggctgtgttacgaaaactatgcatagaagcaaaaataagtaatactacaactgacagtcgttgtccaacgcaaggagaagccacccttgtagaggaacaagacgcgaatttcgtatgccgaagaacatttgtcgaccgcggatggggcaatggctgtggattatttggaaagggaagcctaataacttgtgccaagttcaagtgcgtaaccaaattagaaggaaaaatagtacaatatgagaatttaaagtatagcgtcatagtgacggtccacacaggcgatcaacatcaggttggtaacgaaaccacagaacacggtactattgccacaataaccccgcaagcgccaacaagtgaaatccaattgacagattacggtgcactcacacttgattgttccccaagaacagggctagactttaacgaaatggtgctcttgacaatgaagcggaaaagctggttagtccacaaacaatggttcttagacttacctcttccatggacatctggtgcaagtacaccccaggaaacatggaatcgtgaagaccttcttgtgacattcaaaaccgctcacgctaaaaagcaagaagtggtcgttttaggcagccaggaaggtgctatgcacacagcattaacaggcgctactgaaattcaaaccagtggaaccacaaaaatcttcgctggacatttaaagtgtaggttgaaaatggacaaattaactttaaagggcatgtcgtatgtcatgtgtactggatcgttcaaacttgaaaaagaggtggcagaaacccaacatggaactgtattggttcaagtcaaatatgaaggaacagacgcaccatgcaagattccgtttagtacacaagatgaaaaaggtgtaactcaaaatggaagactaataactgccaatccaattgtgacagataaagagaagcctgtaaacatcgaagctgaaccaccattcggtgagtcctatattgtagttggagctggagagaaagcacttaaactctcatggttcaagaagggtagtagcattggaaagatgttagaagcaacggctagaggagctaggcggatggctatcctaggcgacaccgcatgggactttggatcaataggcggagtttttacttctgtaggaaaattagtacatcagatcttcggaacggcatatggagtactgtttagcggcgtctcatggacaatgaaaattggcattggtatactcctgacatggctgggtctcaacagcagaagtgccagtctgagtatgacctgtatagccgtaggtatggttacattatatttgggtgtaatggttcaagcagactctgggtgcgtgataaactggaaagggcgagaacttaagtgtgggtctggcatttttgtaaccaatgaggtacatacttggactgaacaatacaaatttagagctgattctcctaagcgattaagtgcggcaattgggaaagcctgggaagaaggcgtgtgcgggattcgttccgcaacaaggctagagaacattatgtggaaacagattagtaatgaattaaatcatatacttttagaaaatgacatgaaattcacagtggtagtaggagatgtctctggtatactaacgcagggtagaaaaatgatcggtccacaaccgatggaacataaatatagttggaaatcatggggaaaagccaaaatcattggagcagacgtacaaaacacaacctttataatcgatggaccgaatacacctgaatgtccggacgaccaaagagcatggaacatttgggaagtagaagattatggattcggtatatttactactaacatatggctaaagctgagagatagttacactcaagtatgcgatccaaggttaatgagcgctgctataaaagactcaaaagctgtgcacgctgacatgggatattggattgaatcagagaaaaacgagacatggagacttgcacgggcttcattcatcgaggtcaagacgtgtgtatggccgaaatcacatacattatggtccaatggcgtcttagaatcggagatgataataccaaaaatatacggaggaccaatcagtcagcataattatagaccgggctattcaactcagaccgccgggccatggcacttaggaaaacttgaattagattttgacctctgtgaagggacaacagtagttgtagacgagcattgtggtaatcgtggtcctagcctacgcacaacaacagtaacgggaaaaatcatacatgaatggtgttgtcggagttgtaccctaccaccactgagatttaaaggtgaagatggatgctggtacggaatggaaataagaccagtaaaagacaaagaagaaaaccttgttaaaagcctcgtctcggccgggtcaggcgaagtcgactctttttctttaggactactttgtgtttcgataatgatcgaagaggtaatgcgctcaagatggagcagaaaaatgttaatgacaggaacgcttgccgtcttcttgttactgataatgggtcagttaacctggaatgacttaatacgtttatgtattatggtcggagcaaatgcctcagaccgaatgggaatgggtactacatatctggccctaatcgccacattcaaaatgagaccaatgtttgcagtaggattattattcaggcgattaacgagtagggaggtattattacttacgattggattaagcctagtggcttctgttgaattaccgaatagcttagaagaactaggggacggtctggctatggggatcatgatcctcaaactactaacagacttccaaagccaccaactatgggctgcattattatcactaacgtttattaagaccacgtttagtttgcattatgcctggaagacaatggccatggtcttaagcaccgttagcctgttcccattatgtctttctacgacatctagaaaaacaacatggcttcccgtactattaggtagcctgggatgtaaaccactaactatgtttctaattgcagaaaataaaatatggggtagaaagtcttggccactaaacgaaggtatcatggccgtgggcattgtctccatattattgtcttcactactcaaaaacgacgttccactagctggtccactaatagctggaggtatgcttattgcctgttacgtcattagcggaagtagtgctgatctttctttagaaaaagcggcggaagtatcctgggaggaagaagcagaacactcaggagcttcacataacatcttagtagaagtccaggacgacggaaccatgaaaataaaagatgaggaaagagacgacacgcttaccattctgctaaaagcaaccttgttagcagtatcaggagtgtatccaattagcattcccgcaacactttttgtatggtacttccgacaaaagaagaaacaacgatccggggtattatgggatacccctagccctccggaagtagaaagagcagtattagacgatggaatatatcgaatcttacagagaggactattaggtcgaagtcaagttggcgttggtgtatttcaggaaggagtattccacacaatgtggcatgtcacccgaggcgcagtattgatgtatcagggtaaaagacttgagccatcgtgggcgtctgtaaagaaggatttgattagttacggtggcgggtggagatttcaaggcagttggaatactggtgaagaagtccaggtcattgcagtcgagccaggaaagaaccccaaaaatgtacaaacagctcccggaacattcaagacccctgaaggagaagttggcgtgatcgctctggattttaagccgggaacaagtggttccccgatcgtcaatcgggaagggaagatagtaggtttatatggaaacggagtggtgacaacttctggtacttacgtaagcgctatagcgcaggccaaagcatcgcaagaaggtcctcttccagaaattgaagatgaagtatttagaaagaggaatctcacaataatggacctacatcctgggtcgggtaagactagaagatacctacctgcaatcgtacgtgaagcgataaagcgtaaactaagaactttaatattggcgccaacgagggtagtagctagcgaaatggcagaagcacttaaaggcatgccgataagatatcaaacaacagccgttaaatctgagcacactggtagagaaatagtcgatcttatgtgccacgccaccttcactatgagactactatctcctgtcagagtaccaaattacaatatgatcataatggacgaagcgcactttactgacccggccagtatcgctgcaagagggtatataagtacacgcgtaggaatgggagaggcggcggcaatatttatgactgctactccaccaggctctgtggaagcgtttccccaaagtaatgcagtaattcaggatgaggaaagagatattcctgaaagaagctggaatagtggctatgattggataacagatttcccagggaaaacagtatggtttgtaccaagtataaagtcgggaaatgatatagcaaattgccttcgcaagaacggcaagagagtaatacagctaagtcgtaaaacttttgacactgaatatcaaaagactaaaaataatgactgggattacgtagtcacaactgatattagcgaaatgggtgccaacttcagagccgatcgagttattgacccccgaaggtgttcaaaaccggttattttgaaagatgggccggagcgtgtaattctggccggacccatgcccgtaactgttgcaagcgcagcacaaaggcggggcagaatagggagaaatcaaaacaaagaaggtgatcagtatatttatatgggacaaccattaaacaatgatgaagaccacgcccactggacagaagcaaaaatgctattagataacattaatacaccagaaggcattataccagcgctattcgaaccagagcgagggaagtcagccgcaatagatggtgaatatcgcctaaggggtgaggcaagaaagacatttgtagaactcatgcgaagaggggatctgccagtttggttatcgtacaaagttgcttcagaagggtttcagtattctgaccgaaaatggtgttttgatggtgaacgaaacaaccaggttttggaagaaaacatggatgtagagatttggactaaggaaggcgaaagaaagaaactaagaccacggtggctagacgctcggacatattctgatccccaggcgttaagggaatttaaagagttcgccgccggcagacgaagtgtctctggtgatctaatattggaaataggaaaactaccgcagcatcttacccaaagggcacaaaacgcgttggataatttagtcatgttgcacaactcggaacaaggaggaaaagcctatcggcacgcgatggaagaattaccagacacgatagaaacccttatgctattagccctaattgccgtgctgactggaggcgtgacattattctttttatccggacggggactaggcaaaaccagcataggactattatgtgtcatggccagctcagtacttctttgggtcgcaagtgttgaaccacactggatagctgcaagcataatacttgaatttttccttatggtacttttgatcccagagccggatagacaaagaactccacaggataaccaattagcatatgtcgtaattgggttgttatttatgatcttaacggtagccgcgaatgaaatgggattattagaaacaaccaaaaaggacttaggaattggacatgtagcagttgaaaatcaccatcatgccacgatgctagatgttgatctcaggccggcaagtgcatggacactatatgccgttgctacaacaataataacaccgatgatgcgtcatacgattgaaaacaccaccgcaaatataagtttgacagctatcgcaaaccaggcagccatacttatggggcttgacaagggttggccgatatctaaaatggatataggtgtccccctactagcattaggttgttatagccaagtaaatccaccaactttaattgcagccgtgttgatgttggttgcacattacgcaattataggtcccggtctacaagcaaaggcgacccgagaagcacagaaaagaacggcagcgggaattatgaaaaatcctacagtcgacgggattgtagcaatcgacttagatccagtagtgtacgatgctaaattcgaaaagcaattgggccaaatcatgttacttatcttatgtacatcacagatcctaagtatgcgaactacgtgggcactatgtgaatctatcactttagccactggtcctttaactaccttgtgggaaggaagtcccggaaaattttggaataccacgatagctgtttcaatggcaaatattttcagaggcagttatttagcaggagctggattggcttttccattgatgaaatcgctcggtggcggtcgaagaggtaccggggcacaaggagaaactttgggagagaagtggaaaagacaattgaaccaattgtcaaaaagtgaatttaatacatataaaagatcaggtataatggaagtcgatagaagcgaagcaaaagaaggtttaaaaagaggtgaaactaccaaacatgctgtttcccgtgggaccgcaaaacttaggtggttcgtcgaaagaaacttggtcaaacccgagggtaaagtgatcgaccttggttgcggtcgtggtggatggagctattattgtgcgggtctcaaaaaggtaacggaggtgaaaggctatacaaaagggggacccggacatgaagaaccaatcccaatggcaacgtatgggtggaatctagtaaagttacattcaggaaaagatgtattctttacaccgccagaaaaatgtgatacattactatgtgacataggcgaatcatcacccaatcctacaattgaagagggaaggacgcttcgagtgctgaaaatggtagaaccatggctacgtggcaatcaattttgtataaaaatcctaaatccttatatgccgtcagtagtggaaacattagaacaaatgcaaaggaaacatggaggaatgctcgtacgtaaccctttgtccagaaacagcacacacgagatgtattgggtaagttgtggaacgggtaacatagtgtcagcagtgaatatgacaagtcgtatgttactaaatcggttcactatggcgcatagaaaaccaacttatgagagggatgtagatctaggagctggaactagacatgtagctgtggagcccgaggtagcaaatttggacataattgggcagcgcatcgaaaacataaagaacgaacataaatctacatggcattatgatgaggataatccctacaaaacatgggcgtaccatggctcttatgaagttaaaccctcagggagtgccagttcaatggttaatggagtagtaagactactgacaaaaccttgggatgttattccaatggttacacaaattgcgatgacagatacaacaccattcggccagcagcgagtctttaaagaaaaggtggacacacgaactcctaaggcgaaacgtggtactgcgcaaataatggaagtaactgctaggtggttatgggggttcttaagtcgaaacaagaaaccacggatatgtacacgagaggaatttacgcgtaaagtgcggagcaacgctgccattggtgcagtgttcgtagacgagaaccaatggaatagcgcgaaggaagcggttgaagacgagagattctgggacctagttcatcgagaacgtgaacttcacaaacaaggtaagtgtgcgacttgcgtttataacatgatgggtaaaagggaaaagaagttgggtgaatttggtaaggctaagggaagtcgcgctatctggtatatgtggttaggggcaagatttcttgaatttgaagcgctcggatttatgaatgaggaccattggttcagtcgcgaaaactctttatcaggtgtggaaggagaagggctacataaacttggatatattttaagagatataagtaagataccaggagggaatatgtatgcagacgatacagcagggtgggatacacgaattaccgaagacgatctacaaaacgaagccaaaataacagatataatggaacctgaacatgcacttttagcaactagcatatttaaattaacataccaaaacaaagttgtgcgagtccaaaggccagctaagaatgggacggttatggatgtaatatcaagaagagatcaacgtgggagtgggcaagtgggtacatatggcctaaatactttcacaaatatggaggtccagttaatacggcaaatggagtcggaggggatattttcaccttctgagcttgagacccctaatctggctgaacgtgtccttgattggttggaaaaacatggtgtagaaaggctaaaaagaatggctatatcaggagacgattgtgttgtgaagccaacagatgatagatttgcaacagctttaactgctcttaacgacatgggtaaagtaagaaaggatataccacaatgggaaccctcaaagggttggaacgactggcagcaagtaccattttgttcacatcatttccatcagctaataatgaaagatggtcgagaaatcgtcgttccatgtagaaatcaagatgaacttgtaggcagagctcgcgttagtcaaggagcaggttggagcttgagagagactgcgtgtttaggaaaatcatatgcacaaatgtggcaattaatgtactttcacaggagagatttaagactagcagcaaatgccatttgcagtgctgttccaattgactgggtacctacatctagaacaacgtggagtattcatgcacatcatcagtggatgactaccgaggacatgttgtcagtatggaacagggtctggatagaagaaaacccatggatggaagacaagacccacgtatccagctgggaagatgtaccctatctaggtaaacgagaagatcaatggtgtggatcactcattggattaactgcgagggcaacatgggcaaccaatattcaagttgcaataaatcaagttcgcagactaataggaaatgaaaattacttagactacatgacctccatgaagagatttaaagacgaatctgacctagaaggggcattatggtga

SEQ ID NO: 22011 - RNA, 9879 nt, synthetic construct
  misc_feature 1..9879: note = derived and/or modified CDS sequence (opt6) from DENV-1__HQ624983__SS-prME
  source 1..9879: mol_type = other RNA
tctgtaactatgctactgatgcttgtaccgaccgcactagcatttcaccttacaacacgaggtggggaaccgcatatgatagtttcaaaacaagaacgaggaaaatcacttctatttaaaacaagtgctggtgtaaatatgtgtacactgatagcaatggatcttggagaattttgtgaagacactatgacatataaatgtccaagaatctcagaagcagaacctgatgacgtcgactgttggtgcaatgcaaccgatacttgggtaacatatggaacatgcagtcaaacgggtgagcatcgtagggataaaagatcagtggcattagcaccacatgtgggtctagggctggaaacaagaacagaaacgtggatgagttctgagggagcatggaaacaaatacagagagtggagacatgggcgctgagacatccggggtttacagtcatagccctctttttagcacatgctattgggacaagtataacgcaaaaaggaattattttcatcctactaatgctcgtaaccccatctatggccatgaggtgtgtcgggattggctcacgggatttcgtggaaggccttagcggtgccacttgggtagatgtagtattagaacatggttcgtgtgtaactacaatggcaaaagataaaccaacattggatatagaacttctcaaaacggaagtaacaaatccagcagtcttacgtaaactttgtatagaagctaaaatttcaaataccacaactgactcccgatgcccaacacaaggagaagctacccttgtcgaagaacaagacgctaactttgtttgtagacgtacctttgtggatagagggtggggaaatgggtgcggtttatttggtaaagggtccttaatcacatgtgcgaaattcaaatgtgtgaccaaactagaaggaaaaatagtccaatatgaaaatcttaaatattctgttatagtgacagttcatacaggtgatcaacaccaagttggcaatgaatcaactgagcatgggacaacggctacaataacccctcaagccccgagtacggagatacaattaacagattacggtgcactaactctagattgttcgccaagaacgggcctcgattttaatgagatggtgcttttaacaatgaaagagaaaagttggttggtccacaaacaatggtttctggatttaccattaccgtggacttctggcgcgtcgacaagccaagaaacctggaatagacaagatttattagtaacttttaaaacagcacatgctaagaaacaagaggtagtcgtattaggaagccaagagggggcaatgcacacagcactaaccggcgctacggaaatacaaacatctggaacaacgactatctttgcaggtcatcttaagtgcaggctaaaaatggacaagctaaccctgaagggtatgagttatgttatgtgcacaggttccttcaaactagagaaagaagtggccgaaacgcaacacgggacggttttagtacaaattaaatatgaaggtacagacgctccatgcaagatcccattcagcacccaagatgaaaaaggagttacgcaaaacggaagattaattaccgcaaacccaatcgtaaccgataaagaaaagccagtgaacattgaagcagagcctccattcggagaaagttacattgtgataggcgccggagagaaggctctcaaactaagctggtttaagaaaggaagcagtataggcaaaatgtttgaagcaacggcacgaggagctcgtcggatggcgatattgggtgacactgcatgggacttcggttcaatcggcggagtgtttacatcagtggggaaattagtacaccaaatatttggtacagcttacggagtactattttcgggagtaagttggacaatgaagataggaataggggtgcttttaacatggctggggttaaacagccgaagtacttcactatctatgacatgcattgcagtagggctcgttacgctttacttgggggtaatggtacaagccgatagtgggtgtgtaataaattggaagggacgtgaattaaaatgtggatcgggaatatttgtcacaaacgaagttcatacctggaccgagcaatacaagttccaagcagatagtcctaaaagactgtcggccgcgatcgggaaagcatgggaagagggtgtttgtggcatccgcagtgctactcgcttggaaaacatcatgtggaaacagataagcaatgagctcaatcacatattactggaaaatgacatgaagtttactgtagtagtaggcgacgtggccgggatattagcgcaagggaagaaaatgattcgcccccaaccaatggaatacaaatattcttggaaatcatggggtaaagccaagattataggtgcagacgttcaaaatacgactttcattatcgacggtccaaataccccggagtgtccggatgatcaacgcgcatggaatatatgggaagttgaagattatggatttgggatatttaccactaatatttggttgaaactaagggattcgtacacacaagtatgtgaccatcgtttaatgtcagctgctataaaagacagtaaagccgttcacgccgatatgggctactggatagaaagtgagaaaaacgaaacatggaagttggcacgggcctcgtttattgaagttaaaacatgtatatggccaaagagtcataccctctggtcaaatggcgtactagagtctgaaatgattattcccaagatctatggagggccaattagtcaacacaactatcgccctggatactttacgcaaacggcggggccatggcacttgggaaaattagaacttgacttcgatctatgtgagggaacaacagtagtcgtggatgaacactgtgggaatcgcggtccgtcgctcagaaccaccacagtgacggggaaaataatacatgaatggtgctgcagatcttgtacgttaccacctctcagattcaaaggggaggatggctgttggtacggaatggaaatccgaccggtcaaagaaaaggaagaaaaccttgtcaaatccatggtaagcgccgggtccggcgaagtagattcgttctctctgggattattgtgcatttccataatgatagaggaagtgatgaggtctcgatggtctaggaaaatgcttatgaccggcacgttagcagtgttctttttactaataatgggccaactaacgtggaacgatcttatacgtttatgcataatggtgggcgcaaacgccagtgataggatgggtatgggaatgacttatttagcattaatggcaacattcaagatgcgacctatgtttgcagtcggcttattattccgaagactaacaagcagagaggtactcctcttaaccattggtttgagtcttgtggcgtcagtggaactgccaaactcacttgaagaattaggtgatggtttagctatgggcataatgatattaaaactcctcacggattttcaatctcaccagctgtgggctaccctgttgagtctaacgttcataaagactacttttagtcttcattatgcctggaaaactatggctatggttctaagtatcgtgagcttattccccttatgcttatcaacaacaagtcagaaaacaacgtggttaccagtcttattgggatcgttaggatgcaaacctctaaccatgttccttatcgctgagaacaaaatttggggtcgcaagagttggccccttaacgaaggaattatggccgttggaatagtaagtatcttactcagttctttattgaaaaatgacgtgccgctagctggacccttaatagctggtggaatgttaatagcatgctacgtaataagtgggtcaagtgcagatctttcattagagaaggccgcagaagtaagctgggaagaagaggcagaacacagcggcgcctctcacaatattttggttgaagtccaagacgacggaacaatgaaaataaaagacgaagaaagggatgatacattaacgattctcttgaaagccacattacttgcagttagtggtgtctatcccctatcaataccggctaccttgtttgtatggtatttttggcagaagaagaaacaacgaagcggagtattatgggatacaccgtcaccaccagaagtagaacgtgccgtcttagacgatggaatttatcgcataatgcagcgcggactcctgggcagaagccaggtaggtgtaggcgtgtttcaagagaatgtctttcacaccatgtggcacgtaacaagaggagcggtgcttatgtaccaaggaaaacgtttagagccatcatgggcaagtgtaaagaaggatctcattagttatggaggaggctggaggctacagggcagctggaatacaggcgaagaagtacaagtaattgcagttgaaccgggcaaaaatcccaaaaatgtccagacagcacctggaacgttcaaaacaagtgaaggagaagtcggagcaatcgctctcgactttaaaccgggtacctcaggtagcccaatagttaacagagagggtaaaatagtaggcctatacggtaatggagtcgtaaccacgtcgggtacatatgtctctgccatagcccaagcaaaagcatcgcaggaagggcccttacctgaaattgaagacgaggtatttagaaagcgcaatctaaccataatggacctgcacccaggaagtggaaaaacacgacgttacctacccgctatagttagagaagccattaaaagaaagttacgtaccttgattctagcacctacaagagtggttgcatcggagatggctgaagcgcttaaaggaatgccgatcagataccaaactacagctgttaaatcagaacatacaggcaaagaaatcgtcgatttgatgtgtcacgcgacattcacgatgagactattatcgcctgttcgtgttcctaattataacatgataataatggatgaagcacactttacagatcctagtagtatagccgcaagaggatatattagcacaagagttgggatgggggaggcggctgcgattttcatgaccgcaacaccaccgggaagtgtcgaagcattccctcagagtaatgcagttatacaagatgaagaaagagatattccagaacgttcatggaactcgggctacgaatggattacagatttccctggcaaaactgtatggtttgtcccctcgatcaaatctggcaacgatattgcaaattgtctcaggaaaaatggcaaaagggtaattcaactatcccgtaaaacgtttgacaccgaatatcagaaaaccaaaaataacgactgggactacgttgttacaacggatatttcagaaatgggggcgaacttccgcgcagatagggtaatagacccccgacgatgtttaaaacccgtcatattaaaagacggcccggaaagagtaatactcgcgggtccaatgccagtcacagttgcctctgcggcccaaagaaggggccgcataggaaggaatcataataaagaaggagaccaatacatttatatgggccaaccactaaataatgatgaagaccacgcacactggaccgaggcgaaaatgctactagacaacataaatactccagagggtattatacccgcattgttcgaaccagagagggagaaatcggcagcaatagatggcgagtatagactaaggggagaggcacgtaaaacattcgtagaattaatgcgtagaggggacctaccggtatggttgagctacaaagttgcttcagaaggtttccaatattcagacaggaggtggtgtttcgatggcgaacggaacaatcaagtcctagaggaaaatatggatgttgagatttggacaaaagaaggggaaagaaagaaacttagacctaggtggttagatgcgagaacatatagtgatccattagctctgagggaatttaaagaatttgcagcagggaggcgctccgtctcaggcgacttaatactcgaaattggaaaattacctcaacatttaacacaaagagctcagaatgcactagacaatcttgtgatgttacataactcggagcaaggcgggcgcgcttacagacacgctatggaagaactaccagatactattgaaaccctgatgcttctcgccctcatagcagttttgacaggaggggtgacactattctttctctcgggccgaggattaggcaaaacatcaatcggtttgctttgtgtaatggcttcctctgtactcctttggatggcttccgtggaacctcactggattgcagcgtccattatcttagagttctttttaatggtgcttctaattcccgaaccagataggcaacgaaccccacaagacaaccagttggcttacgttgtgataggactactttttatgattctcacggtagctgccaatgaaatgggactgttagaaacaacgaaaaaggatttaggtataggtcatgtagcagttgagaatcatcaccatgccgctatgctcgacgtcgatcttcaccctgcctctgcatggaccttatacgccgtggccacaacaataattacgcctatgatgcgccatactatagaaaacacaaccgctaatatatcattgacagccatagcaaatcaggctgctatattgatgggactagataagggttggcctatatccaaaatggacatcggcgtaccccttttagcactaggttgttactcacaggttaatcctctaacgctaacagcggccgtgttaatgcttgtcgctcattatgcaattattgggccaggtttacaagcaaaagcaactagagaagcacaaaaacgaacggctgcagggataatgaaaaatcctactgtggacggaatagttgctatagatttggatcctgtagtttacgatgctaaatttgagaaacaactaggacagataatgttgcttatcctatgtacatcgcaaatactattaatgagaaccacatgggccttatgcgaatctataacactagctacaggccctctgacaactttgtgggaaggttcaccggggaaattttggaacacaacaatagctgtcagtatggcaaatatctttcgcggctcatacttagcaggagcaggactagctttctcgctaatgaaatctttgggaggtgggagacgtggcaccggtgcgcaaggtgagacgttaggagaaaaatggaagcgtcagttaaaccatctaagcaaatctgaatttaatacttataagcgttcaggaatcatggaagtcgatcgctccgaggcaaaagaagggttgaagcgaggagaaacaaccaagcacgcagtatcaagagggacagcaaagttacgatggtttgtagaacggaatttagtgaaacctgaaggaaaggtaatagatttaggttgtgggcgaggagggtggtcgtattattgcgccggactcaagaaagtcactgaagttaaaggctatactaagggtggacctggccacgaagaaccgatacccatggcaacgtatggatggaatttagtgaaactccatagcggaaaggacgtattcttcgtaccgcctgaaaaatgcgatacattattatgtgatataggtgaaagcagccctaaccccacaatagaagaaggccggacgttacgtgtattgaaaatggttgaaccctggctacgaggtaatcaattttgcataaaaatactaaacccgtatatgccgtccgtggtagaaacacttgaacaaatgcaaaggaaacatggtggtatgttagttaggaaccccttatccaggaactcaacccatgaaatgtattgggtctcatgcggaactggaaacattgtatctgccgtaaacatgacatctcgtatgctgttaaatcgtttcacaatggctcaccgtaagccaacgtatgaaagagatgtagatctaggtgcaggtacaaggcacgtagctgtagaaccagaggtagccaacctcgatataattggtcaacgaatagaaaacataaaacacgagcataaatccacctggcactatgatgaggataatccatataaaacatgggcgtaccatgggagctacgaagtaaaacctagtggttctgcttcaagcatggtgaatggggtcgtgaagttacttaccaaaccttgggacgtaattcctatggtcactcaaatagcaatgacagacacaacaccgtttggccaacagagagtttttaaggagaaagtcgacacgagaacaccaaaggccaagagagggacagctcaaataatggaagtaactgctaaatggttatggggatttttaagtcgaaataagaaaccacgcatatgtaccagggaggaatttacacgaaaagtacgatcaaatgccgctattggtgccgtgtttgttgacgaaaatcaatggaactcagccaaggaggcagtagaggacgaacgtttttgggatctggttcaccgggaaagagaattacataaacaaggaaaatgtgcgacatgcgtttataatatgatggggaaacgagagaagaaactcggagaatttggaaaagcgaaagggtcaagagcgatttggtacatgtggttaggcgcccgtttcttagagttcgaagctctagggttcatgaatgaagaccactggttctccagggaaaattcattatccggtgtagaaggagaagggctacacaaactgggatatatcctgagagacataagcaaaatctcgggtggaaacatgtatgcagatgacacagcgggatgggataccagaattacggaggacgacttgcaaaacgaagcaaaaattaccgatatcatggaaccggaacatgcgctacttgcgaacagcattttcaaacttacctaccaaaataaggtggtcagagttcagagacctgccaaaaatggcacagtaatggacgtaatatcccgaagagaccaacgaggtagcggtcaagtaggtacgtatggattaaacacatttactaacatggaagcacaattaatacgacaaatggaaagtgaagggatattttctccctctgaattggaaacaccaaatcttgccgaaagagttttagactggctggaaaagtatggagttgaaagactcaaaaggatggcaatctctggagacgattgcgttgtaaagcctatcgacgatagatttgcaaccgccctaactgcgctcaatgatatgggaaaagtcagaaaagacataccgcaatgggagccaagcaaagggtggaatgattggcagcaagtcccattctgctcacaccactttcaccaattaatcatgaaagatggtcgagagatcgttgtaccatgcagaaatcaggatgaattagtgggccgcgcgagagtatcacaaggggcgggctggtcactaagagaaacagcgtgtttgggaaaatcttatgcacaaatgtggcaactaatgtatttccatcgccgcgatctaagactcgcggccaacgctatttgctcagcagttccagtagattgggtcccaactagcaggaccacatggtcgattcatgcacatcatcaatggatgactgcagaggatatgctgtcagtatggaatagagtttggattgaagaaaatccatggatggaagacaagacccatatttcatcatgggaggatgtgccatatttaggaaaacgagaggaccaatggtgtggcagtcttataggactaaccgcaagggccacttgggccacaaacatacaagtagcaattaatcaggtaagaagactaataggcaatgaaaattacctggattatatgacctcaatgaaaagatttaagaatgaaagtgatccggaaggcgcgctctggtaa

SEQ ID NO: 22012 - RNA, 9879 nt, synthetic construct
  misc_feature 1..9879: note = derived and/or modified CDS sequence (opt6) from DENV-1__FJ384655__SS-prME
  source 1..9879: mol_type = other RNA
tccgttacgatgctacttatgctcctccccacagctttagcatttcatctcacgacaagagggggagaacctcacatgatagttagtaaacaagaacggggcaaaagtttattatttaaaacatcagctggtgtaaacatgtgtacactaatcgctatggatttaggggagctttgtgaagacacaatgacgtacaaatgcccgcgaattacagaagcagaaccagacgacgtagattgttggtgcaatgcaacagatacctgggtaacatatggaacatgttcacaaacgggggaacatcgacgggataaaaggagtgtcgcgctagctcctcacgttggcctaggcttagaaactaggactgaaacctggatgtctagtgaaggtgcatggaaacaaatccaaaaagtcgaaacatgggcactgagacacccgggattcacggtaatagcactgttcctcgctcacgctatcggaacctcaataacacaaaaaggtattatttttatactattaatgcttgtaaccccctcgatggcaatgaggtgtgtcggaataggaaacagggactttgtagaaggactgtctggagcaacttgggtagatgtggtgcttgaacatggcagttgtgtgacaacaatggcgaaaaacaaacctacactagatatagaactactaaaaacagaagttacaaaccccgcagtactacgaaaattatgtattgaagcaaaaatatcgaatacaacaaccgattcaagatgtccaactcaaggagaagccacactggtggaagaacaagatgctaacttcgtatgtcgccggacatttgtagaccgtggatggggaaatgggtgtggtttgtttggcaaaggatctttattaacatgcgctaaatttaaatgtgttaccaaattagaaggcaaaatagtgcaatacgaaaatttaaaatactctgttatagtaaccgtccatactggggatcaacaccaagtaggaaacgagacgacagaacacggaacgatagccaccattactccacaagcacccacaagtgaaattcaattaacagattatggtgctcttacccttgactgcagcccacgtactggactcgattttaacgaaatggttctcttaacaatgaaagagaaatcatggcttgtgcataaacaatggttcctggaccttccattgccgtggacatcaggagcatcaacatcacaagaaacttggaatagacaagacctgctagtaacgtttaaaactgcgcatgcgaaaaagcaagaggtcgtagtactgggcagtcaagaaggtgcaatgcatacagcgctaacgggtgcgacggagattcagaccagtggcacaaccacaatattcgctggccacttgaaatgtcgattgaaaatggataaattgactttaaaaggaacatcatatgtaatgtgcactggctcttttaaactagagaaagaagttgccgaaacacaacacggaacagtgctagtacaagttaaatacgagggtacggatgcaccctgcaaaattccctttagtacccaggacgaaaagggggtgactcaaaacggtcggctcattacagcaaacccaattgtaacagataaggagaaaccagtaaatattgaaaccgaaccacccttcggcgaatcttacatagtagttggggctggagaaaaggcgttaaaattaagttggtttaagaaagggagctctatagggaagatgtttgaagcaacggcacgtggtgcgagaagaatggctattttaggcgacactgcatgggactttggtagcataggaggagtatttacgtcagttggaaaattggttcatcaagttttcggtactgcatatggagtcctttttagtggtgtatcctggacaatgaaaatagggatcgggatacttctaacatggttaggtttaaacagtcggtcaacttctctatcaatgacgtgcatcgcagtaggaatggtgacactctacttaggagttatggttcaagctgattctggatgtgtaataaactggaaaggacgcgagctaaaatgcggcagcgggatatttgttacaaacgaggtgcacacatggacagaacaatataagtttcaggctgatagtccaaagagattaagtgcggcaataggaaaggcttgggaagaaggagtttgtggtattcgctcagcgacgaggctagaaaacatcatgtggaaacaaattagtaacgaactaaaccacatcctgttagaaaacgacatgaagttcacagtagtagttggtgacgcgaatggaatccttgcgcaaggaaagaaaatgatcagaccacaacccatggaacacaaatattcatggaaaagctggggcaaagctaaaattataggtgcagatatacaaaacacaactttcatcatagacggacctgacacgccagaatgcccagatgaacaacgagcatggaatatatgggaagtagaagattatgggtttggaatatttacaacaaatatctggttgaaacttagggacagttacacacaaatgtgtgatcatagattgatgtccgccgccataaaagatagtaaagctgtacacgccgacatgggatactggatagagtctgaaaagaacgaaacatggaaattagcgcgagcaagttttatcgaggtgaaaacgtgcatttggccgaaatcgcatacactatggagcaacggcgtattagaatcagaaatgataatcccgaaaatatacggtggaccaatatcgcaacacaactacagaccggggtattttacacagacagcgggcccgtggcatttaggtaagctcgagctcgacttcgacttgtgtgaaggaacaactgtcgtcgtcgatgagcactgtggaaaccgtggaccgtcccttcgaacaacgacagttaccggcaagataatacatgaatggtgctgtagatcgtgtactctaccaccactccgatttcgcggagaagacgggtgttggtatggcatggagatacgaccagtcaaagaaaaagaagaaaatttggtaagaagtatggtcagcgcaggaagcggagaagtagatagcttttcactaggtatactatgtgtaagtataatgatcgaggaagtaatgcgcagtcgatggtcaagaaaaatgttaatgacgggaactctagccgtatttttactacttatcatggggcaactgacatggaatgacctcattaggttgtgtataatggtgggagcaaatgcttcagataaaatgggaatgggtacaacatatctcgccctaatggctacctttaaaatgagaccaatgttcgccgttgggttattgtttaggaggctggccagccgagaagtattgttactgacaataggcttaagcctcgtggcaagtgttgaattacctaatagcctagaagaactaggcgacgggttagccatgggtatcatgatgctgaaacttctaacagagttccaaccccatcatctatggacgacattattatcgctaacgttcataaaaacgacgttatcactagattatgcctggaaaacaacagcaatggtactgagcatagtttcattgtttccactctgtctctctacaacgtcgcagaaaaccacgtggctacccgtgttactgggttcttttggatgcaaacccctgactatgttcttaataacagaaaataaaatctggggacgaaaatcatggcctctgaacgaagggatcatggcaataggcattgtgagtattttactatcttcactactcaaaaatgatgtaccactagcaggtccactaatagcgggcggtatgcttatagcctgttacgttatctcaggatcgtcggcagatctgagtctagaaaaagcggcagaagtctcttgggaggaggaagcagaacattcagggacaagtcataacatcctcgtggaagtccaagacgacggcgctatgaaaatcaaagacgaagaaagagacgatactttaacaatattgcttaaggcaacccttctagcagtgagcggtgtgtatccgatgtcgatccctgcaacactattcgtatggtatttttggcaaaagaaaaagcaaagatctggggtcttatgggacacaccatcgccccctgaagtagaaggagcagttcttgatgacgggatatataggatattacagagagggcttttaggaagaagccaggtaggcgtcggagtattccaagatggggtatttcataccatgtggcacgtgacccggggcgccgtcctaatgtatcaaggaaagcgtctggaaccaagctgggcaagcgttaagaaagatttaatttcgtacggaggaggctggagattccaaggaagttggaatacaggagaagaagtacaagtaatcgccgttgaacctggaaagaacccgaaaaatgtacaaactacaccagggacatttaaaacaccagaaggcgaagttggggcaatagcactggattttaaaccaggtacttctggctcaccgatcgtgtcgagagaaggtaaaatcgttggactatatggcaacggtgttgtaacgacaagtggcacttatgtctcggctatcgcacaagcgaaagcgagtcaagaaggaccattacctgagatcgaggatgaagtttttaagaaaaggaatttgactattatggatcttcatccaggaagcggaaaaacccgaagatatttaccggctatagtgagagaagctataaaaagaaaacttaggacattaatcttggcgccaacccgggttgtagctagcgaaatggccgaagccttaaaaggcatgccgatcaggtaccaaaccaccgcagtcaaaagtgaacatactgggagagaaatagtggacttgatgtgtcatgcaacatttacaatgcgcctcctgtcaccagtcagagtaccgaactataacatgataataatggacgaagcccatttcactgatcctgcatcgatagcagcacgaggatatatatctacgagagtcggtatgggcgaagcggcggcaattttcatgacagcaactcccccgggaagtgtagaagccttcccccaaagtaatgcagtcatacaagatgaagaaagagacatcccagaacgtagttggaactcgggatatgattggataaccgacttccccggtaaaacggtatggtttgtcccgtccattaaaagtgggaatgatatagcaaattgtctaaggaaaaatggtaaaagagtgatacaactttctagaaaaacatttgacacagagtatcagaagacgaaaaataatgactgggattatgttgttaccacagacatatcagagatgggcgcaaattttagagcagatcgggtaattgacccccgaagatgtttaaaaccggtaattctaaaggatggaccggaacgtgtaatcttagctggacctatgccggtaactgtagcgtctgcagcacaacgacgtggaagaataggaagaaatcaaaacaaagaaggcgatcagtacgtgtacatgggtcaaccattaaacaatgacgaggaccacgcacattggacggaagcaaaaatgcttctcgataacataaatacacctgaaggcattatccccgcgctattcgaaccagagagggagaaatcagcagcgatagatggtggatacagattaaggggagaagctaggaaaacattcgtagaattaatgagaaggggagacttgccagtgtggttgtcttataaggtagcatcagaggggtttcaatatagtgacaggcgctggtgctttgacggtgaaaggaataaccaagtattggaagagaatatggatgtagaaatatggacaaaagaaggggaacgcaagaaattgcgaccaagatggttagatgcacgaacatatagcgaccctttagcattgcgtgaatttaaagagttcgcagcaggacgacgttccgtaagtggagatttaatcttggaaataggaaaacttccccaacatctaactcttagagcacaaaatgcactggacaaccttgtaatgctgcataacagtgaacaaggtgggaaggcttacagacacgcaatggaggaacttccggacaccatcgagacgcttatgctactcgctctcatagctgttttaacaggaggtgttactcttttcttcctgtcgggaaaagggttaggaaagacgtcaatcggattattatgtgtcacagcttcatccgccctgttatggatggcaagtgtagaaccacactggatagctgcgtcaattatcttagagttcttcctcatggtactccttataccagaacctgatagacaaagaacaccccaagataatcaattagcctatgttgtaatcggtttattgtttatgattcttacagtggctgcaaacgaaatggggctgctagaaacaactaagaaagatctgggcattggacacgtagcggccgagaatcatcaacatgctactatgctagatgttgacttaaggccagcaagtgcatggactttatatgcagtagcgacaactgtaattaccccaatgatgagacacacaattgaaaatactactgcaaatatttccttaacagccattgcaaatcaagccgctattcttatgggtctagataaaggttggcccatttcaaaaatggacatcggtgttccactattggctcttggatgctactctcaagtaaaccccttgacgcttacagcggcagtattaatgttggtcgcacattatgctattattgggccaggattgcaagctaaagcgactagagaagcgcagaaacggacggcggctggtattatgaagaatccaactgttgacggtattgtagcaatagacttggacccggttgtatacgacgctaaatttgaaaaacagctaggtcaaattatgttattaattctttgtacctcccaaatactcttaatgcgtactacatgggcactatgcgaaagcataactctggcgacaggaccactaacaacattgtgggaagggtcgccaggtaagttttggaataccacaatagccgtctctatggcaaacatatttagaggatcttatttagctggagcaggcctggcattctcacttatgaaaagtcttggtggtgggagaaggggaacaggagcccaaggagaaacgcttggggaaaaatggaaacgccaactaaaccaattgtcaaaatcagagtttaatacgtataagcgctccggaataatggaagttgacaggagcgaggccaaagaggggctaaaacgaggagaaaccaccaaacatgcagtaagccgggggaccgctaaattaagatggtttgtagagcgcaatttggtaaaacctgaaggtaaagtcattgacctagggtgcggtcgaggaggctggtcatattattgtgcaggactcaagaaagtaactgaagtgaaaggatatacaaaaggtggaccaggacacgaagaaccggtaccgatggcgacctacggatggaacttagtaaagttgcattcggggaaagatgtattcttcatgccacctgagaaatgcgatacattattatgtgacataggcgagtcaagtcccaacccaactattgaagaaggaagaacactacgagttcttaagatggtagaaccgtggttaagaggtaaccagttctgcataaagatactaaatccatacatgccttccgtagttgaaactttggaacagatgcagcgaaaacatggtggcatgctggttcgaaaccccttaagtagaaattctactcatgaaatgtattgggtgtcatgtggaaccgggaatattgtgtcagcagtcaacatgactagcagaatgttactaaacagatttacaatggctcacaggaagccaacatatgaacgagacgtagaccttggagcaggtacccggcatgtagcagtagagccagaagtagccaatcttgacataattgggcaacgaatagagaatattaaaaatgaacataaatctacatggcattacgatgaagataacccatataagacatgggcatatcacggaagctatgaggtcaaaccttcaggctcggcctcaagtatggtgaatggcgtagtgaggcttttaactaagccttgggacgtaattcctatggtcacccaaattgcgatgacagataccacaccttttggacaacagcgcgttttcaaagaaaaagtggatacaagaacaccaagagcaaaacgtggcacggctcaaataatggaagtcactgcaaaatggctttggggatttctatcaagaaataaaaagccgcgaatttgtacacgcgaagagtttacccgaaaagtaagaagcaatgcggctatcggtgcggtctttgtggacgaaaaccaatggaactcagctaaagaagcagttgaggatgagagattttgggatctagtccacagagaaagagaactgcacaagcaaggaaagtgtgcaacatgcgtttacaacatgatgggaaagagggagaagaaattaggagagttcggaaaagcaaaaggaagtagagcaatatggtacatgtggctgggcgcacggtttttggagtttgaggctctaggttttatgaacgaagatcactggttttcaagagaaaactcattgtccggagtggaaggcgaaggattacacaaactgggatatatcctgcgagatatatctaagattcccggcggaaacatgtatgctgacgatacggctgggtgggatacacgcataacggaagatgacctacaaaatgaagctaagataacagacatcatggaacctgaacacgcactactagcaacatccatttttaaattaacataccaaaataaagtcgtaagagtccaacgaccagccaaaaatggaactgtaatggacgtaatttcccgacgagatcaaagaggatcggggcaagttggaacttatggcttaaatacgtttacaaatatggaggttcaattaatcagacaaatggagtccgagggtatcttcttaccaagtgaactagagacaccgaacttagcggaaagagtattagattggcttgaaaaacacggggctgaacgcttgaagagaatggcaatatcaggagatgattgcgtcgttaaaccaatagacgacagattcgcaacggcattaatagcccttaacgacatgggaaaagtccgaaaagatataccccaatgggaaccgtcaaaggggtggaatgattggcagcaagtaccattttgtagtcatcatttccaccaattgattatgaaggatggacgcgaaatagttgtaccctgcaggaaccaggatgagttagtaggacgtgcaagagtaagccaaggtgcagggtggtcgcttcgggaaacagcatgtcttggtaaatcatatgcacaaatgtggcaactaatgtactttcaccgaagggatcttagactagcagctaatgcaatttgtagcgctgtaccagtagattgggtaccgacaagcaggacaacttggtcaattcatgcacatcatcaatggatgacaacagaagatatgttgtctgtatggaatcgagtgtggatagaagaaaacccgtggatggaagacaagactcatgtctcgtcgtgggaagaggtaccttacttgggtaagagggaagatcaatggtgtgggtcacttattggcctaactgctcgcgctacctgggcaaccaacatccaagtggccataaatcaagttagacggcttattggtaacgagaattatctggattacatgaccagtatgaaaagatttaaaaacgaatcagacccagaaggagccctatggtaa

SEQ ID NO: 22013 - RNA, 9879 nt, synthetic construct
  misc_feature 1..9879: note = derived and/or modified CDS sequence (opt6) from DENV-1__KC759167__SS-prME
  source 1..9879: mol_type = other RNA
tctgttaccatgttattaatgttaatgcccaccgcgctagcattccatcttacaactagaggaggagaaccacacatgattgtaagtaaacaagaaagaggcaagagcctcttattcaagactagcgctggcgtaaacatgtgtactttaatcgcgatggacctcggtgaattatgcgaagacacaatgacgtacaagtgtccacgaataaccgaggccgaacctgatgatgtagactgttggtgtaatgcgaccgatacttgggtaacatacggaacttgtagccaaactggggaacataggcgcgataaaagatcggtggcccttgcgccacacgtgggactgggattagaaactaggacagaaacttggatgagcagcgaaggagcatggaagcaaattcagcgagtagaaacatgggcattaaggcatcctggattcacggtaatagcactattccttgcacatgcaattggaacatcggttacacaaaaaggaattatctttatcttgctaatgctggtaacaccctctatggcaatgagatgcgtaggtatcgggagtcgcgattttgtagaaggcctcagtggagccacatgggttgatgtcgttctggaacatggatcttgcgttactacaatggcaaaggataaacctaccctggatatagagctcttgaaaaccgaggtaactaatccggcgatattaagaaaattatgtatagaggcaaagatctcaaatactacaaccgacagtaggtgtccgacccaaggggaagcaccagaagtggaagaacaggacgctaatttcgtctgcaggagaacttttgtagataggggatggggaaatggctgtggtctttttggtaagggatccttgattacatgtgccaagttcaaatgcgttactaaattggaaggcaagattgtacaatatgaaaacttaaagtattctgtaattgtcacggttcacacaggggaccagcaccaagtcggaaatgaatcaaccgaacacggcacaacggctaccataacgccacaggcccctacaactgagatacaattaactgattatggagccctgactttggactgctctccaagaacgggtctagattttaatgagatggtgttgctaactatgaaagaaaagagttggttagtccacaaacaatggtttctagatttaccacttccatggacaagtggggcatcaaccagtcaagagacgtggaacagacaagatcttctcgtgacttttaaaaccgcacatgctaaaaaacaagaagtagtagtattaggatctcaagaaggagccatgcacactgcccttacaggtgctacagagatacaaacatctggtactactactatatttgcaggacatttaaagtgccggctgaagatggacaaactaactctaaaaggaatgtcatatgtaatgtgtacaggttctttcaaattagagaaagaggtagccgaaacacaacatgggaccgtactggtccaaattaagtatgagggaacagacgccccgtgcaagattccgttttctacacaagacgagaaaggagtcactcaaaacggccgcctaattacagcaaaccctatagtcactgacaaagaaaagcctgttaatatagaggcaaagccgcctttcggagaatcatgcatagtaataggagcaggtgaaaaagcattaaaattatcatggttcaagaaaggaagtagtataggaaaaatgtttgaagcaactgccagaggagctaggcgaatggcaatacttggagatacagcctgggactttggcagtatcggcggagtgtttacgtccgtaggaaaattagttcatcaaatctttgggactgcgtatggtgtacttttttctggtgtatcatggacaatgaaaatagggattggtgtgcttttaacctggttaggactaaactctagatcgacaagcctttccatgacatgcatagcagttggcttagttacgctttatttaggcgtgatggttcaagcagattccggctgcgtgataaattggaaaggtagagaacttaaatgcgggtcagggatatttgttacaaacgaagtccacacttggacagagcaatacaaatttcaagctgattctcctaaacgattatcagctgccattgggaaagcgtgggaagaaggggtctgtggaataaggtcagctacaagacttgaaaacattatgtggaagcaaatatccaacgagttaaaccatatcttgttagaaaacgatatgaaatttactgtagtggttggggacgtcgctggaattctagcacaaggtaaaaagatgattcgaccccaaccgatggagtataaatacagttggaaatcttggggaaaagcgaaaataataggcgcagatgtgcagaataccacattcatcatagatggaccgaacacgccggaatgtcccgacgaccaaagagcatggaacatttgggaagtggaagattatggttttggaatttttacaactaacatttggttaaaactaagagattcttatacacaagtatgtgatcaccggctaatgagcgctgcaataaaagacagcaaggcagttcacgctgacatgggctactggattgagtcagaaaaaaatgaaacgtggaagttagcacgggcatcatttatagaagtaaaaacatgtatttggcctaagtcgcacactttatggtctaacggagtgttagaatcagaaatgattatcccaaagatatatggcggcccaatcagtcaacacaactataggccaggatattttacacaaacagcggggccctggcaccttggcaaacttgaactcgactttgacctttgcgagggtactactgtggtcgtagatgagcactgtggaaacaggggaccatcattaaggacgactacagtgacgggtaaaataatacatgagtggtgctgtagatcatgcacacctccgcctttacgattcagaggagaagatgggtgctggtacggaatggagatacgaccagtaaaggaaaaagaggaaaacctcgtcaaaagtatggtaagtgctggaagtggtgaagtagatagcttttccctagggctgctatgtatatccataatgattgaggaggttatgaggtctaggtggtcacgtaaaatgttgatgactggagcactagccgtttttttacttctaattatgggacaattaacatggaatgatcttatacgtttatgtatcatggtaggtgcaaatgctagcgacagaatggggatgggtacgacttacttggctctaatggcaacatttaagatgcgacctatgtttgccgtgggccttctttttagaaaattgacaagtagagaagtattactactcactatcggactgagcctggtcgcatcagtagagttacccaattctctagaagaattgggtgatggtctagcaatgggtataatgatactaaaattactcacagattttcagagccatcaactgtgggccacactcttatctctcacattcatcaaaactactttcagtttacattatgcgtggaaaacgatggcgatggtattgagcatcgtatctttattccctctatgtctcagtactacttcccagaagacgacatggctacccgtactgctgggatctctaggttgcaaaccactgacgatgttcctaatagctgagaacaaaatatggggaaggagaagttggccgctcaatgaaggaataatggcagtaggcatagtttctatattactatccagtttacttaagaacgacgtacctctcgcaggacccttaattgccggcggtatgttaatcgcatgttatgtgatcagcggaagttcggcagacctaagcctagagaaagcggctgaagttagctgggaagaggaagctgaacattctggagcatctcataacatattggtagaagtacaagatgatggaacgatgaaaattaaagacgaagaacgtgatgatacactcacaatactactgaaagcaacgctcttagcagtgtctggggtatatccactttccattccagcaactttatttgtttggtacttctggcgcaaaaagaaacaaaggtcaggagtactttgggataccccgtctccaccagaagtggaaagggcagttttggatgacggaatttataggatcatgcagcggggattattagggcgttcccaagtaggagtaggtgtattccaggagaatgtgttccacacaatgtggcacgtgactagaggtgcagttcttatgtaccaaggaaaaagacttgagcctagttgggctagtgttaaaaaggatttgataagttatgggggtgggtggagacttcaaggtagctggaataccggtgagggagtccaggtgatcgcagtggaacccggtaaaaacccaaagaatgttcaaacagcgccaggaacgtttaaaacgccggaaggcgaagtaggagcgatagctttggactttaaaccgggtacaagcggatcgccgatagtaaacagagaaggaaagatagtaggcttatacggaaacggggtcgtcacaacgtctggtacatacgtctcagcgatagcacaggcaaaagcttcgcaagagggaccgcttccggaaatagaagatgaagtattcagaaaaaggaatctaacaatcatggatctacatccagggagtggtaagacaagaaggtatttaccagcaatagtgagagaagccataaaacgaaaactccgtacactaatactagcccctacccgtgtcgtagcctcagaaatggcggaagcactgaaaggtatgcctattagataccaaactacagcagtgaaatcagaatatactggaaaagaaatagttgatctcatgtgtcacgccaccttcacgatgcgattgttatcaccagtcagagtcccaaactacaatatgatcattatggatgaagcacactttacagatccatcaagcatagcggcaagaggttacatatcaacacgcgtaggcatgggtgaagctgctgcaatattcatgactgctaccccccccgggtctgttgaagcctttccacaatcaaacgctgtaatccaagatgaagaacgggatataccggagagatcatggaattcgggttatgaatggataactgacttccccgggaaaacagtatggtttgtaccaagtattaaaagtggaaatgatatagccaattgcctaagaaaaaacggaaaacgggtcattcaactttcacgcaagactttcgatactgaatatcagaaaacaaaaaacaatgactgggattacgttgtgactaccgacataagtgaaatgggagcgaacttcagagcagatagagtaattgatccacgccgttgtctgaaacctgttatcttaaaagacggccctgaaagagtcattttagcgggacccatgccagtaacagtcgcatcggcagcacaaagaaggggtagaattggtcggaaccacaacaaggagggagatcagtatatatatatgggccaacctttaaataatgatgaggaccatgcacattggactgaagctaaaatgctattagataatattaacacacctgaaggcatcattccagctctatttgagccagaaagagaaaaaagcgccgctatcgatggagaataccggctgcgaggggaagctagaaagacgtacgtagaactaatgcgcaggggtgatttgcccgtatggttgtcgtataaagtcgcttcagagggtttccagtactccgaccgacgctggtattttgacggggaaagaaataaccaagtattagaagaaaacatggacgtagagatttggactaaagaaggagaacggaaaaagctaagaccgcgatggttagacgcaagaacttattcagaccccttagcactcagggaatttaaagagtttgcggcggggagaagatcggtgagtggtgacttaatacttgaaatcggtaagctgccgcaacatttaactcaaagggcccaaaatgcattggacaatctggttatgctacataactcagaacaaggaggtagagcatacagacacgcaatggaggaattgcctgatacaattgaaactttaatgctactagctttaatagctgttttaaccggtggagttacgttattttttctatcagggagaggtcttgggaaaacaagtatcggcttactctgtgttatggccagcagtgtactcctatggatggcttccgtagagccacattggattgcagcaagcataatattagagttctttttgatggtactactaatacccgaacctgacagacaacgcacgcctcaagacaatcaactggcgtacgtagttattggtctattattcatgattttaacagtagccgcaaacgagatgggattgctggaaactaccaagaaagacctgggcataggccatgttgcggtaggcaatcatcatcacgcagcaatgctagacgttgatctacacccggccagcgcgtggaccttatatgcagtagcaaccactataataacccctatgatgcgccatacgatagaaaatacaacagccaacatttcccttacggccatcgctaaccaagcagccatattgatgggattggataaaggatggccaatatctaaaatggatattggagttcccttactagcgctgggctgctatagtcaagttaaccctttaacactaacagcagcagtcttaatgctcgtggctcactatgcaatcatcggtcccggattgcaagctaaagctactcgagaagcccaaaagagaactgcagcaggaatcatgaaaaatcctacggtagatggtatagtggccattgacttagatccagtggtctatgatgcgaagtttgaaaagcaattaggtcagataatgctattgattttatgtacaagtcaaattttactgatgagaacaacctgggcgttatgcgaaagtataacactggcgacaggaccattaacgactctatgggagggttcacccggaaaattctggaacactacaatagcagtgtcaatggccaatatattcagaggcagctacctcgcgggcgccgggctagcttttagtcttatgaaatcactaggtggagggagaagaggcactggtgcccaaggtgaaactttaggagaaaagtggaaaagacagcttaaccaactgtcaaagttagaatttaactcttacaaaagatcgggaattatggaagtggacaggagtgaagctaaagaaggattaaaaaggggggaaacaacaaagcacgcggtgtcaagaggaacagctaaattaaggtggttcgtagaaagaaatttggtaaagccagaagggaaagttatagatttaggatgtggcaggggagggtggtcatattattgtgccggcctgaaaaaagtaactgaagtgaagggatacacaaaaggaggaccaggacatgaagaacccataccaatggcaacctacgggtggaacctggtaaaactacacagcggaaaagatgtattttttattcccccagaaaaatgtgatacacttctgtgtgatatcggagagagcagcccaaaccctacaatagaggagggacgaacactgcgtgtactcaaaatggtagagccatggctgagaggtaatcagttttgcataaagatacttaacccctatatgccgtcagtcgtagaaactctagaacaaatgcagagaaaacatggtggaatgcttgttcgtaacccactatctcgaaatagcactcacgaaatgtactgggtgagctgcggaactggtaacattgtaagtgccgtgaacatgacatccagaatgttactaaaccgattcactatggctcaccgtaaacctacatacgaacgtgacgtcgatctaggcgctggaacgaggcatgttgctgttgagccagaagtggcaaacttagacattatagggcagcgtatagaaaacataaaacatgaacacaaaagtacatggcattatgatgaggataatccatataaaacatgggcttaccatggctcatacgaagtgaaaccatcgggtagtagctcgtcgatggtaaatggggtcgtaaaactattgacaaaaccctgggatgtaataccgatggtgactcaaatagcaatgacagatactaccccttttggtcaacagcgcgtgtttaaagaaaaagtagacacacgaactcctaaggcaaagagaggtacagcgcaaataatggaggtgaccgctaaatggctatggggttttttatcacgaaataaaaagcctcgtatctgtacaagagaggaattcacaaggaaggtaagatcaaatgccgcaatcggggctgtatttgtagatgaaaatcaatggaatagtgcaaaggaagcggtcgaagacgaaagattttgggacctcgttcatcgtgaacgcgaacttcacaaacaagggaaatgtgcaacttgtgtatacaatatgatgggcaaaagagaaaaaaaactaggtgagttcggcaaggcaaaaggatcccgcgcaatttggtatatgtggttgggagcacgctttctcgaattcgaagcactaggctttatgaatgaggaccactggttttcgagggagaattcactgtcaggagtcgaaggtgaaggactacacaagctcggttacattttacgggatatatcgaagattcctggaggaaacatgtatgcggatgacacagcaggatgggatacaagaataacggaggatgatttacaaaacgaagcgcgaattacggatataatggaacctgaacacgccttgctggctaaatcaatattcaagctaacttatcaaaacaaagtggtgagagtacaacgaccagcaaaaaatggaacggtaatggatgtaattagtagaagggaccagcgaggtagtggccaagtgggtacctatggactaaacacattcacaaacatggaagctcagttaataagacaaatggaatcggaagaaatatttagtccgtcagaattggaaactcctaaccttgcggaaagagtactagattggctggaaaaatatggaatcgagcggcttaaaagaatggcaatatcaggcgacgactgtgtggtaaaaccaatagataaccgatttgcgacagcattgaccgcacttaacgatatgggcaaagtaagaaaagatataccgcaatgggaaccttcgaagggatggaacgattggcaacaagttccgttgtgttcacatcattttcatcagcttataatgaaagatgggcgtgaaattgttgtaccatgccggaaccaagatgaattagtagggagagctcgagtgtcacaaggagctgggtggtcacttagagaaaccgcatgcctaggtaaatcgtatgcccaaatgtggcaactcatgtatttccatcgcagggatttaagattagcggcaaatgctatatgtagcgctgtcccggtagactggattcctacttcaagaacaacatggtcaattcatgctcatcaccaatggatgacaaccgaagacatgctaagcgtttggaatcgagtgtggattgaagagaacccatggatggaagataaaactcatattagttcttggggagacgtgccttatttaggtaaacgtgaagatcaatggtgcggctcacttataggtttaacggcacgagcgacatgggccacaaacatccaagtggctataaaccaagtgaggcgactgataggcaacgagaactatctagattatatgacttctatgaaacgctttaagaacgaatctgacccggagggcgccctctggtag

SEQ ID NO: 22014 - RNA, 9879 nt, synthetic construct
  misc_feature 1..9879: note = derived and/or modified CDS sequence (opt6) from DENV-1__JQ048541__SS-prME
  source 1..9879: mol_type = other RNA
tcggtcactatgctcctaatgctaatgccaacagccttagcctttcatctaactacacgagggggagaaccccatatgatagtatctaagcaggagcgaggaaaatccctactcttcaaaacatccgcaggtgtgaacatgtgtaccctaatagcaatggatctgggcgaattatgcgaagatacaatgacgtataaatgccctagaataacagaagcagaaccagacgatgttgattgctggtgtaatgccacagacacttgggtgacatacggtacttgttcgcaaacaggagaacatagacgggacaaaagatcggtagcacttgcacctcatgttggtctaggcttagaaacaagaaccgaaacatggatgagctcagaaggtgcgtggaagcagattcagcgagtagagacatgggctttgcgccaccctgggtttaccgttatcgctttatttttagcacatgcgataggcacttccataacacaaaaaggtataattttcatactactaatgttagttactccgagcatggcaatgcggtgtgtcggaattggatcacgagactttgtggaaggcctatcaggagcaacatgggtcgatgtggtgctagaacacggtagttgtgtaaccactatggcaaaagataaaccaaccttagacattgaattgcttaaaacagaagtgacaaatcctgcggtcctccgtaagttgtgtatagaagcaaaaataagcaatacaaccaccgactcacggtgccctacgcaaggagaagcgacattagttgaggaacaagatgcaaactttgtgtgcaggagaacattcgtggaccgtggttggggcaacggatgtggtttatttggtaaggggtcccttataacatgcgcgaagtttaaatgtgttacgaaattggaaggaaagattgttcaatacgagaatttaaaatattcagtaattgtcacagtacatacaggtgatcagcatcaagtgggtaacgaatctaccgaacatggtacaacagctacaatcacaccacaggcaccaactacagaaatacaattgactgattatggcgcacttacgctagactgttctcccagaacaggactagactttaacgaaatggtgctactaacgatgaaagaaaaaagctggctcgttcacaagcaatggttcctggacttaccattgccatggaccagcggggcttctacatcacaagaaacttggaatcgtcaagacttgctagttacatttaagacagctcatgcaaaaaaacaggaagttgtggttttaggctcacaagagggcgcaatgcacacagctctgacgggtgcgacggaaatacagacaagtgggacaaccaccatctttgctggccatttgaaatgcagactaaaaatggacaaattaacgttaaaaggaatgtcatatgtaatgtgcacaggtagttttaaattagaaaaggaagtagcagaaacgcagcatggaactgtccttgtacagattaaatatgagggcacggatgcaccgtgtaaaatcccattcttaactcaagatgaaaaaggtgttacgcaaaatgggagacttataacagcaaatcctatcgttactgataaagagaaaccagttaatattgaagctgaaccaccttttggggaatcttacattgtgataggagcaggagaaaaggcactaaaactttcatggttcaagaaaggtagctcaatcggcaaaatgttcgaggcaactgcaagaggagcgagacgtatggccattttaggtgatacagcttgggactttggaagtattggaggagtatttaccagtgtaggtaagttggttcaccaaatttttggtacagcctatggggttttattcagtggagtatcgtggactatgaaaattggaattggagtactactgacctggctaggcttgaactctaggtcaacaagtctgagtatgacttgcattgctgtaggcctagttactctatacttgggggtcatggtacaagctgactcaggatgtgtaattaactggaaagggcgggaactcaagtgcgggtcaggtatattcgtaactaacgaggtacatacttggacggagcaatacaaattccaggcagactcaccgaagaggcttagcgcagctataggaaaagcatgggaagagggagtctgtggcatccggtcagctacaaggctagaaaacattatgtggaaacaaatcagcaatgagttaaatcatatactactcgagaatgacatgaaatttaccgtagttgtaggcgacgtagctggaattttagcacaagggaaaaaaatgatccggccacagccaatggaacacaaatattcttggaagtcttggggcaaagccaaaatcataggcgcagacgtacagaacacgaccttcataatcgacgggccaaacactcccgaatgcccggatgatcaaagagcttggaatatttgggaagtcgaagactatggcttcggaatatttacaacaaacatctggctgaaattgcgagatagttacacacaggtttgtgaccacagattaatgagcgcagccataaaagattcaaaggcggtacatgctgacatgggctattggatagaatctgagaaaaatgaaacatggaaacttgctagggccagttttatagaagttaaaacatgtatatggcctaaatcacacactttgtggtcaaatggagtactagaatcggaaatgatcattccgaaaatttatggcggaccgatatcccaacataagctaaggcccggatatttcacccaaacagctggcccatggcacctaggtaagttagagttggattttgatctctgtgaaggaactacggtagtggtggacgaacattgtgggaacaggggaccatctctgaggaccacgactgttactgggaagattatacatgagtggtgctgtcgaagctgtacactaccaccactccgattcagaggagaagatggctgctggtatggaatggagatccgccctgtcaaagaaaaagaagaaaatctagttaaatcaatggtaagtgcgggcagcggagaagtagattcatttagtctaggacttttatgcattagtataatgattgaagaagttatgagaagtaggtggtcacgaaagatgttgatgacaggaacattggctgtcttctttcttctaataatgggtcaactaacctggaatgatcttataaggagttgtataatggtaggcgccaacgcttcagatcgtatgggtatggggacaacatatctcgctcttatggctacctttaagatgagacccatgtttgcagttggattactatttagacggctcacctcgcgcgaagtattactgcttacaataggattaagtctcgtagcatcagtggaactgcctaatagcctagaagaactaggagacggcctagcaatggggattatgatactaaaactacttactgattttcagtctcatcagttatgggcaactttattatcactaacgtttattaagaccactttttcactacactatgcatggaagactatggcaatggtattgtcaattgtatcacttttcccactatgtcttagtaccacttctcaaaaaaccacatggctaccggttttattaggatccttgggttgcaaaccgcttacaatgttcctaatcgccgaaaacaaaatatggggtcgaaagagttggccactcaatgaaggcattatggcagttggaatcgtatctatattgctgagctccctcctcaagaacgacgtacctttagctggtccccttattgctggcggtatgctaatcgcatgttatgtaataagtggttcgtccgccgacctttcattagagaaggccgctgaagttagttgggaagaggaggcagaacatagcggagcatcacacaacatcttagtcgaagttcaggacgatggaactatgaagataaaagatgaagaaagggatgatactttgacaatattactcaaagccacactactcgccgtatcgggagtttatccactatccatcccagcaaccctatttgtctggtacttttggcaaaagaaaaaacaaagaagtggggttctatgggacacgccatcaccaccagaagtagagagagccgtattagatgatggcatctatagaatcatgcagaggggattacttggaagatcacaagtaggcgtaggggttttccaggaaaacgtgtttcatacaatgtggcacgtaacacgcggagcggtattaatgtaccaaggaaagagactggagccaagctgggcaagtgtcaaaaaagatcttataagttacgggggaggatggcgacttcaaggctcatggaataccggtgaagaagtacaggtaatagcagttgaaccgggaaagaatcccaaaaatgtacagactgcacctggcacgtttaaaacaccagaaggagaagtcggtgcaatcgcgctcgatttcaagccgggtacaagtggatctcctattgtcaacagggaaggaaaaatagttgggctatatggaaacggagtggtcacgactagtggcacttatgtttcagccatagcgcaagccaaggcttcacaagaaggtccattacctgaaattgaagacgaagtttttcgaaaacggaatctgactatcatggacctacatcctgggtctggaaaaactcgtcggtatttaccggctatagtgagggaagcaattaagcgtaagttacgtactctaatcttggcaccaacgcgagtggttgcatcagaaatggcagaagccctaaaaggcatgccaatacgataccaaaccacggcagtcaaatcagaacatactggtaaagagatcgttgatctaatgtgtcatgccacttttaccatgcgactgttaagcccagtacgagtaccaaactataatatgatcataatggatgaagcacattttactgatcctagctccattgctgcgagaggatatataagcacacgtgtggggatgggtgaagctgcagctattttcatgactgcaactccccctggatccgtcgaagcatttcctcagtccaatgcagttattcaagatgaagaacgcgatataccagaacgaagctggaattccgggtacgagtggatcacggacttccctggtaaaactgtatggtttgtaccaagtataaaatccggaaacgatatagctaactgcctaagaaaaaatggaaagagagttattcaactgtccagaaaaacattcgataccgaataccagaaaactaagaacaatgactgggattatgtggtgacaactgacataagcgaaatgggggccaactttcgtgcagatcgagtcatagatccaaggcgctgtttaaaaccggtgatattaaaggatggtcccgaaagagttatattagcagggcccatgcctgtaacagtcgcatcagcagcccaaagacgaggacgtataggaagaaatcataataaagaaggagatcaatatatttatatgggtcagcctctaaataacgacgaggatcacgcacattggacagaggctaaaatgcttcttgataacataaacacaccagaagggatcatccctgcattgttcgaacctgagcgagagaaaagcgctgcaatagatggggaatataggcttagaggtgaagcaaggaaaaccttcgtggaattaatgagacggggtgatttaccagtgtggctatcatataaagtggcaagtgaaggtttccagtattcagaccggcgatggtgttttgacggcgagcgtaataaccaggtacttgaggaaaatatggatgtagagatatggactaaagaaggagagcgcaaaaaattgagacctagatggctggatgctagaacctattcagatcctttagcgctacgtgaattcaaggaatttgctgcaggacggagatcggtctccggagatctaatccttgagataggcaagctgccacaacatctcacacaaagagcacaaaacgctttggataacttagtaatgcttcataatagtgagcaaggcggacgagcatatcgacatgctatggaagaactaccagacacaatcgaaacgctgatgctgcttgcattaatcgcagttctaactggaggagtaactctctttttcctcagcggtcggggactcggaaaaacatcaataggtttactctgtgtaatggcctcaagcgtcctcctatggatggccagcgttgaaccacactggatagcagcaagtattatacttgaattcttcttaatggtactgctaatacccgagccggatcgacaaagaaccccccaagacaatcaattggcatacgtagtgataggtcttctgtttatgatattaacggtagcagcaaatgaaatgggactattggaaacaactaaaaaagatctagggatcggacatgtagcggttgagaatcaccatcacgccacaatgttagatgttgacctacatccagcaagtgcatggacactgtatgcagttgctacgacaattattacaccaatgatgcgacacaccatagaaaatacaacagcaaacatctcactaacagctatagctaatcaagcagcaattttgatgggattagataaaggatggcctatcagtaaaatggatatcggagtaccattattggcccttggatgttattcacaagtgaaccctctgacactaacggcagcagtgctcatgcttgttgctcactacgctattatcggtccagggctgcaggctaaggccaccagggaagctcagaaaagaactgcggctggaatcatgaaaaaccctactgtcgatggaatagtagcgattgatctagatccagtagtatacgatgcaaaattcgaaaaacaattggggcaaattatgttattgatcttatgcacgagtcaaatcttattgatgagaacgacgtgggcgctctgtgaatctattacactggcaaccggaccattgacaacattgtgggaaggatctcccggtaaattctggaacacgacaattgcagttagcatggcaaacatttttcgaggtagctacttggcaggagcaggactggcattttcgttaatgaaatcattaggaggaggccggagaggaacaggagcccaaggtgagacactaggagaaaaatggaagcgccaattaaaccaattatctaaatctgagtttaacacgtacaaacgaagcgggataatggaagttgatcgatctgaagcaaaggaagggttgaaaagaggggaaacaacaaagcatgctgtatcaaggggtaccgccaagttacgctggtttgtcgagcggaatcttgtaaaaccagaaggcaaagttatcgacctcggctgcggccgaggtgggtggagttactactgcgccggtctaaagaaagtaaccgaagttaaaggttacactaaaggaggaccaggtcacgaggagcctataccgatggcaacttatggatggaacctagttaaactttatagcggaaaagatgttttcttcatgcctccagagaaatgtgatacgctactttgtgatataggagagtctagcccaaatcccacaatagaggaaggccgaacattgagggtcttaaaaatggtagaaccatggttacgaggaaatcaattctgcattaaagtactgaatccttatatgccatcggtggtagaaacactggaacaaatgcaaagaaaacatggaggcatgctggtaaggaacccattgagccgtaatagcacacatgagatgtactgggtctcgtgcgggacaggaaacattgtttctgctgttaacatgacatcgagaatgcttctaaataggtttactatggctcacagaaaaccaacgtacgaacgtgacgtagatttaggagcgggtacgcggcacgtagcagtcgaaccagaagtagcgaatctggatattatagggcaaagaatagaaaatataaaacacgaacataagtcaacttggcattacgacgaagataatccttacaaaacatgggcgtaccatggttcttacgaagttaaaccgtcaggttccgcatcaagtatggtaaacggcgtagtaaaacttttaactaaaccttgggatgtaataccaatggtaacgcaaattgcaatgactgacactaccccatttggacaacaacgggtgttcaaggaaaaagtcgacacacgcactcccaaagctaaacgaggaacagcacagataatggaagtaacagctcgatggttatggggatttttgagtcgaaacaaaaaaccccggatatgtacgcgagaggagtttactcggaaagtacgtagtaacgcagcgattggagcagttttcatagatgaaaaccaatggaactcggcaaaagaagctgttgaagacgaacggttttgggatctagtacatcgcgaaagagaactacacaaacaaggcaaatgcgcgacatgtgtttataacatgatgggaaaaagagagaaaaaactcggagaattcggaaaagcaaaaggttcccgtgcaatttggtacatgtggttaggagctcgattcctggaatttgaagcattggggtttatgaacgaagatcattggttctcacgtgagaactcattatctggagtggaaggagaaggcttgcataagctcgggtatatcctacgggacatttccaaaatcccgggaggcaatatgtacgcagacgacactgcaggatgggatacacgaataacagaggatgatttacaaaacgaggctaagattaccgatatcatggaacctgaacacgcgttgcttgctaaggccatatttaaattgacataccaaaataaagtagtcagagtgcaacgtcctgccaaaaatggtactgtaatggatgtgatatctagacgagaccagcgagggagcggtcaagtaggaacatatggcctaaacacgtttacaaacatggaagcacaacttattagacaaatggaaagtgaaggaatattctcaccatcagaactagaaacaccaaatcttgccgaacgagtacttgattggcttgaaaaatacggagttgaacggctgaagcgaatggccatatcaggggacgattgtgtcgtcaaacctattgatgacagatttgccacagcattaacagcgttaaatgatatgggtaaggtaagaaaagacattccgcaatgggagccttctaaaggttggaatgattggcagcaggtgccattttgttcccatcattttcatcaacttataatgaaagatggtcgagagatagtagttccgtgtcgaaaccaagatgaactggttggaagagcaagggtgtcgcagggagccggctggggtttgagagaaacagcctgtcttggaaagtcatatgcacaaatgtggcaattaatgtacttccacagaagagatttaagacttgcagcaaacgcgatttgttcagccgtaccggtagattgggtgcctacgagcagaactacctggagtatacatgcacatcatcaatggatgacaactgaagacatgttaagcgtatggaaccgagtttggatagaagaaaatccatggatggaagataaaacacatatttcatcatgggaagacgtcccttacctagggaagagagaggaccagtggtgtggaagtttaataggtctgaccgcaagagctacttgggccaccaacattcaagtagcaatcaatcaagtgagaagattaatcggaaacgaaaattacctagattatatgacatcaatgaaacgctttaaaaacgaatccgacccggaaggcgccctttggtaa

SEQ ID NO: 22015 - RNA, 9879 nt, synthetic construct
  misc_feature 1..9879: note = derived and/or modified CDS sequence (opt6) from DENV-1__JN697056__SS-prME
  source 1..9879: mol_type = other RNA
agtgtaacaatgctcttaatgctgttaccaaccgctctaactttccacctaacaacaagaggtggcgaaccacatatgatagttagtaaacaagaacgagggaaatcactcttatttaaaacaagcgctggggtcaacatgtgcaccctaattgcaatggatttgggggaattgtgcgacgacaccatgacttacaaatgtcctcggataacggaaaccgaaccagacgacgtggactgctggtgcaatgcgactgaaacgtgggtaacgtatggtacatgctcacaaactggtgaacataggagagataaaagatctgtggcacttgcaccacatataggattaggacttgaaactagaactgaaacctggatgagttcagaaggggcatggagacaaatccagaaagtagaaacatgggcgttacggcaccccggattcactgttatcgcactattcttggcccacgccataggtacttccataacacaaaaaggtataatctttattctgctgatgttagtaactccgagtatggcgatgcgatgtgtagggataggaaatcgagatttcgtagaaggtctttctggagctacgtgggtagacgtggtgctagaacatggatcttgtgtgactacaatggctaaagacaaaccaaccttagatatagaattattgaaaacggaagtcactaaccccgcagtcctacgcaaactctgcatcgaagctaaaatcagcaacacaacaacagacagcagatgccctacacagggcgaagctaccctggttgaagaacaagatacaaattttgtgtgtagaagaacatttgtagaccgaggatggggaaatggttgcgggttatttggaaaaggatctctcataacatgtgcaaaatttaaatgcgtaacaaaactagaaggcaaaattgttcaatacgaaaacttgaaatactctgtaatagtgactgttcatacgggagatcagcaccaagtaggcaatgaaaccactgagcatgggacaattgctaccataactccacaggcgccaacctcagaaatacagctaactgattatggagcacttacactagattgcagccctagaacgggattagacttcaacgagatggtactattgacgatgaaagagaaaagttggttagtacacaaacaatggtttctagatttgcctttgccttggacaagtggagcctccacaagtcaggaaacttggaacagacaggacttgctagtcacgtttaaaaccgcccatgctaaaaagcaggaagtcgtggttctaggcagtcaagaaggtgccatgcataccgcgctgacgggagctaccgaaatacagacgagtgggacaacaacgattttcgcaggtcatctaaaatgtagactcaaaatggataaactaaccctcaaaggcatctcgtatgttatgtgtacggggccattcaaattagaaaaggaggttgctgagactcaacatggaaccgttctggtccaagttaaatacgagggtacagacgcaccatgtaaaataccctttagttcccaagacgagaagggagtaacccaaaatggacgactcgtaacggcaaacccgatcgtgactgataaagagaaaccagtcaatatagaagcagagccaccgttcggagaaagttacattgtcgtaggtgctggcgaaaaggctttaaaactttcatggtttaagaaagggtcgtcaataggtaaaatgtttgaagcaacggcccgaggcgccagaaggatggcaatacttggagataccgcgtgggatttcggatcaatcggtggcgtgttcacttcagttggaaaattagtccatcaaatatttggaacagcatacggtgtcctattcagtggagtaagttggactatgaaaataggaattggcatactactaacatggctaggacttaactctcgtagcacatcgttaagtatgacctgtatcgccgtgggaatgattacgttatacctaggcgttatggtacaagcagattcagggtgcgtcataaattggaaaggaagagaattaaaatgcggaagtgggatctttgtaacaaacgaggtccatacctggacagaacaatacaaattccaggcggacagtccaaaacgtctgtcagccgctataggcaaagcatgggaagaaggtgtttgtggaattaggtccgcaacgagattagaaaatataatgtggaaacaaataagtaatgagctgaatcatattttacttgaaaacgacatgaaatttactgtggtagttggtgatgtgagcggtatacttgcgcagggtaagaaaagtataagaccacagccaatggaacacaagtacagttggaaaagttggggaaaagcgaagattataggtgccgacgttcaaaatactaccttcatcatagatggaccaaatacacctgagtgtcctgacgaccaaagggcatggaatatatgggaagtagaagactatggctttggaatatttacaaccaacatttggctaaaactcagggactcatacacacaagtatgcgaccataggttaatgtcagcagctataaaggattcaaaagcagttcatgccgatatgggatactggatagaatccgagaaaaatgagacttggaaactggcccgagcaagttttatagaagttaaaacgtgcatctggcccaaaagtcataccctttggtcaaacggtgtactagagtcggaaatgatcattcccaaaatttatggcggtcccatttctcaacataactacagaccaggatattttactcaaactgctggtccatggcaccttggcaaattagaactcgattttgatttgtgtgaaggcactacggtagtggtagatgagcattgtggcaatagaggaccgagcctaagaacaacgactgttactggcaagataatccacgaatggtgttgtagatcatgtactctaccaccactgaggtttaaaggtgaagatggatgttggtacgggatggaaatacgaccagtaaaggaaaaagaagaaaatttagtaaagagtatggtaagtgctggaagtggagaagttgacagtttttcactaggattattatgcataagcataatgatagaagaagtaatgagaagtcgctggagtaagaaaatgctaatgaccggaacattggcagtgtttctgctgcttacaatgggacaattaacttggaacgacttaataaggttgtgtataatggtaggtgcaaacgcatctgataatatgggtatgggtacaacttatttagcattaatggctactttcagaatgagacctatgtttgctgtaggattactgtttcgaagactaacgagtcgagaagttctactactaacggtgggcctaagtcttgtagcctctgtagaacttccgaatagcttagaagaactgggcgatggtctagcgatgggaatcatgatattgaaattattaacagactttcaaagccaccaactctgggcaactctattatcattaactttcgttaaaaccactttttcgctacactatgcgtggaaaacaatggcgatgatattgtcaattgtttccctattacctttgtgtttatccacaactagccagaaaacaacttggttacccgtcctacttggatcattaggctgcaaacccttaacaatgtttctaataactgaaaataaaatctggggtagaaaatcatggcctctaaatgagggaattatggcggtaggtatcgtctcaatattgttgtcatcactactgaaaaacgacgtaccacttgccggaccactcatagccggtggcatgctcatagcatgctatgttatctcaggcagttctgcggatctttcactggagaaggccgcggaagtatcttgggaagaagaagcggaacattcaggagcaagtcataacatactggttgaaatacaggacgacggaacaatgaaaataaaagacgaagaaagagacgacacaataaccatattactaaaagctacattgttagcaatctcgggagtatatcctatgtcaatccctgcaacactatttgtgtggtatttttggcaaaagcgcaagcaacgtagcggagtactctgggacacacccagcccacctgaagtggaaagagctgtcctagacgacggtatatataggattctacagcggggattgctaggtagatcccaggtcggcgtgggagttttccaagagggagtcttccacactatgtggcacgttacgagaggagcagtattaatgtatcaagggaaaagactcgaaccatcgtgggcaagcgtaaagaaggatttgataagttatggaggagggtggagattccaaggttcctggaacactggtgaagaggttcaagtcatagcagtggagcctggaaagaatcccaaaaatgtacaaactgctccgggtactttcaaaacttcagaaggcgaggtgggagcaatcgccttagattttaaaccgggaaccagtgggagtccaatagtcaacagagaaggtaaaatagttggtttatacggaaatggtgttgttacgacttctggcacgtacgtgtcagccatagcgcaagctaaagcatctcaggaaggacctcttccagaaatcgaagatgaggtttttagaaaacgcaatctaacgataatggatctacatccgggttccggcaagacacgacgctatctacctgcaatcgtacgggaagctattaaaagaaaattacgtacattagtcttagccccgacacgagttgtcgctagtgaaatggcggaagcgcttaaagggatgcctattaggtaccagacgactgccgtcaaatctgaacatactggccgagaaatcgttgacctcatgtgccacgcgactttcacgatgagactactgagccccgttagagtaccaaactacaatatgatcattatggatgaagctcatttcacagatcctgcgagtattgcagcacgtggttatataagtacaagagttggaatgggtgaggcagcggccatatttatgacagcaacgccacccggctcagtagaggcttttcctcagtctaatgcggttatattggacgaagaaaaagatattcctgaaagatcatggaactccggatatgattggattaccgactttccaggaaagactgtatggtttgtacctagtataaagtcaggaaatgatattgctaactgcctgagaaagaatggaaaacgagttatccaactatctcgtaagactttcgacacagaatatcagaaaacaaagaataatgactgggactacgtggtgaccacggacatatccgagatgggcgccaacttcagagcagaccgagtaatagatccgaggaggtgtttaaaaccggtgatactaaaagatggacctgagcgtgttatactggcagggcctatgccggtcacggtagcttctgcggcacaacgacggggaagaatcggaagaaaccaaaataaagaaggagatcaatacatatacatggggcaacctttgaataacgatgaagatcacgctcactggactgaagcgaaaatgctgcttgataatattaacactcctgaaggtataatccccgcactttttgaacccgagagagaaaagagtgccgccatagacggagaatatagattacgaggtgaagcaagaaaaacatttgtagaactaatgagacgcggagacttacctgtatggttgtcatataaagtggcaagcgaaggttttcaatactctgacaggagatggtgtttcgacggcgagcggaataaccaagtcctagaagaaaacatggatgtggagatatggacaaaagaaggtgaaagaaagaaacttcgacctcggtggcttgacgcaaggacatacagtgatccacttgcacttagagagtttaaagagttcgctgccgggcgacgatcagtatcaggcgatttgattttagaaataggtaaactaccacaacatcttacgcaacgggcacaaaacgcactagataatctagttatgctccataactctgagcaaggagggaaagcgtaccgtcacgcgatggaggaactccccgacacgatagagactctcatgttgctagcgctgatagcggtcttgacagggggcgtaacgctgttcttcttgagtggcagggggctcggtaaaacatctatcgggttgctttgcgttatgtcaagttcagcactgctctggatggcatcagtagaacctcactggatcgctgcatccattatattggagttctttttaatggtattactaattcctgaacccgatagacaacgaactccacaggacaatcaactggcatatgtcgtaataggcttgctttttatgattctcaccgtcgccgctaacgaaatgggtctattagaaactacaaagaaagacttgggaatcgggcatgccgctgcagaaaaccatcaccatgcagcaatgctggatgtcgatcttcatccagcaagtgcgtggacactctacgcagttgcaacgacaataataactccaatgatgagacacacaatagagaatactacagcaaatatctccttgaccgctatagccaatcaagctgctatactaatggggctcgataaaggatggccaattagtaaaatggatataggcgtaccgttgttagcgttgggttgttatagccaggtaaatccacttacactaactgccgctgttctaatgttagttgcacattatgcaattatcgggcctggcttgcaagcaaaagctactagagaagctcaaaaacgaacagcagccggaattatgaagaatccaactgttgatggcatagtagcaattgatctagaccccgtagtatacgatgcaaaatttgaaaaacaacttggacaaataatgcttctaatattatgtacatcacaaatacttctaatgcggacaacttgggccttatgcgaatcaattacccttgctaccgggccattaactacgttatgggaaggttctcccggtaaattttggaacacaacaatagctgtttcgatggcgaacatattcagaggaagttatttagctggtgctggattagcattttcactgatgaaaagcctaggcggcgggcgccgaggaaccggagcacagggggaaactctgggggaaaaatggaagagacaactaaaccaattatcaaaatcggagttcaacatctataaacgctctggaatagtggaagtggacagaagcgaggctaaagaaggattaaagcggggcgaaacaaccaaacacgcagtatcaagaggaactgctaaattgcgctggttcgttgaaagaaatttagtcaaaccagaaggaaaggttatagatttaggatgtggaagaggtggttggtcctattactgcgccggtctaaagaaagttacggaagtaaaagggtataccaaaggaggaccggggcacgaagaaccaatacctatggcaacttacggctggaacttagtcaaattatactctggtaaggacgttttctttattccgccagagaaatgcgataccttattatgtgatatcggcgaaagttcccctaatccaaccatagaagaaggacgaactttacgtgtcctaaaaatggttgaaccttggttacgaggaaatcagttctgtataaaaattctaaatccttacatgccatcggtagtggagacacttgagcaaatgcaacgaaaacacggagggatgcttgtgcgaaacccattgtccagaaattcaacccacgaaatgtactgggtaagctgtgggacagggaatattgtctctgcagttaatatgacatcgaggatgctactaaaccgattcacaatggctcatcgaaaaccaacttatgaacgcgatgttgatcttggtgcgggaacaagacatgttgcagtggaaccagaagtagcaaatctagacataattggacaacgaatcgaaaacatcaaaaacgaacacaaaagcacatggcactacgacgaagataatccatacaagacttgggcatatcacggatcctatgaagtaaaaccttctggatcagcaagctctatggttaacggtgtcgtccgtctcctaacaaaaccgtgggacgtaattcctatggtcacccaaatcgcaatgactgatactacaccattcggacaacaacgagtatttaaagaaaaagtagatactcgtacaccaaaagcgaagcgaggtacagcgcaaataatggaagtaacggccaaatggttgtggggtttcctgtcccgtaataagaaaccgagaatatgtactcgagaagaatttaccagaaaagtaagatctaatgcagctataggagctgtatttgtagatgaaaaccagtggaacagcgctaaggaagctgtagaggatgaaagattctgggatttggtccgccgagagcgtgaattacataaacagggaaaatgcgctacctgtgtttataacatgatgggaaaacgcgagaagaaactaggagagttcggaaaggctaaagggtcccgggctatttggtatatgtggttaggggcgagatttttagagttcgaagcgttagggttcatgaatgaggatcactggtttagtagggaaaattcattatccggtgttgaaggagaggggttacataaattgggatatattcttcgagatatatcaaaaataccaggaggaaatatgtacgcagacgacacagcagggtgggacacacgcatcactgaggacgatctacaaaacgaagctaaaataacggatataatggagcctgaacatgcgttgttggctacatccatattcaagctcacttatcaaaataaggttgtaagagtacaacgtccagccaaaaatggaacagtaatggacgtaatctcaaggcgggaccagagggggtcaggtcaagtaggaacctatggactaaatacattcacaaatatgggagcacagcttatcagacagatggagagcgaaggcatctttttacctagtgagttagaaactccaaatcttgcagggagagtattagactggttagaaaaacatgggattgaacgtttgagaaggatggctatttccggtgatgattgtgttgttaaaccaatagatgatcggtttgcgaccgcgttaacagccctaaacgatatgggaaaagtccgaaaggatatcccacaatgggagccgtccaaaggttggaatgactggcagcaagtccctttctgtagccatcactttcatcaattgataatgaaggatggacgagaaattgtagtaccctgtcgaaaccaagatgagctagtagggcgtgcgcgggtcagccaaggtgcagggtggtctctaagagaaactgcttgcctaggaaaaagctatgcccagatgtggcaacttatgtacttccatagacgtgatctaaggctagctgccaatgcaatatgttctgcagtgccagtagactgggtaccaacatcccggacgacatggtcaatacatgcacaccatcaatggatgacaaccgaagacatgctaagcgtatggaatagggtatggatagaagaaaacccgtggatggaagacaaaactcacgtttcaagctgggaggatgttccctatcttggtaaacgtgaagatcaatggtgtgggtcactgattgggcttactgctcgtgctacatgggctaccaacatacaggtcgcaataaatcaagtgagacgtttaataggcaatgaaaattacttggattatatgacaagcatgaaacgctttaagaatgaaagtgatccagaaggggcactttggtag

SEQ ID NO: 22016 - RNA, 9879 nt, synthetic construct
  misc_feature 1..9879: note = derived and/or modified CDS sequence (opt6) from DENV-1__JN697057__SS-prME
  source 1..9879: mol_type = other RNA
agtgttacgatgctcttaatgctcatgccaactgctcttgcattccatctgacaactagaggaggagaaccacacatgatagtatcgaaacaggaaagaggtaaatcattgctttttaaaacaagtgcgggagtaaatatttgtaccctaatagcaatggaccttggagaattatgtgaagacactatgacatacaaatgcccgcggattaccgaagctgaaccggacgatgtggactgttggtgtaatgctaccgacacgtgggtaacatacgggacttgttctcagacgggcgaacatcgcagagataaacgatcggtcgcactagcgccacatgtaggcttagggctagaaacccgtacagaaacctggatgtcaagcgaaggcgcctggaaacaaatacaaagagttgaaacttgggctctacgccacccaggcttcactgtaattgcactgtttctggctcatgcgatcggcacatcaattacacaaaaaggcataatctttatacttctcatgcttgtaacaccctcaatggcaatgcggtgcgtaggtattggttctagagactttgtggaaggactaagtggtgccacgtgggttgatgtagtgctagaacatgggagttgtgttacgacaatggcgaaagacaaacctacgcttgacatcgaattattaaaaacagaagtcacgaatcctgcggttctaagaaaactgtgtattgaagcaaagatatctaatactactacggattcgagatgcccgactcagggtgaagcgactctagtcgaagaacaggatgcgaattttgtatgtagacgaacttttgtagaccgcggttggggaaatggatgtggccttttcggcaaaggcagcttaatcacgtgtgcgaaatttaaatgcgtgacgaaactggaaggaaagatagtacaatatgaaaatttaaaatatagtgtaattgtaacagtgcatacaggtgatcagcatcaagtaggaaacgaaagcaccgaacacggaacgacggccacaatcactccgcaagcgcctacaacggaaattcaattaacagactacggtgcactaactttggactgtagcccacgtacaggcttagactttaacgaaatggtcttacttaccatgaaagagaaaagttggcttgtccacaagcaatggtttctggatctcccactaccgtggaccagtggagcgtctacatcccaagaaacatggaatagacaagatctactggttacgtttaaaacagcccatgccaagaaacaagaagtcgtagtattaggttctcaggaaggagctatgcatacagctcttactggagctacagaaatacaaacatcaggaactaccacaatattcgcgggccatttgaagtgcagacttaaaatggataaactgactctaaaaggcatgagctacgtgatgtgtacaggatcattcaaattggaaaaagaagttgccgaaacacaacatgggacagttctagtacagataaaatacgaaggcacagacgctccatgtaaaatacctttttcaacacaagatgaaaaaggagtgactcagaatggtaggcttataacagcaaacccaatagtgactgataaagaaaagcccgttaatattgaagcagagccaccctttggagaatcatacatagtgatcggtgcaggagaaaaagcgctaaaagtatcttggtttaagaaaggttcatctattggaaaaatgtttgaagctacagcaaggggagcaagacgaatggctatactaggagacacggcgtgggattttggatctatcgggggcgttttcaccagtgtcggtaaattggttcatcaaatattcggaaccgcttatggagttttattctcaggggtctcatggacaatgaaaatagggataggagtactcctcacatggctcggtctaaactctagatcaacttccctatcaatgacatgtatcgccgtggggcttgtcacactttacctcggtgtaatggtacaagcagactcggggtgtgtaataaactggaagggaagggagttgaaatgcggctccggcatatttgtaacaaatgaagtacatacgtggacagaacagtacaaattccaagcagactcaccaaaaagattgtccgcggccataggtaaagcatgggaagagggggtgtgtgggatacggagcgctacgagacttgaaaatatcatgtggaaacaaatttccaacgaattaaaccacatccttttggagaatgatatgaagttcacagtagtggtcggcgatgtagctggaatcttagctcaagggaagaaaatgataaggccccaaccaatggaacacaaatatagctggaaatcttggggcaaagctaaaataatcggggcagatgtacagaatacaacatttatcatcgacggtccaaacacacccgagtgccccgatgaccaaagagcgtggaatatatgggaagtagaagactacggttttggtatctttactacgaacatttggctaaaacttagggattcatatacgcaagtttgtgatcacagactaatgtcggcagcaattaaagacagtaaggcagtacatgctgatatggggtattggatcgaatcagagaaaaatgaaacatggaaattagcaagagcatcgttcattgaggtaaaaacatgcatatggcccaaaagtcacacactatggagcaacggagtcttagaatcagaaatgatcatacctaaaatctatggcggacctataagtcagcataattatagaccaggctattttacacaaactgccggcccgtggcatctaggcaaattagaacttgacttcgacctttgcgagggcactactgttgtcgttgacgaacattgtggaaataggggaccatcattacgaacgactacagtaacaggtaagataattcatgaatggtgttgtcgatcatgcacgttacccccattacgtttcagaggggaagatggatgctggtacggaatggaaattcggccggttaaggaaaaagaagaaaatttagtgaaatcaatggtctctgctggcagcggtgaggtagatagttttagtctgggtctgttgtgcataagcattatgatagaagaagttatgcgatcacgatggtctagaaagatgcttatgaccggaactctagcagtgttctttctcctaatcatgggccaattaacttggaatgaccttataagattatgcataatggtaggcgcaaatgctagcgacagaatggggatgggtactacatatctagcgttaatggctacattcaaaatgagacctatgtttgctgttggtctgctattcagacgactaacatccagagaagtgctcctactaaccataggattatcattagtcgcaagtgtagagcttcctaatagtttagaagaactaggggatggactcgcgatgggtatcatgatactgaaacttctgacggactttcaatctcatcaattatgggtgaccctattgagtttaactttcataaagacagcttttagtttacactatgcatggaagacaatggcaatggttctttcaattgttagcttgttccctctttgtttaagtaccacaagccaaaagacaacatggctcccagtactattaggaagtttgggatgcaaacctctaacgatgtttctaattgcagaaaataaaatatggggtagaaaatcatggccattaaacgaaggtataatggcagttgggattgtatcaatcttactgtcaagtctcttgaaaaacgatgttcccctagcgggtccgcttattgccgggggaatgttaatagcttgttatgtaatatcgggatcatcggctgatctaagcctggaaaaggcagcagaagtaagttgggaagaggaagctgaacattctggggcgtcccataacattctagttgaggttcaggacgatggaaccatgaaaataaaagatgaagaaagagatgatactttaacaatattacttaaggcaacgctgttagccgtctcaggagtgtatcccctaagcatcccagcgacgctctttgtgtggtacttttggcaaaagaaaaagcaacgaagcggggtactctgggacacacccagtccacctgaagttgagcgagcagttttagatgacggtatatacagaataatgcaacgtggtcttttagggaggtcacaggtaggcgttggagttttccaggaaaacgtctttcataccatgtggcatgtgacacgtggtgcagtacttatgtaccaaggtaaaagattagaaccatcatgggcatctgtcaagaaagatttaataagttacggtggagggtggagactacaaggatcttggaataccggcgaagaggtgcaagtcatagcggttgaacctggcaaaaaccccaaaaatgtacaaacggctccaggcacatttaaaacgccagagggtgaagttggagctattgctttagactttaagccagggacatcaggctcgcccatagtaaatagggaaagaaaaatcgtaggactgtacggcaatggagttgtaaccaccagcggtacatatgtctcggcaatagcacaggcaaaggcatcacaagagggaccactacccgaaattgaagacgaagtcttcagaaaaaggaatctaactataatggacctacacccaggttcaggtaaaactagaagatacttgccagctatcgtaagggaggccataaaaagaaagttacgaacattaatactggcacctactagggtggttgccagcgaaatggcagaagccctgaaaggaatgccaatacgctaccaaacaacagctgtgaaatctgaacatacaggaaaagagatagttgatttgatgtgccatgctacttttacaatgagactactatctcctgtaagagtaccaaattataatatgattatcatggatgaagctcatttcaccgacccatctagtattgcagcacgtggttacatatcaacgcgagtgggtatgggcgaggccgcagcgatattcatgacggccacacctccaggatctgttgaggctttcccgcagtctaacgctgtcatacaggacgaagaaagagacattcccgaaaggtcatggaatagcggatatgagtggataacagatttcccaggaaaaacagtttggttcgttccaagcataaagtctggaaacgatatagctaattgtttaaggaagaacgggaagagggtaatacaacttagtagaaagacttttgataccgaataccaaaagaccaaaaataatgactgggattacgttgtgacaactgatatatcagaaatgggcgcaaatttccgagctgacagagttatagaccctagaagatgcttaaaacccgtaatacttaaagatggtccagagcgtgtaatactagctggtccgatgcctgtaacagttgcttctgcagctcaaaggagaggacgtattggaagaaatcacaataaagaaggagaccaatacatatatatgggacaaccattaaacaacgatgaagatcatgcacactggacagaagcaaagatgctactagacaacatcaatacccccgaaggcattataccagcactatttgagccagaacgcgaaaaatcagcagcgattgatggagaatatagattaagaggagaagccaggaagacattcgttgaattgatgagaagaggggatcttccagtgtggttgagttacaaagtcgcaagcgagggattccaatattccgacagaaggtggtgtttcgacggtgaaagaaacaaccaagttttagaagaaaacatggatgtagagatttggactaaagaaggggaaaggaagaaactcaggccacgatggttagacgcccgaacctactcagaccctctagctttgcgtgagttcaaagagttcgctgctggtcgacgaagtgtctctggggatttaatcctagagataggaaaattacctcaacatctaacgcagcgtgctcaaaatgcattagataacttagtaatgctacataatagtgaacaaggagggcgcgcataccgacatgcaatggaggaactacccgacaccatcgaaactttaatgttgctagcgctgattgccgtacttacaggaggggtcacgcttttctttttatcagggcgcgggcttggtaaaacctctataggccttctatgcgttatggcttcatcagttttgctatggatggcatcggtggaaccccattggatagctgcttctataatccttgagttcttcttaatggttcttttgattcctgaacctgatagacaaaggacgcctcaagacaatcaacttgcatatgtagtcataggtttattattcatgatactcacagtagcagcaaacgaaatgggactactagaaaccacaaagaaagatttaggtattggacacgtcgctgtagaaaatcaccatcacgctgctatgcttgacgttgatttacatcccgccagtgcttggaccttatacgctgtcgctacaacgatcataacccccatgatgcgccacacaatagagaacactacagcaaacatcagcttgacggcaattgcaaatcaagcagcgattctgatgggtctagataaaggatggccaatttccaaaatggatatcggggtaccattgttagccttgggatgctactctcaggtcaaccctcttacacttacggctgcagtgctaatgctagcggcccattatgcaataataggaccaggcctacaagcaaaagcaactagggaggcacagaagagaactgcagcgggcataatgaaaaaccctaccgtagacggcatagttgcaatcgatttagatcctgtcgtgtacgacgctaaattcgaaaagcaacttggacagattatgctgcttatactttgcacatcccaaatcctgctaatgcgtacgacatgggcattgtgtgagagtataacgcttgccaccggccctcttacgacattgtgggaagggagtcccggcaaattctggaatactacaatagcggtatccatggctaacatatttcgaggtagttatttggctggagccggcttagcattttctttgatgaagagtttaggtggtggcagaagaggcactggagcacaaggagaaacccttggagaaaaatggaaacggcaactaaatcaactatcaaaaagtgagttcaatacgtacaaaagatctgggataatggaagttgaccgatcagaagctaaggaaggcctaaaacgaggtgaaacaacgaaacatgctgtatcacgcggcacagctaagttacgttggtttgtagagcgaaatcttgtaaagccagaaggcaaagtagtagatctcggatgcgggaggggaggatggtcctactactgcgccgggctaaagaaagttacagaagtgaagggttacacgaaaggagggcccggtcatgaagaaccaataccaatggccacttacggatggaatttagtgaagctacattcaggtaaggatgtgtttttcataccaccagagaaatgtgatacattactttgcgatataggcgaatcatcccctaacccaactattgaagaaggacgaactctacgggtactgaaaatggtagaaccgtggctaagaggcaaccaattttgtataaaaatactaaacccatacatgccgtcggttgtagagacccttgaacaaatgcaaagaaagcatggaggaatgttggtgcgaaacccattgtcacgcaactctactcatgaaatgtactgggtttcatgtggaacaggaaacattgtatctgctgtaaacatgaccagtcggatgttactaaaccggtttacaatggcccaccgtaagccaacttacgaaagggatgttgaccttggcgccgggacacgacatgtcgcagtggaaccagaagtagcaaacttagacataattggacaaagaattgaaaatataaaacacgaacataaaagtacatggcattacgatgaagataacccttataagacctgggcttaccatggcagctatgaggtgaagccaagcgggagcgctagcagcatggtgaacggggttgttaaacttctgacaaaaccatgggacgtaattccaatggtcactcaaattgcaatgacagatacaacaccttttggacagcaaagagtctttaaagaaaaggtggatacacgcactccaaaggcgaaaagaggaactgcgcagataatggaagtgacagcacgatggctatggggctttctctcacggaacaaaaagccgcggatatgcacaagagaagagttcactaggaaagtacgctccaatgccgcaataggcgcggttttcgttgacgaaaaccaatggaactcggcgaaagaagcagttgaggacgaacggttttgggacctcgtccatcgagaaagggaattgcataaacaaggtaagtgtgctacgtgtgtatataatatgatgggaaagagagagaagaaactaggagaatttggcaaagcaaaagggtcccgcgcaatatggtacatgtggctaggagcccgtttcctcgagttcgaagcgctaggatttatgaacgaggatcattggtttagtagagaaaatagcctatctggtgtagaaggagagggtcttcataaattgggatacatattacgagacatatcaaaaattcccggagggaacatgtacgcagacgacaccgcaggatgggatacaagaataacagaagatgatttgcaaaatgaggccaaaataactgatataatggaacctaaacacgccttactggccaaagccatattcaaactcacataccaaaataaagttgtcagagtccaaagacctgctaaaaacggaacggttatggatgttatatcccgtcgagatcaaagaggtagcggacaagttgggacttatggattaaatacctttactaatatggaagcacaattgattagacaaatggaatcagaaggaatattcagcccttctgagctagaaactcctaacctggctgaaagggttttagattggctggaaaaatacggagtagaacgtttaaagaggatggccatcagtggagacgactgcgtagttaaacctatagacgatcgatttgccacggctctaactgccttaaatgacatgggcaaagtccgtaaagatataccacaatgggaacctagtaaagggtggaacgattggcaacaagttcctttttgtagccatcactttcaccagttgataatgaaagacggccgagaaattgtagtaccatgccgtaaccaagacgagctagtgggacgcgcgagggttagccaaggtgctggctggtccttaagagaaaccgcatgccttggaaagtcctacgcgcagatgtggcaacttatgtattttcacagaagagatctacggttggcagcaaacgctatatgcagtgctgttccggtcgattgggtgccgacgtcaagaaccacatggagtattcatgcacatcatcaatggatgacaacagaagatatgttaagtgtttggaaccgagtatggattgaggaaaatccctggatggaagacaaaacccacatctcaagttgggaagatgtgccatatctaggtaaacgtgaagaccaatggtgcggctctcttattggactgactgctagagccacatgggcgactaacatccaagtagcaataaatcaggtaagacgtttaattgggaacgaaaactaccttgactacatgaccagcatgaaacgtttcaaaaatgaatcggatccagagggtgctttgtggtga

SEQ ID NO: 22017 - RNA, 9879 nt, synthetic construct
  misc_feature 1..9879: note = derived and/or modified CDS sequence (opt6) from DENV-1__HQ624984__SS-prME
  source 1..9879: mol_type = other RNA
tccgtaactatgttattgatgctcatgccaacagcccttgcttttcatttaacaacaagaggaggagaaccacacatgattgtctcaaaacaagaaagaggaaagagcctgctgtttaagacaagtgcaggggtaaatatgtgcacgttaatcgccatggatttgggggaactatgtgaagatacgatgacatacaaatgtcctagaattactgaagcagaacccgatgatgttgattgttggtgtaacgcaaccgacacctgggtcacatacgggacttgtagtcaaactggtgaacatagacgcgataagagaagcgtagcattggcacctcacgttggtttagggttagaaacgaggactgagacatggatgtcaagcgaatcggcttggaaacaaattcaacgagttgaaacttgggcacttagacacccgggatttactgtaatagctctatttttagcccatgccataggtacgtccataacacaaaagggtattatatttattctactgatgttagtgaccccttcaatggctatgcgttgtgtaggaataggtagtagggactttgtcgagggcttaagtggggctacttgggttgacgtagtcttagaacatggaagctgtgtcactaccatggcgaaagacaagccaacattggatatagagctattaaaaacagaagtgactaaccccgcaatcttaaggaagttatgcatagaggcaaagatcagcaacacaacgactgacagtagatgtcccactcaaggagaagccacattggtggaggagcaagacgcaaatttcgtttgccgaagaacctttgtagatcgtggttggggaaatggctgcggcctattcggtaaaggatccttaataacatgcgcaaaatttaaatgtgtaacgaaattagaggggaaaattgtgcaatacgaaaacttaaaatattccgtaatagtaactgtacacacaggtgaccaacatcaagtcggtaatgaatcaactgaacacggaacaaccgcaactataaccccacaagcaccaaccacggaaatccaattgacagactacggcgctctgactctggactgttcgccacgtaccggccttgacttcaacgaaatggttttattaacaatgaaagagaaaagctggctagtgcacaaacagtggtttctcgatcttccgctaccgtggacctctggggcatccacgtcgcaagaaacatggaacagacaagatcttttggtcacctttaaaactgcccatgctaagaaacaagaagtagttgtgttaggctcacaggaaggcgctatgcatacagcactgactggcgccactgaaattcaaacttctggaactacaaccatttttgccggacacttgaaatgtcgactaaaaatggataaacttacgctcaagggcatgtcgtatgtcatgtgtacaggttcgttcaaattagaaaaggaagtagcggaaacccaacatggcaccgttctagtgcagatcaaatatgaagggacggatgccccatgtaaaattccgttttcaacgcaggatgagaaaggtgtaactcaaaacggcaggctgatcaccgccaatccgatagttacagacaaagagaaaccagtgaatatagaagctgagcctccattcggggaaagttatatcgttattggagcaggagaaaaagctctaaaattaagctggtttaaaaaggggtcgtctatcggaaagatgttcgaagctactgcccgtggcgcgagaagaatggcaatcctgggggataccgcttgggacttcggtagtattggaggggttttcacaagtgtaggtaaactggtacatcaaatattcggtacagcttacggtgtactattttcgggagtttcatggacgatgaaaataggtataggcgtattattgacgtggctgggactaaatagcagaagtaccagtttgtcaatgacatgcatagctgtcggccttgtaacactgtatcttggagtcatggttcaagccgatagcggctgtgtcatcaactggaaaggcagagaactcaaatgcgggagtggaatctttgttacaaacgaggttcacacgtggacggagcaatacaaatttcaagcggattcaccaaaaaggttaagtgcagcgataggaaaagcgtgggaagaaggcgtgtgcggcattagatcagcaacccgactagaaaacattatgtggaaacagatatcaaatgagttgaatcatatactgcttgaaaatgatatgaaattcacggtggttgtaggagatgttgccggaatactagcacaaggcaagaaaatgatacgtccacaacctatggaatataagtatagttggaaaagctggggcaaagcaaagataataggtgccgatgtgcaaaatactacgtttataatagatggacctaatactcctgaatgtccggacgatcaacgtgcatggaacatttgggaagtggaggattacggatttggcatattcacaacgaacatctggctcaagttaagggattcctacacacaggtatgtgaccacaggcttatgtctgcagccatcaaagattccaaggccgtgcatgcggatatggggtactggatagaatcagaaaagaatgaaacatggaaacttgctagagcatcgtttatagaagttaaaacttgcatttggccaaaatcccatacattatggtcaaatggagtattagaatcagaaatgataattcccaaaatatatggaggacctatatcacaacacaattaccgtccagggtatttcacccagaccgcagggccatggcacctaggcaaactagagctagatttcgatttgtgcgagggtacaactgtagtcgttgacgaacactgtggaaacagggggccatcgttaagaacgaccacagtcacaggaaaaataatacacgaatggtgttgtagaagttgtacactcccaccattaagatttcgaggtgaggatgggtgctggtatggtatggagatcaggcctgttaaagaaaaggaggaaaatttagtaaaatcaatggtgtcggcaggctcaggagaagtagattcatttagcctaggactactttgtatttcaattatgattgaagaggtgatgcgtagtcgatggtctcgaaaaatgttgatgaccggaactctcgcagtctttcttctgttaattatgggacaattaacatggaatgacctcattcgactttgtattatggttggagccaatgcatcagatcgaatggggatgggaaccacatacttggccttaatggcaacctttaaaatgagacctatgtttgctgtaggcttactttttcgccgtctaacaagcagggaagttctacttctaacaataggtctttcacttgtcgccagcgtcgaactgcctaactcattagaagaactaggggacggactagcaatgggaattatgatattaaaattgttaaccgatttccaaagccaccaactatgggcaactttattatcgctcacttttattaaaacgactttctcattgcattatgcgtggaagacaatggcgatggttctaagcatagtctctctttttcccctttgtttatccacgacgtcccagaaaacgacgtggcttcccgttttactcggttctctaggttgcaaaccacttacaatgtttctgatcgcagaaaacaaaatctggggtcgacgaagttggccactaaatgaaggtataatggcggtcgggatagtttccatccttttaagctcactcctcaagaatgatgtaccgctggcaggcccactaatagctggtggcatgttaatagcttgttacgtgataagtggaagttcagcggatctgagtttagaaaaagccgctgaggtatcttgggaggaagaagcagaacatagcggggcgtcacacaacattttggtagaggtacaagatgatggaactatgaaaataaaagatgaagaaagagacgacactctcacaatcctgctcaaagctactttactagcagtatccggagtttatccactgagtatcccagcaacactatttgtttggtacttttggcaaaagaagaaacagagatcaggggtgttgtgggacaccccctctccaccggaggtagagagggctgttttagatgacggtatctacagaataatgcaacgcggtctgctcggaaggtcacaggttggagtaggggtatttcaggagaatgtattccatacgatgtggcacgttacgcgaggcgcggtgcttatgtatcaaggaaaaagactagaaccctcgtgggcatctgttaagaaggacctcattagttacgggggagggtggcgcctacaaggtagttggaacacaggtgaggaggtacaagtaatagcagttgaacctggtaaaaacccaaagaacgttcaaaccgcaccgggaacatttaagacatcagaaggcgaggtgggagcaatagctttagacttcaagccaggaacgtcaggatcacctatagtaaatagagaaggaaaaatagttgggctttatggtaacggagtcgtaacgacgtctgggacatatgtgtcagcaatagcccaagcaaaagcatctcaagagggaccccttccagaaatcgaggacgaggtatttcgtaagcgaaatttaacgataatggacctgcatccaggatcaggtaaaacaagaagatatttaccagcaatagtaagagaggcaataaagcgaaaattgcgtacgctaatattagcaccaacgcgagtagtcgctagtgaaatggccgaggctttaaaaggaatgccaataagataccaaactacggcagtcaaatccgaacatacagggaaagaaattgtagacctgatgtgtcatgcaacattcacaatgaggctcttaagccccgtacgcgtcccgaattacaatatgattattatggatgaggcacatttcacagatccatcaagtatcgctgccagaggatatatatcgaccagggttggaatgggtgaagcggccgcaatatttatgacggctaccccaccgggatcggtagaagcatttccgcaatcaaatgcattgattcaagacgaggaaagagacattcccgaacgatcctggaacagcggttacgaatggattaccgacttcccaggcaaaaccgtgtggtttgtgccaagcatcaaaagtggtaatgatattgcaaattgtttaaggaaaaatggaaaacgcgtcatacaattatcacgtaaaacttttgatacagaatatcagaaaaccaaaaacaatgattgggactacgtggtgacaaccgatataagcgagatgggggctaatttccgtgcagatagagtgatagaccccaggcgctgcttaaaaccagtaattttaaaggatggcccggaacgtgtgattcttgcgggcccgatgccagtgactgtcgcctcggccgcccaacgaagaggaaggattgggcgaaatcataataaagaaggcgatcaatatatctatatgggtcaaccactgaataacgacgaagatcatgctcactggacagaagcaaaaatgttgctcgataatatcaacacaccagaaggaataataccggcactctttgaaccagagcgcgagaaatcagcggcaatagatggggagtatcgtctgagaggcgaggcccgaaaaacattcgttgagctgatgagaagaggcgatttaccggtctggttaagttataaagttgcttcagaagggtttcaatattcagacagaagatggtgttttgatggcgaacgcaacaatcaagtgttagaggaaaatatggatgttgaaatctggactaaagaaggagagagaaagaaacttcgtcccagatggctcgacgcaagaacatatagtgatccgttagcactaagagagttcaaagaatttgctgcgggtcgaagaagcgttagtggcgacttaatattagaaataggaaagctgccacaacacctcactcaaagggcacagaatgcattggataacttagtaatgttacataattcggaacaaggtggccgtgcatacaggcacgcaatggaagaattaccggatacaatcgaaacattgatgttattagcgttaatagcagtattgacaggaggggtgacactattctttttatcaggccgtggattgggtaaaacatcaataggactcctatgtgtcatggcttctagcgtcctgttgtggatggcatcagtagaacctcactggatagcggcaagtataatactagagttctttcttatggtcttactaattccggaacctgatcgtcagaggacaccgcaggacaatcagttagcttatgttgtaatcgggcttctatttatgatcttaacagtagcagcaaatgaaatgggtctattagaaaccactaagaaagatttagggattggacatgtagcagtaggcaaccatcatcatgctgctatgctggatgtcgatctacatcccgcgtccgcatggacgctatatgctgttgctacgacaatcatcacgccgatgatgcgccacacaatcgaaaatacaacagcaaatatctctttgacagctatagcaaatcaagcagctatattgatgggtttagataaaggatggccgatcagcaaaatggatataggagtaccattgttagctttaggttgctattcacaagtaaaccctttgactcttaccgcagctgtcctaatgctagtggcccattacgctatcatcggccctgggttgcaagcaaaagctacaagagaggcgcagaaaagaacagcggccggaataatgaaaaacccaaccgtcgacggaatagtcgccatagatctagatcctgtagtctatgatgcaaaatttgaaaaacaattgggacaaatcatgctgctaattctctgtacatcacaaattttacttatgagaacaacttgggccctttgtgaatcgataacattggctacgggtccactaacaacgttatgggaaggttcacccggaaaattttggaacacaactattgcagtgagtatggctaatatttttcgcggttcttatctagctggggcgggtttagcatttagtctcatgaaatctctgggcgggggcaggcgaggtactggagcacaaggagaaactctcggggagaaatggaaacgacaacttaaccaactaagtaaatctgaatttaatacatacaaacgctcaggtataacagaagtcgatcgtagtgaagctaaagaaggattaaaaagaggagagaccacaaaacacgctgtatcaaggggtactgccaaactaagatggttcgtggaaagaaatctagttaaaccagaaggtaaggtaattgatttaggttgtggtagagggggatggtcttactattgcgcgggtttgaaaaaggtaaccgaagtcaaaggttatacaaagggcggtcccggacacgaagaacccatacctatggcaacgtatggatggaatctagtgaaattacattctggaaaggatgtctttttcataccacctgaaaaatgtgacacgttattgtgcgacataggcgaatcatctccaaaccctactattgaggaaggacgaaccctaagagttttaaaaatggtggaaccgtggcttcgcggcaaccaattttgcataaagatacttaacccgtacatgcccagcgtcgttgagaccctagaacaaatgcaaagaaaacatggaggaatgttagtccgtaacccacttagtcgaaactctacacatgagatgtattgggtttcatgcgggactggaaacatagttagtgctgtgaatatgacaagccgcatgctcttgaacagattcacaatggctcatagaaagcccacatacgaaagagatgtagatctgggagcagggactagacatgtcgcggtagaacccgaggttgcgaatttggacattatagggcaaaggattgagaacataaaacatgaacataagtctacgtggcactacgatgaggacaacccttacaaaacctgggcttatcacggatcatacgaagtgaaaccttcgggtagtgcatcttcaatggttaatggagtagtgaaattattaacaaagccatgggacgtaatacctatggtcacccaaattgcgatgacagacacaaccccgttcggacaacaaagggtctttaaagagaaagtagacactagaacacctaaagctaagagaggcaccgcccaaattatggaagtaacagctaaatggctgtggggctttctctcgcgcaacaagaaaccaagaatatgcacgagagaagagtttacaagaaaagtaagatccaatgctgctataggtgccgtattcgtggacgaaaatcaatggaatagcgcaaaagaagccgtagaggatgaacggttctgggatttagtccatagagaaagagaattacataaacaaggcaaatgtgcaacttgtgtatataatatgatgggaaagagggagaagaaattgggagagttcggaaaagcaaaaggatctcgagccatatggtatatgtggttgggcgctcgattcttagaatttgaagcgcttggattcatgaacgaagatcattggttttctagagaaaatagcctatcgggggtggaaggtgaagggttgcacaaattagggtatatactaagggacatttcaaaaatacctggtggaaacatgtatgctgacgatacagccggctgggatactcgtattacggaggatgatctacaaaacgaggcaagaataacagatataatggaacctgaacatgcgctcctagctaaatctattttcaagctaacatatcagaacaaagttgtacgagtacaaaggcccgcgaagaacggcaccgtaatggatgtaattagcagaagagaccaacggggatcgggacaagtgggaacttacggtctaaacacattcacaaacatggaggcacagttaataagacaaatggaatctgaaggtatattttcgccgagcgaactcgaaacacctaatcttgctgagcgagttctagattggttggaaaaatacggcgttgaacggttaaaacgaatggcaatatctggagatgattgtgttgtgaaaccaatcgatgatagattcgcaactgcattaaccgcactgaatgatatgggaaaggttcgcaaagatataccacagtgggaaccaagcaaaggctggaacgactggcaacaagtacccttttgttctcatcattttcaccaattaataatgaaagatggccgtgaaattgtcgtaccctgccgaaaccaggatgaattggtaggccgagctcgcgttagccaaggtgccggctggtccctgagagaaaccgcttgtctaggcaaatcgtacgctcaaatgtggcaactaatgtatttccatcgaagggacctaaggttagccgccaatgccatttgctctgcagtacctgtagactggattcccacttcacgcactacctggagcatacatgcacatcaccaatggatgactacagaagatatgttatcagtatggaaccgtgtctggattgaagaaaacccatggatggaagataagacgcacataagttcttggggagacgtaccgtatttaggtaaaagggaggaccagtggtgcggaagccttattggattaacagcgcgtgcaacgtgggctacaaatatacaagtagcaattaaccaagtgagaaggctcataggaaatgaaaattatttggattacatgacgagtatgaaaagattcaaaaacgaatcagacccggaaggagcgttgtggtaa

SEQ ID NO: 22018 - RNA, 9879 nt, synthetic construct
  misc_feature 1..9879: note = derived and/or modified CDS sequence (opt6) from DENV-1__HQ891314__SS-prME
  source 1..9879: mol_type = other RNA
tcagttacaatgttattaatgctaatgcctaccgcgttagcatttcatctaactacacgtggaggtgaacctcatatgatcgtaagtaaacaagaacgggggaaaagtttactatttaaaacatctgcaggggttaatatgtgcactctaatcgcgatggaccttggagagctatgtgaggacacaatgacttacaaatgcccaagaataaccgaggccgaacctgatgatgttgactgttggtgcaacgccacggacacatgggttacttatggaacatgtagtcaaacgggagaacacagacgggacaaaaggagcgtcgcattggcaccccacgttggattggggctcgagacacgcacggagacgtggatgtcatcagaaggagcatggaaacaaattcaaagagtggaaacttgggcacttcgacacccaggatttaccgtaatagcactgtttttggcacatgcaatcggaacctcaatcacacaaaaaggtataattttcatcctgctaatgctagtaaccccatcaatggcgatgcgctgcgttggtatcggatccagggattttgtggaagggctatcgggagctacatgggtcgacgtagttctagagcacgggtcatgtgtcactacaatggcgaaagataaacccactttagacatagagttacttaaaacagaagtaaccaatcctgcagtactgagaaaactgtgcattgaagctaaaatttcaaacacaacgacagacagtagatgcccaactcaaggggaagcaaccttagttgaagaacaggacgcgaacttcgtatgtcggaggacatttgttgaccgaggatggggtaatggatgtggtttatttggaaaaggttcgctcttaacctgtgctaaattcaaatgcgtgacaaaactggaaggcaaaatcgtacaatacgaaaacttaaaatacagcgtcatagttaccgtacataccggagaccaacaccaagtaggtaatgaatcaacggagcacggtacaactgcaacaattactccccaagcaccaacaacagagattcaacttacagattacggtgcacttacattagattgttcaccgcgaaccgggctagattttacagagatggttttgctaacgatgaaagagaaaagctggctcgttcacaaacaatggttccttgacctaccgttaccttggacatcaggagcatcaacaagtcaagaaacttggaatcgacaggacctactcgtgacgtttaaaacagcacatgcaaagaaacaggaagttgtcgtactcggaagtcaggagggtgcaatgcacacggcactaacaggggccactgaaatccaaacatcaggaacaaccacaattttcgcaggtcacttaaaatgccgcctcaaaatggataaactcactcttaaaggtatgtcatatgtaatgtgtaccggatcctttaaattagaaaaagaagtcgccgaaactcagcatgggacagtcctagtacaaataaaatacgaagggacagatgcgccgtgcaaaataccttttagtacacaagatgaaaaaggagtaacgcagaatggacgattaataacggctaatcctatcgttacagacaaagaaaaacctgttaatatagaggcggaaccacccttcggggaatcttatattgtaatcggagctggtgaaaaagcattgaaattatcttggttcaagaaaggtagtagcatagggaaaatgtttgaagcaacggcacgtggtgcccgtagaatggccattttaggcgatacggcatgggatttcgggagtatcggtggtgttttcactagcgtgggtaagctagttcatcaaatatttggaacagcatacggagttctattctccggagtctcatggacaatgaaaataggaattggggttctactcacgtggcttggtctaaatagtagatccacaagtttatcaatgacatgcatcgctgtaggattagtcacactctacttaggggttatggtacaagctgattcgggatgtgtgataaattggaaaggtcgagaattgaaatgtgggtcaggtatttttgttacgaatgaagttcacacttggacagaacagtataaattccaagctgattcaccgaaacgactaagtgcagccatcgggaaagcctgggaggaaggtgtgtgtggcatcagatccgcaactagacttgaaaatataatgtggaaacaaatttctaacgagctaaatcatatattattggagaacgatatgaaattcaccgtcgtagtgggtgacgtggccggaatattagcacaaggaaagaaaatgatacggccgcaacctatggaacacaaatactcttggaaaaattgggggaaagcaaaaattatcggcgctgacgtgcaaaatagcaccttcattatagacggaccaaatacaccagaatgttcagacgatcaacgcgcttggaacatttgggaagtcgaagactacggatttggaattttcacgacgaacatttggttaaaattaagagatagttatacacaggtatgtgatcatcgattaatgtctgcagccattaaagattcaaaagcggtacacgcagatatgggatattggatagaatctgagaaaaatgaaacttggaaattagcacgtgcctcgttcatagaagtcaaaacctgcatatggcctaaatcacatactctctggtcgaatggcgttctagaaagtgagatgataattccaaagatatacggaggaccaataagtcagcacaattatcgaccggggtactttacccagacagcaggtccctggcaccttggtaaacttgaattagatttcgacctttgcgagggtaccacagttgttgtagacgagcattgcggaaacaggggtcccagcttacgtacgacgacagttacgggtaagattatacacgagtggtgttgcagaagctgcacattaccgcctctaaggtttcgtggggaagatgggtgctggtacggaatggaaattagaccagtgaaggagaaggaggagaacctagttaaatcgatggttagtgccggttcgggcgaagtggactcatttagtttaggtctactatgtatatcaataatgattgaggaagtcatgaggtcgagatggtctagaaaaatgcttatgacaggcactttagctgtattctttttgctcataatgggacaactaacgtggaacgatctcattcgcttatgtataatggtaggggcaaatgcgagcgacagaatgggaatgggcacaacatacttagctttaatggcaacattcaaaatgcgaccgatgttcgctgtaggattgctatttaggcgtttaacctcgagagaggtccttttactcaccattggtctaagtttagtagctagtgtggaactgcccaactcattagaagaattaggtgacggtcttgcaatgggtattatgatactaaaactactaacagatttccaatctcatcagctgtgggcgacattattatctatgacattcatcaagaccaccttttctttacactatgcttggaagactatggccatggtcttgagcattgtatctttatttcctctttgtctttcaacaactagccaaaagacaacatggcttccggtgctacttggatcactaggctgtaaaccattaacaatgttcttgatcgcagaaaataaaatatggggacgtaaatcttggccgctaaacgaaggaataatggctgtcggtattgtctctatattgctctcatcattgctcaaaaatgacgttcccttagcaggaccgttaattgcagggggcatgctaattgcatgttacgtaatcagcgggtccagcgctgatttatcgttagagaaagcagcggaagtaagttgggaagaagaagccgaacactcaggagcgtcacacaatatacttgttgaggttcaagacgacggaacaatgaagataaaagatgaagaacgtgacgatactctcacaatattactcaaggctacactattagcggtgtctggcgtatatcccttgtcgataccagcaactttatttgtgtggtatttttggcagaagaagaaacaacgatctggggtattatgggacacaccaagtcctccaaaagtagagcgcgccgtacttgacgatggcatatacagaataatgcaacgaggtcttttggggcgttctcaagttggagtgggagtattccaagaaaatgtatttcacacaatgtggcacgtaacgagaggagccgtattgatgtatcaaggcaaacgactagaaccctcttgggccagtgtgaagaaagatctaatatcttacggaggaggttggaggctacagggttcatggaatactggagaagaggtgcaagtcatagcagtcgaacctggcaaaaatcccaaaaacgttcagactgcaccaggaactttcaagacacctgagggtgaggtgggagccatagcacttgattttaagccgggaacatccggatctcctattgttaatagagaaggaaaaattgtaggtctctacggtaatggcgtggtaaccacaagtggaacatatgtaagtgcaattgcacaagctaaagcaagtcaagaaggaccgctaccagaaatagaagacgaagtcttccgaaaacgtaatctcacaataatggatttacatcctggtagtgggaaaacaaggcgataccttccggcaatagtaagagaagctataaaacgaaagatgagaacacttattctggcacccacgagagttgttgcctcagaaatggctgaggcactaaagggaatgccaatacgttatcaaacaactgccgttaaatcagaacatactggcaaagaaatagttgaccttatgtgtcacgccacattcacgatgagactattatcacctgtgcgcgtgccaaactataacatgattattatggacgaagctcatttcacggatccctcatcaatagcagcacggggctacatttctacacgagtgggtatgggcgaggcagctgctatttttatgacagccacacccccgggtagcgttgaggcttttcctcaatcaaatgcggtaattcaagacgaagagagggacatcccggagcgaagttggaactcaggatatgaatggatcactgactttcctggaaagacagtttggtttgtgccgagtattaaagcgggtaatgatatagcaaattgcttgcgcaaaaatgggaaaagggtcatacaactatctagaaaaactttcgatacagaataccaaaagacaaagaataatgattgggactatgttgtaactaccgacatctctgaaatgggcgctaatttcagagccgacagggttatagatccgcggagatgcttgaagccagtaatattaaaagatggcccggaacgggttattctggcaggtccaatgccagtcacagtagcttcggctgcacaacgaagggggaggataggaagaaatcacaacaaagaaggggatcaatacatatatatggggcaaccccttaataatgatgaagaccatgcacactggacagaagcaaaaatgttgcttgacaacatcaacacaccagaagggattattcctgccctttttgaacctgaacgggaaaaatcggcagctattgatggtgaatacaggctacgtggtgaggcacggaagaccttcgtcgaactaatgcgacgcggcgatcttccagtctggctctcttataaagttgcatcagaaggatttcaatattccgatcgtagatggtgtttcgatggagagcggaataatcaagtgctggaagagaatatggatgtagaaatctggacaaaagaaggtgagcgaaagaaactacggccacgttggttagatgcccggacatattcagatcctctggcactcagagaatttaaggaatttgccgcaggaaggcgatcagtatctggagatttaatcttagaaataggaaaactcccccaacatcttacccaacgtgcacaaaacgcattagataatcttgtaatgctacataactcggaacagggtggaagggcttacaggcatgccatggaggaactacctgacactattgagacactgatgcttttagcattaatagctgtgctcactggaggggtaacattatttttcttatcgggaaaaggacttggtaagacctccatcggattactttgtgtaatggctagttctgccctactttggatggctagtgtcgagccacattggatagctgcgtccattattctagagttctttctgatggtattattgataccagaaccagacagacaacgtactccgcaagacaaccagctagcctatgtagtaataggcttgctattcatgatactgacggtcgcagcgaatgaaatgggtctattagaaacaacgaagaaagacttaggaatagggcatgtcgcagtcgaaaaccatcatcacgctgcaatgctagatgtagacctccaccccgctagtgcatggactctttacgctgtagcgaccacgataatcactcccatgatgaggcatacaatcgaaaacacaacagcaaatatatcgttaacagcgatagctaaccaagctgccattttaatgggccttgacaagggttggcctatatctaagatggatataggggtcccactattagctttgggatgttatagccaagtaaacccattaacactgactgcggcagtactaatgcttgtggctcactatgcgattataggaccgggattgcaagcaaaagcaactcgcgaagcacagaaaagaacagcggctggaataatgaaaaatcccacaattgatggcatagtcgcaatcgacctagaccccgtagtctacgatgcgaagtttgaaaaacaactcggacaaataatgctactaatattgtgtacatcccaaatattacttatgcggacaacatgggcactttgtgagagcatcactctagcaactggacccctaacaaccttatgggaaggatctcctggaaaattctggaacactaccatagcagtatctatggcaaatatttttcggggatcgtatctggctggagcaggactagcgttctcactaatgaaaagtctgggaggaggcaggcggggaaccggagctcaaggagagactttaggagaaaaatggaagcgccaattaaatcaactaagtaaaagtgagtttaacacgtacaagcgcagtggaataatggaagttgatcgtagtgaagccaaggaaggtctaaaaagaggcgaaaccacgaaacatgcagtcagtcgtggaacggcaaaactaaggtggtttgtagagagaaatctggtcaagccagaaggaaaagtaatagatctcggctgtggtagaggaggatggagctattactgtgcaggtttgaagaaagtaacagaggtcaaaggctatacaaaagggggccctggacacgaggaacctatcccaatggctacatatggttggaacctagtcaaactacattcgggtaaagatgtattctttattccacctgaaaagtgcgacactcttttatgtgatataggcgagtcatccccgaacccaactattgaagagggtagaactttaagagtgttgaagatggtggaaccatggttacgaggaaatcaattttgtataaaaattcttaatccatacatgccatcagtagtagaaacattggaacagatgcaacggaaacatggtggaatgttagtgaggaatccacttagcagaaatagtacccatgaaatgtactgggtgagttgcggaacgggaaacattgttagtgcagttaatatgacctctcgtatgttactgaaccgattcacaatggcccacaggaaaccaacatatgaacgcgacgtggacctaggagccggaacgagacatgtagctgtagagccagaagtcgccaacttagatataatagggcaacggatagaaaacattaagcatgaacacaagtccacatggcattatgatgaggacaatccttataagacatgggcttatcacggtagctatgaagtaaaaccttctggctctgcatcatctatggttaatggtgtcgtcaaattattgaccaagccatgggatgtaatacctatggtaacacagatagccatgaccgatactacaccgtttggacaacaacgcgtctttaaagagaaggtagataccagaacaccgaaagccaagcgtggaacggcacaaataatggaggtgactgctaggtggttatggagtttccttagccgtaacaagaaaccaagaatttgtacgcgggaagaatttacgagaaaggtaaggtcaaatgccgccataggcgcagtcttcgttgatgagaaccaatggaactccgcgaaagaagcagtagaagatgatagattttgggacctagttcacagagaacgagagttacacaaacagggaaaatgcgcaacttgtgtttacaatatgatgggaaaaagagagaagaaactaggagaatttggcaaagcgaaaggtagccgagccatctggtatatgtggcttggagcaagattcctcgaatttgaagcactgggttttatgaacgaagatcactggttctcaagagaaaattcgttaagtggtgtcgaaggagagggacttcataaattagggtacattctccgggacataagtaagatacctggaggaaatatgtatgcagacgacactgctggatgggatacaaggataactgaagatgatttacaaaatgaagcaaaaataaccgatataatggaacctgaacatgcgttactagcaaaatccatatttaagttgacctatcagaataaagtagtgcgcgtccaacgtccagccaaaaatggtacggttatggatgtcataagtagaagagaccagagaggatcgggccaagtaggtacatacgggttgaatacctttaccaacatggaggcgcaattaattagacaaatggaatcggaagaaatattttctccgaatgaactagaaacccccaatttggcggaacgcgttttagactggttagaaaagtatggtgtcgaacgattaaaaagaatggctatttcaggcgacgattgtgtagtaaaaccaatcgatgataggttcgcgacagcattaacggcactaaacgatatgggaaaggtaagaaaggatatcccacaatgggaaccaagcaaaggctggaatgactggcaacaagtgccgttctgtagtcatcattttcatcagttaataatgaaagatggaagagaaatcgtcgtcccttgtcgcaatcaagatgaattggttggcagagcaagagtaagtcagggcgcaggatggagtctacgagaaacggcgtgtcttggtaaaagctatgcgcaaatgtggcaactcatgtatttccatagaagagacttacgattggcagccaacgccatttgtagtgccgttcctgtagattgggttcctacctcacgtacaacctggagtattcatgcgcaccaccaatggatgactactgaggatatgttgagtgtttggaacagggtatggatagaagaaaatccatggatggaggacaaaacgagagtaagttcatgggaagacgtgccttatctcggcaaacgagaggatcaatggtgcggtagcttaataggtttgacggctagagcaacatgggcaacaaatattcaagtcgctatcaatcaagtacggcgtttgatcggaaacgagaattatagtgactacatgacgagtatgaaaagattcaagaatgagtcggaacccgagggcgcactatggtaa

SEQ ID NO: 22019 - RNA, 9879 nt, synthetic construct
  misc_feature 1..9879: note = derived and/or modified CDS sequence (opt6) from DENV-1__HQ891315__SS-prME
  source 1..9879: mol_type = other RNA
tcagtaactatgttactaatgcttatgccgacggcgttagcatttcacctaaccacgcgcggtggagaaccacacatgatagtgtcgaaacaggaaaggggaaagagcttattgttcaaaacatcagccggagtaaacatgtgtacgttgatcgcaatggatctcggagaactgtgcgaagatacaatgacatacaaatgtccccgaattaccgaagcagaaccagatgacgtagattgctggtgtaacgcaaccgacacttgggtaacatacggtacttgcagccaaacaggggaacatcgaagagacaaaagatctgtcgcgcttgcaccgcacgtaggattgggtttggaaacaagaactgaaacatggatgagtagtgaaggcgcttggaaacaaatccaaagagttgaaacttgggctctcagacatcccggatttactgtaatagcgttgtttcttgctcacgcgatcggaaccagtataactcaaaaaggaataatctttattctcttaatgctagtgactccatctatggctatgcgatgtgtcggtatcgggtctcgtgattttgttgaaggtttatctggagccacttgggtggatgtcgtccttgaacatgggtcatgtgtgacaactatggcaaaagataaaccaacacttgacatagaattactgaaaactgaagtcactaacccagctgtactgcgaaaattatgcatagaagctaagatatcaaatacgacaacggattcaagatgtccaacacaaggcgaagcaacattggtagaagaacaagatgccaattttgtatgtcgacgaacgtttgtagataggggatggggaaatggttgcgggctattcggaaaaggttcacttttaacatgtgctaaatttaagtgcgtcacgaaattagaaggaaaaattgtgcagtacgaaaatctaaagtattccgtaatcgtgacagtacacacgggtgaccaacatcaggtaggtaatgaatcgaccgagcatggaaccacagcgacaattacacctcaagcccctaccactgaaattcagttaaccgattatggggccttaactttagactgctcacccaggacaggtttagattttaatgaaatggtgttacttaccatgaaagagaaaagttggttggtacataaacaatggttcttagatttaccactaccatggacctcaggggctagcacatctcaggagacatggaacagacaggacttgttagtaacattcaaaactgcacacgccaagaaacaagaagtagtggtattaggatcacaggagggagcaatgcatacagcactaactggagcaacagagatccagacatcaggtaccaccacgatcttcgcgggacatcttaaatgcaggctcaaaatggataagttaacactaaaaggaatgagctacgttatgtgcacaggttcctttaagctggagaaggaagttgcagagacgcaacacggaacggtcttagtacaaattaaatacgaaggtacagatgcgccgtgtaaaattccattctctactcaagatgagaaaggggtaacgcaaaatggtcgactgataacagcgaaccccattgttacagataaggaaaaaccagttaatatagaagcggaaccgccatttggagagtcatacatagtaattggtgccggtgagaaggccctaaaactatcttggttcaaaaagggtagttcaataggaaaaatgttcgaggcaaccgctcgtggagccagacgcatggccattctgggtgacaccgcgtgggacttcggaagcataggaggggtcttcacaagtgtgggtaaattagtacaccaaatatttggcacagcctacggagttctgttctcgggcgttagctggacaatgaaaataggaatcggagtattacttacatggctaggtctaaactcacgcagcacaagcctatcaatgacatgcatcgctgtcggtctagtaacactatatcttggagtgatggttcaagccgacagtggctgcgtcattaattggaaagggcgtgagctaaaatgtgggtcagggatttttgtgacaaatgaagtacatacctggactgaacaatacaaatttcaagcggattcccctaaaagactatcagctgctataggtaaggcatgggaagaaggggtctgcggaataaggtcggccacccgcttagaaaatataatgtggaaacaaataagtaacgaattaaatcatattttgctcgaaaatgatatgaaatttactgtcgttgttggagatgtagcggggatcctggcacaaggcaagaaaatgataagaccgcaaccgatggagcataaatattcatggaaaaattggggcaaagccaaaattattggagcagacgtgcaaaactcaacattcattattgatggtccaaacactccagaatgtagtgatgatcagcgcgcctggaatatttgggaagtagaagattatgggtttggtatcttcacaactaatatctggcttaaacttcgagattcgtatacacaagtctgtgaccacagactaatgagtgctgcaattaaggatagtaaggcagtacacgcagatatgggttactggattgaatccgagaaaaatgagacatggaagttagctagagctagtttcattgaggtcaaaacatgtatctggccaaaaagccatactctatggtcgaatggtgttcttgaaagtgaaatgataataccaaagatttatggtggaccaataagtcagcacaactatcgaccagggtattttactcaaactgcgggcccttggcatttgggaaaactcgaactagattttgacctctgtgagggcacaacagtagtagtggatgaacattgcggaaacagagggccatcattacgaacgacaacagtaactgggaagataatacatgaatggtgctgcagatcctgcaccctgccaccgttacggtttagaggggaagatggctgttggtacgggatggaaattcgacctgtcaaagaaaaagaagaaaatcttgtgaaatctatagtgtccgctggtagcggtgaggtagattcattttcactaggactcctttgcatttcgattatgatagaagaagtgatgcgctcgagatggagtcgtaaaatgttgatgacagggactctagcagtattctttctactcatcatgggtcaattaacttggaatgatcttataagattatgtataatggtcggagcaaatgcctcagacagaatgggtatgggtacaacatatctggccctgatggcaacattcaaaatgagaccgatgtttgctgttggattactttttcggcgactcacttcaagagaggtattacttctcactataggactttcattggttgcctctgtagaactaccaaattcacttgaagagttaggtgatggtctggcgatgggaataatgatactaaaattgttaacagactttcaaagtcaccagctttgggcaacccttttatcgatgaccttcataaaaactacattctctttacactacgcatggaaaactatggcaatggtactaagcatagtgagtctgtttccattatgtctaagcacaaccagtcaaaagactacctggctacccgttttgcttggaagtctaggttgtaaacctctaaccatgtttttaattgctgaaaataaaatctggggtcgaaagagttggcccctaaatgaaggaatcatggctgtagggatagtttctatcttactaagttcactgctcaaaaatgatgttccactagcaggcccactgatcgcaggaggtatgctcattgcctgctatgtgatttcggggtctagcgcagatcttagtttagagaaagcggctgaagtgtcatgggaagaagaagcagagcatagtggggcatcacataatatccttgtcgaagtacaagatgacgggaccatgaagattaaagatgaagagagagacgacacattgacaatattgttaaaagcaactctgttagcagtaagtggagtttacccactttccatacccgcgaccttattcgtatggtacttttggcagaagaagaaacagcgcagcggagtactctgggatacaccaagtccgccaaaagttgaacgagcagtattggatgatggaatataccgaataatgcagcgaggtttattagggcgttctcaagtgggagtaggagtcttccaagaaaatgtatttcacaccatgtggcatgtcacaagaggtgctgtattaatgtatcaaggcaaacgacttgaaccgtcatgggcttccgttaagaaagatctcatcagctatggtggcggttggagattacagggttcatggaatacaggtgaagaagttcaggtaatcgctgtagaaccgggcaaaaatcctaaaaacgtacaaaccgcccctggaacatttaaaacacccgaaggcgaagttggcgccatagcattagacttcaaacctggcacctcgggtagtccaattgtgaacagggaaggtaaaattgtaggattatacggaaatggggtggttacaaccagcggtacatatgtaagtgcaatagcgcaagccaaagccagccaagaggggcctctaccagaaatagaagacgaggtcttcagaaaaagaaaccttactataatggatttacatccaggtagcggtaaaacacggaggtacctgccagcaattgtacgagaagcaataaaacgaaagatgagaaccctaattttggcaccaacacgggtagtagcatcggaaatggcggaagcattaaaaggtatgccaatacgctaccagacgacggcagtcaagtcagagcataccggtaaagaaatagtagatttaatgtgtcacgcaacattcaccatgcgcttattgtccccagtcagggtgcccaattataacatgattattatggatgaagcccattttacagacccaagttcaatagccgcaagaggatatatttccacaagagtcggcatgggagaggcggccgcgatatttatgacagctactccaccgggaagcgttgaagcctttccacaaagtaatgccgtaatacaagacgaggaacgcgacattccggaacgttcctggaactcaggatatgaatggataacagatttcccgggaaaaactgtctggttcgttccgagcattaaggcgggtaatgatatcgcgaactgcttacgtaaaaacggtaaaagagtaattcaattgtctcggaaaacattcgatacagaataccaaaagaccaaaaacaatgattgggattatgtcgttacaacggacatatccgaaatgggagctaactttcgtgcggatagagtaatagacccacggaggtgtctaaaaccggtgattttaaaagacggtcccgagagagtaattttagcaggaccaatgcctgtaactgtagccagtgcagcgcagcggagaggaagaatcgggcgaaaccacaataaagagggtgaccagtacatctacatgggtcagcctttaaataacgacgaggaccatgcacactggacagaagctaaaatgctactcgacaatatcaataccccagaagggataattccagcgttattcgagccagaaagagaaaaatcagcagcaatagatggcgaatatcggttacgtggggaagctcgaaaaacctttgtagaactaatgagaaggggcgatctaccagtttggctatcctacaaagtagcttcagaaggtttccagtattctgataggaggtggtgttttgatggagaacgcaacaaccaagtactggaagaaaatatggacgttgaaatatggactaaagagggggagcgcaagaaacttcgcccccgatggctcgatgcccgaacgtactcagatccattagccctaagagaatttaaagaatttgcggcgggcagacggagtgtttcgggggatcttatcttagaaattggcaagctaccgcaacatcttacacaaagagctcagaacgcattagataatttagttatgttacataatagcgaacaaggcggacgagcttataggcatgctatggaggagctaccagacactatagaaaccctaatgctccttgccctaattgcagtattaacaggtggggtaacactatttttcctcagtgggaagggtctaggcaaaacaagtattgggttactatgtgttatggcctcaagtgccctcctttggatggcatcagtcgaaccacattggatcgccgccagtataatccttgagttctttttaatggttcttttaataccagaaccagatagacaaagaacaccacaagataatcagcttgcatatgtggttattggcctcctttttatgatattaacagtagctgcaaacgaaatggggttattagaaacaactaagaaagatttaggaattggacatgttgctgtggagaatcatcaccacgctgccatgttagacgttgatctccatccggcctcagcatggacattatatgctgtagcgactacaataataacgccgatgatgagacacactatagaaaatacaaccgccaatatttcgttaactgcaatcgccaaccaagccgcaatattaatgggtctggataaaggttggccaatctcgaagatggatataggggtacccctgctagcgcttggatgctacagtcaagtgaatcctcttacacttaccgcagcagttttgatgttagtcgcccactatgctataatcggtcctggtttacaagcaaaagcaacccgggaagcccaaaagaggacagctgcagggattatgaagaacccaactattgatggaatagttgctatagacttagacccagtagtttatgatgctaaattcgagaaacaattaggccaaataatgctacttattttgtgtaccagccagatccttttaatgagaacaacgtgggccctatgtgaatcaataacattagcaacaggccccctcaccacgttatgggagggatctccgggtaaattttggaacaccacaattgctgtttcgatggcaaatatattcaggggcagttatttagccggcgcgggattagctttctcactcatgaagtctttgggaggagggaggagaggtactggtgctcaaggagagacattaggagaaaaatggaaacgtcaactaaatcagttatcaaaatcggaatttaatacttacaaaagatcggggattatggaagtagacagatcagaagcaaaagaggggctaaaaagaggtgaaacgactaaacacgccgttagcagaggaacagcaaagttaaggtggtttgtagaaagaaacctagtcaaacctgaaggaaaggtaatagaccttggatgcggaagaggaggttggtcatattactgtgcaggactcaagaaagtaacagaagtaaaaggatatacaaaaggaggcccgggccacgaggaaccgatccccatggcaacatatggttggaaccttgtaaaactacacagtggaaaagacgtatttttcatcccacctgaaaagtgcgatacactcctatgtgatatcggtgaatctagtcctaacccaactatagaagaaggacggacgctccgagtgttaaaaatggtagaaccttggctaagaggcaaccaattttgtattaaaattctaaacccatacatgccaagtgttgtggaaacactagaacaaatgcagcgcaaacacgggggaatgctagttagaaatcccctgtctaggaactccactcacgagatgtattgggtttcttgcggtacaggcaatatagtgtctgcagttaatatgacctcccgtatgttgttaaaccgatttacaatggcacaccgtaaacctacatacgaaagagacgtagacttgggagctggtacgcgacacgttgcagtagaaccagaagtagctaatcttgatataataggacaaagaatagaaaacataaaacatgaacataaaagtacttggcattatgacgaagacaacccttataaaacttgggcttatcacggtagttatgaagttaaacctagcggaagcgctagctccatggtgaatggcgtggtaaaattattaacgaagccttgggacgtgattccaatggtaactcaaattgcaatgactgatacaaccccttttggtcagcaaagagtattcaaagaaaaggtcgacacaagaactccaaaggctaaacgtggaaccgcccagatcatggaggtaacagcgcgatggttatggtcattcctttcccggaataagaaaccgagaatatgtacgcgagaagagttcacaagaaaggtaaggtcaaatgcagcaatcggagcagtttttgttgatgaaaatcaatggaactctgcaaaggaagcagtggaagacgatagattctgggacttagtgcatcgagaacgggaactacacaagcaagggaagtgtgcaacatgcgtatataacatgatgggcaaaagggaaaagaaattgggagagtttggtaaagccaagggttctagagccatatggtatatgtggctgggtgctcgctttctagagttcgaggctttgggtttcatgaatgaagatcactggttttccagagaaaattcgttatcaggtgtagaaggagaaggattgcataaacttggatacatactgagagacatatcaaaaatacctgggggtaacatgtacgcagatgacacggctggatgggacactcgaattactgaagacgatctccaaaacgaggcaaagatcaccgacataatggaaccagaacatgccttacttgctaaaagtatattcaaacttacatatcagaacaaagtggtacgggtacaacgaccggcgaagaatggaacggtaatggatgtcatttctagacgtgatcagaggggttctggacaagtcggaacgtacggactaaacacatttacgaatatggaagcacaacttatacgacagatggaatcagaagagatattctcacccaacgagcttgagactccaaacctggccgaaagagttctagactggttagaaaagtacggtgtagaaagactcaaacgtatggccatttctggagatgattgcgtagtaaaacccattgatgatcgatttgcaactgcattaactgccctaaacgacatggggaaggttaggaaagatattccacaatgggaaccgtcaaaaggctggaatgattggcagcaagttcctttctgttctcaccacttccaccaactaatcatgaaggatggacgggagatagtcgtaccatgtagaaatcaggacgagctagttggcagagcacgtgtttctcaaggggcaggatggagcttaagagaaacagcctgcttaggaaaatcttatgcacagatgtggcagttaatgtattttcatcgacgagatttacgcctcgccgcaaacgccatttgctctgcagtaccagttgactgggttcctacatcaagaaccacctggagtatacacgctcaccaccaatggatgacaacggaagacatgttgtcggtatggaaccgagtttggatcgaagaaaacccttggatggaagacaaaacaagggtaagttcatgggaagatgtcccgtatttaggaaagagagaggaccaatggtgtggtagcctaataggattaacagccagagcaacttgggcaacaaatattcaagtggcgataaaccaagttcgtagattgataggtaatgaaaactactccgattacatgacttccatgaagcgttttaaaaacgaatccgaacctgagggcgcattatggtaa

SEQ ID NO: 22020 - RNA, 9879 nt, synthetic construct
  misc_feature 1..9879: note = derived and/or modified CDS sequence (opt6) from DENV-1__HQ891316__SS-prME
  source 1..9879: mol_type = other RNA
agtgtcacgatgctacttatgctaatgccgacggctctggcttttcaccttactactagaggaggggaacctcacatgatagtttcaaaacaagaacgagggaaatcattactgtttaaaacaagcgctggggttaatatgtgcactttaatagcaatggacctaggagaattatgtgaagatacaatgacatataaatgtcctcggataacagaagcagaacccgatgatgttgattgttggtgtaatgcaacagatacgtgggtcacttacggaacttgctcgcaaacaggagagcatagaagagataaaagatccgtggcactagcaccgcatgtagggctaggtttagaaacgagaacagagacatggatgagtagtgagggagcgtggaaacaaattcaacgagtagaaacatgggctttacgacaccctggatttacagtaatagccctatttctagcacacgctataggaacatcaataacacagaaaggaataatcttcatactattgatgttagtcactccctcaatggccatgagatgtgtgggcatcggatctcgtgatttcgtggaaggactatcaggtgccacttgggtagatgtagtgttagaacatggctcatgtgtgacgactatggctaaagataaaccgaccttagatattgaattacttaaaacagaagttacaaatccggcagttttaagaaaactgtgcattgaggccaaaatttctaacacaacaaccgatagtagatgccctacgcaaggagaagccactttggttgaggaacaagatgcaaatttcgtatgtcgacgtacatttgtggatcgtggctggggtaatggctgcggtttatttgggaaaggctctttattaacatgtgctaaatttaaatgtgtcacaaaactagaaggaaaaatagttcaatacgaaaatctaaaatatagcgttatcgtgacagtgcatactggagaccaacatcaagttggaaacgagtcaacagaacatggtactacagctacaattacgccacaagctccaaccacagaaattcagctgacggattacggtgcactaacgctagattgctcgccaagaacaggcctagattttaacgaaatggtattattaacgatgaaagagaaatcctggttagtccacaaacaatggttccttgacctcccattaccttggacctcgggtgcctcaactagccaagaaacgtggaaccgtcaagatttattggtgacgtttaaaacagcacatgcaaagaaacaagaagtagtagtattaggatcgcaggaaggggctatgcatacagcactcactggtgccactgagattcaaacatcaggaaccacgaccatttttgccggacatttaaaatgtaggctgaaaatggacaaattaacattaaaaggcatgagttacgtaatgtgcacggggagctttaaattggaaaaagaagttgcagaaacacagcatgggactgtcttagtgcagattaaatatgaaggaactgacgcgccgtgcaagataccatttagcacacaagacgagaaaggagttacacagaatggcagacttattacagcgaaccctatcgttacggataaggaaaagcccgttaacatagaagctgaaccaccattcggagaatcatacatagttataggcgccggtgaaaaagcattaaaactgagctggttcaagaaaggaagcagcataggaaaaatgtttgaagcaacggcaagaggcgcacgtagaatggcaatacttggagatacagcttgggattttggttccataggaggagtatttacaagtgtaggtaaacttgtgcaccaaatctttggaactgcttacggagttctattttcaggagtatcatggacaatgaaaatcgggataggagtgctattaacgtggttaggactaaattcaaggtctacgagtttaagtatgacatgcattgcagtgggattagtcactctgtatttaggtgtaatggtacaagcagacagcggttgcgtcataaattggaaaggtcgagaactaaagtgtggatcgggaatcttcgtcactaacgaggtgcatacatggacagaacaatataaatttcaggctgactcacccaaaagactttcagcggcaatcggtaaggcttgggaagagggagtttgcggcattcggtccgccacaaggctcgagaatattatgtggaaacaaataagtaacgaattaaaccatatcctcttagagaatgacatgaagtttacagtagttgtaggagatgttgccggcatcttagcccaggggaagaaaatgataagaccccaaccaatggagcataagtactcttggaagaattggggcaaagcaaagatcataggggcagacgtacagaactccacatttataattgacggtcctaacaccccagaatgtagcgacgaccaaagagcatggaatatatgggaagtcgaagattatggattcggtatattcaccacaaatatatggttaaagttgagagattcatatactcaggtctgcgaccatagactaatgtctgcagcaataaaggattccaaagcagttcatgcagacatgggatactggatcgaaagtgagaaaaatgaaacgtggaaacttgcacgcgcttcatttatcgaagttaaaacatgtatatggcctaaaagccatacactatggtcgaacggtgtattagaaagcgagatgataattccgaaaatttatggaggcccgatctcccaacataattatcggccggggtactttacacaaacagcaggaccgtggcatctgggaaagctggagttggatttcgacctatgtgagggaactactgtcgttgtagacgaacattgcggaaacaggggaccttcactaagaactacaacggtaactggcaagatcatccatgaatggtgttgccggtcttgtaccttgccaccactacgatttagaggagaggatggttgttggtacggcatggaaataaggcctgtaaaagaaaaggaagagaatttagtgaagtcaatggtatcggcgggatctggggaagttgatagtttctcactgggcctactctgcatttcgatcatgatagaggaagtgatgagatcacgatggagcaggaaaatgctgatgacaggaactttagcagtatttttcttacttattatggggcaactcacatggaacgatttaataagactttgtataatggtcggggctaatgcatcagacagaatgggcatgggcacgacttatcttgcattaatggctactttcaaaatgaggccgatgtttgcagtgggactactgtttagaagacttacgtcgagagaagtactacttctaacaataggactatcattggtagcttccgtagagctccctaacagcctagaagagttaggagacggcttagccatgggtatcatgatattaaaattgctgacagactttcagagccatcaactatgggcaacattacttagtatgacttttattaaaacaacatttagtctacactatgcttggaagacaatggcaatggtacttagtatagtatctttattcccactgtgcttgagcactacttcacagaaaaccacgtggttacctgtgttgttaggaagcctgggctgtaaacccctaactatgtttcttattgctgaaaataagatttgggggagaaaatcttggccgttgaacgaaggaatcatggctgtaggtatagtgagtatcttgctgtcatcactcctcaaaaatgatgtccctctggctggaccattaatagcagggggaatgttgattgcgtgctacgttatttcaggaagttctgcagatttatccctcgaaaaagcagcggaagtatcttgggaggaagaagcggaacatagtggcgcttcacataacatcctagtagaagtacaggacgatggaacaatgaaaataaaagacgaggaaagagatgatacacttactatattattaaaagccactttactagctgtatcgggagtatacccactatcgataccagcaacattattcgtctggtatttttggcaaaagaaaaagcaaagatcaggagtactttgggacacaccatccccgccaaaagtagagagagccgtactcgatgacggaatatataggataatgcaaagaggacttctcggaagatcgcaagtaggcgttggtgtatttcaagagaatgtatttcacactatgtggcatgtaaccagaggagcggtgctaatgtatcaaggtaagagattagaaccatcatgggcatctgtaaagaaagatctaattagttatggaggaggttggaggctacaaggcagctggaacacaggagaggaagtccaggtgatagcagtagagccggggaaaaatccaaagaacgtacagacagctcctggaacattcaaaactcctgagggggaagtaggagctattgcattggatttcaagccaggaacttccggttcaccaattgtcaatagagaaggaaaaatagtaggtttatacgggaacggagtcgttacgacttcaggaacctacgtgtctgcgatagcccaagcaaaggcttcccaagaggggcctctcccggaaatcgaagacgaggtattcagaaagagaaatctaacgataatggatctacatccgggtagcggcaaaacaaggcgatacttacccgccatcgttcgtgaagcgataaaacggaaaatgcggacattaatactcgccccgactcgagtagtggcatctgaaatggcagaagccttaaaaggtatgccaataaggtatcaaaccacagcggtaaaaagtgaacacaccggcaaagaaatagtagacttgatgtgtcatgccacatttacaatgcgactactgagtccagtaagagtgccaaactataatatgattataatggatgaagcacatttcacagatccgagtagtatagctgcccggggatatataagtactagagtcgggatgggagaagctgcagcaatctttatgacagccacacctccaggatctgtggaagcatttccgcaatcaaatgctgtaattcaagatgaagagagagacatacctgaacgatcgtggaactccggttacgaatggataacagattttcctggcaaaacggtatggttcgtacctagtataaaggccggcaatgatattgcgaattgtttgcggaaaaatggcaaaagagtaattcaattaagtcgaaaaacctttgataccgagtatcagaaaaccaaaaataatgactgggactacgtagttacaacggacattagtgaaatgggtgcaaattttcgtgccgacagagtaatagatcctaggcgatgtcttaaaccggtaatcttgaaagatgggccagaacgtgttattctggcaggaccaatgcctgttacagtagccagtgctgctcaaagacgtgggcgtattggtcgaaaccataataaagaaggcgaccaatatatatatatgggtcaacctttaaataatgacgaggaccacgcacactggaccgaggcaaaaatgttacttgacaatataaatacacctgaaggaataataccagcactttttgagccagaacgggaaaagagtgctgcgatagatggagagtatagactcagaggggaggctagaaaaaccttcgtagaacttatgcgacgcggggatttacctgtatggctttcctataaggtagcaagcgagggtttccagtactcagatagaaggtggtgctttgatggagagagaaacaatcaagttcttgaagaaaacatggatgtggaaatctggaccaaagaaggtgagaggaagaaactaagacccagatggcttgatgcacgcacttattctgatccattggcattacgggaatttaaagaatttgccgccggaagacgaagtgttagtggagacctaatattggaaataggcaaactacctcaacatctcacacaacgggctcaaaacgctctggataatttagtgatgttgcataactctgagcaaggtggacgggcatatcgccacgcaatggaagaacttcctgatacaattgagacattaatgttattggccctcattgcagtactaacaggcggagtgactctgtttttcttatcaggaaaaggcttaggaaagacatccataggtttactctgcgttatggcttctagcgcattactttggatggcaagtgtagaaccacattggatagcagcgagtataatattagaatttttcctaatggtactgttgatccctgaacccgatagacagagaacacctcaggacaatcagctcgcctacgttgttatcggattactatttatgatattaacggttgcagccaatgagatggggcttctggaaacaactaagaaagaccttggaatcgggcacgtcgccgtcgaaaatcaccatcacgcagcaatgctagatgtggatctgcacccggcatctgcgtggaccttatatgctgtggcgacaactataatcacacccatgatgagacatacaatagaaaatacgacagctaatatctctctgaccgcaattgcaaaccaagcggcgatattaatgggcttggataagggttggccaataagtaaaatggacataggtgttccactactagcactaggctgttattcgcaagtgaatcccctcactttaacagcggccgtactgatgttagtagcgcattacgctatcatcggtcctgggttacaagccaaagctacaagagaagcacagaaaaggactgcagcaggaataatgaagaatccaacgatcgatggaattgtcgcaattgatttagaccccgtagtctatgatgcaaaattcgagaaacagctcggacagataatgcttttgatattatgtacatcacagatcttgttaatgcgaactacatgggcgttatgcgagagtataactcttgcgaccggacctttaactacactatgggagggaagtccaggaaaattttggaacacaacaattgccgtaagtatggctaacatatttagaggaagttacctggcaggggccggtctagctttttcccttatgaaaagtctcgggggcggacgtaggggaactggagctcaaggcgaaacattgggggaaaaatggaaacgacaactaaatcaactaagcaagagcgagttcaatacctataaacgctccggcattatggaagttgatagatcagaagctaaagaaggtttgaaaagaggcgagacgacaaaacatgccgtgagcagagggacggcgaaactaagatggtttgtcgaaaggaatttagtaaaacctgaaggtaaagttatagacttgggatgcggacgtggcgggtggagctactattgtgctggcttgaagaaggtcactgaggtaaagggttatacaaaaggtggaccaggccatgaagaaccgataccaatggcaacttacggatggaatctagttaaattacactcagggaaagatgtattctttattccacccgaaaagtgtgacactcttttatgtgatataggtgaatcatccccgaatcccaccattgaagagggaagaacactaagagtcctaaagatggttgaaccttggctacgaggcaatcagttttgtattaaaatcttaaacccttatatgcccagcgtagtagaaacacttgaacaaatgcagagaaaacacggtggtatgctcgtccgaaaccccttatctcgcaattcgacgcacgaaatgtactgggtgagctgtggtacgggtaacattgtatcagcggtgaacatgacatcacgcatgttactaaaccgattcactatggcacatcgtaaaccgacttatgagagagatgtagaccttggcgcaggtacacgacatgtagccgtagaacccgaagtggccaatttagatataattggtcaaagaattgaaaatataaaacatgagcataagtcaacttggcactacgacgaggataatccatataagacgtgggcatatcacgggtcctatgaagtaaagccgtccgggagtgctagctccatggtcaatggcgtggttaaactactgacgaagccgtgggatgtgattcctatggtgactcaaatagcgatgacagacacgacgccttttggacaacaaagagtatttaaggaaaaagtcgatacccgaaccccaaaagcaaaacgtggtactgcacaaatcatggaagtcacagcaaggtggttatggtcattcttatcacgaaacaagaaaccaagaatatgtacaagagaagagttcacccgcaaagtgagaagtaatgctgcgataggagccgtattcgtagatgaaaatcagtggaactccgcaaaagaggcagttgaagacgatcgtttttgggacctagtacatcgcgaaagagaactacacaaacaaggaaagtgtgcaacttgtgtatataacatgatgggaaaaagagagaagaaacttggggaatttggcaaggcaaagggctcacgtgcgatatggtacatgtggttaggtgcaaggttcttggagttcgaagcgttaggctttatgaatgaagaccattggttctcaagagaaaattcgctaagtggagtggagggagagggcttacataaactaggttatatactaagggacataagcaaaatacccggaggtaacatgtatgccgatgatacagccggatgggacacgagaataaccgaggatgacttacagaacgaggcaaaaattacggatataatggaaccggaacatgccttattagctaaatctattttcaaattgacatatcaaaataaagtagtccgtgtacagcgtcccgcgaaaaatggtacagttatggatgttattagcagacgtgaccaacgaggctctgggcaggttgggacatatggactcaacacattcacaaacatggaagctcagcttatacgacagatggaaagtgaagagatatttagcccaaatgaattagaaacacctaatcttgctgaacgggtacttgactggctggagaaatatggtgttgagcgcttaaaaagaatggctatcagcggagatgactgcgtagttaaacctatagacgatcgttttgcaacagctctaactgccttgaacgatatgggaaaggtaaggaaagacatcccgcaatgggaaccatccaagggctggaacgattggcaacaagttcccttctgcagccatcattttcaccaattgataatgaaggatggaagggaaatagtagttccgtgtagaaaccaggacgaattagttggacgagcacgagtgagtcaaggtgccggatggtctttaagagaaacggcatgtttaggtaagagctatgctcaaatgtggcaactcatgtatttccatcggcgcgacctacgattagcggcaaatgcaatatgtagtgccgtaccagttgactgggtgcctacgagtagaactacatggagtatccatgcacatcatcagtggatgacaactgaggacatgctgtcggtttggaaccgtgtttggatcgaggaaaatccctggatggaagataaaacacgagtctctagttgggaagacgtgccatacttaggaaagagagaagatcaatggtgcggtagtctcataggtttaacagctcgtgctacatgggcaacaaatatacaagtagcgattaatcaggtaagacgactcataggaaatgagaattatagcgattatatgacaagtatgaaacgatttaaaaatgaatcagagccagaaggcgcactatggtaa

SEQ ID NO: 22021 - RNA, 9879 nt, synthetic construct
  misc_feature 1..9879: note = derived and/or modified CDS sequence (opt6) from DENV-1__JN054256__SS-prME
  source 1..9879: mol_type = other RNA
agcgtaacaatgctcttaatgcttatgcctacagctttagcatttcatcttacaacaagagaaggagaaccacatatgatcgtttcaaaacaagaaagaggaaaatccctgctatttaaaacttcagctggggtaaacatgtgtacattaattgcaatggatttgggagaattatgcgaagatacaatgacatacaaatgtccccgtatcacagaagcagaacctgacgatgtggattgttggtgcaatgcgactgacacctgggtaacttacgggacctgtagtcaaacaggtgaacacagacgcgataaaaggtctgtagcactagcaccacatgtgggcctaggactagaaacgcgaacggaaacgtggatgtctagtgaaggcgcatggaaacaaatacaacgagtagaaacatgggctttgagacacccgggttttacagtaattgcccttttcttagcgcatgccatcggtacttcaataacacaaaaaggaatcatatttatcttattaatgttagtcacgcctagtatggccatgagatgcgttgggattggcagcagggactttgtagaaggtcttagtggagcaacctgggttgatgtggttttggaacatgggtcgtgtgtcactacgatggcaaaagataaacccacactagacatagaattgttaaaaactgaagttactaatccagctgtactacgaaagttatgtatagaagcaaagattagtaatacgacaaccgactcgagatgtccgacgcaaggagaagcgacacttgtggaagaacaagatgcaaatttcgtatgtagaagaacatttgttgaccgtggatggggaaatggctgcggtctttttggaaaaggcagcttgttaacctgcgcgaaatttaagtgtgtcactaaactggaaggaaaaatagtccaatacgaaaatttgaaatattctgtcattgtgactgtgcatacgggtgatcaacaccaagttggtaatgaaagcaccgaacatggtacaacagcaacaattacaccacaagcaccgactaccgaaatccagttaaccgactatggagcattaaccctcgactgttcgccccgcacaggtttagattttacagaaatggttttgctaacaatgaaagaaaagagttggctcgttcacaaacaatggtttctagatttaccattaccatggacgagtggggcgagtacaagccaggaaacatggaataggcaagacttgctggtaacattcaaaaccgcacacgccaagaaacaagaagttgtagtcctaggatcacaagaaggtgctatgcatactgctttaactggtgccacagaaatacagacatcaggaacgacaacaatatttgcagggcatcttaaatgtagactcaagatggataagttaacgcttaagggcatgagttacgttatgtgtactggctccttcaaattagaaaaagaagtggccgaaactcagcatgggacggtcctagtacagataaagtatgaaggcaccgatgccccatgtaaaatacccttcagtacgcaggatgagaagggcgtgacccaaaacggcagactaatcaccgcaaatccaatcgtaacagacaaggaaaaaccagtgaatatagaagcggaaccaccgtttggcgagtcttatatagtaataggcgctggagaaaaggctttaaaattaagctggttcaagaaaggttcaagcatcggaaaaatgttcgaagctacagcacgcggtgcaagaaggatggcaattttaggggacacagcctgggatttcggttctataggtggtgtgtttacatcagtaggtaaacttgttcatcaaatattcggaacagcatatggagtactgttcagcggagtttcttggaccatgaaaattggcattggggttctgttaacttggttaggattaaattctcggtctacgtcgctatcaatgacatgtattgcagttggtctcgtgaccttatatttgggcgtaatggtacaagcggactcagggtgcgtcattaattggaaaggaagagaactaaagtgcggtagtgggatatttgtaacaaatgaagtacatacatggacggaacagtacaaattccaggcggacagtcccaaaagactctcagcagctataggtaaggcctgggaggaaggtgtctgtggcatccgttctgcaaccagactagaaaatataatgtggaaacagatctccaatgagctgaatcatatattattggagaatgacatgaaattaactgttgttgtaggggatgtcgcgggaatactggcacaaggcaagaaaatgatacggccccaacccatggaacacaagtactcatggaaaaattgggggaaggcaaaaattattggggcagacgtacaaaacagcacatttattatcgacggaccaaacacacctgaatgtagtgacgatcaacgtgcctggaacatatgggaagttgaagattatggatttggcattttcacaacaaatatttggctaaaattaagagatagttatacacaggtatgtgaccacaggttaatgagtgccgcaataaaagattcgaaagcggtccatgcggacatgggatattggatagaaagcgagaaaaatgagacctggaaattagcgagagcatccttcatcgaagttaaaacgtgtatttggcccaaatctcatacattatggtctaacggtgttcttgaaagcgaaatgataatacctaaaatatatggcggcccaatttctcaacacaactacagacccggatattttacgcaaacagcgggtccgtggcacctaggtaagttggagctagatttcgatttatgcgagggaacaacagtcgtagtggacgaacattgtggcaatcgcggtccatcactaagaactacaactgtaacaggcaaaataatccatgaatggtgctgccggtcatgtaccctccctccccttaggtttagaggagaggatggatgttggtacggcatggaaatacgccctgttaaagaaaaagaggaaaatttagtgaaaagcatggtcagtgcaggctcgggtgaggttgacagttttagcctaggactactttgcatatctatcatgattgaagaggtgatgagatccagatggtcaagaaaaatgctgatgactggaacacttgctgtattctttctgttaataatgggccaactcacatggaatgacttaatacggctatgtataatggtaggtgctaacgcttcagacagaatgggaatgggaactacatatttagccctaatggctacattcaaaatgcgtcctatgtttgcagtaggcctactgttccgtaggctcacatcgagagaagtcttacttctgacaataggtttgtcgctagtagctagtgtcgagctaccaaattccttggaagaactaggtgatggtttggctatgggcataatgatattaaaactgttaatagactttcagagtcatcaactttgggcaacgttactgagtatgacctttataaaaaccacattctctttacactatgcatggaagaccatggcaatggtactttcaatagtatcccttttccctctgtgtcttagcaccacctcgcagaaaactacctggctaccagtgttattaggatcactgggatgcaaacctctaactatgttcttaattgctgagaacaaaatatggggcaggaaaagctggcccttaaatgaaggcataatggccgtgggtatagtttctatacttctaagttcgctcctgaaaaacgatgtccctttagcagggccattaattgcgggagggatgctcattgcttgctatgtaatttcaggcagtagtgcagaccttagtttggagaaagccgcagaggtatcttgggaggaggaagcagaacactctggagcatcacataacattctagtagaagtgcaagacgatggaacaatgaaaataaaggatgaagaaagagatgatacactaactatacttctgaaagccacgttattagccgttagcggagtttatcccttatcaataccggcgaccctatttgtatggtatttttggcagaaaaagaaacaacgatcgggagtcttatgggacaccccttcccctccaaaagtagaacgagctgtcttagatgatggaatataccggataatgcaaaggggactactaggtcgaagccaggttggggttggtgtattccaagaaaatgtttttcatacaatgtggcatgtcactaggggtgcagtcttgatgtatcaaggaaaaagattagaaccgtcatgggcaagtgtgaagaaagatttaattagttatgggggaggatggaggttacaaggtagttggaacaccggagaagaagtacaagttatagcggtggaaccaggcaaaaacccaaagaatgtgcagacagctccagggacattcaagacgcccgagggagaagtaggagctatagcattggattttaaaccaggtacatctggatcgccaatcgtcaatagagagggcaaaatagtaggcttatatggaaatggtgtcgtaactacatcaggtacctatgtctccgcaatagcgcaggccaaggcttcccaggagggcccactaccagaaatcgaggatgaggtttttcgtaaacggaacttaactataatggatttgcacccaggctcaggtaaaacacgacgatatttgccagcaatagtaagggaggcaattaaaagaaagatgcgcacgcttatcttagcacccacgagagtggtggcatcggaaatggcggaagcattgaaaggtatgccaattaggtatcagacaacagcagtaaaaagcgagcacacgggtaaagaaatagtagacctaatgtgccacgccacattcaccatgagacttctatctcctgtaagagtgccaaattacaatatgataattatggatgaagcacattttaccgatccatcatcaattgctgctagaggatacattagtacgagagtagggatgggagaggccgcagctatattcatgacggcaacgccgccaggcagcgtggaagcgttcccgcagagcaatgctgttattcaggatgaggagagagacattccagaaagatcatggaactcagggtatgagtggataaccgacttcccaggtaagactgtatggttcgttccttctattaaagccggaaatgatatcgccaattgtctcaggaaaaatggaaagcgtgtaattcaactgtctcgtaagacattcgatactgagtaccagaaaaccaaaaataatgattgggattatgtagtcactactgacattagcgaaatgggtgcaaattttagagctgacagagtaattgatccccgtcgttgtctaaaaccagttatattaaaggacggaccagagcgagttatacttgcgggacctatgcctgttactgttgcatcagctgcgcaacgcagagggcgaatcggtagaaatcacaataaagaaggagatcaatatatttatatgggtcaacctttaaataacgacgaagatcatgcacattggacagaggcgaaaatgcttttggataatataaatacacctgaggggattataccagctctttttgaaccagagcgagaaaagtctgccgctattgatggtgaatatcgactaagaggagaagcacgaaaaactttcgttgagttgatgaggagaggcgatttacctgtatggttgtcatacaaggttgcaagtgaaggattccaatatagcgatcgaaggtggtgtttcgacggtgagcgcaacaaccaagtgctcgaagaaaatatggatgttgaaatatggacgaaagagggtgagagaaagaaactaagaccaaggtggctagatgcacgaacgtatagcgatcctttagcacttcgcgagttcaaagaatttgcggcaggccggagatcggtcagtggagacctgatcctggaaatcggtaaattaccacaacatctaactcaacgagcgcaaaatgcactagacaatctggtgatgttgcataattctgaacaaggcggccgtgcatacagacatgccatggaagaactcccggatactatagaaaccttaatgctcttggcgttgatagcagtcttgactgggggagtaaccttatttttcctctcaggaaaaggcctcggaaaaacgagcattggacttttatgtgttatggcaagctccgctctattatggatggcgtcagttgaaccgcactggatagccgcatcgattatattagagtttttcttaatggttctactgatcccagaaccagatagacaaagaacaccgcaagataaccaattagcgtatgtagttattggcttactcttcatgatcttgacggttgcagctaacgaaatgggcctacttgaaacgaccaagaaagatttaggcatcggtcatgtcgcagtagaaaaccatcatcatgctgctatgttagacgtcgatcttcaccccgcttctgcatggaccctatacgctgtggcaacaaccataataactcctatgatgcgccatactatagaaaacacgacagcgaacatcagtttaacagctatagcaaatcaagctgccatattaatgggtctcgataaaggatggccgatttccaaaatggacatcggagtacctttattagcactcggatgctattcccaggtaaaccctctcaccttgacggccgctgtgttaatgttagttgcacattacgcaattatcggcccagggctacaagctaaggccacacgagaagcccagaagcgcacagcggcaggaattatgaaaaaccccaccatagacggtattgttgccattgatttagatcctgttgtatacgacgcaaaatttgaaaaacaattggggcaaataatgctacttatattatgtacaagccaaatattactcatgaggacaacctgggcattatgcgagtcgataactttagcgacaggaccattaacgacactatgggagggatctccaggaaaattctggaataccacaatagcagtctcgatggcaaatatttttcgaggatcatacctcgcaggagctggattagcgttcagcctgatgaagtcactgggaggaggcagaaggggtaccggagcacaaggagaaacgctcggggagaaatggaaacgacaattaaatcaattatcaaaaagcgagttcaatacatacaaaagaagtggaatcatggaagtagacagatcagaagcaaaagaaggtctaaaacgaggagagacgactaaacacgccgttagtagaggaacggccaagttgcgctggttcgtggaacgcaatcttgtaaaaccggagggcaaagttatagatctaggatgtggaagaggcggttggtcatattattgtgctggactgaaaaaggttacggaggttaagggatatacaaaagggggaccaggtcatgaagaacccataccgatggcgacatatggatggaacctagttaagctacactcaggcaaagacgttttctttattcccccagaaaaatgtgatacgctactctgtgacataggagagtcctcgccaaatccaacaatagaagagggaagaactttacgagtactaaagatggttgaaccttggctacgcggtaaccaattttgtattaaaatactaaatccgtatatgccatcagtagtggagacactcgagcagatgcagcggaaacatggtggtatgctagttagaaatccgttgtccagaaattcgactcatgagatgtattgggtctcttgtggcactgggaatatagtatcagccgtaaacatgacatcacgaatgttacttaatcgcttcacaatggcccatagaaaaccaacgtatgaacgtgatgtagacttaggagcaggtacgagacatgtagccgtagaaccagaagttgctaatctcgacatcattggacaacgcattgagaacattaagcatgaacataaaagcacatggcattacgacgaagacaatccctataaaacatgggcttaccatggtagttatgaagtaaagccctcaggttcggcaagtagcatggtgaatggggttgttaaattactaactaaaccttgggacgtaataccaatggtcacgcaaatcgcaatgactgatactacaccatttgggcaacaaagagtctttaaggagaaagtagacactaggactccgaaagcgaaacgaggaactgcacaaataatggaagtaactgcacggtggctttggtcatttctctctcgaaataagaaaccacgaatatgtacacgagaagaatttacccgtaaagtgaggagcaatgcagccatcggggctgtatttgttgacgaaaaccaatggaactcggcgaaggaagcggttgaagatgacagattctgggatttagtccacagagaacgagagcttcataaacagggcaaatgcgccacgtgtgtttataacatgatgggtaaacgtgagaagaaactcggagagttcggtaaagctaaagggtcaagagctatttggtatatgtggcttggagctagatttctagagtttgaggctttaggatttatgaatgaggatcactggtttagtagggaaaactccttatcgggagtagaaggagaagggttgcacaaattaggctatattttacgtgatataagtaaaattcctggaggcaatatgtacgctgacgacacagcaggatgggatacaagaataactgaagatgatttacaaaacgaagcaaagataacagatattatggaaccggaacacgccctccttgccaaaagcatatttaaattaacctaccaaaataaagtagtccgagtccagagacctgctaaaaatggcacagttatggacgtgatttctaggagggaccagaggggaagtggacaagttggtacttatgggctaaatacttttactaatatggaagcccaattaataagacaaatggagtcggaagaaatcttctccccaaatgagttggaaacaccaaatctagcagaacgagttttagattggcttgagaaatatggagtagagagattgaaaaggatggctataagtggtgatgattgcgtcgtaaaaccaatcgacgatagatttgccacggctctaacagcgttaaatgatatgggaaaagtcagaaaagacattccacaatgggagccttccaaaggatggaacgactggcaacaagttcccttttgttcgcatcacttccaccaactaataatgaaggatggcagagaaatagtggtgccatgcaggaatcaggatgagttagtaggacgagcaagggtaagtcagggagcaggatggagtttacgtgaaacggcttgcttggggaaatcatatgctcaaatgtggcaactaatgtactttcacagacgtgacctccgacttgccgcaaatgcaatatgctcagcagttcccgtggactgggtaccaacttcaagaacaacctggtcaatacacgcacatcatcaatggatgactacagaggatatgttgtcagtatggaaccgagtatggatagaggagaatccatggatggaagacaaaacaagagtaagtagctgggaagatgtaccgtatctagggaagcgagaagatcaatggtgtggaagtttaattggtttaacagcgagggcaacttgggcaacaaatatacaagtagctataaatcaagttcgacgtttaatcggcaatgagaattatagcgactatatgacttcgatgaaaagattcaagaatgaaagcgaaccagagggagccctgtggtga

SEQ ID NO: 22022 - RNA, 9879 nt, synthetic construct
  misc_feature 1..9879: note = derived and/or modified CDS sequence (opt6) from DENV-1__JN054255__SS-prME
  source 1..9879: mol_type = other RNA
tctgtaacgatgttgctaatgttgatgccaactgccctagcctttcacttaacaacacgaggcggagaacctcatatgatagttagcaaacaagaacgaggaaaatcattacttttcaagacgtcggccggagtaaacatgtgcacgttaatcgcgatggatttgggagaactttgcgaagatacaatgacctacaagtgcccaagaataacagaagcggaacctgacgacgtagactgctggtgcaatgcaaccgacacatgggttacttatggtacatgctcacaaactggagaacatagaagagataaaagatccgtagcgcttgcacctcacgtaggtttgggtctagaaactagaactgaaacgtggatgagctcagaaggtgcttggaaacaaatccaacgagtagaaacttgggcattgcgacacccgggattcaccgtaatcgcactattcttagcgcatgctatcggtacgagtataactcaaaagggtataatattcattttattaatgctagttactccttctatggctatgcgttgtgtaggaataggatcacgagactttgtagaagggttaagtggggcgacttgggttgacgtagtattagaacacggctcatgcgttacaacaatggcaaaggacaaaccaacattagacatagaattattgaagaccgaagttacaaatccagcagttcttagaaaattatgtattgaagctaaaatctctaacacaacaacagattcacggtgtcctactcaaggagaagccacactcgtagaagaacaagatgcaaattttgtctgccggagaacttttgtggatagagggtgggggaacggatgcggacttttcggcaaggggtctctgcttacgtgcgcgaagttcaaatgcgtaacaaaactagaaggaaaaatagtacagtacgagaatctgaagtattcagtaatagtaacagttcacacaggcgaccaacatcaggtaggaaacgaatccacagagcatggcactacggcaacgattacgcctcaagctccgaccaccgaaattcaattaaccgactatggagcactgactcttgactgcagtccacgaaccggactagactttaatgaaatggtcttattaacaatgaaggagaaaagctggttagtccacaagcaatggttcttagatctccctcttccatggacatcaggtgcttccacaagccaagagacatggaatagacaagaccttcttgtcacatttaaaacagcccacgccaagaaacaagaggtggtagtacttggcagtcaggaaggagcgatgcacacagctttaacaggagcgaccgaaattcagatgtctggaacaaccacaatcttcgccggtcatcttaaatgcaggttaaagatggataagttaactctcaagggtatgtcttatgttatgtgcaccggatcatttaaactggaaaaggaagtagcagaaacacaacacggaacggtgctagtacaaatcaaatacgaaggtactgatgccccttgcaaaatccctttctctactcaagatgaaaaaggagttacacaaaatgggcgactcataacggcgaatcccatagtaacagacaaagaaaaacccgtaaacattgaagcagagcccccattcggagaatcctacattgtaataggagcaggggagaaagccctgaaactttcatggttcaaaaagggatcctctattggaaaaatgttcgaggcaacagctcgtggagcgcgcagaatggccatacttggtgacaccgcatgggattttgggtccataggtggagttttcacaagtgttggaaaattagtgcaccaaatcttcggcactgcctacggtgttctattctcaggcgtttcttggactatgaaaataggaataggagtgctacttacatggttaggactcaattctagaagtacctctctgtcaatgacctgtatagcggtcggactggtaacattgtatttaggtgtgatggtacaagcagatagtggatgtgttataaactggaaaggaagggagttgaaatgcggttcaggaatttttgtaaccaatgaggtacacacttggactgaacaatataaattccaagcagattcccccaaaagattgtctgccgcgattggtaaagcatgggaggagggagtgtgtggtattagaagcgcaacgagactagaaaatataatgtggaagcagataagcaatgaacttaatcacattcttttggaaaatgatatgaagtttacagttgtagtaggagatgttgctggaatactcgcacaagggaaaaagatgatccgaccgcaacctatggaacacaaatatagctggaaaaattggggtaaagccaaaataataggagcagatgttcaaaattcaacttttattatagatggaccaaataccccagaatgctctgatgatcaaagagcatggaacatctgggaagtcgaagattatggattcggaatctttacaactaacatttggttgaaacttcgagactcctatacgcaggtatgtgaccataggctaatgtcggcggcaataaaggacagcaaagctgttcatgcagacatgggttactggattgaaagtgagaaaaacgaaacctggaaattagcaagagcttccttcatagaagtaaagacttgcatatggccaaaaagccatacattgtggtcgaatggggttttagagtcggaaatgattatccctaaaatttacgggggccccatttcacaacacaactatcgaccagggtattttacgcaaacagcaggcccatggcatttgggtaaacttgaattggactttgacctttgtgaaggtacaaccgttgtggtagatgaacactgcggtaatcgtggacccagcttgcgaacaacaactgtcacaggaaaaataatacatgaatggtgctgccgtagctgtactctaccgcccttgaggtttaggggcgaagatgggtgctggtatggaatggaaatacgacccgtgaaagaaaaggaagaaaacttagtaaagtcaatggtctcggcaggaagtggtgaagtcgatagtttcagtcttgggctgttgtgtatcagtatcatgatagaagaagtaatgagaagtcgatggtctaggaaaatgttaatgacagggaccttggcagtcttctttctattaattatgggacaactcacttggaatgatcttatccggctatgcataatggtaggtgccaacgcaagcgatcgtatgggaatgggaactacttatttagccctcatggcaacatttaaaatgcgtccgatgttcgcggttggactcctattccgtagattaacatccagggaagtcctactactgactataggtctatccttagtagccagtgttgaactacccaacagcctagaagaattaggggatggattggctatggggattatgattctcaaactattaacagactttcagtcgcatcaattatgggcgacactattgtccatgacgtttataaaaaccaccttttcacttcactacgcatggaaaacaatggctatggtattatctatcgtcagcttattcccactttgcctcagtactacgagccagaaaactacttggctccctgtacttcttggtagtctcggatgtaaaccacttacaatgtttttaattgccgagaataaaatttggggtcgaaagtcatggccattgaatgaaggaataatggcagttggtatcgtaagtatactactatcgagtttattaaagaatgatgttccacttgcaggacctttaatcgcaggaggaatgctaatagcatgctatgttattagcggctcgtccgcagatttatcgctagaaaaagcagcagaagtttcgtgggaagaagaagcagaacacagtggggcgtcacataacattctagtagaagttcaggatgacggaactatgaaaataaaagacgaagaacgagacgatacactaaccatactattaaaagctactttgttagctgtatctggggtttacccactcagtatacctgctaccctttttgtctggtacttctggcagaaaaagaaacaaaggtcaggagtactatgggatacaccatcaccgccgaaggtcgaaaaagcagtgctagatgacggaatataccgtataatgcaacgaggtctattaggcaggtcacaagtcggtgtaggagtatttcaagaaaatgtctttcatacaatgtggcatgttactaggggagccgttctaatgtatcaaggaaaacgattagaaccttcgtgggcctcagtcaagaaagatttaataagctatggagggggttggagattacaaggatcatggaatacaggggaagaagtacaagttatagccgtggagcctgggaaaaatcccaaaaacgtccaaaccgcaccagggacgtttaaaacaccagaaggcgaggtcggcgcgatagccttggactttaaacccgggactagcggttcacccatcgttaatagagaaggcaagattgtaggactgtatggaaacggagtagttacgacatctggtacttacgtatcaggaatagcacaagcaaaagctagccaggaaggaccactacctgaaatcgaggacgaagtgtttaggaaaagaaacctgacaatcatggatctacacccaggatcggggaaaacaagaagataccttcccgccatcgtaagagaggcaattaaacgaaaaatgagaacattaatacttgctccaacaagggttgtagcctccgaaatggctgaagcccttaaaggaatgccaatacgataccagacaacagccgttaaatcagagcatacagggaaggaaatcgtagatttgatgtgtcatgcaaccttcaccatgagattgttaagcccagttagagtgcctaattataacatgataataatggacgaagcacattttacagacccgtcgagtatagcagcacgaggttacatttcgaccagggttggaatgggtgaagctgctgcaatattcatgacagcaactccaccagggtccgtcgaggcattcccacaaagtaacgctgttatacaggatgaagaaagagatatcccagaaagatcctggaactccggttatgaatggataacagatttccctggaaaaacggtctggttcgtacctagtattaaagctggaaatgatatagcgaactgtttgagaaagaatggtaaaagagttattcaattatcaagaaaaaccttcgatacagaatatcagaagaccaagaacaatgattgggactatgtagttacaacagatattagcgaaatgggtgcaaactttagagccgatagagtgatagacccccgacgctgcctaaaacctgtaattctaaaagatggtccagaaagggtcatactcgctgggccaatgccagttactgtggctagtgcagcgcagagacggggacgaattggacgtaatcacaataaggagggcgaccagtacatttacatgggacaaccattaaacaacgacgaaaatcatgcgcactggaccgaagcaaaaatgcttctggacaacatcaatacaccggaggggataatccccgccttgtttgaacctgaaagggagaaaagtgcagcaattgacggcgaatatagattgagaggggaggctcgaaaaacctttgtagaattaatgcgtagaggggatcttccagtatggctgagctataaagtggcatccgaaggattccaatacagtgatcgtagatggtgcttcgacggtgagagaaacaatcaagtactagaggaaaacatggacgtggagatctggacaaaagagggagaaagaaagaaattaaggccaaggtggttagatgcaaggacatattcagatccacttgcattgcgagagtttaaagaatttgcggcaggtcgtcgttcagttagtggcgatctaattctcgaaattggaaagctaccccagcacttgactcagcgagctcaaaatgctcttgacaatttagttatgttacacaatagtgaacaaggagggagggcttacagacacgccatggaggaactcccggatacgatagaaacgctgatgcttttagctctaatagccgtgcttactggtggagtcactttgtttttcttgagtggaaaaggtctgggcaagacgtcaataggattactttgtgttatggcaagttcagcgcttctatggatggcaagtgttgaaccacattggattgctgccagtatcatcttagagttctttctaatggtactattaattcccgaaccagatcggcaaagaaccccgcaagataaccaattggcgtatgtggtaattggactactgtttatgatccttacagtggcagcaaatgaaatgggactcctagagacgactaagaaagacctaggaataggacatgtcgctgtagaaaaccatcatcatgcagccatgttagatatcgacttacatcctgctagtgcttggactctttatgctgttgcaaccaccattatcactcccatgatgcgtcatactatagaaaacacaacagcaaacatatcgttaaccgccattgctaatcaggcagcaatcctaatgggattagacaaaggatggccaatcagtaaaatggatataggcgtccccttattagccctagggtgctactcgcaagttaatccactaaccttgacggctgcggtcctaatgttagtggcacactacgccattattggtcctggattacaagcaaaagcgacaagagaagcacaaaaacgcacagccgcaggcatcatgaaaaatcccaccatagatgggatagttgctattgatctagatccagtagtatatgatgcaaagtttgaaaaacaattaggacagataatgctattgattctgtgcacaagtcaaattttgcttatgcggacaacatgggcactatgcgagtctatcacactagctaccggtccacttactacactgtgggagggatcgccaggaaaattttggaatacaaccatagcggtgagcatggcaaatatattccgaggatcttatttagctggcgctggcttggcgtttagtctcatgaagtctttgggtggagggcgacgcggcacgggtgcacaaggcgagacacttggtgaaaagtggaagcgacaactaaaccagcttagtaaatctgagttcaacacgtataagagaagtggcataatggaagtggatagatcagaggctaaagaaggtctaaaacgtggggaaacaacaaaacacgccgtatccagaggtacagccaagctaagatggtttgtggagcgaaatttagttaaacctgaaggcaaggtcatcgacttgggatgcggacgaggtggttggtcatactattgcgctggattaaagaaggtaacagaagtgaaagggtacaccaagggcgggccggggcatgaagaacccatacccatggccacctatggttggaatcttgtaaaattacacagcggtaaagatgtattctttattccacctgagaaatgtgacaccctgctatgtgatataggggaaagctctccgaaccctacaatagaggagggacggactcttagagtcttaaagatggtagaaccttggcttcgaggaaatcaattctgtatcaaaatattaaatccttatatgccctcagttgtcgaaacattagagcaaatgcaacggaaacatggcggaatgttagtgcggaatccattatcgagaaacagtactcacgaaatgtattgggtttcttgcggaaccgggaatatagtgagcgcagtcaatatgacatccaggatgctgctaaatagatttacaatggctcataggaaacctacatacgaacgagatgtcgacttaggagctgggacaaggcacgtagcagtggagccggaagttgcaaatttagatataataggacaaagaatagaaaatatcaaacacgaacataaatccacatggcattatgacgaagataatccctataaaacgtgggcctatcacggttcttatgaagtcaaaccatccggatccgcatcatccatggtcaatgggatggttaaattactaacgaaaccctgggacgttattcctatggtaactcaaatagctatgaccgacacgactccgtttggccaacagcgagtttttaaggagaaggtcgatacaagaacgccaaaggctaaaaggggtactgcgcaaataatggaagtaacagctagatggctatggtcattcttatcacgtaataagaaaccgagaatttgcacaagagaggagttcacacgtaaagtaagatcgaacgctgccataggagctgtatttgttgacgaaaaccaatggaatagcgcaaaggaagcagtagaggatgatcgtttctgggacctagtccatagagagcgtgaactacataagcaaggtaaatgtgcgacatgtgtatacaatatgatgggcaaaagagagaagaaactaggagaatttggcaaggcgaaaggtagcagggcaatttggtatatgtggctgggcgctcgttttctagagtttgaggctctaggattcatgaacgaagaccattggttttctagagaaaattcactttcaggtgtcgagggtgaaggtctccataaacttggttacattctacgtgacatatcgaagataccgggcggtaatatgtacgccgatgataccgcaggttgggacactagaattaccgaagatgatcttcaaaatgaagcaaaaattacggacatcatggagccagaacacgcactgttagcaaaaagcatattcaaactcacataccagaataaagtagttcgtgtacaacgacctagtaaaaacggaaccgtaatggatgtgatctcacgacgagaccaacgaggctcaggccaagttgggacatatggattaaacacattcacgaatatggaagcgcagttaattaggcaaatggagtcagaggagatcttttcgccaaatgaattggaaaccccaaatttggcaaaacgcgtactagattggttagaaaaatatggggtcgaacgtcttaaacggatggcaatatccggagacgactgtgtcgtaaagcccatagacgataggttcgctacagctctaacagccttaaacgacatgggtaaggtgagaaaagacattccacaatgggaaccatcaaaaggatggaatgactggcaacaggtccctttctgttcacaccacttccatcaattaatcatgaaggatggtcgagagattgtagtaccatgccgcaatcaagacgagctcgtaggcagagctcgtgtaagtcaaggggcaggatggtcattaagagaaactgcatgtcttggaaaatcatacgcacaaatgtggcagctaatgtatttccaccgccgtgatctgaggttggctgcaaatgctatctgtagtgcagtacccgtggattgggtaccaacaagtaggactacctggtcgatacatgcccatcatcaatggatgacaacagaagatatgttgtcagtttggaatcgtgtatggatagaagagaacccgtggatggaagataaaacaagggtatcgagttgggaagacgttccatacttaggaaaacgggaagaccaatggtgcggttctttaattggtttaactgcgagagcaacttgggccaccaatatacaagttgctattaaccaagtaagacggctaattggaaacgagaattatagtgattacatgacgagtatgaaacgatttaaaaatgaatcagagcccgagggagcattatggtaa

SEQ ID NO: 22023 - RNA, 9879 nt, synthetic construct
  misc_feature 1..9879: note = derived and/or modified CDS sequence (opt6) from DENV-1__KP406801__SS-prME
  source 1..9879: mol_type = other RNA
tcagtaacaatgcttttaatgctactccctacggcacttgctttccatctgactaccagaggcggtgaaccacacatgatagttagcaaacaagaacgcgggaaaagtcttctgttcaaaacttcagctggggtgaatatgtgcactctaatagccatggacttaggcgaactgtgcgaagatacaatgacatacaaatgccctaggataacagaagccgaaccagacgatgtagactgttggtgtaatgctaccgatacatgggtgacatacggcacatgttcccaaacaggtgaacataggagggataaaaggtctgtagctctagctcctcatgtcggtttaggattagaaacgcgtacagaaacatggatgtcatccgaaggggcttggcgtcaaatacaaaaagtagaaacttgggcactacgacatccaggtttcacagtaatcgctttgtttttagcacacaccattggaacaagtataacacaaaaggggataatatttattctattaatgttggtaacaccgtccatggcgatgcgttgcgttggaattggaaatagagactttgtagaaggtttgtcaggggcaacttgggtagacgttgtgctagagcatggaagttgtgtcaccactatggccaaaaacaaacccactttggacattgaacttttaaaaacggaagtcacaaatccagccgttctgaggaagttatgcattgaagcgaaaatcagcaatacgactacagatagtaggtgcccaacacaaggtgaggcaactcttgttgaggaacaagacgcaaattttgtttgccgaaggacctttgtagaccgtggatggggtaatggatgtgggctatttggtaaaggatctttacttacttgcgcaaaatttaaatgcgtgacaaaattggagggtaaaatcgtccagtatgaaaacttgaaatatagtgttattgtcaccgtacatacaggagaccaacatcaagtgggtaacgaaactacagaacacggaactatagccactatcactcctcaagcgcctacatccgaaatccaactaacagattacggcgctctaacattagattgctctccccgcactggtctcgattttaacgaaatggtattactaactatgaaagaaaaatcttggttggtgcacaaacaatggttcctagacttaccgttaccttggacatctggggcctccacaagccaagaaacttggaatagacaagacctactcgtaacattcaaaacggcccacgccaagaagcaagaagttgttgtcctaggctcccaagaaggtgcaatgcacacagcactagcaggagcaacagaaattcaaatgtcgggtacaacaacaattttcgcgggccacctaaagtgtagattaaaaatggataaactaacgcttaaaggtgtttcatatgtgatgtgtactggcagtttcaaacttgaaaaagaagtagctgagacgcagcatggaacagttcttgtacaagttaagtatgaaggtacagatgcgccctgtaaaataccgttctctattcaagatgaaaaaggcgtgacgcaaaatggcagactaataacagccaacccgatagctacagataaagaaaaacccgtaaatatagagactgaacctccgtttggtgaatcctacatcgtgattggtgcgggagaaaaggccctgaaactatcgtggtttaagaaaggaagttctataggaaaaatgttcgaagctacagcacgtggagcaaggagaatggcaatcctgggggatacagcctgggattttggtagtataggaggagttttcacgtccgtgggaaagctggtacatcaagtatttggtaccgcctatggtgtcttattcagcggagtctcttggacgatgaaaatagggattggtatccttctaacttggttgggcttaaactcacggtccacatctctcagcatgacatgcatcgccgtaggcatggtaaccttatatcttggcgtcatggttcaggctgactctggatgcgttataaattggaaaggaagagagctaaagtgtggatcaggtatttttgttactaacgaagtgcatacttggacagagcaatataagtttcaagctgattcccccaaaagactaagcgctgcaataggaaaggcttgggaggaaggagtctgcggtataaggtccgcaacccgtctggaaaatataatgtggaaacaaatatcaaacgaattaaatcatatacttcttgagaatgacatgaagttcaccgttgtagttggcgatgcaaacggtatattaacccaaggtaagaaaatgattcgaccgcaacccatggaacataaatatagctggaaaagttggggaaaggcaaagatcatcggcgcagacactcagaataccacttttattatagacggtcccgacacaccggaatgtcctgatgatcaaagggcctggaacatatgggaagttgaggattatggatttggtatatttacaaccaatatctggttgaaattgcgtgatagctatactcaaatgtgcgaccatagattaatgtccgcggcaattaaagatagcaaagcagtacatgcagacatggggtattggatagagagtgagaaaaacgagacttggaaactagcaagagccagctttatagaggtaaaaacttgcatatggccacgatcgcacacattatggagtaatggagtcctagaatcagaaatgataataccgaaaatctatggtggaccaataagccaacacaattatcgacctggatacttcacgcagacagcaggtccgtggcacctgggtaaactagagttagacttcgacctttgtgaaggaactacagtagtcgttgatgagcattgcggtaatcgagggccatcattacggacaacgactgtaacaggtaaaattatacacgagtggtgttgtagatcatgcacgttaccacccttacgattcaaaggtgaagatggatgttggtacggcatggaaatcagacctgtaaaggaaaaagaggagaatctcgtaagaagtatggtctcagcaggatcaggagaagttgactcattcagtcttggattgctttgtgtcagtataatgatagaagaagtgatgcgcagtagatggtcacgtaaaatgctaatgacgggaactctagcagtcttcttcttactaataatgggtcaattaacttggaatgatttaattcgtctttgtatcatggtaggcgcaaatgtatctgacaggatgggtatgggtacaacctatttagccctaatggccacgttcaagatgagacccatgtttgcagtagggttactatttagaagattgacgagcagagaagttttattgttaacgataggtttatcgttggtagccagtgtcgaacttccaaattccttagaagaattaggggacgggttagctatgggcataatgatgttaaaattgttaacggattttcaaagtcaccaattatggactaccttattgtcacttacatttatcaaaacaacgctttcactagactatgcgtggaagactattgctatggtactcagtatagtttcattattccctctatgcctgtcaacaaccagtcagaaaacaacatggttaccggtcttgttaggctcctttggatgtaaaccattgaccatgtttttgataacagagaataagatttggggtagaaggtcatggcccttgaatgagggaataatggctgtaggaatagtcagtatactactttcttctttacttaaaaatgatgtacccctagctggtccgttaattgcgggcggtatgttaatagcatgttatgtaattagtggaagctccgcagaccttagcctagagaaagcagctgaagtatcatgggaggaagaggctgaacattcaggagcgtctcataatattttagtagaagtacaagacgatgggacaatgaaaataaaagacgaggaacgtgacgatacacttacgattcttcttaaagcaacactactcgccgtaagcggggtctaccctatgagtataccagccaccctttttgtgtggtatttctggcagaagaagaaacaaagatccggtgtactgtgggacactccctcacctcccgaagttgaaagagcagtgttagacgatggaatatataggattctccaaagaggattattagggagaagccaagtaggagtcggtgtgttccaagatggagtttttcacaccatgtggcacgttacacgaggagctgtactaatgtaccagggtaaacgattagagccatcatgggctagcgtcaagaaagacctgatctcatacggcggtggatggcgattccaaggaagttggaacactggagaggaagttcaagttatcgccgtagaacctggtaaaaatcctaaaaacgttcaaacgacacctggaaccttcaaaactccagaaggggaagttggggccatagcactggatttcaagcccggaacaagtggtagccccatcgtcaatcgagaaggtaaaatagtgggactttacggcaatggtgttgttacaacaagtggaacgtatgtgtctgcaatagcacaagctaaagccagccaggaggggcccctccctgaaattgaagatgaggtttttaagaaaagaaatttaacaattatggatctacaccctgggtcaggaaaaacaagaagatatttacctgcgatagttagagaagcaatcaagcgaaaacttcgaacgctaatattagcgccaacaagagtggttgctagtgaaatggcagaagcgttaaaaggcatgcctatcagatatcaaacgactgcagttaagagcgaacatacaggaagagaaatagtggatttaatgtgccacgcaacgttcacaatgcgcttattaagtcctgttcgggtgccaaactataatatgattataatggacgaggcacattttacagatcctgcgtcgatagctgcaagagggtacattagtacaagggtaggaatgggtgaagctgccgctattttcatgactgcaactcctccaggtagtgtagaggcgttcccacaaagtaatgcggtaatacaggacgaggaaagagatataccggaaagaagttggaactctggctacgactggataactgacttcccagggaaaacagtatggtttgtgccatcgatcaaaagtgggaacgacatcgcaaactgtttgcggaaaaatggaaaacgagtaatacaacttagtagaaaaacctttgatactgagtaccagaaaactaaaaataatgattgggattacgtcgtcaccacagatatatcggaaatgggagcgaactttcgtgcagatcgcgtgatagatccacgtcgttgcttgaagcctgtaatcttaaaagacggaccagaaagggttatactcgcaggaccaatgccagtgacagtagcatcagccgctcaacgtagaggaagaattggccgtaaccagaacaaagagggcgaccaatatatttacatgggtcagcctcttaacaatgatgaggaccacgctcattggacagaagcgaaaatgctcttagataacataaatacacccgaagggatcattccggcgctttttgaaccagaacgcgagaaaagcgcggcaattgacggagaatacagattgcgaggagaagcacgcaaaacatttgtcgaacttatgcgaagaggagatctaccagtctggttatcctataaagttgcatcagaaggtttccaatactcagacagacgttggtgcttcgatggcgaaaggaataatcaagtattagaagaaaatatggacgtagaaatatggaccaaagaaggggaacgcaagaaactaagacccagatggttagatgcgcgcacctattcggaccctcttgcattaagggagtttaaagaatttgcggcaggccgtcgatcagtatcaggagacttaattttggaaatcgggaaactgccccaacacttaacgcttcgcgcccagaatgccttagataacctggttatgcttcacaactcagaacaaggaggtaaagcatacagacatgctatggaggaactacctgacacaatagaaacactcatgttattagccctaatagcagttttgactggtggtgtaaccctattctttctatcaggcaaaggactaggaaagactagcataggtttactatgtgtaatggctagtagtgtactgctatggatggcgtccgtcgagccccactggatcgcagcttctataatcttagaatttttcttaatggttttattaatacctgaaccagacagacaacgtactccacaggataaccagttagcatatgtcgtaataggacttttatttatgatactaactgtagcggcgaacgagatggggttattagaaactacaaagaaagacctgggtataggacacgttgtggctgaaaatcaccaccatgcaacaatgttggatatcgacttacacccagcaagtgcatggactttgtacgccgtagcaaccactatcataactccaatgatgaggcatacaatagaaaatactactgcaaatatctcactcactgctattgcaaaccaagcggccatattaatggggctagacaaaggttggcctataagtaaaatggacattggagttcctttgttagcgttaggatgttatagtcaagtaaatccgctaaccctgacggccgcggtactaatgttagtagcacattatgcaataattggaccaggattacaagcgaaagcaaccagggaagctcagaaaagaacagcagctgggataatgaaaaatccgacggtggatggtattgtagccatagacctcgatccagttgtctatgacgcaaaatttgaaaaacagctaggtcagataatgcttctgatattatgtacaagtcaaatattgctgatgcgaacaacttgggcactctgcgaatcgataacacttgctactggaccacttacgaccctctgggaaggtagtccaggtaaattttggaatacgacgatagctgtaagcatggcaaacatatttaggggatcttatctagctggcgcgggtctcgccttttccctcatgaaatcactaggagggggcaggcgtggcactggtgcgcagggtgaaacattaggcgaaaaatggaagcgtcaattaaaccaattgagtaaatcagaatttaatacatataaaaggagtggaatcatggaagtagatcgaagcgaagcaaaagaaggattaaaaagaggagaaacaacgaagcatgcagtatcccgtggaaccgccaaacttagatggtttgtagaacgtaatctcgttcgcccggaaggaaaagtaattgaccttggctgcggccgagggggttggtcatattattgtgcagggctcaaaaaggtcactgaagtaaaaggatatacgaaaggtggtccaggacacgaggagcccatcccaatggccacatatggatggaatctggtcaaattatacagtggcaaagacgttttctttacaccaccggagaagtgtgacactttactatgcgatataggggagagtagtcctaatcctacaatagaggaagggaggacactgcgggtgctcaaaatggtggaaccgtggctaagagggaatcagttttgtataaaaattcttaacccatatatgccaagtgtagtggaaacattagaacaaatgcaacgaaaacatggtgggatgttagtgcgaaatcctctatcaagaaattctactcatgaaatgtattgggtgagctgtgggaccggtaatatagtatctgctgtaaatatgacctcacgaatgcttttaaatcgcttcaccatggctcaccgaaaaccgacatacgaacgagatgtagacctcggagctggtacgcgacacgtagcagtcgagcctgaaattgctaaccttgatataataggacagcggatcgaaaacattaaaaatgaacacaaatccacatggcactatgatgaagataatccttacaaaacctgggcatatcatggttcatacgaagtaaaaccaagcggatccgcatcaagtatggtaaacggggttgtacgtctattaacgaaaccatgggatgtaatcccgatggttacccaaatagctatgacagacacaaccccatttggacaacagagagtatttaaagagaaagtcgatacaaggaccccacgacctaaaagaggtacagcacagataatggaagtaactgcaaagtggctttgggggtttctatcaaggaataaaaagccacgaatctgcacaagggaagagttcacaagaaaagtccggtcaaatgcagccattggagccgtatttgtagacgaaaaccaatggaatagtgccaaagaagctgtggaggacgaaaaattttgggatcttgtacatcgggagcgtgaattacataaacaaggtaaatgtgctacatgtgtctataacatgatgggaaaacgagagaagaaactaggggagttcggtaaagctaaggggagcagagccatatggtacatgtggctaggcgctagatttctcgaatttgaggctctagggtttatgaacgaagaccactggttttctagggaaaacagcttgtcaggagttgaaggtgaaggtttacataaactcggatatattttacgagatatatcaaagatcccgggaggcaacatgtatgctgacgatacggcgggatgggatacccgcataacagaagacgatttgcaaaacgaagcaaaaataactgacataatggaacccgaacacgcactattagcaacgagcatctttaaactaacatatcagaataaagtggtcagggttcaaaggccagcaaaatctggtacggtaatggatgtgataagccgaagggatcaacgggggagtggacaagtaggcacctatgggttaaatacattcactaacatggaggtacaattaatacggcagatggaaagtgaaggtattttctctccgtcagagctagaaaattctaatttagctgaacgagttttagactggcttgaaaaacatggagtagaaagacttaagagaatggctataagtggtgatgattgcgttgttaagcccaccgatgaccgatttgcaaccgctctaacggcactcaatgatatgggtaaagtgaggaaggatattccacaatgggaaccaagcaaaggttggaacgattggcaacaagttcctttttgctcacatcacttccaccaacttattatgaaagatggccgtgaaatagttgtaccttgtcgaaaccaggatgaactcgtggggagggcgcgagtatcacagggcgcgggttggtcgctaagagaaacagcttgcctcgggaaaagttatgcacaaatgtggcaattaatgtatttccatcggcgtgatttaaggctcgccgctaatgcaatttgctcagctgtgccagttgattgggtaccaacttctcgcactacctggagcatacacgcacaccaccaatggatgacgacggaagacatgctatcagtatggaacagagtatggatcgaagaaaacccatggatggaagataaaactcatgtgagctcatgggaagatgtgccatatcttggtaaacgagaagatcaatggtgtggttcactaattggtttaacggcacgcgcaacttgggcgactaatattcaagttgcaataaaccaagtgagaagattgattggaaatgagaattatctagactatatgacgtctatgaaaagatttaagaatgaatcagatcctgaaggggctttatggtga

SEQ ID NO: 22024 - RNA, 9879 nt, synthetic construct
  misc_feature 1..9879: note = derived and/or modified CDS sequence (opt6) from DENV-1__KP406802__SS-prME
  source 1..9879: mol_type = other RNA
agtgtaacaatgttactgatgctgatgcctaccgctttggcgtttcacctaacaacgagaggaggagaaccccatatgattgtttcgaaacaagaaagaggaaaaagccttttgttcaaaacctcagcagggattaatatgtgcacactgatagctatggacttaggggaactatgcgaagatacattgacatataaatgcccgcgaatcactgaagctgaaccagatgatgtggactgctggtgcaatgcgacagatacgtgggtgacatatggaacttgtagtcaaacaggcgaacatagacgggataaacgtagcgtagccctagctccccacgtcgggttaggattggaaacaagaacggaaacctggatgtcttcggaaggtgcgtggaaacaaattcaacgagtggaaacatgggcacttcgtcatcccggattcactgttatagctttattcttggcccatgctattgggaccagtataacacaaaaaggcataatctttatacttcttatgttagtcacacccagtatggctatgcgatgcgtaggcattggtagcagagacttcgttgaaggactatcgggtgcaacttgggttgacgtggtcctcgaacacggctcttgcgtgaccacgatggcgaaagataaaccgactttagatatagaacttttaaaaaccgaagtcactaatcctgcagttctcaggaaattatgtatagaagctaaaatatcgaacacaaccacagactctagatgccctactcagggtgaagcgacattagtcgaggaacaagatgcaaacttcgtatgtaggcgcacctttgttgacagagggtggggtaatggttgtggcttatttggaaaagggtcattaataacctgtgctaaattcaaatgcgtcaccaaattagaaggaaagattgtccaatacgaaaatcttaaatatagcgtaatcgtaactgtgcatacaggggatcaacaccaagtagggaatgagagtacggagcatggaactaccgcaaccataacaccccaagctcctactactgaaatacaattaacagattatggtgcattaacattggattgttccccaagaactggattagactttaacgaaatggtactactaacaatgaaggagaaatcatggttagtgcataaacagtggtttctggacctaccactgccttggacatcgggcgccagtacatcccaagaaatatggaaccgacaagacctgttagtcacattcaaaacagcccatgcaaagaaacaagaggtagtggtccttgggtctcaggagggtgcaatgcatactgcactaacaggagctacagagatacaaacctcgggtacaactacaatctttgcaggccatttaaaatgtaggttaaaaatggacaaactaacgttaaaaggcatgtcctatgtaatgtgtacagggagctttaaattagaaaaagaagttgctgaaacacagcatgggacggtacttgtacaaattaaatacgaaggcactgatgctccatgtaaaattccattctcgacacaagacgaaaaaggcgtcactcaaaatggacggctaattacagcaaatccaatcgtaacagacaaagaaaagccagtaaatatagaagcggaaccgccttttggcgaaagctatatagtaataggagctggagaaaaagcactcaaacttagctggttcaagaaaggtagttcaataggcaaaatgtttgaagcaacagcaaggggtgccaggaggatggccatactaggagacacggcatgggactttggttcaatcggaggagtattcacatctgtgggtaaactcgtacatcagatctttggaactgcttacggagtcctattttcaggagtgtcgtggaccatgaaaattgggataggggtgctactaacatggttaggactaaattcaagatcgacctcattgagtatgacttgtatagcagtaggcctcgtaacgctataccttggagttatggtacaggctgactccggatgtgtaataaactggaagggaagggaattaaagtgtgggagtgggatctttgtaaccaacgaagttcacacttggacggaacaatataagttccaagctgacagtccaaaaagactttcggcggccataggaaaggcatgggaagaaggagtatgtggcataagatctgccacaaggttagagaacattatgtggaagcagatcagcaacgagctaaatcacatcctgttagaaaacgacatgaaatttactgtcgttgtaggcgatgttgcagggatcctcgcacaaggtaagaaaatgatcaggccacaaccaatggaacataagtacagttggaagtcttggggtaaagctaagatcatcggagccgacgttcagaataccacatttataatcgacggtccaaatactccagaatgtcctgacgaccagagagcatggaacatatgggaagtcgaagactacggttttggtatatttaccactaatatatggctcaaattaagagatagctacacgcaagtgtgtgaccatcgactaatgtccgcagccataaaagactcaaaagcagttcatgcggacatgggatattggattgagagcgagaaaaatgaaacgtggaaactcgctcgcgcatcgttcatagaggtcaaaacatgtatatggccgaaaagccataccttatggtcgaacggagtgctggaaagtgagatgatcatccctaaaatctatggtggccctatatcgcaacacaattatcgaccagggtattttacccaaacagcgggaccgtggcacctaggtaaactagaattggattttgacctgtgtgaaggaactacggtggtagtagatgaacattgtggaaatagaggtccaagcctaagaacgactacagttactggaaaaataatacacgaatggtgttgtagatcttgtactttacccccattgcgcttcagaggtgaggatggttgttggtacggaatggaaatccgacccgtcaaagaaaaagaagaaaatttggtaaagtcaatggtcagtgccggtagcggagaagtcgatagcttctcgctagggctgctttgtatatcaataatgattgaggaagtcatgcgtagcagatggtcaagaaaaatgcttatgacgggaactctggctgtattctttttgctaataatgggacaattaacatggaacgatctaatccgactatgtatcatggttggggctaacgcgtcagacagaatgggaatgggaacaacatatctagcacttatggccacgttcaagatgagaccaatgtttgcggtcggtctactatttcgtcgattgacgtcaagggaagttctgttgttgacaataggattatctttagtggcatctgtagaactcccgaatagtctagaagaattaggagatgggttggctatgggaataatgattttaaaattattaaccgatttccaaagtcaccagttatgggcgacgttactaagtcttacattcataaaaacgacttttagcttacattacgcatggaagacgatggcaatggtgctaagtattgtgagtttatttcccctttgtctatcaactacatctcagaaaaccacatggttacccgtattattgggttcgttaggctgtaagccattaacaatgtttttgatcgcagaaaacaaaatatggggtcgtaagtcatggccattaaatgagggaattatggcggttggaatagtttctattttattgtcatctctactcaaaaacgatgttcctttagcgggaccattaatagcagggggaatgcttatcgcgtgttatgtaatatctggttcgagcgcggacctcagtttagagaaagctgcggaagtctcgtgggaagaagaagctgagcattcgggtgcttcacacaacatcttagttgaggttcaagacgatggtacgatgaaaatcaaagacgaagaacgggatgatacattaacgatcctactaaaagcaaccctactagcagtaagtggggtatacccccttagcataccagctaccctattcgtgtggtatttttggcagaagaagaaacagcgtagtggcgtattatgggatacaccgtcacctcctgaagtggagcgtgcggtgctcgatgatggaatataccgaataatgcaacgaggtttactcggaagaagtcaagttggtgtgggtgtgttccaagaaaatgtcttccacacaatgtggcatgtgacaagaggagctgtattgatgtatcagggcaaacggctagaaccaagttgggcgagcgttaagaaagatctaataagctatggtggaggctggcgcctacaaggatcctggaatacaggagaagaagtacaagtaatagcagtagagcccggcaaaaatcctaaaaatgtacagacggctcctggaacattcaaaacacccgaaggcgaagtaggcgcaattgcactcgatttcaaaccaggaacgagcgggtccccgattgtgaatcgagaggggaaaatcgttgggctttatggaaatggagtagttacgacaagtgggacctacgtttcagcaattgctcaagcgaaggcgtcacaggaaggccccctaccagagatagaagatgaagtcttccgaaagcgaaatctcaccattatggatctccaccctggaagcggcaagacaagaagatacctacctgccatagttagggaagcaatcaagcgcaaactaagaacgctaatattagcgccgacgagagtagtagctagtgaaatggcagaagctctgaagggaatgcctattcgctatcagactacagccgtaaagagcgaacacacaggaaaagaaatagtagacttgatgtgccacgcaacatttacaatgcgactactctcgccagtgcgtgtacctaattacaacatgataataatggatgaggcgcatttcacagacccgtcttcaattgcagcgagaggttatatatctacacgtgtagggatgggtgaagccgctgctatttttatgaccgctacacctccaggttctgttgaggcttttcctcaaagtaatgctgtgatacaagacgaagaacgagacataccggaacgaagctggaactcaggttatgaatggataacggactttcctggaaaaacggtttggtttgtaccaagtattaaatcaggtaatgacatagctaactgtttacggaaaaatggaaaaagagtcatacaattatcgagaaaaacatttgataccgagtatcagaaaactaaaaacaacgattgggattacgtggtcacaacagatataagtgaaatgggagccaattttcgagcagatagagtaatagatccacgacgttgcctaaaacctgtaattttaaaagacggacctgagcgagttatactcgcgggacctatgcctgtaaccgttgctagtgctgcccagagacgaggacgagtagggcgtaatcacaacaaagaaggtgaccagtacatttacatgggacaacctttaaacaatgacgaagaccacgcgcactggaccgaagcaaaaatgcttcttgacaacataaataccccggagggaattatacctgcattatttgaacctgaacgtgagaagtcagcagcgatagatggagaatacagactacgaggcgaggcgagaaaaacctttgtggaacttatgaggcgtggtgatctgccggtatggctctcttacaaggtagcaagtgaagggtttcaatatagtgatcggaggtggtgtttcgacggtgaacgcaataatcaggtattggaggaaaacatggacgttgagatttggacaaaggagggagaacggaagaaattaaggccaagatggctggacgccaggacctattcggatccgctggcactgagggaatttaaagaatttgctgcgggtagacgtagtgtgtcaggcgatcttatattagaaataggtaaattaccacagcatttaacacaaagggcacagaatgctcttgacaacttagtcatgttgcacaatagcgaacaaggagggagagcgtacagacatgcaatggaggagttacccgataccattgaaactcttatgcttctagcactcattgctgttctcaccggaggagtgacgttgtttttcctatcaggaagaggacttggtaaaacaagtataggcttactatgtgtcatggcatcttcagtactattgtggatggcatcggtagaaccacattggatagctgccagtatcatcttagaatttttcttaatggtattgctaatccccgagccagaccgacagcggacacctcaagataatcaactcgcatatgtagtgatcggattactatttatgattttgacagtagcagctaacgaaatggggctactagagaccaccaagaaagacttgggaattggacatgtcgccgtggaaaatcatcaccatgcagcaatgctggacgtagatttacatccagcttctgcgtggacactatacgcagtggccacaactataattactccaatgatgagacatacaattgaaaatactacagctaatatcagtctgacagcgatcgcaaatcaagcggcgatattaatgggcttagataaagggtggccaatcagtaaaatggatatcggagtacctctgctggcacttggatgttactcacaagttaacccgttaaccttaacagctgctgtactaatgttagtagcacactatgccattattggccctggcctccaagccaaggctacacgagaggcacagaaaagaacagctgcgggaataatgaaaaatcctactgtagatggtatagttgctatagatctggaccccgtggtatatgatgcaaaatttgaaaagcagcttggccaaataatgttgttaatcctctgcacatcacaaatcttacttatgcgaacaacctgggccctatgcgagtctattactctagccacaggtccacttactactctatgggaaggatcacccgggaaattttggaacacgactatcgcggtttctatggcaaacatattccggggaagttacctagctggtgccggactagcattttctctaatgaaaagtttgggcggcggtaggagaggtacaggagcgcagggcgaaacgcttggggaaaaatggaaacggcaacttaatcaactatcaaaatcagaatttaacacttataaacggagtggaataatggaagtagatcgctctgaagccaaggaaggtttaaaacgtggtgagacaactaaacatgccgtatccagaggaacggccaaattaagatggtttgtagagagaaatctcgtcaaaccagaaggaaaggtaattgacctcggttgtggacgaggaggatggtcttactattgtgcaggactcaagaaagtaacagaagtaaaggggtatactaaaggtggacctgggcatgaagaaccaataccaatggctacttatgggtggaatctggtaaagttgcacagtggcaaagatgtcttctttatccctccagaaaaatgtgacaccctactttgtgacataggagaaagttctcctaatccaacaattgaggagggacgaacactaagggtccttaaaatggttgaaccctggctgcgaggaaaccaattttgtataaaaatcttaaacccatatatgccgtcggttgtagaaaccttagaacagatgcaaagaaaacatggtggaatgttagtacgtaatccattatcacgcaatagtacacatgagatgtattgggtaagttgcgggacaggtaacatagttagtgcggtcaacatgacttcgagaatgcttctaaacagattcactatggcccaccgaaagccaacatacgaaagagatgtagatttaggggctggaactcgccacgtcgcagtagaacccgaggtcgctaatttagatataataggacaacgaatcgagaatattaaacacgaacataaatctacatggcattatgacgaagataacccatacaaaacgtgggcctatcatggaagctacgaagtcaaaccaagcggcagtgcttctagtatggtaaatggtgtggtcaaactattaacgaaaccttgggatgttattccaatggtgacgcaaattgcaatgactgatacgacaccttttggacagcaaagagtatttaaagaaaaagtagatacacgaactccaaaggcaaagcgaggcacgacccaaataatggaagttactgccagatggctgtggggtttcttaagccgaaataagaaaccgagaatatgtacgagagaagaatttactagaaaagtccgatcaaatgctgcaataggggcagtgttcgtagatgaaaatcaatggaactcagctaaagaggctgtagaagacgaacgtttctgggaccttgtccacagagagcgagaattgcataagcaaggaaagtgtgcgacatgtgtatacaatatgatgggcaagagagagaagaaattaggtgagttcggaaaagccaaaggtagtcgagccatttggtatatgtggctcggcgctagatttcttgaatttgaagcactgggatttatgaacgaagatcattggtttagcagggaaaactctctatcaggtgttgaaggtgaaggtttacataaattaggttatatacttcgagatatttcaaaaatcccaggtggtaacatgtacgcagatgatacggcaggttgggacaccagaataacggaagacgatcttcaaaatgaggcaaaaattaccgacataatggagccggaacacgccttattggccaaagctatctttaaattaacgtatcaaaacaaagttgttcgagtacagcgtcctgccaaaaatgggacagtaatggacgtaatttcacgtagagatcaacgaggcagtggtcaagtgggaacctatggtcttaacacctttacaaacatggaagcccaattaataagacaaatggaatcagaaggaatattttcaccatccgaattggaaacacctaatttggccgaaagagtactagattggttggaaaagtacggagtagagaggttaaagcgaatggcaatatcgggagatgattgtgtagtcaaacccatcgatgaccgctttgctacagccttaacagcactaaatgatatgggaaaagttagaaaggacataccgcagtgggaaccatcgaaaggttggaacgactggcaacaagtacctttctgttcacatcattttcaccaacttattatgaaagatggtagagaaatagtggtaccttgccgaaatcaagatgagttggtaggtcgagctcgagttagccaaggggcaggatggtcacttagagaaaccgcctgcctaggaaaatcttacgctcaaatgtggcaactaatgtacttccacagaagagatcttcgtctcgcagccaatgcaatttgctcggctgtacccgtggactgggtacctacatcgcgaacgacttggagtatccacgcacatcaccaatggatgactaccgaagatatgttgagcgtatggaacagagtatggattgaggaaaatccatggatggaagacaaaacacacataagtagttgggaagatgttccatacttaggcaaaagagaagatcagtggtgtggctcactgataggcctgactgcgagagctacatgggcaacaaatatacaagtggcaataaatcaagtccgaagattaataggtaacgaaaactacttagattacatgaccagtatgaaaaggtttaaaaatgagtcagacccggaaggagcattatggtag

SEQ ID NO: 22025 - RNA, 9879 nt, synthetic construct
  misc_feature 1..9879: note = derived and/or modified CDS sequence (opt6) from DENV-1__KP406803__SS-prME
  source 1..9879: mol_type = other RNA
tcagtaactatgttgttaatgctactccccactgctctagcatttcatcttaccacccgtggtggagaaccccacatgatagtcagtaaacaagaacgtggaaaaagcctactattcaaaacatccgcgggggttaacatgtgtactttaatagccatggatctcggggaactgtgtgaagacacaatgacgtataaatgcccacgcataacagaaacagaaccagatgacgtagattgctggtgtaatgcgacggagacatgggtaacatatggtacgtgttctcaaacaggtgaacatcgcagagataaacgtagtgttgcgctagccccacatgtaggtctaggacttgaaaccagaaccgaaacatggatgtcatcggaaggagcttggcgccaaattcaaaaagtcgaaacatgggcattgagacatccaggttttacagtaatagctttgttcttagcacacgctataggaaccagcataacacaaaaaggtataatctttatcctactcatgctagtaactccctccatggcgatgaggtgcgtcggtattggaaatagagattttgtggaaggtctctcgggagcgacgtgggtcgatgtcgtactagaacacggttcatgtgttactacaatggctaaagataaacctaccctggatattgaactgctaaaaactgaagttacaaaccccgcagtactacgtaaactatgcattgaggccaaaatctcgaatacgacaaccgactcgcggtgtccgactcaaggagaagctacattggtggaagaacaagacactaactttgtgtgcagaagaacgtttgtagacagaggatgggggaatggatgcggattattcggcaaaggatcgctgataacttgtgcaaaattcaaatgtgtaacaaaattggaaggaaaaattgtccaatacgaaaatctaaaatatagtgttatcgttaccgtccatacaggcgatcaacatcaagtaggaaatgaaacaaccgaacacgggacaactgcaacaataacaccgcaagcgcccacatccgagatccaactaacggattatggggccctaactttagattgttctcccagaaccggtttagatttcaatgaaatggtactgctaacaatgaaagagaaaagctggctggtacacaaacaatggtttctagacttacccttaccctggacgtccggggcaagcacaagtcaagaaacatggaataggcaagaccttttagtgacatttaaaacggctcacgccaagaaacaagaggttgtagtacttggctcacaagaaggcgcaatgcatactgcacttacaggtgctacagaaatccaaacatctgggacaacaactatattcgcgggacatcttaaatgcaggttgaaaatggataaactcaccttaaagggggtaagctacgtaatgtgtacgggtagtttcaagctagaaaaagaagtagcagaaactcaacacggcactgttttagttcaagtaaaatatgaaggaacagatgcgccttgtaagattccgtttagcagtcaagatgaaaaaggagtaacacagaatggtagattaatcacggcgaatcccattgttacagataaagagaagcccgttaatatcgaagcggaacctccattcggggaatcatatttagtggtaggagcaggagaaaaagcgttgaagttaagctggttcaagaaaggaagttcgataggaaaaatgtttgaagcaacggctagaggagcaagaaggatggcaatcttaggagataccgcatgggactttgggagcatcgggggagtcttcacttcagtcgggaaacttatacatcaaatttttggtactgcatatggggtactgttttccggtgttagctggactatgaaaataggcataggcattcttttaacatggctaggcctaaatagtagaagcaccagcttatcaatgacatgcatagcggttggaatggtaacgctatacttgggtgttatggtgcaagctgattcaggctgcgtaattaactggaaaggtagggagttaaaatgtggatccggaatattcgtaactaacgaggtacatacgtggacagaacaatataagttccaggcagactcgcccaagaggttatccgctgccataggaaaagcgtgggaagaaggtgtatgcgggattagatcagctacacgactagagaacataatgtggaaacaaatatccaacgaactcaaccacatcttacttgaaaacgacatgaagttcactgtagtagttggcgatgtcaatgggattttagcgcagggaaagaaaatgatacgtccgcaaccaatggagcataaatattcatggaaatcttggggtaaagccaaagttattggcgcagatgttcagaacattacgtttatcattgatggcccaaacactcccgagtgcccagatgatcagagagcatggaatatatgggaagttgaggactatgggttcggcatttttacaacaaatatctggttaaagctgagagatagctatacacaagtttgcgaccatagactaatgagcgccgcaattaaagattctaaagctgtacatgcagatatgggatactggattgaatcggagaaaaatgaaacatggaagttaaccagagcatccttcatagaagtaaagacctgtgtgtggcccaaatctcatacgttatggagtaatggcgtcctagaaagcgaaatgatcattccgaaaatttacggtgggccaatatcacaacacaattaccgacctggttatttcacacaaacagcgggaccatggcacctgggtaaacttgaattagattttggtctatgtgaaggtaccacggtggtcgtggacgagcactgtggaaacagaggaccatctttgcgtaccactacagtcacaggaaaaattatccacgagtggtgctgcaggagctgcaccctaccacccctaaggttcaaaggagaagatgggtgctggtacggtatggaaattagacctgtaaaagaaaaagaagaaaatttggtaaaatctatggttagcgccggctcaggagaagtcgatagcttcagtttaggcttgttatgcatatctataatgatagaagaagttatgcggagcagatggagcagaaagatgctaatgacaggaacactagcagtatttctgttattaataatgggtcaacttacgtggaacgacctcatacgtctatgtataatggtaggagccaatgcaagtgataaaatgggtatgggaactacctacctagcgttaatggctacattcagaatgagaccaatgttcgcggtaggacttctattcagacgattaacaagtcgtgaggttctgttgctcactgtaggattgtcactggtagcatcagttgaattacccaatagcctagaagaactaggcgacgggctagccatgggaataatgatgttgaaattattaacggactttcaatcccaccaactttgggccgcactattgtcactaactttcgtgaaaacgactttttctcttcactacgcgtggaaaaccatggcgatgattttaagcatagtctcactcttccctctatgtttaagcacaacaagtcagaagacaacgtggctcccggtattgttagggtcactaggatgtaaaccacttactatgttcctgataacagaaaataaaatatgggggcgaaagagttggccgctgaatgaaggaattatggcggttggcatcgtatcaatacttttatcttcactccttaaaaatgatgtacccttagctggaccgttaattgcgggtggaatgcttatagcttgttatgtgatttcaggatctagtgcagatttatcattagaaaaagcagctgaggtatcctgggaagaagaagcagagcatagtggtgctagtcataacatcctagtagaagttcaggatgatggtacaatgaaaattaaagatgaagaacgagatgacacactgacaattctacttaaggcaacgctactagctattagcggcgtctacccaatgagtataccagcaacattattcgtttggtatttttggcagaagaagaaacaaagatcgggagtactctgggacactccatcgccaccggaagtggaacgcgctgtcttggatgacggtatatatcgaatattacagagaggactcttagggaagtcacaggtgggagtgggagtcttccaggaaggagtttttcataccatgtggcatgttacaagaggtgccgtcttaatgtaccagggaaaaaggttggaaccctcgtgggcttcggttaagaaagatttgataagttacgggggaggatggaggtttcagggctcctggaacacgggcgaagaggtccaggtaatcgctgtcgaacctggcaaaaaccccaaaaacgttcaaacagcacctgggacatttaaaacaccagagggggaagtaggggcgatagcactcgacttcaaacctggaacctcagggagtcctatagttaatcgtgaaggtaagattgtcggactatacggaaatggtgtagttaccacttcagggacttatgtttccgcaatcgctcaggccaaggcttcacaagaaggtccattaccggaaatagaagacgaagttttccgtaaaagaaacttaactataatggatttgcatcctggcagcggtaaaacaagacgttatctacctgccatcgtgagagaggcgataaaaagaaaacttagaacccttgtactcgcacctacaagagtagtagcctcagaaatggccgaggcgttaaaaggtatccctataagatatcaaacaacagctgtcaaatcagagcatacaggtaaagaaattgtagatttaatgtgccatgctacgtttaccatgagactattaagtcctgtaagagtgccaaattataacatgataattatggatgaagcgcatttcactgatccggcaagcatagcggcaagaggatatatcagcactagagttggaatgggcgaggccgcggctatatttatgactgcgacaccgcctggaagtatggaggcttttcctcagagcaatgcagcaatacaagatgaagaaagagatattccagaacggtcatggaacagtggatatgattggattacagattttccaggaaagacggtttggtttgtaccgagtataaagtcggggaatgatattgctaactgcttacggaaaaatgggaaaagagtggttcaactcagtagaaaaacatttgacactgaataccagaaaactaaaaacaacgattgggattatgtagttaccacagatatctcagaaatgggcgcaaattttcgtgccgatagagttattgacccaagaaggtgcttaaaaccagtaatacttaaggacggaccagagcgtgtgattctcgcagggccaatgccggtcactgtcgcctcagcagctcaacgacgcggacgtataggtcgaaatcaaaacaaagaaggcgatcagtacatctatatggggcaacccttaaataatgatgaagaccatgcgcactggacggaagcaaaaatgttgttagacaatataaatacacctgaaggaataattccggctctatttgaaccagaacgagaaaagagcgccgccatagacggcgaataccgattaagaggtgaagcgagaaaaacatttgtagaactgatgagacgaggagatcttccagtttggctaagttataaggttgcatccgaagggttccaatatagtgatcggagatggtgttttgacggagaacgaaataaccaagttctcgaagaaaatatggacgttgaaatatggacaaaagagggcgagagaaagaaactaagaccacggtggcttgacgcaaggacctacagcgatcctttggctctaagggagtttaaggaatttgctgcaggcagaagatcagtatcaggagatttaatcctagagataggcaaattaccacaacacttaacacagagagctcaaaatgcattggataacttagtgatgttgcacaactctgaacaaggcggaaaagcgtacagacatgccatggaagaactaccggatacaattgaaactctaatgttactagctctaatcgctgtcttaacgggaggggttaccctattctttctaagtgggagaggcttaggaaaaacttcaatcgggttgctttgtgtaatggcaagttctgctctgttatggatggcaagtgtcgaaccccattggattgcggcgtcaattatcctggagttctttctaatggtattattaataccagaaccagataggcaacggacgccacaggacaatcaattagcatatgttgtcataggcctgctttttatgatacttactgttgcagcgaacgaaatgggattactagaaactactaagaaagatctcgggataggacatgtcgcagctgaatcccaccatcacgcagctatgttggacgtcgaccttcatccagcctccgcctggactctatatgcagttgcaactaccataatcaccccaatgatgagacacacaatagaaaacactacagccaacataagccttacagctatagctaaccaagccgcaattttgatgggtcttgacaagggatggcccatatcgaagatggatattggagtgcctcttttggctctaggttgttatagtcaagtgaatccgttaacactgactgccgcagtgctcatgcttgtagcgcactatgcaataataggtcccggattgcaagcaaaagcaacgagagaggcacaaaaacgaaccgccgctgggattatgaaaaatcctactgttgatggaatcgtagcaattgatctagatccagtagtatatgacgcaaaattcgaaaagcagttaggccaaattatgttattaatattatgtacaagtcagatactcctaatgcgtacaacatgggcactatgtgaaagtatcacactcgctacgggtccgttgactactctttgggagggttcccctggaaaattctggaacacaacgatcgctgtgagtatggctaatatttttagaggctcttacctcgcaggagctggcttagcatttagcctcatgaaatctttgggtggtggacgccgcggtactggggcacaaggagagacactaggggaaaagtggaaacgccaattgaaccagttgagtaaatcagagtttaacacctataagagatcaggcatcatcgaagtcgataggtcggaagcaaaagagggtctcaagagaggagaaacaactaaacacgcagtatctcgaggaacagctaaactacgttggtttgtagaacgaaacctggttaaaccagaaggtaaagtaattgacctggggtgtggcagaggaggttggtcctattattgtgcaggcttaaagaaggtaaccgaggtaaagggctatacgaagggcggtcccggacatgaggaacccataccaatggcgacctacggttggaatttagtaaagttatatagtggaaaagacgtcttctttactccacctgaaaaatgcgatactttactttgtgacataggggagtctagcccaaaccccactatcgaagaagggagaacactcagagtactgaggatggttgagccttggctcaggggaaatcaattctgcattaaagtattaaacccatacatgccgtctgtagtagaaaccttagaacagatgcaaagaaaacatgggggtatgctagttagaaatccactgtctcgaaattctacacatgaaatgtattgggtgtcgtgcggtactggcaatattgtctcagcagtcaatatgacaagtaggatgttgcttaatcgatttacgatggctcaccgaaaaccaacatatgaacgagacgtagatctaggagcaggaacacggcatgtcgcagttgaacccgaagttgcgaacctagatatcattggacagcgtatagagaatatcaaaaatgaacataagagcacttggcattacgatgaagacaacccttataaaacctgggcttaccacggctcttacgaagtgaaaccaagcggcagtgcctcgtctatggtcaatggggttgttaggctactaacaaaaccctgggatgtaatacccatggtaacgcagatagcgatgactgatactacacctttcggacaacagcgggtcttcaaagaaaaagttgacacgcgcactccaaaagccaaaaggggaaccgctcaaatcatggaagtaacagctagatggttatggggattcctttcaagaaacaagaagcctcgcatttgtaccagagaagaatttacgagaaaagtacgatcgaatgccgctataggcgcagtctttgttgatgagaatcagtggaactcagccaaggaagctgtagaagacgaacggttttgggacctagtccatcgagaaagagaacttcacaaacaggggaaatgtgcgacatgtgtctataacatgatgggcaaacgagaaaagaaattaggagaatttgggaaggccaaaggatcacgtgcgatctggtacatgtggctaggcgcaaggtttcttgaatttgaagccctcggttttatgaatgaagatcattggttcagtcgagaaaatagtctatccggtgtagaaggagaggggctccataaactaggttacatattaagagatatcagtaaaataccgggagggaatatgtatgctgatgatactgcaggatgggatacgaggataacggaagatgacttacagaacgaggctaagattactgatatcatggaaccagaacacgctttgctcgcaacctcaattttcaaattgacatatcagaacaaggtggtaagggtccaacgcccggcaaagaacggtacagtaatggacgtaataagccgacgagatcagagaggatcaggtcaagtaggtacgtatggtctaaatacattcactaatatggaagctcaattaattagacaaatggaaagtgaagggatattccttccctcagaactggaaacccctaaccttgctgaaagagtattagattggcttgaaaagtacggtatagaacgactaaaacgaatggctataagtggagacgactgtgttgttaaacctatagatgacaggtttgcaacagcactaacggctcttaacgacatgggtaaagtgagaaaggacattccacaatgggaacccagtaaaggatggaacgattggcaacaggttcctttttgcagtcaccactttcatcaactgataatgaaagatggacgtgaaattgtagttccatgcagaaaccaagatgagctagttggacgagcaagagtctcgcaaggcgcgggatggagtttgagggaaaccgcatgtttagggaaaagttacgcacagatgtggcaacttatgtattttcatcgaagagatttgaggttggcagcgaacgcaatctgtagtgcagtacccgtcgattgggttccgacatctaggacgacatggtctatccacgctcatcaccaatggatgaccactgaggacatgctaagtgtatggaatcgtgtttggatcgaggaaaatccatggatggaagacaagacacatgtaagttcatgggaagatgtaccttacctgggaaaaagggaggatcaatggtgtgggtcgcttataggtttaacagcacgggccacttgggccacaaacattcaagtagcaatcaaccaggtcagaagactaatcgggaacgagaattatttagactacatgacttcaatgaaacgattcaagaatgaaagcgaccctgagggcgcgctttggtga

SEQ ID NO: 22026 - RNA, 9879 nt, synthetic construct
  misc_feature 1..9879: note = derived and/or modified CDS sequence (opt6) from DENV-1__KJ438293__SS-prME
  source 1..9879: mol_type = other RNA
agcgttacaatgttacttatgctcatgcccaccgctctcgcatttcatctcacaacaagaggaggggaaccccatatgattgtctccaaacaagaaagaggaaaatcattattattcaaaactagcgcgggagtcaatatgtgtacattaatagccatggatcttggggaactatgcgaagatacaatgacgtataaatgcccaagaattacagaagccgaacccgacgacgttgattgctggtgtaatgcaactgatacatgggtcacatacggtacttgtagtcagacaggagagcatagaagagataaaagatctgtcgctctagctccacacgtgggattgggactagaaacacgtacagaaacatggatgtcttctgaaggcgcatggaaacaaattcagcgtgtggaaacatgggccttgaggcacccaggattcacagtaatagcgttatttttagcccatgctatcggaacatctatcactcagaaaggtataatttttatcctcttaatgcttgttacaccaagtatggccatgagatgcgtagggatagggtcccgagactttgtggaaggattaagcggagccacttgggtcgatgtcgtattggagcatggaagttgtgtgaccactatggctaaagataaacccacattagatatagaattattgaaaacagaagtcaccaacccagccatattacgtaaactatgcatcgaagcgaaaatatcaaatacaacaaccgatagtcgttgtcccacccagggagaagctacacttgtcgaagaacaagatgctaacttcgtatgtcgacggaccttcgttgatagaggatggggaaacggctgtggactattcggaaaaggttcactcatgacgtgtgcaaaatttaaatgtgtaacaaaactggaaggaaaaattgtgcaatacgagaatctcaaatattcggtaattgtgacagtacatacgggcgatcaacaccaagtaggtaatgaatcaaccgaacatggtacaactgcaaccatcacaccgcaggctccgaccacggaaatacaactcacagattacggcgccttaacactagattgttcccctcgcaccggcctagatttcaatgaaatggttttgcttaccatgaaggagaaatcatggctagttcacaaacaatggttcttagatctacccctcccctggacctcaggagcaagcacatctcaggaaacgtggaatcgacaggatttactggttactttcaagactgcccatgccaagaaacaagaggtcgttgttttggggagtcaggaaggtgcgatgcatacagcgctaaccggagccaccgagatccagactagcggaacgacgacgatctttgctggacacctaaaatgtagacttaaaatggacaaactaactttaaaaggaatgagctacgtgatgtgcacaggaagttttaaacttgaaaaggaggtcgcagaaactcaacatggaactgtcttagtacaaattaagtatgaaggcacggacgctccttgtaaaatacctttttcaacacaagatgagaaaggtgtcacgcagaacggacgactaattacagcgaatccaatagtgacagacaaagagaaaccggtcaacatagaagctgaaccaccatttggagaaagctacatagttattggcgccggtgaaaaagcattaaagattagctggtttaagaagggaagttcaataggaaagatgtttgaggcaacggctagaggagcaagaagaatggcaatattaggtgacacggcatgggactttggatccataggaggcgtattcacatccgtaggcaagttagtccatcaaatttttggtacagcatatggagtcttattctccggagtcagctggactatgaaaatcggaataggagtactcttaacatggttaggcttaaattcaaggagtacctcattaagtatgacgtgtatagctgttggcttagtaaccctataccttggagttatggtgcaagcggacagtgggtgtgttataaactggaaagggcgggaactcaaatgtggcagcggcatctttgtaactaacgaggtgcatacttggactgagcagtacaaattccaagcggattcgcctaaacgtctctcggctgcaataggaaaggcttgggaagaaggggtttgtggcattcgaagtgccacaaggcttgaaaatatcatgtggaaacaaatctctaatgagctcaatcatattttgcttgaaaatgatatgaaattcacagtagtggtgggagacgtggccggaatattagcacaaggcaagaaaatgataagaccgcaaccaatggaatataaatattcatggaaaagctgggggaaggcaaaaataattggcgcagacgttcaaaatactacatttataattgacggccccaacacccccgaatgtcctgatgaccagcgcgcatggaatatctgggaagtcgaggattacggatttggcattttcactaccaatatttggttaaaacttagggattcatatacacaagtctgtgatcatcgcttaatgtcggcagcaataaaagactccaaagccgtgcacgcagatatggggtactggatcgaaagcgagaaaaatgaaacttggaaattggccagagcgtcatttatagaagtcaaaacttgcatttggcccaaatcacatactctatggagtaatggggttctcgaaagtgaaatgataataccaaaaatatatggcggacccatttcacaacacaattatagaccaggatattttacgcaaacggcgggcccatggcacctcgggaaactagagttggactttgatctatgcgaaggtactacagtagtagtcgatgagcattgcggtaataggggaccatcgctacgaacaaccactgtcactggaaaaattattcacgaatggtgttgtagaagttgcacgttacccccattacggttcagaggagaggacggctgctggtatggcatggaaattagacccgtaaaggagaaagaggaaaacttagtaaagagtatggtgtcagcaggaagtggcgaggtagacagcttctcattaggcttgctatgcataagtataatgatagaagaagtaatgcgctcaaggtggtcaaggaagatgcttatgacagggactctagcagtgtttttccttctgatcatgggccaactaacctggaatgacttaatccgattatgtattatggttggagcaaatgcaagtgacagaatgggaatgggtactacttacttagcattaatggcaaccttcaaaatgcggccaatgtttgctgttgggctgttattcagaaggttaactagcagagaagtattactattaaccattggactatcgctggtagctagcgtggaattacccaactctctggaagaactcggagacggactcgcaatgggtatcatgattctcaaattattaacaggatttcaatcccatcaactgtgggcaacgctcttgtctcttacattcattaagacaactttttcattacattatgcatggaaaacaatggccatggttttatctatcgtatcactgttccccttgtgtctgtcaacgacttcacagaagaccacatggctacctgtactcctaggttcgctcgggtgtaaaccattgacaatgttcttaataacagaaaacaagatatggggtagaaaatcttggccactaaacgaaggcataatggcagtgggaattgtctccatacttttaagctcattactaaagaatgacgtacccctagccggacccttaatagcgggaggaatgctaattgcatgctatgtcatatcgggaagttctgcagatctgtcactggaaaaagcagcagaagtcagctgggaagaggaggcggaacattccggagcgtcccacaacattttagtagaggttcaagatgatgggacaatgaaaataaaagacgaggaaagggacgatacattaactatattgttaaaagcaaccttattagccgttagcggagtttatccactaagcatccccgcaacactttttgtgtggtacttctggcagaaaaagaaacaacgttcaggcgtactttgggataccccaagccctccggaggtagaaagagccgtcctagacgatggaatatacagaatcatgcaaagaggccttttaggtagatcacaagtgggcgtaggcgtcttccaagaaaacgtattccatacaatgtggcacgtcacgaggggcgcggttctaatgtatcaagggaagagactagaaccatcgtgggcatctgtcaagaaagacttaatctcatacggcggtggttggagacttcagggttcatggaatactggcgaagaagtgcaagttatagctgtagaacccggtaaaaatcccaaaaacgttcaaacagctccaggaacctttaaaaccccagagggcgaagtaggcgccattgcactagattttaaaccaggaacatcaggaagtcccattgtgaatcgcgaaggtaagatagtaggtttgtatggtaacggtgtagttacgacaagtggaacgtacgtatccgcgattgcacaagctaaagctagccaagaaggtccactcccagaaattgaagatgaagtatttagaaaaagaaacctgactataatggacctacacccaggttccggaaaaaccagaagatacttaccagcaatagtaagggaagcaattaagagaaaattaagaacattaatattggccccaacaagagtagtggcatcagaaatggcagaggccttgaagggtatgccaatccgataccaaacaaccgcagtaaagtcagaacataccggcaaggagatagtcgatctaatgtgccacgcgacttttacaatgagactacttagtccagtacgagtgccaaactacaatatgataatcatggacgaagcccattttaccgatccctcgagcatagctgccagaggttacatcagcaccagggtgggtatgggagaagccgccgcaatattcatgacagcaaccccgccaggatctgttgaagcatttccccaaagtaacgccgttatacaagacgaagagagagacataccagaaaggtcatggaactccgggtacgattggataacagattttccaggaaagacagtatggtttgtaccatccataaaatccgggaatgatatagcaaattgcttaaggaaaaatggcaagcgtgtgatccaattatccagaaagacgtttgatacagaataccagaaaaccaaaaacaatgattgggattatgtagtaacgacagacatcagtgagatgggagctaacttcagagccgacagagtaattgaccccagaagatgtttgaagccggtcatcctgaaagacgggcctgaaagagtggttctggctggtccgatgcctgtaaccgtagcatccgcagcccagcgtagagggcgaataggtcgaaaccacaacaaggaaggggatcaatatatctatatgggacaacctctcaacaacgatgaagaccacgctcactggacagaagctaaaatgttacttgataatattaacacaccggaaggaattataccagcattattcgagccagagcgcgagaaaagcgcagctatcgacggcgaatatcgcctcagaggagaagcgcgcaaaacattcgtagaactaatgcggaggggagatctccccgtgtggctaagttataaggtggcaagtgaaggatttcaatactcagatcggagatggtgttttgacggagaaaggaataatcaagtgttagaagaaaacatggacgtcgagatatggactaaggagggagaaaggaagaaattaagacccaggtggctcgacgcgcgaacttactctgacccactagccctaagagaatttaaagaatttgcagccggcagacgaagtgtcagtggagacctaatattagaaattggcaaactgccccaacacctaacacaaagagcacagaatgctctagacaacttagtgatgttacataatagcgagcagggaggtcgcgcctatagacacgctatggaggaattaccggatacgatagagaccctaatgctacttgcgctaattgctgtactaaccggaggagtaaccttattcttcttaagtggtcgagggttgggtaaaacatcgattggattactatgtgtaatggcttcttccgtactcctatggatcgcttctgtcgaacctcattggatagcagccagtataatcctagagttcttcctaatggtcctgttaatacctgaaccggaccgccaaagaacaccccaagacaatcagcttgcttacgtcgtaattggattattattcatgatattgacggttgcagcaaacgagatgggtctactagaaacaacgaagaaagatctcggcataggtcatgtagcagtagaaaaccaccatcacgccgcaatcctggatgtagatttacacccagcttcagcatggacgctgtatgcagtggctaccactataatcactcccatgatgagacatactatagaaaacaccacagcaaacatatcacttaccgcaatagcaaatcaagcagccatactcatgggtttggataaaggatggccaattagcaaaatggatattggagtacccttattagcattaggctgttatagtcaggtgaaccccctaacgctaacggctgcagtattaatgctcgtcgcacactacgcaattataggtccaggactgcaagctaaggcaactcgggaggctcaaaaacgaacggcagcgggaataatgaagaacccaaccgtagatggaattgtggctattgatttagatcctgttgtgtatgatgcaaaatttgaaaaacagttaggtcaaataatgctattgatcttatgtacgagtcaaatacttttaatgcgaacaacctgggccttgtgtgagtcaataaccttagctaccgggccgctaacaacactgtgggaaggatcgcccggaaagttttggaataccacaattgccgtatcaatggcaaatatatttagaggctcatacctagcgggtgcagggctagcattttcattaatgaaaagtctaggtggtgggagaagaggcacaggagcacaaggagaaaccctaggagaaaaatggaaacggcaacttaaccagttaagcaagagtgaatttaatacttacaaacgatcaggaataatggaagtagacagatctgaagctaaagaaggtttaaaacgaggagaaacgacaaagcatgcagtcagcagaggcacagcaaagctaaggtggtttgtagagagaaaccttgtgaaacccgagggaaaagtcattgatttaggttgtggtcggggtggatggtcttattattgcgctggcctcaaaaaggtcactgaggtgaaagggtacacaaaaggtggaccagggcacgaagaacctatacctatggccacctatggatggaatttggtaaaactgtactctggaaaggacgttttcttcatacctcccgaaaaatgcgataccttactatgtgatataggtgaatcatcacctaacccaacaatcgaggaaggaagaacattgcgagtcttaaaaatggttgaaccatggctacgggggaaccagttttgcattaagatacttaatccatatatgccaagtgtcgtagaaacactggaacaaatgcaaagaaagcatggaggtatgttggttaggaacccactatcacgaaactcaactcacgagatgtactggataagttgtgggacaggtaacatcgtatcagctgtgaatatgaccagtcgtatgctcctaaaccgattcactatggcgcatagaaagcctacatatgagagagacgttgatctcggcgcaggtacaaggcatgtagccgtggaaccggaagtcgcgaatctggatataataggccaaaggattgaaaacataaagcatgaacacaagtcaacatggcattatgatgaagataacccgtataaaacatgggcatatcacggatcgtacgaagtgaagccaagcggctcagcaagttcaatggtgaacggagtcgtgaaacttcttactaaaccatgggatgtcatccctatggtgactcagatagctatgacagacactacacctttcggacaacaacgtgtattcaaggaaaaagtggacactaggaccccaaaggcaaaacggggcaccgctcaaattatggaggtaacagcccgatggctatggggctttttaagtagaaataagaagcccaggatttgtacacgagaagaatttaccagaaaagtaagaagcaatgccgctatcggagcagtatttgtagatgaaaaccaatggaactcggcaaaagaagcagttgaagatgagagattctgggatctggttcatagagaaagagagcttcataaacaaggcaaatgcgcaacctgtgtctataatatgatgggtaaaagagagaagaaattgggggagttcggcaaggctaagggatccagggctatttggtatatgtggttgggcgcgcgattcttggaatttgaggctttggggttcatgaacgaagaccactggttctctcgtgaaaattctttatctggtgtagagggggaaggattacacaaacttggatatatattacgcgatataagtaagatacctggaggtaatatgtacgctgatgacacagcagggtgggataccagaataacagaggatgatttgcagaacgaagctaaaatcacggatataatggagcctgaacacgctctgctggctaaagctatctttaaactcacctaccaaaacaaagtagtcagagtacagcgtccagcgaaaaacggtacagtcatggatgtaatttctagacgagatcaaagaggatccggacaagtaggaacctatgggctcaatacatttacaaacatggaagctcaattgattaggcagatggagtctgaaggaatttttagtccatcagaacttgaaactcccaatttagctgaaagagtcttagattggctagaaaaatacggagtcgaaaggttgaaacgaatggcaataagcggagatgattgcgtggtaaaaccgatagatgaccggtttgccactgcattaacagcgctcaacgacatggggaaagtgaggaaagatataccccaatgggaaccgagtaaaggctggaatgactggcagcaagtccccttttgcagtcatcactttcaccaattgataatgaaagatggcagagagattgtagtgccctgtagaaatcaagacgagttagtaggtagagcacgtgtttctcaaggtgcgggttggtcattaagggaaacagcatgcctaggtaaaagttatgcgcagatgtggcagctgatgtattttcataggcgtgatttaaggcttgcagcaaacgcaatatgctcagcagttcccgtagattgggtaccgacgtcacgaacgacgtggtcaatacatgctcatcatcagtggatgactactgaagatatgttaagtgtttggaaccgagtttggattgaagaaaatccatggatggaggataaaactcacatatcaagttgggaagatgtgccatatctaggcaaacgagaagatcaatggtgcggatcactaataggcctgactgctagagccacgtgggcgaccaacattcaagtggcaatcaatcaagtacgacgtctgataggtaacgagaactatttggactatatgacaagtatgaaaagattcaagaatgaatcagaccccgaaggtgctttatggtaa

SEQ ID NO: 22027 - RNA, 9879 nt, synthetic construct
  misc_feature 1..9879: note = derived and/or modified CDS sequence (opt6) from DENV-1__KJ438296__SS-prME
  source 1..9879: mol_type = other RNA
agcgtcacgatgctattaatgctgatgcctacagccctagcctttcacttaacaacaagaggaggcgaaccacatatgatggtcagtaaacaagaaagaggaaaatctctactctttaaaacttcggctggagttaatatgtgtacactgatcgctatggatcttggtgaattatgtgaagacacaatgacttataaatgtccaagaataaccgaagctgagcccgacgacgtggattgttggtgtaatgctacagatacctgggttacctacggtacatgttcacaaaccggtgaacatcgacgagataaacggtctgtcgcgcttgcaccacatgtaggtctaggattggaaacacggacagaaacatggatgagtagtgaaggtgcatggaaacaaatccaacgggtagaaacgtgggcgctcagacatccaggattcacagtaatagcacttttcctagcgcatgctatcggtacatctataactcagaaaggtatcattttcattttactaatgttagtcaccccgtccatggcgatgagatgcgtaggtatcggaagccgagatttcgttgaaggtttatcaggggccacatgggttgatgttgtcctcgaacatggatcatgcgtaactactatggcaaaagataaacctacacttgacatagaactacttaaaactgaagttacaaatccagccgtattacgtaaattatgcatagaagcaaaaatctcaaacacaacaacggactctagatgcccaacgcagggagaagcgacacttgtagaagaacaagatgccaacttcgtatgcagacggacattcgttgatcgaggatggggtaacggctgtgggctgttcggtaaagggtctttaataacgtgcgccaaatttaaatgtgtaactaaacttgaaggcaaaattgtacaatatgaaaatctaaaatactctgttatagtgacagtgcacactggggaccagcaccaagttggaaatgaaagtacggagcacggtacaacagccactatcacgccacaggcaccaacaacagaaattcaactaaccgattacggagctctgacattggattgctcaccgagaacgggattagattttaatgaaatggttctacttacgatgaaagagaaaagttggctggtccacaaacaatggttcctggacctacccctcccatggacttccggagcatcgacctcacaagagacctggaataggcaggatcttttagtaacattcaaaacggctcatgctaagaaacaggaagtcgtagtattaggtagccaagagggagcgatgcatacagctttaaccggagctacggagatacaaacctcgggaactaccacaatttttgcaggacacttgaaatgtcgattaaaaatggataaactgaccttgaaaggaatgtcctatgtaatgtgcaccggctcgtttaagctggaaaaagaagtagcagaaacacagcacggaacagtgttagtccagataaaatacgagggtacggacgcaccatgtaagataccgttttcaacacaagacgaaaagggcgtgacacaaaacgggcgattaataactgccaatccaatagtaactgataaagaaaaacctgtaaatatcgaagctgaaccaccctttggcgagtcatatatagtcattggagctggtgagaaagcattaaaactatcttggttcaagaaaggttcatcaatcgggaaaatgtttgaggcaactgctaggggagctagaaggatggctatattaggagatacagcctgggatttcgggtcgataggtggtgtgtttaccagcgtaggtaaattagtccaccaaatatttggaacagcatacggtgtactatttagtggcgttagctggacaatgaagattggaataggggttctattaacttggttaggtctcaatagtcgatcaaccagcctctcgatgacctgcattgccgttggcctagtaacgttatatttaggggtaatggtccaagctgattcaggatgcgtgataaattggaagggaagggaactaaaatgcggttcaggaattttcgttacaaacgaagtacacacatggacagaacaatataaattccaggccgactcccccaagcgactttctgcagcaattggtaaagcatgggaagaaggggtctgtggaatacgctcggcgacaagacttgaaaacattatgtggaaacagatctctaatgaacttaatcatatattactcgaaaacgacatgaaatttactgtcgtcgtgggtgatgtagctggaatacttgcacagggcaagaaaatgataagacctcaaccaatggaatataaatattcatggaagtcatggggaaaagccaaaataataggtgctgacgtacaaaacaccactttcattatagatggaccaaatacaccagaatgtccagatgatcaacgagcgtggaacatttgggaggtcgaagactacgggttcggcatttttactactaatatatggttaaagctaagagacagttatacgcaagtctgtgatcacagattgatgtcggccgctataaaagactcaaaggcagtacacgccgatatgggatattggatcgaaagtgagaaaaacgagacatggaaactagctcgagcttcattcatcgaagtaaaaacttgcatatggcccaaatcgcatacactttggtcaaatggggttctcgaaagtgagatgattatccccaaaatctatggaggtcctatcagccaacataactacagaccagggtatttcacgcaaacagcgggaccctggcacttaggtaaacttgaactggacttcgatctctgtgaaggtacaaccgtggtagtagacgagcattgtggtaataggggcccttcacttcgaactactactgtcacggggaagattattcatgaatggtgctgccgtagttgcaccctaccgcctctaagatttcgtggcgaggacggatgttggtacggaatggaaattagacctgtaaaagaaaaggaagaaaacttggtaaagtccatggtttcagcaggctcaggagaggtggatagctttagtttaggtctcttatgtatatctataatgatagaggaagtaatgcgatcacgatggagtagaaagatgttgatgattgggacgttggcagtattctttttgttaattatgggtcaactgacatggaatgacttaattagattgtgtataatggttggcgctaacgcaagtgaccgaatgggaatgggcacaacgtacttagcattaatggcgacttttaaaatgagacccatgtttgcagtcggactactgtttaggagactaaccagtagagaagtcctcctgcttactattggattatcgctcgtagcgagcgcagaattgccaaattcactagaagaattaggggatggactagctatggggataatgatcctaaaattactgacagactttcagtcccatcaattatgggcaactctcttatctttaactttcattaaaactaccttcagtttacactacgcatggaagactatggcgatggttttaagcatagtctccttaatacctctgtgtctttcaacgacttcacagaaaacaacatggttgccagtgttactagggagtctaggttgtaaacctctaacgatgtttctaatagcagaaaacaaaatttggggtaggaagtcgtggccattgaacgaaggtatcatggcggttggtatcgtctcaatactacttagttctttgttgaaaaatgacgttcctcttgcaggtccgttaatagctggtggcatgcttatcgcttgttatgtaattagtggctcaagcgccgacttatctttggaaaaagcagcggaagtcagttgggaagaggaagctgagcatagcggtgcaagccacaacattttagtggaagttcaagacgatggcaccatgaagataaaagatgaggagcgggacgatactttaaccatactccttaaagcaacactactagcagtatctggtgtttttcctctctcaataccggctacattgtttgtttggtacttttggcaaaagaagaaacaaagatcgggagttttgtgggatacaccctccccaccggaggtcgaacgtgcagttctggacgatggtatttatagaattatgcaaagaggactgctaggaaggtcacaagtcggagtgggagtttttcaggaaaatgtttttcatacgatgtggcacgtaacgcgaggcgctgttctgatgtatcagggaaaacgattagaacccagctgggcaagtgtaaagaaagaccttattagctacggcggtggatggaggcttcagggatcgtggaatacaggagaagaggttcaggtaattgcagtagaacccggtaaaaatcctaagaacgtccaaacagcaccgggaacttttaaaacgcccgaaggagaagtaggtgccatcgctttagatttcaaaccaggcaccagcggctccccgatagtgaacagggaaggtaagatagttggactttatggcaatggagtcgttactaccagcgggacatatgtttctgcaatcgcccaagcgaaggcatcccaagaggggccattaccagaaattgaagatgaagtgtttagaaagcgaaatttaactataatggacttacaccctggatcaggaaaaacaaggagatacttacctgctattgtgcgtgaagccattaaacgcaagctacgaaccttgatcctagcaccgacacgggttgttgcatctgaaatggcagaagcacttaaaggcatgccaatacgataccaaacaacagcggttaagagtgaacatacaggtaaagagatagttgacctcatgtgccatgcaacttttacaatgcgcttattaagtccagttcgggtacctaactacaacatgattatcatggacgaagctcacttcaccgaccccagctcaatcgcagcgagagggtatataagtaccagagttggaatgggggaagctgctgcaattttcatgacagcaacaccaccaggcagcgtcgaggcattccctcaatccaatgcagtcattcaagatgaagaacgagatatacctgaaagaagctggaatagcggatatgaatggataacagatttccccggcaaaacagtttggtttgtcccttcaattaaatcaggcaatgatattgcaaactgcctccgtaaaaacggtaaacgggtcatacaactaagtagaaagacctttgatactgagtatcagaaaaccaaaaacaatgattgggactacgtggtgacaacagatatatcggagatgggtgcaaatttcagggctgaccgagtgatcgatccaagacgatgcctaaagcctgtcatacttaaggatggacctgaaagagtgatcttggcaggtccgatgcctgtgactgttgcatcagctgctcaaagaagagggaggatcgggaggaaccataataaagaaggggaccaatacatttatatgggacagccactgaataatgatgaagaccatgctcactggacagaagcgaaaatgctactagacaatataaacactccggagggaataataccagctctttttgaacctgaaagggaaaaatcagcagcgattgacggtgagtacaggcttaggggcgaagctcggaaaacatttgtagaacttatgaggagaggtgacctacccgtctggttatcctacaaagttgctagcgaggggtttcaatattcggatcgtcgttggtgttttgatggtgaaagaaataaccaagttttagaagagaacatggatgttgaaatatggacaaaagagggagaaaggaagaaactacgaccgcgctggctagacgcgcgtacttactcagatccgttagccctaagagagttcaaggaatttgcagctggaaggcgttcagtatctggtgatcttatcctagaaataggaaaactaccacagcacttaacccaaagggctcaaaatgccttggataatttggtaatgctccacaatagtgaacaaggaggtcgagcatacagacacgctatggaagaactcccggatacaatagaaaccctaatgttattggcactgatcgctgtattaactggaggagttacccttttctttttatcaggacgaggattagggaaaacgtcaataggactgttatgtgtaatggctagtagcgtccttctttggatggcgtctgtagaaccacattggatagcagccagtataattttggagttctttctaatggtactattgatcccggaacctgaccgacaaagaaccccacaggataatcaattagcgtatgtagtgataggattgctattcatgatactgaccgtcgccgcaaacgaaatgggcctattagaaacaaccaagaaagatcttgggataggtcacgtggcagttgaaaatcatcatcatgcagcaatgctagatgtagacctacaccccgcaagcgcgtggacattatacgcagtcgcaactactataataacacctatgatgagacatacaatagaaaacacaaccgccaatatatcattaacagctattgcaaatcaagccgctatattaatgggattagataagggttggcccatcagcaagatggacattggtgtccctctcctagcattaggatgctatagtcaagtcaacccccttacgctaactgcagctgttttaatgttggtcgcgcattatgcaataataggacctggactacaagctaaagcaactcgagaagcacagaaaagaactgcggcagggataatgaaaaatcccacagtagatgggatagtcgcaatagatctagatcctgtcgtctatgacgcaaaatttgaaaaacaactcggacagataatgctgctaatattatgtacttcacagattctgttgatgcgtaccacttgggctttatgtgaatctataacattagccacaggcccacttaccactttatgggaaggctcacccggtaagttctggaatacaaccatagccgtttctatggctaacatatttaggggtagttatttagcgggtgccgggttagcattttcactaatgaaatcactaggaggtggaagaagggggacgggggcacaaggtgagactttaggtgaaaagtggaagagaagactaaatcaacttagcaaaagtgaatttaacacttacaagcggtccgggatcatggaagtagaccgatccgaagcaaaagaaggattaaaacgtggagagactactaaacacgcagtctcgagaggaacagcgaaattacgttggtttgtagaacgtaaccttgtaaagccggaaggcaaggtaatagatctaggttgtggacgtggcggatggtcctattactgcgcaggtttgaagaaagtgaccgaagttaaaggttatactaaaggtggaccaggacacgaagaacctattccaatggctacttatggatggaatctagtaaaattacactcgggtaaagacgtattctttataccacctgaaaaatgcgatacacttctttgcgacattggagaaagtagtccgaatccaacaatcgaagaagggagaacattaagagtattaaaaatggtcgaaccatggttaagaggtaaccaattctgtataaagattttaaatccatacatgcctagtgtggttgaaactctagagcaaatgcaacgaaaacatggcggaatgttagttcgtaatcctctatcgcgcaattcaacacacgaaatgtattgggtttcctgtggtacaggtaacatagttagtgcagtaaatatgacttcacgaatgttattgaatcgattcacaatggcgcacagaaaaccgacttacgagagagatgtagacttaggcgcaggtacaagacacgtagctgtagagcctgaagttgcaaatctcgatataattggtcaacgaatagaaaatattaagcatgaacacaaatccacgtggcactatgatgaagataatccttataaaacctgggcttaccatggctcctacgaagtaaaaccgagcggaagtgcttcaagcatggtcaatggcgttgtaaaattactaacaaaaccctgggacgttatcccaatggtaacccaaattgccatgacagacacaacaccgtttggccaacaaagagtatttaaagagaaagtagacacaaggacccctaaagcgaaacgcggaaccgcccaaattatggaagtcaccgcgagatggttgtgggggtttctctctcgcaataagaaaccgagaatttgtacgagagaagaatttactcgtaaagtaagatcaaatgccgctataggtgcagtattcatagatgaaaatcaatggaactctgcaaaagaagccgttgaggatgagagattctgggatcttgttcacagagaaagggaattacataaacaaggaaaatgtgcaacgtgtgtatataacatgatggggaagagggagaagaaattaggagagttcggaaaagcaaaaggatccagagcgatatggtacatgtggctaggagccaggtttcttgagttcgaggctttaggtttcatgaacgaagaccactggttttccagagaaaattcattaagcggtgtagaaggtgaaggactgcacaagttgggttatatactcagggatatttcgaaaattccagggggtaacatgtatgcagatgatactgctggttgggatacgaggataacagaggatgacctacaaaatgaagctaaaataactgatataatggaaccagaacatgcactattagcaaaagctatattcaagctaacatatcaaaataaagttgtacgggtacagcgcccagccaagaacggaactgtaatggatgtgatatcccgaagagatcaaagaggttcaggtcaggtaggaacttacggtttaaatacttttacaaatatggaagcgcaacttataagacaaatggagagcgaagggattttcagcccatccgaattagaaacacctaacttagcagaacgggtactggactggttaggcaaatatggcgttgaaagactaaaaaggatggccattagcggtgatgattgcgtcgtaaagccaattgatgatagatttgcaactgctctaacagcgttgaatgacatgggaaaagtccgcaaggatataccacaatgggaaccatcaaaaggttggaacgattggcaacaagtccctttctgctcacatcacttccatcaactaataatgaaggatggcagagaaattgttgtaccgtgtagaaaccaagacgaattagtaggtagggccagggtttcacaaggtgctggatggtccttgcgtgagaccgcttgcctaggaaaaagctatgcccaaatgtggcaattaatgtattttcaccgtagagatctaagattagctgcaaacgcaatatgtagcgctgttcctgtcgattgggtaccaacgagccgaacgacctggtcaattcacgcgcatcatcaatggatgactacagaagacatgttgtccgtttggaacagggtgtggatcgaggagaacccatggatggaagacaagacacatatatccaattgggaagatgtaccttatctgggaaagagagaagaccaatggtgtggaagcctaatagggcttactgcaagagcaacatgggcgactaacattcaagttgctataaaccaagttcggcgtctaataggaaatgaaaattatttagactacatgacaagcatgaaaaggtttaaaaacgaaagtgatccagaaggggcactatggtag

SEQ ID NO: 22028 - RNA, 9879 nt, synthetic construct
  misc_feature 1..9879: note = derived and/or modified CDS sequence (opt6) from DENV-1__KC692495__SS-prME
  source 1..9879: mol_type = other RNA
tctgtaacaatgttgctaatgctactgcccactgctttggcgtttcatcttacaactaggggaggtgaaccccatatgatagtgtctaaacaagaacggggaaaatccctattgttcaaaacttcggctggagttaacatgtgtactttaatagctatggatctaggagaactatgtgaagatacaatgacctacaaatgccctcgaataaccgaagcggaaccagatgatgtcgattgttggtgtaatgcaacagatacgtgggtgacgtacggaacatgttctcaaactggagaacaccgcagggagaaaagaagcgttgccttagcgccacacgtaggattaggtttagaaacccgaacggaaacatggatgtccagtgaaggagcttggaaacaaatacaacgagtagaaacgtgggccttaaggcacccaggatttacggtaatagcattcttcctcgcacacgccattggaacgtctattacacaaaaaggaattatatttattctcttaatgctagtaacgccaagtatggccatgcgttgcgttggaataggaaatcgtgactttgtagaaggattaagcggcgcaacctgggttgacgtggtgttggaacatggctcttgtgtaacaacgatggctaaaaataaaccaacacttgatatagaattgctaaaaaccgaagtaactaaccctgccgtgttgcggaaattatgtattgaagcgaaaattagtaatacaaccacagactctcggtgtcccacccagggagaagcaacgttggtggaagaacaagatgctaattttgtatgcaggagaacttttgtagataggggatgggggaatggttgtggactttttggaaaagggagcttactcacatgtgcaaaatttaaatgtgttactaaattagaaggaaaaatagtccaatatgaaaatttaaaatattctgtgattgtaacagtgcacacaggtgatcaacatcaagtgggcaatgaaaccaccgaacatggaacaatcgcaacaataactccgcaagcacccacatccgaaatacaattaactgattacggtgctctgaccttggattgtagtccgaggaccggcctagattttaatgaaatggtattattaaccatgaaagagaaaagctggttagtacacaaacaatggttcttagaccttccgctaccatggacatccggtgcatcaacctcgcaagaaacatggaatcgacaggatctattagtgacattcaaaacagcgcacgccaagaaacaggaagtggtagtgcttggctctcaagaaggtgcgatgcacactgcgttaactggcgcaacagaaatacagacatcaggtaccaccaccattttcgcaggtcacctaaaatgcagattgaaaatggacaaattaacgttaaaaggtatgagttacgtcatgtgtactggttccttcaaactcgaaaaagaggtagcggaaacacaacacggcacggtcctcgtccaagttaaatatgaaggaacggacgcaccttgtaagattcctttttctactcaagatgaaaagggagttactcaaaatggaagactcatcactgcaaatcctatagtaacagacaaagagaaaccagttaacatagaaaccgaaccaccctttggcgaaagttacatagtagtaggagctggcgaaaaggctttaaaacttagctggttcaagagaggcagttctataggtaaaatgttcgaggcaactgcaagaggtgcacggaggatggcgatactaggagatacggcttgggacttcggttccattggtggagttttcaccagtgtaggaaagctagtccaccaagtctttggaactgcctatggagtcctcttttctggggtgtcatggactatgaagatcggtattgggattctattaacgtggcttggtttaaatagtaggtcaacaagtctaagtatgacttgtatagcagttggaatggtaacattgtaccttggagtaatggtccaggcagatagtggatgcgttataaattggaaaggtagagaacttaagtgtggcagtggcatttttgtaacaaatgaggttcatacatggacagaacaatacaaattccaggcagacagtccaaaacgccttagtgcagctataggcaaggcttgggaagagggtgtatgtggtatacgctccgcaacacgactcgagaacattatgtggaaacaaatatccaatgaacttaatcatattttattagagaatgatatgaaatttactgtagtcgtgggagatgcaaatgggattctcgctcagggaaagaagatgataaggccccagcccatggagcataaatactcttggaagtcatggggaaaggcaaaaattataggtgccgatatacaaaacacaacatttattattgacggcccggacacaccagagtgtccagatggacaacgcgcatggaatatttgggaagtcgaggactatgggttcggagttttcacaactaatatctggctcaaactaagagatagttacacacaaatgtgtgaccatagactaatgagtgcagcaatcaaagatagtaaggcagtccatgcggatatgggatactggattgaaagtgagaaaaatgaaacttggaaactggcaagagcttcgtttatagaagtaaaaacttgtacatggcctaaaagtcatacactgtggtccaacggtgtactagagagcgaaatgattattccaaaaatttttggaggaccaataagtcagcacaactatcgcccgggttatttcactcaaactgctgggccttggcatttagggaaacttgaactagattttgatctgtgcgaaggaacaacagtagttgtagacgaacattgtgggaacaggggaccatctctacgaactacaaccgtaacagggaagattatacatgaatggtgctgtagatcttgcaccttacctccactcagatttagaggtgaagatgggtgttggtacggcatggagatcagacccgttaaagagaaagaggaaaacttagttcgatccatggtttcagctggctcaggggaagtggatagcttctcattgggtatactttgcgtgagtataatgattgaagaagtgatgagatcaagatggtcaaggaaaatgctcatgacggggacattagcagtctttttgttactaatcatgggacaacttacttggaatgatctcataagactatgcataatggttggggcgaacgcttcagatagaatggggatgggtactacctatctggctttaatggcgacattcaaaatgcgacccatgttcgcagtcggcttactgtttaggagattaacctcgcgcgaagtcctgcttttaacgatcggactgtccttagtagcgtcagttgaacttcctaactcattagaagaacttggagatggactagctatgggaattatgatgttgaaattattgactgaatttcagccacaccaattatggacaacattgctatccttaactttcgttaaaacaactttaagtctagactatgcatggaagacgacggcaatggtattgagtattgtttcactgttcccgttatgtctaagtacgacaagtcaaaagacaacgtggttacctgttctccttggatccttcgggtgcaaaccactcactatgtttctaataaccgagaataaaatctgggggaggaagtcgtggccacttaatgaaggcataatggcaatcggtatagtgagtattcttctatctagtttattgaaaaatgatgtacctttggcaggtccacttatagcgggtggcatgctgatcgcatgttatgtgataagcggctcatccgcagatctcagcttagagaaagcagcagaggtgagttgggaacaagaagcagagcactctggagcatcacacaacatattagtagaagtacaggacgatggaacaatgaaaataaaagacgaggagcgggacgacacattaacaattcttttgaaagctactcttctcgctgtatcaggtgtgtacccaatgagtatccctgcaacactttttgtatggtatttttggcagaagaagaaacaaagatcaggggttttatgggacacaccatcaccaccagaagtagaacgtgcagtgcttgatgacggtatatatcgcatactacaaagaggcctacttggaagatcccaagtaggagtaggagtattccaagatggagtattccatacgatgtggcacgtaactaggggagctgtgttaatgtatcaaggcaaaagacttgaaccttcatgggcatcagtaaagaaagatttaattagttacggaggtggctggaggtttcaaggcagttggaataccggagaagaagtacaagtaatagcggtagaaccagggaaaaacccgaaaaacgtgcagacgactccaggcacattcaaaacaccagagggagaagtgggagcaatagcgctggatttcaaaccaggaacgagcggttcaccaatcgtaaaccgtgaagggaagatcgtcggactatatggaaacggagtagtaacgacttcaggaacatacgtaagtgcaatagcccaagccaaagcgagtcaggaaggacctttacctgagatcgaagatgaagtattcaagaaacggaacttgacaataatggatctacatccaggttctggaaaaacaagaagatatctcccagcaatagttagggaagccattaaaagaaaactaagaactctcattttagcacctacaagggtagttgcgagcgaaatggctgaagccctaaaaggaatgccaatcagataccaaacaacagccgtaaaatctgaacatacaggcagggaaattgtagacttaatgtgtcatgcaaccttcacaatgagattactatcaccagtgagggtaccaaattacaatatgataattatggatgaagcccattttactgaccccgcttcaatagcagccagagggtacatttcaacccgagttggaatgggagaggcagcagcaatatttatgacggcaacaccaccaggatcagtagaggcttttccacaaagtaatgcagtaattcaagatgaagaaagagatattccggaacgaagctggaatagcggttatgattggataacggacttcccaggaaaaacagtatggtttgtcccaagtattaagtcaggaaatgatattgccaattgcctaagaaagaacggcaaaagagtcattcagctatcgcgtaagacatttgacaccgaataccaaaagactaaaaacaatgattgggactacgtagtaacaacagacattagcgaaatgggagcaaacttccgagcagacagagttatagacccaagacgatgtttgaaacctgtgatactgaaagatggaccagaaagagtaatccttgcagggccaatgcctgtcacggtagcttcagcagctcagaggcgtggtcgaatcggaagaaaccagaacaaagagggggaccaatacgtatatatgggacagcccttaaacaatgacgaagatcatgcacattggactgaagccaaaatgttactcgataatataaacacaccggaaggaattatcccggcattgtttgaaccggaacgtgaaaagtcagcagcgatagatggggaataccggctgagaggcgaagcaaggaaaactttcgtggaactgatgaggcgaggtgatctcccagtgtggttgagttataaggtagcatctgagggtttccaatattctgatcgacgctggtgtttcgatggtgaaagaaacaatcaagtgctagaagaaaatatggacgtagaaatatggactaaggagggagagagaaagaagctacgacctcgatggcttgacgctcgaacatattcagatcctcttgccctgagggagtttaaggaatttgccgctggtcgaagatccgtatcgggtgatctgatactagaaatcggtaagctacctcagcacttgacgctaagagctcagaatgctctagataatttagtcatgctacataatagcgagcaaggcggtaaagcctacagacatgccatggaagaactgccagatacaatcgagacactaatgctattagcattaattgcagtgttaactggcggagtgacgttattctttttatctggaaaagggctagggaaaacttctattggcctactatgtgtaacggccagctcagcactcttatggatggcatcagtagaacctcactggatagcagcgtcaatcattctagagttctttcttatggtgctgttaatcccggagcccgatcgacaaagaacaccacaagacaaccaacttgcttacgtggtaatcggcctcttgtttatgatactgacggtcgcagccaatgaaatgggtctattggaaacgacgaagaaagacttaggtatcggatatgtagctgcagaaaatcatcaacacgccactatgcttgacgttgatctccatcctgcgtccgcttggacattgtatgcagtagcaactaccgtgattactcctatgatgaggcatacaatcgaaaacaccactgcgaatataagtctaacagcgattgcgaaccaggctgccatattaatgggactagacaagggctggcctatttctaaaatggacataggcgtaccactgttagccctaggatgttacagccaagttaatcctctaacgttaacagcggctgtacttatgttagttgcacactatgccataataggaccaggactccaagcaaaagcaactcgagaagcgcagaaaaggacagccgcaggaataatgaaaaaccctactgtcgacggtattgttgctatagatcttgatcccgtagtctacgatgccaagtttgaaaagcagttaggccaaataatgctactaattctatgcacctcccaaatacttctcatgaggacaacgtgggctttgtgtgaaagcataaccttagctacaggacctttaaccacactttgggagggaagtcctggtaaattctggaatacaaccatcgcagtttctatggcaaacattttcagaggaagttatttggcgggtgctggtcttgcattttcactaatgaaaagtttaggaggcggcagaagaggtacaggtgcacaaggtgaaacattgggagaaaaatggaaacgtcaattaaatcaactttccaaatcggagtttaatacgtataagcgaagcggaataatggaagtcgacagatctgaagctaaagaaggactaaaaagaggtgaaaccacaaaacatgcggttagccggggtacagccaagttacgttggttcgttgaaaggaatcttgttaaacccgaaggtaaagtaatcgacttaggatgcggaagaggagggtggtcgtattactgcgcaggcctcaagaaagtcacagaggtaaaaggttatactaaaggtggacccggacatgaagaacccatccccatggcgacgtatggttggaacttggtcaagctacacagcggtaaagacgttttcttcatgccaccagagaaatgtgatacattactctgtgatataggggagtcgagcccaaaccccacgatcgaagaaggaagaacattgagagtacttaaaatggtagagccttggttaagaggaaatcaattttgtattaagatacttaacccgtatatgccgtcagtagtggaaaccctcgaacagatgcaaaggaaacacggcggtatgcttgttagaaatcctttgagtcgtaattctactcacgagatgtattgggtgtcttgtggaacaggtaatattgtgtcggctgttaatatgacaagtagaatgctactaaatagatttacaatggcccatagaaagccaacttatgaacgtgacgttgacttgggagcaggaacgcgacatgtggctgtcgagccagaagtagctaatctagatataatcggacaaaggattgaaaatatcaaaaatgaacataaaagtacctggcattacgatgaggacaacccatataaaacgtgggcttatcatggatcatacgaggtaaagcctagcgggagtgcatccagtatggtaaatggtgtagtacgactactgacgaagccatgggacgtcatacccatggtaactcaaatagccatgacagacaccactcccttcggccaacaacgtgtatttaaagaaaaagtagatacacgaactccccgtgcgaaacgagggactacgcaaataatggaagtcacagcaaagtggctctgggggttcctgagtagaaacaagaaaccacgaatatgcactagggaagagttcactagaaaggtaagatctaatgccgctatcggagctgtttttgtagatgagaaccaatggaatagtgccaaagaagcagtcgaagacgaacgattttgggatcttgtacatcgagaacgggagctacacaaacaaggaaaatgcgcaacatgcgtatacaatatgatgggtaaaagagagaaaaagttaggagagttcggaaaagccaaaggaagtagggctatctggtatatgtggttgggtgcaaggttcctggagttcgaagcattaggtttcatgaatgaagatcactggttttcgcgtgaaaactcgttatcaggcgtcgaaggggaaggactacacaaattgggctacattttaagagatatatctaagatcccgggaggaaatatgtatgctgacgacaccgccggttgggacacgagaataacggaagacgacctacagaacgaagcaaaaatcaccgacattatggagccagaacacgctttacttgctacgagcatattcaaacttacatatcagaataaagtggtgcgagtccaaagaccagctaaaaatggaactgttatggatgtaataagccgaagggatcaacgtggcagcggacaagtcggaacttatggcttaaatacgttcacgaatatggaagtacagttgattagacaaatggagtcagaaggaatttttctgcctagcgagttagaaacgcccaatctagccgaaagagctctggattggctggagaaacacggagcggaaagactaaaaagaatggcgatttctggtgacgactgtgttgttaaacctattgacgatagattcgcaacagcgttaaccgcacttaacgacatgggaaaggtccgtaaagacattccacaatgggagccatctaaaggttggaatgactggcaacaggtaccattttgcagccaccattttcatcaattgataatgaaagacggaagggaaattgtagtaccatgtagaaaccaagatgaactcgtaggcagagcgcgagtatcacaaggagcaggttggtcactcagggaaacagcttgtttaggcaaatcatatgctcagatgtggcagctcatgtattttcaccggcgagatctgcgtttagctgccaatgctatttgctcagctgtaccggtagattgggtaccagcttccagaactacctggagcatacatgctcaccatcaatggatgacaacagaagacatgctttcagtatggaatagagtatggattgaggaaaacccatggatggaagacaaaacacatgtgagttcgtgggaagaggtcccatacctgggcaagagagaagatcagtggtgcggctccttaattggcttaacagctcgggcaacctgggctaccaacatccaagtggcaataaaccaagtacgcaggttaattggaaatgaaaactatttggactatatgacatcaatgaaaaggtttaaaaacgaatccgaccccgaaggcgccctatggtag

SEQ ID NO: 22029 - RNA, 9879 nt, synthetic construct
  misc_feature 1..9879: note = derived and/or modified CDS sequence (opt6) from DENV-1__KC692496__SS-prME
  source 1..9879: mol_type = other RNA
tcagtaacaatgttgttaatgctgttaccgacagctttggcatttcacttgactacaagaggaggtgaacctcacatgatagtcagtaaacaagaaagaggcaaatccttactttttaaaacaagtgccggtgttaatatgtgtacacttatcgccatggacttaggagagttatgcgaggacacaatgacatataaatgtccacgcatcactgaggctgaacctgacgatgttgactgctggtgcaatgcgacggatacctgggttacatatggaacatgcagccaaacgggagaacatagaagagagaaacgcagtgtagcactggccccacatgttggattgggcttagaaacgaggaccgaaacgtggatgagctctgagggagcatggaggcaaatacaacgagtcgaaacgtgggcattacgacacccaggttttactgtcatagcattctttttagcacacgcaataggtacgtcgataactcaaaaaggaatcatattcatactgctcatgttagtcacaccttctatggccatgagatgtgtaggcataggaaatagagattttgttgagggtctgagtggtgctacttgggttgatgttgtcctcgaacatggaagttgtgtgacgacgatggcgaaaaataaacccacacttgacattgaacttttgaaaactgaagtgaccaacccagctgtattacgaaaattatgtatagaagctaaaatcagtaataccactacagactccagatgtcctacacaaggtgaagcaacattagtggaggaacaagacgccaactttgtatgtcgacgaactttcgtggaccgaggatggggtaatggatgtggcctttttggaaaagggtctcttcttacttgcgcaaaattcaaatgtgtaacaaaactggaaggaaaaatcgttcaatatgaaaacttgaaatactcagtaatagtgacggttcatacaggcgatcaacaccaggttggtaatgagacaactgaacatgggacgatcgccacaattacgcctcaagctcccacatcagaaattcaattaactgattatggagctcttacactagattgctctcctcgtactggtctcgacttcaatgaaatggtcctattaacaatgaaagagaaatcctggttagtacacaaacagtggttcctggatttgcccctaccatggacatctggagcttctacatcccaagaaacttggaataggcaagaccttttagtaacctttaaaacggcacatgccaagaaacaagaagtggtagtactaggatcgcaagaaggtgcaatgcacacagctctaacaggtgcgacagaaatacagacttccggcacaacaactatattcgccggacatttaaaatgcaggctgaaaatggacaaattaaccctaaaaggaatgagttacgtgatgtgtaccggttcctttaaattagaaaaggaagtagccgaaactcaacacgggactgtgctcgtgcaagtgaagtatgaaggaacggacgcaccctgtaaaattccgttctcaacccaagacgaaaagggcgttacgcagaatggtagactaataaccgcaaatccgatcgttacagataaagaaaagcccgtcaatatagaaacagaacctcctttcggagagtcatacatagtcgttggtgctggtgaaaaagctctaaaactttcttggtttaaaagggggagctccataggaaaaatgttcgaagcaacagctcggggagctcgacggatggcgatcctaggtgatacagcgtgggattttggatctataggcggggtttttacctcggtaggtaaattagtacaccaagtgttcgggactgcttatggagttctattttcaggtgtgtcatggacgatgaagataggtatcggaattttacttacatggctgggtttaaattcgcgttccacgtctctttccatgacttgcattgcagttggcatggtcaccttatacttaggggttatggttcaagctgattccggttgcgtgataaactggaagggacgtgagttaaaatgcgggtccggaatattcgtaaccaatgaggtacacacatggacagaacaatacaaattccaggcagatagtccgaaaaggctatcagcagccataggaaaggcatgggaggaaggtgtttgtggaatcagatctgctacaaggcttgaaaatattatgtggaaacagatctccaacgaattaaaccacatactactggagaatgatatgaagtttacagtcgtagtaggtgatgccaatggtatactagcgcaaggtaaaaagatgatacgtcctcaacctatggaacataagtactcctggaaatcatggggtaaagcaaaaattatcggtgccgacatacaaaacacaacatttattatagatggtcctgatacaccagaatgtcctgatggacaaagagcctggaatatatgggaagtggaagattatggatttggtgtttttactacaaacatatggctaaaattacgagattcatatacccaaatgtgtgatcatcgtctaatgtccgcagcaatcaaagattctaaagctgtacacgccgacatggggtactggatagaatcagagaaaaacgagacatggaaactcgcacgtgcatctttcattgaggtaaaaacctgcacatggcctaagtcacatacactttggtcgaacggcgtattagagagcgaaatgattattccgaagattttcgggggaccaatatcccagcataactatagaccgggatattttactcaaacagcaggcccttggcatctaggcaaattagagttggatttcgatctatgtgaaggtactactgtcgttgtcgacgaacactgtggaaatagaggacctagtttgagaaccacaaccgtcacaggtaaaatcatccatgaatggtgctgcaggtcttgcactctcccaccattaaggtttaggggcgaggacggatgttggtacggaatggaaatacggccagttaaagagaaagaggaaaatctggtaagatcgatggtgagtgcggggagtggtgaagtggacagtttctccttaggaatactatgtgtatctataatgatagaagaagtcatgcgatcgaggtggagtcggaaaatgctcatgactggaacacttgcggtcttcctactgttgatcatgggccaattaacatggaacgacctaatacgcctatgcataatggtcggtgctaacgcatcagatcgaatgggtatgggtacaacctacctcgcactgatggctacatttaaaatgcgccctatgtttgccgtgggattactattcagaaggctaacatcaagagaggtattattacttacgattggactatcgttagtagcatcagtagaacttccaaatagtctcgaagaattaggagacggattggccatgggaattatgatgctaaaactgttaaccgaatttcagccccatcaactctggacgacgctactatcgttgacatttgttaaaacgacactcagtctcgactatgcgtggaagacgacagctatggtactctctatagtttcattgttcccactatgcttaagcacaactagccagaaaactacttggttaccagttttattaggctcatttgggtgcaaacctttaacaatgtttctaataacagagaacaaaatatggggacgcaaaagttggccattaaatgagggaataatggctatcggaattgtctcaatactactttccagtctacttaaaaacgatgtacccttagcaggccccttactcgcaggaggtatgcttatcgcatgttatgttatttcgggttcgtctgcagatctatctttggaaaaggcagccgaagtaagttgggaacaagaagctgaacattccggagctagccataatatcctagtagaagtgcaagatgacgggacaatgaaaatcaaagatgaggagcgcgacgacactctaacaatcttattaaaagccacactactagcggtatctggagtatatcctatgtcaatacccgcaacgttattcgtgtggtatttttggcagaaaaagaaacaaagatcaggagtactgtgggatacgccatcacctccagaggtagagagggcggtcttggacgatggaatctataggatcctacagagaggattattgggacgatctcaagtaggagttggcgtatttcaagatggcgtatttcatacaatgtggcatgtgactcgcggagcagtattaatgtatcaaggaaaaagactagaaccatcttgggccagtgtcaagaaagatttaataagctacggaggcggttggagattccagggatcatggaacactggggaagaagtacaggtaatcgcagtggagccaggcaaaaaccctaagaatgttcaaactacaccaggcacatttaagactccagaaggtgaagtaggagcaatagctttggatttcaagccaggcacatctggaagcccgattgtaaatagagaaggtaaaatagttggcttatatgggaatggcgtcgtaaccacttcaggaacgtatgtctcagccatcgcccaagcgaaagcgagtcaagaaggaccattacctgaaatagaagacgaggtctttaagaaaaggaatttaactataatggacctacacccaggatcaggaaaaacaagaagatatctacccgcaattgtcagggaagcgatcaagaggaaattgcgtacattgatcttggctccaacacgtgtagtggccagtgagatggcggaagccctgaaagggatgcccatcagatatcaaacgactgctgtaaagagcgaacacacgggaagagaaatcgtcgatttaatgtgccatgctacatttacaatgcgacttctctcacctgtacgggttcccaattacaatatgataatcatggatgaagcacatttcaccgatcctgcaagtattgctgccagagggtatattagtaccagggtcggcatgggggaagctgcggccatctttatgaccgcgacacctccaggaagtgtagaagcattcccacaatccaatgcggttatccaagatgaggagcgagatatacccgagagatcttggaactcaggctatgattggataactgactttccgggaaagacagtgtggttcgttccatcaattaaatctggaaatgatattgcaaattgcttaagaaagaacgggaaaagagtcatacagctatcgcgaaaaacttttgacacagaatatcagaaaactaaaaataatgactgggactatgttgtcactaccgatataagtgaaatgggcgctaatttccgcgctgacagagtaatagacccacgaagatgcctgaagcccgttatattaaaagatggaccagaaagggtaatactagccggaccaatgcccgtaactgtagcttccgccgctcagagacgcggtcgaatcggacgcaatcaaaataaagagggggatcagtacgtgtacatgggtcaaccactgaacaatgacgaagatcacgcacattggactgaagcaaagatgttattagataatataaatacaccagaaggaataattcctgcattgttcgaaccagaaagagaaaagtcagccgcaatagacggcgaatacagattaagaggtgaagcaaggaaaacatttgtagagctaatgcgtagaggagatcttccagtttggctgtcatacaaagtagcatctgaaggttttcaatattctgacagacgatggtgctttgatggagaaagaaataaccaagtactagaagaaaacatggacgtagaaatttggactaaagagggagaacgcaagaaattacgtcctcggtggttagatgcacgtacatattcggacccgttagcattaagagaatttaaagagttcgctgccggtagacgaagtgtgtctggcgatctcatcttagagataggtaaactcccccaacatctaactcttagagcacaaaatgccttagacaatttagtgatgcttcataactccgaacaaggaggaaaggcttacagacatgccatggaagagttaccagatacaatagaaacattgatgttattggcactgatcgcagtacttacaggaggggtcacactattctttctatcaggtaaaggtctcggaaaaacaagtatcggtcttttgtgcgtgaccgcctcaagcgcacttttgtggatggctagtgtagaacctcattggatagctgcgagtataatcctcgagttctttttgatggtcctattgatacccgaacctgacagacaaagaacgcctcaagataaccaacttgcttatgttgtcattggattgctttttatgattcttacagtagcagcaaacgaaatgggtttgctagaaactaccaagaaagatctaggaatcggttacgtcgctgcagaaaatcaccaacatgccactatgttagatgtggacctgcacccagcttcagcatggaccctatatgcggttgccactacggtcataacaccgatgatgcggcatacaattgaaaacacaacagctaatatatctctgactgctattgccaatcaagcggcaatattgatgggattagataaaggctggcctatatcaaaaatggacataggcgtgccgttactggccctaggctgctactcacaagtaaatcccctaacattaaccgccgctgtactaatgctggtagcgcattatgcaataataggacctgggctacaagcaaaagcaacaagagaagcccaaaaacgtacagctgctggcataatgaaaaatccgactgtagatggcatagtagccatcgacctcgacccagtagtatacgatgcgaagttcgaaaaacaattaggacagataatgttattgatattatgtacctcccaaatattattgatgcgtacaacttgggcactgtgcgaatctataactctagcaactggacctttaacgacactttgggaagggtctccaggtaagttctggaacacaactatagcggtgtcgatggccaacatatttagaggaagttacttagcaggcgcaggtctagccttttcactgatgaagtcccttggcggcgggagacgtggaacaggagcgcaaggagaaacattgggtgagaaatggaaaagacagcttaatcaactaagcaaaagcgaatttaatacttacaaaagatcaggcataatggaggtagatcgtagcgaagcaaaagaaggtctaaaaagaggtgaaacaactaagcacgcagtgtcacgtggaacggctaaattaagatggtttgtagaaagaaatttggtcaaaccagaagggaaagtaatagatctaggatgtggccgtggcggttggtcgtattactgcgcaggtctaaagaaagtgacagaggtcaaaggctataccaaagggggccccggacacgaagaaccgataccaatggcaacgtacggctggaatctggtcaagctgcactccggtaaagatgtattctttatgccacctgaaaaatgcgacactctattatgcgacataggtgaaagcagtcctaatcctaccatagaagaaggacgcacactgcgagttttaaagatggttgaaccttggctaagaggaaaccaattctgcataaagattcttaacccttatatgccatctgttgtagaaacacttgaacaaatgcaaagaaaacatggtggaatgctcgtgagaaatccactgtcaagaaattccacgcatgaaatgtattgggttagttgtggaactggaaacatagttagcgctgtgaatatgacgtcgagaatgcttttgaataggtttaccatggcacatcgaaaaccgacgtatgaaagagacgtggacttaggagcaggcacccgtcacgtggcagtggagccagaagtcgccaatttagatattattggacaaaggatcgaaaatataaagaacgaacataaatcaacatggcattacgatgaggacaacccgtataagacatgggcgtatcatggcagctatgaagtaaaaccctcagggtcagcatcatccatggttaatggagttgtgcgactgttaacaaaaccatgggacgtcattccgatggttacacaaatcgcaatgacagacactactccgtttggccaacaaagagtatttaaggagaaggtcgatactagaactcccagagctaaaagaggtactactcaaatcatggaggtaacagcgaaatggctctgggggtttttgagtagaaataagaaaccgcgcatttgtacgagggaggaatttacacgaaaagtcagatctaacgctgcaataggcgccgtttttgtcgatgagaaccaatggaactctgccaaagaagcagtagaagatgagcgattttgggatcttgttcatagagaaagagaactacataaacaagggaaatgtgctacatgtgtgtataacatgatgggtaagcgagagaagaaactcggagagtttggaaaagccaaaggtagccgtgcaatatggtacatgtggctgggtgccagattccttgaatttgaagctctaggttttatgaatgaggatcactggttttcgcgtgaaaattctctttcaggggtagaaggtgaaggactacataaactaggatatattttaagggatataagtaaaataccaggaggaaatatgtatgccgatgataccgcaggttgggatactcgcataacagaagacgatctacaaaacgaggcaaaaataacggacattatggagcccgaacatgccctattagctacgtctatttttaaattaacataccaaaataaagtcgtacgagtacaacgtcctgccaaaaatgggacagtaatggatgtaatatctagacgtgatcaaagagggtctgggcaagtaggtacttatggccttaacacattcaccaatatggaagttcagcttataagacaaatggaaagcgagggtattttccttccctcagaattagaaacacctaacctagctgaaagagcacttgactggctagagaaacacggagctgaaagactaaaaagaatggcaattagcggagatgattgcgtagtcaaaccaatagatgacaggtttgctacggctttaacagcactaaacgacatgggaaaagtcagaaaggatataccgcagtgggaaccatccaaaggctggaatgattggcagcaagtacccttctgtagtcatcactttcaccaactaattatgaaagacggaagagagatcgtagtaccatgcaggaatcaagacgaattagttggccgtgcgagagtatcacaaggtgcaggctggtctttaagagaaactgcatgcttgggtaaaagctacgcgcaaatgtggcagcttatgtacttccacaggagagacttaagattggcagctaatgctatttgttccgccgtccctgtcgactgggtacctgctagtaggacaacatggtcaatacatgcacatcaccagtggatgactactgaagatatgttatcagtttggaacagggtctggattgaggaaaacccatggatggaggataaaacacacgtgtcatcttgggaagaagtcccctatctcggaaaacgtgaagatcagtggtgcggcagtttgataggattaactgccagagccacatgggcaacaaatattcaagttgcgattaaccaagtgcggaggctcattggcaacgaaaattacctcgactatatgacgtcaatgaaaagatttaaaaatgagagtgatcctgagggagctctttggtaa

SEQ ID NO: 22030 - RNA, 9879 nt, synthetic construct
  misc_feature 1..9879: note = derived and/or modified CDS sequence (opt6) from DENV-1__KC692497__SS-prME
  source 1..9879: mol_type = other RNA
tcagtgactatgctactgatgcttctacctacagctcttgcattccacttgactacaagagggggtgaacctcatatgattgttagtaaacaagagcgcgggaaatcattactgtttaaaacgtcggccggtgtcaacatgtgtacccttatagctatggatctaggagaattgtgcgaggacactatgacatataaatgtccacggataactgaagcagaaccggatgatgtagactgttggtgtaatgctacagacacgtgggtaacgtatggtacatgttcacaaacaggagaacatcggagggaaaaacgatcagtcgcgcttgcacctcacgttggactaggccttgaaactaggacggagacatggatgagtagtgagggagcatggaaacaaattcaaagggttgaaacatgggctttacgacatccggggttcactgtcattgcactgtttctggcacatgcaataggaacaagtataacacaaaaaggaattattttcatactcttaatgctagttacaccatcgatggctatgcgatgcgtcggtattggtaatcgcgactttgttgaaggactgagcggtgcaacctgggtagacgtcgtactcgaacatggtagttgtgtaacaaccatggctaaaaataaacctacactagatattgaacttttgaaaacagaagtaacaaatcctgctgtacttagaaaactttgcatagaggccaaaatcagtaacactacaacggacagtcgctgtcctacgcaaggagaagcgacacttgtggaagaacaagatgctaatttcgtttgtagaagaacgtttgtagaccgaggttggggtaatggttgcggactctttgggaaagggtctctccttacctgcgcaaaatttaaatgcgttactaaacttgagggcaaaatagtacaatatgagaatctcaaatacagcgtcattgttactgtacacaccggcgaccaacatcaagtaggaaacgaaacaactgaacatggcaccattgcaactataaccccgcaagcgcctacgtcagaaatacaattaactgactacggagccctcacgttagactgctctccaagaaccggattggacttcaacgaaatggttttactgacgatgaaagagaaaagctggcttgtacacaaacaatggtttctcgacctaccattaccctggacatccggggcctcaacatcccaggaaacctggaataggcaggacttactggttacatttaaaacagcacacgcaaagaaacaggaagtcgtagtcttgggtagtcaggaaggagcaatgcatacagccttaacaggcgctaccgagatacagacgtcaggaactaccaccatctttgcaggacacctaaaatgcagactgaaaatggacaaactaaccctaaaaggaatgtcttacgtaatgtgcacaggatctttcaaacttgaaaaagaggtagcagaaacccagcatggaaccgttttagtccaagttaaatatgagggtacagatgcgccttgcaaaattccctttagcactcaagatgaaaaaggagtaactcaaaatgggcgattgattactgccaaccctatagttactgataaagagaaaccagtcaacattgaaaccgaaccaccatttggagagtcttacattgtagttggggcaggagaaaaagcacttaaactatcttggttcaaacggggatctagtatcggaaaaatgttcgaagcaacagctagaggggcgcggagaatggcgattttgggcgacactgcatgggactttgggagcattggaggggtattcacgagcgtcggaaagctagtccaccaagtattcggaactgcttatggcgttctattctcaggagtaagttggacaatgaaaatcggaatagggattttactcacctggctgggtcttaacagccgatctacatctttatctatgacgtgtatagcggtcggaatggtcactctttatctaggagtaatggtgcaagcagattctggatgtgtaattaattggaaaggccgtgagctaaagtgcggatcaggtatatttgtaacgaacgaagtccatacatggacagagcagtataaattccaggctgactcaccaaaaaggcttagtgctgcgatagggaaagcgtgggaagaaggtgtgtgtggcataaggtccgcaacacgactagaaaatataatgtggaaacaaatcagtaatgaattaaatcatatactattagagaacgacatgaaatttacagttgtagtaggggatgcaaacggtatattagcacaagggaagaagatgatccgtccacaaccgatggagcataaatatagctggaaaagttggggaaaggctaagataataggagccgatatccaaaatacaacgtttatcatagacggtccggatacaccagaatgtcccgatggacaacgagcgtggaatatatgggaagtggaagattatgggttcggtgtctttacaacgaatatttggttaaaattacgcgattcatacacacagatgtgcgatcaccgattaatgtcagcggcaataaaggattccaaggcggtacacgctgatatgggctactggatagagagtgagaaaaatgaaacgtggaaactcgcacgtgcatcatttatagaagttaagacatgtacatggcctaaatcccatacattgtggtcaaacggagtgcttgaatctgaaatgataattccaaagatcttcggaggaccaatctcccaacacaattaccgacccgggtacttcacacaaacggcaggaccttggcacctaggtaaattggagctagattttgacctttgtgaaggtactaccgtagtggtcgacgaacactgcggaaatcgaggaccaagtctaaggactacaacagtaacaggaaaaatcatacacgaatggtgttgtagatcatgcactcttccacccttaaggtttagaggagaagatggatgttggtatggaatggagataaggccagtaaaggaaaaagaagaaaatcttgtgaggtctatggtttcggcagggtccggcgaggtggactcatttagcttaggaattttatgtgtgagcataatgattgaagaagtaatgagatctagatggtccaggaagatgctcatgactgggacactagctgtatttttattattgattatgggacaattaacatggaatgatttaattcgactgtgcataatggtgggagcaaatgcatctgacaggatgggtacgggtaccacttacttagccctaatggcgacatttaaaatgagacccatgtttgcggttggactattatttagacgtttgacgtctagagaggtacttctacttacaatcggtcttagcctagtggcttcagtagaacttcccaactcattagaggagctcggagacggactagcgatgggtatcatgatgctcaagttactaactgagtttcagccacaccaactatggaccactctattgtcattaacttttgtgaagacaaccctctctctggattatgcttggaaaactactgctatggtattatcgatagtcagcctgtttccattatgcctatcaacaacctcacagaaaacgacctggcttccagtattattaggctcatttggctgtaaaccattaacaatgtttttaatcacagagaataagatatgggggcggaaatcctggccattaaacgaggggattatggctataggaatcgtttcaatcttactatcttccttgttgaaaaacgatgtgccacttgcaggtccattaatcgccggtggaatgttaattgcatgttatgttattagcggatcttccgccgatctctcgctggagaaggcagcagaagtttcctgggagcaggaggctgagcactccggagcttctcataacatcctagtagaagtacaagatgatggaacgatgaaaataaaagatgaagaacgagacgataccctcactatattactcaaggcaaccttgttagcagtatcgggcgtttatcctatgtcaattccagctacgctattcgtatggtatttctggcaaaagaagaaacaaagatcaggtgttttatgggataccccctcaccgccagaagttgaacgggcagtattagatgatgggatataccgaatattacagaggggccttctaggacgaagtcaagttggagtaggcgtattccaagatggagtctttcataccatgtggcacgtgacacgaggcgcagtgctaatgtaccagggtaaaagattagaaccgtcttgggcttcggttaaaaaggatctcatctcatatggaggtggctggagatttcaaggctcctggaacacaggagaagaagtacaagtaattgctgtcgaaccaggtaaaaatcccaaaaatgttcaaactacaccaggcacatttaaaactcctgagggcgaagtaggtgcgattgctttagattttaaaccgggaacaagcggctcaccgattgtaaatcgggagggcaagatagtaggactatatggaaatggcgtagtaacaacaagcggtacgtatgtaagcgcgatagcacaagctaaagcgagccaagagggaccactgccagagatagaagatgaagtatttaagaaaaggaacctaacaattatggacttacatccggggtcaggaaaaacacgtagatatctgcccgcaattgtacgtgaggctattaagagaaaactaagaactctaatcttagcaccaactagagttgttgctagtgaaatggcagaggctcttaaaggaatgcctattagataccagaccacagctgtaaaatccgaacacaccggaagagaaatagtagatctaatgtgccatgcaacatttactatgagacttttaagtccggtaagggtaccaaattacaatatgattataatggacgaagcccactttactgatccagctagcatcgcagcaagagggtacatttcgacacgagtcggtatgggcgaagctgcggcaatatttatgaccgcaacaccgccaggttctgttgaagcgttccctcagtcaaacgctgttatacaggatgaggaacgagatatacctgaaagatcatggaacagtggctacgactggattactgattttccgggtaagaccgtctggtttgtaccatcaataaaatcaggcaatgatattgcaaattgcctaaggaaaaacggcaaacgggtaatccaactatcccgaaaaaccttcgatacagaataccagaaaaccaaaaataatgactgggattatgtggtaacaactgacatatcagagatgggtgctaattttagagcagatcgtgtgatagaccctcgacgctgtttaaaacccgtaattctaaaagatggtccagaaagggtaatcctagcggggccaatgcctgttaccgtagccagtgcagcacaacgaagaggccgcataggccgcaatcaaaataaagaaggtgaccaatacgtctatatgggtcagccgcttaacaacgacgaagatcatgctcattggacagaagccaaaatgctattagacaatatcaatactcctgaggggataatacccgcactattcgaaccagagagggagaaatcagcagcaatagatggcgaatatagactacgcggagaggcaaggaaaacatttgttgaacttatgcgaaggggtgatctaccagtttggctatcttacaaagtagcgtccgaaggatttcaatattcagaccggcgatggtgcttcgacggtgaaagaaataaccaagtcctcgaggaaaatatggacgtagaaatctggacaaaagaaggcgaaaggaagaaattacgtcctagatggctagacgccaggacctacagcgatcccttagcccttagggaatttaaagaatttgcggctggtcgacggagcgtgagcggagatttaatcctagagataggaaagctaccccagcatctgaccttaagggctcaaaacgcactggacaacttagtcatgctacataatagtgaacagggaggaaaggcttaccgtcatgctatggaagaattacctgatacaatagaaactctaatgctattagcactgatagcggtattgactggtggagtaacattattctttctatcaggtaagggtttaggcaaaacaagtattggcctattatgcgtaacggcgtcttcagcgctactttggatggctagtgtggaacctcactggatcgcagcatcgataatcttggagttctttttaatggtattgctgattcctgaaccagatagacaaagaacaccacaagacaaccaattagcatatgtagtaataggattgttatttatgattcttacggtggcggcaaatgaaatggggctattagaaactactaagaaagacctaggaattggctatgtagctgcggaaaaccaccaacacgcaacgatgttggacgtagacttacatccagcgagcgcatggacactgtatgcagtcgccacaaccgtaattacccccatgatgagacatacaatagaaaatacaacagccaatataagtctaacggctattgctaatcaagctgcaatcctaatggggctcgacaaaggatggcccattagtaagatggatatcggagtgccattattagcgctagggtgttattcacaggtcaacccccttacactaactgctgcggtgctaatgttagttgcccactatgctataataggcccaggccttcaagcaaaggcaacgcgcgaagcacagaaaaggacagccgctggaataatgaagaacccaacagtagatggtatagttgcaattgacctagatccagtagtgtacgatgccaaattcgaaaaacaactgggacaaataatgctgctaatattatgtacatcccaaatcctattaatgagaactacgtgggccctttgtgagagtataactctggcaaccggaccgttgacaacactctgggaaggcagccctggaaaattttggaatacaaccatagcagtatcgatggcgaatatattccgtggttcatacttagctggggcgggtctagcattcagtctgatgaaaagtctaggaggcgggagaaggggtacaggggcacaaggggaaactttaggcgaaaaatggaagagacagttaaaccaattgtctaaatcggaatttaacacatataagcgtagtggtataatggaagttgatagaagtgaagcaaaagaagggctaaagcgaggagaaacgacaaaacatgctgtctcgcgcggaactgccaagctaaggtggtttgttgaaaggaaccttgttaaacccgaaggaaaagttattgacttgggatgcggaagaggtggttggtcgtattactgtgcaggactcaagaaagtaacagaagtcaagggatacactaaaggaggtccaggacatgaagaacctatacccatggcgacctatggatggaacttagtaaaattacattctggcaaagacgtcttctttatgccgcccgagaaatgtgatactttactttgcgatataggagaaagttcaccaaacccaacgatcgaggaaggtcgaactctaagagttttaaagatggtagaaccctggctaagaggtaatcaattctgtataaaaatactaaatccatacatgccaagtgtagtcgaaacattagagcaaatgcagagaaaacatggtggcatgcttgtaaggaatccactgtcaagaaactctacacatgaaatgtattgggtctcctgtggaacaggcaacatagtttcggcagtgaacatgacatcaagaatgctattaaacagattcacaatggcccacagaaagccaacatatgagagggacgtagatttaggagctggtacaagacatgtagcggttgaacccgaggtagcaaatctagatgtcatcggacaacgcatagagaatatcaaaaacgaacataaatcaacctggcattacgacgaagataatccgtataaaacatgggcttatcacggttcgtacgaagtcaaaccaagcggtagcgcttcttctatggtaaacggtgttgtcaggctattaacgaaaccttgggatgtcataccaatggttacccagatagcgatgacagatactacgccattcggccaacagcgagtctttaaggaaaaagtcgacacaagaacaccaagagccaaacgaggtacgacacaaataatggaagtaacagcaaagtggttatggggatttctttcgagaaataagaaacctagaatttgtacaagagaagaatttacgagaaaagttcgatccaatgcagccataggagctgtattcgtcgatgaaaaccaatggaactcagcaaaagaagcagtcgaggacgaacgattttgggacttagtccatagggagagagaattacataaacagggaaaatgcgctacttgcgtgtataatatgatgggaaaaagagagaagaaattaggcgagttcggaaaagcaaaaggcagtcgtgcaatctggtatatgtggttaggagcacgcttcctagaatttgaggcacttggattcatgaatgaagatcactggttttccagagaaaatagtttaagcggagtagaaggagaaggcctccacaaacttgggtacatacttagagacataagtaaaatacccggtggcaatatgtatgctgatgacacagctgggtgggataccaggattacagaagatgatttacaaaatgaagcgaagattacagatattatggaaccagaacatgcgttattggcgacaagtatattcaaactcacttatcagaacaaagtagtcagagtacaacgacctgctaagaatgggactgtaatggacgtcatatctagaagggaccagagaggtagtggtcaggtaggaacctatgggttaaacactttcaccaacatggaagttcaacttatcagacaaatggaatcagaaggcattttcctaccttcagaacttgaaacgccaaatttagccgaacgtgccttagattggttggaaaagcacggcgctgaacggcttaaacgaatggccatatccggggatgactgtgtagttaaaccaatagatgataggtttgcaaccgctctaactgctcttaacgacatgggaaaggttcgtaaagacatcccacagtgggaacccagcaaaggttggaatgattggcagcaggttcccttttgctctcatcactttcatcaactaatcatgaaggatggcagagaaatagtcgtaccatgtcggaatcaggacgaattagtcggcagagcaagggtgtcacagggggcagggtggagtctgagagagactgcatgcctaggtaagtcatatgcacaaatgtggcaactaatgtactttcatcgacgagacctcaggttagcggcaaatgccatatgttctgcggttccagtagattgggtgccagcctcacgaacaacatggtcaatacacgcccaccatcaatggatgaccacagaagatatgctcagtgtatggaatagggtgtggatcgaagaaaacccctggatggaggacaagactcacgtgtccagctgggaggaagtaccatatttaggcaaacgagaagatcaatggtgtggttccttaattgggctaactgctagagcgacatgggcaacaaacatccaagttgccattaaccaagtaaggagattgattggaaacgaaaactacttagattatatgacaagtatgaaaagatttaaaaacgagagcgaccccgaaggagcattatggtaa

SEQ ID NO: 22031 - RNA, 9879 nt, synthetic construct
  misc_feature 1..9879: note = derived and/or modified CDS sequence (opt6) from DENV-1__KC692498__SS-prME
  source 1..9879: mol_type = other RNA
tcggtgactatgttactcatgctgcttcctactgcacttgcgtttcatttgactacacgaggaggtgaacctcatatgattgtaagtaaacaagaaagaggtaaatcgctactatttaaaacgtcagccggtgttaatatgtgtacattaattgcaatggatctcggtgaactatgtgaagatacaatgacatataaatgccctcgaatcacagaagccgaaccggatgacgtagattgttggtgtaacgcaactgatacatgggttacctacggaacttgtagtcaaacaggagaacatagaagggagaaaaggagtgtagctttggcaccccacgttggactaggcctagaaactaggactgaaacatggatgagcagcgaaggtgcttggaaacagatacaacgagtggaaacatgggcgttacgacatcctggtttcacagtaatagcattgttcctagcgcacgcgattggtacatcgatcactcaaaaaggcataattttcattcttttaatgcttgtcacaccctccatggccatgaggtgcgtcggcatcggcaatagagattttgtagaaggattgtcaggagctacgtgggtagacgtcgttctggaacatggtagttgtgtcacaacgatggctaaaaacaaacccacgctcgatatagaactactaaaaacagaagttactaatcctgctgtgctacgcaaattgtgcatcgaagcgaaaatatctaatacgacgacagattcacgttgcccaactcaaggtgaagcgaccttagtagaagaacaagatgctaattttgtctgcaggaggacgttcgtagatagaggttggggaaatggttgtggactcttcggtaaaggttcgctactaacatgtgctaaatttaaatgcgtaactaaactagaagggaaaatagtgcaatatgaaaacctcaaatacagtgttattgtaacggtacatactggagatcaacaccaagtcggaaatgaaacaacagaacacggtacaatagctacgataactccacaagcgccgacatcggaaatacaacttactgattatggcgctcttaccctagactgctcacccagaacggggttggactttaatgaaatggttttgttgacaatgaaggaaaaatcctggttagtgcacaaacaatggtttttggatctccctttaccatggacatcaggcgcatcaacatcacaagaaacttggaatcgccaagatctattagttacctttaaaactgcacatgctaagaaacaggaagtagtagttctaggtagccaagaaggtgcaatgcatactgcattaacgggggctactgagatacagacatcggggacaacaactatattcgctgggcaccttaagtgccgacttaagatggacaagctaaccttaaaggggatgagttacgtaatgtgcactggtagttttaaacttgaaaaagaagtggccgaaacacaacatggaacggtcctagtccaagttaagtatgaagggactgatgctccatgcaagataccttttagcacacaggatgaaaaaggagtaactcaaaatgggcgtctcataaccgccaatccaattgtcaccgataaagagaaacctgtaaacatcgaaactgaaccaccattcggcgaaagttacatagtcgtgggtgctggggaaaaggcactaaaacttagctggttcaaaagaggaagttccatcgggaagatgtttgaagctactgccagaggggcgaggaggatggctatactcggcgacacagcctgggattttggttcgattggcggagtatttacatcggtaggcaaacttgtccaccaagtatttgggactgcgtatggtgtactgttctcaggagtctcctggaccatgaaaatcggaataggaatcttactaacctggttagggctaaattctagaagtacttctctatcgatgacctgcattgccgtaggtatggttactctttacctcggagtaatggttcaggctgacagcggttgcgtaataaattggaaagggcgtgaactcaagtgcgggtcagggatatttgtcacaaatgaagttcacacttggaccgaacaatataaatttcaggcagattcaccaaaaaggctatcagcagcaatcggaaaagcatgggaagaaggagtatgtggaatacgtagcgcaacgagactagaaaacataatgtggaagcaaataagcaatgaattaaaccacatattactagagaacgatatgaaattcacagttgtagttggagatgctaacggtatcctcgcacaaggcaagaaaatgatacgtccccaacccatggaacacaaatatagttggaaatcttgggggaaggcgaaaataataggcgcagatatccagaacactacatttataatagacggtccagatacacctgagtgtcctgatgggcaaagagcttggaacatctgggaagtagaagattatggttttggggtattcactactaatatatggctaaagctaagggatagttatacgcaaatgtgtgaccatcgccttatgagcgccgcaattaaggattcgaaagcagtacatgcagatatgggttattggatagagagtgagaaaaatgaaacttggaaactggctagagcaagtttcatagaagttaagacttgcacctggcctaaaagtcacacattgtggtctaatggtgtcctagaatctgaaatgataataccaaagattttcggcggacctatctcacagcacaattacagacctggatatttcacacaaaccgccggaccatggcatcttgggaagctagaattagactttgatttatgcgaagggacaacagtcgttgttgatgaacattgtgggaatagaggaccatctttaagaaccacgactgtcacggggaaaatcatacacgaatggtgttgcaggtcttgcaccttacctccattaagattcagaggagaggatggctgttggtatggcatggaaatacgtccagtaaaagaaaaggaagagaatttagtacggagtatggtatctgcaggatcaggagaagtagactcgttctccttaggcatattatgtgtatctataatgatagaggaggttatgcgatcccgatggagcagaaaaatgttgatgacaggaaccttagctgttttcctattactcattatgggacaattaacgtggaatgatctaatacggttgtgtataatggttggagcgaatgcatctgatagaatggggacaggtacgacatacctagctcttatggcaacctttaagatgcggccaatgttcgcagtgggtcttctctttagaagacttacgtcaagagaggtactactactaacaatcgggctgagtctagtggcctcagtggagctaccaaatagcctcgaggaattgggtgatggattagcgatggggataatgatgctgaaattattaactgaatttcaaccgcatcagttatggacaactttattgtcactgacgtttgtaaaaacaacgttgtcattagattatgcgtggaagacgacggctatggtattaagtattgtgagtctatttccattgtgtctttcgacgacatcccagaaaacgacctggctaccggtattgctcgggagttttgggtgtaaacccctaacaatgtttctaataaccgaaaataaaatatggggccgaaagtcatggcccttaaacgaaggaataatggcgattggcattgtttcaatattactgagtagcttattgaaaaatgatgtacctctagctggaccactaattgctggaggaatgctaatagcatgttatgtaatatcgggaagctcagcggatcttagtttggaaaaggctgcggaagtaagttgggagcaagaggccgaacatagtggtgcgagtcataacatattagtagaagtacaagatgatggtaccatgaaaatcaaggatgaggagagagacgatactttgacgattttactaaaagctactctcctggcggttagcggagtatatccaatgtctatcccagcgaccctattcgtatggtatttttggcagaagaagaaacaaagatccggagtcttatgggacacaccttcgcctccggaagtcgaacgtgcagtattagatgatggaatatatcggattcttcagcgaggcttacttgggagaagccaagtaggcgtgggcgtatttcaagatggtgtcttccatactatgtggcatgtgactcgaggtgcagttttaatgtatcaaggaaaacggttagaaccatcatgggcaagcgtgaaaaaggatctaatttcatatgggggaggttggcggtttcagggttcttggaatacaggagaagaagtacaagttatagcggtcgaaccaggtaaaaacccgaaaaacgttcaaacaacgcctggtactttcaaaactcccgaaggagaagtaggtgcgattgccttggattttaaaccaggtacaagtggaagccctattgttaatagagaaggaaagattgtcggactgtacgggaatggagttgtgacaaccagcggtacatacgtttcagccattgcccaagcaaaggcttcacaggaaggcccccttccagaaatagaagatgaagtttttaaaaagcgaaatttgactatcatggacttacatcccggcagtggaaagactcgtaggtatctaccagcgatagtgagggaggcaattaaacgaaaactaagaacacttatattagcaccaacaagagttgttgcttcagagatggccgaggcgttgaaaggtatgccaatccgatatcaaactactgcagttaaatcggaacataccgggcgtgagatcgttgatttgatgtgccatgcaacatttactatgagactgttaagcccggtgagagtcccgaattataatatgataataatggatgaggcacacttcacggatccagctagtatagcagcgcgtggatacatttctactagggtcggcatgggagaagcagcagcaatattcatgacagcgacgccaccgggaagtgtcgaggctttcccacaatcaaacgcagtaatccaagatgaagaaagagatataccggagcgatcatggaacagcggatacgactggattacggacttttctggaaaaacagtatggtttgtaccatcaataaaatcggggaatgatatagccaactgcttaaggaaaaatggaaagagagtcatacaattaagtagaaaaacctttgatacggaataccagaaaactaaaaataacgactgggactatgtggtgactactgatatatctgaaatgggcgctaattttagagcagacagagtgattgatccacggaggtgcttaaaaccagtaatcttaaaagacggacctgaaagagtaatattggcaggaccaatgccagttactgttgcaagtgctgcacagagacgaggtaggataggtagaaaccagaataaagaaggagaccaatacgtatacatgggccaaccgttaaacaatgatgaagatcatgctcactggacggaggcgaaaatgttgttagacaatatcaatacaccagaaggaattatacccgctttattcgaaccggaacgagaaaaatcagcagccatagatggagaatatagattgagaggtgaagcacgaaaaacattcgtggaactcatgcgaagaggcgatctgcccgtatggctaagttataaagtagcttcggaaggatttcaatattcggatcgacgatggtgcttcgacggcgaacgtaataaccaagtcttggaagaaaatatggatgttgaaatatggaccaaagaaggtgaaaggaagaaacttcgaccaagatggctagatgccaggacctattcagatcctctagccttgagagagttcaaagagttcgccgctggtcgaagaagtgtatcaggagatttaatactggagataggtaaactgcctcaacacctaactctacgggcacaaaatgcactagacaacttggttatgttacataatagcgaacaaggcgggaaagcatacaggcatgccatggaggaactcccagatactatagaaaccctgatgctgttagcattaatagcagtattaacagggggtgttaccttattctttcttagcggaaaaggattaggcaaaacgagcataggtcttttgtgtgttacagcatcatcggccctactatggatggcttctgtagaaccacattggattgccgcgtccattatcctagagttcttccttatggtgttactaataccagaaccagacaggcaaagaaccccacaggataatcaactagcatatgtagtaatcggtctacttttcatgattttaacagttgcggccaatgaaatgggcctccttgaaactacgaagaaagatttgggaatagggtacgtagcagctgaaaaccaccaacatgcgacaatgttagatgtggacctacatcccgcctcagcttggacactgtatgccgtagctaccactgttataacaccaatgatgcgacacactatagaaaacactacggcaaatattagtttaacagccatagcgaaccaggcagcgattctgatgggtttagacaaaggttggccgatatctaaaatggatattggagtaccacttctcgcactaggctgttactcccaggttaatcctctcaccttaacagcagctgtattaatgctggttgcgcattacgccattataggaccaggtctacaagcaaaagcaacgcgagaagcacaaaagcgtacggcggcgggcataatgaaaaatccgacagtcgatggaatagtcgcaatagatctagaccctgtcgtatacgatgccaaatttgaaaaacaactaggccaaataatgctattaatactctgtactagccaaatattactcatgagaacaacctgggcgctatgcgaatctatcacattagctactggcccactgactactctctgggaggggtccccaggaaaattctggaatacaacgatcgcagtctctatggctaacattttcagaggatcctacttggcaggcgcaggattagcattctctctgatgaaaagtctagggggaggaaggcgaggcacaggagctcaaggtgaaacattgggagagaaatggaaacgtcaattaaaccagctcagcaaatccgaatttaatacttacaaaagatcaggaataatggaggtagatagaagtgaggctaaagaaggactaaaacgcggcgagacgactaaacacgccgtctctaggggtacagcaaaattaagatggtttgtggaaagaaacctagtaaaacctgaaggaaaagtaattgatttaggttgcggcagaggagggtggagctactactgcgctggattaaagaaagtgacagaggttaaaggttatactaagggtggacctggtcatgaagaaccaattcccatggcaacgtatggatggaatttagtaaaattacattcgggaaaagatgtgttcttcatgccacccgaaaaatgcgatacactcctatgcgatataggagagagtagtccaaatcctaccatcgaagaaggaaggacgttgcgagttcttaagatggtagagccgtggttacgaggaaatcagttttgcataaaaatcctcaacccatacatgcctagcgttgtagaaacactagagcagatgcagagaaagcacggaggaatgttagtgagaaacccgttatcaaggaatagtacacatgagatgtactgggtaagttgtgggacaggaaacatcgtcagtgcggttaatatgacctcgcgtatgctactaaatagattcaccatggctcatcgaaaaccgacatatgagagagatgtagatcttggagcggggactaggcacgtagcagtagaaccagaagtagcgaacttggatgttataggccaacgaatagagaacattaaaaatgagcacaaatcgacttggcactatgatgaagacaatccgtataaaacttgggcataccacggatcatacgaagttaaaccttcaggatccgcaagtagcatggtgaacggcgtagtacgtttactgacgaaaccgtgggatgtcattcctatggtgacgcaaattgcgatgacggatactacacctttcggacaacagagagtttttaaagagaaggtggatacgagaacaccccgagccaagagaggcactactcaaataatggaggtgactgcaaaatggttatggggttttctttcgagaaataaaaagccacgaatatgtacaagggaagaatttactaggaaagtccgatcaaacgcggccatcggggcagtattcgtggatgagaatcagtggaactcagctaaagaagctgtcgaagacgaacggttttgggatctagtacatagagaacgtgagttacacaaacaaggaaaatgcgccacatgtgtttacaacatgatgggtaaaagggagaagaagctaggagagttcggcaaagcaaaagggagtcgagcgatatggtatatgtggctcggtgccaggtttctagagttcgaagcactagggttcatgaatgaagatcactggttcagtcgtgaaaattcactatctggagtcgaaggggaaggccttcataaattaggctacatactaagagacatctccaaaattcccggaggaaatatgtacgctgatgatacagcaggatgggacactaggataacagaagatgatttacaaaacgaggcgaaaattacggatattatggagccggaacacgctctcctagcgaccagcatattcaaattgacttatcaaaataaggtagtacgcgtgcaacgcccagctaaaaatggaaccgttatggacgtaatttcaagaagagaccagcgaggctctggccaagtaggaacgtatggtcttaacacattcaccaacatggaagtccaactaattcgacaaatggaaagtgaaggaatattcttaccaagcgaactagaaacaccgaacttagcagaaagagcattagactggcttgagaaacacggagcagaaagactcaaacggatggcaataagcggcgatgactgtgtggtgaaaccgatagacgatagattcgccaccgcattaactgcgttgaacgacatgggaaaggtacgaaaagacattcctcaatgggagccatcaaaaggctggaacgattggcaacaagtgccattctgctcccatcattttcatcaactaataatgaaagatggaagggaaatagttgtgccgtgcagaaatcaggatgaactcgtgggtagagcacgtgtgagccagggagcgggatggtccctgagagaaaccgcgtgtctgggaaagtcatatgcccaaatgtggcagcttatgtactttcaccgacgagatttaagattagccgcaaacgcaatttgtagcgcagtgcccgtagattgggttcctgcatcacgtactacatggagcatccacgcgcaccatcaatggatgacaactgaagatatgctaagcgtatggaaccgagtatggatagaagaaaacccatggatggaagataaaactcatgtctcaagttgggaagaagttccttatctaggtaagagagaggaccaatggtgtggttcgttaatagggttaactgccagagcgacttgggcgacaaacattcaagtagctatcaaccaagtgagaaggttaatcggaaatgaaaattacctggactatatgacgtccatgaaaagatttaagaatgagagcgaccccgaaggagcattatggtaa

SEQ ID NO: 22032 - RNA, 9879 nt, synthetic construct
  misc_feature 1..9879: note = derived and/or modified CDS sequence (opt6) from DENV-1__KC692499__SS-prME
  source 1..9879: mol_type = other RNA
tcagtcactatgcttctgatgttgctaccaacagcattagcgtttcatctgacaactagaggtggagaaccacatatgatagtcagcaaacaagaacgtggaaaatccctattgtttaaaacatctgcaggagtcaacatgtgcacgttaatagcaatggacttgggtgaactttgtgaagatacaatgacatacaaatgcccgcgcataacagaagcagaacctgatgatgtagactgttggtgcaacgccacagatacttgggtgacatacggtacctgttcacaaacaggtgaacatcgccgagagaaaagatcggtcgcgctagcacctcacgtcgggctaggattagaaacccgcacggaaacgtggatgtcatcggaaggagcatggaaacaaattcaaagagttgaaacatgggcactgagacatcctgggttcacggttattgccttctttcttgcgcatgctattggtacttcgattacgcaaaaagggataatatttatactactaatgttagtcacaccaagtatggcaatgcgctgcgtaggaataggaaatagggacttcgtagaaggattgtcaggagctacatgggtggatgtagtgctagaacatggcagctgcgtcacaaccatggcgaaaaataaacccaccttagatatagaactgctaaaaactgaagttactaacccggccgttcttaggaaattatgtatcgaagcaaaaatatcaaataccactactgattcgaggtgtcctacacaaggcgaagctacgctggtagaagaacaagacgtaaactttgtgtgccgacgtaccttcgtagatagaggctggggtaatggctgtggactatttgggaaaggatcattattaacttgcgcaaaattcaaatgtgtcacaaaattggaaggaaaaatagttcaatacgaaaacctcaaatatagcgttattgttacggttcatacaggtgaccaacatcaagtaggtaatgagacaacggaacacggcactatagccacgattactccacaagcaccgacgagtgagatacaactaactgattatggagcactaacattagactgctcacctcgaactgggctggattttaacgaaatggtcttactaacgatgaaagagaaaagttggttagtacataaacagtggtttctagacttaccattaccctggacttcaggagccagcacaagtcaagaaacatggaacagacaggatcttttggtaacgttcaaaacagcgcacgccaagaaacaggaagttgttgtactaggaagtcaagagggtgcgatgcacactgcactcacaggcgcaaccgagatacaaacgagtggtacgactacgatatttgctggacatttaaaatgtagattgaagatggataaattgaccttaaaaggaatgtcatatgttatgtgtacagggtcattcaaactagaaaaagaagtcgctgagacacaacacggtacagttcttgttcaagttaaatacgaaggaacggatgcaccttgtaaaattccgtttagcacccaagacgaaaaaggcgtaacacaaaatgggagattgataacagcaaatcccatcgtaaccgacaaggaaaaaccagtaaatattgagactgaaccacctttcggcgagagttatatagtagttggggccggtgaaaaggcccttaagttaagttggtttaaaagaggatcatccataggaaagatgttcgaagctaccgctcgtggagcaaggagaatggcaattcttggggacacagcctgggattttgggagtataggtggcgtctttacgagcgtaggcaagctagtgcaccaagtatttgggacagcttatggggtattatttagcggcgtctcgtggacgatgaagatcgggatcggcatactcctcacttggctcggtctaaatagtaggagcacctcgcttagcatgacttgtatagctgttggcatggtaactctttatttaggagttatggttcaagccgatagcgggtgtgtaataaactggaaaggacgagaactaaagtgtggaagcggaattttcgtgacaaacgaagtccatacttggacagaacaatataaattccaagcggactcaccaaaacgtctaagcgctgcgatcggaaaggcttgggaggaaggggtatgtggaatacgatcagctacacgcttagagaacataatgtggaagcaaataagcaacgaactaaaccacattttgcttgaaaatgacatgaaattcacggtagttgtaggggatgcgaatggaatacttgctcagggcaagaaaatgattagacctcaaccaatggaatacaaatactcatggaagtcatgggggaaagcaaaaattattggcgccgacattcaaaatacaacttttatcatagatggacctgataccccagaatgccccgatggacaaagagcatggaacatttgggaagtagaagattacggctttggagtattcacgactaacatatggctgaaacttagggatagttacactcaaatgtgtgatcatcgcctgatgtcagccgccataaaagattctaaagcagttcatgcagatatgggctactggatagaatcggagaaaaacgagacctggaagctagcaagggcgtcctttatagaagtgaaaacctgcacatggccaaagagccatacgttatggagcaacggagttctagaaagcgaaatgataatacctaaaatatttggtggacctatttcgcagcacaactacagacctggatattttacacaaactgcaggtccatggcatttaggaaaattagaactggattttgacttgtgcgaaggcactacagtagtggtggacgagcattgtgggaatagaggcccaagcctaagaacgactactgttacaggcaagatcatacatgagtggtgttgtaggagctgcacattacccccactaagatttcgcggggaagacggctgttggtacggaatggaaatacgaccagtcaaagaaaaagaagaaaaccttgtacggtcaatggtaagtgcgggaagcggtgaagtagacagcttctcattaggaattttatgtgtgtccataatgattgaagaagtaatgcgatcacgatggagccgcaaaatgttaatgactggcactttagctgtatttttattgttaatcatggggcaactcacatggaacgacctcataagactatgtataatggtaggagctaacgcttcagatagaatgggcatgggcacaacatatttagctttgatggctacatttaaaatgcgccccatgttcgcagtaggtttgttgtttagacgattaacaagtcgagaagttctgttattaacgataggattaagcctagttgcttcggtagaactcccaaatagtttagaagaattaggagatggtttagcgatgggaatcatgatgctaaaactcttgacggaatttcagccccatcaattatggactacattgctcagcttaacctttgtgaaaacaaccttgtccttagattatgcatggaaaacaacagcgatggtgttgagtatagtctcactatttcccctctgcctatccacgacttcacagaagacaacatggctacctgtactactgggttcatttggatgtaagcctctaactatgttcctaattactgaaaataagatatggggacgtaagtcgtggcctctcaatgaaggtatcatggcgataggtattgtttctattctcttatcctctttactcaagaacgatgtacctttggcgggaccactcattgctggtggtatgcttatagcttgttacgtaatatcaggatcttctgctgaccttagcttagaaaaggctgctgaagttagctgggaacaagaggccgaacactcgggtgcgagtcataacatcttagtggaagtacaagacgacggaactatgaaaattaaagatgaggaaagggacgatacacttacaatactattaaaagcaacattgttagcagtttcaggggtttatccaatgagcattcccgcaactcttttcgtatggtatttttggcagaaaaagaaacaaaggtctggagtcttatgggacacacctagccctccggaggtagaaagagccgtgctagacgacgggatatatagaatcttacagagaggtttacttggacgaagtcaagtaggagtgggtgtgttccaagacggagtattccatacaatgtggcatgtaacaaggggagctgtattaatgtatcaaggaaaacgactggaaccctcttgggctagtgtgaagaaagatttgataagctatggaggcggttggagattccaaggttcttggaatacaggggaagaagtccaagtaatcgcggtggaacccggcaaaaacccgaaaaatgttcaaactacaccgggaaccttcaaaacaccagagggagaggttggagcaatagctctggactttaaaccagggacttcagggtcacccattgtaaaccgagaaggaaaaatagttgggttatatggaaacggtgttgtgacgacatccggaacatacgttagcgctatagcccaagcaaaagcgtcacaagagggacccttgccagagatagaagacgaagtctttaagaaaagaaatcttacaataatggatttgcacccaggatctggaaaaacacgacgatatcttccggccattgtgagagaagcgataaaacgaaaacttaggacgctaatattggcaccaacacgagttgttgcaagtgaaatggcggaagcgttaaaaggcatgcccattcgttatcaaaccactgctgtaaaaagtgagcacacaggaagggagatagtagaccttatgtgtcatgccactttcacaatgagactacttagtccggtaagagttcccaattataatatgattattatggacgaagcccattttactgatcctgcctcgatagccgcgagaggttatatatctacacgtgttggaatgggggaagcggccgccatttttatgacggctacaccccctgggtccgtagaagcattccctcaaagtaacgccgtaatacaagatgaagagagggacatacccgaacgttcatggaactcaggttatgactggattgccgactttcctggtaaaactgtctggtttgttccaagcatcaaatcaggtaatgatattgcgaactgcctcaggaaaaatgggaaacgagtaattcaattatcaagaaaaaccttcgataccgaatatcagaaaactaagaataatgactgggactatgtagttaccaccgacatatcagaaatgggtgcaaattttagagcagatagagttatcgaccccagacgatgcttgaagccagttatactaaaggatggacccgaacgagtcatactagcaggaccaatgccagtcactgtagcaagtgcggcacaaaggcgtggacgaataggacgaaaccaaaataaggaaggcgaccagtatgtatatatggggcaaccgttgaataacgatgaagatcacgcccattggacagaagccaaaatgctactggacaatattaatacaccggagggaattatacctgcattgtttgaaccagagagagagaaaagcgcagcaatagatggggaatatcggctacgcggcgaggctcgaaaaacgtttgtcgagttgatgcgacgaggagatttaccagtatggctgagttataaggtggcctcagaaggtttccagtactcggatcgacgctggtgctttgacggggaaaggaataaccaggttctagaagaaaacatggacgtagaaatatggacaaaggaaggagaaaggaagaagctaagacccagatggttggacgcccgaacttattcggacccactcgcgttaagagaatttaaagaatttgccgcaggcagaagatcagtatcgggcgacttaatattagaaataggaaaactaccgcaacatctcacattgagagcgcaaaatgcattagataatttagtaatgttacacaactcagagcaaggtgggaaggcttatagacatgccatggaagaacttcccgatacaatagaaacgttgatgctgctcgcattaattgccgtattaactggaggagtaacattgttctttttatcagggaaaggattaggaaaaacgtccatcggtctgctttgcgtgacggcgagctccgcacttttatggatggcttcagttgagcctcactggattgcagcaagtataatccttgagttcttcttgatggtacttcttattccagaaccagataggcagaggactcctcaagacaaccaactagcgtatgttgtaataggcctgttattcatgattttaacggtagcagccaatgaaatgggcctgctggaaacaaccaagaaagatttaggcataggatacgtagctgcagagaaccatcaacacgcgaccatgctagatgtcgatctccacccggcatcagcatggactttatatgcagtagcaaccactgttataacgccaatgatgcgtcatactatagaaaacacaactgctaacatctcattaacagctatagcgaatcaggcagcgatcctgatgggactagataaaggatggccaattagtaaaatggatataggtgtgccactattagcattaggctgttacagccaagttaacccattaactttaaccgccgcagtactaatgttagttgctcattatgcaataataggtccgggcctacaagctaaagcaaccagggaagctcagaagaggacggccgcaggtataatgaaaaatccaactgttgatggtattgtagcaatagaccttgatccagttgtatacgatgcaaagtttgaaaaacaactgggtcagattatgcttttgatcctctgtacttctcaaatattgcttatgcgaactacttgggctttatgtgagtcaattacactcgctactggtccgttaacaacgctttgggaaggaagcccaggtaagttctggaatacaactattgcagtatctatggcaaatatattccggggtagctatttagctggagcaggattagcttttagccttatgaaaagcctgggaggtggacgacgcggaaccggagcgcaaggagaaacactaggtgaaaaatggaaacgacagctaaatcaattaagtaaatctgaatttaacacatataaaaggagtggtattatggaagtagatcgttccgaagcaaaagagggactaaaaagaggcgaaacgactaagcatgctgtatcgagagggactgcaaaacttcgatggttcgtagagagaaatttagtcaaaccggaaggtaaagtgattgatttaggttgtggacgcgggggttggtcctattattgtgctggattgaagaaagtaacagaagtgaaagggtatacaaaaggcggaccaggacacgaagaacctattcctatggctacgtatggctggaatcttgtaaaattacattcaggaaaagacgttttctttatgccaccagaaaagtgtgacacattactatgtgatattggtgaaagtagccctaacccaacaattgaggaagggaggacactaagggtgttaaaaatggtagaaccttggcttaggggaaaccaattctgcataaaaattctcaacccttacatgccatctgtagtggagactcttgaacaaatgcaaagaaaacacgggggaatgctagtaagaaatccactttctagaaatagcacccacgaaatgtactgggtttcgtgcggaaccggaaatatagtatcggctgttaacatgaccagtagaatgttactaaataggtttaccatggcacaccgcaaaccaacctatgagagggatgtggacttaggagccgggacgagacacgtcgccgttgaacccgaggtcgccaatctagacataattggtcaaagaatcgagaacatcaaaaatgaacacaaaagcacgtggcattatgatgaagacaacccgtataaaacatgggcatatcatggttcatatgaggtcaaacccagtggaagtgcatcaagtatggtcaacggtgttgtgcgcctactaactaaaccatgggacgtaatacccatggtaacccaaattgcaatgactgatactacaccttttggtcagcaaagagtgtttaaggaaaaagtagacacaagaacacctagagcaaaaagaggaacaacacaaataatggaagttaccgccaaatggttatggggtttcctgagcagaaacaagaaaccacggatttgcacgcgcgaagaatttacaagaaaggtacgaagcaatgccgcgatcggggctgttttcgtagacgaaaaccaatggaacagcgcgaaagaagcagttgaagacgaaaggttctgggacttagttcaccgcgaaagagaactacataaacaaggaaagtgcgccacttgtgtttataacatgatgggtaaacgcgagaagaaattaggagagtttggtaaagctaaagggtcgcgagccatttggtatatgtggttaggggctcgctttctagaatttgaggctctcggctttatgaatgaagatcattggttttcaagagaaaatagtttgtcgggcgtagaaggagagggactccataaattgggctacatactaagagatataagtaaaatcccaggaggaaacatgtatgcggatgacacagcaggttgggatacaaggatcactgaagatgatttgcagaacgaagctaagatcacggatataatggaacctgaacacgccctgttagcgacgtctatcttcaagttaacataccaaaacaaggtagtacgtgttcaaagacccgccaaaaacgggactgtgatggatgttatatcaagaagggaccaaagaggcagtggccaagtcggaacctatggactaaatacatttacaaatatggaggtccagctaatacgacaaatggaaagcgaaggtatatttttacccagcgagctcgaaacacctaatctagcagagcgagcgttagactggctagaaaagcacggtgctgaaagattgaaaaggatggccatttcaggagatgactgtgtagttaaacctattgacgatcgattcgcaacggcactaactgctttaaatgacatgggaaaagtccggaaagatataccgcaatgggaaccttcaaaaggttggaatgattggcagcaagtacctttctgttcacaccattttcatcaactaattatgaaagatggacgcgaaatagtagtaccatgtcgaaatcaagacgagctagtaggcagggcaagagtatcccagggggcagggtggagcctacgcgaaactgcatgcttggggaaatcatacgcacaaatgtggcaattaatgtacttccataggagggatctcaggcttgcagctaatgctatctgcagcgcggtacctgtagattgggtacccgcaagtaggacaacttggtccatacatgctcatcatcaatggatgacgactgaagacatgctaagcgtatggaaccgagtatggattgaagaaaatccttggatggaggacaaaacgcacgtatccagctgggaagaagtaccatacttaggcaaacgggaagatcaatggtgcgggtcgttaattggtctcacagcacgcgctacatgggcaactaatattcaagtagctataaatcaagtacgacgccttataggaaacgaaaactatttggactatatgacgtcgatgaaacgatttaaaaatgaaagcgaccctgagggagccctatggtag

SEQ ID NO: 22033 - RNA, 9879 nt, synthetic construct
  misc_feature 1..9879: note = derived and/or modified CDS sequence (opt6) from DENV-1__KC692500__SS-prME
  source 1..9879: mol_type = other RNA
agcgtgacaatgttattgatgttacttcctacagcacttgcgtttcatttaacaaccagaggaggggaaccacacatgatagtctctaaacaagaacgaggaaaaagccttttattcaaaacgagcgccggtgtcaatatgtgtacactgattgcaatggacctaggcgaactgtgtgaagataccatgacatataagtgtccgagaataactgaagcagaacctgacgatgtcgattgttggtgtaatgcaaccgatacttgggttacgtacggaacttgcagtcagactggagaacacaggagggagaaacgatctgtagcactagcaccacatgtcggactaggactagaaacaaggactgagacttggatgtcttctgagggggcttggaaacaaatacaacgagttgagacatgggcattacgacaccctggattcacggttatagcattctttctagcacatgctataggtacgtctataactcagaaaggtataatctttatattactaatgttggtcacacctagcatggcgatgaggtgtgtgggaattggtaacagagatttcgtggaaggtttgagtggtgcaacctgggtagatgtcgtactcgaacatggatcctgcgtaactactatggctaaaaataaaccgacacttgatatagaacttttaaaaacggaagtcactaatccagcggtcttacgaaaattatgtatagaagcaaaaatatcaaatacaaccaccgatagtagatgcccaacacaaggagaagcaacattagtagaagaacaggacgctaacttcgtatgcaggcgaacgttcgtggaccggggctgggggaacggttgcggattgttcggaaaaggatctctactgacctgtgcaaaattcaaatgtgtgacaaagctagaaggtaagatagttcaatacgagaatctgaaatactcggtaatcgtaactgtccatacgggagaccaacatcaagtaggaaatgaaacaaccgagcacgggacaatagctacaattacaccccaggcaccaacttcggaaattcaattgactgattatggagcgctcacactggactgtagtccacggactggtctcgattttaacgaaatggttcttcttacgatgaaaggaaaatcatggcttgtgcacaaacagtggttccttgacctaccgctcccatggaccagtggggcgagcacctcacaagaaacgtggaataggcaggatttactggttacattcaaaacggcgcacgctaagaaacaagaagtagtagtcctaggaagtcaagaaggagcgatgcacacggcattaacaggagccacagaaatacaaacatcaggaaccacaacaatatttgccggccatcttaaatgtagactaaaaatggataaactgacgctgaaaggtatgtcctatgttatgtgcactggtagctttaaattagagaaagaagtcgctgaaacgcaacacgggaccgttctcgtgcaggttaaatatgagggaacagacgctccttgtaaaataccatttagtacccaagacgaaaaaggtgtaacccagaacggacgtcttataacagcaaacccaatagtaacggataaagaaaaaccggtgaatatagaaacagaaccaccttttggtgaatcctacatcgttgttggagccggtgaaaaggctttgaaactatcttggtttaaacgaggaagttcaatcggcaaaatgttcgaagcgacagctagaggagcgcgaagaatggcaatactaggggatactgcatgggacttcggtagtatcggaggcgtattcacttctgtcggaaaattagttcaccaggtatttggcacggcatatggcgtattatttagtggtgtatcctggacaatgaaaataggcataggaatattgcttacatggttaggactaaatagccgcagtacatctctgagtatgacgtgtattgctgttggtatggtaaccctgtatctaggagtaatggtacaggctgacagcggatgcgttataaattggaaaggaagggaacttaaatgcggaagcggcatttttgttacaaacgaagtccatacatggaccgaacaatacaaatttcaagcagatagccctaaaagactaagcgctgctataggtaaggcttgggaagagggtgtttgtggaatccgcagtgcaacaagactcgaaaatattatgtggaaacaaataagtaatgaactaaatcatattcttctagaaaatgatatgaaatttacggtcgtcgtaggagacgccaatgggatattagcacaaggtaagaaaatgatcagaccgcaaccgatggaacataaatattcatggaaaagttggggcaaagccaaaataataggggctgacattcaaaataccacttttataattgatggacccgatactccagagtgccctgatggacagcgagcttggaacatctgggaagttgaagattacggttttggagtgtttacaacaaacatatggttaaagctacgcgactcctacactcaaatgtgtgatcatagattaatgagtgctgcaattaaagatagtaaagcagttcatgcagacatgggctattggatcgaaagcgagaaaaatgaaacttggaagttggctagagccagtttcatagaagttaaaacgtgtacctggccaaaaagtcacactttgtggtccaatggagtgttagaatcggaaatgataatacccaagatattcggcggaccaatatctcaacacaattatagaccaggatattttacgcaaacagcgggaccgtggcacctaggaaaattagagcttgactttgatttgtgtgaaggaacaacggtcgttgttgacgagcattgcgggaacagagggccaagtttgcgcacaacaactgtaacaggtaagataattcacgagtggtgttgtagaagctgtacgctacctcccttgcgatttagaggggaagatggatgttggtacggtatggaaatacggcctgtaaaggaaaaagaagaaaatctggtgagatcaatggtttcagctggctccggggaggtagatagtttttcattaggaattttatgtgtgtcaataatgatagaagaggtgatgagaagtcgctggtcgcgaaagatgcttatgactggtacactagctgttttcctcttattaattatgggccaactaacatggaacgatttgatccgactttgtatcatggtaggagctaatgcatcagacagaatggggatgggaactacatatttagctttaatggctacctttaaaatgagacccatgttcgccgtaggtttattatttagacggctaacatctcgtgaggtactcctcttaacgatagggttatctttagtggcttcagtagaattaccaaactcgttggaagaattaggagacggattagcaatgggcatcatgatgctaaaattattaactgaatttcaaccgcatcaactctggacgacactattaagccttacattcgtaaaaactaccctgagcttagattatgcttggaaaactactgcaatggttctctcaattgtatcactattcccactatgtttgtcaacgacctcgcaaaagacaacatggctaccagtattgttgggttcatttggatgcaaacctttaactatgttcttaatcaccgaaaataagatctggggtcgtaaatcttggccgctaaatgaaggaataatggcaattgggatagtaagtatcttattatcaagtttattgaaaaatgacgtacctttggctgggcccctgattgccggaggaatgttaatagcctgttacgttatttcggggtcttcagcagatctaagcctagaaaaagcagctgaagttagttgggagcaggaagcggaacacagcggtgcaagccataatattttggttgaagttcaagatgatggaacaatgaaaatcaaagatgaagagagggacgatacactcacgattcttctgaaggccactttactagcagtatccggtgtatatcctatgagcattccagcaacccttttcgtttggtacttctggcagaagaagaaacaacgatcgggagttctctgggacacaccgagtccccctgaggtagaaagagccgttcttgacgatggaatatacagaattttacaaagaggtctgcttggaaggtcccaagtaggagttggagtattccaggatggagtatttcacaccatgtggcatgtcacgcgaggagctgtacttatgtaccagggcaaaagattagagccgagttgggcatcagttaagaaagatctaatctcatatggtggcggatggagatttaaggggtcttggaacactggagaagaggtgcaggtaattgctgtcgaaccgggcaaaaatcctaaaaacgtacaaaccacgcctggaactttcaaaacaccagagggcgaggtgggcgcaattgcgctggactttaaacctggaacatctggctcaccgatagtcaacagggagggcaaaattgtcgggctctatggaaatggcgttgtaacaacgtccggtacgtatgtatcagcaattgcgcaagcaaaagcatcacaagaaggtcctttaccggaaatagaggacgaagtattcaaaaagagaaaccttactataatggatctgcatcctggaagtggtaagactagaaggtatttaccggctattgtacgagaggcaatcaaaagaaagttacgaactctaattctggctcccacgcgtgttgtggcatccgaaatggcagaagcacttaaaggtatgcctattcggtaccaaactacggcagtaaaaagcgaacataccggtagggaaatagtagatttaatgtgtcacgcgacatttacaatgcgtcttctgtccccagtaagagttccgaattacaacatgattattatggacgaagcacacttcacggatccagcgtctatagccgcccggggttacataagcacaagagtaggtatgggggaagccgcagctatatttatgacagccaccccaccaggaagtgtcgaagcatttccccaatctaacgctgttattcaagatgaagaaagagatatacccgaaagaagctggaacagtgggtacgattggataacagattttccaggaaagaccgtatggttcgtacccagcatcaaatcgggtaatgatattgcaaattgtttaaggaaaaacggtaaaagagttattcaattatctaggaagacttttgatacagaatatcagaaaaccaaaaataatgactgggattatgtagtaacaaccgatatatctgaaatgggagccaattttagggccgatagagtcatagatccaaggagatgtctaaaaccagtcatattaaaagacggacctgaacgagtaattttagcgggacccatgccagtcaccgtggccagtgctgcacaacgaagagggagaatcggtcggaatcaaaacaaagaaggtgaccaatatgtctatatgggccaaccgttgaacaacgatgaggaccatgctcactggaccgaggctaaaatgttattggataatatcaatactcctgaaggaataattcccgcgctatttgaaccggaaagagagaagtcggcggcaatagatggtgaatatagattacgtggagaggcgaggaagactttcgtagagttaatgcgacgaggagacttaccagtatggttaagctataaagtagcttcggaaggcttccagtactccgatcgaagatggtgcttcgatggagaacgaaacaatcaagtcctagaagaaaatatggacgttgagatctggactaaagagggagaaagaaagaaacttagacctagatggttagatgcaaggacttactcagacccattagccctacgggagttcaaagagtttgctgcaggccgaaggagcgtgagcggagacttgatacttgaaattggtaaactaccacaacacctaactctacgcgctcaaaatgctttagacaatctagttatgctccacaactcagagcaaggtggtaaggcttacagacatgcaatggaagaattgccagatacaatagaaactcttatgctcttggcattaattgctgtactaaccgggggagtaacactgttctttttatccggaaaagggctgggaaaaacttcaattggtctattgtgtgtcaccgcctcaagcgctttgctatggatggcttcagtcgaaccacactggattgccgcatctataatcctagaatttttcctgatggtattactgatcccagaaccggatagacaacgtacaccacaagataaccaactggcttatgtagttattggattactatttatgatactaacagtagcagctaatgaaatgggtctgttagaaacaacaaagaaagatctcggcatcggttatgttgctgcagagaaccatcaacacgcaacaatgcttgatgtagatttacatccggccagtgcttggacgctatatgccgtagcaactacagtaataaccccaatgatgaggcatactatcgaaaatacaaccgccaatattagcctcacggcaattgccaaccaagcggccatactaatgggtttagataaaggatggcccatatcaaaaatggacattggagtaccgctactggcattaggttgttattcccaggtcaatccattaacactaaccgctgctgtattgatgctcgtagcacactacgcaatcattggtcctggcttgcaagctaaagccactcgggaagcgcagaagaggacagcagccggaattatgaagaatccgacagtagatggtatcgtcgccattgatttggatccagtagtgtatgacgctaaattcgaaaagcagttagggcaaataatgctattgattctatgcacatcccagattctactcatgagaactacgtgggctttgtgcgaatcgataaccctcgctacaggacctttgacaaccttatgggaagggtctccgggtaagttttggaatacgaccattgcagtgagtatggcgaacatttttagaggaagttatctcgcgggagcgggtctagcattttcattgatgaaaagtctgggtggagggagacgtgggaccggagcacaaggtgaaacacttggggagaaatggaaacgtcaacttaatcaattatcgaaaagcgaatttaacacatacaagaggagtggtataatggaagttgacagatcagaggctaaagaagggttaaaaagaggtgagacaacgaagcacgcggtatctagaggaacagcgaaattaagatggtttgtagaacgaaacttagtgaagccagaaggaaaagtcatagacctaggatgtgggagagggggctggagctactactgtgccggacttaagaaagttacagaagtcaaaggatacacgaaaggcggtcctggacatgaagaacccatacctatggcaacgtacggatggaacctggtaaaactgcatagcggcaaggacgtatttttcatgccaccggaaaaatgtgatactcttctatgcgacataggtgaatcttctcctaatccgactatcgaagaggggcgcactcttcgggttctgaaaatggttgaaccgtggctaaggggcaatcagttttgtataaagatactaaatccatacatgccatcagtagtagaaactctggagcagatgcagaggaaacatggtggaatgttagtcagaaaccctcttagtcgaaattccacacacgagatgtactgggtatcatgtggaacgggcaatattgtaagtgctgtaaacatgacctcccgtatgttattaaataggtttaccatggcacatcgtaagcccacgtatgaaagagacgttgatttaggagcagggacaagacacgtggcagttgagcccgaagtcgcaaacttggacattatcggccagcgtattgagaatatcaagaacgagcacaaatcgacatggcattatgacgaggataatccttataaaacatgggcttaccacggatcttacgaagttaaaccgtcaggttcagcttcaagtatggtgaatggagttgtacgacttttaactaaaccatgggatgtcatcccaatggttacccaaatagcaatgacagatactactccattcggacaacaaagagtattcaaagaaaaagttgacaccaggactccacgggccaaacggggcacgacacagattatggaagtaacagctaagtggctttggggcttcctaagtaggaataagaaacccagaatctgcacaagagaagaatttacaaggaaagtaagatcgaacgctgctattggagcggtctttgtagatgaaaatcaatggaactcggctaaggaagcggtagaagatgaaagattttgggaccttgttcatagagaacgagaactccataaacaaggtaaatgtgcaacatgtgtatataatatgatgggaaagagggaaaagaaactaggtgaatttgggaaggccaaagggtccagagctatttggtacatgtggctcggagcacgctttctagagttcgaggccctcggttttatgaacgaggatcattggttttcacgagagaacagcttgagcggagtggaaggagaaggattacataagttaggatatattctccgagatattagcaagatcccaggagggaatatgtacgctgatgacacggcgggatgggatacgagaataacggaggacgatctacagaacgaagctaaaataaccgatataatggaaccagaacacgcactattggcgacatcaatctttaaattaacgtatcagaacaaggtagtaagggttcaaagaccggccaaaaatggaacagttatggatgtaatcagtagaagagatcaacgaggtagtggccaagtcgggacatatgggttaaataccttcactaatatggaggtacagctcatccggcaaatggagtcggaaggaatcttcctcccatctgagttggaaactccaaatctcgcagaacgagctctagactggctagagaaacacggagctgaaaggcttaaacgaatggctataagtggagacgactgtgtagtcaaaccgatagacgatagattcgcaacagcactgacagcactaaatgatatgggtaaagttagaaaagatatacctcaatgggagccatcaaaagggtggaacgactggcaacaagtccccttctgttcacatcatttccatcaattaatcatgaaagacggacgcgaaatagtcgtaccgtgccgtaatcaggatgagttagtaggtcgagcgcgagtgtcccaaggcgcaggatggtccttacgtgaaaccgcatgcctgggcaaatcatacgcacaaatgtggcaacttatgtatttccatcgacgagacttacgcctagcagcaaacgcgatctgttccgcggtgcctgtagattgggtacctgcatctcgaactacttggtctattcatgcacaccatcagtggatgaccacggaagatatgttatcagtttggaatagagtatggatagaagaaaatccttggatggaagataagacgcacgttagttcatgggaagaggtaccgtatcttggaaaaagggaagatcaatggtgtgggagcttgataggactaacagccagagccacttgggccactaatatacaagtggcaatcaaccaagtaagacgattgataggaaatgaaaactacttagattacatgacgagcatgaaaagattcaaaaatgaatcagaccctgaaggcgccctatggtga

SEQ ID NO: 22034 - RNA, 9879 nt, synthetic construct
  misc_feature 1..9879: note = derived and/or modified CDS sequence (opt6) from DENV-1__KC692501__SS-prME
  source 1..9879: mol_type = other RNA
agtgtgacgatgttattaatgttactaccgacagctctcgcctttcatttaactactagaggaggggaacctcatatgatagtttctaaacaagaacgagggaaatctttactgtttaaaacttcagccggtgtaaatatgtgtacccttattgctatggatttgggggaactttgtgaagacactatgacttacaaatgccctagaatcacagaagcagaacctgacgacgtagactgttggtgtaatgcaaccgacacttgggtaacatacggtacttgcagtcaaaccggagaacatcgtcgcgagaaaagaagcgtagcactggcaccccacgtaggactcgggcttgaaacccgcactgaaacttggatgtcgtcagaaggagcctggaaacaaattcaacgagtagaaacgtgggcattgagacatcctggatttacagttattgcgttctttttagcacacgctataggcacttccatcactcaaaaaggtataatttttatattacttatgcttgtcacaccatcaatggcaatgaggtgcgtaggaataggtaatagggacttcgtagaaggacttagcggagcgacatgggtcgacgtcgtattggaacatggtagctgtgtaacaactatggcgaaaaataaaccaacattagatatagaacttttaaaaacagaagttacaaatccagcagttctgagaaaactgtgcatcgaagcaaagataagtaacactacaacagactccaggtgtccaacacaaggagaagcaacgttagttgaagaacaagacgcaaattttgtctgcagacgaacatttgttgaccgtggatggggtaacggctgtggcttatttggtaaagggagccttcttacatgtgcaaaattcaagtgtgttactaaattggaaggtaaaatagttcagtatgaaaacctcaaatatagtgtaatagtaacagtgcatacaggagaccaacatcaagtgggtaatgaaacgacagaacacggcacaatagcgacgataacaccacaagcccctacatcagaaatacaactgacagactatggagcattaaccttagattgtagccctcgtactggactagattttaatgaaatggtcctcttaacaatgaaagaaaagtcctggctagttcataagcaatggtttttggatctccccctcccatggacatcgggcgcatcaacatcacaagaaacatggaatcggcaagatctactcgtaacttttaaaaccgcacatgccaagaaacaagaagtagtagtacttggatctcaggagggcgcaatgcatactgccctaaccggggccacagaaatacagacgtccggaaccactacgatcttcgccggacacctaaagtgcagattgaaaatggataaacttaccttgaaaggcatgtcttatgtcatgtgcacaggatcctttaaacttgaaaaagaagtcgcggagacacagcatggaacagttttagtccaagttaagtatgaaggaacagatgcaccgtgcaaaatacctttctccactcaagatgaaaagggagtgacccaaaatggaaggctaatcactgcaaaccctattgtaactgataaagagaaaccagtaaacatagagactgaacctccctttggagaatcatatattgtagtaggagcaggcgaaaaggcactaaaattatcatggtttaaaagagggagctcaataggaaaaatgtttgaagctactgctagaggggcacgccgtatggccatattaggggacacagcatgggacttcgggtctattggtggagtctttacaagcgtgggaaaactggtacatcaagtatttggcaccgcttatggagtgctattctcaggagtgtcttggacaatgaaaataggaattggaattttactaacatggcttggcttaaatagtcggagtacgagtctgagtatgacttgcattgcagtaggaatggtaacattatatctgggtgtcatggttcaagccgatagcggatgtgttataaactggaaaggaagagaactaaagtgtggttcaggtatatttgtaacaaacgaggttcatacttggacagaacagtataaatttcaggctgactcaccaaagcgactgtctgcagccattggcaaagcatgggaggagggtgtatgtggtattagatcagcaacaagactagaaaatattatgtggaaacaaatctctaacgaattaaaccacatcttattggaaaatgatatgaaatttactgtcgtcgtaggcgacgcaaatggtattttagcccagggtaaaaagatgattagaccacaaccaatggagcataagtacagctggaaaagctggggcaaagccaaaataataggggctgacattcaaaatactacctttatcatagatggtccagatacacccgaatgtcctgacgggcaaagagcatggaacatatgggaagtagaagactacggattcggagtatttactacgaacatatggcttaaactacgtgactcgtatacacagatgtgtgatcacaggctaatgagcgcagctattaaagacagtaaagcagttcatgctgatatgggatattggattgaaagtgaaaagaacgaaacttggaaactagctagagcatcattcatagaagtcaagacttgtacgtggcctaaatcacacacgctttggtcaaacggtgtcctagagtcagaaatgatcattcccaagatattcggtggacccatttcacaacataactataggccaggatatttcacgcaaacggcagggccctggcatcttggcaaacttgaacttgacttcgacttgtgcgaagggacaactgtagtcgtagatgagcattgcgggaatagaggccccagcttgagaactactacagttactggaaaaattatacatgaatggtgttgtcgtagctgcacattgccaccgctgcggtttaggggcgaagatggatgttggtatggtatggaaatacgccctgtaaaagaaaaggaggagaatcttgtacgctcgatggtgagcgcaggtagcggagaagtagacagcttctcattgggcattctctgtgtaagcataatgatagaagaggtaatgcgaagtaggtggagtaggaagatgttaatgaccggtacgttagcagtattcttactgttaatcatgggacaacttacatggaacgacctgatacgactttgtataatggtcggcgctaatgcatctgacagaatgggaatgggaacgacgtatttagcattaatggctacctttaaaatgcgcccaatgtttgcggttggattactattccggagacttacatctcgtgaagtactcttacttacgatcggattatcactcgtcgcgagcgttgaactacctaattctttagaagaactgggtgatggattggcaatgggcattatgatgctcaaactactgactgaatttcaacctcaccaactttggacgactctattatctctcactttcgtaaagactactttaagtttagattatgcctggaagactacggcaatggttctctcgattgtgagtttattcccgctgtgcttaagcactacatctcagaaaacaacatggttacccgttttactaggcagttttggatgtaaaccattgaccatgtttcttatcacggaaaataaaatatgggggaggaagtcctggccgttgaacgaaggaattatggcgattggaatcgtttcaatactgttatcatcccttttgaaaaacgatgtaccactagcaggtcctctaatagctggaggaatgctaatagcgtgctatgtaataagtgggtcatcagccgatttaagccttgagaaagccgcagaagtgtcatgggaacaagaagctgaacatagtggtgcatcacacaatatattagtagaagtacaagatgacggaacaatgaagattaaagatgaagaaagagacgacacattaacaatattactaaaggcaactctactagccgtcagcggagtataccccatgagcatacccgccactctatttgtgtggtacttttggcagaaaaagaaacaaagaagtggtgtcctgtgggatacaccatcaccaccagaagtggaaagggctgttttagatgatggaatatatagaatcctacaaagaggtttgttaggcagaagtcaagtcggcgttggtgtgtttcaagatggcgtattccatacgatgtggcatgtaacgaggggagctgtgctcatgtatcaaggtaaacgcctcgagccgtcttgggcaagtgtgaagaaagatctgatctcttatggtggtgggtggaggtttcaaggttcatggaataccggcgaagaagttcaagttatagcagtcgaaccggggaaaaatcctaaaaatgtgcagaccacgccaggaacttttaaaactccagaaggtgaggtaggagctatagctcttgatttcaaaccaggtacttccggtagtccaatcgtaaaccgtgaagaaaagatagtcggactttacggaaacggggttgtaacaacttctggtacctatgttagcgctattgcacaagctaaagcaagccaagaaggacccctacctgaaattgaagacgaagtttttaagaagagaaatctcacaattatggacctccatcctgggtcaggaaaaacaaggcgttatttacccgcaatcgtacgcgaagctataaaacgcaaattaagaacactgatactcgcgccaacgcgtgtagtagctagtgaaatggcagaggcgttaaagggaatgccgattcgctaccaaacgactgcagttaagtcggaacatactggaagagagatagtagatctcatgtgccacgcaacctttactatgaggctgctaagtccagtaagagttcctaattataatatgatcattatggatgaagctcacttcacagatccagcgagtattgcagctagaggatatatatcaacaagagtagggatgggtgaagccgcagccatatttatgacagccacaccacctggatcagtggaggcttttccgcagtcaaacgcagttatacaagatgaggaacgtgatatcccagaaagaagttggaatagtgggtatgactggatcacagactttccgggaaagactgtttggtttgtcccgtccataaagagtggcaacgatatagcaaactgtctgaggaaaaatggtaaaagggtaatacaattgagtcgaaagacatttgacacagagtaccagaaaactaaaaataacgactgggactatgtagtaaccactgatatctcggaaatgggcgctaatttcagagcagacagagttattgatccaagaaggtgcctcaagccagtaatcttaaaggatggaccagaacgagtcatattggcaggtccaatgcctgttactgtagcctcggcagcacaacgaaggggcaggataggcagaaaccaaaataaagaaggagatcaatatgtttatatgggtcagccattaaacaacgatgaagaccacgcccactggacagaagccaagatgcttttagacaatataaatacaccagagggaataataccagcattgttcgagcccgagagggaaaagagtgcggccatagacggagaatatagattaagaggggaagcaagaaaaacgtttgttgagctaatgcgaagaggagatctaccagtttggctttcttacaaggttgcttcggagggattccaatattcagacaggagatggtgttttgatggtgaacgcaacaatcaagtactcgaagaaaacatggatgtagaaatatggacgaaggaaggagaaaggaagaaattaagaccgagatggctagatgctaggacgtatagtgatccacttgcactacgtgagttcaaagagttcgcagctggacgtcgtagtgtctcgggagacttgattctcgaaataggtaagctaccgcaacatctaacattacgtgctcagaatgcgttggataatttggtaatgctacacaactctgaacagggtggaaaagcgtacagacacgcaatggaagaattacccgatacaatcgaaaccttgatgctattagctctaatcgcagtactaacaggaggagtcacactattcttcctgagcgggaaaggattaggtaaaacatcaatcggattactatgtgttacagcatctagtgcgcttctatggatggcatcagtcgaaccacattggattgctgcatccattattttggagttcttccttatggtcctgcttattcctgaaccagacagacaaaggacacctcaagataaccaacttgcatatgtcgttatcgggcttttatttatgatactgacagttgcagctaatgaaatggggttactcgagacgaccaagaaagatctaggaataggctatgttgctgcagagaatcaccaacacgcaaccatgttggacgtcgaccttcatccagcaagtgcttggactttatatgcagtagcaaccacagtcattacaccaatgatgagacatacaatagaaaacactacagcaaacatctcactcactgctatagccaatcaagcagcaattttaatggggttagataagggttggcctatatcgaaaatggatattggagtacccctcttagcattaggatgttattcacaagtgaaccctctaaccctaacagcagctgtcctgatgctggtagctcactatgcaatcataggcccaggattgcaggcaaaagcaacacgggaagcacaaaagcgaacggcggccggaattatgaaaaacccaaccgtcgacggaattgttgcaatcgacttagatccggtagtatacgatgcaaaatttgaaaaacaactagggcaaattatgctactaattttatgcacttcacaaattctccttatgagaacaacttgggctctctgcgaaagtattacattagcgaccggtccgctgactacgttgtgggagggttcaccaggaaaattttggaatactacgatagcagttagcatggctaatatatttagaggtagttaccttgcaggcgctggattggccttttcattaatgaaaagccttggtggagggcgacgaggaacaggggcacagggagaaaccctgggagagaaatggaaaagacagttaaatcaactcagtaagagtgaatttaatacttacaagaggagtggaatcatggaggtggacaggtctgaagcaaaagaaggcctaaaaagaggagagacaacaaaacatgcggtttcgcgaggaactgctaagttaaggtggtttgtagaaagaaatctggtaaaaccggaaggtaaagtcattgatctaggatgtggacggggtggatggtcttactactgcgctggattaaagaaagtaactgaggtgaagggatacacaaagggaggaccgggacatgaagaaccaatcccgatggcaacttatgggtggaacctagttaagctgcactccggcaaagatgtattctttatgccgcctgaaaagtgcgatacgcttctatgtgacataggagaatcatctccaaatcctactattgaagagggacgaacattgcgggttctaaagatggtcgaaccctggttgaggggaaaccaattttgtataaaaatattaaatccgtatatgcccagtgttgttgaaactctcgaacagatgcaacgcaaacatgggggcatgctagtcagaaatcccttatctagaaattcaactcacgagatgtattgggtcagttgtggcacaggaaatatagttagtgctgtgaatatgacgtcgaggatgctactcaatcgttttaccatggcacatcgtaaaccaacatatgaacgggatgtggatttaggcgctggtacccggcacgtggcagttgaacctgaagtggccaatttggatattatcggacaaagaatagagaatatcaaaaacgagcacaaatccacctggcattacgatgaggacaatccatataagacatgggcttatcatggatcgtacgaggttaaaccatcaggctccgcatcctcgatggtaaatggagtagttagactcttgacgaagccctgggatgtaattccaatggttacacagattgcgatgacggacacaaccccgttcggacaacagagagtgttcaaagaaaaggtagacactcgaacacccagagctaagaggggaacaacacaaattatggaagtcacggccaaatggttgtggggtttcctgagccggaacaagaaacctcgtatatgtacacgagaagaatttacaagaaaggtccgctctaacgcagctataggagctgtgttcgtcgatgagaaccaatggaactccgctaaagaggcagtagaagatgaaagattttgggatctagttcatagagaaagagaactgcacaagcagggtaaatgtgcaacctgcgtctacaatatgatggggaagagagagaagaaattgggggagttcggaaaggcgaagggctctcgggccatatggtacatgtggttaggagcaaggtttctagagttcgaggctctaggcttcatgaacgaggatcactggttcagcagagagaatagtctaagtggagtagagggagaggggctgcacaaacttggttatatacttcgcgacataagtaaaattcctggaggcaatatgtatgctgatgacactgccggttgggacaccagaataacagaagacgaccttcaaaacgaagcgaaaataacggacataatggaacctgaacacgccttgctagcaacatctatattcaaactaacataccaaaataaggtagtaagagtgcaacgaccggcgaaaaatggtacagtgatggacgtcatttcgaggagagatcaaagaggatcaggacaagtaggaacgtatggtttaaatacatttacaaatatggaagtccaactaatcaggcaaatggaatctgaaggaatatttttacccagcgaattggaaaccccgaacttggcagagagggcattggattggcttgaaaaacatggcgccgaaagattaaaaagaatggctatttcaggagatgattgtgtagtaaaaccaatagacgaccgattcgcaactgcgcttacagctttaaatgatatgggtaaggtacgcaaggatattccacaatgggaaccatccaaaggatggaatgactggcaacaggtacccttctgttcacaccattttcaccagctaataatgaaagacgggagagagatcgttgtaccatgcaggaaccaagacgaacttgtaggtcgagcgcgggttagtcaaggggcaggatggtcacttagagaaaccgcttgcttgggaaaatcatacgcacagatgtggcaactgatgtattttcataggagggatctacgattagccgcaaacgcaatttgtagtgcagtcccagttgattgggttccagcatcgagaacgacttggagtattcatgcacatcaccagtggatgacaacagaagatatgttgtcggtatggaaccgagtatggattgaagagaatccctggatggaagataaaacacatgtttcaagttgggaagaagtaccatacctcggcaaaagagaagatcaatggtgcgggtcgctaataggattaacggcaagagccacctgggccactaacatacaagtagcaattaatcaggttcgacggctcattggaaatgaaaactacttagactacatgacttcaatgaaacgttttaaaaatgaaagcgatcctgaaggtgcattgtggtaa

SEQ ID NO: 22035 - RNA, 9879 nt, synthetic construct
  misc_feature 1..9879: note = derived and/or modified CDS sequence (opt6) from DENV-1__KC692502__SS-prME
  source 1..9879: mol_type = other RNA
agtgtaacaatgttgctaatgttactaccaacggcactagcttttcacctgacaacaagagggggtgaacctcacatgattgttagtaaacaagaaaggggaaaaagcctactttttaaaacctctgcgggggttaatatgtgtacattaatagcaatggatttaggggaattatgtgaagacacaatgacgtataaatgcccgcggatcacggaagccgaaccagacgatgtcgattgttggtgcaatgcgacggacacttgggtaacatatggaacatgttcccaaacaggtgaacataggcgcgagaaaagatctgtcgcattagcacctcatgtggggctaggattagaaactcgtaccgagacatggatgagttcagagggtgcatggaaacaaattcaacgagtcgaaacatgggcattaagacatccaggctttacggtaatagcatttttcctagcacatgctattggaacaagcattactcaaaaaggaattatatttatactgttgatgcttgtaacgccgagcatggccatgagatgcgttggcattggtaatagagactttgtcgaaggtctaagtggagctacctgggttgacgtggttttagagcatggttcctgcgtaacaacaatggctaaaaataaacccacacttgatatagaactactgaaaacagaggtgacaaatccagcagtattgagaaaactatgtatagaggcgaaaatatcaaacacaacaactgattcgcgatgtcccacccaaggtgaagcaacgttagtagaggaacaagatgctaactttgtctgccggaggactttcgtagacagaggatggggcaacggctgcggccttttcggaaaaggttctttattaacttgtgccaaatttaagtgcgttaccaagctagaaggaaaaattgtacaatacgaaaatctaaaatactctgtaattgtcacagtccatacaggtgaccaacatcaagttgggaacgagacaacagaacatggaacaatcgcgacaataacaccacaagctccaacatcggagatacagctcacagattatggtgccctcacattggactgtagcccacggacggggctagatttcaacgagatggtattacttaccatgaaagagaaaagctggttagtacataaacagtggtttctagatctaccactaccatggacttcgggtgcaagcacgagccaagaaacatggaacagacaagacctcctggtaacattcaaaactgcgcatgctaagaaacaggaagtggtagtactcgggtcgcaagagggagcgatgcacaccgcgcttacaggtgctacggaaatacagacgagtgggacaacaaccatatttgctggccatttaaaatgccgactaaaaatggacaaactgacgctaaaaggtgtaagttacgttatgtgtactgggagcttcaaactagaaaaagaagttgccgaaactcaacatggcacagtcctagttcaggtcaaatacgaaggtaccgacgccccttgtaaaatccccttctcaacacaggatgaaaaaggagttacgcaaaacggaaggctaatcacagcaaacccaatagtaacagacaaggaaaagcccgtcaatattgaaacagaacctccatttggagaaagctatatcgtagtaggcgccggagagaaggctcttaaattgtcatggttcaaaagagggtccagtattggaaaaatgtttgaagcaaccgcaagaggagcaagaagaatggcaatccttggtgatactgcatgggactttgggtcaatcggaggtgtttttacaagtgttggaaagctagttcatcaggtttttggaactgcttacggagtactatttagtggagtaagttggacaatgaaaattggaattggtatacttctaacctggctaggactaaattctcgatccacctcactttcgatgacctgtatagctgtcggtatggtaacgttatatttaggggtcatggttcaagcagatagtggttgcgttatcaattggaagggtagagagctgaagtgcgggagcgggatctttgtgacgaatgaagttcacacatggacagagcaatataagttccaggctgatagtccaaagagactaagcgccgctatcggaaaagcgtgggaggagggtgtatgtggaattagatcagctacaaggctagaaaatatcatgtggaagcaaataagcaatgaactcaatcatatactactggaaaatgatatgaagttcacagtagtggttggcgatgcaaacggtattttagcccaaggtaagaaaatgatcaggccccaacctatggagcataaatatagttggaagtcatgggggaaagctaagatcattggggccgacatccaaaacaccacatttataattgatggaccagatactcctgaatgtccagatgggcaaagggcatggaacatttgggaagtagaggattatggtttcggggtgtttaccactaacatatggctcaaattaagagatagctacactcaaatgtgcgaccatcgactgatgtcggcggccatcaaggactccaaggcggtgcacgcagacatgggctattggatcgaatcagagaaaaatgaaacatggaagctcgcccgcgcatcattcattgaggtgaaaacatgcacttggcctaagtctcatacattatggagcaatggcgtattagagagcgaaatgataattccgaaaatcttcggagggccaatttcccaacacaactaccgccctggatactttacccaaactgcgggaccttggcatttaggtaaattggaattagactttgatttatgtgaaggaacgaccgtggtagtagacgaacattgtggaaatagaggtccaagtttaagaacgacaacagtaacaggcaaaattatccacgaatggtgttgtagatcgtgcacattacccccactacggttccgaggtgaagacggatgctggtacggaatggaaataagaccagtaaaggaaaaggaagagaatttggttcgttcgatggtgagtgcaggctctggagaagtagattctttctcattaggaattttgtgtgtatccataatgatagaggaagtcatgagatcaagatggagcaggaaaatgctaatgaccggaacactggcagtatttttgctgttaattatgggacaattaacatggaacgatttaatcagattatgcatcatggtcggagccaacgcaagcgatcgcatgggaatgggaactacgtatcttgcgctcatggctacattcaagatgagacccatgtttgcggttggactattattccgtaggttaacttcaagagaagtacttctattgacaataggactaagtctagttgccagtgtagaactacctaattcactagaagaattaggagatggactggcgatgggtattatgatgttaaaactattgaccgaatttcaacctcaccaattatggacaactctactatcattaacctttgttcgaaccacactatcattagattatgcatggaaaacaactgcaatggtactgtccattgtcagtttatttccactttgtttatccaccacgagccagaaaacaacttggctccccgtactgctgggaagttttggatgcaagcccctaactatgtttttaattacagaaaacaagatctggggacgtaagagctggccgctaaatgaaggtataatggcaattgggatagtaagtattttactaagctcattgcttaaaaatgacgtacctctcgcaggtcctttaattgccgggggtatgctcatagcttgctacgttatatccggtagctcagcagatttgtctttagagaaagctgctgaagtcagctgggaacaagaagcagaacattctggcgcctctcacaacattcttgtagaagtccaggatgatggtacaatgaaaataaaggatgaagagagggacgacaccctaacgatacttctaaaggccaccttgctagcggtatctggagtatatcctatgagtattcctgcaacactcttcgtatggtacttctggcagaaaaagaaacaaagaagtggtgttctttgggataccccatctcctccagaaatggaacgtgccgtcttggatgatggcatttatcgaatactacaacgtggcctattgggaagaagtcaggtcggcgtaggagttttccaggacggcgttttccataccatgtggcatgttactaggggagctgttttgatgtatcaagggaaaaggttagagcctagttgggcaagtgtcaagaaagatctcataagttacggcggtggttggcggttccaaggatcgtggaatacaggagaagaagtacaggtaatagctgtagaacccggtaaaaatcccaagaatgtccagactactcctggaacttttaagacacctgagggagaagttggagctattgcactggatttcaaaccaggaacgagtggctcacctatcgtgaacagggaaggcaagattgtggggttgtacggcaacggtgttgtgactacctctggaacgtacgtctcagctattgcacaagcaaaagcatcgcaggaaggaccacttcctgagattgaggatgaagtattcaagaaaaggaacttaacaattatggacttgcaccctggatctgggaaaacccgaagatatttacctgccatagtcagagaagccataaaaagaaaattacgtacattaatcctagcgcccacaagggtggtagcgagtgaaatggcagaagcactcaaaggaatgcccataaggtatcaaacgacagctgtaaaaagcgaacataccgggagagaaattgtagatttaatgtgccatgcaacatttacaatgagactcttgtctcctgtccgtgttccaaattataatatgattatcatggatgaagcccactttacggatccagcttcaattgctgcccgaggttacatatctacccgagtggggatgggggaagcggccgcaattttcatgacagcaacgccaccaggttcagttgaagcattccctcaatctaacgccgtaatacaagacgaggaacgagatattcccgagaggagctggaactcaggttacgactggataacggactttcctggaaaaacagtttggtttgtaccaagcataaaaagcggcaacgatatagcaaattgtcttaggaaaaatggaaaacgggtaatacagttatctcgaaagacattcgacaccgagtaccagaagaccaaaaataatgactgggattatgttgttactacagacatctctgaaatgggcgctaactttcgagcagatagagtaatagatccgcgtcgatgtctcaaaccggttatattaaaagatggacctgaaagagtaattttagcaggcccaatgccagtaacagtcgcaagcgcggcacaacggaggggaaggataggtaggaatcaaaataaagagggtgatcagtatgtttatatgggacagcctttaaataacgacgaggaccacgcacattggacggaagcgaaaatgctactagataacatcaacacccccgaaggtattataccagctctctttgaaccggaaagagagaaaagtgcagctatagacggggagtaccgtctacggggtgaagctagaaagacgtttgtagaattaatgcgtagaggagacttgcccgtatggctgagttacaaagtggcctcggaaggttttcagtacagcgataggaggtggtgtttcgacggcgaaagaaataaccaggtactagaagaaaatatggatgtagaaatttggacaaaagaaggtgaaaggaagaagctgaggccaagatggctagatgccagaacatacagcgatccattagctttgcgtgagtttaaggagtttgctgcgggaaggagatccgtctccggggatttaattctagaaataggaaaactacctcaacatcttacgttgcgtgcacagaatgctctagataatctagtaatgttacataacagtgaacaaggaggaaaggcttacagacatgcgatggaagagttacctgacactatagaaacactgatgttattagcactgatagcagtgctaacaggtggtgttacgttattctttctaagtggcaaggggttagggaaaactagcatcggattactatgtgtaaccgcttcgtctgcactgctatggatggcttcggtagaaccacattggatagcagcgtcgattatactcgagttctttctgatggtactgcttataccagaaccggatcgtcagagaaccccgcaagacaaccagctggcatacgtcgttatcggactactatttatgatactaaccgtcgcagcaaatgaaatgggtcttctagaaacaaccaagaaggacctgggaataggatatgtcgcagcagaaaaccatcaacatgccactatgttagacgtggacttgcatccagcatctgcgtggacactctacgcagtagccacaacagttatcaccccgatgatgagacacacgattgagaataccactgcaaacatttctttaacagccattgcaaatcaagcagctattttgatgggacttgacaaagggtggccgatttctaaaatggatataggagttccgctcttagcacttggttgctactctcaagtaaatccgcttacactcactgctgcagttttaatgttagttgcacattatgcaattataggtccagggctgcaagcaaaagccactagagaagcacagaaaagaacagctgccggaattatgaaaaaccccaccgtagatggcatcgttgcgatagacttagatccagttgtatacgacgctaaattcgaaaagcaactcggacaaataatgctccttatcttatgcacatcgcaaatactgcttatgcgaaccacatgggcactatgtgaatctataacgctcgctacaggtcccctaacaacgttgtgggaaggtagtcccggcaagttttggaatactacaatagcagtttcaatggctaatatttttagaggcagctatctagcaggcgcgggactcgcttttagcttaatgaaatcattaggcggaggaaggaggggaacaggagcccaaggagaaacgttaggcgagaaatggaaaagacaactgaaccaattgtctaaaagtgaatttaacacatataagagaagcggcataatggaggtagaccgaagtgaagctaaagaaggattaaaaagaggtgagacaacgaaacatgcagttagccgcggtacggcgaagctgcgatggtttgttgaaagaaacttggtcaaacctgaaggaaaggtaatcgatttaggttgtggacgtggaggatggagctactactgcgcaggattaaagaaagtaactgaagtaaaaggctacactaaaggaggaccgggccacgaagaacccattcctatggcaacctatggttggaatctggtcaagctgcatagtggaaaggatgtattcttcatgcctccagaaaagtgtgataccctcctgtgcgatattggtgaaagtagtcccaacccaaccatcgaggaagggagaactttaagagttctcaaaatggtggagccatggctgaggggtaatcaattttgtataaagattctaaacccatatatgccctcagtagttgaaacattagaacagatgcaacggaaacacgggggaatgttggtcagaaaccccttatctagaaatagtacacacgaaatgtattgggtatcgtgcgggactggtaacatagtatccgcagtaaatatgacgagtagaatgcttttaaatcgattcaccatggcccatcgtaaacccacatacgaaagagatgtagacttaggagccggaacacgacatgtagcggtagaaccggaggttgcaaaccttgacataattggtcaaagaatagaaaatattaaaaatgaacataagtctacctggcactacgatgaagacaatccatataaaacctgggcttatcacgggagttacgaggttaaaccatccggatcagcaagctcaatggttaatggagttgttagactattaacgaaaccatgggatgtcataccaatggtaacgcaaattgcaatgacagatacgaccccgttcgggcaacagagagtcttcaaagaaaaagttgatactcgtacgccaagagcaaaaagagggactacacagatcatggaagtgacagctaaatggctttggggctttctttcaagaaacaagaaaccacgtatctgtactcgtgaggagttcacaagaaaagtgcgttcaaatgcggcaataggggcagtatttgttgatgaaaatcaatggaactccgcaaaagaagcggttgaagatgagaggttttgggatctagttcatcgagaaagagaactacataaacagggtaagtgtgccacatgcgtttataatatgatggggaaaagagagaagaaattaggcgaatttggtaaagccaaaggaagcagggcaatttggtatatgtggttgggagcacgattcttagaatttgaggcactcgggttcatgaatgaggatcattggttcagtcgagaaaattctttaagtggggtagaaggagagggcttacataaactcggctatatccttcgcgatataagtaagattccaggaggaaacatgtatgcagatgataccgcaggttgggatacccgtataacggaagacgatttgcagaatgaagccaaaattacggatatcatggaaccagaacatgcattactagccatgtctatattcaaattgacttatcagaataaggtcgtcagggtgcagagacccgccaaaaatggaaccgtaatggacgtaatatcgaggcgggaccaacgaggttccggtcaagtaggaacatacggattaaacacctttactaacatggaagttcaactcataaggcaaatggaatcagaaggaatattcttaccaagcgaattagaaacacctaacttagcagaaagggcgctagactggttagaaaagcacggtgcggaacgcctgaaacgaatggccatcagtggcgatgactgcgtagtaaaaccaatcgatgaccgtttcgcaaccgcattaaccgcgctaaatgatatgggaaaagtaagaaaggatattccacaatgggaaccatccaagggttggaatgattggcagcaagtaccattttgttcccaccacttccatcaacttattatgaaagatggtagagagatagttgtcccttgtagaaatcaagatgaacttgtaggcagggcaagagtttctcaaggagcaggatggagtctaagagagacagcctgtttaggtaaatcatatgcccaaatgtggcaattgatgtatttccatcgtcgtgatctgcgtttggctgcaaatgcgatatgctctgcagtcccagtagactgggttccagcatccagaaccacatggagtatacatgcacatcatcaatggatgacaacagaggatatgctttcagtatggaacagggtgtggattgaggaaaacccttggatggaagataagacacatgtcagttcatgggaagaagttccctatctaggaaaaagggaagatcaatggtgtggatcgcttatcggtttgaccgcgagagcaacatgggcaacgaacatccaagtcgcaatatcacaagtaaggagattgataggaaatgagaattaccttgactatatgacaagcatgaagcgtttcaaaaacgaatctgatcctgagggcgcactctggtag

SEQ ID NO: 22036 - RNA, 9879 nt, synthetic construct
  misc_feature 1..9879: note = derived and/or modified CDS sequence (opt6) from DENV-1__KC692503__SS-prME
  source 1..9879: mol_type = other RNA
agtgtcactatgctactgatgttgttacctacagcattagccttccaccttactacgcgaggaggtgaacctcacatgatagtctctaaacaagaaagaggaaaatctttactatttaaaacgtcagcaggggtaaacatgtgcacactaatagccatggacttaggagaattgtgtgaagatactatgacatataaatgcccacggataactgaagcggaaccagacgatgtagattgctggtgtaatgctacagacacgtgggtaacctatggaacttgtagtcaaacaggagaacatcgcagagagaaaagaagtgttgcgcttgcaccacatgtaggattaggcttagaaactagaacagaaacgtggatgagttcggaaggcgcctggaaacaaattcaaagagtagaaacatgggctttaaggcatcctggatttacagtaattgcattctttttggcacatgccatcggaacgagcattacacaaaaaggcataatctttatacttttaatgctcgtcacccctagcatggctatgagatgtgtgggcataggtaatagagactttgttgaagggctttcaggagcaacctgggtagatgtagtactagaacatggtagttgtgtaaccactatggccaaaaacaaacccacacttgacatagaacttctaaaaacagaagtaactaatccagcggtattaaggaaactttgtatagaagctaaaatatccaacacgacaaccgacagtagatgcccaactcagggcgaagcaactttagtagaagaacaagacgctaatttcgtttgtcgtaggaccttcgttgatagagggtggggtaacggatgtggactttttgggaaaggatcgttactcacatgtgctaagttcaaatgcgtgacaaaattagagggcaaaatagtccaatatgaaaatctaaagtacagtgtgattgttactgttcacacaggggatcaacaccaagtaggcaatgaaacgactgaacatgggacgatagcaaccattacgccccaggctccaacttctgaaattcaacttactgattatggagctttaaccctagattgcagtcctcgaaccgggctagattttaatgagatggtattactcactatgaaagaaaaatcctggttagtacataaacaatggttcctggacctacccctcccttggacatctggtgcatctacatcacaagaaacctggaataggcaagatctattagttacgttcaaaacagctcatgcgaagaaacaagaagtagtcgtactaggaagtcaggaaggcgcaatgcacacagcgctaacgggagctactgaaatacaaactagcggtacgacaactatattcgccgggcatctgaaatgtaggctgaagatggatagattaactttgaaagggatgtcatatgtcatgtgcacaggatcgtttaaattagaaaaagaagtcgcggaaacacagcatggaactgttttggtccaagtaaagtatgagggcaccgatgccccatgcaaaattccctttagcacgcaagatgagaagggagtaactcaaaacggtcgattaatcacagcaaatccaattgtaacagataaagagaaaccagtaaatattgaaacggaaccaccgttcggagaaagttatattgtggttggtgcaggggagaaagcccttaagttaagctggtttaagagaggcagtagcataggaaaaatgttcgaagcaaccgcgcgaggcgcgaggagaatggccattttaggagacacagcatgggactttgggtctataggcggagtattcacttctgtggggaagttagtacatcaagtatttgggacagcatacggagtattgttttcgggagtaagctggacaatgaaaattggcatagggattttattaacttggctcggattaaacagtaggtcaacaagtttgtctatgacatgcatcgcagttggaatggtcacactttatctaggcgtaatggttcaagcagattcgggctgcgtaatcaattggaagggcagagagttgaagtgtggttctggaatctttgtcacgaacgaggtacatacgtggaccgagcaatataaatttcaagcagatagcccgaaacgtctatcagcagccataggtaaagcctgggaagaaggcgtttgtggaataagaagtgcaacccgactagaaaatataatgtggaaacaaatttcaaacgaacttaatcatatccttttagaaaacgacatgaagtttacagtcgtagtgggtgacgcaaatggaatattggcacaaggcaagaaaatgataaggccacaaccaatggaacacaaatattcttggaaaagttggggaaaagctaaaattattggggcagatatacaaaacaccacgttcattattgacggcccagacacaccggagtgtcctgatggacaaagagcatggaacatatgggaggtggaggattatggtttcggagtgtttacaactaatatatggctaaaacttagagattcatatactcagatatgtgatcatcgactgatgtcagcagccattaaagacagtaaagctgtccatgcggatatgggatactggatagaaagtgagaaaaatgaaacctggaaacttgcccgagctagttttatagaagtgaagacttgtacttggccaaagagccatactttatggtcaaatggtgtattagaaagcgaaatgataataccaaagatatttggcggtcccatctcacaacataactatagacctggatatttcacccaaacagcaggaccatggcacctagggaagctagagctcgactttgatttatgcgaagggacaactgtcgtcgtggatgaacattgcgggaatcggggtccttcattacgaacaacaactgtaactggcaaaataatacatgagtggtgttgtaggtcatgcaccctaccgcccctaagattccgcggagaagatggttgttggtacggaatggaaatccgtcctgtcaaagaaaaagaagagaatttagtaaggagtatggtatcagcaggttcaggtgaagtcgattcttttagcctggggatattgtgtgtatcgattatgatagaggaggtcatgagaagtcggtggtctagaaaaatgcttatgataggtacactagctgtgtttttgttattaatcatggggcagttgacatggaatgatttaatccgattatgcattatggtaggagcaaacgccagtgatagaatggggatgggaacgacatatctcgcattaatggctacattcaaaatgaggccaatgtttgctgtaggactcttgttcaggagactgacaagtcgcgaagtgctgttgctaaccattggcctatctttagtggccagcgtagagttgccaaattccttggaagagttaggagatggcctagctatgggaataatgatgctcaaattactaacagaatttcaaccgcaccagttatggaccacactgttgagtttaacatttgtaaaaaccacactaagcctcgattatgcatggaaaaccactgcgatggtgctaagcattgtaagcctttttccattgtgcctgtcaacaacaagccaaaagactacctggttaccagtccttctaggttcgtttggctgtaaaccgttaacaatgtttctcataaccgaaaacaaaatctggggtaggaaatcatggccgttgaacgaaggaataatggctattgggattgtctcgatattgctctcatcattactaaagaacgatgtgccacttgcagggccattaattgcgggtggaatgttaatcgcatgttacgtcatttctggcagcagcgctgacctaagtcttgaaaaagcagcagaagtgtcgtgggaacaagaagccgaacattcaggggcatctcacaatattttagtcgaggtacaagatgatggcacaatgaaaatcaaagatgaagaaagagatgatacacttactatattactcaaagcaactctgttggccgtgtccggcgtatacccaatgagtataccagccactttatttgtctggtacttttggcagaaaaagaaacagcgaagcggagtgctatgggacactccttctccaccggaggttgaaagagcggtgctagacgacggaatatacagaatacttcaacgtggtctactaggcagaagccaggtcggtgttggagtattccaagacggggtctttcataccatgtggcacgttacaaggggagcagtcctaatgtaccaagggaaaagactagagccatcgtgggcttctgtcaagaaagatttgataagttacgggggaggttggcgtttccagggtagttggaatacgggggaagaggtacaagtcatcgctgtagaacctggcaaaaatcctaaaaacgtccaaactacaccaggaacattcaaaacacctgaaggcgaggtcggtgctatagcgctagactttaaaccaggcacaagtggtagcccaattgtaaatagggaagagaaaatagttggactatacggaaatggagtagtcaccacatcaggaacatatgtgtcagcgattgctcaagctaaagctagtcaagaaggtccattgccagaaattgaagatgaagttttcaagaaacgaaatttgacaattatggatttacatcctgggtcaggaaaaacacggagatacctacccgcgatagttcgcgaagcgataaagagaaaacttagaactttaatccttgctccaacaagagttgtagcgagtgaaatggccgaagcattaaaaggcatgcctattcgatatcagacaacagctgtaaaatcagaacatacgggacgagaaatagtagaccttatgtgccatgctacattcactatgagattgttgtcgccagttcgagttcctaattataatatgataattatggatgaggcgcatttcactgatcccgcctctatagctgccagaggatatatctctacccgggtgggtatgggagaggcagccgcaatcttcatgactgctacacctccagggagtgtagaagccttcccacaaagcaacgcggtgattcaggatgaagagagagatataccggaacggagttggaacagtggttacgactggataaccgatttcccaggaaagacagtttggttcgtccctagcatcaaatcgggtaacgatatagcaaactgtttaaggaaaaacggtaaaagagtaatacaattatcacgtaagacgtttgacacagagtaccaaaagacgaaaaataacgattgggactatgtcgtcacaaccgatatatcagaaatgggagcgaatttccgagcggaccgagtcatcgacccaagaagatgtttaaaacccgttatactcaaagatggtcctgagagagtgatactagcaggacctatgcccgtgacggtagcatcagctgctcaacggagagggcgaataggcagaaatcaaaataaagaaggtgatcaatacgtatacatggggcagccacttaataatgatgaggatcacgctcattggacagaggctaaaatgttacttgataacatcaatacaccagaaggtataataccagcacttttcgagccagaaagggagaaaagtgcagcaatcgacggagaatacaggttaaggggcgaagctcgtaaaacgttcgtagaattaatgcggagaggggatttgccagtatggttgtcctataaagtcgcaagtgaaggattccaatacagtgaccgaaggtggtgctttgatggtgagcgaaacaaccaagttttggaagagaacatggacgtcgaaatctggactaaggaaggagaacggaagaaattaaggccaagatggctagatgcgcgaacctactccgaccctttagcgttaagggaatttaaggaatttgcggcgggaaggcgttcagtaagcggagatttaattttagaaataggcaaacttccacagcatttaactttaagagcacaaaacgcattagacaacttagtgatgctccacaattcggaacaaggaggtaaggcatataggcacgccatggaagaactacctgacactatcgaaacattaatgctgctggctttaattgctgtgcttacaggtggcgtgactttattctttctatcaggaaaaggacttggaaaaacgtctatcggtttgttatgtgttactgcgtcatctgctcttttatggatggcttcggtcgaaccacactggatcgccgcttccattatacttgagtttttcttaatggtattattaatccccgaacctgatcgtcaacgaacaccacaggacaatcaactggcatacgtggtaataggtttgctatttatgatactaacagtggcagcaaacgaaatgggattattggaaactactaagaaagatttggggataggatatgtagcagctgagaaccatcagcatgcaaccatgctagacgtagacttacaccctgcatcagcatggacattgtacgcagtagctacaactgtgataacacctatgatgagacatacgattgaaaatacgacagctaatataagcctaacagctatagccaatcaagcagccattctaatgggattagataaaggatggccaatttccaaaatggacataggagtgcccctcttagctctggggtgctactcgcaagtaaatccattaaccctaaccgctgcagtgctcatgctagttgctcattatgcgataatagggcctggacttcaagctaaggcaactagagaagcgcaaaaacgaacagccgcagggataatgaaaaatcccactgtagacggaatagtcgctattgatcttgatccagtcgtatacgacgcaaagtttgagaagcaactgggccagatcatgctgctgattttatgtacttctcaaatactcttgatgcggactacatgggcattatgcgagtctataacattagccactggtccccttactactctatgggaaggcagtcctggaaagttctggaatacaactattgctgttagcatggcaaacatattcaggggatcatacttagctggtgctggattagcgttctcactaatgaagtcattgggcggaggtaggcgagggaccggagctcaaggagagaccttaggcgaaaagtggaagagacaattaaatcaattatcaaagagtgagttcaacacatacaaacgctctggaataatggaggtagacagatcagaagcaaaagagggtcttaaacgaggagagacgacaaaacatgcagtaagcagaggaactgcgaaactaagatggtttgtagaaagaaatctggtaaagccggaaggtaaagtaattgacttgggttgtggtcgcggtggttggagctactactgcgctggtcttaagaaagttactgaagttaaaggatatacgaaaggcggaccaggtcacgaagaaccaattcccatggccacatatggctggaatttggttaagttacacagcggaaaagacgtatttttcatgccaccagagaaatgtgatacattactctgcgacataggagagagttcaccaaacccaacaattgaagaaggcagaacactcagagtcttaaagatggtagaaccttggctacgaggaaatcaattctgtatcaaaatcttgaacccctacatgcccagtgtagtggagactcttgaacagatgcaacgcaaacacggtgggatgctagttcggaatccattaagccgcaactcgacacatgagatgtactgggtatcatgtggcacaggtaacatagtatctgcagttaatatgacgtctaggatgttattaaaccgattcacaatggcacacagaaaaccaacatatgaacgagatgtcgacttaggcgcaggtacaaggcatgtggcagtggaaccggaagtagcaaatctagacatcataggacaaaggatagagaacatcaaaaatgaacataaaagtacctggcactatgacgaggataatccttataagacatgggcctatcatggatcttacgaagtcaaaccgtcaggaagcgcatcatccatggtcaatggagtagtacgactcttaacaaaaccgtgggatgtaatcccgatggttacgcagatagctatgactgatacaaccccatttggacaacaacgggtattcaaagaaaaggtggataccaggacacctcgagctaagcgtggcactacgcagataatggaagttacagctaaatggctgtggggatttctgagtcgaaataagaaaccacgtatttgtactcgtgaagaatttacaaggaaagtgagatccaatgctgcaattggagctgtatttgttgacgaaaaccaatggaactcagctaaggaggcagttgaggatgagcgattctgggacctagttcacagagaaagggagttacataagcaagggaaatgtgctacatgtgtctacaacatgatgggaaaacgagagaagaaactcggagaatttgggaaagccaaaggaagcagagctatttggtacatgtggttaggcgcaagattcctagagttcgaagccctgggctttatgaatgaagaccactggttcagccgggaaaatagcttgagcggagttgaaggtgaaggcctacacaaactcgggtacatattacgagacatctctaaaatccccggcggtaatatgtacgcggacgacaccgccggatgggatacacggattaccgaagacgatctgcaaaatgaagcaaaaataacagatataatggaacctgaacacgccctgttggcgacgtcaatatttaagttgacctaccaaaataaagttgttcgtgtccagagacctgcaaagaacgggacggtgatggatgtaatctcaagacgcgatcagagaggttccggtcaggttggaacatacggattaaatacgtttacaaacatggaagtgcagctcataaggcagatggaatccgaaggcattttcctaccttcagaactggaaacacctaacctggcagaacgagcacttgattggctagaaaaacacggggcagaaagattgaaaagaatggcaatatcaggtgatgattgcgttgtaaaacctattgacgatagatttgcgactgcattgacagctctaaatgatatgggaaaagtcaggaaagatatcccccaatgggaaccatcaaagggttggaatgactggcaacaagttccgttttgttcacaccactttcatcagttgatcatgaaagatgggagagaaatcgttgttccgtgcagaaatcaggacgaattggttggacgagcaagagtcagccagggggcaggctggagcctaagggaaacggcatgtttaggtaagtcgtacgcacaaatgtggcaactgatgtatttccacagacgtgacttaagattggccgctaacgctatctgcagtgctgttcccgtagattgggtgcccgcaagccgaacaacttggagcatacacgctcatcatcaatggatgacaacggaagatatgctaagcgtttggaacagagtgtggatagaggaaaatccctggatggaggacaagacacatgtgtccagctgggaagaagtcccgtatttaggcaagcgcgaagaccagtggtgtggaagtttgataggacttacagccagggctacctgggcgactaatatacaagttgcgataaatcaagttagaaggctaattggcaacgaaaactatcttgattatatgactagcatgaaaagatttaaaaatgaaagtgacccagaaggggcactatggtag

SEQ ID NO: 22037 - RNA, 9879 nt, synthetic construct
  misc_feature 1..9879: note = derived and/or modified CDS sequence (opt6) from DENV-1__KC692504__SS-prME
  source 1..9879: mol_type = other RNA
tctgtaacaatgctactcatgctcttgcctacagcactagcgtttcacctcactacaaggggaggtgaaccgcatatgattgtctctaaacaagaaagggggaaaagcctactattcaaaacatccgcgggagttaacatgtgcacattaatagcaatggatcttggggaactctgcgaagatacaatgacatacaaatgccctcgaattacagaagcagaacccgatgatgtcgactgttggtgcaacgcaacagacacatgggttacttacggtacatgttcacaaactggagaacatcggagagaaaaacgttcggtagctctagcaccacatgttggattaggtctcgaaacccggacagaaacatggatgtcgtcagaaggagcctggagacaaatccaacgtgtagaaacatgggctctcagacatccaggcttcaccgtcattgcctttttcctagctcatgctataggaacatcaataactcaaaaaggaattatatttatattactgatgctcgtgacgccaagcatggcgatgagatgtgtaggcattgggaatcgcgatttcgtcgaaggattatccggagcaacgtgggtggatgtcgttttagagcatggctcatgcgttacaaccatggccaaaaataaacctaccctagatattgaattattaaaaacagaagtaatgaatcctgcggtacttcggaaactatgtatagaagcaaaaatttctaatacaaccactgactcaagatgtccaactcaaggagaagctaccttagtagaagaacaggatgccaactttgtctgtaggcgcacatttgtagatagaggatggggcaacggctgtggcctatttggaaaagggtcattattaacatgtgcgaaatttaaatgtgttacaaaattagaaggaaaaatagttcaatatgagaatttaaaatacagtgtaatcgtgactgttcacacaggagatcaacatcaagttggcaatgaaacaacagagcacggtacaatagccacaatcactcctcaagctccgacctctgaaatacaactcaccgattacggtgctttaacgttggattgttcacccagaaccggcctagattttaacgagatggttttgcttactatgaaagaaaagtcctggttagtgcacaagcaatggtttttagacctgcctctcccgtggacaagtggagcctctacatctcaagagacctggaaccgacaggaccttctagtaactttcaaaacagctcatgctaagaaacaagaagtagttgttttaggaagccaagaaggtgcaatgcataccgcccttacaggcgctactgaaatacaaacgtccggaaccacgacaatcttcgcgggccacttgaaatgtcgattaaaaatggataaactgacattaaaaggtatgagttatgtcatgtgcactggatcgttcaaactagagaaggaagtagcagaaacccaacatggaacggtattagtacaagtcaaatatgaaggaaccgatgcaccatgtaaaataccattttctacccaagacgaaaaaggagtaacacaaaacggacgactcattactgctaatcctattgtgacagacaaagagaagccagtaaacatcgaaacagaaccacccttcggcgaaagctatatagttgtaggtgctggagaaaaggctttaaaactctcctggttcaaaagaggatcctccataggcaaaatgttcgaagcaaccgcacggggtgcaagacggatggcaattctgggtgatacagcttgggatttcgggtcaattggtggagtgttcacatctgttggtaaacttgtccatcaagtattcggtacagcatatggagtacttttcagtggggtcagttggactatgaaaattgggattgggatactcctgacctggttaggtctgaatagtcgaagtacaagcctgagtatgacgtgcatagcagttggaatggtgactttgtatctgggagtaatggtacaggctgacagtggatgtgtaattaactggaagggaagggaactaaaatgtggctctggcatatttgtaacaaatgaagtccatacatggacggaacaatataagttccaagcagactctccaaaacgtctgagtgccgcgatcggcaaagcatgggaagagggagtttgtgggataagatctgctacccgactcgaaaatattatgtggaagcaaataagcaatgaacttaaccatattcttctagagaacgatatgaagtttacagttgttgtcggagacgccaatgggatattagcacaaggcaaaaagatgatacgcccgcagcccatggagcacaaatatagttggaaatcgtggggtaaagcaaaaattatcggagctgatatacaaaatacaacatttatcatcgacggtcctgatacgcctgaatgtccagatggccaaagagcctggaatatctgggaggtggaggactatggctttggtgtcttcacaactaatatttggttaaaattacgtgactcatacactcaaatgtgcgatcatcgtttaatgtcagctgcaataaaggattcaaaggctgtacatgcagatatggggtactggattgagtcagaaaagaatgagacgtggaaacttgcccgcgctagttttatagaagtaaaaacatgcacatggcctaaatcacacacgctctggtcgaatggtgtacttgaaagcgaaatgatcataccgaaaatttttggaggcccaatttctcagcataattatagaccgggttactttacgcagaccgcaggaccatggcatctaggtaaactggaactggacttcgatctttgcgaaggcactacagttgttgttgatgagcactgcggaaaccgaggcccgagtttgagaacaacaactgttactgggaaaatcattcacgaatggtgttgtagaagctgtacgctaccacccttgcgttttcgaggtgaggacggttgttggtatggcatggagatccgaccggtaaaagaaaaagaggagaaccttgtacggagtatggtttccgcaggcagtggagaagtagatagtttttcactaggcatcttatgcgtatccatcatgattgaagaggtaatgagatccaggtggagtaggaaaatgctgatgacggggactttggcggtgtttttactgcttatcatgggacaattaacatggaacgacttaatccgactgtgcataatggtgggggcaaatgcatctgataggatgggcatgggtacgacctacttagcgttaatggctactttcaagatgagaccgatgtttgcagttggtctcctcttcagacgtttaacatcaagagaagttctattattaaccatcggccttagcctagttgcttcagttgagttacccaactccttagaagaactcggggatggcctagcgatgggaataatgatgctcaaacttcttacagaatttcagccacaccaattatggactacgctactttctctaacttttgtgaaaacaactttatctctagactacgcatggaaaacaacagctatggtattaagtatagtgagcctatttccgttgtgcctgtcaacgacatcacagaaaactacttggctacccgtgctattaggatcctttggatgtaaaccgttgaccatgtttctaataactgagaacaaaatatggggccgtaaatcctggccattaaatgagggtataatggcgataggcattgtcagcattttattatcctcacttctaaagaacgacgtacccctagcaggaccactcattgccggtggaatgttgatagcctgttacgtgatatccggctctagcgccgatttaagtttagaaaaagcggccgaagtatcgtgggaacaagaagcagaacattccggtgcatctcataatattttagttgaagttcaagatgatggtactatgaaaatcaaggatgaagaacgagacgatacattaactattttattaaaagcaacattattggctgtatccggagtttaccctatgagtatacctgctacattattcgtatggtatttctggcagaagaagaaacaaaggagtggtgtgctgtgggacacaccatctccacccgaagttgaacgtgctgtactagacgatggcatatatcggatactgcaacgaggtttactaggaagatcccaagtaggtgtaggagtcttccaagacggagtcttccatacaatgtggcatgtaactagaggggcggtacttatgtaccaaggaaagcgactcgaaccatcttgggcaagtgttaagaaagaccttataagttacggaggaggctggagatttcaaggaagctggaataccggtgaagaagttcaagttatagcagtcgagccaggcaaaaatcctaaaaatgtacagaccacgccgggaacttttaaaactcctgaaggtgaagtaggggcaatagctttagattttaaaccaggtacatcaggaagtcccatagtaaaccgggaaggcaaaatcgtaggattatatggcaacggagtggttactacatctggcacctatgtctcagccattgcccaagccaaagctagccaagaagggcccttgccagaaattgaagatgaagtttttaagaaaagaaacctaactatcatggacttacacccaggttccggaaagacaagacgatatctacctgcaatagtcagagaagccattaaaagaaaattacgaactctaatattagcaccgaccagagtagtcgcttccgaaatggcagaggcgctaaaaggtatgcctattaggtatcaaacaacggctgttaagagcgaacatacaggaagggaaatagtggacctaatgtgtcacgcaactttcacaatgagattattaagtcctgttcgagttccaaattataatatgataataatggatgaagcacacttcacagatcctgcttccatagctgctcgagggtatatctctacgagggtaggaatgggagaagcggccgcgattttcatgacggccacgccaccaggctccgtcgaggcttttccgcaatctaacgcagtaattcaagatgaggaacgagatattcccgagaggtcctggaactcaggatatgactggataacagatttccccggcaaaactgtttggtttgttccttcaataaagagtggaaatgatatcgccaactgccttaggaaaaatggtaaacgtgtcatacaattgagtagaaaaacgtttgatacagaataccagaaaactaaaaataatgattgggattatgtagtaacaaccgacatctcagaaatgggtgcgaattttagagcagatcgtgtaatagatcccagacgatgtcttaaacctgttatactcaaagacggaccagaacgggttatattagcgggaccaatgcccgtaactgtagcttcagctgcacaacgaaggggacgaattgggaggaatcaaaacaaagaaggagaccaatacgtttatatgggtcaaccgctaaataacgacgaggaccatgcgcactggaccgaagccaagatgcttctagacaatataaatactcctgaaggaattatacccgcattatttgaaccagagcgagaaaaatcagctgcaatcgatggtgagtatcgtcttcggggagaagccagaaagacgttcgtagaattaatgcggagaggagatctgccagtatggttgtcttacaaagtcgcatctgaaggatttcaatactctgatagacgatggtgctttgacggtgaacgaaataatcaagttctcgaggaaaacatggatgttgaaatctggacaaaagaaggagaacgtaagaaactcagaccaagatggttagatgccagaacgtattcagacccattggcactaagagaatttaaagaatttgcagcaggacgaagaagtgttagcggggacctaattctagagataggcaagttaccccaacacttaactctccgggcccaaaatgcactcgataatcttgtgatgttgcataattcagaacaaggaggtaaggcttataggcatgccatggaagaactacctgatacgatagaaactctaatgttgctagccctcatcgcggttttaactgggggagtaacattattcttcttgagtggcaagggcctggggaaaacaagtattggtctcttatgtgtaactgcctccagcgcactcctttggatggcttctgtagaacctcactggatcgcagcatctataatcctagagttctttctcatggtattgttgataccagaacccgatagacaaagaacaccacaagacaatcaactagcatatgtagtaattggtttactatttatgatacttacagtggcagctaacgagatgggtttgttagagacaaccaagaaagatttaggtatcggttatgtggctgcagaaaaccatcaacatgctaccatgctcgatgttgacttacacccagcctcggcgtggactttatacgcagtagcaactaccgttataactcctatgatgcgtcacaccattgagaatacgacagcaaacattagcctaacagctattgctaatcaagcagcaatactaatggggcttgataaggggtggccaatctcaaaaatggatataggagtgccactgcttgctttaggctgttatagtcaagttaatcctttgaccttgaccgccgctgttctaatgcttgtagcacactatgcgataattggaccagggttgcaagcaaaagcaactagagaggcccagaaaagaacagcagctggaataatgaaaaatcccacagtagatggaatagtcgcgattgatcttgacccagtagtctacgatgcaaagttcgagaaacaactgggtcaaattatgttacttatcctgtgtacaagtcaaatactcttaatgcgtacaacatgggctttatgcgaatctataactttagcaaccggaccgctcacgacactatgggaaggttcacccggcaagttttggaacaccactatagcagtaagcatggctaacgtattccggggcagttatcttgcgggggcagggttagccttcagtctaatgaaatcacttggaggcgggcgccgaggaacaggtgcacaaggagaaacactcggtgaaaaatggaaaagacagttaaaccagttatctaaaagcgagttcaatacctataagaggtccggaattatggaagtcgacagatcagaagctaaggaaggattgaagcgcggtgaaaccacaaaacacgcagtaagcagagggacggcgaaactacgatggtttgtagaaagaaacctcgttaaacccgaaggtaaggtaatagatttaggctgcggcagaggtgggtggtcatactattgcgccgggttaaagaaagtaacagaggttaaaggatacaccaaaggagggcctgggcatgaagaacccataccaatggcgacctatggctggaatttggtgaaattacatagtggcaaagacgtattctttatgcctccagaaaaatgtgacacattactctgcgacataggagaaagttctcctaatcctacaattgaagagggaaggacactacgcgtactaaaaatggtagagccctggctgagaggtaatcaattttgtattaagattctaaatccctatatgccctctgtagtagagacacttgagcaaatgcagcgtaagcacggcggcatgctggttcgcaaccccctatcaagaaatagtacccatgaaatgtactgggtatcttgcggcacaggaaatatagttagcgccgtaaatatgacgtcaaggatgcttctcaatagatttacgatggcacatcgaaaaccgacgtatgaaagggatgtcgaccttggcgctggaacacggcacgtagcagtcgaacctgaagtagctaatttagacataataggtcagaggattgagaacattaaaaacgagcacaagagtacttggcactacgatgaagataatccctataaaacatgggcatatcacggatcatatgaagtcaaaccctctggaagtgcaagttcaatggtcaacggcgtagtaaggcttctcacaaaaccttgggacgtaatacctatggttacccaaatagctatgacggataccactccattcggacagcaaagagtttttaaagaaaaagtagacacacgtaccccacgtgctaaaagaggtacgacacaaataatggaagtaaccgcgaaatggttatgggggttcctaagtcgtaacaagaaaccaaggatatgtacccgagaagagttcactcgaaaggttcgttcaaacgccgctatcggcgccgtatttgtagacgaaaatcaatggaactcggcaaaagaagcagttgaagacgaacgcttttgggatcttgtacatcgggaaagagaattacataaacaaggcaaatgcgcaacgtgtgtatacaatatgatgggaaaacgcgagaagaaacttggagagtttggcaaagcaaaaggcagtagggcaatttggtatatgtggctaggagcgaggttcttggaatttgaggcacttggttttatgaatgaggatcattggttttcaagagaaaacagcctgtcaggagtggaaggagaagggttacataaactaggctatattttaagagatataagtaagatacccggtgggaacatgtacgcagatgacactgctgggtgggacacgcgtataaccgaagatgacttgcaaaacgaagccaaaattactgatataatggaacctgagcacgccctactcgcgacaagtattttcaaattaacttaccaaaataaagttgtccgcgttcaaagaccggcgaaaaacggaacagtaatggatgttatatcaagaagagatcagcgcggatcaggacaagtgggaacttacggtctgaatacatttacaaatatggaggttcaattaatccgacaaatggagtccgaaggaatatttttgccttccgaattagagacaccaaatcttgctgaacgtgctttagattggttagaaaaacacggagcggaaagattaaaaaggatggcgatctcaggtgatgactgcgtagtaaagccgatcgacgatagattcgctactgcattaaccgctctaaacgatatgggcaaagtaaggaaggatatcccccaatgggagccatctaaagggtggaacgactggcaacaagtgccgttttgtagtcatcattttcatcaacttattatgaaggatggacgagagatagtagtcccttgtcgaaaccaagatgaattggtaggtcgagcccgagtaagtcaaggagcgggctggtctttacgcgagacagcgtgtctaggaaaaagctacgcgcagatgtggcaattaatgtatttccatagacgtgaccttagactagccgctaatgctatttgctctgctgtaccagtagattgggtaccggcaagtagaacaacatggagcatacacgcccaccatcagtggatgacgactgaggacatgttgtcagtctggaatagggtttggattgaggaaaacccttggatggaagataaaactcatgtgagtagttgggaagaagtaccatatttgggaaagagggaggaccaatggtgtggatcactaataggattgactgctcgagctacatgggcaacaaacattcaagtggcaattaatcaggttaggcgattgatcggtaatgaaaattacttagattatatgacgtctatgaaacgctttaaaaacgagtccgatcctgaaggggcactatggtaa

SEQ ID NO: 22038 - RNA, 9879 nt, synthetic construct
  misc_feature 1..9879: note = derived and/or modified CDS sequence (opt6) from DENV-1__KC692508__SS-prME
  source 1..9879: mol_type = other RNA
agtgtaacaatgctattgatgcttttaccaacagcgttggcatttcacttaacaactcgaggtggtgaacctcatatgatagtatctaaacaagaacgtggaaaatcgcttttattcaaaacatcagcgggtgtaaatatgtgtacgttgattgcaatggatttaggtgaactctgcgaagatacaatgacttataaatgtcctcgaataacagaagcagaacccgacgacgtagattgttggtgcaatgcaaccgatacgtgggtcacttatggaacgtgtagccaaacaggagaacacagaagagagaaaagatctgttgcattagcacctcacgtcggattaggactagaaacgagaactgaaacgtggatgagttcggaaggagcctggaaacaaattcaaagagtagaaacctgggcattacggcatcctggatttacggttatagcgttctttcttgctcacgcaatagggacatcaataactcaaaaaggtattatcttcatactacttatgttggtcactccatccatggcaatgcgttgtgtaggtattgggaacagagattttgttgaaggtttgtcaggagcgacctgggtagatgtggttttagaacacggatcatgtgtgacaaccatggccaaaaataaaccgacgctagacattgaattgctcaaaactgaagtgacaaacccagctgtattgcgaaaactttgcatcgaagcaaaaatatcgaacacaacgacggattcacgatgccctacgcagggggaagcaacactggttgaagaacaagatgctaattttgtatgccggcgaacttttgtcgatcggggatggggcaacggttgcggtttgtttggcaaaggatcactcttaacgtgcgctaaatttaaatgcgttactaaattagaagggaaaattgttcaatatgaaaacttgaagtatagcgtaattgttactgttcataccggcgaccagcatcaagtgggaaatgagacaactgaacacggcacaatagcgacaataactccacaagcgccgaccagtgagatccaattgactgattacggagccctaacactagattgttcccctagaacagggttggattttaatgaaatggttttattaactatgaaagagaaaagttggctagttcacaaacaatggttcctagatttgcctttaccatggacgtccggagctagcacaagtcaagaaacttggaatcgccaagacctacttgtgacattcaaaactgcacacgcgaagaaacaagaagtggtagtactcgggtcacaggaaggcgcgatgcatactgctcttacgggagcaactgagatccaaacttcaggaactacaacaatatttgctggacacctaaagtgtagactaaaaatggataagttaactttgaagggaatgagttacgtaatgtgtactggaagttttaaacttgaaaaagaagttgccgagactcaacatggaacagttttagtacaagtaaagtatgaaggcactgacgcaccatgcaaaataccctttagtacacaagacgagaaaggtgtcactcaaaatggacgtttaattacagctaatccaatagtgacagataaagaaaaaccagtaaatattgaaacagaaccaccgttcggtgaatcttatatagtcgtaggagctggcgaaaaagctctgaagttatcgtggtttaaacgaggtagcagtataggaaaaatgtttgaagctaccgcacgcggtgcccgaagaatggcgatacttggtgacacagcatgggattttgggagtatcggaggcgtgtttacctccgttggtaaacttgttcaccaagtgttcgggaccgcctatggagtactattttcaggcgtgtcttggactatgaaaataggtatcggaatattacttacatggctaggccttaattcacggagcacctcactatcaatgacatgtatagcagtgggtatggtcacattatatttaggggtgatggttcaggctgatagcggctgtgtaatcaactggaaaggaagagagcttaaatgcggcagtggtatttttgtaactaatgaggtccacacttggacagaacaatataaattccaagcggatagcccaaaacgcttaagtgccgcaatcggaaaggcttgggaggagggagtttgcggtattagaagtgcaacaagattagaaaacataatgtggaagcaaataagcaacgagctaaatcatatactactagagaatgacatgaaattcactgtagtagtaggagatgccaatggtatattagcacagggcaagaaaatgatacgtccccaacctatggagcataaatactcatggaaatcttggggaaaagccaaaataatcggagcagacatccaaaacaccacattcataattgacggaccggacacgcctgagtgcccagatgggcaacgcgcttggaatatatgggaagtagaagattacgggtttggagtcttcaccacaaatatctggttaaagctacgagacagttatacccaaatgtgtgaccatcgacttatgagcgcagcgataaaagacagtaaggccgtacacgcagatatgggatactggattgaatctgagaaaaatgaaacgtggaaattggcaagagcttcatttatagaagttaagacatgcacttggcctaagagtcatactctttggtcaaatggcgtattggagtctgaaatgataataccgaaaatattcggaggaccaattagtcaacataattatcggcctggttacttcactcaaacggcaggcccttggcatctggggaaattagaactagactttgatctatgtgagggaacaacggtcgttgtagatgaacattgcggaaaccggggtcctagtctacgcactacaacagtaactggtaagataatacacgaatggtgctgtagatcatgcactctccctcccttaagatttcggggtgaagacggctgttggtatggtatggagattaggccggttaaagagaaagaagaaaatttagtacgctcgatggtctctgcagggtctggagaggtagattcatttagcctaggaatactatgtgtgtcgataatgattgaggaagtaatgaggtcacgatggagtagaaaaatgcttatgacgggcaccttagccgttttcttattgcttataatggggcaactaacatggaatgacctaatcagactctgcatcatggtgggagcaaatgcgagcgaccgaatgggcatgggcactacatatttagcccttatggctacatttaaaatgcgcccaatgttcgcggtagggcttctgttcagaagacttacctcgagagaggtccttcttctaacgattgggctcagtctggtcgcatccgtagaattacctaactccttagaagaacttggagatggtctagctatgggcataatgatgttaaaactactaactgaatttcaaccacaccaactttggaccacactcttgtcgctaactttcgtgaagaccactctttctttagactacgcatggaaaacaacagcaatggtactaagtattgtcagtttatttcctctttgtctatccacgacatcacagaaaaccacatggctgcctgtgttactaggatcatttggatgtaagccgttaaccatgttcctaataacagagaacaaaatatggggcagaaaaagctggccacttaatgaaggtataatggcaattgggatagtaagtatcctactcagttccctcctaaagaatgacgttcctctagccggacctcttatagctggtgggatgctaatagcatgttatgttataagtggaagttcggcagatctcagcttggagaaggcagctgaggtcagttgggaacaagaagccgaacactctggtgcatcgcataatattttagtagaagtacaggatgatgggactatgaaaatcaaagatgaagaacgtgacgatacattaaccattctattaaaggcaaccttactagcagtaagtggagtgtatccgatgtctataccagctacactgtttgtttggtatttttggcagaaaaagaagcaacgaagcggtgtcttatgggacacgccaagtccccctgaagtcgaaagagcagtattagatgatggtatttaccgtatactacaaaggggtttactagggcgaagccaagtaggcgtaggagtatttcaagatggagtatttcatactatgtggcacgtaaccagaggagctgtacttatgtatcaaggcaaacgcctagagccgagttgggcatcagtcaagaaagacttaataagttacggcggtggttggagatttcagggctcatggaatactggagaagaagtacaagttatagcagtagaacctgggaaaaatcccaaaaatgtacaaacgacaccaggtacatttaaaactccagaaggggaagttggagcgatagcactcgatttcaaaccaggtactagcggatcccctatagttaatagagaaggaaagatagtaggattatatggcaacggagttgtaaccacaagtggcacatatgttagcgcaatagcgcaagcaaaagcgagccaagagggcccgttacctgaaatcgaagacgaggtttttaagaaacgaaatctgacaataatggatttacatcccggctcaggcaaaacaagacgctatcttcccgccatcgtacgggaggctattaaacgtaagttaagaactctaatattagccccaacccgcgtggtagcatccgaaatggcggaagctctaaagggaatgcctattagatatcaaacaacggcagttaaatcggaacataccggaagagaaatagtagatttaatgtgtcatgcgacatttacaatgaggttgctttcgcccgttcgggtaccgaactacaacatgataatcatggatgaagctcactttaccgatccagcgagcattgcagctcgaggttatatttccaccagggtgggaatgggagaggcggcagctattttcatgaccgccaccccgccaggctccgttgaggcatttccacagagtaatgcagtaattcaagatgaagaacgagatatcccagaacgttcttggaacagtggttacgactggataacagactttcctggtaaaactgtctggtttgttccatctattaaaagtggtaacgatatagctaactgtctcaggaaaaatggcaaacgtgtaatccaactaagtcgtaaaacttttgacaccgaatatcagaaaactaaaaataatgattgggattatgtagtaacgactgatataagtgaaatgggcgccaacttcagggcagatagagtcatagatccgcgaaggtgcttgaagcctgtaattttgaaagatgggccggaaagggtaatattagctggacccatgcccgtaaccgtggcttcggccgctcaaaggcgaggtagaatcggtcgaaatcaaaataaggaaggtgatcaatatgtatatatgggccaacctttaaataatgacgaagaacacgctcactggacagaggcaaagatgttgctcgataatatcaacacacccgaagggataattccagccttattcgagcccgaacgcgagaaaagcgcagctatcgatggggaatacagattaagaggagaggcacgaaaaactttcgtagaattaatgaggcgtggagacctacctgtatggttgtcgtataaagtagcttcagaaggatttcaatactcagaccgcagatggtgcttcgatggcgaacgtaataaccaagtcttagaagaaaatatggacgtcgagatatggaccaaagaaggtgaaaggaagaaactaaggccgagatggttagatgcaagaacatatagcgatcctctagcactgagagagttcaaagaatttgcggcgggcagacgctccgtgtccggggacctaatcttagagataggtaaattaccacaacaccttacactaagagcgcaaaatgccctggataatcttgtaatgctacacaactccgaacaaggaggtaaagcatatcgacatgcaatggaagaactaccggacacgatagagacgttaatgctactagcactcatcgcagtattaacaggtggggttactttgttcttcttatccggtaagggcttaggcaaaacctcaattgggttactatgtgtaactgcatctagcgcgttattatggatggcttcagtggaacctcattggattgcagctagcattattcttgagttcttccttatggtgttactcattccagagccagacagacaacgtacgccccaagacaatcaactagcttacgtagtcataggtcttttgttcatgatcttgacagttgcagcaaacgaaatgggattgctcgaaactaccaagaaagatctcgggatcggttacgttgcagcggaaaatcatcagcatgcgacaatgctcgacgtagacctacatcctgcgagtgcttggactctgtatgctgtggcaacaacagttataaccccaatgatgaggcatacaatcgaaaataccacagcaaacattagtttgactgcaattgcaaatcaagcagctatattaatgggactagataagggatggcccatttccaaaatggatatcggagtacctcttctcgcattaggatgttactcgcaagtcaatccgttgacgttgacggcagcggttctaatgttagtagctcactacgcaatcataggaccgggtctgcaagcaaaagcaacgagagaagcacagaaaagaacagcagctggcatcatgaaaaatcccaccgttgatgggattgttgcaatagatttagatcccgtagtgtatgacgcaaagtttgagaagcaactaggtcaaatcatgctgttaatattgtgtacctcccaaatcctgttaatgagaacgacatgggctttatgtgaatctataacacttgcaaccggaccactgacaacattatgggagggcagtccaggcaaattttggaatacaacaatagctgtgagcatggcgaatatattcagagggagttatcttgccggtgcagggttggctttcagcttgatgaaatcactgggtggaggtcgtcgggggacaggcgctcaaggcgaaactcttggcgaaaaatggaaaagacagcttaaccaactatccaaatctgagttcaacacgtacaaaagaagcggaataatggaagtagataggtccgaagcaaaagagggattgaaacgaggtgaaacgacgaaacatgcggtctctagaggaactgccaagttaaggtggttcgtcgagaggaacctcgtcaagccagagggaaaagtaattgaccttggttgtggaagaggtggttggagctattattgcgccggtttgaagaaggtcacagaagtcaaaggctatacaaaaggcggacccggtcacgaagaacccattccaatggccacctacggctggaatctagtaaagttacattctggaaaggacgtgtttttcatgccacccgaaaaatgtgatacattgttatgtgacataggggagagttctccaaatcctacaatagaggaaggacgaactttaagggtattgaaaatggtagaaccatggcttagaggtaatcaattttgtatcaaaatactaaatccgtatatgcctagcgtagtggagacgttagaacagatgcagcgaaagcacggaggtatgctagtcaggaacccgctgagccgaaatagtacccatgaaatgtattgggtatcatgtggaaccggtaatattgttagtgcagttaatatgacctcaagaatgttactaaatcgttttaccatggcacacaggaaaccaacgtatgaacgtgacgtagacttaggagctggtactcgacatgtagcagttgaacctgaggtcgcgaacctagacatcataggtcaaagaattgaaaatatcaaaaatgaacataaaagcacgtggcattatgacgaagataacccatataaaacatgggcataccacggttcatacgaggtaaaaccgtccggaagtgcttcctctatggtaaatggagtagtaagattgctaacaaagccatgggacgtaatacccatggtgacacaaattgcaatgacagacactacaccttttggtcaacaaagggttttcaaagagaaagttgacacgcgaacaccccgagctaaacgagggacaactcagataatggaagtgacagcaaaatggttgtggtcgttcttaagtcgtaataagaaacctagaatctgcacaagagaagagttcacacggaaagttcgctcaaatgcagctataggtgcagtattcgtggatgaaaatcagtggaactccgcgaaagaagccgttgaagacgagagattttgggatttagtacatcgagaaagggagctacacaaacaaggtaagtgcgccacgtgcgtttataacatgatgggaaaaagggagaagaaactaggggaatttgggaaagccaaaggaagccgggcaatatggtacatgtggctaggtgcacgattcttagaatttgaggcgttgggatttatgaatgaggatcattggtttagcagagaaaacagcttatcaggagttgaaggcgagggactccataagttgggttatattttaagagatatcagcaagatacctggcggtaatatgtacgcagatgatacggcgggatgggatacccggataacagaagatgatttacaaaatgaagcaaaaataacagacataatggaacccgaacacgcattattagcaacaagtatattcaaactcacataccaaaataaagtagtcagagtacaaagacccgccaaaaacggaacggttatggatgtaataagtcgacgagatcagagaggttctggtcaagtcggtacatacggattgaacacttttacaaatatggaggtccagttaatcagacagatggagtcggagggaatatttctcccaagtgaactggaaacccctaatttggcagaaagagcattggattggttggaaaaacatggcgcggaaagactcaagcgaatggcaatctcaggggatgattgtgtagttaagcctattgacgatagatttgcaacagcactcaccgctttgaatgatatgggtaaagtcagaaaggatataccccagtgggaaccttctaaaggatggaatgattggcagcaggtaccattctgctcccatcattttcatcaactaataatgaaggacggcagagaaattgtagtaccgtgccggaatcaagatgaattagtaggacgagcacgtgtaagccaaggagcgggttggtccttaagagaaaccgcctgtttaggtaaaagttacgcacaaatgtggcaactgatgtattttcacaggcgcgacttacggttggcagcaaatgccatatgcagtgctgtaccagtggattgggtaccagcatcgaggaccacttggagtatccacgctcaccaccaatggatgacaacggaagacatgctctcagtttggaacagagtatggattgaagaaaatccctggatggaagacaaaacacacgtaagctcatgggaagaagtaccgtacttagggaaacgagaggatcaatggtgtggatcacttataggactgaccgctagagcaacgtgggccacaaatatacaagtcgctataaatcaggtaagaagactaataggtaatgaaaattatctggactatatgactagcatgaaaagatttaaaaatgagagcgatcctgaaggcgcgctatggtag

SEQ ID NO: 22039 - RNA, 9879 nt, synthetic construct
  misc_feature 1..9879: note = derived and/or modified CDS sequence (opt6) from DENV-1__KC692509__SS-prME
  source 1..9879: mol_type = other RNA
agtgtaactatgttactgatgttacttccaactgcacttgcttttcacctaactactcgaggaggtgaaccacacatgatcgtatctaaacaagaaagagggaaatcactattatttaaaacaagtgcaggagttaatatgtgtacacttatagcaatggacttaggagaattgtgtgaagatacaatgacatataaatgcccaagaattaccgaagcagaaccagatgacgtcgattgttggtgcaatgccacagatacatgggttacctatggaacatgttctcagacaggcgaacaccgaagagagaaacgatcggtggcactggcccctcatgttggactcggactagaaacacgtactgaaacatggatgtcctctgaaggagcgtggaaacaaatacaacgagtagaaacgtgggcattaaggcatccagggttcacggtgattgcctttttcttagcacacgcgattggaacttcaatcacacaaaaaggaataatttttatactcctaatgttagtcaccccaagcatggccatgaggtgcgttggaatcgggaatagagatttcgtagagggcctctccggagcgacttgggtagatgtagttttagaacatggatcctgcgtaactacgatggccaaaaataagccaacgttagatattgaactcttaaaaactgaggtgactaatccggccgtactcaggaaactttgtatagaagcgaaaatatcaaataccacaactgattcaaggtgtcccacacaaggggaagcgaccttggttgaggaacaagacgcaaatttcgtatgccgaagaaccttcgtagatagaggatggggcaatggttgtggcttatttggaaaaggctccctgttgacatgcgctaaattcaaatgcgtaacgaaattggagggcaagatcgttcaatatgaaaacctaaaatacagtgtgatcgtgaccgtccacacaggtgaccaacaccaagttggaaatgaaacaacagaacacggaacaatcgcaacaatcacaccacaagcaccaacaagtgaaatacaactgacagattatggcgcattaacactggattgtagcccccgcacaggtttagactttaacgaaatggtcctactaaccatgaaagaaaagagttggttagtacacaagcaatggtttttagatttgccactaccttggacctcaggagcctcgacaagtcaggaaacctggaacagacaagatctcctcgtaacttttaagacagctcatgccaaaaagcaggaagtagttgtcctaggatcacaagagggggccatgcatacagcactaacgggtgcaaccgaaatacaaacatccggtaccactacaattttcgcaggacatcttaagtgccgacttaaaatggataagttaactctcaagggagtcagctatgtcatgtgtacgggctcatttaaactagagaaagaagtagccgaaactcaacatggaactgtcctagtacaagtcaagtacgaagggactgacgctccatgtaaaattccattttctacacaagacgaaaaaggcgttactcaaaacggaagattaatcactgctaatccaatagtaacagataaagaaaagccagtaaatattgaaactgaaccaccattcggggaatcttatattgtagttggcgctggggagaaggcactaaaactatcctggttcaaaagaggttcaagtatcggaaaaatgttcgaagccacggcacgaggtgctcggcgaatggctatactaggagacactgcatgggatttcggttccataggaggagtatttacttctgttggaaaactcgttcatcaggtgttcggaacagcatacggtgtgttatttagcggagtaagttggaccatgaagataggaatcggaatattactaacgtggttaggtttaaactcacgatcaacttctttgtcaatgacatgtatagcagtcggaatggtaactctataccttggtgtgatggtccaggctgattcggggtgcgtaataaactggaaaggacgtgagctcaaatgtggtagtggaatattcgttacaaacgaggttcacacatggactgagcagtataaattccaagcggacagtcctaaacgtctttctgcggctataggaaaagcgtgggaagaaggagtctgtggaatccgtagtgccaccagattagaaaatattatgtggaaacagatatcaaatgaattgaatcatattttgctagaaaatgacatgaagttcactgttgtggtaggagatgcaaatggtatacttgcccaaggaaagaaaatgatccgaccacaaccaatggaacataaatatagctggaaaagctggggaaaagcgaagatcataggcgctgatatacaaaacacaacatttatcatcgatggacctgatacaccagaatgtccagacggtcaaagagcatggaatatatgggaagtcgaagattacggttttggagtatttactactaatatatggctaaagctgagggatagttatacacagatgtgcgatcacagattaatgtcggctgctataaaagacagtaaagcggtacacgcggatatggggtactggatagaaagtgaaaagaacgagacttggaaactagccagagcgagctttatcgaggtcaagacctgtacatggccgaaatcgcatacgttatggagtaacggagtgttagagtcagagatgattattccgaagatctttggtgggccaatttcacaacataattacagacctgggtattttacacagacagcaggaccatggcatctaggaaaattggagttagattttgatttatgtgaaggcacgacagttgtcgttgatgagcactgtggtaaccgaggaccaagcctgcgaactacaacggtaactggtaaaataatacatgaatggtgctgccgatcttgcacattaccaccccttcggttccgcggagaagacggctgttggtatggaatggagataaggccagttaaagaaaaagaagagaatttggtgagatcaatggtgagtgccggtagtggggaagttgatagctttagcctgggaatcttatgtgtttcaataatgatagaagaagtcatgcgttcaaggtggagccgaaaaatgctgatgacagggactttagcagtatttctactattgattatgggacaattaacatggaatgatcttataaggctatgcatcatggtaggggcgaacgcttctgacagaatgggaatgggtacgacctatctcgcgttaatggcaacattcaaaatgcgcccaatgttcgccgttggtctgctatttagaaggctaaccagcagggaagttctactgttgactataggtctgagcttagttgcaagtgttgaactaccaaactcacttgaagaattaggggatggccttgctatgggaattatgatgctcaagttacttacagagttccaacctcatcagttatggacgactttattgtccctaacctttgtacgaacaacgctcagcttagactatgcatggaaaacaactgcaatggtcttatctatcgtttcactatttccattatgtctttcgacaacgtcacagaaaactacatggctacctgtgctacttggctctttcggttgtaaaccattgacaatgtttctaatcactgaaaataaaatctggggaaggaaaagttggcctttaaatgaaggaataatggctatcggcatagtctcgatactcctctcatccttactcaaaaatgacgtgccattagcaggaccgctaatagccggtggaatgctaatagcgtgttacgtgatttcaggtagttcggcagatttaagtttagaaaaagccgcagaagtatcatgggaacaagaagcggaacactccggcgcatcacacaatattttagttgaagtgcaggatgacggaacaatgaaaatcaaagacgaggaaagagacgacacactgactattctcctaaaagcaacattattggcagtttcgggagtatatccaatgtcaataccagctaccttatttgtctggtatttttggcagaagaagaaacaaagatccggcgtcctatgggacactccaagcccaccagaaatggagagagcagtacttgacgacggaatttacagaattttgcaaagaggtttacttggaagatctcaagtgggtgtcggagtatttcaagacggtgtctttcatacaatgtggcatgtcaccagaggagcggttctaatgtatcaaggaaaacgtttagaaccttcgtgggcttcggttaagaaagacttaatatcatatggagggggatggaggttccaagggtcgtggaatacaggcgaagaagtccaagtaattgcagtagaaccgggcaaaaatcccaaaaatgttcaaaccacacctgggacatttaaaacccccgaaggcgaggttggagccatcgcattagacttcaaaccgggaacctcaggttcaccaatagtaaaccgcgaaggaaaaatagtcggcctctatggaaatggtgtggttactacaagtggaacttacgtatccgctatagcccaagcaaaagcgtctcaagaaggaccgttaccggaaatagaagatgaggtcttcaaaaagagaaacttaacaatcatggatcttcatcccggaagcggaaagacacgacgatacctcccggctatagtaagagaagcaataaaaagaaaactaagaaccttaatacttgcaccaacaagggtagttgcaagtgaaatggccgaagcattaaaaggaatgccaatacggtatcaaacaactgcagtgaaaagtgaacatactggccgagaaatagttgatctaatgtgccacgccacgtttacaatgagattattgtctcccgtgagagtgcccaactacaatatgataataatggatgaagcgcatttcaccgatccagcctcgattgcggcccgcggatatatttctacgcgagtaggtatgggggaagctgctgctatatttatgaccgcaacccctccagggtcagtagaagcctttcctcaatcaaacgccgttatccaggacgaggaacgtgatatacctgagagatcatggaactctggctatgattggataactgatttcccaggcaagacggtgtggttcgtaccaagtattaaatctggcaatgatatcgctaactgcttaaggaaaaatggaaaaagagtaatccaactgtctagaaaaactttcgatacagagtatcagaaaactaaaaacaatgattgggattacgtcgttaccacagatatctccgaaatgggcgcaaattttagagctgatcgtgtcatcgatccacggcgatgtttaaagccagttatactcaaggacggacctgaacgagtaatactagccggacctatgccagtaacggtcgcatctgccgcacaaagaagaggcagaatcggcaggaatcaaaacaaagaaggggatcaatatgtatacatgggccagccattaaacaatgatgaggatcatgcacactggactgaagcaaaaatgttgctagataatattaatactccagaaggtatcattccggctctttttgaaccagagagggaaaagagcgctgctattgacggagaataccgtttaaggggagaagcaagaaagacatttgttgaattgatgcgaagaggtgatcttcctgtatggttaagttataaagtcgccagcgaagggtttcagtatagcgaccgaagatggtgctttgacggggagagaaacaaccaagtgctcgaagagaatatggacgtagagatatggacaaaggaaggagaaaggaaaaagctccgtcctaggtggctcgacgcacgtacgtacagcgacccactagcattgcgagaatttaaagagttcgccgcaggtcgaagatcagtctctggagacctaattttggagatcggtaaactaccgcagcacttaactttaagagctcaaaatgctcttgataacctagtaatgctccataatagcgaacaaggtggaaaggcataccgacatgcaatggaggaacttccggacacaattgaaaccttaatgctgctagcattaattgcagtactgaccggaggtgtaaccctatttttcctatctggaaaaggattgggcaaaacaagcattggacttttatgcgtaactgcctcgagcgcattgttatggatggcgtcagtagaaccacattggatagccgcttcaataatattagagttctttttgatggtcttactcatcccagaacctgaccgacaacgaacgccgcaagacaatcagcttgcatatgttgtgattggactactttttatgatcttaactgttgcagctaatgaaatggggctacttgagacgacaaagaaagacctcgggataggctatgtagccgctgaaaatcatcaacatgcaactatgctagatgttgatttgcaccctgcgtcagcttggacattatacgcagtagcgacaaccgtgatcacacctatgatgcgacatacaatagaaaataccaccgccaatataagtctaacagcaattgccaatcaagcagctattttaatggggctcgataaaggttggccaataagtaaaatggacataggggttccactcttggcactcggatgttattcgcaagttaatcctcttacgctaacagcagcagtgctgatgttagtagcacactacgcaattataggacccggcttacaagcaaaagccacacgtgaagctcagaagagaacggcagctgggatcatgaagaatcccactgtcgacgggatcgtggccatagacttagatccggtagtttacgacgcaaaatttgaaaaacaactaggacaaattatgttgctaatcctatgcacgtcacaaattcttctcatgcgaacaacatgggcactatgcgaaagtattacactggcaaccggaccacttacaacgctgtgggaaggaagtcctggcaaattctggaacacaaccattgcagtttccatggcaaacattttcagaggatcataccttgcaggagccggcttagccttttcccttatgaaatcgttgggtggcggcaggagagggacaggtgcacaaggagaaacgttaggtgaaaaatggaagcgacagttgaatcaacttagtaaatcagaatttaacacgtataaacgtagcgggataatggaagttgaccgttctgaagccaaagaaggcctgaaacgtggagagactaccaaacatgctgtgtcacgcggaactgcaaagctaagatggtttgttgaacgaaacttagtcaaacctgaaggaaaagttattgatctagggtgtggccgcgggggttggtcgtactattgtgcgggactaaagaaagtaacagaagtaaaaggatatacaaaaggagggccaggacatgaggaaccaatacccatggcgacgtacggctggaatctagtgaaacttcattctggaaaagacgtatttttcatgccacctgaaaaatgtgacacccttttgtgcgatataggtgaatccagtccaaatcctaccattgaagaaggccgaaccctaagagtacttaaaatggtagaaccttggcttcgtggtaatcaattttgcattaaaatcttgaatccctacatgccttctgtagtggaaacgttagagcagatgcaaagaaagcacggtggtatgttggtaaggaatcctctaagtcggaatagcacacatgaaatgtattgggttagttgtggaacaggaaatattgtttcggcagtgaatatgacctcacgtatgcttctgaataggtttacgatggctcatagaaaacccacgtatgaacgagatgtagatcttggagcgggaacaagacatgtagcggtggaaccggaagtagctaacctagatatcatcgggcaacgaattgaaaatattaagaacgaacataagtcaacttggcactacgatgaggataatccctataaaacatgggcgtaccatggatcctatgaggtaaagccaagtggcagtgcgtctagtatggtaaatggggtcgtacggttgttaaccaagccctgggatgttatacctatggtgactcaaattgcgatgacagacactaccccttttggccaacagagagtcttcaaagaaaaagtagacacccggacgcctcgagcaaagagaggaaccacacaaataatggaagtgacagcaaagtggttatggggattcttatcacgaaacaaaaagccacggatatgtacgagagaagagttcacacgtaaggtacggtcgaacgctgctataggagccgtatttgtagacgaaaatcaatggaactccgcgaaggaagcggtagaagacgagaggttttgggatttagtccatcgagaaagagaattacataaacaaggtaaatgcgcaacatgcgtctataatatgatgggaaagcgtgaaaagaaactaggagagttcgggaaagctaaaggaagccgagccatttggtacatgtggctcggtgctcgattcctagaatttgaagcacttggttttatgaacgaagaccattggttttcaagagaaaattctcttagtggggtagaaggtgaaggcctacataagttaggatatattctccgagacattagcaagataccaggtggaaacatgtatgcagatgatacagcgggttgggacaccagaataactgaagacgatttgcaaaatgaagcgaaaataacagacataatggaacctgaacatgccttgttagcaactagcatcttcaaactcacctatcaaaacaaagtcgtaagagtacaaagaccagctaaaaatggtactgtaatggatgtaatatcaaggagagatcagcgcggttcaggacaagttggaacatatggcttgaatacattcaccaacatggaagtacaactaatccgccagatggaatccgagggaatcttcttaccaagcgaacttgaaacgccaaacctagcagagagagccttagattggttagaaaaacatggtgcagagcgtttaaagagaatggccatctcaggggatgattgcgtcgtaaaaccaattgatgatcgatttgcaacagccctaacggcattaaacgacatgggaaaagtaaggaaagacatcccccaatgggagccgagtaaaggatggaacgattggcaacaagtgcctttctgtagtcatcactttcaccaacttataatgaaagacggaagggaaatcgtagttccctgccggaaccaggacgagctagttggacgagctcgtgttagtcaaggtgccggctggagtctaagagaaaccgcatgtttaggaaagtcctatgcccaaatgtggcaattaatgtattttcataggcgagacttgcgtcttgcagcaaatgcaatttgctctgcggttcctgtggactgggtacctgcatcgagaacaacgtggagcatccacgcacatcatcaatggatgacaactgaagacatgttaagcgtatggaaccgagtatggatagaggaaaatccatggatggaagataagactcacgtatcaagttgggaagaagttccttatttggggaagcgagaagatcaatggtgtggtagcttaatcggactgactgcccgtgcaacttgggcaaccaacatacaggtagctataagtcaagttagacgactaatcggaaatgagaattatttagactatatgacatcgatgaaacgatttaaaaacgagtccgacccagagggggcattatggtaa

SEQ ID NO: 22040 - RNA, 9879 nt, synthetic construct
  misc_feature 1..9879: note = derived and/or modified CDS sequence (opt6) from DENV-1__KC692510__SS-prME
  source 1..9879: mol_type = other RNA
tccgtgaccatgcttctaatgctactacctacagctctggcttttcacctaacgaccagaggtggagaaccacacatgatagtaagcaaacaagaacggggaaaatccttgctctttaaaacgagcgccggtgttaatatgtgcaccttaattgcaatggatctgggagaattatgtgaagatactatgacatataagtgtccgaggataactgaagctgaaccagatgatgttgactgctggtgtaacgcaactgatacctgggtaacttacggaacgtgtagtcaaacaggggaacaccgacgagaaaaacgaagcgtagcactagcacctcatgtgggtttaggattagaaacacggacggagacctggatgtccagcgaaggtgcatggagacaaattcaacgcgttgaaacatgggctttgagacacccaggattcacagttattgcgttctttctcgcccatgcgataggaacctctataacacaaaaaggaattatcttcatactgttaatgttagttactcccagcatggcaatgaggtgtgtagggataggaaatcgagattttgttgaagggctatcaggagcaacctgggtagacgtggtacttgaacacggatcgtgtgtaacaacgatggcaaagaataaacctacgttggatatagaattactaaaaactgaagtaacgaacccagctgtattacgaaaattgtgtatagaagcgaaaatatctaatactaccactgactcccgttgtccaactcaaggcgaagctaccctggttgaagaacaagacgcgaatttcgtgtgtagaagaacatttgtagaccgtggatgggggaacgggtgcggattatttggaaagggatcacttttaacatgtgccaaattcaaatgtgtaacaaaattagaaggaaaaatcgttcaatatgaaaatcttaaatactctgtaattgtaacggtgcatacaggagatcaacatcaagtaggcaacgagacaacagaacacggaactatagccacaatcacaccacaggctcccaccagcgaaattcaacttacagattatggcgccttaacgctcgattgtagcccacgtaccggcttagactttaatgagatggtattgcttacaatgaaagaaaaatcgtggttggtacataaacaatggtttcttgacttacctttaccctggacgtccggtgcttctactagccaggaaacatggaatagacaagacttactcgtaacatttaaaaccgcgcacgccaagaaacaagaggtagtagttcttggtagtcaggaaggagctatgcacacagcactaactggggcaactgaaattcaaacctcaggaacgaccacaatttttgcaggacatctaaaatgtaggttaaaaatggataaactaacattaaaagggatgagttatgtgatgtgtaccgggagttttaaacttgaaaaggaggtcgcggagacacaacatggtacggtcctagtgcaagtcaagtatgagggtaccgatgcgccttgtaaaataccatttagtactcaggacgagaagggagtcacacaaaatggacgcctcataacagcaaacccaatagttacagataaagaaaagcctgtaaatattgaaactgagcctccgttcggtgagagttacatcgtggtcggggcaggagaaaaagccttaaagctcagctggttcaagagaggatcatcgattggaaaaatgttcgaagcaacagcgagaggggcaaggcgaatggctatattaggtgatactgcatgggactttggatctattggcggtgtttttacttcagtcggcaaactcgttcaccaagtatttgggaccgcctacggtgtgttatttagcggagtaagttggacaatgaagatagggattggcatacttctaacatggctcggcttgaacagcaggtcaacttctttaagcatgacttgtatagcagttgggatggtaacactgtatctaggagtaatggttcaggctgatagcggatgtgttataaactggaagggtcgagagttaaaatgcgggtcgggtatcttcgtgacaaatgaagtccatacttggaccgaacaatataaatttcaagcagattcgcccaaaagactaagtgcagccattggcaaagcatgggaagagggggtatgcggaataagatctgcaacaagattggagaatattatgtggaaacaaatatcaaacgaattaaaccatattctattagagaacgatatgaaatttaccgtagtggtgggcgacgctaacgggatcttggcacagggcaagaagatgatacgtccacagcccatggaacacaaatacagttggaaaagctgggggaaggcaaaaattataggcgcagacatacaaaatactacatttattatagacggaccggatacacctgagtgcccagatggccaacgggcctggaatatatgggaagtcgaagactacgggtttggtgtttttacaacaaatatctggctaaaattaagggattcctatacacaaatgtgtgatcaccgactcatgtcagcagcaataaaggatagcaaggcagttcatgcagacatgggctattggatcgaaagtgagaaaaacgaaacatggaaacttgcaagggcatcgttcattgaagtaaagacatgtacgtggccaaaatcacatactttatggagcaatggcgttctggagtcggaaatgatcatcccaaaaatcttcggcggaccaatatcccagcataattacaggccaggatacttcactcagacagcaggaccttggcacttaggcaaacttgaattagattttgatctttgtgaggggaccacagtagtagtagatgaacactgcggaaaccgagggccatctttaagaactacaacggttacaggaaaaatcatacatgaatggtgttgtagaagttgcacactgccaccattacgtttcaggggtgaagacggttgctggtatggtatggagattagacctgttaaggaaaaagaagaaaatctagtacggtcgatggtatcagcaggatcgggagaagtggacagttttagcttagggattttatgcgtttcaataatgattgaggaggttatgagatcgagatggagtagaaaaatgcttatgactggtacactagcagtttttctactacttattatgggacagttaacttggaacgatttaatccgactatgtataatggtaggagcaaatgctagtgatcgcatgggaatgggtacgacttacctagctttaatggcaacttttaaaatgagacccatgtttgccgtcggactactgttccgtcgattaacatcaagggaggtcctcttattaaccattggcttaagtttagtagcgtctgtagaactccccaacagcttagaagaattgggagacggcctagcaatgggaattatgatgcttaaactattaactgaatttcagccgcaccaactctggacaactttgttgtcactaacattcgtaaagactacattaagtttagactatgcctggaaaaccacagctatggttctaagcatcgtctcattatttccattatgtttgagtacgacttcacaaaagactacatggctaccagtgttacttgggtctttcggatgtaaacctttaacaatgtttttgatcacggaaaataagatctgggggcgtaagtcatggccactaaatgaaggaataatggcgataggaattgtttctatattactttcttcattactaaagaacgacgttccactagccggaccgctaatcgctggtggtatgctaatcgcctgttatgtaatatcaggatccagtgcggacttatcattagagaaggcagctgaagtatcatgggaacaagaagcagaacacagtggagcatctcacaatatactggtagaggttcaagatgacggaacaatgaagataaaagatgaagaaagagacgacacactaacaatcttgctaaaagccactctattagcagtatctggcgtctacccaatgtcaattcctgcaactctttttgtgtggtatttttggcagaagaagaaacaacgaagtggagtattatgggatacaccatctccgcctgaggttgaaagggctgttttagatgatggaatatatagaattttacaaagaggacttttaggaagatcacaagtcggtgtcggagtctttcaagatggagtatttcatactatgtggcatgtcactagaggcgccgtgctaatgtatcagggaaagaggctagagccaagctgggcatctgtcaagaaagacttaatcagttacggcgggggctggcgcttccaggggtcatggaacacaggggaagaggttcaagtcatcgcggtagagccaggcaaaaatccaaagaacgtacagacaactccaggaacatttaaaacacccgaaggtgaagtaggagctatagctcttgacttcaaacccggaacaagtgggtcccctatcgttaatagagaaggaaaaatagtaggcctttacggaaatggcgttgtgaccacgagtggcacttacgtctcggcaatcgcccaagcaaaagccagtcaagaggggccattaccggagatagaagatgaagtattcaagaaaaggaatttgacgattatggacctgcatccagggagcggcaaaacccgacgatatctccccgccatcgtgcgcgaggcgataaagaggaaacttcgaacattgattttagcaccgacaagagttgtggccagtgaaatggctgaagcattaaagggtatgcctataaggtaccaaactactgcggtaaaatcagaacatacgggtagagaaattgtagaccttatgtgtcacgcgacatttaccatgagattattatcacccgtacgagtaccaaactataatatgattataatggacgaggcacacttcacagatcctgcaagcatagcagcccgaggctatatatcgacacgggtaggcatgggtgaagccgcagctatattcatgacagcgacacctcctggatcagtggaagcattcccacaatcaaacgctgtgatacaagatgaagaaagagacattccagagcgtagttggaacagcggttatgattggataacagattttcccggtaaaactgtctggtttgtaccatctattaaatcaggaaacgatatcgctaattgcctgaggaaaaacgggaaacgtgtcatacaattgagtagaaagactttcgataccgaataccagaaaacgaaaaataacgattgggactacgtagtaactactgacatatcggaaatgggtgcaaacttcagagctgatagagttatagatcctcgtagatgcctaaagccagtcatactaaaggacgggccagagcgagttattctggcgggaccaatgccggtcacagtggcttccgctgctcaacgaagaggtagaataggaaggaatcaaaataaagaaggagatcaatatgtttatatgggtcaacctttaaacaatgatgaagatcacgcacactggactgaggccaaaatgctcttagataatattaatacgcctgaaggtataattccggcactatttgaaccggaaagagagaaatcggctgcgatagacggagaatatagattaagaggtgaagcacgcaaaacttttgtagagttgatgagacgaggagatcttcctgtatggttatcatacaaagtcgcgtcggaaggatttcaatatagtgatagaagatggtgcttcgatggcgaaaggaacaaccaagtactggaggaaaatatggatgttgaaatatggacaaaagaaggtgaacggaaaaagttaaggccgagatggttagacgctcgaacgtattcagatccactcgcgttgcgtgaatttaaggagttcgccgctggtagacgaagcgtatcgggcgatttaatactagaaatcgggaaattaccacaacacttaacactacgggctcaaaacgcattagacaatttagttatgctacataatagcgaacagggtggtaaggcttacaggcatgctatggaagaactaccagatacgatagaaacgctaatgctattggcgctaatagcggtactcactggaggagtcactttattctttctgtctgggaaaggtctgggaaaaacatccataggacttttatgcgtaaccgcttctagtgccttactgtggatggcatctgttgaacctcactggatcgccgcgagtataatcctagaatttttcctaatggtattacttattcctgaacccgaccgacaaagaacaccgcaagacaaccaattagcgtacgtagtaataggactactcttcatgattctaactgtggctgcaaacgaaatgggtctattagagaccactaaaaaggatttagggattggatatgtagccgccgaaaatcaccagcacgctacaatgttggatgtggacttacatccagcatctgcatggaccctgtacgcagtggcaaccacagtaattactcctatgatgaggcatactatagaaaacacgacggctaatatctcacttacggccattgcaaaccaggcagccattcttatgggacttgacaaaggatggccgatctcgaaaatggatataggagttccactcctagctctgggctgttactcgcaagtgaatcctctaacgttaacagcagccgtattaatgctcgtagcgcattacgccataattggtccaggactacaagcgaaagccacacgtgaagcacaaaagaggacagcagcaggtataatgaaaaacccaacagttgacggtatagtggcaattgacctagatcctgtagtttacgacgcgaaattcgaaaagcagctaggacaaataatgctactaatcttatgtacaagtcaaattctactaatgaggaccacttgggcattatgtgagtccattactcttgcaacaggtcctttaaccaccctatgggaagggtcacctggcaaattttggaacactacaattgcagtgtctatggcgaatattttcagaggatcataccttgcaggagcgggtctggcattcagtctaatgaaatcattagggggaggtagacgaggtactggtgcacaaggagaaaccttgggcgagaaatggaaacgtcaacttaaccagcttagtaaatccgaatttaatacctacaaacgttctggaataatggaggtagacagatcagaggcaaaagaaggactgaagcgaggagagaccactaaacacgcagtctcgcgaggcactgcaaaactccgttggttcgtagagaggaatttagtcaagccggagggtaaggtcattgatcttggctgtggtaggggaggatggagctactattgtgctggattgaagaaagtcactgaagtaaaaggatatacaaaaggaggaccagggcatgaagaaccaatacccatggcaacgtatgggtggaacttggtaaagctacattcaggcaaggatgtcttcttcatgccccctgaaaaatgtgatacactcctatgcgatattggagaatctagtccgaatccaactatagaagaaggaagaaccctgcgagtgttaaaaatggtagaaccttggctacgcgggaatcaattttgcataaaaatattgaacccctatatgccaagtgtcgttgaaacacttgaacagatgcaacgaaaacatggcggcatgctagtcaggaatccattaagtcgaaacagtacgcatgagatgtactgggtgtcttgcggtaccggtaatatcgtttcagccgtaaatatgacctcaagaatgttacttaaccgcttcaccatggcgcaccgaaagcctacgtacgagcgcgatgttgacctgggcgctggaactcgacacgtagccgtagaaccagaagtggcaaacctagatataattggacaacgaatagaaaatatcaaaaatgagcacaagagtacgtggcattatgatgaggataatccttataaaacatgggcatatcacggttcatatgaggttaaaccatctggatcagcctcttccatggtaaatggagtagttcgtctacttacgaaaccatgggatgtaataccaatggtaacacagattgcaatgaccgatactaccccttttggacaacaaagggtatttaaggaaaaggtagatacacgtaccccacgtgctaaaaggggcacaacacaaattatggaagttacagctaaatggctgtggggtttcctttctcgaaacaagaaaccaaggatttgcactcgagaggagttcacacggaaagtgagaagcaacgcagcaataggggccgtattcgtcgatgaaaaccaatggaactcagccaaggaagcagtagaggatgaaagattttgggacttagtacatagggaaagagagctccataaacaagggaaatgtgcaacatgcgtatacaacatgatggggaaaagagagaagaaacttggtgagttcggcaaagccaaaggatctagagcgatctggtacatgtggttaggtgcaagattcttagagttcgaggctcttggtttcatgaatgaagaccattggttcagtcgcgaaaattctttaagcggcgtagaaggtgaaggtctgcataagctaggatatatactaagagatatatctaaaattcccgggggaaatatgtacgcggatgatactgctggttgggacacccggataacggaagacgacttacaaaacgaagcaaaaatcactgacatcatggaacctgagcatgctctcttagccacaagtatattcaaacttacctatcagaataaagtcgtgagggtacaaagaccagccaaaaacggaactgtaatggatgtcatttcgagacgtgaccaacgaggatccgggcaagtagggacatatggcctaaacacattcacaaatatggaagtacaattaattcgccaaatggaaagcgaggggatattcctccccagcgaattagaaacacccaacttagccgaaagagcattagactggttggaaaaacacggtgcagagagattaaagagaatggcgataagtggggacgattgtgttgttaagccaatcgacgataggttcgcgacagctctcacagcgctcaacgatatggggaaggttagaaaggatattcctcaatgggaaccatctaaagggtggaatgattggcaacaggtacctttctgcagccatcatttccatcaacttataatgaaggacggtagggaaatagttgttccatgtcgaaaccaggatgagctagtgggacgagcgagagtatcacaaggtgcaggatggtcattacgggaaacggcatgccttggtaagagctatgcacaaatgtggcaattaatgtactttcacagaagggacctaaggcttgccgcgaacgctatttgctctgcagtaccagtagattgggtacccgcatcgagaactacgtggtctattcatgcccatcatcagtggatgaccactgaggatatgctctctgtttggaatcgagtttggatagaagaaaatccgtggatggaagataaaacccacgtctcatcatgggaagaagtaccatacttgggtaaacgagaagatcaatggtgcggatctcttatcggattgacggcgcgtgcgacctgggcaacgaatattcaagtcgctataaatcaagtaagacggctcataggtaacgaaaactacttagattatatgacttccatgaaaagatttaagaacgagtcggacccagaaggagccctttggtaa

SEQ ID NO: 22041 - RNA, 9879 nt, synthetic construct
  misc_feature 1..9879: note = derived and/or modified CDS sequence (opt6) from DENV-1__KC692511__SS-prME
  source 1..9879: mol_type = other RNA
tctgtaacaatgctcctgatgctactccccacggctttggcattccatctcactacacgagggggtgaaccccatatgatcgtatcaaaacaagaaagagggaaaagtcttctattcaaaacttcagtaggagttaacatgtgtacccttatcgcgatggatttgggagaattatgcgaagacacaatgacatacaaatgcccccggataacagaagcggaacccgacgacgtagattgttggtgcaatgcaacagacacatgggtaacatatggcacgtgctcccaaacaggtgaacaccgaagagacaaacgatcggtcgcacttgcaccccatgtaggattaggtctagaaacgcgtactgaaacctggatgtcgtccgaaggggcttggaaacaaatacaaaaagttgaaaactgggcactcagacaccccggcttcacggtaatagcattatttctagcacatgccattggtacgtcaataacacagaaagggattatttttattttgctgatgttagtaacacctagcatggcaatgagatgtgtcggtataggaaatagagattttgtagaagggctatccggtgctacatgggttgacgtagtgcttgaacacggatcgtgcgtaaccacaatggccaaaaacaaaccaacactagacatagaacttttaaaaacagaagtgacaaacccagcggttcttagaaaattgtgcattgaagctaaaataagcaatactaccactgacagtagatgcccaacgcaaggtgaagcgacattagttgaagaacaagatgcgaatttcgtttgtcgtcggacttttgtggacagaggatggggtaacggatgcggcttgttcgggaaaggcagtctattgacttgcgcgaaattcaaatgcgtcacaaaattagaaggcaaaatagtgcaatatgaaaatttgaaatattcagtgatagtcacagtgcatacaggggatcagcaccaagtgggtaacgaaactacagaacatggaacaattgctacaataactccacaagccccaacttctgaaattcaactgaccgattatggggcgcttacacttgactgtagcccacgcacaggtcttgacttcaatgaaatggtccttttaactatgaaagagaaatcatggttggtccacaaacaatggttcctagatctaccacttccgtggacctccggtgcgtccacatcacaggagacttggaaccgacaagatttattggtaacgtttaaaacagctcatgccaagaaacaggaagtcgtggtattaggtagccaagaaggagctatgcatacagctctgacgggagcgacggaaattcaaacatcaggtacaaccactatatttgcgggacatttgaaatgcagattaaaaatggataaattaacattaaaaggaatgtcgtatgtgatgtgcaccgggagcttcaaattggaaaaagaagtggcagaaactcagcatggaaccgtccttgttcaagttaaatatgaaggcaccgacgcaccatgtaaaataccattcctaactcaggacgaaaaaggagtaactcagaatgggcgtttaataactgcaaacccaatagttaccgataaagagaaaccagtaaatatagaaactgaacctccatttggagaatcatatatcgttgttggcgcaggagaaaaagctctgaaattatcttggttcaagaaaggttctagcattggaaagatgtttgaagcgacggcaagaggggcacgccgaatggccattttgggggataccgcttgggactttggcagcatcggtggtctatttacatcagtaggaaaacttattcatcaaatctttggaaccgcgtatggcgtactattcagtggtgtcagttggaccatgaaaatagggatcggaatattactaacttggctaggattaaactcaaggagtacatcgctgtctatgacttgcatcgcggtaggtatggttacactatatctaggagttatggtacaagcagattctggctgcgttatcaattggaagggaagagaacttaaatgtgggtcaggaattttcgtcactaatgaggttcacacatggaccgagcaatacaaattccaagccgactcacctaagagattgagtgcagccatcggtaaggcatgggaggaaggagtatgtggtatacgtagtgcaaccagactagaaaatataatgtggaaacaaatctctaacgaattaaactacatactgctagaaaacgacatgaaatttaccgttgttgtaggggatattaacggcattctagctcaaggtaagaaaatgataagacctcaaccaatggaacacaaatattcgtggaaatcatggggcaaagcgaaaattataggagctgatattcaaaatactacgtttattatagatggtccagacacgcccgaatgccctaacgatcaaagggcttggaatatatgggaagtagaagactatggctttggaatattcacaacaaatatatggttgaaactacgtgacagtcacactcaaatgtgtgatcatagactaatgtcagctgcaataaaagactctaaagcagtccatgctgatatggggtattggatagaaagcgaaaagaacgaaacatggaaattagcaagagccagttttatcgaagtaaaaacttgcatatggcccaaatcacatacattatggtctaacggagtccttgaatcggagatggtaatacccaaaatttacggaggtcccatatcacaacacaattatagaccgggctatttcacacaaactgcaggaccatggcatctgggaaaattggaattggattttgatctttgcgaaggaaccactgtagtagtggacgaacactgtggatataggggtccgtctctcagaacgacaacagttaccgggaaaattatccacgaatggtgctgtagaagttgcaccctacctccccttaggttcagaggcgaagatggatgctggtacgggatggaaattaggcctgtaaaggaaaaagaggaaaacctcgtacgatcaatggtttctgctggttccggtgaagtagactcatttagtttagggatcttatgtgtatctattttaatagaggaagtgatgcgaagtagatggtctagaaaaatgctaatgaccggtacgttagcagtattcctattacttattatgggtcaattgacctggaacgacctgattagactttgtataatggtcggagcaaacgctagcgaccgaatggggatggggacgacctacctcgctcttatggcgaccttcaagatgagaccaatgtttgctgtaggtttattatttcggcgtctaacaagccgagaagtacttttactaacagttggtttgtctctggttgcgagtgtcgaattacctaattctctagaggaactcggagatggcctagctatgggaattatgatgctaaaattactgactgattttcaacctcaccaattatggaccaccctactgagtcttacttttattcgaacttcattaagtctcgattatgcatggaagacaatggcaatggcattatcaattgtgtcgttattccccttgtgcctaagcacaacatctcagaaaacaacttggttaccggtactactaggaagtttcggttgtaagcctctgacaatgtttcttatcactgaaaataagatatggggcaggaaatcctggccaataaatgagggtattatggcagttgggatagtatctattttattatcaagcctactcaagaacgatgtaccgttagcaggcccattaatagctggtgggatgttaatagcatgttacgtcatatcaggatcatcagcagacttatcgcttgagaaagcagcggaagtaagttgggaagaggaggcggagcactccggaacctcacacaatatacttgtagaagtccaggatgacggaacaatgaaaataaaagatgaggaaagagatgataccctgactatactgttgaaagcaacactcttagctgtctcgggggtttatcccatgagcattcctgctacattattcgtttggtacttttggcagaaaaagaaacaaagaagcggggttttatgggacacaccgtctccgccggaagttgaacgagcggtacttgatgacggaatataccggattctgcaaagagggctactcggcagatcacaagtcggcgtgggagtatttcaagatggtgtatttcacacgatgtggcacgttactagaggagcagtacttatgtatcaaggaaaaaggttagaaccatcatgggcgagcgtcaagaaagatttaattagttatgggggagggtggaggtttcagggctcatggaacacaggagaagaagtgcaagtaattgccgtggaacctggtaaaaatcctaaaaacgtgcaaacgacaccaggaacatttaaaactccagagggagaagtaggagcaatagcgctagactttaaacctggaacatcaggaagtccgattgtcaacagagaaggtaaaatcgtcggtctttacggaaatggggtggtgactacctctggcacatatgttagtgcaatagctcaagctaaagcaacacaagaaggtcctttaccagaaattgaagatgaagtttttaagaaacgaaacctcaccattatggacctacatccgggaagcggtaaaacccgtagatacctgcctgcgatcgtgcgtgaggcaatcaaacgtaagctgcgtacattaattctcgcaccaacccgcgtagtggcttccgaaatggccgaggctttaaaaggtatgcccattcgatatcaaactaccgctgtcaaaagtgaacatacaggacgggaaatcgttgatctaatgtgccatgcaacatttacgatgcgattactttccccagtccgcgtaccgaactataatatgatcatcatggacgaagctcattttaccgatcctgctagcatcgctgctcggggctacatttccacacgcgtaggtatgggcgaagcggcagcaatatttatgaccgctacaccacccggttccgttgaagcctttccgcaaagtaatgcagtaatacaagatgaagaaagggatatccccgaaaggtcttggaatagtggttatgattggatcacagatttccccggtaaaacggtttggtttgtgccgtccatcaaatccggaaatgatatagcaaattgtttaaggaaaaatgggaaaagagtgatacaactgagccgaaagacattcgacacagaataccagaagaccaaaaataatgattgggattacgtagtaacaactgatataagtgaaatgggagctaattttcgggcagatcgtgtaatagatccccgaagatgtttaaagccagttattttgaaggaaggtccagaaagagtaattctcgcggggcccatgccagtaaccgtggcgagtgccgcgcaaagacggggacgaattggtagaaaccaaaacaaagagggagaccaatatatttatatgggccaaccactaaacaacgatgaagatcacgcccattggacagaagcgaaaatgttattagacaatataaatactccagagggtataataccagcgctattcgagccggaacgcgaaaagagcgccgcaattgacggagaatatagattaaggggagaagcacgaaaaacattcgttgagttgatgagaaggggtgacttgccagtttggcttagttacaaggtagcctccgagggttttcaatattccgatcggcgatggtgctttgatggggaacgaaataatcaagtcttagaggagaatatggacgtagaaatatggacgaaggaaggagaaaggaagaaacttcgtccaagatggctagatgcacgaacctactcggacccgctagcgctacgagaatttaaagagtttgcagcgggaagaagatctgtctcaggtgacctcatactggaaatagggaaattacctcaacacctgacactgcgtgcacagaatgcgttggataacttggtaatgttgcataattccgaacagggcgggaaggcctatcgccacgccatggaggaacttccagatacaatagaaacacttatgttgttggcactaatagctgttttgacgggaggtgtaacgttattctttctatcaggaaaaggattgggaaagacatcaataggtttattatgtgtaatggcgagctcagcgctgctttggatggccagcgtggaaccacactggatcgccgcatcaatcattctggagttcttcctaatggtactcttaattcccgagccagacagacaacgaactcctcaggataaccaactagcatatgttgtaataggattattatttatgatattaacagtagccgctaacgaaatgggactacttgaaaccaccaagaaagacctcggaataggtcacgtggcagtggaaaaccaccatcacgctactatgcttgatgttgacttgcgcccagcgagtgcatggaccctatacgcagtggctaccacggtaatcacgcccatgatgcgccacacaatagaaaacactaccgcaaatatctcactgacagcaatagctaaccaagcggcaatattgatggggttagataagggttggccaatttcaaaaatggatattggggtaccccttttagcactaggatgttattcacaagtaaatcctctgacattaactgccgctgtattgatgctagtcgcccattacgctataatcggacctggattacaggcaaaagctacaagagaggcacaaaaacgaactgccgccggtattatgaagaatccgaccgtagacgggatagtcacaatcgatttagacccagttgtctatgatgccaaattcgaaaagcaactaggacagataatgcttctaattctatgtacaagccagattctactaatgcgaacaacttgggcattatgcgagagtatcacgttagctaccggtcctctgacaactttatgggaaggctccccaggtaagttttggaacacaaccatagccgtttctatggctaatatctttagaggatcatacctagccggagcaggcttagcttttagtttaatgaaaagtctaggcggtggccgaagaggcacaggggcccaaggagaaacattaggtgaaaaatggaaaaggcaattgaatcaactaagcaaaagtgagttcaacacttataagaaatccggtatcatggaggttgatagaagtgaagcaaaagaaggactaaaaagaggagagacaaccaagcatgcggtcagccgcggtactgcaaaattacgatggtttgtagaacgtaacctagttaaaccagaagggaaggtaatcgatcttggctgtggtaggggtggctggagttactattgtgcaggattgaagaaagtgacagaagtcaaaggatatactaaaggaggacccggtcatgaggaaccaattccgatggcaacatatggatggaatctagttaaactacattccggtaaagatgtatttttcactcctccggaaaaatgcgacacgctactatgtgacattggagaatccagtccaaacccaacaatcgaagaaggccgtaccctgagagttctaaaaatggtggaaccctggctaagaggtaatcaattttgcataaaaattttaaacccatatatgccttcggtagtagaaaccttagaacaaatgcaaaggaagcacggaggaatgttagtaagaaaccctctaagtcgtaattctactcatgagatgtattgggtaagttgcggtacaggtaacatagtatccgcggtcaacatgacttctagaatgcttctaaatcgtttcacaatggcacatcggaagcctacatatgaacgagatgttgacctcggtgccgggacaagacatgtcgctgttgaaccagaagtcgctaatttagatatcatcgggcaacgcatcgaaaacattaaaaatgagcacaaatccacatggcactacgatgaagataatccatataagacctgggcataccacgggagttatgaggtaaaaccttccggaagtgcatctagcatggtaaacggggtcgtgaggttactaacaaagccatgggatgtaattccgatggttacacaaattgcaatgactgatactacgcccttcggacaacagagagtgtttaaagagaaagtggatacacgtacacctcgggctaaaagaggcaccgcacagatcatggaagttacggcgaaatggttatgggggttcttgagtcggaacaagaaacccagaatttgtacgagagaggagtttactagaaaagttcgttccaacgcagccatcggagcagtattcgtagatgaaaaccagtggaacagtgcaaaagaagcagtcgaagatgaaagattttgggacctagtccatcgagaacgagaattacataaacagggaaaatgtgccacttgcgtatataatatgatgggtaaacgtgaaaagaaattaggagagttcggaaaggcgaagggatcacgagccatatggtatatgtggctaggggcaagatttctagagtttgaagcactaggtttcatgaatgaagatcattggttttcacgtgagaactcattaagcggggtagaaggggaaggactgcacaagctaggttatatcctaagagatatatccaaaatccccggaggtaatatgtatgcagatgatacagcaggatgggacacgaggataactgaagatgatctacaaaatgaagcgaaaatcactgacatcatggagcctgaacatgcacttctggctacaagcatatttaaactaacctatcagaataaagtcgtacgtgtgcaaagaccagcgaaaagtggaaccgtcatggacgtaatctcacgtagggatcagaggggatctggtcaagtagggacttacggactaaatacgtttaccaacatggaagtacagctaataagacagatggagagtgaaggtatctttagtccctccgaattagaaacacctaatctcgccaagaaagtcttagattggctcgaaaaacatggagctgaacgattaaaaagaatggcgattagcggagatgattgcgtagttaaacccatagacgatcgattcgctacagcattgactgcactaaacgacatgggtaaggtaagaaaggacattccgcaatgggaacccagtaaaggctggaatgactggcaacaagttccattttgctcgcatcactttcatcaactgataatgaaggacggaagagaaatcgtagtaccatgtagaaatcaagatgaattagtaggaagggcgagagtatctcagggagcagggtggagtctcagagaaaccgcctgcctagggaaatcctacgctcagatgtggcaactcatgtactttcaccgaagagacttgaggcttgctgcaaacgcaatttgttcagcagtaccggtagactgggtccctacttctagaacaacgtggagtattcatgcacatcatcaatggatgacaaccgaagacatgttatcagtatggaacagagtctggatcgaggaaaacccatggatggaagataaaacccatgtttctagttgggaagaagtcccatacttaggaaagagggaagaccaatggtgcgggtcactaattggactgacagcacgagctacatgggctaccaacattcaggtagccatcaatcaagtacgccgattgatcggtaatgaaaattatcttgattatatgacctcaatgaaaagattcaaaaatgagtctgacccagaaggggctctttggtaa

SEQ ID NO: 22042 - RNA, 9879 nt, synthetic construct
  misc_feature 1..9879: note = derived and/or modified CDS sequence (opt6) from DENV-1__KC692512__SS-prME
  source 1..9879: mol_type = other RNA
tcagttactatgttgttgatgttattacccacagctctagcattccatcttacgacaagagggggagaacctcatatgatagtttccaaacaagaaaggggaaaatcgctgctattcaaaacatcagctggagtcaatatgtgtacgctcatagcaatggatttgggggaattgtgtgaagatactatgacgtacaaatgcccaagaatcacagaggctgaaccagatgacgttgattgctggtgtaatgcaacagatacatgggtcacatacggtacttgtagtcaaacaggcgaacatagacgtgaaaaacgatcagttgccctagctccacacgtgggcctggggttagaaaccagaactgaaacttggatgagttctgaaggagcctggaaacaaatacaaagagtagagacatgggcattacggcaccccggatttacagtaatagctctttttcttgctcatgctataggaacaagcatcacacaaaaaggaattatctttatactattgatgctagttacacctagcatggcaatgagatgcgtgggaataggcaaccgggattttgtagaagggttgagcggtgctacctgggtagatgtcgtactggaacatgggtcatgtgtaacaacaatggccaaaaataaaccaacattagatatcgaacttctgaaaacggaagtcactaatccagcagttctcagaaaactttgcattgaggctaaaatatccaacacaacgactgactcccgatgtccaacacaaggagaagcaaccttagtggaggaacaagatgctaacttcgtatgtcgccgtacatttgtagatcgtggatggggtaatggttgcgggctctttggaaaaggcagtttactaacttgcgcaaaatttaaatgtgttacaaaactagaaggcaaaatagtacaatatgaaaatcttaaatattcagtaattgtcactgttcacactggcgatcaacaccaagtcggtaatgaaacaacagaacatggcactatcgccacaataacaccacaagcaccgacaagtgaaatccaacttactgactacggggcgctcacgctcgattgttcacctagaacaggtttagactttaatgaaatggttttactcactatgaaagaaaaatcatggcttgtacacaaacaatggtttttggatcttcctttaccatggacatcgggcgcgtccacttcgcaagaaacatggaaccggcaagatctgctagtaacctttaaaactgcgcatgcgaagaaacaggaggttgtagtgctaggtagccaggaaggagcaatgcacaccgcattaacaggcgccacagaaatacagacttcaggaacgacgacaatatttgctggacacttaaaatgccgtttaaaaatggacaaactaacacttaaaggcatgtcatacgttatgtgtaccggaagttttaagctagaaaaagaggtggccgaaacccaacacggtacagtactcgtccaagtaaaatatgaaggtacagatgcaccctgcaaaatacccttttctactcaggacgaaaagggagtgacccaaaatgggcgtctgataaccgcaaacccaatcgtaacagacaaggaaaaacccgttaatatagaaacagaaccaccatttggcgagtcatacatcgttgttggagctggagaaaaagcgctaaaacttagctggtttaaacgcggatcgtcgattgggaaaatgtttgaagctacagcaagaggcgcaagacggatggcaattttaggggatacagcgtgggactttgggtcaatagggggagtctttacttctgttggaaagctagtgcatcaagtatttggtactgcttacggtgttctcttttccggggtatcgtggaccatgaaaatcgggatagggattctgttaacatggcttggacttaattcaaggtccaccagcttgtcaatgacatgtatcgcagtgggcatggtaacattgtatctgggcgtcatggtgcaggcggattctggctgcgtcatcaattggaaaggaagagaacttaagtgtggatctggaatatttgttacaaacgaggtccatacatggacagaacagtacaagtttcaagcagattcaccaaaaaggctaagtgcagctataggcaaggcttgggaagaaggcgtttgcggcataagatcggcaacaaggcttgaaaacataatgtggaaacaaattagtaatgagctaaaccatatacttctggaaaacgacatgaaattcacggtagttgtcggggatgccaatgggattttagcccaaggaaagaagatgatacggcctcaaccaatggaacataaatacagttggaaatcgtggggcaaagctaagataatcggagcggatatccaaaacacgacttttattatcgacggaccagatacaccagaatgcccagatggacaacgagcctggaacatttgggaagtagaagattatggattcggagtattcacaacgaacatttggcttaaattaagagattcctacacccaaatgtgcgaccatagattaatgagtgcagcgattaaggacagtaaagcggttcacgctgatatggggtattggatagaatcagagaaaaatgaaacttggaagttagctcgagcttcatttatcgaagtaaagacgtgtacttggccaaagtcacacacgctatggagcaacggagttttagagtccgaaatgataatacccaaaatcttcggcgggccgatatcacaacacaattatagacccggctacttcacacagaccgcaggtccgtggcacctcgggaaattagaactggactttgacttatgcgaagggaccacggtggtagttgatgaacactgtggcaaccggggtccgagcttgagaactacaacggtaacaggtaaaattatacatgaatggtgttgcagatcttgcactcttccacctttaagatttagaggagaagacggctgttggtatggaatggaaattcggccagtaaaggagaaggaggagaatttggtacgaagtatggttagcgctgggtccggtgaagttgatagttttagtttggggatactgtgtgtaagcataatgattgaggaagtcatgcgttcgagatggtctagaaaaatgttgatgacaggaacattagcagtattcctccttttaatcatgggtcagctaacttggaacgatctcattcgcctatgtattatggttggagctaatgcatcggatagaatgggcatgggaactacatatttagcactgatggccacatttaaaatgagaccaatgttcgctgtaggtctattgtttcggaggctaactagcagagaggtcctcctactaaccatcggcctaagtttggttgcctcggtagaattaccgaacagtttggaagaacttggcgacggcctcgcgatgggaataatgatgctcaaattgctcactgaatttcagccacatcaactgtggacaacattattaagcctaacattcgtaaagacaacattatcactagattacgcatggaaaactacagcaatggttttatctatagtgtcactattcccattatgtttaagtaccacttcgcagaaaacaacatggttacctgtcttactaggttcatttggctgtaagccattaacaatgttcttgattacagaaaacaagatctggggtagaaaatcttggcctttgaacgaaggaattatggccattggtatcgtaagtatcttactatcatcattgttaaagaatgacgtaccgttggcgggaccattaatcgctggaggcatgttgattgcctgttatgtaattagtggcagctctgcagatttatctttagagaaagcggccgaagtatcttgggaacaagaggccgaacacagtggtgcttcacacaatatcctagtcgaagtacaagatgacggcaccatgaaaattaaagacgaggaacgggacgacacattaaccattctattaaaagcaaccctattagcggtctcaggtgtatatcccatgtctattccagctactctctttgtatggtacttttggcagaagaagaaacagagaagcggagttttatgggatactccatctccccctgaagtagaaagggcagttcttgatgatggcatttatcgaatcctacaaaggggtttgttaggaagatctcaagtaggagtgggagtatttcaagatggggtcttccatacaatgtggcacgtaacgagaggcgcagtgttgatgtaccaggggaaacgtctggaacccagctgggccagtgtgaagaaggatttaataagttatggaggtggttggcgttttcaaggttcatggaatacgggagaagaagtacaagtgatcgccgtagagccaggcaaaaatcccaaaaatgtacaaaccactcctggaactttcaaaacaccagaaggagaagtgggggccattgctctagactttaaaccagggacctcgggcagccccatagttaatcgagaagagaagatagttggattgtacgggaacggtgtagtaacaacttcaggaacatatgtatcagcgatagcacaggccaaagctagtcaagaaggaccgctgccggagatagaagatgaagtattcaagaaaagaaacctaacaattatggacctccatcctggaagtggtaaaaccagaagatatttaccagccatagtcagagaggctataaaaaggaaactaagaaccttgatattggcaccgacccgggtcgtagcgtcagaaatggcagaagcattaaaaggaatgcctattagatatcaaactactgccgtgaagtctgagcacacggggcgagaaatagtagatttaatgtgtcatgcaacatttaccatgcgtctactcagtccagtacgggtgccaaactataatatgattatcatggacgaagcacattttactgatccagctagtatagcagcgagaggttatattagcactagggtcggtatgggagaagctgccgctatttttatgacggctactccgccaggttccgttgaagccttcccgcaatctaacgccgttatacaagatgaagaacgagacataccggaacgcagttggaactcgggttacgactggattacggactttcccggcaagacggtatggttcgtaccatcaattaaaagcggaaacgatatagcaaattgtcttagaaagaatggaaagagagttatacaactttcaagaaaaactttcgatactgagtatcagaaaacaaagaataatgattgggattatgttgttacaacagatatatctgaaatgggggctaacttcagagcggaccgagtaattgacccacgtcgctgtcttaaacccgtaatattaaaggacggacctgaaagggtaatccttgcgggtccaatgccagtaacggtggcaagcgcagctcaacgtcgcggtcgtattggacgcaaccagaacaaagaaggagaccaatatgtctacatggggcaaccactaaataacgacgaggatcatgctcattggaccgaggcgaaaatgttgctagacaacattaatactccagagggaattatcccagccctattcgaaccagagagagaaaagagtgccgctatagatggagaatatagactacggggcgaagcgagaaaaacatttgtggaactaatgcgaagaggtgatctgcctgtctggctgtcatataaagtagcttctgagggtttccagtatagtgatagaagatggtgttttgatggtgaaagaaataatcaagttctagaagagaatatggatgttgaaatatggacaaaggagggagagaggaagaaactccgcccgcgatggttggatgcgagaacctatagtgaccccttggcactaagagaatttaaagagtttgcagcagggcgacggagcgtatcaggtgatctaattttagaaatcggaaaacttccacaacatttaacattacgcgcccagaatgccttagataacctcgtaatgttgcacaatagcgaacaaggagggaaggcttaccgacacgccatggaagaattaccagatacaattgagacgttaatgctactagcgttgatcgcagtactgacagggggtgtaactttattctttttatcaggaaaaggactcggaaaaacatcaattgggctcctttgcgttacagcatccagcgcgctactttggatggcctcagtcgaaccccactggatcgccgcctctataatcttagagttcttcctaatggtattactaattccagaaccagacagacaaagaacgcctcaggataaccaattagcttatgtcgtaataggattattattcatgatattgacggttgctgcaaacgaaatgggtttactagagactactaaaaaggacttgggaatcggacatgttgcagcagaaaatcatcaacattcaacaatgctcgatgtagatctacacccagcatctgcgtggacactatacgcagtagcaacaacagtcataacgcctatgatgcgacataccatagaaaatacaacagcaaatatttctctaactgcgatagcaaatcaagcggcaatcttaatgggtctcgataaaggctggccaatatctaagatggatataggggtcccattacttgcccttggctgttactcccaagtaaatccccttaccttaacagcagcagttttaatgcttgtagctcattacgcaataattggtcctggactacaggcaaaagctacgagagaagcacagaaaaggacagcagcagggataatgaaaaatccgactgttgacggaattgttgccatagatcttgatccagtagtatatgatgcgaaattcgaaaaacagctaggacaaataatgctgctcatattgtgtacatcgcaaatactattaatgcgcaccacatgggccctttgtgagagtataacacttgccacaggtccactaacaacattgtgggaaggaagccccggaaaattttggaataccacgattgccgtgtcgatggccaatatttttcgaggttcttatcttgctggagcaggactcgcatttagtttaatgaaatcattaggtggtggccgtcgcggtacaggggctcagggagagacgttaggggaaaaatggaaacgacaattgaaccaactgtccaagagcgaatttaatacatacaaacggagcggtatcatggaggtagacagaagtgaagcaaaagaagggttaaaacggggagaaactacaaaacatgcagtatcgagaggaactgcaaaactaaggtggtttgttgaacgtaacctagtaaaaccggaaggtaaagttattgatctagggtgcggaagaggcggttggagctactactgtgcgggattaaagaaagtaacggaagtaaaaggatacacaaaaggaggtccagggcatgaagaaccaattcccatggcaacatacggctggaacctagttaaactgcattcaggaaaagacgtgttctttatgccacccgaaaaatgtgacacgttattatgtgatataggcgaaagttctcctaatcccacgatcgaggaaggcagaactctcagagttctaaaaatggtagaaccatggttacgaggaaatcaattttgcattaaaatactaaacccatatatgccttcagtagttgaaactcttgagcagatgcaaagaaaacacggaggaatgttggttagaaacccattgtctcgtaattctacacatgaaatgtactgggttagttgcggcacaggaaacatagtgtctgcggtaaatatgacttcaagaatgttgctaaatagatttacaatggcacacagaaaaccaacgtatgaacgagatgttgatttaggtgctggtacaaggcatgtagcagtagaaccggaggtggcaaatctcgatataatcggtcaacgtatagaaaacattaagaacgagcataggagcacatggcactatgatgaagataatccttacaaaacttgggcgtaccatgggtcgtatgaagtgaaaccaagcgggtcggcgtcatcaatggtcaacggcgtagtccgacttctaacaaaaccttgggacgtaatacccatggtcactcaaattgcaatgacagacacaacaccctttggccagcaacgtgtgtttaaggaaaaagtagatacacgaacaccgcgtgctaagcgaggcactacccagatcatggaggtgacggcaaaatggctatggggatttctatcaagaaataagaaacccagaatatgtacaagagaagagttcaccagaaaagttcggtcgaacgcagcaattggtgcagtatttgtagacgaaaaccaatggaactcggctaaagaagctgtcgaagatgaacgtttttgggatcttgtacatcgagagagagagttacacaagcaaggtaagtgtgcaacgtgtgtgtacaatatgatgggcaaacgagagaagaaactgggagaatttggaaaagcaaagggttctcgagctatatggtatatgtggctaggagcaagattcttagagtttgaagcattgggctttatgaacgaagatcactggttctctcgtgaaaattcactgtctggagtggaaggtgaagggctacacaaacttggatacatactacgcgatatcagcaagattcctgggggcaacatgtacgccgatgacactgcaggttgggatacgcggattacggaagatgacttacagaatgaagccaaaataacggacatcatggagccagaacacgccttattggcgacgagcattttcaaattaacatatcaaaacaaagttgtacgagtacaacgaccagctaagaacggtaccgtgatggacgtaataagcagaagggatcaacgtggctctggccaagtaggaacgtatggcttaaatacctttacgaatatggaagttcaattaataagacaaatggaaagcgaagggatatttttaccatcagaactagaaacacctaatctagccgaacgagccttagattggttggaaaagcatggtgcagaacgcttaaagcgaatggcaatctcaggggatgattgcgtcgtaaaaccgatcgatgaccgatttgctacggcactaacagcgctcaacgacatggggaaagtacgtaaagatatccctcagtgggaaccaagcaaaggatggaacgattggcaacaagtcccattttgctcgcatcatttccaccaactaataatgaaggacggtcgagaaatagtagtgccatgtagaaaccaagacgaactggtaggacgagcacgcgttagtcaaggcgcaggctggagcttacgggaaactgcatgtttgggcaaaagctatgctcaaatgtggcaactaatgtattttcaccgtagagatttgagattagctgctaacgcaatatgctctgcggtcccggtcgattgggtaccggcaagccgaactacatggtccatacatgctcaccatcagtggatgacaaccgaggacatgttatcagtatggaaccgtgtatggatcgaagaaaatccttggatggaggacaagactcacgtgtcaagctgggaggaagtaccatatttagggaaacgcgaagaccaatggtgtggctcattgataggcctcactgctcgtgccacatgggcaactaatatacaagtggctataaaccaagttaggaggctaattggaaacgagaactacctcgactatatgacttcgatgaaaagatttaaaaatgagtcagacccagaaggagccttatggtaa

SEQ ID NO: 22043 - RNA, 9879 nt, synthetic construct
  misc_feature 1..9879: note = derived and/or modified CDS sequence (opt6) from DENV-1__KC692513__SS-prME
  source 1..9879: mol_type = other RNA
tcggttactatgctattaatgctacttccaacggctcttgcatttcatctaacgactaggggaggggaacctcacatgattgtatccaaacaagaacgcgggaaatctctattgtttaaaacatctgtcggagttaatatgtgtactttaattgctatggacttaggagaattgtgtgaagatacgatgacctataaatgtcctagaataacggaagcggaacccgatgacgtagattgctggtgtaatgcgacggacacatgggtaacttacggtacatgttctcaaacaggtgaacatcggagggataaacgaagtgttgccctagcaccccacgttggtttaggactagaaactcgaacagaaacctggatgtccagtgagggtgcgtggaaacaaattcaaaaagttgaaacctgggcccttaggcatcccggatttacggtaatagctttatttctagcacatgccataggtaccagtataacgcaaaaaggtatcatatttatattattgatgttagtaacaccaagcatggcgatgagatgcgtaggaattggtaatagggactttgttgaaggactatctggtgcaacgtgggtagatgtagtgctggaacacggttcatgcgtaacgacaatggctaaaaataaaccaacacttgacattgagcttttgaaaacagaagttacaaatccagcggtattaagaaaactatgtatcgaagctaaaatatccaacacgacaacggattctaggtgtcctacccaaggggaagccaccctagtggaagaacaggatgcaaatttcgtctgcagacgaacttttgtggatagggggtggggaaacggatgtggattgttcggtaaaggttcattattaacgtgtgccaaatttaagtgtgtaactaaattagaaggaaaaatcgttcagtacgaaaacctgaaatattctgtaatcgtaaccgtccacaccggcgatcaacatcaagttgggaatgagactaccgaacatggtacaatcgccacaattacaccacaggcgccgacatccgaaattcagctaaccgactacggcgcattaacacttgattgctcgcccagaacggggttagactttaacgaaatggtcttactaaccatgaaagaaaaatcatggttagttcataagcagtggtttttggaccttccgttaccctggacatctggagcatctacaccacaagaaacatggaatagacaagatctcctcgtaacattcaaaacagcgcacgccaagaaacaggaagtagttgtccttggaagtcaagaaggggctatgcacaccgcgttaacgggagccacagaaatccaaacaagcggaactactacaattttcgctggacaccttaaatgtaggctaaaaatggataaattaacattaaagggaatgtcctatgttatgtgcacgggtagtttcaaactcgaaaaagaagtcgcggaaacgcaacacgggacggtcctagttcaagttaaatacgaaggtaccgatgctccatgtaaaataccattcttaacacaagatgaaaaaggtgtgacccaaaacggtcgattaatcacggcaaatccaatagtcaccgacaaggagaaacctgtaaacatagagactgaacctccatttggggagtcctatatagtcgttggggctggtgaaaaggcattaaaattatcatggtttaaaaagggaagttccattgggaaaatgttcgaagccacagcaagaggagccaggcgaatggcaatattaggagacacggcatgggacttcggatcaataggaggtttgtttacctctgtcggaaaactcatacatcaagtatttggaaccgcttatggggtgcttttctctggtgtaagttggactatgaaaatcgggatagggatactcttaacttggttagggttaaattcaagatctacaagcctgagtatgacatgcatcgctgtcggaatggtaacgttatacctcggtgtcatggtacaagccgattccgggtgtgtgattaattggaaaggaagggaattaaagtgcgggtcgggaatattcgtaacaaatgaagtgcatacatggactgaacaatataaatttcaggcggatagcccaaaaaggctgtccgcagcaataggaaaagcctgggaagaaggcgtatgtggtatcagaagtgccacgagactggaaaacattatgtggaaacaaataagtaatgaactaaattatatactccttgaaaatgatatgaaatttacagtagtagtgggggacataaatggtatccttgctcaaggcaagaaaatgataagaccacagccgatggaacataaatactcctggaaatcgtggggtaaagccaaaattataggtgctgatatacaaaatacgacttttattatagatgggccagataccccggagtgtccagacgatcagcgagcatggaacatctgggaagtagaagattacggctttggaattttcacgacaaatatatggctaaaacttagggatagtcatacacaaatgtgcgaccatcgactaatgagcgcagcaataaaagactctaaagctgttcatgcagatatgggctactggatcgagtcggagaaaaatgaaacctggaaactagcaagggcttcttttatcgaagtaaagacttgtatatggccaaaaagtcatactttatggtccaatggagttcttgaatcagaaatggtcattccaaaaatatatgggggtccaatatcccaacacaactacagaccaggatattttactcaaaccgcgggaccctggcatctaggtaaacttgagctggattttgatttgtgcgaaggaaccacagtagttgtagatgaacattgtggctatcgtggtcccagtcttcgtacaacgacggtaacaggaaaaataatacacgagtggtgctgcagatcatgcactttacctccattaagatttagaggagaagatggatgttggtatgggatggaaataagaccagtaaaagagaaggaagaaaatttagttcgatcaatggtatcagcaggctctggagaggttgatagtttcagcctgggtatcctctgcgtttctattctaatagaagaagtaatgcgtagccggtggagccggaaaatgcttatgaccggtacactagcagtgtttttattattaattatgggacaacttacttggaacgacttaataaggctatgtatcatggttggagcgaatgcaagtgaccgcatggggatgggaacgacatacttagcgttaatggctacattcaagatgagacctatgttcgctgtgggtttactatttcggcgcttaacaagtcgtgaagttctattgcttaccgtgggactctctttagtagcatcagttgagctacctaattcacttgaggagctaggtgatggcttagctatgggtattatgatgttgaaacttttaaccgactttcagcctcaccaactttggacaacattgttgagtttgacttttataaggaccagtctgagtttggactacgcatggaaaactatggcaatggctttgagtatagtatcattatttcctctatgtttgtccacaacgagccagaaaacgacgtggcttcccgtactattagggtccttcggttgcaagccactgaccatgttcctaataacagaaaataaaatatggggacgtaagagttggccaataaatgagggtattatggctgtgggaatcgtatcaatattgctgagcagtttgctgaagaatgatgtgcccttagcgggtcccctgatcgcaggaggcatgttaattgcttgttacgtaatttctggaagttcagcagatctttctcttgaaaaggctgccgaggtttcctgggaagaagaagcagaacacagtggtacgtcccataatatcctagtagaagtccaggacgacggaactatgaaaataaaggacgaagaacgtgatgacacattaacgatcctactgaaggccacactattagcagtttcaggggtatatccgatgagtattccggccacgttatttgtatggtatttttggcagaagaagaaacagcgaagtggtgtcttatgggatacaccctcaccacccgaagtggaaagagctgtacttgacgacgggatataccgtatcctacagcgcggactattaggacgtagtcaagttggagtgggtgtatttcaggatggtgtatttcacacaatgtggcatgtcacaagaggagcagtactcatgtaccaaggtaaacgattggaaccatcctgggccagtgttaagaaagatttgatatcttacggcggaggttggcgtttccaaggatcatggaatacaggggaggaagtccaagtgatagcagttgaaccaggcaaaaatccgaaaaacgttcaaacaacacccgggacttttaaaacacctgaaggtgaagttggagctattgcattagactttaaacctggcacctcgggatctccaatcgttaatagggaaggtaaaattgtaggattatacgggaatggtgtggttactacaagtggaacgtatgtaagtgccattgcacaagcgaaggcaactcaagaaggacctctaccagaaatagaagatgaagtctttaaaaagagaaatctcacaatcatggaccttcatccaggtagtggaaagacgaggcgttatctcccggctattgtgagagaagcaattaaaagaaaattaagaactttaatcctagctccaactagagtagttgctagcgaaatggcagaagcactgaagggcatgccaattcgataccaaacaacagcggttaaatcagagcataccggaagagaaatagtcgacttaatgtgccacgctacatttacaatgcgcttactgagtccggtaagggttcctaattataatatgataataatggatgaggctcatttcacagatccagcgtcgattgctgcgcgaggttacatatctactagagtaggcatgggagaagctgcagcaatatttatgactgcaactcccccaggctcagtggaggcttttcctcaaagtaatgccgtaatacaagatgaagaaagggatataccagagagaagttggaactcagggtacgactggattactgatttcccaggaaaaaccgtgtggttcgtgcccagcataaagagcggaaatgatattgcgaattgcctacgcaaaaacggtaaaagggtaatccaattatcaagaaaaacatttgatactgaatatcagaaaactaaaaataatgactgggattatgtagttacaaccgatataagtgagatgggggcaaactttagggcagacagagttatagatcctaggagatgtctaaaaccagtaattctcaaggaaggtccagagcgagtcatacttgctgggccaatgcccgtaactgttgcttcagccgcccagaggcgtgggcgtatcggtagaaatcaaaataaggaaggagaccaatacatatatatgggacaacctttaaataacgatgaagatcatgcacattggacagaagccaaaatgttgcttgacaatatcaacacacctgaagggatcataccagcattatttgaacccgaaagagaaaagtcggcagcaatcgatggggagtacaggttaaggggagaggccagaaaaacgttcgtcgaactgatgcgaaggggtgacttaccagtttggctatcatacaaagtggcatctgaaggattccaatacagcgatagacggtggtgctttgatggtgaacgtaacaatcaggtgttagaggaaaatatggatgtagaaatatggactaaagaaggtgagagaaagaaactgagacctcgttggcttgatgcaagaacctattctgacccactagcattacgggaatttaaagagtttgcagcaggccgtcggagtgtatcaggagacctgatactagagataggaaaattgccgcaacacctgacattaagggctcaaaatgcgcttgacaatcttgttatgctacataactctgaacaaggtggtaaggcatatcgacatgctatggaagaactaccggatacaatagagaccttgatgctgctagctctaatcgcggtcctaacgggaggagtcaccctattctttctatcgggcaaaggcttaggaaaaacttcaattgggttgttgtgtgtaatggcatcaagtgcactactgtggatggcgagtgtcgaacctcactggatagcagcatcaataatattagagttctttttaatggtcttactcataccagaaccggatcgacaaagaactccccaagataaccaacttgcttacgtcgtgatcggactattgttcatgatattaaccgtcgcagcaaatgaaatgggtttattagaaaccactaagaaagatctgggaattggccatgtagcggtcgaaaaccaccaccatgcaacaatgttagacgtagatttaagacctgcatccgcatggacattatatgctgtcgcaaccacagttataactccgatgatgagacatacaatagaaaatactacagcgaacatatcactcacggctatcgcaaatcaggccgctatcttgatgggacttgacaaaggctggccgataagtaaaatggatattggagttccgttattggcactaggttgctacagtcaagtaaatcccttgaccctaaccgccgcagttctcatgctggtggcacattatgcaattataggaccaggcctacaagccaaagcgacccgtgaagcgcagaaaaggacagcagccggtattatgaagaatccaaccgtcgatggaatagtgacaatcgacctagatccggtagtctatgacgcaaagtttgaaaaacaactaggccagataatgttattaatactatgcacaagtcagatacttttaatgcgtactacttgggcactctgcgagtcaattacattagcaacgggaccgttgaccaccttatgggaaggaagtccaggaaagttttggaataccactatagctgtcagcatggcgaatatatttagaggttcgtatctcgcaggagctggcctcgcgttcagtctaatgaaaagtcttggaggaggtcggagaggaaccggggctcaaggtgaaacgttaggcgagaaatggaagagacaacttaaccagctctctaaaagtgaatttaatacatataagaaatcaggaataatggaagtagacaggagtgaagcaaaggagggtcttaaacgaggagaaacaacgaaacacgccgtcagtaggggcacagccaaattgcgatggttcgtagaacgtaacttagtaaaaccagaaggtaaagtaattgatttgggatgtggaagaggaggatggagctactattgtgcagggttgaaaaaggtaactgaagttaagggttatacaaaaggcggaccaggtcatgaggaacctataccaatggctacatatgggtggaatttggtaaaactacatagtggaaaggatgtattctttactccacccgaaaaatgtgatactctgttatgtgacataggagaaagcagtccgaatcccacaatcgaagaaggcagaacccttagagttctaaagatggttgaaccgtggttaagaggtaatcaattctgtataaaaattctaaatccatatatgccttctgtagttgaaacactagaacagatgcaaaggaagcatggaggaatgctcgtgagaaatccattgtctcgcaatagtactcacgaaatgtactgggtttcttgtggaacaggtaacatagtaagtgctgtgaacatgacaagtcgaatgttactgaatcgatttaccatggctcatagaaaacctacctatgaaagagatgtagacttaggagctggcacaagacacgtggcagtagaaccagaagtagccaatctagacataattgggcaacgaatagaaaatatcaaaaatgaacacaagtcgacttggcattacgacgaggacaatccgtacaaaacttgggcatatcacggctcatatgaagtaaaaccatcgggttcagcgagctcgatggtaaacggagtcgtacgattgttgacgaagccttgggacgtcatcccaatggtaacacaaatcgctatgacagacacaactccgttcggtcagcagagggttttcaaggaaaaggtggacactagaacaccaagggcaaaacgcgggaccgctcaaataatggaagtaacagcgaagtggctatggggatttctatcgaggaataagaaacccagaatatgcacaagggaagaatttaccaggaaagtcagaagcaacgccgcaataggagcggtttttgtcgacgaaaaccaatggaactccgctaaggaggcagtcgaggatgaaaggttctgggatctcgtgcaccgtgagagagaattacataagcaaggaaaatgcgctacttgtgtgtacaacatgatgggaaaaagagagaagaaactgggtgaatttggaaaggctaaagggtctcgtgccatttggtacatgtggctcggagccaggtttttagagttcgaagcattgggttttatgaatgaagatcactggtttagtagagaaaatagtctatcaggagtggaaggcgagggcctacacaaattgggatatatactaagggacatatccaagatacctggtggtaacatgtatgctgatgacacggccggttgggacacacgaataacagaggacgatctacaaaacgaagcgaaaattacggatattatggagcctgaacacgcgctgttggccacatcaatttttaaactaacttatcaaaataaagtcgtacgcgtacaacgacccgctaaatcaggaactgtaatggatgtcatcagtagaagggatcaacgaggaagtggtcaagtaggaacttacggccttaacacattcactaacatggaagtacaactgatcagacaaatggaatcagaaggaatcttcagtccctcagaattggaaacgccgaatcttgccaagaaagtgctagactggttagagaaacatggtgcagaaaggctaaaacgtatggccatcagcggtgatgattgtgtggttaaacctatcgacgatcgctttgctacggcacttaccgctctaaatgatatggggaaagttaggaaagatatacctcagtgggaaccttcgaaaggatggaatgattggcaacaagtccccttttgttctcatcactttcatcagttaataatgaaggatggaagagagatagtagtaccatgtaggaatcaagacgaattagtaggacgagcgagagtaagccaaggtgcaggatggtcattacgtgagaccgcatgtctaggtaaaagctatgctcaaatgtggcagcttatgtatttccacaggagagatttaagactggcagcaaacgcaatttgctcagctgtgcccgtagactgggtaccaacaagtcgtaccacctggtctattcacgcacaccaccaatggatgacaacggaagacatgttatcagtttggaatagggtttggatagaagaaaatccatggatggaagacaagacacatgtaagctcatgggaagaagtaccttacttaggaaagagagaagatcaatggtgtggcagtttaattgggttaactgcccgcgcaacctgggcaaccaacatacaagtagcaataaatcaggttagaaggctcataggatcagaaaactatctagactacatgacctcaatgaaaaggttcaagaatgaaagtgatccagaaggtgcgttatggtaa

SEQ ID NO: 22044 - RNA, 9879 nt, synthetic construct
  misc_feature 1..9879: note = derived and/or modified CDS sequence (opt6) from DENV-1__KC692514__SS-prME
  source 1..9879: mol_type = other RNA
tcagtcacgatgttgctaatgttactgccaacagcattggcatttcacttaactacgagaggaggtgaaccccatatgattgtaagcaaacaagagagaggaaaatctttattatttaaaacaagcgctggtgtgaatatgtgcacactaatcgcaatggatttaggagaattgtgcgaagacaccatgacttacaaatgcccacgcataactgaagcagagccggatgatgtcgactgttggtgtaatgcaacagatacctgggtaacatatggaacctgctcacaaacaggagaacaccgaagggaaaaacgaagtgtagcgttagcaccacatgttggtttgggattagaaacccgaacagagacgtggatgagctcggaaggagcttggcgacaaatacaaagggtagaaacttgggctttacggcatccgggattcacagtaatagcctttttcttagctcacgcaattggtacatcaataacacaaaaaggaattatattcattttgctgatgttggtaacgccatcaatggcaatgcgttgtgttggaattggaaatagagatttcgtagaaggattaagcggtgcaacgtgggtagatgtcgtcttagagcatggatcatgtgttactactatggcgaaaaataaacctacacttgatattgaattattgaaaactgaagttacaaacccagcggtacttagaaaactttgtatagaggctaaaatatcaaataccactactgatagccgttgcccaacacaaggagaagctaccctcgttgaagaacaagatgctaatttcgtttgtcgtagaacatttgttgatcgaggatgggggaacggatgtggattatttgggaaaggaagccttttaacatgtgccaaatttaagtgcgttacaaagctggaaggcaaaattgtgcaatacgaaaacttaaaatatagtgtaatagtaactgtgcatacaggtgaccaacaccaagtaggaaacgagacaaccgaacatggcaccatcgcaacaatcacgccacaagcacccacatcagagatccaattaacagactatggagcacttactcttgattgttctcctagaacgggtttggatttcaatgagatggtcctactgactatgaaggagaaaagctggttagtacacaaacaatggtttttagatctaccactaccttggacaagtggcgcaagtacatcacaagaaacttggaacagacaagacctattagttactttcaaaacagctcacgcgaagaaacaagaagtcgtcgttttgggttctcaagaaggagcaatgcatactgctctgacaggagcaacagaaatacaaacctccggaacaaccacaatatttgccggacatcttaagtgtcgcctcaagatggataaattgacactaaaaggtatgtcatatgtgatgtgtacagggtcatttaaacttgaaaaagaggtagctgaaacacaacatggtactgtccttgttcaagtgaaatatgaagggacagatgctccatgtaaaataccattttcaacacaagatgaaaaaggagttacacaaaacggacggcttatcacagcaaatccaatagtcacagacaaagagaaaccagtaaatattgaaacagaacctccattcggtgagagctatattgtagtcggtgccggtgaaaaggctttaaagctctcatggttcaaaagaggatcttctattgggaagatgtttgaggcaacagcgagaggtgctcgacgaatggcaatcctgggggatactgcatgggatttcggaagtataggcggagtatttacgagcgtaggcaaacttgttcaccaagtgttcggaacagcttatggtgtactattctcgggagttagttggactatgaagataggcataggaatattattgacgtggttaggtctcaatagtagatccacttcattaagcatgacatgtatcgccgttgggatggtgactttatacttgggcgtgatggtacaagcagatagtggatgcgtgattaattggaagggtagagaactaaaatgtggctctggaatttttgtcactaacgaagtgcatacatggacagaacaatacaaatttcaagccgattcaccaaaaagattatctgcggctataggaaaagcctgggaagaaggagtttgtggcattcgttctgccacacgtcttgagaacatcatgtggaaacagatatccaatgaacttaaccatattctgctggaaaacgacatgaaattcacagtagttgtaggagacgcaaacggaattttggcccagggcaagaaaatgataagacctcaaccaatggaacataaatattcatggaaatcctggggcaaggctaaaatcattggggcagacattcaaaatactacattcattatagatggtcctgatacgcctgaatgcccagatggtcaacgcgcatggaacatatgggaagttgaagactatggtttcggggttttcacaactaacatatggttaaaactaagggatagctatacacaaatgtgtgaccaccgattaatgtcagctgctataaaagactcaaaagcagtacatgcggatatgggatattggattgagtccgagaaaaatgagacctggaaattagcccgagcttccttcattgaagtaaaaacctgtacatggccaaaatctcatacactatggagtaacggcgtcttagaatccgaaatgataataccaaaaattttcggcgggccaatatctcaacataattatcgaccaggatattttacacaaacagctggcccatggcatctcgggaaactagaactagatttcgatctgtgcgaaggaactactgtagtagttgatgaacattgcgggaatcgaggacctagtctaagaaccacaacggtcacaggtaaaataattcacgaatggtgctgtagatcttgtaccctgccaccgttacgatttaggggtgaagatggatgctggtacgggatggaaatacgaccagtcaaagaaaaagaagagaaccttgtacgtagtatggtgagtgctgggagtggagaggtagattcctttagcttgggcatattgtgtgtaagcataatgatagaagaagtaatgagatcaagatggtccagaaaaatgcttatgacaggaacattagcagtgtttttgttattaatcatgggacaattgacatggaatgatcttatcagattgtgtatcatggtgggtgcaaacgcctcagaccgcatggggatgggtactacctatctggctttaatggccacattcaagatgagaccaatgttcgcagtaggactactctttcgtaggttaacctcaagggaagttttattactaaccatagggctatcccttgtagcgagcgtagaactgccaaactcacttgaagagttaggagacggtttagcgatgggcataatgatgctgaaattgcttacagaatttcaaccccatcaattgtggaccacactgctgtctcttacctttgtcaaaacaactcttagcttagactacgcttggaaaactacggcgatggttctgagcatagtatcactgtttccattgtgcttatctacaacttcccagaaaactacatggctgcctgtactattaggctcttttgggtgtaaaccgttgactatgtttctgataacagagaataaaatatggggacgaaaatcttggcctcttaacgaagggattatggcaatcggtatagtaagtatacttctcagtagtctattgaaaaatgatgtacctttggcaggacctttgatagctggcggtatgttaatagcatgctatgtaatttcaggatcgtcagcagacttatctttagagaaagctgcagaagtgagttgggagcaagaagccgaacactctggcgcaagtcacaatatacttgtggaggtccaagatgatgggacaatgaaaattaaagacgaagaaagggatgatacactaaccatactccttaaggcaacgctcctagctgttagcggcgtgtacccaatgagcattcctgccactctatttgtatggtacttttggcagaaaaagaagcagagatcaggtgtcttatgggacactccgtcaccccctgaagtagaacgcgccgtattagatgatggaatttaccggatacttcagagaggtcttctcgggcgttcacaagtgggggttggagtgtttcaagatggcgtgtttcatacaatgtggcacgtcacgcgaggagcagtattaatgtatcagggaaaacgcctcgaacccagctgggcatctgtgaagaaagatctcataagttacggaggtggctggagatttcagggaagttggaacaccggagaagaagttcaagtgatagcagttgagccaggaaagaaccctaagaacgttcaaacaacaccaggaacatttaaaactcctgaaggagaagtcggagcaatagcactagactttaagccaggcactagcggttcgcctattgtgaacagagagggcaaaattgtaggtttatacggtaatggagtagtaacaacgagtgggacttacgtctcagccatagcacaagcaaaaacttcacaggaaggaccacttcccgaaattgaagatgaagtgtttaagaaaagaaatttgacaataatggatctacaccccggaagcgggaaaacgagaagataccttccggctattgtacgagaagctataaaacgtaagttacggacgctaatattagcaccaactagggtagttgcttctgaaatggccgaggctctcaagggtatgcccatacgttaccaaactactgcagttaaaagtgaacatactggaagggaaatcgttgatctgatgtgtcacgccacattcacaatgagactattaagcccagttagagtaccaaattacaacatgattataatggacgaagcacactttacggatcctgcgtcaattgctgccagaggttacatctcaacgcgggttgggatgggggaagccgcggcgatttttatgacggccacccctcccggttctgtcgaggcgtttcctcaatcaaacgctgtgattcaagacgaagaacgagacataccagagagatcatggaacagcggatacgattggatcacggattttcctggtaaaacagtctggtttgtaccttcgataaaatcaggaaacgatattgctaactgtttaaggaagaatggaaaaagagtcatacaattgagccgtaagacattcgataccgaatatcagaaaaccaaaaacaatgattgggactacgttgtcacaacagatatatctgaaatgggagctaacttcagagccgaccgtgtcattgatccaaggagatgtctcaagcctgtaatcttaaaagatgggcctgaacgagttatactcgccggacccatgcccgtaactgttgcaagtgcagcacagagacgtggccgtataggaagaaatcagaacaaggaaggcgatcaatacgtatacatggggcagccactaaacaatgacgaggatcatgcccattggaccgaagcgaaaatgctccttgataatattaatacaccggaaggcataattccagctttattcgagccagaacgagaaaaatcagctgcgatagatggagagtacagactcagaggggaagctaggaaaacgtttgtggaacttatgcggagaggcgatctgcctgtatggctcagttataaagtagcttctgagggattccaatattctgatcgacgatggtgctttgatggtgaacggaataatcaagtgttggaagagaatatggacgtagaaatttggaccaaagaaggggaaagaaagaaattacgacctcgatggctagacgctagaacatactcagacccgttagcactgcgtgaatttaaagaatttgccgcaggccgaagaagcgtatcgggagacctgatattggaaatcggcaaattacctcagcacttaactctacgagctcaaaatgctttggataatctagttatgctacataattcagagcaaggtgggaaagcctatcgacacgctatggaagaattaccggatacaatcgaaaccctaatgttattggctctaatagcagtgctaactggcggggttacgttattctttttgagtggcaaaggcctgggcaaaacctcaataggcttactatgtgtaacagcgtctagcgccttattatggatggcatccgtggaaccgcactggatcgcggctagcatcattctagaatttttcctaatggttctcctcatcccagagccagatagacagaggacaccacaagataaccaactagcttatgttgtaatcggcttgttatttatgattttaactgttgcagcgaatgaaatgggtttgttagaaactaccaaaaaggatctggggatcggatacgtcgcagcggaaaatcatcaacatgccactatgctagatgtcgacttacatccggcatcggcatggactttgtacgcagttgcgaccacagttataactccaatgatgcggcatactatagaaaacaccacagcaaacatatcactaaccgcaatcgcaaaccaagccgccatcctaatgggtctcgacaaaggttggccaatatccaaaatggacattggcgtaccattattagcactagggtgttatagtcaagtaaaccccttgacattgactgctgctgtgttaatgctggtagcacactatgcgatcattggaccaggacttcaggccaaagcgaccagggaagcacagaaaaggacagcagccggaataatgaaaaacccaacagtggatggaatcgtagccattgacttagatcctgtagtatacgatgcaaaatttgaaaaacaactcggtcagataatgttactaatcctatgtacatcacagattttgctaatgaggacaacttgggctctttgtgaatccattacactagcaacaggtccattgacgactttgtgggagggtagtcctggtaagttttggaacactacaatagcggtatcaatggctaacatatttcgcggtagttatctagctggcgctggtcttgcatttagccttatgaaatccttaggaggcggcagacgaggtacaggggcccagggagagacgctaggcgaaaaatggaaacgtcaattgaaccaattatcaaaaagcgaatttaatacctataaaagaagtgggataatggaagtcgacagatcagaggctaaggagggtctaaagcgaggggaaacaaccaaacatgcagtatcaagaggcacagcaaaactacggtggtttgtagaaagaaacctagtgaaacccgaagggaaagtgatcgatctaggctgtggacgagggggatggagttattattgcgcaggcctaaagaaagttactgaagtaaaagggtatacaaaagggggtccggggcatgaagaaccaataccgatggctacttatggatggaacctagtaaagttacactcaggaaaggacgtattctttatgcctcccgagaaatgtgacacattattgtgcgacattggagaatcatcaccgaacccgacaatcgaggagggacgtactctaagagtattaaaaatggttgaaccatggctaagaggaaatcagttttgcataaaaatattaaacccgtatatgccatctgtggtggaaactctcgaacagatgcaacgtaagcacggtgggatgttagtacgtaacccattatcacgaaacagcacacatgaaatgtactgggtgagctgtggtactggaaatatagtatccgccgttaatatgacaagccgtatgctcctcaataggttcactatggcacatagaaaaccaacttatgagagagacgtagacctaggcgccggcacaagacatgtagcggtagagcctgaggtagcaaacctagatataattggtcagagaatagagaatattaaaaacgaacataaatctacatggcattacgacgaagataatccttacaaaacttgggcatatcacggctcctacgaagtaaaaccctccggttctgcctcaagtatggtcaatggtgttgtgcgattactaactaaaccttgggacgtaatcccaatggtgacacaaattgcaatgacagatacaacaccgttcggccaacagcgagtattcaaggagaaagtggacactagaacgccaagagcgaaacgtggcaccacacaaataatggaagtaactgccaagtggttatgggggttcttatcgcgaaataagaaaccacgaatatgcacccgcgaagagttcactagaaaagtgcgatctaacgcagctatcggtgctgttttcgtagacgaaaatcaatggaatagcgcaaaagaagcagtagaagacgaaagattctgggatttggtgcacagagaaagggaactccataagcaaggtaaatgtgcgacctgtgtgtacaatatgatggggaaacgtgagaagaaattgggtgaatttggcaaagcaaaaggtagcagagcaatctggtatatgtggctaggagcacgatttttagagtttgaagcattgggattcatgaacgaagaccactggttttccagagaaaacagcctttctggagtcgaaggtgaaggattgcataaattgggttacatattgagagacatcagcaaaattccaggaggcaatatgtatgctgacgatacggctggatgggatactagaataacagaagatgatttacagaacgaagccaaaataactgatataatggaacctgagcacgccttacttgctacttcaatatttaaactaacctaccaaaataaagttgttagagtacaaaggcctgccaaaaatggcacggttatggacgtgattagtagacgagaccaacggggttctggtcaagtaggtacatatggtttgaatactttcacgaacatggaggtacagctaataagacagatggagtctgagggaatatttctaccaagtgaattagaaacacctaatttagcagaacgtgctcttgattggttggaaaagcacggcgctgagagattgaagcgcatggcgatctccggcgatgattgcgtagtcaaaccaattgatgaccggtttgcgacagcgttaaccgcactcaatgatatggggaaagtgagaaaggatatccctcagtgggaaccatcaaaaggctggaatgattggcaacaagtacctttctgtagtcatcatttccatcagctgattatgaaagatggtagagaaatagtagtaccctgtcgaaaccaggatgagttagtaggcagagctagagtgtcacaaggtgctggatggtctctgagggaaaccgcttgcttaggaaaatcatatgctcaaatgtggcagctaatgtatttccatcgaagagatttgcgtcttgctgctaacgccatatgtagcgcagttccagtcgattgggttcctgctagccgtactacatggagtattcacgcacatcaccaatggatgacgacagaagatatgctcagtgtttggaaccgagtatggatagaagaaaacccttggatggaagacaaaacccatgtatcatcctgggaagaagttccctatctgggaaaaagagaggaccaatggtgtggtagcttaataggactaacagcgcgtgctacctgggcaacaaacatacaagtcgctataaatcaagtgagaagattaatcggaaatgaaaactacctggattatatgaccagcatgaaacgttttaagaacgaaagtgatcctgaaggagctctctggtaa

SEQ ID NO: 22045 - RNA, 9879 nt, synthetic construct
  misc_feature 1..9879: note = derived and/or modified CDS sequence (opt6) from DENV-1__KC692515__SS-prME
  source 1..9879: mol_type = other RNA
tccgttacgatgctacttatgttgctaccaacagctttagctttccatctaacaactcgagggggagaaccacatatgattgtttcaaaacaagaacgaggcaaaagcctactcttcaaaacgagcgcaggagtgaacatgtgtacgttgattgcaatggacttaggagagctttgcgaagatactatgacgtacaaatgtccacggatcacagaggcagaaccagacgatgtcgactgttggtgcaatgcgacagatacatgggttacgtatggaacatgcagtcaaactggcgaacatcgtagggaaaaaagatctgtcgcattagcacctcatgtaggattagggttagagacgagaacagaaacatggatgtcgtcagaaggagcttggaaacaaatccaaagagtcgaaacctgggctctacgtcatcctggcttcactgtgatagcactgttcttggctcacgcaataggcacttcaattactcaaaaaggaattatatttattctcttaatgcttgtgacgccctcgatggctatgcggtgcgttgggataggtaatagagactttgtggaaggactgagtggtgcaacatgggttgatgtagtgttagagcatggctcttgtgtcacaaccatggcaaaaaataaaccaaccctagacatcgaattgttgaaaacagaagttacaaaccctgcggtactacgaaaactatgtatcgaagcaaagataagcaacaccaccaccgacagtcgctgcccaacacagggcgaggcaacattagtagaagaacaagacgcaaacttcgtatgccgaaggaccttcgttgatcgaggttggggtaacggatgtggattgtttgggaagggaagcttactaacctgcgccaaatttaaatgtgtgaccaaattagagggaaaaatagtacaatatgaaaacttaaaatatagtgtcatagttactgtccatacgggcgaccaacaccaagtcggcaacgaaacgactgaacatggaactatagctaccataacgcctcaagcccccacatcggaaatacaacttaccgattatggagcactgaccctagattgctctccaagaacgggcctagacttcaatgaaatggtacttcttacaatgaaagaaaagtcgtggctagttcataagcaatggtttctggatctcccactaccatggacttcgggagcatcaacaagccaagaaacgtggaacagacaagacttgcttgtaacttttaaaaccgcccatgctaaaaaacaagaagtggtggttttaggaagtcaagaaggagcaatgcataccgcacttactggggcaacagaaattcagactagcggaacaactacaatctttgctggacatttaaaatgcagacttaaaatggacaaattaacgctaaaaggaatgtcttacgtaatgtgcacgggaagtttcaaactcgaaaaggaggtggccgaaacgcaacatggaactgtgttggttcaggttaagtatgaaggcaccgatgccccgtgtaaaataccatttagcacgcaggatgagaaaggagtcactcaaaacggacgtctaattacagccaacccaatcgttacggacaaggaaaaacctgtaaacatcgaaacagaaccaccattcggtgaatcttatatcgtagtcggcgcaggtggtaaagcgttaaagctctcatggtttaagcgtggatcttcgataggcaagatgtttgaggccacagctcggggagcacgacgtatggccatattaggagacacggcatgggatttcgggagtatcggaggagtattcacatcagtcggaaaactcgttcaccaagtgtttggtacagcatacggcgtactcttctcaggggtgtcttggactatgaagatcggtataggtatccttctaacatggctaggtctaaactcgagatcaactagtttatccatgacatgcatcgcagtaggaatggtaactctctatttaggagtgatggtccaggcagatagcggatgtgtgataaattggaaaggaagagaattgaaatgcggcagtgggatttttgttacgaacgaagtacatacatggaccgaacaatacaagtttcaggctgattcaccaaaacgtttgtctgctgcaattgggaaggcatgggaagagggggtttgcggaataaggtctgccaccagattagagaatataatgtggaaacaaatttcgaatgaattaaatcatatattacttgaaaacgatatgaaatttacagtcgtggtaggagacgcaaatggtattttagcgcaaggaaaaaaaatgatacgtccacaaccaatggaacataaatactcatggaaaagctggggaaaagcaaaaataatcggagcagatatccaaaatacaacattcattattgacgggccagacacaccagaatgccctgatgggcagcgagcatggaatatttgggaagtcgaagactacggatttggtgtcttcacaactaatatatggttaaagttgagggattcatatacacaaatgtgcgatcaccgcttaatgagtgcagcaataaaagacagtaaggccgtacatgctgacatgggttactggatagaatcagaaaaaaacgagacatggaaactagctcgagccagttttatagaagtcaaaacgtgcacatggccaaaatcacacacactttggtcaaatggtgtactagagtccgaaatgattattcccaaaatattcggcggacccatatcccaacataattatcgtccggggtacttcacacaaacagcgggaccatggcacctgggtaaactggagctagattttgacctatgtgagggaacaacagtcgtagttgatgaacactgcggcaatagagggcctagtttaaggacgacaacagtaacaggaaagataatacatgagtggtgctgcaggagctgtacgttgccaccattaagatttcggggagaagacggttgctggtatggaatggaaatacgcccagtaaaagagaaagaggaaaacttagtaaggagcatggtctctgctggatcaggtgaggtcgatagcttctcattaggaatattatgcgttagcataatgattgaggaagtcatgagatcccgatggtcaagaaaaatgctgatgactggaacacttgcagtcttcttacttctgatcatgggacaattaacctggaacgaccttatcagactatgtataatggtgggtgctaacgcaagtgaccgtatgggaatggggacaacatacttggccctcatggctacctttaaaatgagacctatgtttgcagtgggacttttatttcgacgtttgacgtcgcgtgaagtactactcctcacgataggactatcgttagtggcatccgtcgaattaccgaatagtcttgaagagttaggtgacggacttgcgatgggaattatgatgcttaaattgctcacggaatttcaaccacatcagctttggacaacactattatcactaacattcgttaaaacaactttatcacttgattatgcgtggaagaccactgctatggtcttgtcaatagtaagtttatttcccctatgcctttcaactacaagccagaaaaccacctggttaccagttttactcggttcttttggctgcaagcctttaactatgtttctaataactgagaacaagatttggggaaggaagtcttggccgttaaatgaaggaatcatggctataggaattgtttcaatattattgtcttcactattgaaaaatgatgttccgctagcaggccctcttattgcaggaggtatgttaatagcatgttacgtaattagtggatccagtgctgatcttagtttagaaaaagcggccgaagtatcatgggaacaagaagctgaacactcaggagcttcccacaatatattagtggaagtacaggatgacggtacaatgaaaataaaggacgaggagagggacgatacattaactattttgcttaaagcaacgctccttgcggtgagtggggtatacccaatgtcaatccctgcaacactatttgtttggtatttctggcagaagaagaaacagaggtcgggcgtactatgggacaccccaagcccaccagaggttgaacgtgctgtactcgatgacggaatttatagaattctccaacggggattactagggcgtagccaagttggagtaggagtctttcaagacggcgtttttcatactatgtggcacgttacaagaggggcggtattgatgtatcaaggcaaacgtttagaaccatcttgggccagtgtcaagaaagacttgattagttatggaggaggatggcgctttcaaggttcatggaacacgggtgaggaagtccaagtaatcgctgttgagcctggcaaaaacccaaaaaatgtacaaacaaccccaggcacgtttaaaactccagaaggagaagtgggtgctattgccctagacttcaaaccaggaacaagcggaagtccaattgtaaatagagaagaaaaaattgtggggctgtacgggaatggagtcgttacaacttcgggcacatatgtaagtgctattgcacaagccaaagccagtcaagaaggccccctacctgaaattgaggacgaagtctttaagaaacgaaacttaacgataatggatttacaccctggaagtggaaaaacacgcagatatttaccagctattgtccgtgaagcaataaaaaggaaactaagaactttaatattagctcccacacgagttgtagctagtgaaatggctgaggccctcaaaggtatgccaattcgataccaaacaactgctgtcaaatcagagcatacaggacgagaaattgtagatttaatgtgtcacgctaccttcacaatgaggctgttaagtccagtacgtgtgccaaactacaatatgattattatggatgaagcccactttacagacccagcttccattgcggcacgagggtacatatcaaccagagtgggcatgggtgaggcggcggccattttcatgacagcaacaccaccagggtcggtggaagcctttcctcaaagcaatgcagttattcaagatgaagagcgcgacatcccggaaaggagttggaatagcggttatgactggatcactgatttccccggaaaaactgtttggtttgtaccgtcaatcaaaagtggtaacgatatagcaaattgtttacggaaaaatggaaaaagggttattcaactttctcggaaaacattcgataccgaatatcagaagacgaaaaacaatgactgggactatgttgtgactacagatattagcgaaatgggagccaatttcagagcggaccgcgtcattgatccgcgtcggtgcctaaaacctgtcatcctcaaagatggaccagaaagagtaatattggcaggacccatgccggttactgtagcaagcgcagcccaaagaagaggaagaataggccgtaatcaaaataaggagggggaccaatacgtgtatatgggccaaccgttgaataatgatgaagaccacgcacattggaccgaagcgaaaatgctgttagataacattaatacaccagaagggattattcccgccctgtttgagcccgaaagagagaagagtgcagcaatagatggagaataccgccttaggggagaagcgaggaaaacgtttgtagagctaatgagacgtggggatttacccgtatggctcagttataaagtagcttctgaaggttttcagtattctgacaggaggtggtgttttgacggagaaaggaacaatcaggtattggaggagaatatggatgtcgaaatctggacaaaggaaggtgagagaaagaaattaagacccagatggttggatgcacgtacgtattcagatcccctcgcattgagggaatttaaggaatttgctgcaggacgaagaagcgtaagtggcgatttaatactagaaataggaaagttgccacaacatttaacgctacgagcacagaatgctttggataatttggtaatgttacacaatagtgagcaaggaggaaaagcatacaggcacgctatggaagaactccccgatacaattgaaacacttatgttgttggcactaatcgcagtactaacgggaggggtcactttattttttctgtcaggtaaaggattgggaaaaacatcgattggtctattgtgtgtaacagcttcatcggctcttttatggatggcaagcgtggaacctcactggattgcagcgagtattatattagaattcttcctcatggtacttcttataccggaaccagatcgccaaagaactccccaagataatcaattagcgtatgtagttataggactgttgtttatgatccttacagttgcagctaacgaaatggggttactagaaacaacgaaaaaggatttaggaataggacatgttgcagcggaaaatcatcaacattcaacaatgctagatgtcgacctacatccagcatcagcctggactctgtatgccgtcgcaaccacggtaattaccccaatgatgcgccatactatagagaacacaacagccaacatcagtttaactgcaatagccaaccaagccgcaatactgatgggcctcgataagggctggccaatatccaaaatggatattggtgtaccactactcgctttaggctgttattcacaggtgaacccattaacattaacagctgcagtgttaatgctagtagcacattatgctataataggtcctggtttgcaggcaaaagcaacaagagaagctcaaaaaagaacagcggctggtattatgaaaaacccgacagttgatggaatcgtagcaattgatctcgacccagtggtgtatgatgcaaaattcgaaaaacaacttggacagataatgttattaattctatgtacaagccaaatcttgcttatgcgcactacatgggcattgtgtgagtcgattacactggcaacaggaccactcacaacgctgtgggaaggttcgccaggtaagttttggaatactacaatagcggtatcaatggctaatatttttcgcggatcttacttagcaggggctgggcttgcattttctctaatgaaatcgttaggaggagggcgtcgtggaactggtgcacaaggagaaaccctaggagagaagtggaaacgacaacttaatcaactatcaaaatcagagttcaacacatacaaacgtagtggcattatggaggttgaccgttccgaagcgaaagaaggactcaaacgtggggaaacgacgaagcacgcagtgtctagaggaacagcaaaactgcgatggtttgttgaacgaaacttggttaaaccagagggaaaagttatagacctcggctgtggtcgcggtgggtggagctactactgcgcaggactgaaaaaagtgaccgaagtgaagggctacacaaaagggggaccaggtcatgaagaaccgatacctatggccacgtacggatggaacttggtgaagctacattcagggaaagacgttttttttatgccacctgaaaaatgtgatacactgttatgcgatatcggtgaaagtagtccaaatccaacgatagaggagggtagaactctaagggtattgaagatggtagagccatggctaagaggaaatcaattttgtataaaaatcctaaatccgtacatgccatccgtcgtagaaacgcttgagcagatgcagagaaaacatggcggaatgttagtaagaaatccattaagtaggaactccactcatgaaatgtattgggtaagctgcggcacaggtaacattgtctcagcagtaaatatgacatcacgaatgttactaaatagatttacaatggcacacagaaaacctacatacgaacgagacgtagacctcggcgctggcacgaggcacgtagccgtagagccagaagttgcaaatttagacatcattggtcaaagaattgaaaatattaaaaatgaacacagatccacctggcattacgacgaggataacccatataaaacatgggcgtaccacggaagttacgaagtaaagccaagtggttcggcatcatcaatggtgaatggcgtagtaagattattgacaaaaccgtgggacgtaattccgatggttacacaaatagcaatgacagataccactccgtttggacagcaacgagtatttaaggaaaaagttgatacaaggacgcctagggctaaacgaggcactacgcaaatcatggaagtgacagctaaatggttatggggattcctaagcagaaataaaaagccaaggatttgcacaagggaagagtttacaaggaaagtgagaagcaatgcagcaataggagctgtctttgtagatgaaaatcaatggaacagcgcaaaagaagctgtagaagatgagagattttgggacttggtacatagggaaagggaactacacaagcaaggaaaatgcgcaacctgtgtatacaatatgatgggtaaacgcgaaaaaaaattgggggagtttggtaaagccaaggggagcagagcaatctggtatatgtggctaggagcaagatttttagaatttgaagctttaggttttatgaacgaagatcattggtttagcagagaaaatagtctaagcggagttgaaggtgaaggattacacaagctaggttatattcttagagatataagtaaaatacccgggggaaatatgtatgctgatgataccgcgggctgggatacacgaataacggaggatgatctgcagaacgaagcaaaaatcaccgatataatggagccagagcacgcgttactcgctacaagcatattcaagttaacgtatcagaataaagtagtccgtgtacaaagacccgcgaagaatggaacagtaatggacgtaatatctcgccgcgaccagaggggaagcgggcaagttggcacatatgggttgaacacttttactaatatggaggtacagttaattagacaaatggaatctgaaggcatatttttgcccagcgaactagaaaccccaaatctagcagagagagctttagattggctcgaaaaacatggggcggaacgcctcaaacgcatggcaataagcggagatgactgcgtagttaaaccaatagatgatcggttcgcaacagctttgacggctttaaatgacatggggaaagttagaaaggacattcctcaatgggagccatcgaaaggatggaatgattggcaacaagtgcccttttgttcccaccattttcaccaattaatcatgaaagacggacgagaaatcgtagtaccatgtcgcaaccaggacgaactagtgggacgcgccagagttagtcagggagcgggctggagcctcagagaaactgcatgtctgggaaagtcctatgcccaaatgtggcaactgatgtactttcatagaagagaccttcgtttagctgcaaacgcaatatgttctgccgtgccggtggactgggtgccggcatcgcgcacaacctggagcattcatgcacaccaccaatggatgaccacagaagacatgcttagtgtttggaacagagtgtggattgaagaaaacccctggatggaagataaaacccatgtatcaagctgggaagaagtaccctacctaggcaaacgtgaagatcagtggtgtggtagcctcataggtcttactgcgcgggcaacatgggcgaccaacattcaagttgctataaatcaagtgagaagacttattggcaatgaaaactatttagattatatgacctctatgaagcggttcaaaaacgaaagcgacccagaaggagccctatggtaa

SEQ ID NO: 22046 - RNA, 9879 nt, synthetic construct
  misc_feature 1..9879: note = derived and/or modified CDS sequence (opt6) from DENV-1__KC692516__SS-prME
  source 1..9879: mol_type = other RNA
agcgtaacgatgcttctaatgttattacccactgcccttgcttttcatctaacaactcgtggaggggaaccacacatgatagtgtcaaaacaagaaagaggaaaatcgttgctttttaaaacgtcggcgggagtaaatatgtgtacattaatagccatggatctaggagaattatgtgaagacactatgacctacaaatgtcccaggattacagaagctgaaccagatgatgtcgattgctggtgcaacgctaccgatacttgggttacatacggaacatgcagtcaaacaggtgaacatagaagagagaaacgaagcgtagccctagcaccccatgtaggtttaggtctagaaactaggacggaaacttggatgagcagtgaaggagcgtggaaacaaattcaacgtgttgaaacctgggctcttagacacccgggatttacagtcatagcattcttcttggcgcatgctattggaacaagtataacccagaaaggcataatatttattttactaatgcttgtaaccccatcaatggcaatgagatgtgtcggtatagggaatagagatttcgtagaaggtttaagtggagccacatgggtagatgtagttctagaacacggttcatgcgtaactaccatggcgaaaaataaacctacactggacatagaattgctaaaaacagaagttacgaatccagccgtgctacgaaaactttgtatagaagcaaaaatatcgaatactacgactgattctcgctgtcccactcaaggggaagcaacacttgtagaagaacaagacgctaattttgtctgtagaagaacctttgtagatagagggtgggggaacggctgcgggctatttggcaaagggtctctattaacatgcgcaaaatttaagtgtgttactaaattggaaggaaaaatagtacaatatgaaaacctcaaatatagtgtgatagttacagtgcatactggagatcaacatcaggttggaaatgagacaacggaacatgggaccatagcaacgattacgccgcaagcaccaacttcagaaattcaactaaccgattatggagccctaacattggattgctcgcctaggacaggattagattttaatgaaatggtattgcttacgatgaaagagaaaagctggctggtacataaacaatggtttttggatttaccccttccatggactagcggagctagtacatcacaagaaacctggaatcggcaagatctgttagttacatttaaaacagctcatgcaaagaaacaagaagtagttgtactaggatcacaagaaggcgccatgcatacggctttgacaggcgcaacggaaattcagacatcagggacaactacgatatttgctggacatctgaaatgcagactaaaaatggataaattaaccttgaaaggtatgagttacgtaatgtgtacaggaagttttaaattagagaaagaagttgcggaaactcagcacggaacagtgctggtgcaagtaaagtatgaaggtacagatgcaccttgtaaaatacccttctccacacaagatgaaaaaggagtaacacaaaatggaagactcataacagcgaatcctatagtcacagacaaagaaaaaccagtaaatattgagacagaaccacccttcggtgaatcttacatcgtggttggagctggcgagaaagcgttgaaattatcatggttcaaacgagggagcagtataggaaaaatgtttgaagcaacagctagaggagccagacgtatggctattcttggagatacggcctgggatttcggtagcatcggaggcgttttcacaagtgtaggtaaactggttcatcaggtgtttgggacggcctatggagtattgtttagtggtgtatcatggacaatgaagataggtataggcattcttctaacgtggttgggcttaaattcgcgatccaccagtctaagcatgacttgcatagccgttggaatggtgactttatacttgggggtcatggtacaagcggactctggatgcgtaatcaattggaagggtcgagaactgaagtgcgggtccggcatcttcgtaacgaacgaggtacatacttggactgaacaatacaaattccaagctgactcaccaaaaagactctccgcggcaataggaaaggcttgggaagaaggagtatgcgggatacgatcggcaacaagactagaaaatatcatgtggaagcaaatatcaaacgagctcaatcatattttgctggaaaatgatatgaaatttacagtagtagttggggatgccaacggcatattagcacaaggtaagaaaatgataagacctcagccgatggagcataagtactcatggaaaagctggggtaaagcaaagataataggtgctgacatacagaatacaactttcattatagacggaccagacacaccggagtgtcctgacggacaacgggcatggaatatatgggaggtcgaggactatggttttggcatcttcactacaaatatatggcttaagttacgtgatagctacacacaaatgtgtgatcaccgacttatgagcgcagcgataaaagatagtaaagcagttcatgcggacatgggttattggatagaatcagaaaagaatgaaacatggaaactggcacgagcaagtttcatagaagtaaagacatgtacgtggccaaaatcacatacgctctggtcgaatggagttttagaatctgagatgataatcccgaaaatttacggaggacctataagtcaacataactatcgacctgggtactttactcaaacagccgggccatggcacttggggaaattagagctagattttgacctttgtgaaggcacgacagttgtcgttgacgagcattgcggcaatcgcggacctagcttaaggactactactgtaacagggaaaatcatacacgagtggtgctgtcggtcatgtaccctaccgcctctacgatttcgtggggaggacggctgctggtacgggatggagattagaccagtaaaagaaaaagaagaaaatttagttaggagtatggtgagtgccggctccggagaagtagataatttcagccttggtatactctgtgtaagcatcatgatagaagaagtgatgagatctcgttggtcacgtaagatgcttatgacaggtacattagcggtcttcttattattaataatgggacaattgacatggaacgacctaatacgactttgcataatggtcggtgcaaatgcaagtgatagaatgggaatgggaactacatatttagccttaatggccactttcaagatgagaccaatgttcgcagtcggactgctgtttcgcagattaacctccagggaagttttattactcacgatcggtctatcgctggtagctagccttgaattaccaaactcgcttgaagaattaggtgatggtcttgctatgggaattatgatgctgaaactattaactgaatttcaacctcaccaactctggacaacactgctctcgcttacgtttgtaaaaaccacactcagcttagattatgcatggaaaacgacagcgatggtgctaagtatcgtaagtttattccccttgtgcctgtcgacaacgtcacagaaaacaacatggttgcctgtactattaggatcatttggttgtaagccattgacaatgtttcttataacagaaaataaaatctggggaagaaaatcttggccactaaatgaaggaattatggctatcggaattgtaagcatactattatcttcgttacttaaaaacgatgtaccattggccggtccgcttatagcaggagggatgttaatagcttgttacgtaatcagtggatccagtgccgatttaagtctcgaaaaagctgctgaagtctcctgggaacaagaagcggaacatagtggggctagccacaatattcttgtcgaagtacaagatgacggaactatgaaaattaaagatgaagaacgggacgatacattgaccatcctacttaaggctactttattggcggtaagtggcgtatatccaatgtccataccagcgacactatttgtctggtacttctggcagaagaagaaacaacgatcaggagtgctctgggatacgccgtcgccgcccgaagtcgaaagggctgtgttagatgatggaatataccgaatattgcaaagaggacttttgggacgaagccaggtcggagtaggtgtattccaggatggtgttttccatacaatgtggcatgttacgcgcggggcggtattaatgtaccaaggtaaacgtcttgaaccatcttgggcatgtgtgaaaaaggatctgataagctacggcggtggatggagatttcaaggactatggaacactggcgaagaggtccaagtaattgcagtcgaaccaggtaaaaatcctaagaatgtccagacaactcctggtacctttaaaacacctgagggtgaagttggcgcaatcgcattagactttaaacctggaacaagcggaagccctatcgttaaccgagaaggaaaaattgtaggtttatacggaaacggagttgttacaacttccgggacatatgtatctgctatagctcaagcaaaggcttcacaagaagggcctttaccagaaattgaagacgaagtatttaagaaaagaaatctaacgattatggatcttcatccaggttccggtaaaactcgcaggtacctcccagccatagttcgagaagcaattaaaagaaagttaaggactttaatattggcaccaacaagagtcgtcgcaagcgaaatggcagaagctctgaaaggcatgcccataaggtaccaaacaactgccgttaagagcgaacatacaggtcgtgaaattgttgacctcatgtgtcacgcgacatttacaatgaggttgctctcgcccgtcagagtcccgaattacaatatgatcattatggatgaagcacacttcacagatccagcaagcatcgcagcaagagggtacataagtactcgagtgggcatgggtgaggcagcagccatcttcatgacagcaaccccgccaggatcggttgaggcatttccacagtcgaatgcagtgattcaagatgaagaacgagatattccagaacggagttggaactcaggttatgactggattacggattttcccggaaagaccgtatggtttgtccccagtatcaaatcgggaaacgatattgcgaattgcctacggaaaaatggtaagagagttatacaactgtcgagaaaaactttcgacacggagtatcagaaaaccaaaaataatgactgggactacgtagttactacggacatttcggaaatgggagctaattttagagctgacagagtaatagacccacgccgttgtctaaagcctgtaatacttaaagacggcccagaaagagttatattagcaggtccaatgccggtaacagtggcaagcgcagcgcaaagacgtggcagaataggacgaaatcaaaacaaagaaggtgatcagtacgtctatatgggtcaaccattaaacaatgacgaagaccatgctcactggacagaagccaaaatgttactagataatattaatactcccgaagggattataccagcccttttcgagccagaacgtgaaaagagcgctgccattgatggagagtataggctgcgaggtgaagcacggaaaactttcgttgaattaatgcgcagaggggacctcccggtgtggttatcctataaggttgcatcagaggggttccaatatagtgaccgtaggtggtgttttgacggagaaaggaacaaccaggttttagaagaaaacatggatgtggaaatctggacaaaggaaggcgaacgcaagaaattaagaccaagatggttagacgcgcggacatattcagatcctttagctctgcgagaatttaaagagttcgccgcaggaaggcgttccgtttccggagatctgattttagaaattggaaaactaccacaacacctgacgcttcgcgcacagaatgcattagataacctagtgatgctacacaacagcgagcagggcgggaaagcatatagacacgctatggaggagctacctgacactatagagacattgatgttacttgcactcatagcggttcttaccggcggtgtcacactgttctttctatctgggaaaggcttagggaaaacatctatagggttactgtgcgtcacagcgtcaagtgcacttctgtggatggcgtccgtagaacctcactggatcgcggctagtataattctggagttctttcttatggtattgctaattcctgaacccgatagacagcgaacacctcaagataatcagctagcctatgttgtaatcggcctgctgtttatgatattgacggttgccgcaaacgagatgggtttactagaaaccaccaagaaagatctcggaattgggcacgtggcagcagaaaatcaccaacatgcaactatgttagacgtagatttgcatccagcttcagcatggacgctctacgctgttgcaactacggtcatcactcccatgatgagacacactattgaaaatacaacagcaaacatcagcctaacagcaatagctaatcaagcggctatactaatgggcctagataaaggttggccaatatcaaagatggatattggagtccctttacttgccctgggatgttattcacaagttaacccattaacattaacagcagccgttttaatgttagttgcacattacgctataatcggtcctggccttcaagcgaaagcgaccagagaagcacaaaaacggacagcagctgggattatgaagaatccaacggtcgatggaatagtagccattgatcttgaccctgtagtatacgatgcaaaatttgaaaaacaattaggccaaataatgcttcttatattgtgtacttcacaaatcttactaatgaggacaacttgggcgctctgtgaatctattactctagctacaggcccactgacaactttatgggaaggtagtccaggcaaattttggaacacaacaatagcagtaagtatggcaaatatatttaggggttcatatttagctggcgcgggcctcgcctttagtttaatgaaaagtcttgggggcggtagaagggggactggcgctcaaggggagacgctaggggaaaaatggaaaagacaattaaaccaactcagtaaatccgaatttaacacttacaaaagatcgggtataatggaagtggatagatcagaagccaaagagggacttaaaaggggagaaacaacgaagcacgccgttagtcgaggaactgcaaaactacgatggttcgtagaacgcaatcttgttaagccagaaggtaaggtcattgacttaggctgtggaaggggcgggtggtcatactattgtgctggactcaagaaagtaacagaagtcaaaggatacacaaaaggcggtcctgggcatgaagaacctattcctatggcgacatatggctggaacctagttaagttacatagcgggaaagacgtattctttatgcccccagaaaaatgtgatactttgttatgtgatatcggtgaaagttcaccaaacccgacgatagaagaaggtagaacgctacgcgtactaaagatggtggaaccatggctcagaggtaaccaattttgcataaaaattttaaatccgtacatgccatccgtggttgaaactttagaacaaatgcagaggaaacacggtggaatgttggtcagaaaccccttgtcgcgaaattccacgcatgagatgtactgggttagcagaggtaccggaaacatcgtaagcgccgtcaacatgacatctagaatgctattaaacaggtttaccatggcacataggaaacctacatatgagagagacgtggatctcggagctggtacgcgacatgtagccgtagaaccagaagtggcaaatctagacataataggacaaagaatagaaaacatcaaaaatgaacataaatcgacgtggcattacgacgaagacaatccttataagacttgggcgtatcatggaagttacgaagtaaagccgtcaggatccgcctcgtcgatggttaatggtgtagtgaggttactcacaaagccgtgggacgtcattccgatggtaactcagatagcaatgaccgatactacacccttcggtcaacagcgcgtcttcaaagagaaagtagatacaaggacgccacgagctaagcgagggacaacacagatcatggaagtaacagcgaaatggttatggggatttttaagcaggaataagaaaccaaggatatgtactagagaagagtttacaagaaaagtaagatctaatgccgcaattggagcggtattcgtagacgaaaagcagtggaacagcgcgaaagaggcagtagaagatgaaaggttttgggacttggttcacagggaaagagaattacacaaacaaggaaagtgcgccacatgtgtatataatatgatgggtaagcgagagaagaaattgggagagtttggcaaggcaaagggctcacgggccatatggtatatgtggttaggagcgagattcctagagttcgaagccctcggatttatgaatgaagaccattggttcagcagggaaaattcactatcaggggtggaaggggaaggtttacacaagttgggctacattctccgagacatatcgaaaataccaggaggtaatatgtacgcagacgatacagcaggttgggacaccagaatcactgaggatgatctccagaatgaagcaaaaataaccgatataatggagccagaacacgctttacttgctacctcgatatttaaacttacttaccaaaataaggtcgttagagtacaaaggccagcgaaaaacggtaccgttatggatgtaatatctagacgagatcaacgtggctcagggcaagttggcacctacggattaaacacattcactaatatggaggttcaattaataagacaaatggagagtgaaggcatattcttaccgtccgaattggaaacgccgaatctagcagagcgagtacttgactggttagagaaacatggggccgaaagacttaagaggatggcgattagcggagatgactgcgtggttaaaccaatcgacgaccggttcgctacagcgttaaccgcactgaacgatatgggtaaagtaaggaaagacattccgcaatgggaaccgtccaaaggatggaacgattggcaacaagtaccgttttgtagccaccattttcatcagcttataatgaaggacggtcgcgagatcgtggtcccgtgccgcaaccaagatgagcttgttggcagagcacgagtatcacaaggagcagggtggtctttgcgagagacagcatgcctaggaaagtcctacgcgcaaatgtggcagttaatgtatttccatagaagagacttaagattagcagctaacgctatatgctcagcagtgccagtagattgggtacctacaagcagaacaacgtggtcaattcatgcccatcatcagtggatgacaacagaagacatgttatctgtatggaacagggtatggattgaagagaatccatggatggaagataagactcacgttagctcctgggaggaagttccatatctaggtaaacgcgaggatcaatggtgtggcagcttgattggcttgacagctagagcaacctgggccacgaatatacaggtcgcaataaatcaggttagacgattaatagggaatgaaaactatctagactatatgacatcgatgaaaagatttaagaatgaatcagatcccgaaggagctttatggtaa

SEQ ID NO: 22047 - RNA, 9879 nt, synthetic construct
  misc_feature 1..9879: note = derived and/or modified CDS sequence (opt6) from DENV-1__KC692517__SS-prME
  source 1..9879: mol_type = other RNA
tctgtaacaatgttacttatgttactccccaccgctttagcgtttcacttaacgaccagaggaggggaacctcatatgatagtgagcaaacaagaacgagggaaatcacttttattcaaaaccagtgcaggagtcaatatgtgtaccctcatagcgatggacctgggagaattgtgcgaagataccatgacatataaatgccctcgtataacggaagctgaacctgacgatgtggattgttggtgcaatgctacagatacatgggtaacgtatggaacatgtagtcaaaccggagaacaccgaagggataaacgatcagtagcattagcaccccacgttggtttaggattagaaactagaacggagacatggatgagtagtgaaggtgcctggaaacagatacaacgtgttgagacgtgggctttacgacatccaggattcacggtaattgcgctatttctagcccatgcaattggcacgagcatcacacaaaaaggcataatatttattctcttgatgttagttacaccgtctatggcaatgcgatgcgtcgggataggcaatcgagattttgtcgaaggactttcgggtgccacatgggtagatgtagtattagaacacggttcttgcgttacaacgatggcgaaaaacaaaccaacactagacatagaattgttaaaaacagaggttacaaatcctgcggtgctgagaaaactttgcatagaagcgaaaatatccaatacaactaccgatagcagatgcccgacacagggcgaagccacactggtagaagaacaagacgcgaattttgtttgtagaagaacatttgtagatagaggttggggaaacggatgcggtttgtttggaaaaggaagtttattgacctgtgctaaatttaaatgcgtcactaaattagaaggtaaaatagtacaatatgaaaacctaaaatattcagttattgtaactgtacacacaggtgatcaacatcaggttggaaatgaaaccatagaacatggaacgatagctacaataactcctcaagcacccacgtcagaaattcaattgacggattacggtgcattaaccttagattgttcaccaagaacgggtctagatttcaatgaaatggtacttctcacaatgaaagaaaaatcgtggctagttcataaacaatggtttctcgaccttccccttccatggacgagcggagcaagcacccctcaagagacttggaaccgacaagatttgttagtaacctttaaaacggcccatgcgaagaaacaggaagtcgttgtattaggaagccaagaaggtgcaatgcacacagctttgactggcgcaaccgaaatacagacctcgggaacgactacgatcttcgccggacatttgaaatgtcgtctcaaaatggataaacttacgctaaaaggaatgtcatacgtaatgtgcacagggtccttcaaactagagaaagaagtcgcggaaacacaacacgggacagtattggtacaagtaaaatacgaaggtactgatgctccttgcaaaatcccattctcaacacaagatgaaaaaggcgtcacgcaaaatggcaggctgataacagccaatccaatagtcacagacaaggagaaaagcgtaaatatcgaaactgaacccccattcggggaaagttacatagtcgttggtgtgggagaaaaagcactcaaactctcttggttcaaaaagggatcctcaatcggcaagatgtttgaagctacagcaagaggagcaagaagaatggcaatcctaggagatactgcgtgggactttggatcaatcggcggcgtgtttacgtcagtgggaaaactggtacatcaggtatttgggacagcttacggtgtcttatttagcggagttagttggacgatgaaaattgggataggtatacttttaacttggctgggcctaaattcgagaagtaccagtttatctatgacttgtatcgccgtagggatggtaacactctatctaggagtgatggtgcaagcggacagtggatgcgtaataaattggaaagggcgtgaattgaagtgtggttccgggatattcgtcacaaacgaggtacacacctggacggaacaatacaaattccaagctgacagtccaaagcgactatcggcagccataggtaaggcttgggaggaaggagtatgtgggataaggtctgcaacaagactagaaaatataatgtggaaacagatcagtaacgaactcaaccacatcttattagaaaatgacatgaaattcactgtagtagtaggcgatgcaaacggaatacttgctcagggtaagaaaatgatacgacctcaacccatggagcataaatattcgtggaagtcctggggtaaagcaaaaattatcggtgcagacatacaaaacacaacatttattatagacgggcccgatacaccggagtgtccagatggccaaagggcgtggaacatatgggaagttgaggattatggcttcggcatattcacaacaaatatttggctaaagttgagggacagttacactcaaatgtgcgaccacaggttaatgagcgcagcgataaaagatagcaaagctgtccatgcagatatggggtattggatagagtccgagaaaaacgaaacatggaaacttgctagagctagcttcatcgaagtaaaaacatgtacctggccaaaatcgcatacattatggtctaacggcgtacttgaatccgaaatgataatacccaagatttatggaggaccaatttcgcagcacaattacagaccaggctactttacccaaacagccgggccgtggcatttggggaaattagaactggattttgacttatgtgagggaactacagtagtagtcgatgagcactgtggaaatagaggtcccagcctacgtacgacgactgtcaccgggaagataatacatgaatggtgttgccgcagttgtactctgccacctctcagattccgtggtgaagacggttgttggtatggcatggaaatacggccagtgaaagagaaggaagaaaacttagtccggagtatggtcagtgcgggctctggggaagtcgactcgttttctctaggcatcttatgcgtatcaattatgatagaggaagtaatgagatcacgatggtcaagaaagatgcttatgactggcactctagccgtattccttctattaataatgggacaactgacatggaacgatttaatcaggctctgtatcatggtcggagcgaatgcctcggataggatgggcatgggaaccacatatttagcactaatggctacattcaagatgagacctatgtttgcggtaggactactttttcgaaggttgacaagccgcgaagttttactattaaccatcggcctaagtctcgtcgcttctgtcgaactcccaaattccctagaagaacttggcgatgggttggcaatgggaataatgatgctgaaattattaactgaatttcaaccacaccaattatggacaactttattatcacttacatttgtaaaaacaactctatcattagattatgcctggaaaactactgcaatggtactaagcatagtatcgctgtttccactatgtttatcgactacaagccaaaagaccacttggctcccggtattgctcggatcattcgggtgtaatccattgactatgttcctcataacggaaaacaaaatctggggcagaaaatcttggccgttaaatgaaggcataatggctatcggaatcgtttctattcttttatcttcattattaaagaatgacgttcctctcgcaggtccgctgatagcaggcggaatgttgatcgcgtgttatgtaatcagcggatcttcagccgatctctccttagagaaagccgcagaagtaagctgggaacaagaagcagaacactcgggcgcatctcacaacatcctggttgaagttcaagacgacgggaccatgaaaataaaagatgaagaaagagatgatacattaacaatattactaaaagctactttattagccgtttctggagtctatcccatgagtataccagcgacattgttcgtgtggtacttttggcagaagaagaaacaaagatcgggggttctatgggataccccaagtccacccaaagtagaaagggccgtcttagacgatggcatataccgtattctccagagagggttactgggaagatcgcaagtaggtgttggagtgtttcaagatggagttttccatacgatgtggcacgttactcgaggggctgttctgatgtaccagggcaagagacttgagcctagttgggcgagtgttaagaaagacttaatatcatatggtggagggtggagatttcaaggaagttggaatacaggtgaggaagttcaagttattgccgtagaacctggcaaaaatcctaaaaacgtacaaaccacgccaggaacctttaaaacaccagagggtgaagtaggtgccatagcactggatttcaaaccgggaacatcgggttccccgatcgtgaaccgggaaggtaaaatagtaggactctacggcaatggagttgtgaccacctcgggtacatacgtaagcgccattgctcaagcaaaggcatctcaagagggacccttaccagaaatagaagatgaggtgttcaagaaaagaaatttaactatcatggacctgcacccaggtagtggtaagacgagacgatatttacctgctatagtacgtgaagcaataaagcgcaaactacgcacattaattttagccccaactagagttgttgcctcggaaatggcagaggctttgaagggcatgccaattagatatcaaacaacagcagttaaatccgaacacacaggcagagaaattgtagatctcatgtgtcacgcaacttttacaatgagattactttccccagttagggtaccaaactacaatatgataattatggacgaagcccactttacagatcccgcaagcatagcagcaagaggctatatatcaactagggtcggaatgggcgaggcagccgctatttttatgacagcaactcccccgggatctgtagaggcctttcctcaaagtaatgcagtaatacaagatgaagaacgtgatatacccgaaagatcctggaactcaggatacgattggataactgatttccctggaaagaccgtgtggtttgtacctagtataaaaagtggaaacgatatagcaaattgtctacgtaaaaatggaaagagggtcattcaactatcaagaaagacgtttgacactgaatatcagaaaaccaaaaataatgattgggactacgttgtcacaacagatataagtgagatgggagcaaacttcagggcggacagagtaatagatccgcgacggtgtcttaaaccagtaatcctaaaagatggaccggagagagttatattagcgggacccatgcctgtaaccgtagcgtcagcagctcagcgtcgtggtcgaattgggcgtaatcaaaataaagaaggggatcaatatgtttacatggggcaacctctcaacaatgacgaggaccacgcccattggacagaggcgaaaatgcttctcgataatattaacacaccagaaggtataataccagcattattcgaacccgaacgcgaaaagtcagccgcaattgacggggaataccgtttaaggggagaagctagaaaaactttcgttgaacttatgcgaagaggtgatttgccagtatggctaagctacaaagttgcgagcgaaggtttccaatattctgatagaaggtggtgttttgacggggagcggaataatcaagtgttagaagaaaacatggatgtagaaatttggactaaagagggcgaaaggaagaaactaagaccaagatggctagacgcacgaacctatagcgacccactggccttaagagaatttaaagagtttgcagcaggtcggaggagtgtatcgggagatttaatattagaaatcggaaaattaccgcagcatttaacgctgcgcgcccaaaatgcattagataatctggttatgctccataacagtgaacaaggaggtaaggcttaccgccatgccatggaagagttaccggatacgatcgagactttaatgttgttagctttgatagcggttctaacaggaggggtaacactattctttttaagcggaaaaggtcttggcaaaacaagcattgggttgctatgtgtcaccgcctcttccgcattattatggatggcaagtgttgaaccgcactggatagctgcttctattatattagaatttttccttatggttctgttgatccccgaaccagatagacaaagaaccccacaagacaatcaattggcatatgtcgtgataggactgttatttatgatcttaacagtggcggcgaatgaaatgggtttactagaaacaactaaaaaggacttagggatcgggtatgtggctgcggaaaaccatcaacatgcgactatgctggacgttgatttaaggcccgctagcgcttggacactgtacgccgtcgcgactacggtaatcacaccaatgatgagacacaccattgaaaatacaacggctaatatatcactaaccgcaatcgcaaatcaagccgcgattctcatgggtctggataaaggatggccaataagcaagatggatataggagtaccgctgttagctctaggatgttatagtcaagtcaatcctctaactttaacggcagccgtgttaatgctagttgcacattatgcaattatcggccctggattacaagcaaaggcaactcgggaagctcaaaaacgtacagctgctggtataatgaagaaccctactgtggatggtatagtagcgattgatctggatccagtagtttatgacgcaaaatttgaaaaacaactaggccaaataatgttgcttatactctgtacctcgcaaatattacttatgagaactacttgggctttatgcgaaagcattacattggccacaggaccactaactaccttgtgggaagggagccccggaaagttctggaacacgacaatagcagtaagtatggcaaatatatttaggggatcttatttggcaggagcaggcctcgctttttcgcttatgaagtctttaggaggtggtagaaggggaacaggtgctcagggcgaaacacttggtgagaaatggaaacggcaattaaaccaattgagcaagtctgaatttaatacatataagaggagcggaatcatggaagtggatcggagcgaagcgaaggaagggctcaagcgcggcgaaactacaaaacatgcggtgtcgagagggactgcgaaactacggtggtttgtagaacgtaatttggttaaacctgaaggaaaagtcatcgacctaggatgtggtcgcggtggttggagttattactgtgccggccttaaaaaggttaccgaggtcaaaggttatacaaaaggcggtccggggcacgaagaaccgataccaatggcgacatatggttggaacctagtgaaactccattcgggcaaagacgtattcttcatgccgcccgaaaaatgcgatactttattatgcgacataggtgagagttcaccgaatccaactatcgaggaaggacggacacttcgagtgctaaaaatggtagaaccatggctaagaggaaatcagttttgtatcaaaattctcaacccatacatgcccagcgtagtggagactttggaacaaatgcaaagaaaacatggcggaatgctagttcgaaatcctttaagtcgaaattcaacacatgagatgtactgggtgtcctgcggaactggaaatattgtctccgctgtaaatatgacatctcggatgctactaaatagatttacaatggcccatagaaagccaacctatgaaagggacgtagatttgggggctgggacgagacatgtagcagtggaacctgaagtagctaacctagatattataggccaaagaattgagaatataaagaatgaacacaagtccacttggcattatgatgaggacaatccctataaaacgtgggcttatcatgggtcctacgaggtcaaaccaagtggtagtgccagtagtatggttaatggagtggtaagattactcactaaaccatgggacgttattcccatggtaactcaaatagcaatgacagatacgacaccatttggacaacagcgggtcttcaaagaaaaagtagatacgcgaacaccccgagcaaaaagaggaactactcaaataatggaagtcacggcgaaatggctatggggattcttaagccgtaacaaaaagccgcgtatatgcacccgtgaagagtttacacgcaaagtaagatcaaatgctgctattggcgcagtgttcgtcgatgaaaatcaatggaactcagcgaaagaagcggttgaagacgaacgtttttgggacctcgtacatagagaaagagaactccataaacaaggtaaatgtgctacatgcgtttacaacatgatgggaaaacgagagaagaaattgggagagtttggcaaggcaaagggaagccgggcaatctggtatatgtggctaggtgcacggtttctagagttcgaggctttaggatttatgaatgaagaccattggttcagtagggaaaattcgctatcaggagtagagggagaagggttgcataaacttggttatatattacgagacatatctaaaatacctgggggtaacatgtatgcggatgacactgcgggctgggacacacgtattaccgaagacgatttacaaaacgaagctaaaatcactgatataatggaaccagaacacgctctcctagccacctcaatcttcaaactcacttaccagaacaaggtagtacgcgtacagcggcctgccaaaaatggcaccgttatggatgtaatatccaggcgtgatcaacgcggaagcggccaagttggaacatacggcctaaatacattcacgaatatggaggtccaactggttcgtcaaatggaaagcgaaggcatttttctgccatccgaacttgagaccccaaatctagcagaacgtgtattagattggctagaaaaacacggtgttgaaagactaaagagaatggcaattagtggagatgactgtgtagtaaaacctatagatgatagattcgcaacggcgctcactgcactaaatgatatgggtaaggtaagaaaagacataccgcagtgggaaccttccaagggatggaatgattggcaacaagtccctttttgcagtcaccactttcaccaactaataatgaaggacggaagagaaatcgttgttccctgtagaaaccaagatgaacttgttggacgggcaagggtaagtcaaggggccggctggagcttaagagaaactgcttgccttggtaagagttacgcacagatgtggcaattaatgtactttcatcgaagggatttacggttagcggctaatgcaatatgtagtgctgtgccagtagattgggtgccgacctctagaacaacttggtccatacacgctcatcaccagtggatgacaacagaagacatgttatctgtttggaatcgagtttggatagaggaaaatccttggatggaagacaaaacgcatgtcagcagctgggaggaggtgccttacctaggcaaaagagaagaccaatggtgtggttcactaatcggtctaacggcaagggccacatgggccactaatattcaagtcgcaataaatcaagtacggcgactgatcggaaatgaaaactatttagattacatgacatcaatgaaacgtttcaagaacgaatcagatccagaaggcgcgttatggtaa

SEQ ID NO: 22048 - RNA, 9879 nt, synthetic construct
  misc_feature 1..9879: note = derived and/or modified CDS sequence (opt6) from DENV-1__KC762649__SS-prME
  source 1..9879: mol_type = other RNA
agcgtgacaatgttattgatgttgatgcctaccgcgctagcttttcatttaactaccaggggaggggaaccccacatgattgtaagtaaacaagaaaggggaaaatcactgctgttcaaaacatcagctggcgtgaatatgtgcacgttaatcgcgatggacttaggtgaattgtgcgaagatactctgacgtataaatgtccaagaattaccgaagctgaacctgatgacgttgattgttggtgtaacgcaaccgacacatgggttacatatgggacatgtagtcaaacaggggaacatcgcagagataaacgctctgttgcactagcccctcatgtcggtctaggactagaaactcgaaccgaaacatggatgtcaagtgaaggagcctggaagcaaattcagagggttgaaacgtgggctctgagacatccaggatttacggttattgctcttttcctagctcacgctattggagcaagtatcacgcaaaagggcatcatttttattctcctaatgttagtaacaccctctatggcaatgagatgcgtgggcattggcagcagggacttcgtggaaggtttgagtggagccacgtgggttgatgtggtcctcgaacacggttcatgtgttacaacaatggccaaggataaacccacactagacattgaactcctaaagacagaagttacgaaccctgcagtcttacgaaagctatgcatcgaagccaagataagcaacactacaacagattcccgatgtccgacgcagggtgaagcaacattagtagaagaacaagatgcaaactttgtgtgccgcagaacgtttgttgatcgtggatggggaaacggatgtggcttatttggcaaaggatccctaattacatgtgcaaagtttaaatgcgttagcaaattggaaggaaagatagtgcagtatgaaaatctgaaatattccgtaatagtaacagtgcatacaggagatcagcaccaggtaggaaacgagtccactgaacatggtacaaccgcgaccattacaccacaagcgcctacaacagaaatacaattaactgattatggagcgcttacacttgactgctccccgcgaactggtctcgacttcaatgaaatggtacttttaaccatgaaagagaagtcttggctggtgcacaagcaatggtttctagatcttccacttccctggacaagtggcgcttcaacatcacaagagacttggaatcgtcaagacctcttagttacttttaaaacagcacatgccaagaaacaagaagttgtcgtactaggaagccaagagggagcaatgcacactgcactaacaggggcaacagaaatacaaacctccgggacgacaacgatttttgcgggacatttaaaatgccgactaaagatggataaattaacacttaagggcatgtcatacgtaatgtgtacaggctcatttaaattagaaaaagaggttgcagagacccaacatggaacagtgcttgtgcaaatcaaatacgaaggtactgatgcgccatgtaaaattccattttctacccaagacgagaaaggcgttacccaaaacgggagattgatcaccgccaatcccatcgtgacagataaagagaaaccggtcaatatcgaagctgaaccaccgttcggtgaatcgtatatagtcatcggagcaggcgaaaaagccttgaaactatcatggtttaagaaaggaagctcaatcggcaaaatgttcgaagctactgcccgtggagcacgacgaatggcgatattaggtgacacggcatgggacttcggttctataggaggggtatttacaagtgtgggcaaattagttcaccaaatttttgggacggcttacggggtattatttagcggggtatcatggaccatgaaaataggcatcggtgtacttctgacttggttaggtttaaattcaagatcaacatctcttagtatgacttgtatagcagtaggcttggttacgttatatttaggagtaatggtgcaagcggattcagggtgtgttatcaattggaaagggcgagagttgaaatgtggatcaggcatctttgtaacaaacgaagtacatacctggaccgaacagtataaattccaagcagattcacctaagagattatccgcggctatagggaaagcatgggaggaaggtgtctgcggaatacggtcagcaacgagactggaaaatattatgtggaaacagatcagcaatgaactcaatcatattttattggaaaatgatatgaaattcacggtagtagttggagacgtagcaggtatcttagcacaagggaaaaagatgatccggccgcaacccatggagcacaagtatagctggaaatcttggggcaaggctaaaattataggcgcagacgtacaaaatacgacctttataatagatggaccgaatactccggaatgcccagatgatcagagagcatggaatatatgggaagtagaagactatggtttcggtatctttacaacgaacatatggttaaaactaagagattcctacactcaagtctgcgatcatcgtctaatgagcgcggcaataaaagactctaaggcggttcatgccgacatgggatattggatagaaagcgagaaaaatgagacgtggaagttagctagggcttcattcattgaagtaaaaacttgcatttggcccaaaagccacacactatggagtaatggagttttggaaagcgaaatgatcataccaaagatttatggaggaccgatcagtcaacacaattataggccaggatattttacacagacggcgggcccttggcatcttggcaaattggagttagattttgacctctgcgaaggaacaaccgttgtcgtagatgaacactgtggcaacagaggaccctctctcaggacaactacagtcacagggaagatcatacatgaatggtgctgtagatcttgtacattaccaccactccgttttaggggagaagatggctgctggtatggcatggaaataaggccggtgaaagaaaaagaggaaaacctagttaaaagcatggtatcagctggatctggcgaagttgattcatttagcttaggattattatgtatttcaataatgatagaagaggttatgagatctcgttggagccgaaaaatgctaatgactgggacattggctgtattctttttgttaatcatgggtcaactaacgtggaatgacttaataagactctgtataatggtcggagcgaacgcgtctgacagaatgggcatgggtacgacctatttagccctaatggcaactttcaaaatgaggccgatgtttgcagttgggctactcttcagacggttaacgagtagagaggtgcttcttttaacaatcgggttgagcttagttgcaagtgtcgaattgcctaactccctggaagaattaggagatggcctagcaatgggtatcatgatactaaagttacttacagatttccaatcacatcaattgtgggctactttactatctctaacttttattaagactacgttttccttacactacgcgtggaaaactatggcgatggttttaagcattgtatccctattccccctgtgcctatccaccacaagtcagaaaactacttggctaccagtccttttaggaagtctcggatgcaaacctctaacgatgttcctgattgccgagaataagatatgggggagaaaaagctggccactaaatgagggaattatggcagtgggcatagtttctattcttctctcatcattactcaaaaatgacgtaccgctagctggtcccctaatcgccggtgggatgttaatcgcatgttatgtgatatcaggatcaagtgcagatctaagtctagagaaagctgctgaagtgagctgggaagaagaagcggaacattccggtgcatcgcataacatcttggtcgaagttcaagacgatggcaccatgaaaattaaggacgaggaaagagatgatactttaactatattattaaaagccacacttttagccgtaagtggggtataccccctcagtattccagctactttattcgtctggtatttttggcagaaaaagaaacaaagatctggagtactgtgggacacacctagtcctccggaggtagaacgagcagtcttagatgatggaatatacagaataatgcaacgcggactattaggacgatcgcaagtaggagttggtgtcttccaggaaaatgtattccataccatgtggcatgtgactaggggtgcggtgttaatgtatcaaggtaagcgcttagagccatcatgggcgtctgtcaagaaagatttgatatcgtacggagggggatggcgattacaaggaagttggaacacgggagaagaagtgcaagtcatagcagtagagccaggtaagaatcccaaaaacgtgcaaacagctcccggtattttcaaaacacccgaaggcgaagtaggagcgatagcactagatttcaaaccgggaacatcgggaagtcccatagtaaacagagaaggcaaaatcgttggattatatgggaatggagttgtaacaaccagtggaacttatgtaagtgctatagctcaagcaaaagcaagccaagaaggaccccttcccgaaatagaagatgaagtgttccgtaaacgaaatctaactattatggatctacaccccggaagtggtaaaactagacgttacttacctgctattgtcagggaggcgataaaacgtaaattaagaaccttgattcttgcgccgactcgggttgtcgctagcgaaatggcagaagcattgaagggaatgcccatccgataccaaactacggcggttaaatctgaacacactggtaaggaaatagttgatcttatgtgtcatgcaacatttaccatgaggttgctatcaccagttagagtccccaattataacatgataatcatggacgaagcccacttcacagatccaagttcaattgctgcacgaggatatatcagtacgagagtgggtatgggcgaggcagcagctatatttatgacggctacaccacccggttccgtagaagcattccctcaaagtaacgcggtaatacaagacgaagaaagggacatacccgaaagatcatggaactcaggatacgaatggataacagactttccaggaaaaactgtatggttcgttcctagtatcaaatctgggaatgacattgcgaattgcttacgtaaaaatggcaaacgagtcatacaactaagtagaaaaacattcgacaccgagtaccaaaagactaaaaataacgactgggattacgtcgtgactacggacatatccgaaatgggggcaaatttccgggccgacagggttatagatccaagacgttgtttaaaaccggtaatattaaaagacgggcccgaaagggtgatcttagcaggacctatgccggtgaccgtagctagtgcagcacagaggagagggcgtgtcgggagaaatcacaataaagaaggagatcagtatatatatatgggtcagccattaaataatgacgaggatcatgcccactggacggaagccaagatgttgctagataatattaatactccagaaggcataataccagcgttattcgagcccgagcgcgagaagtcggcagcaattgatggcgaataccgattgagaggtgaagcacgtaagacatttgtggaattgatgcggaggggagatctgcccgtatggctttcatataaagtagccagcgaaggatttcaatattctgaccggagatggtgctttgatggggaaaggaataaccaagtactcgaggaaaacatggatgtagaaatatggacgaaagaaggtgaaaggaagaaactacgaccaagatggttagatgcaagaacttattccgacccactagctttaagagaatttaaagaatttgccgcgggacggcgttcagttagtggagacttaatattagaaataggaaaactaccacaacaccttacccaacgagcacagaacgctttagataatctcgtgatgttacacaacagtgaacagggcggcagagcatataggcacgcgatggaggagcttccagacacaattgaaactttaatgttgctcgccttaattgcagtgctgactggaggtgtaacattattcttcctcagcggaagagggctaggtaaaacctcaatagggcttttatgtgtaatggcaagcagcgttcttttatggatggcaagcgttgagcctcattggatagctgcatcgataatattagagttctttttgatggtactcttaataccagagccagacagacaaaggactccacaggataatcaactcgcatatgtagttattgggctattgttcatgatactaacagttgcagcaaacgaaatgggtttactagaaacaacaaagaaagacttaggaattggacatgtagccgttgaaaatcaccatcatgcggccatgctggatgtggacctccatcctgcgagcgcatggactctctacgctgtagcaactacaattattacgccaatgatgcgccatacgatagaaaataccacggcaaatattagcttaacagctattgcaaaccaagcagccattctcatggggctagataaagggtggcctatcagcaaaatggatattggagtaccactccttgccctgggttgctatagtcaggtaaacccattaaccctaactgccgcagtattgatgttagtagcacattacgcaataataggtccaggattacaagccaaagctactagggaagcacagaaaagaaccgcggcaggaataatgaagaatcccacagtagatggtatagttgccatagacttagatccagtggtttatgacgcgaaattcgaaaaacagctcggacaaataatgttattgattctgtgtacatcccaaattttgcttatgagaactacttgggcactatgtgaaagtatcaccttagcgacaggccctttaacaactttatgggaaggtagcccgggtaaattctggaatactacgatcgcggtatccatggccaatatatttcgcggcagctatctagcaggagcaggacttgcgttcagccttatgaaaagtctcggagggggcagacgtggaaccggtgcacaaggagaaacgcttggagaaaaatggaaaaggcagctcaaccaattgtctaagagtgagttcaatacttacaaaagatcgggaataatggaagtagatagatctgaggcgaaagaaggattaaaaaggggtgagacaaccaaacatgccgtaagcaggggaactgctaaactcagatggttcgtagaacgaaacttagtaaaacctgaagggaaagtaatagacttaggatgtggtagaggtggctggagctattactgcgcaggactaaagaaagtaaccgaagtgaaagggtataccaagggcggtcccgggcacgaagaaccaataccgatggccacgtacggatggaacttagtaaaattacactcaggaaaagatgtgttcttcattccacctgagaagtgcgatactctactatgcgacatcggcgaatccagtcccaatccaacaatagaagagggtaggacattgcgtgtattaaaaatggtggaaccatggttaagaggaaaccaattttgtattaaaatattaaacccatatatgccctccgttgttgaaacgcttgagcaaatgcagagaaaacatggtggcatgctagttaggaatcctctctcacgtaattctacccatgaaatgtattgggtaagctgtggtacaggaaacattgtctctgcggtaaatatgacttctagaatgcttttaaacagatttacaatggcacatagaaaacctacgtacgaaagagatgtggacttaggtgcagggacgcggcatgtcgccgtggaacctgaagtagctaacttggatattatagggcaacgcattgaaaacattaaacatgaacacaaaagcacatggcactacgatgaagacaatccgtataaaacttgggcatatcatggcagttatgaggttaaaccaagcgggtctgcttcaagcatggtaaatggcgtagtcaaactcttaactaaaccatgggacgtcataccgatggttacacagattgcaatgacagatactacacccttcggtcagcaaagagtatttaaagaaaaagtagacacgaggactcccaaagctaaacgaggtacaacgcaaatcatggaggttaccgccagatggttgtggggatttctaagtaggaacaaaaagcccagaatatgcacgagagaggaatttactagaaaagtcagatccaatgccgcaataggcgcagtattcgtagatgaaaaccaatggaacagtgcgaaggaagcagttgaagatgaacgattttgggacttagttcatcgggaaagagagttacacaaacaaggaaaatgtgctacctgtgtatataatatgatgggtaaacgtgagaagaaacttggtgaatttggaaaagcaaaaggttcaagagctatatggtacatgtggctaggcgccaggtttctcgagttcgaggctttaggtttcatgaacgaagatcactggtttagtagagaaaattctttatcaggcgtcgaaggggaaggactacataaattaggctatatacttagagacatttcaaaaatcccaggtggaaacatgtatgcggacgatacagctggatgggatacaagaataacggaagatgacctacagaatgaagcaaaaataaccgatatcatggaaccggaacatgcactgttagctaaagcaatctttaagctcacataccaaaataaggttgttcgggtacaaagaccagccaaaaatggcaccgtaatggatgttatatcacgcagggaccaaaggggttcaggacaagttggaacatatggtttaaataccttcacaaatatggaagctcagttgattcgccaaatggaatcagaaggaatattttcaccaagtgagttagaaacaccaaatcttgccgaacgggttctagactggcttgaaaagtatggagtggaaaggttgaaaaggatggccatttctggagatgattgtgtagtgaaaccaatagatgatagattcgcaactgccctgactgcactaaacgacatgggaaaggtcagaaaagatattcctcaatgggaaccatcaaaaggttggaacgactggcagcaagttcctttttgctcacaccactttcatcagttaattatgaaggatggaagagaaatagttgtgccgtgtcgaaaccaagatgaattagtcggacgcgcacgagtctctcaaggcgcgggatggtccctacgtgaaacagcatgcctaggaaaaagctacgcccagatgtggcaattaatgtattttcataggagagatctacgactagctgctaatgcgatatgtagcgctgttccggtagattgggttcccacgtcgagaactacttggtccatacatgcacatcatcaatggatgactactgaagacatgctatcagtttggaacagagtatggatagaagaaaatccatggatggaagacaaaacccacattagttcctgggaagacgtaccatacttaggaaagagagaagatcagtggtgtggtagcctaataggactaactgcaagagctacttgggcaaccaacatacaagtggcaatcaatcaggtaagacgtttaataggaaacgaaaattatttagattacatgacctcaatgaaacgattcaagaatgaatcagatccggaaggtgctctctggtaa

SEQ ID NO: 22049 - RNA, 9879 nt, synthetic construct
  misc_feature 1..9879: note = derived and/or modified CDS sequence (opt6) from DENV-1__KC762625__SS-prME
  source 1..9879: mol_type = other RNA
agcgttacgatgttgctaatgctaatgcctactgcacttgcatttcacttaactactcgaggaggagaaccacatatgatagtatccaaacaagaacgagggaaatcgttgctatttaaaacatcagccggggtaaatatgtgtacactaatagctatggaccttggagaactgtgtgaagacacactaacgtataaatgccctaggattacggaagctgaaccggatgacgtagactgttggtgtaatgcaactgatacatgggttacgtacggaacctgttcccaaacgggagagcatcgaagggataaaaggtcagtagcactagctccacatgttggattaggactcgaaactaggaccgaaacttggatgtcgtcagaaggcgcctggaaacaaattcagagggtagagacttgggcattgcgtcatccaggtttcacagtaatagcattgttcctcgcccacgcaataggcacatcaattacgcaaaaagggatcatatttattttattaatgcttgtaacaccatcaatggcgatgcgatgtgttgggatagggagtcgcgactttgttgaaggattaagcggagcgacgtgggtggatgtggtattagaacacgggtcttgtgttacaactatggcaaaagacaaaccgaccctagatatagaattactaaaaacggaagtaacaaacccggccgtgctacgaaaactgtgcattgaggctaaaatttcgaatacgactacagattcacgttgccccacacagggagaagcaacgttggtagaagaacaggacgctaacttcgtctgccgacgtacttttgtagacagaggatgggggaatggatgcggcttgttcggaaaaggttcacttataacctgcgcgaaattcaaatgcgttagcaagttagaaggaaaaatagttcaatacgagaatttgaaatactcagtcattgtaacagtacatactggcgaccaacatcaggtaggaaatgagagtaccgaacatggaactacagctacaataacaccacaggcaccaactacagaaatacaactaactgactatggtgcactcacacttgactgtagcccaagaacgggacttgactttaacgagatggtactactaacaatgaaggaaaaatcatggctggtacataaacaatggtttttagatttgcccttaccatggacaagcggagcttcgacttcacaagaaacatggaacagacaagatctccttgttacttttaaaactgctcatgcaaagaaacaggaagtcgttgtccttggatcacaagagggagcgatgcatacagcgctaactggcgctacagaaatacaaacgtcaggcacaactaccattttcgccggacaccttaaatgccggttgaagatggataaattaaccttaaaaggaatgagttacgtcatgtgtaccggttcgttcaaattggaaaaagaggttgccgaaactcaacacggtacagtgctagttcagataaaatatgaaggcacggacgcaccttgtaagatacccttttccacacaagacgaaaaaggtgtgacacaaaacggaagattaataacagccaaccctatagtaactgataaagaaaaaccagtaaatatcgaagcagagcctccattcggcgaatcatacatagtaataggagctggggaaaaagcactgaaattatcatggtttaagaaaggctcctcaattggaaaaatgttcgaagcgacagccagaggcgcaagaagaatggcgatattaggggataccgcatgggattttggctcaatagggggtgtattcacaagcgttggcaagttagtacatcaaatatttggaaccgcgtacggggttctattttcgggagtatcatggacaatgaaaataggaataggagtcttactcacatggttagggctaaactctagaagtacctcattatccatgacgtgtatagcagtaggccttgtaactttatatctaggtgtgatggtacaagcggactcagggtgtgtcattaactggaagggaagagaactcaaatgtggatcgggtatatttgtgacaaatgaagtgcacacgtggacggaacaatataagttccaagcagattcacctaaaagactatcagcagccatagggaaagcctgggaagaaggagtttgtggaatcagaagcgcgactaggctagagaatattatgtggaaacaaatttctaacgaactaaatcacatcctattagaaaatgatatgaaatttacggtagtcgtaggtgacgtagcaggcattcttgctcaaggaaagaaaatgataagaccacagccaatggaacacaagtacagctggaaaagttggggtaaagcgaaaattataggagccgatgtacaaaatacaacattcataattgacggtcctaatactcctgaatgtccagacgatcaacgcgcttggaacatctgggaagtagaggattacggcttcggcatttttaccacgaacatttggctaaaacttagagatagttatacccaagtgtgcgatcataggttaatgtcagccgcgataaaagattcgaaggcagtacacgctgacatgggctattggatcgaaagcgagaaaaacgagacctggaagttagccagggcaagttttatagaagtaaaatcatgtatctggccgaaaagccacaccttatggtcaaatggtgtgttagagtccgaaatgattattccaaaaatctatggaggccccatctcgcaacataactaccgacccggatatttcacgcaaacagctggaccatggcatctaggtaaacttgagctagactttgatttatgtgaaggaacaaccgtagtagttgatgagcattgcggaaaccgcggccccagcctgaggaccacgacggttactgggaaaatcatacatgaatggtgttgccgtagttgtacattaccacctcttcgattcagaggtgaagacggatgctggtatggcatggagatccgacctgtaaaggaaaaggaagagaacctcgtcaaatccatggtatctgcgggctcaggagaagttgattccttctcattaggactattatgtattagcataatgattgaagaagttatgagatctagatggtcccggaaaatgcttatgactggcacattagctgttttctttctccttataatggggcaattgacatggaacgacctcataagattgtgtataatggtcggtgcaaatgcaagtgatcgaatgggtatggggacaacgtatttagctttgatggcgacgttcaaaatgcggccaatgttcgctgtaggattgctatttagaagattaacgtctagggaagtactattactcacaatcgggttatctttggttgcttcagttgaattaccaaacagtctggaggaattgggggatgggttggcaatgggaataatgatacttaaattactaaccgactttcagagccatcaactttgggcaactttattgagtttaactttcataaaaactaccttttcactccactatgcatggaaaactatggccatggttttgagcatcgtaagtttattcccactgtgtttatctactacgtcccaaaagaccacatggcttccagttctactcggcagcttaggatgcaaaccactaaccatgtttttgatagccgaaaataaaatatgggggaggaaatcatggccactaaacgaagggataatggccgtggggatcgtctctatactcctttcatcacttcttaaaaacgacgttccactagcaggacctctaattgccggtgggatgttgattgcatgctacgtgataagcggatctagtgcggatttgtcactggagaaagcagcagaagtcagttgggaggaagaagccgaacactccggagcatcacacaatattctggtagaagtacaagacgacggaacaatgaaaatcaaggatgaggaacgggatgataccttaaccatattattaaaagccacactactcgctgtttcgggcgtttatccactctcaatacccgcaactctcttcgtttggtacttctggcaaaagaagaaacaaaggtccggcgttttatgggatactccgagtcctccagaggtagaaagagcagttttagatgatggaatatacaggattatgcaaagaggcttgttaggcagatctcaagtcggagtaggagtatttcaggagaatgtattccacacaatgtggcacgtaacaagaggggcagtgctaatgtaccaaggaaaacgcctagagccatcatgggcaagtgtaaagaaggacctgatttcgtacgggggcggctggagactgcaaggttcctggaatacaggggaagaagtacaagtaatcgccgttgaacctggcaaaaatcccaaaaatgttcaaacagcgccgggtacatttaagacacccgaaggagaagtaggggcaattgcactagacttcaaacctggtacatcgggttcgcccatagtaaatagagaaggcaaaatagtaggcctttacgggaacggagtcgtgactacatcaggtacatacgttagcgcaatagcgcaagcaaaagcctcgcaagaaggcccgctgccggaaatagaagatgaggtctttcgaaagcggaacctaacaataatggacttacatcctggaagcggaaagacacgcagataccttccagcaatagtcagggaagcaattaaaagaaaactaagaactcttattttggcgcccacacgtgtagtcgcgtccgaaatggcggaagccttaaaggggatgcccatccgataccaaacgacagcagtaaaatcagaacacactggaaaagaaatagttgaccttatgtgccatgctacatttaccatgagattacttagccctgttagggtacctaattacaatatgataataatggacgaagcgcactttactgacccgtcaagtatcgcagcacggggatatatcagcactcgggtaggtatgggagaggccgcagcgatatttatgacagcgacacccccaggttcagttgaggcttttccacaatctaatgctgtaattcaagacgaggaacgcgacatacccgagcgtagttggaatagtggttatgaatggataacagatttccctggtaagaccgtatggtttgtcccatcaattaagagtggcaatgacattgcaaactgtttgcggaaaaatggtaaaagagtaatacagctaagtcgtaagacattcgacactgagtaccagaagaccaagaacaatgattgggattatgtagtaaccacagatataagtgaaatgggggcaaatttccgcgctgatcgagtaatcgaccctagacggtgtctaaagcctgtcattctcaaggatgggcccgaaagagttattcttgcgggaccaatgcctgtcacagtagcaagtgcagcacaaagacgtggaagagttggcagaaaccataataaggaaggtgatcaatacatatatatggggcagccattaaataatgacgaggatcatgcgcactggacagaagcaaaaatgctgcttgacaatataaatacaccagagggaatcataccggccctgtttgagccagagagagagaaaagcgctgctatagacggagagtaccgtttaaggggtgaagctaggaagacattcgtagaattaatgaggcgaggtgatcttcctgtctggttgtcctataaagtcgcctcagagggttttcagtattcagaccgaagatggtgctttgatggtgagagaaacaatcaagtactcgaagaaaatatggatgtagaaatatggacaaaggagggtgaaagaaagaaactccgtccccgatggctcgacgcaagaacttattccgatccgctggcacttcgcgagttcaaagaatttgcggcaggacggagaagtgtatcgggggacttaattctggaaattggaaaacttccgcaacatctcacccagagagctcaaaacgctctagacaatctcgtcatgcttcacaattccgaacaaggaggacgagcatataggcatgcaatggaagaattaccggatactatagaaaccttgatgcttctagcccttatagctgttttgacaggtggagtaacattattctttttaagtggtaggggattggggaaaacaagcatcggtctgttatgtgttatggcaagtagtgtccttttatggatggcttccgtagaaccccattggatagccgcttcaataattttagaatttttccttatggtattattgataccggaacccgaccgccaacgaaccccgcaagataatcaattagcatatgttgttataggcctgctgttcatgatattaactgtcgctgcaaacgaaatgggccttttagaaaccaccaagaaagacctgggtataggtcacgtagcagtggaaaatcaccatcacgccgctatgctggacgttgacctacaccctgcgtcggcctggacattatatgcagtggctacaactataattacgccgatgatgcgtcatacgattgaaaatacaacggccaatatttccctaacggcaatcgcaaatcaagcggcaattctaatgggtcttgacaaaggatggccaatcagcaaaatggatattggagtaccactcttagcattaggatgttactcacaagtgaatccattgaccctaaccgcggcagttttaatgcttgttgctcattatgcaataatcggtcccgggctacaagcgaaagctaccagagaggctcaaaaacgaacagccgcgggtataatgaagaatccaaccgtcgatggtatagttgccatcgacttagatccagtcgtttacgatgccaaatttgaaaaacaactaggtcaaataatgctattgatactatgtacttcccaaatattattaatgcgtacaacatgggcgttatgtgaatcaattactttagcaacgggtccattaaccacgctttgggagggatcaccaggcaaattttggaatactactatcgccgtgtcaatggctaatattttccgtggttcatatttagcaggggcgggcctcgcattctctctgatgaagagtttaggaggaggtagaaggggaaccggcgcacaaggagaaacattaggagagaagtggaaacgtcagctcaatcaactcagcaaaagcgaatttaatacgtataaaagaagcggaattatggaggtggaccgttccgaagccaaagaaggtctaaaacggggagaaacgacgaaacatgctgttagtcgaggtacagccaagttaagatggtttgtcgaaagaaacttagtaaaacctgagggcaaggtaatagatttagggtgtggaagagggggctggtcgtactattgcgctggtttgaagaaagttactgaggttaaaggctacacaaaagggggtccaggacatgaagaacccatacccatggctacgtacgggtggaatttagtcaaattgcattctggaaaggacgttttcttcataccccctgaaaaatgcgatacactactttgtgacattggcgaatctagcccgaaccctactattgaagagggacgtactttaagagttttaaaaatggtagaaccttggctaaggggtaatcaattctgcataaaaatacttaatccatatatgccatcagttgtagaaacactggagcaaatgcaaagaaaacacggtggcatgttagtaagaaacccactctctcgaaattcaactcacgaaatgtattgggtctcctgtggcaccgggaatatagtgtcggcagtaaatatgaccagtagaatgctcttaaaccgattcaccatggcccatagaaaacccacctacgaaagggacgtcgatttaggagcaggtactcgtcatgtggctgtagaacccgaagttgctaaccttgacataataggacaacgcattgaaaacataaaacatgaacacaaaagtacctggcactacgatgaagacaacccatataaaacgtgggcataccatggttcttacgaggtgaaacctagcggcagcgccagtagtatggtaaatggagtggtcaaacttctaacaaaaccatgggatgtaataccaatggttactcaaattgctatgactgatacgaccccatttggtcagcaacgtgtgtttaaagaaaaagtagacactaggacacccaaagctaaacggggtacgacacaaatcatggaggtgactgcccgatggttgtggggctttctaagtaggaacaaaaagccgagaatatgtacgcgtgaagagtttacaagaaaggtcaggagtaacgcagcaattggtgctgtatttgtagatgagaatcaatggaacagtgcaaaagaagcagttgaagatgaacggttctgggatcttgtacatagagagagagagctccataaacaaggcaaatgtgctacatgtgtttacaacatgatgggcaaacgtgagaagaaactcggcgaatttggaaaagcaaaaggttcaagggcaatttggtacatgtggctaggtgcgcgtttcttagaatttgaagcattaggatttatgaacgaagatcattggttttcgagggaaaatagccttagcggagtagaaggagaaggattacataaactcggctatatattacgcgatatcagcaaaatacccggcggaaatatgtatgcagatgacacagcgggatgggacacaagaatcacagaagatgatttgcaaaatgaagcaaagatcaccgatataatggaaccagaacacgcattattagcgaaagcgatttttaagctcacttaccaaaataaagtagtaagagtacaacgaccagcaaagaacggtaccgtaatggatgttattagtcggagagatcaacgcggcagtgggcaagtcgggacttacggtctcaatacttttacaaatatggaagctcaactaattagacagatggaatcggaaggaattttctccccgagcgaactcgaaactccaaatttggcagaaagggttctagattggctcgagaaatatggcgtagaaaggttgaagcgaatggcaataagtggagatgattgtgtggtcaaaccaatagacgatcggtttgctacagcactgactgcattaaacgacatgggcaaagtacgaaaagacataccacaatgggaaccgagtaaaggttggaacgactggcaacaagtgccattttgttctcaccattttcaccaactaattatgaaagatggtcgagaaatagtagtgccatgccgcaatcaagatgaattggtaggacgggcgagagttagtcaaggtgcagggtggtctcttagagaaaccgcatgtctcgggaagtcgtatgcacaaatgtggcaacttatgtactttcacagacgagatctcagactagctgcaaacgcaatatgctcagctgtaccagtagattgggtaccaacttctagaacaacttggtcaatacacgcccaccaccaatggatgaccacagaggatatgttgtcagtttggaatagggtgtggatagaagaaaacccgtggatggaggacaagacacatatcagttcctgggaagatgtaccatatctcggaaagagagaggaccagtggtgcggtagtcttatcggtctaacagcgcgtgcaacctgggcaacgaatatacaagtagcgattaatcaagtaagacgcctaattgggaacgaaaattatcttgattatatgacatctatgaagcgattcaaaaatgaatccgatccggaaggagcattatggtaa

SEQ ID NO: 22050 - RNA, 9879 nt, synthetic construct
  misc_feature 1..9879: note = derived and/or modified CDS sequence (opt6) from DENV-1__KC762635__SS-prME
  source 1..9879: mol_type = other RNA
tctgttactatgttgctaatgttaatgccgacagcactggcattccatttaactacacgtgggggtgaaccgcatatgatcgtttccaaacaagaaagggggaaatccttattgttcaaaacaagcgcaggggtaaatatgtgcacacttattgctatggatttaggggaactctgtgaagatacattaacatataaatgtccgcgaattacagaagcagaaccagatgatgtagattgttggtgtaatgcaaccgatacatgggtaacatatggaacatgcagccaaactggagaacatcggcgagataaaaggagcgtagctcttgcacctcacgtagggctcggacttgaaacaagaacggaaacttggatgagtagtgaaggtgcttggcgacaaattcaaagagtagaaacatgggcattacggcaccctgggtttactgtaatcgccttattcctagctcacgcgataggtacgtccataacgcaaaaaggcataatcttcatcttattgatgttagtgacaccgagcatggctatgagatgtgtgggaatcggcagtcgcgactttgtcgagggacttagtggtgcaacttgggttgatgtagttttagaacatggttcttgcgttacaacaatggccaaagataaaccaacccttgacattgagcttttgaaaacagaagtaactaacccggcagtccttagaaaactgtgcattgaagcgaaaatttcaaatacaacaacggacagtagatgtcctactcaaggagaggctacattggtagaagaacaagatgccaactttgtttgcagacggacattcgtcgatcgaggttggggaaatggttgcggactattcggaaaaggttctctaatcacatgcgcaaagtttaagtgtgttactaaacttgaagggaaaattgtacaatatgaaaatctaaaatattcagtcattgtgaccgtacacacaggagaccaacaccaagtcggaaacgaatccacagaacacggcacaacagcgactattacaccacaagctcctactactgaaatacaactcactgactacggagctctgaccctagactgtagcccgaggactggattggattttaatgaaatggttctacttacgatgaaggagaagtcatggcttgtccacaaacagtggtttttggacttacctctgccttggacaagcggagcttctacctctcaggaaacgtggaatagacaagatttacttgtaacctttaaaacagctcatgccaagaaacaggaagtggtagttctgggttctcaagaaggagcgatgcacacagcactaacaggtgctactgagatccaaacaagtggaaccacgacaatatttgcgggtcatcttaagtgtcgtttaaagatggacaaattaacactcaagggaatgtcctatgtgatgtgtactggttcgtttaaacttgagaaggaggtagcagaaacccagcacggtaccgtattagttcaaattaagtatgaaggcactgatgcaccatgtaaaataccgttttcaacccaagatgaaaaaggcgtaactcaaaacggtagacttataacagctaatcccatagtaacagataaagaaaaacctgttaatattgaggctgaaccaccctttggtgaatcttacatcgtaatcggcgcaggagaaaaggcactaaagttaagttggttcaagaagggctcctcaattggtaaaatgtttgaagcaacagcaagaggtgcgcgaaggatggcaattcttggagacactgcatgggactttggttccattggaggtgtctttactagcgtaggaaaactggtccatcagatcttcggaacggcatatggcgtcttattctctggtgtaagctggacgatgaaaataggcataggcgttcttctcacttggcttggcctaaactcaagaagtacatcattgtcaatgacatgcatagctgttgggttagtaaccttatacctaggagtcatggtacaagcggattcaggctgtgtgataaattggaaagggcgtgagttaaaatgtggttccggaattttcgtaactaatgaagttcacacttggactgaacaatacaaattccaagcggatagtcctaaaagattatcagctgctataggtaaagcatgggaagaaggggtatgcggaataagaagtgcgacccgattagaaaatataatgtggaaacaaatttcaaacgaactaaatcatatactcctcgaaaatgacatgaaattcacagtagtagtcggtgatgtagctgggattctcgctcaagggaagaaaatgattagaccacaaccaatggagcacaaatatagttggaaaagttggggaaaagcaaagattattggcgctgacgtccaaaatacaacattcattatagacggaccaaacactccagaatgcccagatgaccagcgtgcatggaatatttgggaagtggaggattatggatttggtatatttacgacaaatatttggttgaagctccgagactcttatacacaagtgtgtgaccatcgactaatgtcagcagcaatcaaggattccaaagctgtacacgcagatatgggatactggatagaatcggagaaaaatgaaacatggaaattggcaagagcttctttcattgaagtaaaaacttgtatctggccaaaaagtcatacactatggtcaaatggtgtcctagaatccgagatgataatacctaaaatatatggaggaccaatttcacaacacaactatcgacctggttattttacgcaaacagcgggaccatggcatttaggtaaacttgaacttgactttaacctatgcgaaggcaccacagtagtagttgatgaacattgcggaaataggggcccaagcctcaggaccacgacggtaacgggaaagataatccatgaatggtgttgccgaagctgcactctgccaccactacgatttagaggagaagacggttgttggtacggaatggaaattcgtcctgtaaaggaaaaagaagaaaaccttgttaaatcaatggtgtccgcgggatcaggagaagtagactcattcagtcttgggctgttatgtatatcaatcatgattgaagaggtcatgagatcgagatggtcaagaaaaatgttaatgacaggcacattagcagtcttctttttgttgatcatgggacaactaacttggaatgatctgataagactatgcattatggtaggtgcgaacgcaagtgatagaatgggcatgggtacaacatatttggctttaatggccaccttcaaaatgaggccaatgttcgcagtagggcttttatttcgcagattgacgagtcgagaagtgttattgctaactataggattaagtttagtagcatccgtcgaattgccaaattcattagaagaattaggagatggactagcgatggggataatgatattaaagctgttgacagatttccaatcccatcaattatgggcaaccttattgtcactaacgtttataaaaacaactttctctctgcattatgcatggaagacaatggcaatggtactcagcatcgtatctctgttccctttatgtctctctacgacttcccagaaaactacatggctaccagttttgcttggatccctcggatgcaaaccacttactatgtttttaatagcagaaaataagatttggggaaggaaatcttggccattaaacgaaggtatcatggcagttgggatagtgtccattttactatctagtttgctgaaaaatgatgttcctcttgcaggacccttaatcgcaggaggtatgttaatcgcctgctacgtaataagtggatccagtgcagacctatcgcttgagaaagcagcggaggtatcttgggaggaagaagcagaacacagtggggcgtcacacaatattttggttgaggttcaagatgatggtacaatgaagatcaaagatgaagaaagagacgatacactaaccatactcctgaaagcaacgttgctcgccgtatctggtgtttacccactgagcattccagctacactttttgtatggtacttctggcagaagaagaaacaacgaagcggagtcctttgggacacaccatcgccacccgaagtggagagggctgtactggatgatggtatttacaggataatgcaacgggggttactcggaagatctcaagtcggtgtaggagtttttcaagaaaatgtatttcacacaatgtggcacgtaactaggggagcagttttaatgtaccaagggaagcggttagaaccatcatgggcgtcggttaagaaggatttgataagttacggcggaggatggcggcttcaaggatcatggaatactggtgaagaggtacaagttattgcagttgaacccggcaaaaatcccaaaaatgtacaaaccgccccggggacatttaaaacaccagaaggagaggtaggagctatagcgcttgacttcaaaccaggtacatcgggaagtccgatcgtaaatagagagggaaaaatcgttggtttatacgggaacggcgttgtcacgacttcggggacctatgtatctgctatagcccaggctaaagcaagtcaagagggacccttacctgaaattgaagacgaagtttttcgcaagaggaatcttactattatggacttacaccctggaagtggaaaaactcgacgttacttgcctgctatagtacgggaagctataaagcggaaactaagaacactaatcttagcaccgactcgggtagtagcaagtgaaatggctgaagcactaaaaggcatgccaattagatatcaaactactgcagtcaaaagtgagcacacgggaaaagagatagtcgacctaatgtgccatgctacatttacaatgcgattactatcacctgtaagggtcccaaattacaatatgataattatggacgaagcgcattttacagacccaagcagtatcgcggcaagaggctatatttcaacgcgtgtaggaatgggagaagccgcagctatatttatgacggcgacacctcccggaagcgttgaagcatttccacagtctaacgctgttatacaagatgaagagagagacatccccgaacgttcatggaactctggatacgaatggataacggattttcccggaaaaacagtttggtttgtaccttcaataaaatcagggaatgatatcgcgaactgtttaaggaaaaacggtaaacgagttatccaactttctcgcaaaacattcgatactgaatatcagaagactaaaaataatgattgggactacgtagtcactactgacatttcagaaatgggcgcaaattttcgagctgatcgagttattgatccaagacgctgcttgaaaccggtgatactaaaagatggaccagaacgggtcatcctggcagggccaatgcccgtcacagtcgctagcgcagctcaacgaaggggaagagtaggaagaaaccacaataaggaaggcgatcaatacatatatatgggtcaacctcttaataacgatgaagatcatgcacactggacagaagcaaaaatgttactagataacattaatacacccgaagggattattcctgctctgttcgaacctgaaagagaaaaatcagctgcaatcgatggggagtatagattgagaggggaggctcgaaaaacttttgtggaacttatgagacgcggagatttacctgtatggttaagctataaagtagcatcagagggttttcaatattctgataggaggtggtgctttgacggtgaaaggaacaatcaagtcctagaggaaaacatggacgtagaaatctggaccaaagaaggagaaaggaagaaactacggccgaggtggcttgatgctcgaacgtattcggatcccctcgcactgagagagtttaaagagtttgcggctggcagaagaagtgtttcaggggatttaattctcgagattggaaaattacctcagcatttgacacagcgtgcccaaaatgcactagataatcttgtaatgttgcataatagtgaacaaggcggccgtgcctaccgccatgcgatggaggaattgcctgatacgatagagactctaatgctattagccttgatagcagtgttaacaggaggcgtgactctattctttctctcaggtcgcggacttggaaaaacatcaatcggattgctctgtgtgatggctagtagcgtattactctggatggcttcggttgagcctcattggatagcagcatcaataattttagaatttttcctgatggtactacttatccccgaacccgatagacaacgcactccacaagacaatcagctcgcttacgtggtaataggattattatttatgattctcaccgttgctgcaaatgaaatgggactccttgaaacaacgaagaaagatttagggattggccatgtagctgtagaaaatcatcaccacgcagcaatgctggatgtagatctccacccggcaagcgcatggacactttacgccgtggcaacgactataattacacccatgatgcggcacacaatagagaatacaaccgcaaatataagcctcacagccatagcaaaccaagcagccatattaatgggattagacaaaggttggcctatctcaaaaatggatataggggtgccgctactcgcattgggttgttattcccaggtgaatccattgacattgacagcagctgtactcatgttagttgctcattatgcaataattggccctggattgcaagcaaaggcaactcgagaggcccagaaaagaacggcggccggaataatgaaaaaccctaccgtagatggcatagtggcaatagatctagaccccgtagtgtatgatgccaaatttgagaaacaactaggacaaataatgttattaattttatgtacgagtcagatattacttatgagaactacttgggcattgtgtgagtccataactctcgcaaccgggcctctaacaactctatgggaaggttcccccggtaaattctggaacacaactattgcagtcagtatggcgaatatatttagaggatcatacttagcgggtgcaggcttagcatttagtctgatgaaatctctaggaggtggcagaagaggtacgggagcccagggagaaaccctgggagaaaaatggaaaaggcaattaaaccaattgagtaaatcagagtttaatacttataagcgttcaggaattatggaagtagataggagcgaagccaaggaaggattaaaaagaggggaaaccaccaagcacgccgtatcacgaggcacagccaaattgcgctggttcgttgaaagaaatctagtaaaaccagaaggcaaagtaattgatttaggatgtgggagaggagggtggtcttactactgtgcaggattaaagaaagttacagaggtaaaaggctacacgaaaggaggaccaggacacgaagaaccgataccaatggcaacatacggctggaatctagtaaagctacattctggcaaagatgttttcttcataccccctgaaaaatgtgacacattactctgtgatataggcgagagtagtccaaatccgactatagaagaaggcaggacgctccgtgtgctaaaaatggttgaaccgtggttgcgagggaaccaattttgtattaaaatattgaatccatacatgccaagcgtggtagaaacacttgaacaaatgcaaagaaaacatggagggatgttagttcgaaatccactatccaggaacagcacgcatgagatgtattgggttagttgtggtacagggaacatagtctccgcagtaaatatgacttctagaatgttgctcaaccgttttacaatggcacatcgaaaaccgacctatgaacgagatgttgatctaggcgctggaactagacacgttgctgtcgaaccggaagttgcaaacctcgatattataggccaaagaattgaaaatataaaacatgaacacaagtcaacatggcactacgatgaagacaacccttacaagacttgggcttaccacggctcctacgaggtaaaaccttcagggtccgctagcagtatggtgaacggagtcgtcaaacttctaaccaaaccctgggatgtcattcctatggttacacaaatagccatgactgatactacgccttttggacaacagagggtattcaaagagaaagtagataccagaacccctaaggcgaaaagagggaccacacaaataatggaggtgaccgcaaggtggctttggggatttctaagcagaaacaaaaagcctagaatctgtacgagggaagaatttacgagaaaagtacgctccaacgcagcaatcggggcggtctttgtggatgaaaatcaatggaatagcgcaaaagaggctgtagaggatgaacgattctgggatctcgtacatcgagaaagagaattacataagcaaggaaaatgcgcgacatgcgtttacaatatgatgggaaaaagagagaagaaattaggagagttcgggaaagccaaagggagtcgggcaatatggtatatgtggctaggcgccagattcctcgagttcgaggcactaggatttatgaatgaggatcactggttcagtagggaaaatagcctgagtggagtggaaggagaaggattgcacaaactcggctatatactccgagacataagtaaaatacctggaggtaatatgtatgccgatgacactgcaggatgggatacacgtatcacagaggatgatctacagaatgaagctaaaataacagacattatggaaccggaacacgcactattggcaaaggcgatttttaaactcacatatcaaaataaagtggttagagtgcaaaggccagcgaaaaacggtactgtaatggacgtgatatcgagaagagaccaaagagggagtggtcaagtgggaacctatgggttaaatactttcaccaacatggaagcgcaattaataagacaaatggagagtgagggtatattttccccatcagaactggaaaccccgaatctcgccgaacgagtattggactggttagaaaaatacggcgtggaaagattaaaaagaatggcaattagtggggatgactgcgtagtaaaaccaatagacgataggtttgcgactgcactaactgctctgaacgacatgggaaaggttaggaaagatattcctcaatgggaacccagcaaaggatggaacgattggcaacaagtgcctttctgttcccatcactttcatcaactaatcatgaaagatggtagagagatcgttgtaccatgtagaaatcaagatgaattagtaggacgtgctagagtcagtcaaggggcaggttggagtttgagagaaacagcctgccttggaaaaagttatgctcagatgtggcaattgatgtattttcatagacgagacctcagattagcagcgaacgccatttgttcagctgtccctgtcgactgggtgccgacatcgagaaccacttggagtattcatgcacaccatcaatggatgactacggaagatatgttaagtgtttggaatagggtatggatcgaggaaaacccgtggatggaagataagacacatataagtagttgggaagatgtcccctacttaggtaaaagggaggaccaatggtgcggtagtctgattggattaaccgcaagagcgacctgggccacaaatattcaagtagccataaaccaagtaagaagattaataggaaacgaaaattacttagattacatgacatcaatgaagagatttaagaatgaaagcgaccccgagggtgcactatggtaa

SEQ ID NO: 22051 - RNA, 9879 nt, synthetic construct
  misc_feature 1..9879: note = derived and/or modified CDS sequence (opt6) from DENV-1__KC762650__SS-prME
  source 1..9879: mol_type = other RNA
tcagtaactatgctgttaatgttaatgcctacagcattagcatttcacctcactacacgtggaggagaaccacatatgattgtatctaaacaagagagaggaaaaagcctattgtttaaaacaagtgcaggggttaatatgtgtacacttattgcaatggatcttggagaactttgcgaagacacacttacgtacaaatgcccaaggataacagaagcagaacctgacgatgtggattgctggtgcaacgccactgatacatgggtaacttacggaacatgcagtcagacgggagaacaccggagggataaaagatcggtagcactcgctccacatgtgggacttggactagaaaccagaactgaaacttggatgtcatccgaaggtgcttggcgacaaattcagcgagttgaaacgtgggctctccgacatcctggttttacggttatagcattattcttagcgcacgcaataggaacaagtatcacacaaaaaggtattatatttatcctattaatgcttgtgactccttctatggcaatgcgatgtgtaggtatagggtcacgagattttgtggaaggactttcaggagctacctgggtagacgtagtattagaacatgggtcttgtgtaacaacaatggctaaagataaacccacgttagatatagagttgctgaaaacagaggtaactaatcctgcagtgttgcggaaattatgcatagaagctaaaatttcaaataccacaacagatagtcgctgtcccactcaaggcgaggcaactctagttgaggaacaagacgcaaatttcgtatgtaggagaacgtttgttgaccgcggatggggtaatgggtgtggcttatttggaaaaggatcacttattacatgtgcgaaattcaaatgcgttacgaaattggaaggaaaaattgtacaatacgagaatttaaaatacagcgtaatagtaacagtacatacaggagatcaacatcaagttggtaacgaatccactgaacatggaaccaccgcaactatcactccccaagctcctacaacagaaatacaattaacagactatggcgcattaacgctggattgttctccaaggacgggcctagattttaatgaaatggtgctactcactatgaaagagaaatcatggttagttcataaacagtggtttctagacttaccactaccgtggacatctggcgctagcacttcacaagagacttggaacaggcaagatctattagttacattcaaaacggcgcacgccaagaaacaagaagttgttgtattaggatcacaagaaggagctatgcacaccgctttgactggcgcgactgaaatacaaacatcaggcacaacaacaatattcgctggtcatttgaaatgtcgcctcaaaatggataaactcacattgaagggcatgtcttatgtaatgtgcacaggtagcttcaaacttgaaaaggaagtagccgaaacacagcacgggacagtcttggtgcagataaagtacgaaggtactgacgcgccttgtaaaataccattctccacacaggatgaaaaaggtgtaactcaaaatggaaggcttataactgcaaatccaatagtaacagataaagagaagccagtcaatattgaagctgaacctccatttggagagtcttacatagttattggagcgggagaaaaagcactaaaattaagttggtttaaaaagggctcctcaataggtaaaatgtttgaggcaacggcgaggggagctcggcgaatggcgattttaggcgacactgcttgggatttcgggagtatcggaggggtattcacttcagtaggaaaattagttcaccaaatattcgggacagcttatggcgtgttattttccggagtcagttggacaatgaagataggaattggcgttctactaacatggttgggactaaatagccgaagcacgtcacttagcatgacttgtattgctgtaggactcgtaacattatacttaggagtgatggttcaagctgattcaggatgtgtgataaattggaaaggaagggaattaaagtgcggatcagggatatttgtaacaaacgaagtgcatacatggacagaacaatataaattccaagctgactcgccaaaaagattatccgcagcaatcggtaaagcgtgggaagagggtgtatgtggtatcagatctgcgacgcgactcgaaaacataatgtggaaacagataagtaatgagctaaatcatatactccttgaaaacgatatgaaatttactgttgttgttggcgacgttgcggggatactagcgcaaggcaagaaaatgattagaccccagcccatggaacataaatatagttggaagtcatggggaaaggcaaagatcattggcgctgacgttcaaaataccacgttcattatagatggccctaatacacccgaatgccccgatgatcagcgtgcctggaatatatgggaagtagaagactatgggttcggtattttcaccacaaacatatggcttaaactcagggactcttatactcaggtttgcgaccatcgtcttatgagcgctgcaataaaagatagcaaagcagtacacgcggacatggggtactggatagagagcgagaaaaatgaaacgtggaagttagcacgggccagttttatcgaagttaaaacttgcatttggcccaaaagtcacacactgtggtcaaatggggttctggaaagtgaaatgataattccaaaaatatatggaggaccaatatctcaacataattataggccaggctatttcacgcaaacagccggtccttggcaccttgggaagttagaattagattttaacttgtgcgaaggaactacggttgtggtcgacgagcattgtggaaatcgcggtcctagcttacggactacaacagttactgggaaaattatacacgaatggtgctgcagaagctgcactctgcctccactacgttttagaggcgaagacggctgttggtacggtatggagatacgacctgtcaaagaaaaggaagaaaacctagtcaagtcaatggtctcggcgggaagtggagaggtagactctttttcgcttggtttactatgcattagtattatgatagaggaagttatgcgttcaaggtggagtagaaaaatgttaatgactggcacactagcagtctttttcttactaataatgggacaactgacttggaatgatttaattagattatgtatcatggttggcgccaacgcaagtgacagaatggggatgggaaccacatacctcgcacttatggcgactttcaagatgaggcctatgtttgcggtaggactcctgttcaggcgactaacctctcgagaagtcctcctattaaccatcggtttgagcctggtagcaagtgtagaacttccgaactcattggaagaattaggagatgggctagccatgggaataatgatactaaagttgttgacagattttcaaagccaccagttatgggctacactactgagtttaactttcatcaagactacattttcactccactatgcttggaaaacaatggcaatggtcttgtcaatcgtttccctattccctttatgtttatctactacaagtcaaaagactacatggttaccagtactgttaggttcacttgggtgtaagccactaaccatgtttttaattgcagaaaataaaatatggggtagaaaatcatggcctcttaatgaaggtataatggcagttggcatagtgtcaatcttgttgagtagcttattaaagaatgatgtaccactagctggtcccttaatagcgggaggcatgttaatagcttgttatgtaatatctggctcgtcggccgatttgtcgttagaaaaagcggctgaggtgtcatgggaggaagaggcagaacacagtggcgctagtcataatatattggtagaagtacaagatgacgggaccatgaagattaaagatgaagaaagggatgacacactaactatcctactcaaagcaacactcctcgccgtcagtggagtataccccctaagcatcccggcaaccttgttcgtgtggtacttttggcagaagaagaaacagagatcaggtgttctctgggacaccccatcaccaccagaagtagaaagagccgtcttggatgatggaatatatagaatcatgcaaagaggcctactcggaagaagccaagttggggttggcgtgtttcaagaaaacgtgtttcatacgatgtggcatgtaaccagaggcgccgtcctaatgtatcaaggaaaaaggcttgaaccatcttgggcttccgtcaagaaagatcttatatcttacggtgggggatggcgtcttcagggatcatggaatacaggtgaagaagtgcaggtaatagcggtagaaccaggcaaaaacccgaaaaatgtccaaactgcgccaggtacatttaaaactccggagggggaagtaggggctattgctctagattttaagccaggtacaagcggttctccgatagtaaaccgggaaggaaagattgttgggttatacgggaacggggtggtaactacgagcggtacgtatgtgtcagcaatcgcacaagcgaaggcttcacaagaaggtcctttaccggaaatagaagatgaggtctttagaaaaagaaacttgacaataatggatctccatccaggctccggaaaaacccggaggtatttaccagcaatagtacgagaagcgataaaaaggaaattaagaactctaattctggcacctacacgtgtcgtagcttcagaaatggcagaagctcttaaagggatgcctataagatatcagaccacagcagtgaagagtgaacatacaggcaaagaaattgtggatttaatgtgccatgccacttttacaatgaggttacttagcccagtacgggtacctaattataacatgatcattatggacgaagcacactttactgatccgagctcaatagcagcaagaggatatataagtacacgagtagggatgggcgaggccgccgcaatttttatgacggcaacccctccaggaagtgtagaagcctttccgcagagcaatgcagttatacaagatgaagaacgagacataccagagcggtcttggaactccgggtatgaatggataactgattttccaggaaaaacggtgtggtttgtaccaagtataaaaagcgggaacgatatagcaaattgcttgaggaagaacggtaagagagtaatacaactatcaagaaaaacgtttgatactgagtaccagaaaactaagaacaacgattgggattatgtagtgacaaccgatatatccgaaatgggtgcaaattttagggccgatagggttatagacccaagacggtgcttgaaaccggtaatactaaaagacggaccagaacgagttattctggccggaccaatgccagtaacagtagcttcggcggcccaaaggcgaggaagagtaggacggaatcataataaggaaggcgaccaatacatctacatggggcaacctctcaataatgacgaggaccacgcacactggactgaggctaagatgctgctagataatataaatacccctgaaggtataatacctgctctatttgaaccagaacgggaaaagtctgcggcaatagatggtgaatataggttacggggcgaagcaagaaagacgtttgtcgaattaatgcgtcgaggcgacttacctgtgtggttaagttataaagttgctagcgagggattccaatactccgatcggcgatggtgttttgacggtgagcgaaataaccaagtgctggaagaaaacatggatgttgaaatttggacaaaagaaggagaacgcaagaaactgagacctcgttggttagacgctcgtacttactcggatcctttagccctgagggaatttaaagaatttgcggcaggtagaagatcagtaagtggggatttaattcttgaaattggaaaattgccccagcatttaactcaaagggctcagaatgcgctagataacctagtgatgcttcacaactcggaacaagggggcagagcttacagacacgctatagaggagcttcctgataccatagagacattaatgcttctagcattaatcgccgtattaacaggaggtgtaacgttattctttctatcagggagaggattaggtaagacttcaattggccttctctgcgttatggcctcgagcgtacttttgtggatggcttccgtcgaacctcactggatagccgccagcataatattagagttctttctgatggtgcttttaatacccgaacctgaccggcagagaacgcctcaagacaaccaactagcttatgttgtaatagggttactttttatgatactcactgtagccgcaaatgaaatgggcctccttgaaaccactaagaaagatctaggcataggccatgtagccgtcgaaaaccatcaccatgccgctatgctagatgtggatctgcacccagcatcagcttggacattgtatgccgtagcaacgactatcataacccctatgatgaggcacactatcgaaaacacaactgctaacatatctcttacagcaatagctaaccaagcagccatattgatgggactagataaaggctggccaatatcgaagatggacattggagtaccgttactggctttagggtgctatagccaggtaaacccactgaccttaaccgcagcggtactaatgttggtagctcactatgccataataggtcccgggttacaagcaaaagccacaagagaggctcagaagagaacagcggcagggataatgaaaaacccgactgtagacggaattgtagctatcgaccttgatccagtagtatatgatgcaaaatttgaaaaacaactgggacaaataatgttgttaattttatgtacgagtcaaattctccttatgcgaacgacctgggcattatgcgaatcaattacattagcgactggtccattgacgacgttgtgggaaggtagtccagggaaattctggaatactacaatagcggtctcaatggctaatatttttcgcgggagttatctggccggagcaggtctagcgttttcgttaatgaagtcactagggggagggagacgaggtacaggcgcacagggtgaaacgctaggtgagaaatggaaacgacaattaaatcaattaagtaaaagtgaatttaacacttacaaaagatccggtataatggaagttgatcgaagcgaagcgaaagagggtttaaagaggggtgaaacaacaaagcatgcggtgtcacgcggaacagcaaaacttcgatggtttgtcgaacgaaaccttgtaaagccagaaggaaaggttatagatttggggtgtgggagaggagggtggtcatactactgtgcaggtttaaagaaagtaacagaagttaaaggctacacgaaaggaggaccaggacacgaagaaccaataccgatggctacatatggctggaatctagtgaaacttcatagcggcaaagatgtatttttcattccacccgaaaaatgtgataccttattgtgtgatatcggagagagtagtcctaatccaactatagaagaaggtcgaacactaagggtactaaaaatggttgaaccatggctcagagggaatcagttctgcatcaagattttaaatccctacatgccatcagtagttgaaactttagagcaaatgcagagaaaacatggaggaatgctcgtcagaaatcctctgagtcggaatagcacccatgaaatgtattgggtgtcttgtggaactggaaatatagtaagcgcagtgaatatgacgtcaagaatgctattaaaccgattcaccatggcacaccgaaagcctacatatgaaagagacgttgatctcggtgcaggaaccagacacgttgcggtcgagccagaagtggcgaacttagatataatcggccagcggatagagaatataaaacacgagcataaaagtacctggcactacgatgaagacaatccatataaaacatgggcataccatggaagttatgaggtcaaaccaagcggctctgctagttccatggttaacggagtagtgaaactgttgaccaagccatgggatgtcataccaatggtaactcaaatagccatgactgatactactccttttggccaacaacgtgttttcaaagagaaagtagacacgcgaactcccaaggcgaaaaggggtacaacacagattatggaggtgactgcaagatggctatggggatttttaagtcgaaataaaaagccgagaatatgtactagggaggaatttacaagaaaagtacgctcgaatgcagcaataggagccgtatttgttgatgaaaaccaatggaatagtgcaaaagaagctgtggaagatgaacgattctgggatttagtacaccgagagagggaattacataaacaaggcaaatgtgcgacatgcgtatacaatatgatgggaaaaagggagaagaaactaggagaatttggtaaggcgaaagggtcacgagcaatctggtacatgtggctgggagcccgattcctagaatttgaagccttggggtttatgaatgaagaccactggtttagccgagaaaattccttatcaggagttgagggcgagggattgcataaattgggttatattttacgagatatctctaaaataccgggtgggaatatgtatgcagacgatacggcgggctgggatacacgtataacagaagacgatttgcaaaatgaagccaaaattacagacattatggaaccagaacatgcgctactagcgaaagccatttttaaattaacatatcaaaacaaagtcgtacgcgtgcagagacccgccaaaaatggaactgtaatggatgtcatatccaggagagatcagagaggctctgggcaagtgggaacatatggcttaaatacattcacgaacatggaagcccagttaattagacaaatggaatctgaagggatattttcaccaagcgaactggaaacaccaaatctagctgaaagagtgcttgattggctagaaaaatatggggtagaaagactaaagcgcatggcaatttcaggagatgattgtgtggtcaagccgatagatgaccggttcgctactgcactcacagccctcaatgacatgggaaaggtacgaaaagatattccgcaatgggaaccttctaaaggatggaatgactggcaacaggtaccgttttgtagtcaccatttccatcaattgatcatgaaggatggaagagaaatagtagtgccgtgtaggaaccaggacgaattggtcggacgtgcgagagtcagtcaaggtgcgggatggtcactcagagaaacggcctgcttaggaaaatcatatgctcaaatgtggcagttaatgtattttcaccgtagagacttgagactagctgcgaatgctatatgttctgcagttcccgttgattgggttcctacttcacggacgacatggagtatacacgcacaccatcaatggatgacgactgaggacatgcttagcgtttggaatcgtgtctggatagaagaaaacccatggatggaagacaagacacacatatcgagctgggaagatgtgccttatttaggaaaaagagaagatcaatggtgtggatccttaattggcttgactgcgagggcaacatgggctacaaatatacaagtggccataaatcaagtgcgcagattaataggaaatgaaaattaccttgattatatgacatcgatgaaaaggttcaaaaatgagtcagatccagaaggagccctatggtaa

SEQ ID NO: 22052 - RNA, 9879 nt, synthetic construct
  misc_feature 1..9879: note = derived and/or modified CDS sequence (opt6) from DENV-1__KC762623__SS-prME
  source 1..9879: mol_type = other RNA
tctgtaactatgttgttgatgctcatgcctacagctttagcatttcatcttacgacgagaggtggggaaccacacatgatagtatcaaaacaagaaagaggtaaatcactgttgttcaaaaccagtgcgggtgttaatatgtgtactcttattgcaatggacctaggagaactgtgcgaagatacacttacgtataaatgtccgaggataacagaagcggaaccagatgatgtagattgttggtgcaatgctacagatacatgggtaacttatggaacatgtagtcaaacaggagaacataggagggacaaaaggagtgtagctctcgcaccacacgtcggactgggtctggaaacacgaacagaaacctggatgtcgtcagaaggagcatggaaacaaatacaacgagtagaaacttgggcacttaggcacccgggtttcacagttatagcattgtttttggctcacgctatcggcacatcaattacccaaaaagggatcatattcatactacttatgcttgttactcctagcatggctatgcgttgtgttggcattggctcacgcgacttcgtagaaggattatcaggagcaacgtgggttgatgtggtcctggaacacggatcatgcgtaacaactatggcaaaagataaaccaactttggacatagaactgttaaaaacggaagtcacaaatccagccgtactgaggaaactgtgtatagaagctaaaatcagcaatactacaacggattcaagatgcccgacacagggagaagcaactcttgtcgaagaacaggacgctaattttgtatgtagaagaacatttgtagacaggggatggggtaatggatgtggactttttggaaaaggaagtttgataacttgtgctaaattcaaatgcgtaagtaaactagaagggaaaatagtacagtatgaaaatttaaagtactcagtaatcgtgacggttcatacaggagatcagcaccaggtcggtaacgaaagcactgagcatggcaccacagccactattactccccaagccccgaccactgaaattcaattaacagactatggagcactcacattagactgcagtcccagaaccggtttagacttcaatgaaatggtccttctcacaatgaaagagaaaagctggcttgtgcacaaacaatggtttctggatctgccattaccttggactagcggggcctctacaagtcaagaaacatggaatagacaggacttacttgttacttttaaaactgcgcatgccaagaaacaagaagttgtagtgctcggaagtcaggaaggtgcaatgcatactgcactaacgggagcaacagaaatacagacttctggaaccactactatatttgcagggcatctgaaatgcagattaaaaatggataaattgacacttaagggaatgtcatatgtaatgtgtactggtagttttaagctggaaaaagaagttgcagaaacacaacacggtacagtacttgtccagataaaatatgagggtacagatgccccatgtaaaatacccttttccactcaagacgaaaagggagtgactcaaaatggaagattgataaccgcaaaccccatcgttacggataaagagaaaccggtgaatatagaagccgagccacccttcggagaaagttatattgtcattggcgctggtgagaaagcgttaaagttgagttggtttaaaaagggctccagcatcgggaagatgttcgaggcaactgcaaggggcgctcggcgaatggctatactcggagatactgcatgggactttggtagtattggcggggtctttacatcagtgggaaaactcgtacaccaaatttttggtacggcatatggagttttattttcgggagtgtcatggacaatgaaaatcgggataggggtcttacttacatggttaggattaaatagccgttccactagcttaagcatgacgtgcatagcagtgggcctagtgacattatacttaggtgtcatggtccaagcggattccggttgcgtcataaattggaagggtagagaattaaaatgtggatcaggcatttttgtaactaacgaggttcatacctggacagaacaatataaatttcaagcagactcacctaaaagactttcggcggcgataggaaaagcatgggaagagggcgtatgtggcatccgaagcgcgactcggttagaaaatataatgtggaagcagatttctaatgaattaaaccatatcctgctcgaaaatgatatgaaatttacggttgtagtgggtgacgtcgctggcatacttgcccagggcaagaaaatgattagaccacaacccatggagcacaaatattcgtggaaatcatgggggaaagcgaaaataataggagccgacgtccaaaatacaacctttataatagatgggccaaatacacccgaatgcccggacgaccagagagcctggaacatttgggaagtagaagattatggatttgggatttttacgacaaacatttggcttaagttacgcgattcttacacccaagtatgcgaccatcgtctgatgagtgctgcaatcaaggattcaaaggcagtacacgcagatatgggttattggatagaatctgagaaaaatgaaacatggaaactggctagggcatcatttatagaagtaaaaagttgtatatggccgaagagtcatactttatggtcaaatggtgtgctggaaagtgagatgattataccgaaaatatatggaggaccaatttctcaacataactatcgtcccggttattttacacagaccgctggaccttggcatctaggcaaactggaactggatttcgatttatgtgaaggtactactgttgtggttgatgaacattgcgggaatcgcggtccttctttgcgtacgacaactgtcaccggaaaaataatacacgagtggtgttgtcgatcatgtacgttgcccccgttgcgttttagaggtgaagatggatgttggtatggtatggaaataagaccagttaaagaaaaagaggaaaatctcgtaaagtccatggtatcagctggatcaggagaagtagactccttttctcttggactcttatgtatttctataatgattgaagaagttatgcgttccagatggtcgagaaaaatgcttatgacgggaacactggccgtatttttcctcctaataatgggccaattaacttggaatgacttaataagattatgtattatggtaggtgcaaatgcatctgaccgtatgggtatgggtacaacgtatctagcgttaatggctacgttcaaaatgaggccaatgtttgccgtggggcttctatttagaagacttacgagcagggaagtcctcttactaaccattggtttaagccttgtagcgagtgttgaattacccaatagtctagaagaattaggcgacggccttgctatgggaataatgatcttaaaactattgacagactttcaatctcaccaactgtgggcgaccttattatctcttacctttattaaaactacgttcagtttacactatgcatggaagacaatggcaatggttttgtcaatcgtaagcctattccccttatgcctctccacaacaagtcaaaagaccacttggctaccagtactactagggtcgctcggatgtaaacctctaactatgtttttgattgcagaaaacaaaatctggggtagaaaatcttggccgctaaatgagggaataatggcggttgggatagtgtcaattctcctgagtagccttttaaagaatgatgtgccactcgcgggtccattgatagcaggaggtatgctcatagcatgttatgttatttcggggtcctcagcagatctatccctagagaaggctgctgaagtttcttgggaggaggaggcagagcatagtggtgctagtcataacattcttgtcgaagtacaggatgatgggacgatgaagataaaggacgaagaacgcgatgacacattgacgatattactgaaagccaccctactagcagtttcaggggtttatccattatcgattccagcaactttattcttatggtacttttggcagaagaagaaacaaaggagcggagttttatgggataccccctcaccacctgaggtagaacgagccgttctagacgacggcatttatcgtatcatgcagcgtggactcctaggacgttcccaagtaggtgtaggcgtcttccaggagaacgtattccacacaatgtggcatgttacaaggggcgcagtattgatgtatcaagggaaacgactagaaccctcttgggcatcggtcaagaaagatctcatcagctatgggggaggctggaggttgcaaggctcatggaacacaggtgaagaagtccaggtgatcgcagttgaacctggcaaaaatccgaagaatgtccaaactgctcctggaacttttaagacgccagaaggtgaagtaggagcgatagcactcgattttaaaccaggaacgtccggttcacctatagtaaatcgtgaagggaagatagtaggattatatggtaatggtgtggtaactacatcgggtacgtacgtgtccgctattgcacaagctaaggcatctcaggagggaccgctaccagaaatagaagacgaggtttttcgaaaaaggaatctaacaatcatggacttacatccaggatcggggaaaactcgacgctatctacctgcaatagtccgagaagctataaaaagaaaattacgaactttaatcttagccccaacgcgagttgtggcgtcagagatggctgaggctttaaaaggcatgcctatacggtaccaaacaacagcagttaaatcggaacatactggaaaagagattgtagatcttatgtgtcatgccacatttacgatgagactattatcccccgtaagagtcccaaattataacatgattataatggatgaagcccactttactgacccaagtagtattgccgcgagaggttatatatcaacccgcgtcggtatgggtgaggcagctgctatctttatgactgccactccacctggctcagtagaagcctttcctcaaagtaacgctgtaatccaggatgaagagagagacatcccagagaggtcatggaactcagggtacgaatggataactgatttccctggaaaaacagtctggttcgtcccatcaataaaatcaggtaatgatattgcaaattgtttacgtaagaatgggaaacgcgtaatacaacttagtcgaaagaccttcgatactgaatatcagaaaactaagaataacgattgggactatgtagtgaccacggacatcagtgaaatgggagcgaattttagagccgatagagtcattgatccaagaagatgcttaaagccggtaattcttaaagatggaccagagagagtgattctcgctggaccgatgcctgtcactgttgcttcagctgctcaaaggaggggtagagtagggagaaatcataataaagaaggcgatcaatatatatatatgggacaaccattgaataatgacgaggaccatgctcattggactgaagctaaaatgctattagataacattaacacacccgaaggaattataccagcattattcgaaccggaaagagagaaaagtgctgcgatagatggagaatacagattacgcggtgaagccagaaaaacttttgtagagttgatgcggcgaggggatttaccagtctggttaagctacaaagtagcaagcgaagggttccagtatagcgatagaagatggtgtttcgatggtgaaagaaataaccaagtcttagaggaaaatatggacgtagagatatggactaaagaaggcgaacgtaaaaagttaagaccaagatggcttgacgctcgaacttattctgatccacttgcactacgagagttcaaagaatttgcagctggacgtagaagtgtgtcgggagacttaatcttagagattggcaaactacctcaacacctaacacagcgggcacaaaatgctctagataatcttgtaatgttacataacagtgaacaaggaggaagggcttatagacatgctatggaagaactcccagacacaattgagaccttaatgctcctagcgttaatagcagtcctaacaggaggtgtgaccttatttttccttagcggacgcggtctaggaaaaacaagtatcggcttattgtgtgttatggccagcagcgtcttgctttggatggcatcagtagaaccacattggatagcggcatcaataatcctggagttctttctcatggtcctgttgataccagaaccagacagacagcgcacaccacaagacaatcaactggcatacgtagtaataggcttgctgtttatgatactgactgtcgcagcgaatgaaatgggtctattagagactacaaagaaagacttaggaataggacacgtcgctgttgaaaaccaccatcatgcagcgatgctcgacgtagatttgcacccagcttccgcgtggaccttgtatgctgttgctaccactattataacaccaatgatgaggcacacaatagaaaatacaaccgcgaacataagtttaaccgccatagctaatcaagctgcaatcctaatgggactagacaaaggatggccaatatctaaaatggatatcggcgtccctctcttagcattgggatgctattctcaagtaaacccgttgactttgacagccgctgtcttaatgcttgtagcgcactatgcaattataggtccaggattacaagcaaaggcgaccagagaagcacagaaaaggacagcagctggaatcatgaaaaacccgacggtagatggcatcgtggctattgacctggatccagtagtatacgatgcaaaatttgaaaaacaattgggacagattatgctacttatattgtgcacgtcgcaaatcttattaatgcgaaccacctgggctctatgtgaaagcattactttagcaactggcccattaaccacactatgggaaggttcacctgggaaattttggaacactacgatagctgtgagtatggcaaatatattcagaggcagctatttagccggtgcaggccttgctttcagtttaatgaaaagtttaggtggagggcgaagaggtaccggcgctcaaggagaaacattaggagagaaatggaaaagacaattaaaccaactcagtaaaagcgagttcaatacttataaaagatctggaatcatggaggtagacaggtcagaagccaaggagggattaaaaagaggagaaaccacaaaacatgcagtttcaagaggtactgcaaaattgcgatggtttgtagaaaggaatcttgtaaagccagaaggtaaggtaattgatttaggctgtggacggggtggatggagttactactgtgctggacttaagaaagtgacagaggttaaaggatacacaaaaggcggtccggggcacgaggaacccattccaatggcgacatatggttggaatctagtgaaattgcatagcggtaaggacgtattcttcatcccaccagaaaaatgtgatacactactctgtgatattggagagagtagtcctaatccaacgatagaagaaggaagaacactgcgggttcttaaaatggtcgaaccatggttacgtggtaatcaattctgtattaaaatattaaatccttatatgccttcagttgtggaaacccttgaacaaatgcagcgcaaacatgggggtatgctagtacgaaatccgttatccagaaacagcactcacgaaatgtactgggtctcatgtggaacagggaatattgtgtccgcagttaatatgacatctagaatgttattgaatagattcacaatggcccataggaaaccaacctacgaaagggacgttgatctaggtgcagggactaggcatgtcgcagtagaacctgaagttgctaatctcgatataatcggacagaggatagaaaacataaaacatgaacacaagtctacgtggcattatgacgaagacaatccatacaagacctgggcatatcatggatcctacgaggtcaagccgtcgggatccgcctctagtatggttaatggagttgtcaagttgttaactaagccttgggatgtaatcccgatggtgacccaaatagccatgacagataccaccccatttgggcaacagagggtgtttaaagaaaaagttgatactaggaccccgaaagcaaaaagagggacaacgcaaataatggaggtcactgcgagatggttatggggatttttaagcagaaataaaaagccacgaatttgcaccagagaggaatttacacgcaaagtgcgaagtaacgccgcgatcggcgcagtgtttgtggacgaaaaccagtggaactcagctaaagaagcggtcgaagacgaacgattttgggatctagttcatagagaaagagaactacataaacagggtaagtgtgcaacctgtgtctacaacatgatgggaaaaagagaaaagaagctcggtgagttcggaaaagcaaagggtagccgagcaatatggtatatgtggttgggagctcggttcttagagtttgaggccttaggattcatgaatgaagatcattggttttcacgagaaaactctttaagcggagttgaaggagaagggctccataaattgggatacatattaagagatatctcaaaaatccctgggggaaatatgtacgccgatgacaccgcaggatgggatacgagaattaccgaagacgatctccaaaatgaagcgaagattactgatattatggagccggagcatgccctacttgcaaaggcaatatttaaacttacgtatcaaaataaagtagtaagggtgcaaagacccgcgaaaaatggtacggttatggatgtaattagcagacgggatcagaggggaagtggacaagtcggaacttacggactaaatacattcacaaacatggaggcacaattaataagacaaatggagagtgaaggaatcttttcaccctcagaactagaaactcctaacttagctgagcgagtcttagattggttggaaaaatacggggttgagagactcaaaagaatggcaatatctggagacgactgcgtagtgaaaccaatcgacgacaggtttgctacagcattgactgccctgaacgatatgggaaaagtccgaaaggacataccgcaatgggaaccatcaaaaggttggaatgactggcaacaagtaccattttgtagtcaccacttccatcagttgattatgaaagatgggcgagaaattgtggtaccttgtagaaatcaagatgagttggtaggcagggcgagagtatcgcagggagctgggtggagcttaagagaaaccgcctgtctcggcaaatcctacgcacaaatgtggcaattaatgtacttccatcggagagatttgagactggctgcgaatgctatatgtagcgccgtacccgtagattgggtacccacctctcggacaacttggtcaattcatgctcatcatcaatggatgacaacagaggacatgctcagtgtatggaaccgggtgtggattgaagagaatccttggatggaggacaaaacacatatttcatcatgggaggatgttccttatttaggcaagagagaagaccaatggtgcggatcactgattgggctaacagcaagagcaacgtgggcaacaaacatacaagttgcaataaaccaagtaagacgtctgataggtaatgaaaactatctagattacatgacatcaatgaagagattcaaaaatgaaagtgatccagaaggagccctatggtaa

SEQ ID NO: 22053 - RNA, 9879 nt, synthetic construct
  misc_feature 1..9879: note = derived and/or modified CDS sequence (opt6) from DENV-1__KC762632__SS-prME
  source 1..9879: mol_type = other RNA
tctgtaactatgttacttatgttaatgccaacagctctcgcatttcacttaaccaccaggggaggtgaaccccatatgatagtctctaaacaggaaaggggtaaaagccttttatttaaaacttcagctggagtaaacatgtgcactctcatagccatggatctaggagaactgtgcgaagatacacttacttacaaatgtcccaggattacggaagcggaaccagatgacgttgactgctggtgtaacgcaacggacacatgggtaacatatgggacctgtagtcaaacgggtgaacatcggcgggataaacgtagtgttgcattggctccgcacgtgggactaggattagaaacgcgaacagaaacctggatgtcaagcgaaggagcatggcgtcaaatgcaaagagtagaaacttgggcgctgagacacccaggttttacagtgattgctctctttttagcgcacgcgattggcacctcgattacgcaaaaagggataatcttcatattattaatgctcgtaactccttctatggctatgaggtgcgtaggcataggatctcgagattttgtagaaggattatccggagccacatgggtagatgttgttctggaacatggttcctgtgtcaccacaatggcaaaggataaacctactctcgatatagagttactaaaaaccgaagtgacaaacccagccgttttaaggaaactttgtattgaagcaaaaataagcaatatcacaacagacagtagatgcccaacccaaggcgaagcaacactggttgaagaacaagatgcaaattttgtctgtagacgaacatttgtggatagaggttggggaaacggctgtggcctttttggaaagggcagcctaataacatgtgcaaaatttaaatgtgttacaaagttggaaggtaaaatcgtacaatatgaaaatctaaaatactccgtaatagtcacagtacatactggagaccaacatcaggtaggcaatgaatcgactgagcacggtacgactgcgactattacaccgcaagcaccaacgactgagattcaacttactgactatggagcgttgacgttggattgctccccacgaactggactagatttcaacgaaatggttttattaactatgaaggaaaagtcatggctagtacataaacagtggttcctagacttgccattaccatggacaagtggcgcttcaacaagtcaggaaacatggaatagacaggacctattagtaacttttaaaacagcgcacgccaaaaagcaagaagtagttgtcctaggtagtcaagaaggtgctatgcacacagcattgacgggcgcaactgagatacaaacgtcaggaactaccacaatttttgcagggcatctcaaatgccgacttaaaatggataaattgacccttaaaggaatgtcttacgtgatgtgtaccggttcattcaaacttgagaaggaggtagctgaaacacaacacggtactgtgttagtccaaataaaatatgaagggactgatgcgccttgtaagattccattttcaacacaggacgagaaaggggtcacacaaaatggaaggttaattaccgccaatccaatagtcactgataaagaaaaacctgtgaatattgaagcagaaccaccattcggcgagtcttacatagttataggggcaggggagaaagccctaaagctatcctggtttaagaaagggtcgtctataggaaaaatgtttgaagctactgcccgtggggcaagaagaatggcaatattaggggatacggcatgggattttggatcaataggcggtgtgttcacaagtgtaggaaagttagtccaccaaatttttggcacagcatatggagttctattttcgggtgtaagctggacaatgaaaatagggatcggagttttactcacgtggttagggctgaatagccgttccacttctttatcaatgacatgtatagccgtaggactggtgacattgtatctgggagtaatggtgcaagcagattcaggttgtgtcattaattggaagggaagagaattaaagtgcggctccggtatttttgtgacgaatgaggtacacacatggactgaacaatataaatttcaagcagattcacctaagcgcctcagtgccgctatcgggaaagcatgggaagagggagtatgcgggataagaagtgctactaggcttgagaatattatgtggaaacaaataagtaacgaattaaatcatattttgctagagaacgatatgaaattcaccgtggtcgtcggtgacgtagcaggcatcttagcacagggcaaaaagatgataagaccccaacctatggaacataaatatagctggaagtcttggggaaaagcaaaaataatcggtgctgatgtgcaaaacacaacttttatcattgatggtccaaacaccccagagtgtccggacgaccaaagggcctggaatatatgggaagttgaggactacgggttcggcatatttacaacaaacatatggctgaaactaagagattcatatacacaagtatgcgatcataggttaatgtctgcagcaataaaagactcaaaagcagttcatgccgatatggggtattggatagaaagcgagaaaaatgagacttggaaactagctagagcttcttttattgaagtgaaaacttgtatttggccaaaatctcatacactttggagcaatggagtgctcgaatctgaaatgataattccgaaaatatatgggggaccaatatcgcagcataattaccgaccagggtatttcacccaaacggcgggcccatggcacttggggaaactggaactagactttaatctctgtgagggaacaacggtcgtcgtggatgaacattgtggaaatcgggggccatcactacgcacaactacagtgacgggaaaaattatacacgaatggtgctgtcgatcttgcacacttccccctttaagatttagaggggaagatgggtgttggtatggcatggaaattagaccagtcaaagaaaaagaggagaatctcgtgaaatcgatggtttctgcaggtagcggagaagtagatagcttctcactagggctcttatgtatatcaattatgatagaagaggtaatgagatctaggtggtcacgtaagatgctaatgactgggacactggctgtgttctttttattgataatgggtcagttgacttggaatgacttaatccggctatgcattatggtcggggcaaatgctagcgatcgcatggggatgggcaccacttatttagctttaatggcaacctttaaaatgagaccaatgtttgcagtgggtctactattccgaaggcttacatcacgcgaagtcttgttactaactattggtctatcacttgtagcgtcggttgaattgcctaatagtttagaggaattaggagatggattagctatggggattatgatactaaaattactaactgattttcagtctcatcaactgtgggctaccctcttgagtctcacatttataaaaacaactttctcattacattatgcgtggaagaccatggcaatggtactctccattgttagtttgttcccattgtgcctctctacaacgtcccagaaaacgacctggctcccagtattgttaggatccctgggatgcaaaccactaacaatgttccttatagcagaaaacaaaatatggggtagaaaaagttggcctttaaatgaaggtataatggcagtagggatagtgagtatactgttatcatcgttactaaagaatgatgttcctttagcaggtcctttaattgcaggcggtatgcttattgcatgttacgttatcagcggaagcagtgctgatttaagtttagaaaaagccgcagaagtcagttgggaagaagaagcggaacatagtggagcaagtcacaacatattagtggaagtacaagacgatggaacaatgaaaataaaggacgaggaaagggatgacactttaactatattactgaaagccacactattagccgtatctggagtctatcccctttccataccggcaacattgtttgtatggtatttctggcaaaagaagaaacagagatctggtgtcctatgggatacgccatcacctcctgaagttgaaagggcagtgctagatgatggaatctaccgtataatgcaaagaggtttactagggagatcgcaagttggagtcggggtttttcaagagaacgttttccatacaatgtggcatgttacacggggcgctgtgctcatgtaccaaggaaaaagactcgaaccatcatgggcatccgttaagaaagatctcatatcctacggtggcggatggaggcttcaaggttcgtggaatacaggagaggaggtacaagttattgcagtagagccgggcaaaaaccctaagaacgtacagacagcgccgggcacattcaaaacgccagaaggggaagtgggtgcaatcgctttagattttaaacccggaacatccggttcaccgatagtcaacagagaagggaaaatcgtaggattgtacggaaacggagtagttacaacatccggaacgtatgtaagtgcaatagcacaggcgaaggcaagtcaggaaggaccactacccgagatagaagacgaagtattccgtaaacgaaatttaaccatcatggatttacatccgggttccggtaaaactcggagatacttgccagccattgtccgagaagctattaaacggaaactaagaaccctaatcttagcaccaacgagagtagttgctagtgagatggcagaggctttaaaaggaatgccaattcgctaccaaactacagctgtaaaatccgaacatacaggtaaagaaatcgtagatttaatgtgccatgcaacttttacaatgcgacttctatcgccagtgcgagtgcctaattacaacatgataattatggatgaggctcactttacggatccgtcaagcatagcagctcgagggtatatcagtacacgagtcggaatgggagaagctgcagcgattttcatgacggctacaccaccaggttcggttgaggctttccctcaatctaatgctgtcatacaagatgaagaaagagacatacccgaaagaagttggaatagtggttatgaatggattactgatttcccaggcaaaacagtgtggtttgtcccaagcataaaaagtggtaacgatattgctaactgcctcagaaagaatggaaaacgagttattcaactaagtcgaaaaacatttgatacagagtaccagaaaaccaaaaacaacgactgggactatgtggtcactacagatatcagtgaaatgggagctaatttccgcgctgacagagtaatagatccaagacggtgtctaaaaccggtaatactgaaagacggaccagagagggttattctagcgggacctatgcctgtaacagtggctagtgctgcccaaagaagaggtcgcgttggaagaaaccacaataaagaaggagaccaatatatatatatggggcaaccgctaaataatgatgaagaccacgctcattggaccgaagcaaaaatgttactagacaatattaatacaccagaaggcataatcccagctctattcgaacccgaaagagagaaaagtgccgccattgacggtgagtacagattacgtggtgaggctcgtaaaacatttgtggaattaatgagaagaggggacctacctgtttggctttcatataaagttgcgtcagaaggtttccaatactcggaccgtcgctggtgttttgacggcgaaagaaataaccaggttcttgaggagaatatggacgtcgaaatctggactaaagagggtgaacgaaagaaattaagacctagatggttagatgcacgtacatattcagatcctttagcacttagagaatttaaagaatttgccgcgggaaggagaagtgtttccggtgacttaatattggaaataggtaaactaccacaacatctcactcaacgagcacagaacgctcttgataatttagttatgctccataacagtgaacaaggagggcgagcttaccgacatgcgatggaagaattaccggacaccattgaaacactaatgttattagcacttatagccgttttaactggaggtgtaacactattctttttatcgggccgtggactagggaaaacatctattggcttactttgtgtaatggcctcgagcgtattactttggatggcatcagtagaaccacattggattgccgccagcatcattctagaatttttcctaatggtcttgttaataccagaaccagaccgacaacgaacgccacaggataaccaattagcttatgttgtaatcggactactgtttatgatcctaacagttgccgcgaatgaaatggggctattggaaacaactaagaaagacctaggtattgggcatgtagcagttgaaaatcaccatcatgccgctatgttggatgttgatttacacccagcctctgcatggaccttgtatgctgttgccacaactatcataaccccaatgatgaggcacaccatcgaaaatacaaccgctaatatatccttaacagctatagccaatcaagcggctatattgatggggctagataaagggtggccaatatcaaaaatggatataggcgttccattattagcactggggtgttacagtcaagtaaacccactcacgctcacagctgctgtgttaatgctagtggcccactacgcaataataggaccgggcttacaagcaaaggccacacgagaagcgcaaaaacgaaccgcagccggtataatgaagaatccgactgtggacgggatagttgcaatagatcttgacccagtcgtctatgatgcaaaatttgaaaagcaattaggtcagataatgctattgatactatgcacttcgcagatcttacttatgcgcactacatgggctttatgcgaatcaataacgttagcaaccggtccactaaccaccttgtgggaaggaagcccaggcaaattctggaacaccaccattgcagtatccatggcaaatatctttagaggatcgtatttagctggagcggggttagcattctccctcatgaagtcattaggaggaggcagaagagggactggagctcaaggagaaacccttggggaaaaatggaaacggcagctaaaccagctgtccaaatcagagtttaacacatacaaaagaagtggtataatggaggtcgacaggagtgaagctaaagaaggattaaagcgtggagaaacgaccaaacacgctgtttcacgcggaacagctaagctaagatggtttgttgaaaggaacttagtgaaaccagaaggaaaggtaattgatttagggtgtggaagaggtgggtggagttactattgcgccggcctaaagaaagtgactgaggttaaaggatacaccaagggtggaccaggccatgaagaaccaattcccatggccacctatgggtggaatctagtcaaacttcacagcggaaaagacgttttcttcatacccccagagaaatgcgatacgctactgtgtgatattggagagtctagtccaaaccccaccatagaagaaggacgtacactacgagtattgaaaatggttgagccctggctaaggggaaatcagttttgtataaagattctcaacccatatatgccaagcgtggtggagacattagaccaaatgcagaggaaacatgggggtatgttagtacgaaatcccctatcacgaaatagcacacacgagatgtactgggtcagctgtggaactggcaatatcgtaagtgcggtcaatatgacttcaagaatgctcttgaatagatttactatggcgcatagaaagccaacctatgaaagagacgttgatctgggagccggaactagacacgtcgctgtagaacctgaagttgccaatctcgacattatcggtcagcgaattgaaaacataaagcatgaacataaaagtacctggcactacgacgaagataacccatataaaacctgggcttaccatggtagttacgaggtcaaaccaagcgggtcagccagttctatggttaacggcgtggtgaaactactaactaaaccatgggatgttatccctatggttacacaaatcgctatgactgatacgacacctttcggtcaacaaagagtgttcaaggaaaaagttgatactcggacgcctaaagcgaaaagaggaacaacgcaaattatggaggtcactgcaagatggctatgggggttccttagtcgaaacaagaaacccagaatttgtactagagaagaatttacaagaaaagtcagaagcaatgctgcaataggtgcggtattcgttgatgaaaatcaatggaactccgcaaaggaagcagtagaggacgaacgattttgggacctagtacatagagaaagagaattgcataagcagggaaaatgtgcaacatgtgtgtataatatgatgggaaaaagggagaagaaattaggggagttcggcaaagcaaaaggctctagagcaatatggtacatgtggttaggcgcaaggtttctagaatttgaggcgctaggttttatgaatgaggaccattggttctctcgtgaaaactcattatcaggggtagaaggagaaggtttacataaactgggatatattctaagggatatatcaaaaatccctggtggtaacatgtacgcggacgacactgcgggatgggacacaagaattacagaggatgacctacaaaacgaggcaaaaataacggacattatggagccggagcatgcactcttagctaaagcaatcttcaaacttacgtaccaaaataaagtggtacgtgtacagaggcccgccaaaaacggtactgtcatggacgtaatatcacgtcgggaccagagaggctctggacaagtaggaacgtatggcctgaacacttttactaatatggaagcccaattgatacgccaaatggaaagtgaaggaatttttagtccatcagagctagagacaccgaacctagcggaacgcgtattggattggttagaaaaatacggggtagaacgtctaaaacgaatggcaatatcaggcgatgattgtgtagtaaaacctattgatgatcgctttgcaacagcgttgacagccctgaacgatatgggaaaagtaaggaaagatataccacaatgggaaccatctaaagggtggaacgattggcaacaagtacctttttgcagccatcatttccaccaactcatcatgaaagatggtagagaaatagtggtaccttgtagaaatcaagatgaattagttggcagggccagagtaagccagggagcaggatggagcctacgcgaaacagcgtgcttgggtaaatcttacgctcaaatgtggcaactaatgtattttcataggagagacctaagacttgcagcaaacgcgatctgctccgcggtaccagtcgactgggtaccgacaagtcgtaccacatggagtattcatgcccatcatcagtggatgacaacagaagacatgctgagtgtctggaatagagtatggatagaagaaaatccatggatggaagacaaaactcacatatccagttgggaggacgtaccttacttagggaaacgagaggaccaatggtgcggtagtttaataggtttgaccgcaagagcgacatgggctaccaatattcaagtcgctataaaccaggtacgcagacttataggaaatgaaaattaccttgactatatgacgtcaatgaagaggtttaaaaacgaaagtgatccagaaggtgctctatggtaa

SEQ ID NO: 22054 - RNA, 9879 nt, synthetic construct
  misc_feature 1..9879: note = derived and/or modified CDS sequence (opt6) from DENV-1__KC762637__SS-prME
  source 1..9879: mol_type = other RNA
tcagtaacaatgcttttaatgctgatgccaacggcattagcttttcacttaacaacaaggggaggagaaccacatatgatcgtgagtaaacaagaaagaggtaaatctttattatttaaaacaagtgcaggagtcaatatgtgtacattaatagcaatggatttaggagaactctgtgaagatactctgacgtataaatgccctagaataacagaagcggaaccagacgatgtggactgctggtgcaatgcaacggatacttgggtcacatacggtacatgttcacaaaccggtgaacaccggagggacaaacgaagtgttgcattagcaccccatgttgggctcgggttagaaacacgcaccgaaacatggatgtcatctgaaggagcatggaaacaaattcaacgggttgaaacgtgggctttacggcacccaggattcactgtgattgctctcttcctggcacacgcaataggaacatcgattacacaaaaaggtataatattcatcttactgatgttagttacgcctagtatggctatgcgatgtgttggaatcggatcacgagactttgtggaaggacttagcggtgcaacctgggtagacgtagtgctagaacatggcagctgtgtgacgaccatggccaaagataaaccaacgctagacatcgaattacttaaaacagaagtaaccaacccagcagtattacgaaaactgtgcatagaagccaaaatatccaatacaacaacggactcccgctgtcccactcaaggagaagcgaccctagtggaagaacaggatgcaaattttgtatgtagaagaacgtttgttgatcgcggatggggtaacgggtgcggattgtttggtaaaggttctttgattacatgcgccaagttcaagtgtgtcacgaaattagaaggaaaaatagtgcagtatgaaaacttaaaatattcggttatagttacggtacatacaggagaccaacaccaggttggaaacgaatctacagaacacggaacaacggctactataacgccacaagctccaacaacagaaattcaactaactgattacggcgcgttaacgctagactgttccccacgaacaggtttagactttaatgaaatggttttgttgactatgaaagagaaaagctggcttgtgcataaacaatggtttctcgatttaccgctcccctggacatcaggagcatccacaagtcaggaaacgtggaatagacaagacctactcgtaacctttaaaacagcacatgccaagaaacaagaagttgttgtccttgggtctcaggaaggagccatgcatacggcactcaccggggctacagaaatacagacaagtggaactacgacaatattcgcaggtcaccttaaatgtaggttaaaaatggataagctaaccctcaaaggtatgtcatatgttatgtgtacgggtagctttaaattagaaaaagaagttgcagaaacacaacatggaacagttttagtacaaataaaatatgaaggaaccgacgctccatgcaaaattccgttcagtacgcaagatgaaaagggagtcactcaaaacggacgccttataacggcaaacccgatcgtaactgataaggaaaagccagtaaacatagaagccgaacccccttttggtgaaagctatatagtcataggagccggtgaaaaagccctgaaactgtcatggtttaagaaaggatcatcaattggaaagatgtttgaagcaaccgctagaggggcacgaagaatggctatcttaggtgatactgcctgggactttggatcaatcggtggggtgtttacaagtgttgggaaattggtacaccaaattttcggaacagcttatggtgtactgttctccggagtttcatggacaatgaaaatagggataggagtacttctaacttggttagggctgaactcgcgatcgacctccttaagtatgacatgtatagccgtgggattagtaaccttatatttgggagtgatggtgcaagcagatagtggatgcgtaataaactggaaaggacgagaactgaagtgcgggtctggaatattcgtcacgaatgaagtgcatacatggaccgaacaatacaaatttcaggcagattcgcctaaacgattgtctgctgccattggcaaggcttgggaagaaggagtgtgtggtatacgatctgccacccgactcgaaaatattatgtggaaacagatatccaacgagttgaaccatatattacttgaaaatgatatgaagtttacagtagtagtgggtgacgtcgccggcatactagcccaaggcaagaaaatgataagaccacaaccaatggaacataagtattcatggaaaagctggggaaaggctaaaattattggtgccgatgtacaaaatacaacattcataatcgatggtccaaatacccccgaatgcccggacgatcaaagagcttggaacatttgggaagtggaagattacggattcggtattttcacaactaatatctggcttaaattaagagacagttacacacaagtatgtgatcaccggttaatgagtgctgcgataaaagactctaaggcggtacacgcggacatgggatattggatcgaatctgagaaaaatgaaacatggaaattagccagagcctcgtttatagaggtcaagacctgtatatggccgaaaagtcataccctatggagtaatggtgtcctcgagagcgaaatgattataccaaaaatttacggaggccctataagccaacataattatcgacccggttattttactcaaacagcaggaccctggcacctgggaaagttagagctagacttcgacctatgcgaagggactacagtagttgtcgatgagcactgtggaaaccgtggaccctcgcttcgtacaactacggtaaccggtaaaataatacacgaatggtgctgcaggagctgcactctaccgcccttacgttttcggggagaagatgggtgctggtacggtatggaaatacgacccgtcaaagaaaaagaagagaatctggtcaaaagtatggttagtgcgggaagtggcgaggttgacagcttctccctcggtctattatgcatcagtataatgatagaagaggtaatgcgaagtagatggtcaagaaaaatgctaatgactggcacgttggcagtattctttttacttataatgggtcagcttacttggaacgatctgatacggctctgcataatggtcggagcaaatgctagtgatcgtatgggaatgggtacaacatatttggcattaatggctactttcaaaatgcgaccaatgttcgcagtgggattattatttcgtcgccttacttcacgagaggtattgttgctgaccatcggcctttcacttgtagcctcagtggaactgccaaactcattagaagagttaggggatggattagccatgggaataatgatcctgaagctactcaccgacttccaatcacaccaattatgggccactttattgtcgctaacattcattaaaaccacattcagcctccattacgcgtggaagactatggcgatggttttatcaatcgttagcctgtttccgctgtgtctgtccacgacatcacaaaagacaacttggctgccagtgttgcttggtagtctaggttgcaaaccactaacaatgttcctcatagccgaaaataagatatggggtcgaaaaagctggccattaaacgagggcatcatggcagtcgggattgtctcaatactattatcatcgttattaaagaatgatgttcctttagcgggcccactaatagctgggggtatgctaattgcatgttatgtcatctcagggtcaagtgctgacctatccttagaaaaagcagcagaagtttcctgggaggaagaagccgaacatagcggggcatcgcacaatatcttggtagaagtacaagatgacggaacaatgaaaattaaagacgaagaaagagatgatacattgacaattttactaaaagcaacactattggcggtaagtggtgtctatcccttaagtataccggccactttattcgtttggtacttttggcagaaaaagaaacaaaggtctggcgtactatgggacaccccgagtccacctgaagtagagcgtgctgtactcgacgacggtatatatcgtattatgcaacgtggcttactaggaagatctcaggtaggcgttggagtctttcaggagaacgtgtttcatacaatgtggcacgtcactagaggcgcagttcttatgtaccaagggaaaagattggaacctagttgggcatcagtaaagaaagatctaatcagttatggaggaggctggagactacaaggcagttggaataccggtgaggaagtacaagtaatagcagttgaaccgggcaaaaaccccaaaaacgtacagactgcaccaggcacgttcaaaacacctgagggggaagttggagccattgctttagactttaaaccagggacaagcggatcgcctatcgttaatcgagaagggaaaatagtgggtctatacggtaacggtgtggtaacgacatcaggaacatatgtaagtgccatagcgcaagctaaagcatcacaggaggggccgcttcctgaaattgaagacgaagtattccgcaaaagaaatctgacaattatggatttacatccgggatcaggaaaaactcgccgatacctaccagctatagtgcgagaagcaataaaaaggaaactcaggacacttatacttgctccaaccagagtagtagctagcgaaatggccgaagcgttaaaagggatgcctatacgatatcaaacgacggcagtaaaatctgagcacaccggtaaggagattgtagatctgatgtgtcatgcgacatttacaatgcgattattaagccccgtaagagtgccaaattataatatgatcataatggatgaagcacattttacagatcctagtagcatagcagcacgcggatatatctcaacaagagtcggtatgggtgaggcagcagcaatattcatgaccgcaactccaccgggaagtgtggaggcttttcctcaatctaacgcggttatacaggatgaagaaagagacatacctgaaagaagttggaactccggttatgaatggataacagatttcccaggaaaaacggtatggttcgtaccctccataaaatcaggaaatgatatagctaattgtctgaggaagaacggtaagagggtcatacaattgtcacggaaaacttttgacaccgaatatcagaaaaccaaaaataatgattgggattacgtcgtcacgactgatatcagtgaaatgggagctaacttccgcgcagacagagtgattgacccacggcgttgcttaaaaccggtcattttgaaagacggaccagaacgggtaatcttagcgggtcctatgcccgtaacagtcgctagcgcagcacaaaggcgtggaagagtaggacggaaccataacaaagaaggagaccaatatatatatatgggtcaaccattgaataacgatgaagaccatgcacattggaccgaagcaaaaatgcttttagataatattaacacaccggaaggcatcataccggctctatttgagccagagagagagaaaagtgcagcaatagatggagagtatcggttaagaggcgaagcgcggaaaacattcgttgaactaatgaggcgaggtgatttacctgtgtggttaagttataaggtagctagcgaaggcttccaatacagtgatagacggtggtgctttgatggggaaagaaataaccaagtactagaagaaaatatggacgtagaaatatggactaaagaaggtgaaagaaagaaattgagaccacgctggctggacgcgcgtacatattccgatccgctagctttgagagaatttaaagagttcgcagctgggcgaagaagtgttagtggagatctaatacttgaaattggaaaattaccccagcatctaacccaacgggcccagaatgcattagataacctagtgatgctacataactcggaacaaggagggcgagcatataggcacgcaatggaagaacttccagatacaatagaaacccttatgttacttgctctcattgcggtattaacaggcggcgttactctattcttcctaagtgggaggggtttgggcaaaacgagcataggtttactatgcgtcatggcatcatcagtcttactatggatggcaagcgtagaaccacattggatagcagcttcgatcatcttagagttcttcttaatggttcttttaatacctgagcctgaccgacaacgtactccacaagataatcaactggcatatgtagtaattggacttttgtttatgatccttacagtagcagccaatgaaatgggtcttttagaaacaactaagaaagacctagggattggacacgtcgcagttgagaatcatcatcatgcggctatgctagacgttgatctacaccccgcatcagcgtggacattatatgcagttgcaactacaattattacaccgatgatgcgtcacacgatcgagaacacgaccgctaatataagtttaacagctatagctaatcaggctgcaattctaatggggttagataaaggttggcctatctccaaaatggatataggagtcccacttctagcactaggttgctactcccaagtgaaccctttgaccctaacggctgcagtattgatgttagtagcgcattacgcgattataggaccaggactacaagctaaggctacgagagaagcacaaaaacgaacggcagcagggataatgaaaaatcctacggtcgatggtatagttgcaattgatttggaccccgtagtgtatgacgcaaaatttgaaaagcaactaggtcagataatgttgttaatattatgcacaagtcagatactgctaatgcggacaacttgggcactatgtgaatcaatcacgttagctacgggtccactaacaactttatgggagggatcacctggaaaattttggaacacaacaattgccgtcagcatggctaatatattcagaggatcatacctggctggggccggcctggcgttcagtttaatgaaaagcctagggggtggaagacgtggtacaggggctcaaggtgaaactctgggagaaaaatggaaacgccaacttaaccaactctctaaaagtgagtttaatacgtacaaaaggtctggcatcatggaagtggatcgatcagaagctaaagaaggtttaaaaagaggtgaaacaacaaaacacgcagtctcacgcggtactgctaaattgcgatggttcgtcgaaaggaatttggtaaagccagaaggaaaagttatcgatctcggctgtggaagaggtggatggtcttactattgcgccggacttaagaaagttactgaggtgaagggatacaccaaagggggaccaggccatgaagaaccaataccaatggccacgtacgggtggaacttggtcaaacttcactcaggtaaagatgtatttttcattccacctgaaaagtgtgacacgttgctttgtgatatcggtgaatcgtcaccgaacccaactatagaagaaggacgtactctacgcgttctgaaaatggtagaaccctggttacgaggaaaccagttttgcatcaaaatattaaatccatatatgccgagtgtggttgaaacacttgaacagatgcaacgtaaacatgggggcatgctcgtgagaaatccactgagtagaaatagtactcatgaaatgtactgggtaagctgtggaactggaaatatcgtaagcgctgttaacatgacatctagaatgcttttaaacagattcacgatggcacatcgcaaacccacttacgaaagagacgtcgatttgggggctggtactagacatgttgcagtagaacccgaagtagccaacttagatataataggacaaaggattgaaaatattaaacacgaacacaaaagtacatggcattacgatgaagataatccatataaaacttgggcctaccacggatcatatgaagtaaagccgtctggatcagcctcgagtatggtcaatggagtcgtcaaacttttaacaaagccgtgggatgtcataccgatggtgacgcaaattgcgatgactgatacgaccccttttggccaacaacgagtatttaaagagaaagtagacactagaacacctaaggcaaaaagagggacgactcagataatggaagtaactgccagatggttgtggggcttcctcagtaggaataagaaaccaagaatctgtacgcgagaagagtttaccagaaaagtacgatcgaacgccgcaataggggctgtctttgtagatgaaaaccagtggaactcggctaaagaagcggtggaagatgaacgattctgggatcttgtacatagagaacgcgagctacataaacaggggaagtgtgcaacttgcgtatacaatatgatgggtaaaagagagaagaaactaggagaatttggcaaagcaaaaggatcgcgtgcaatttggtacatgtggcttggtgcacgctttttagagtttgaggcattaggatttatgaatgaggatcattggttttcccgtgaaaactcactttccggcgtagaaggagagggtctacataaattgggctacatacttcgagatataagcaaaattccaggaggtaatatgtatgcggacgacacagctggctgggatacacgaataactgaagatgatttacaaaatgaggcgaaaatcacagacattatggaaccagaacatgctttattagcaaaggctatattcaagctaacttatcaaaataaggtcgtgagagttcaaagacctgccaaaaatggaactgttatggatgtaataagcagaagggatcagcgcggaagcggacaagtcgggacctatggactaaatacctttacaaacatggaagctcaattaatacgtcaaatggagagcgagggaatcttcagtcctagtgaactggagacccctaatttagcagaacgagtcttagattggctcgaaaaatatggagtagaaagattgaaacggatggcgataagtggagatgactgcgtagtaaagcccatagatgacaggtttgcgactgcactaacagctctaaatgatatgggaaaagtgaggaaggacataccacaatgggaaccctcgaaaggatggaacgactggcaacaagtccctttttgcagccatcattttcaccagctaataatgaaagatggacgtgaaatagtggttccttgtagaaatcaagatgaattagtcgggagagctagagtctcacagggtgcaggttggtcattaagggagacagcctgtctaggcaaaagctacgcccaaatgtggcagctgatgtactttcatcgtcgggatctaaggctagcggcaaatgcaatatgctctgctgtaccagtagattgggttcccacgtcacgaaccacttggtcgatacatgcgcatcaccaatggatgacaacagaagacatgctctcggtatggaatagagtttggattgaagaaaatccctggatggaagataaaacacatatttcatcttgggaagatgttccgtaccttggaaagcgggaagatcaatggtgtggtagcctcataggattgactgcgcgagcgacctgggcaacaaacattcaagttgccataaatcaggtgagaagactgataggtaacgaaaactacctcgactatatgacaagtatgaaaaggttcaagaatgaaagcgatccggagggagcattgtggtga

SEQ ID NO: 22055 - RNA, 9879 nt, synthetic construct
  misc_feature 1..9879: note = derived and/or modified CDS sequence (opt6) from DENV-1__KC762620__SS-prME
  source 1..9879: mol_type = other RNA
tccgtaactatgttgtttatgctactaccaaccgctcttgcattccacttaactacacggggtggtgaaccacacatgatagtaagcaaacaagaaagaggaaaatctttgctatttaaaacgagcgcaggagttaacatgtgcactcttattgcaatggatcttggagaactgtgcgaggatactatgacttacaaatgccccagaataactgaaacagaaccagacgacgttgactgttggtgtaacgcaaccgaaacttgggtaacttatggtacctgctcgcaaactggagaacatagaagagacaaacgaagcgttgcacttgctccacacgttggattagggctagaaactcggacagaaacttggatgagctcagaaggggcatggaaacaaattcaaaaagttgaaacttgggctttaagacacccaggatttactgtaatcgcgttatttctagctcatgccataggaacatctattacgcaaaaaggcatcatatttatacttttaatgctagttactcctagtatggccatgagatgcgtcggtatcggaaatcgagattttgttgaagggctaagtggtgcaacatgggtggatgtagtattagaacacggatcttgtgtgactacaatggctaaagataaaccgacacttgacatcgaacttctgaaaactgaggtgactaacccagccgtgctcagaaaactttgtatcgaagcaaaaatctcaaatacaacaactgacagtcgttgtccaacacaaggagaagcaactttagttgaggaacaagacactaactttgtgtgtcgtagaaccttcgtagataggggatggggtaacggatgcggactatttgggaaaggcagccttattacatgcgcaaaatttaaatgtgttaccaaattggaaggaaaaatcgttcaatacgaaaatcttaaatactcagttatagttaccgtccatactggggaccaacaccaagtcggaaatgaaacgattgagcacggaaccacagctacaataacaccgcaagcacccacttccgaaatacaattaacagattatggtgcactaacactagactgtagtccacgtacaggattagatttcaacgaaatggtattattaacaatgaaagaaaaatcgtggttagtgcacaaacaatggtttttagatttgccattaccctggacaagtggagccagcacttctcaagagacatggaaccgtcaagacctcttagtaactttcaaaacagcacacgccaagaaacaagaagtcgtagttctcggctcgcaagaaggagctatgcacacagctttaacaggcgctacagagatacagacttccggcactacgacaatatttgcgggccatctcaaatgcagactaaaaatggacaaacttacactaaagggagtttcgtatgtgatgtgtactgggtccttcaagttagaaaaagaagtagcagaaacacaacacggcacagtcctagtacaagtaaagtacgagggaacagacgcgccttgtaagatcccctttagcagtcaagatgagaggggagtgatccaaaatgggcgtttaatcacagcaaatccgattgttactgacaaagagaaaccagttaacatagaagcagaacctccatttggagaatcatacatagttgtcggtgcaggagagaaggctcttaagttatcctggttcaagaaaggatcttctatcggtaaaatgttcgaggccactgcacgaggagcgcgaaggatggccatcttgggtgatacggcatgggacttcggatctatcggtggagtcttcacttcagttggaaaacttgtccatcaaatatttggaacggcttacggagtactctttagtggtgtatcatggacgatgaaaataggcattggaatactgctcacatggcttggtttaaacagcagaaatactagcttgtcaatgacatgtattgcggtcgggatggtaacactctacttaggggtaatggtacaagcggattccggctgcgttataaattggaaaggtcgtgaactaaaatgtgggtctggaattttcgtcacaaacgaagtacacacatggacagaacaatataaatttcaagcagattcgccgaaacgactttccgcagcaataggtaaggcatgggaggaaggtgtatgtgggatacgttcggccactcgacttgaaaacatcatgtggaaacagatctccaacgagctcaatcatattttactagaaaatgatatgaagttcaccgtagtagttggcgacgttagtggaatcttggcacagggcaagaaaatgattaggccacaaccaatggaacacaaatacagttggaaatcatggggaaaagctaaaattattggcgcagacgtccagaatacaacattcatcattgatgggccaaacaccccagaatgtccagacaaccaacgtgcctggaatatatgggaagtcgaagattatggcttcggtgtgttcacaactaatatctggctcaagctacgagatagttatactcaagtttgcgatcataggttaatgtcggcggctataaaagatagcaaggccgtacatgctgatatgggatattggatcgaatccgagaaaaacgaaacctggaagttagaaagagcatcatttatagaggttaaaacctgcatatggccgcgatcacatacactttggagtaatggcgtactggaatctgagatgataatcccaaaaacatatggtggtcctgttagccaacacaactatagaccaggttactttactcaaactgcgggaccatggcacttaggaaaactcgaattggactttgatttatgcgaaggaacaacagttgtggtcgatgaaaactgtggcaacagagggccatcattgaggactacaacagtaacaggtaaaattatacacgaatggtgttgtaggtcatgtacactaccgcctttgagatttaaaggggaggatggatgttggtatggtatggaaattagacctgtaaaggaaaaagaggaaaatctagtaaaatcgatggttagcgctgggtctggagaggtagattcttttagtcttggactactatgcattagcatcatgatagaagaagttatgcggagccggtggtctggaaaaatgttaatgacgggtacgttggctgtctttctattgttgactatgggacaactcacttggaatgacttaataagattatgtataatggtaggcgctaacgcgtcagatatgatgggtatgggcacaacttacctagctttaatggccacgtttagaatgagaccgatgtttgcagtcggactgctattccggagactcacatcacgggaagtgctgttactaactgttggcttgtcgctagctgcaagcgttgagctaccaaattcgttggaggaactgggagacggccttgccatggggataatgatgttaaagttactgacggacttccaatcacatcagctgtgggcgactttattgtcacttacatttgtgaaaaccacattctctctccattacgcgtggaagactatggcaatgattttatcaattgttagcttattcccattgtgtttgagcacgacctcacagaaaacaacgtggttaccagtacttttgggcagcttgggctgcaaaccgctcactatgttattgattacagaaaataaaatatggggcagaagaagttggccaataaacgaggggatcatggcaataggtatagtatctatattactaagctcactcctcaaaaatgatgtccctctagcaggacccctcatagccggtggaatgttaatcgcttgttacgttatcagtggaagttccgcagacttatcgctagaaaaagctgccgaagtgtcctgggaggatgaagcagaacactccggagcaagtcacaatattttagttgaagtgcaagatgacgggacgatgaaaattaaggatgaagagagggacgataccctcaccatactattaaaggcaacgctccttgctatttcaggcgtttacccaatgtctataccagcgaccttattcgtatggtatttctggcagaagaagaaacaacgctccggagtgctgtgggatacgccttcaccccctgaggttgaaagagctgtgttagacgatggcatctacagaattttacaacgtggattactaggaagaagtcaggtaggagtcggagtatttcaagagggagtatttcataccatgtggcacgtaacccgaggagcagtcttaatgtatcaaggtaaaagattagaacctagttgggcaagtgttaagaaagaccttatctcatatggaggaggttggagatttcaagggtcttggaatacgggggaagaagtacaagtgatagctgtcgagcctgggaaaaatccaaagaatgtgcaaacaacaccaggcacatttaaaactagcgagggtgaggtaggggcaatagccttggacttcaaacctggtacaagtggtagtccaattgtgaatcgagaaggtaaaatagtcggactctacgggaacggggtagtgactacatcaggaacgtatgtcagcgcaatcgcacaagccaaagctagccaagaaggtccgctaccagaaatagaagacgaagtctttagaaagcgtaaccttacaataatggacctacaccctggttcagggaaaacacggcgttatcttcctgcaatactaagagaagccatcaagcgaaagttgcggacattagtactagcaccgacccgtgtggtagcatcagaaatggcagaggcacttaagggaatgcccatccgttatcaaacaacagcagtcaaaagtgaacatacgggcaaggaaatagtagatctgatgtgtcacgcgacgtttaccatgagactgttgagtccagttagggttcctaattacaacatgatcatcatggatgaggcacacttcaccgatccggcaagtattgcagcaagaggttacataagtaccagagtcggaatgggggaagcagcagcaatattcatgactgctacacccccaggctccgtagaagcattcccacaaagcaatgcggtaattcaggatgaagaacgagatatcccggaaagatcatggaactctggatacgactggataaccgacttcccgggaaaaaccgtatggtttgttccaagtatcaaaagtggtaacgacatagctaattgcctaaggaaaaatggcaaaagagttgtacagctatctcgcaaaacattcgacactgagtatcagaaaacgaaaaacaacgattgggactacgtggtgaccaccgatattagcgaaatgggggccaattttagagccgacagggtgatagatcctagacgatgtttgaagccagttattctaaaggacggtccggaaagggtaatcctagctggaccaatgcctgtaaccgtcgcatcagcagcacaaagacgaggaaggatcggacgtaattcaaacaaggagggcgatcaatatgtttatatgggacaaccactcaataatgacgaagatcatgctcattggaccgaagcaaagatgttattggataacataaacaccccagaagggataattccagcgctttttgaaccagaaagagagaaaagcgcggctatagacggcgaatacaggttgagaggggaagcaagaaagacatttgtagaattaatgagaagaggggatttgccagtgtggttaagttacaaagtagcgagcgagggattccaatattcagatagacgatggtgttttgatggggaacgtaataatcaagtattagaagaaaacatggatgtagaaatatggaccaaggagggagaaaggaaaaagctacgtcctcgctggctcgacgctcgcacgtatagcgatcccctagcactcagagagttcaaagaatttgcggctggtagacgtagcgtatctggcgacttaatattagaaataggaaaactaccacaacacttaacccaaaaggcccaaaatgcattagacaatctagttatgctccataacagcgaacagggtggaaaagcatacagacatgcgatggaggaactacccgatacaattgaaacattaatgcttctcgcgctaatcgccgtgttaacaggaggtgtaacattattctttctatcaggtcgcggattgggaaaaacgtctatagggcttctctgtgttatggcctctagtgcattattatggatggctagcgttgaaccgcattggatagccgcttcaataatattagagttctttttaatggtattactcatacctgagcccgacagacaaagaactccccaagataaccaactcgcatatgttgtaataggacttttgttcatgatattaaccgtagcagcgaatgaaatgggtcttcttgaaactaccaagaaagatctaggaatcggacatgctgccgcagagaaccaccaccacgccgcgatgctggatgtcgatcttcaccccgcatcggcatggacactatatgccgtagctacaaccatcataacacctatgatgaggcatacaattgaaaacacgacagctaatatttccttaaccgcaatagccaatcaagctgccatattaatgggtctcgataaagggtggcccatatcaaagatggacatcggtgttccgctactggcactcggatgctacagtcaagtcaatccactaaccttaactgccgctgtattgatgttagtcgcacattacgccattatcggacccggactacaagctaaggccacaagagaagcgcaaaagaggacagcggcaggaataatgaaaaaccctactgtagacggcatagtagcaattgatcttgatccagtcgtatacgatgctaaatttgagaaacagctaggccagattatgttactgatcttgtgcacctcacaaattttgctaatgagaacgacatgggcattatgcgagtcaataacattagcaacgggaccgctcacgactctgtgggagggaagcccaggaaaattctggaacacgacaatagcagtctcaatggcgaatatctttcgaggcagctacctagccggagctggactagcatttagtttaatgaagtcactaggaggaggaagaaggggtactggagctcagggggagacactcggtgaaaaatggaaacgacaactaaatcaactttctaaaagcgagttcaatatatacaaaaggtccggaataatggaagtagatcgaagcgaagccaaagagggactaaaacgaggtgaaactacaaaacatgcagtcagtaggggtactgcgaaactgagatggtttgttgaacggaacttagtcaaaccagaaggaaaggttatagacctcgggtgtggaagaggcggatggtcgtattactgtgcagggctaaagaaagtaacggaagttaaggggtacacaaaaggaggacccggccatgaagaaccagtaccgatggcgacatatggctggaacttagtaaaattgcactcgggcaaggacgttttcttcactcctcctgaaaagtgtgatactttattatgcgatattggagagtccagtcctaatccaacaatcgaagaaggaagaacactacgcgtactaaagatggtggaaccttggctacgaggaaatcaattttgcataaaaatcctcaatccgtatatgccatcagtggttgaaactttagaacaaatgcaaagaaaacatggcggtatgctggttagaaatccactatccagaaacagtacacatgaaatgtactgggttagttgtggcacgggcaacatagtctctgcagtaaatatgacaagtcgaatgctattaaacagatttacaatggcgcatagaaaacccacttatgagaaagatgtagacctcggagccggaactagacacgttgcagttgaacccgaggtggcaaatctggatataataggtcagagaatagagaatatcaagaacgaacacaaaagtacttggcattatgatgaagacaatccttataaaacatgggcgtatcacggaagttatgaagtcaaaccatcagggagcgcgagttcaatggtcaacggagtcgtaagactcctcacaaaaccatgggacgtaataccgatggtcactcaaatcgcaatgacagacacaaccccttttggccaacagcgagtattcaaggagaaagtagatactaggacaccaaaagcaaaacgcggtactgcacaaataatggaggttactgctaaatggctgtggggatttctatcccgcaataagaaaccacgcatttgtacacgcgaagaatttactcgaaaggtccgcagtaatgctgcaataggtgcagtatttgttgatgaaaaccagtggaacagtgccaaagaagcagtagaggatgaaaggttttgggacttagtacatagagaaagagaattgcacaaacaaggtaaatgtgctacgtgcgtctataacatgatgggaaaacgggaaaagaaactaggggaatttggcaaagcgaaaggctctagggcaatatggtacatgtggctaggggccaggtttttagagtttgaagcgttgggatttatgaatgaagatcattggttttcgagagaaaattccctttcgggtgttgaaggtgaaggtttacataaacttggctatatactaagagacatttctaaaatacctggtggaaatctatatgcagatgacaccgctggctgggatacccgaatcaccgaggacgatttacaaaacgaagccaaaatcactgatataatggaaccagaacatgcgttacttgctacctcaatctttaaattaacatatcaaaataaagtcgttagggtgcaacggccagcgaagaatggaacagtaatggacgtaatttccagaagggatcaaaggggcagtggtcaggtcgggacatatggtttgaatacattcacaaatatggaagcccaactaattagacagatggagagtgagggtatatttagtccatccgaactagaaactccgaacttggcaaagcgagtcttagactggcttgagaaacacggtattgaacgactaaagcgcatggctatcagtggagatgactgtgtagttaaaccgatcgatgatcgctttgccacagcgttgacggcactaaatgatatgggcaaagtacgtaaagacataccacaatgggaaccctccaaaggttggaacgattggcaacaagtaccgttttgtagccaccactttcatcagttaattatgaaagatggacgagaaatcgtagtcccatgcaggaatcaagatgagcttattggtagagctcgtgtcagccagggagccggttggtcgttgagggaaactgcttgtctaggaaaaagttatgcacaaatgtggcagctcatgtactttcaccgaagagatcttcgtttggcagcaaacgcaatctgctcagcagtccccgtcgattgggtccccacgagcaggaccacatggagcattcatgcgcaccatcaatggatgacgaccgaagatatgttatcggtatggaaccgcgtctggattgaggaaaacccgtggatggaggataaaactcatgtatcatcatgggaagatgttccgtacctcggtaaaagagaagatcaatggtgtgggagcttaataggcctcacagcccgggcgacatgggccagtaacatccaggttgcaattaatcaagttaggcggctcataggaaacgagaattatctagactacatgacaagtatgaaacgtttcaaaaatgaatctgatcccgaaggagcgctgtggtag

SEQ ID NO: 22056 - RNA, 9879 nt, synthetic construct
  misc_feature 1..9879: note = derived and/or modified CDS sequence (opt6) from DENV-1__KC762631__SS-prME
  source 1..9879: mol_type = other RNA
tcagttaccatgttgctgatgttgatgccgactgccttagcttttcatttgactactaggggaggggagccacatatgacagtgtccaaacaagaaagaggtaaaagccttttattcaaaacaagcgcaggagtcaatatgtgcacactgatcgcaatggaccttggcgaattatgcgaagatacgttaacatataaatgcccacgaataactgaagcggaaccagatgatgttgattgctggtgtaatgccaccgatacctgggtaacatatggtacttgcagtcaaactggtgaacataggagagacaaaagatcagttgctctagcaccccacgttggactaggattggaaacgagaacagaaacatggatgtcaagcgaaggggcttggaaacaaattcagagggttgaaacgtgggcattacgtcacccaggctttacggtaatagcactatttcttgcgcatgccataggtacttcaattacacaaaaaggaataatatttattttacttatgcttgttacaccatcaatggcaatgcgctgcgtaggaattggcagtcgagatttcgtagaaggattaagtggggcgacatgggttgatgtcgtattggaacatggaagttgcgtaacaacaatggccaaagataaaccaacattggatatagagctactaaaaacagaagtgaccaatccagcagttttaagaaaactgtgtatagaagcaaagatttctaacacaaccacagatagtcgttgccccactcaaggggaggcaacccttgtcgaagaacaagatgcaaacttcgtgtgccgccgaaccttcgttgatagaggatggggcaacggatgtggcttatttggaaaaggtagtctcataacctgcgctaaatttaagtgtgtaacaaaactagaaggcaagatcgttcaatacgaaaacctaaaatattctgttatcgtaacagtacataccggagatcagcaccaagtcggaaacgagtcgacagaacacggtacgaccgcaaccatcacaccgcaagcacccaccactgaaatacaactaacagattatggagcacttactttagactgcagcccccgcactggactagattttaatgaaatggtcttgttaaccatgaaagaaaaatcctggctagtccacaaacagtggtttttagacctacctctaccatggacttccggcgcgagcacatcacaggaaacatggaatcgccaggatctacttgttacatttaaaacggcacacgcgaagaaacaagaagtcgttgtcttagggtctcaagagggtgccatgcacacagcattaactggagccaccgaaatacagacctccggaactacaacaatctttgccggacatttaaaatgcaggctaaaaatggataagctaacactaaagggaatgagctacgtaatgtgtacaggatcctttaaacttgaaaaggaagttgctgaaacgcaacatggaacagttctagtacagatcaagtacgagggcacagatgcaccatgtaaaatccctttctctacacaagatgaaaagggagtaacgcagaacggaagattaataacggcaaatccaatagttactgataaggagaaacccgttaatatagaagcagaaccaccattcggtgagtcctatatcgtaattggtgccggagaaaaggcactgaagttatcctggtttaagaaagggagttctataggcaaaatgtttgaagctacagctcgcggagcaagaagaatggcaatcctgggagacactgcatgggactttgggtcgattggaggcgtgttcaccagtgtaggcaaactggtacatcaaatttttggcaccgcgtatggtgtcttattctcgggcgtatcatggacaatgaaaatcggaatcggagttttactgacatggttaggtctaaattccagaagtacctcattaagtatgacatgcattgccgtggggttagttacgttatacctgggagtaatggttcaagcggatagcggatgtgttataaactggaaaggacgtgagcttaaatgtggatcaggtatatttgtaacaaatgaagttcatacatggactgaacaatataaatttcaggcagattcgccgaaacgactttcagctgcgattggaaaagcatgggaagaaggtgtgtgtggaatacgaagtgcaactagattagaaaacattatgtggaagcagatatctaatgagctaaatcacatattattagaaaatgacatgaaatttacggttgtcgtaggagatgtcgcgggaattttagcacaaggcaagaaaatgatacgccctcaaccaatggagcacaaatactcttggaaatcatggggcaaagctaaaataataggagcggacgttcaaaatacaacttttatcatagatggacccaataccccagaatgccctgatgaccaacgggcttggaatatatgggaagtagaagactatggttttggtatatttacaacaaacatatggcttaaacttagagattcatacactcaagtgtgtgatcatagactcatgagtgcagctataaaagacagtaaagcagtacatgcagatatgggttattggatagaatccgagaaaaacgaaacatggaagctagcacgagcgtcatttattgaagtaaaaacgtgcatctggccgaaaagtcatacgttatggagtaacggagtacttgaaagcgagatgataatacccaagatttacggtggtcctatatcacaacataattacagacctggatattttacacaaacagcagggccctggcatttaggtaaacttgagttagattttgatctctgcgaaggcacaactgtggtagttgatgaacactgcggtaatagaggacctagccttcgtacaactactgtaactggaaaaatcatacatgagtggtgttgcagatcatgcacacttccacccctacgattcaggggagaagacggatgttggtacggtatggaaataagacctgtcaaagaaaaagaagaaaatctagtaaaatcaatggtctcagctggaagtggtgaagtagacagtttttcgttaggtcttctttgtataagtatcatgattgaggaggtaatgcggagccgctggagcagaaaaatgcttatgacgggtacattagccgttttctttctgcttatcatgggacaattgacgtggaacgacctgataagactgtgtataatggtgggcgcgaacgcaagtgatcgtatgggaatgggaactacgtacttagcactaatggctacttttaaaatgcgtcccatgttcgctgtaggactcctctttagacgactaacatcacgagaagtattgcttcttacaattggcctatctttagtagccagtgtagagctaccaaactcgcttgaagaattaggagatgggttggcaatggggataatgatccttaaattgttgactgactttcaatcccatcaactgtgggccactctcttatccctaacgtttatcaaaacaacttttagcttacattacgcatggaaaaccatggctatggttctcagtatagtcagcctattcccactgtgtcttagtactacgagtcagaaaaccacatggctacctgtcttgcttgggtcgctcggatgcaagcctcttacaatgttcttgatagcagagaacaaaatttgggggagaaaaagctggccgctgaacgaaggaataatggcagttggtattgtttcaattcttctcagtagcttactcaaaaacgatgttccgctagctggaccgttaatagctggaggtatgctaatcgcatgttacgtcatctccggttcgtctgcggatctctcattagaaaaagctgctgaagtgtcttgggaagaagaagcagagcattcaggcgcgagtcataacatactggtggaggtacaagatgacggcactatgaagatcaaggacgaagaacgagatgatactttaaccattttactgaaagcgacgcttcttgctgtctcgggtgtatatccactttcaataccggcgacacttttcgtgtggtatttctggcagaagaagaaacaaagaagcggagtactgtgggacacaccatcgcctccagaagttgagagggcggtactagatgatggtatatatcggatcatgcaacgcggtttgttgggacgctcacaagttggagttggagtatttcaagaaaacttatttcacacaatgtggcacgtgacgaggggagcggtcttaatgtatcaaggaaaaagattggagccgtcatgggcatcggtgaagaaggacttaatcagttatggtggaggttggagactccaaggatcttggaacacgggcgaagaggtacaagtaatagccgtagaaccgggcaaaaatccgaagaatgtgcaaacggcccccggtacatttaaaacgcctgaaggagaggtaggagctattgcgttggactttaaaccaggaacatctggatcaccaatagtcaatcgcgagggaaagatcgttggcttatatggaaatggagttgtgacaacttcgggaacatatgtaagtgccattgctcaagcaaaggcttcacaagaagggccactgccagaaatagaagatgaagtgtttagaaaaaggaatttaacaatcatggacctccatccaggaagtgggaaaactaggagatatttgccggctatagttcgagaagccataaaaagaaaattaagaaccttgatattagcccctaccagagtagtagcgagtgaaatggctgaggcactaaaaggaatgccgattaggtatcaaactactgccgtaaagtcagaacatacaggaaaagagatagtggacttaatgtgtcacgctacgttcaccatgagattactctcgcctgtacgagttcctaattacaatatgataataatggatgaagcacattttacagatccatcttcaatagcagcacgcggttatattagtaccagggtagggatgggagaggccgcagctatctttatgacagccacccctcccggctccgtagaagcgttcccacagtcgaacgcagtaattcaagacgaagaaagagatatccccgaacgaagctggaatctaggatacgaatggattacagactttccaggcaaaacagtgtggtttgttcctagcattaaaagcggaaatgatattgctaactgtcttcggaaaaacggaaaacgagttatacaactaagcaggaaaacttttgatacggaatatcagaaaactaaaaataatgattgggattacgtggttacgactgacatatcagaaatgggcgctaactttcgagcagatcgagtcatagatccacgtcgatgtctcaaaccagttatcctcaaggatggccctgaaagggtaatcttggcaggccctatgcccgttactgtggctagcgcggcacaaaggaggggtcgagtaggtcgtaatcataataaggagggagaccagtacatatatatgggacaaccactaaacaatgacgaagatcacgctcactggactgaagccaaaatgttactcgacaatatcaacactccagaaggaatcattccggcactattcgaaccagaacgagagaaaagcgcagccatagacggcgaatatcgacttagaggtgaagcacgaaaaactttcgtcgaattaatgcgtcgaggggatctaccggtatggctttcctataaagtcgcttctgaaggtttccagtactcagatagaagatggtgctttgatggtgaaagaaataaccaggtcctagaggagaacatggacgtagagatttggacgaaggaaggagaaaggaagaagttacggccgcgatggctagacgctagaacttattcagatcctctagcacttcgagaatttaaagaatttgcagctggaagaagaagcgtatcaggggaccttatcttagaaatcggcaagctacctcaacacttgacacaacgggcacaaaacgcgctggataacctagtgatgcttcataacagtgaacaaggaggacgtgcctatagacacgcgatggaagaattacctgaaacaattgaaaccctcatgctactagcattgatagcggtacttactggtggtgtaacgctgttctttctatcagggaggggattgggcaaaacaagtatcggcttgctatgcgtaatggcatcatcggtacttttatggatggcaagtgtagagccacattggatcgctgcttccattattctcgaatttttcttgatggtcttacttatcccggaaccggacagacaaagaacaccgcaagataatcaactagcatacgtagttattggtttactcttcatgattttaactgtagcagcaaatgaaatgggtttactagagacaactaagaaagacctgggtattgggcacgttgcggtagaaaaccatcatcatgcagcaatgcttgatgtggatttacatccggcttcggcttggaccttatacgcggtagccacaaccattatcacacctatgatgcgacatacaatagaaaatacaacggctaatatcagtctcacagcaatcgcaaatcaagcagcaattcttatggggttagataaaggttggccaatttctaagatggatataggagttccgttgttagccttaggttgttacagtcaagtaaatccccttactttgacagcagctgtgctcatgttggttgcccattacgcgataattggtccaggactacaagccaaagcaactagagaagcacagaagaggaccgcagcaggaataatgaaaaatcctacggtggacgggatcgttgctatcgatttggatccggtcgtatatgatgctaaattcgagaaacaattgggacaaatcatgttactaatactatgtacatcccaaatactcctaatgcggacgacatgggctttatgtgaaagcataactctagcaactggacctctaacaacattatgggaaggaagcccagggaaattttggaatactaccattgctgtgagtatggcaaatatattcagaggaagttacttagcaggcgccggactagcattctcgttaatgaaatctctaggagggggacgaagaggtacgggagcccaaggagaaaccctgggagagaagtggaaacggcaactgaatcagttgtcaaaaagtgagttcaacacatacaaaagaagtggcatcatggaagttgatcgctctgaagcaaaagaaggacttaaaagaggagaaacaacaaagcacgccgtatcgcgtggaacagctaagctgcgatggtttgtggaacgcaatttagtaaagccagaaggtaaagtgatagacctaggatgtggacgaggaggttggagctattactgcgccggattgaagaaagtaacggaagttaaaggatacacaaaaggaggacctggacatgaagaaccaatcccaatggctacatacggatggaacctcgtgaaacttcactccggaaaggatgtatttttcatacctccagagaagtgtgacacactcctgtgtgatataggtgagtcttccccaaaccctacaattgaagaaggaagaacccttagggtgttgaaaatggtagaaccctggttgaggggcaatcaattctgtataaaaatcttgaatccctatatgcccagtgtagtagagaccttggaacaaatgcaaagaaaacatgggggaatgttagtccgcaatcccctttcacgcaactcaacacatgagatgtactgggtgagttgtggtacgggaaacatcgtatcagcagtgaatatgacatccagaatgctgttaaatagatttacaatggcacatcggaaacctacttatgagcgtgacgttgatcttggggccggtacacgccatgtggcagtcgaaccagaggttgccaacctagatataataggacaacgcatagaaaacatcaagcacgaacacaaaagtacttggcactacgacgaagataacccttacaaaacgtgggcgtaccatggttcctatgaagtgaaaccgagcggaagtgcgtcatcgatggtaaacggcgtagttaaattattaactaagccatgggatgttattccaatggtaactcaaatagcaatgacagacacaacgccatttggccagcaaagggtattcaaagaaaaagtagacactcgtactccaaaggccaaaagaggaacaactcaaataatggaggtaacggcaagatggttatgggggttcttatccaggaataagaaaccgcgcatatgcacgcgagaagaatttacgcgaaaggtaagatcaaatgcagctataggtgccgtattcgtagatgaaaaccaatggaatagcgccaaggaagcagttgaagacgagcgattttgggagttagtgcaccgggaaagagaactgcataagcaaggcaaatgcgcgacatgcgtctacaatatgatgggaaaacgtgagaagaaactcggcgaatttggtaaagctaaaggaagtcgagcaatatggtacatgtggcttggggctcgcttcctggaatttgaagctcttgggttcatgaatgaagatcactggtttagtcgagaaaactcactaagcggtgtagaaggagaaggacttcacaaactcggatacatattaagggacatttctaaaataccagggggaaatatgtacgcagacgacacggcaggatgggacacccgtatcaccgaagatgacttgcagaatgaagcaaaaatcacagatataatggaaccagaacatgccttattagccaaagcaatatttaaactgacttatcaaaataaagtagttagagttcaacgcccagctaaaaacggaacggtcatggacgtaatttctagaagggaccaaagaggaagtggccaggtcggtacatatggattgaatacgttcactaacatggaagcacaactaattagacaaatggaatccgaaggtatattttctccaagtgagctcgagacccctaatctggcagagcgggttcttgactggctcgaaaaatacggtgttgaaagattgaaaagaatggcaataagtggggatgattgtgtagtaaaaccgatagatgataggtttgcaacagcgcttaccgctttgaatgacatgggtaaggttagaaaagatatacctcagtgggaaccaagtaagggatggaatgattggcagcaagttccattctgtagccatcactttcatcaattaatcatgaaagatggaagagaaattgtggtgccatgtcggaaccaagatgaacttgtagggcgcgcacgtgtcagtcaaggggcgggttggtccctaagagaaacagcctgcctaggtaagtcatatgcacaaatgtggcaactaatgtatttccatagacgcgatttacggctagctgcaaacgcaatatgttcagctgtacctgttgactgggtaccaacttctcgaacaacctggagtatacatgcacatcatcagtggatgactacggaagacatgctttcagtatggaatcgcgtatggattgaagaaaatccctggatggaggacaaaacacatattagttcttgggaagatgtaccatacttgggtaaaagggaagatcagtggtgtggcagcttgatcgggttaacagcgagggcaacatgggcgactaacatacaggtggcgataaatcaagtgcgtagacttattggaaatgagaattatctagactatatgacttccatgaaaagattcaaaaatgaatcagaccccgaaggtgcattatggtag

SEQ ID NO: 22057 - RNA, 9879 nt, synthetic construct
  misc_feature 1..9879: note = derived and/or modified CDS sequence (opt6) from DENV-1__KC762621__SS-prME
  source 1..9879: mol_type = other RNA
agtgttacaatgttgctaatgctaatgccgacggctctagcattccacttaaccacgaggggaggagaaccacatatgattgtttcgaaacaggaacgaggaaaatccctactgttcaaaacatcggctggtgtaaatatgtgtacattaatagctatggatttaggggaattatgtgaagatacactaacatataaatgcccacgtatcacagaggcagagccagatgacgtagactgttggtgcaacgcaacggacacatgggtaacatacggtacttgttctcagaccggggagcataggagggacaaaaggtcagtagctttagcaccacatgtaggactaggattagagacaagaaccgagacatggatgtcaagcgaaggagcgtggaaacaaatacaacgtgtagaaacctgggcattgagacacccaggattcacagtcatagcgctatttctggctcacgctataggaactagcatcacccaaaaaggaataatatttatattgttaatgctagttactccatccatggcaatgcgttgtgtggggatagggagtcgtgatttcgtagaaggtctctccggggcaacgtgggtagacgttgtgctagagcatgggagttgtgtaactaccatggctaaagataaacccactttagacatagagttacttaaaactgaagtaactaaccctgctgttttaagaaaattatgcattgaggcaaaaatttcaaatacgacaactgacagtcgttgtccgacacaaggcgaagcaacacttgtcgaagaacaagatgcaaacttcgtatgtagaaggacctttgtggatagagggtggggtaacggatgtggcctattcggaaaaggtagtctaatcacttgcgccaaatttaaatgtgtcaccaaattggaggggaaaatagtacaatatgagaatttaaaatacagtgtaattgtaacagtacatacaggcgaccagcatcaagttggcaacgaaagcacagaacatggaacaacggcgacaattacaccacaagctccaactactgaaatccaattaactgattacggtgcgttaactctggactgcagcccaagaaccggtctggatttcaacgaaatggttttattaacaatgaaagaaaaatcatggctagttcataaacaatggtttttagatctccctcttccttggacttcaggagcctcgacctcccaggaaacttggaatagacaagacttattagttacatttaagacagcccacgccaagaaacaggaagttgtagtacttggtagtcaagaaggagcaatgcacacagcgcttaccggtgcgactgaaatccagacaagtggtacaacgactatttttgcaggacacctaaagtgcagattaaaaatggataaactcactctaaagggaatgtcttatgtgatgtgtaccggaagttttaaactagagaaggaggttgctgaaacccaacatgggacggttctagttcaaataaaatacgaaggtacagatgcaccctgtaaaataccctttagcacacaagatgaaaaaggtgtcactcaaaacggtcgtttgattacagcaaatcctattgtgacagataaggaaaaacctgtcaacatagaggcggaaccaccattcggggaaagctatatcgtcataggcgcaggagaaaaggctcttaaattatcatggtttaaaaaggggtcttccatcggtaaaatgttcgaagccacagctcgtggagcaagaagaatggcgatattaggtgatacagcatgggactttggctcaattggaggcgtattcacctcagtgggcaagctagtacaccaaatatttggaactgcttatggcgtgctgttttcaggagtaagttggacaatgaagataggaatcggagttcttttaacctggcttggcttaaattccagatccactagcttgagtatgacttgtatagcagtaggtttggttactttatatcttggcgtgatggtacaagctgattcaggttgcgtgataaactggaaaggaagagaattgaaatgcggctcaggtatttttgttacaaatgaggttcatacctggaccgaacaatacaaattccaagcagatagccccaaacgattatcagcagccataggtaaagcgtgggaggaaggcgtctgcggcattagaagtgccacaagactagagaatattatgtggaagcaaatcagtaatgaactgaatcacatcttgctagaaaatgacatgaaatttaccgttgtagttggagacgttgcaggcattctagcacaaggtaagaaaatgataagaccacaacctatggaacataaatattcttggaaatcctggggaaaggctaaaataataggagcagacgtacaaaatacaacttttataatagacggaccaaacactccggagtgtcctgatgatcaacgcgcatggaacatatgggaagtagaggactatggtttcggtattttcacaacgaatatctggctaaagttacgagactcgtatactcaagtatgtgaccacagactaatgagcgctgctataaaagattcaaaagctgtccatgcagacatgggatactggattgagagtgaaaagaacgaaacgtggaaattggcacgggccagcttcattgaagtaaaaacctgcatctggccgaaatcccatacattatggtccaatggtgtactagagtcagagatgataattcccaaaatatacggtgggccaacttctcagcacaattatcggccaggttattttacccaaacagcaggtccctggcatttaggaaaattagaattagactttgacttatgtgaaggcacgacagtagtagttgatgaacactgtgggaataggggcccgagcctgcgaacaactacagttaccggtaaaattattcatgagtggtgttgcagaagctgtaccctaccacctcttaggtttagaggcgaagatggctgttggtatggaatggaaatacgaccagtaaaagaaaaggaggaaaatctagtgaaaagtatggtgtcagctggttctggagaagtggattcgttttcactaggactgctatgtatcagtatcatgattgaggaggttatgaggagtagatggagtcgaaaaatgttgatgaccggtacactcgcagtattctttttattaataatgggccaattaacgtggaacgatcttatcagactatgtataatggtaggagccaacgccagcgacagaatgggaatgggcacaacttacttagctttaatggcaacatttaagatgcgccccatgtttgctgtaggcctgctatttaggcgcttgactagccgagaagttcttttgctaacaataggcctcagcttagttgcgtcagttgaactaccgaactcactagaagaattaggggacggattagctatgggaataatgatcctgaaattgttaacagacttccagtcacatcaactttgggctactcttcttagcttaacatttattaaaactaccttttcgttacactatgcgtggaaaacaatggcaatggtactgagcatagtcagtctttttccgctttgtctgagtaccacaagtcagaaaacaacctggctaccagtactcttaggatcactagggtgtaaaccgcttacaatgttccttattgctgaaaataaaatttggggtcgtaaatcatggcctcttaatgaaggtataatggctgtaggtatcgtgagtatacttttgtcttccctactcaaaaatgacgttccgctagctgggcctctaattgcgggtggaatgttgatcgcgtgttatgtgataagtgggagctccgcagacttatcattagaaaaagcagcggaggttagctgggaagaagaggcagaacattccggagcctcgcacaatatcttagtagaagttcaagatgacggtaccatgaaaattaaagatgaagaaagggacgatacattaacgattctattaaaagctaccctgctagctgtaagtggagtctatcctcttagtataccagccactctgtttgtttggtatttttggcagaagaagaagcagagatctggagtcttgtgggacacaccctcaccaccagaagtcgagagagccgtgctagacgacggtatttataggataatgcagagaggtttactaggacgctcacaagtaggtgtgggggtcttccaagaaaatgtcttccatacaatgtggcatgtgacgaggggtgcggtattaatgtatcagggcaaaagactcgaaccttcctgggccagtgtcaagaaggatttaattagctacggtggagggtggcgcctgcaaggcagttggaataccggagaggaggtccaagtgatcgccgtagaacctggtaaaaatcctaagaacgttcaaacagcccctggaacattcaaaacaccggaaggtgaagtaggcgcaatagcgttagattttaaacctggcacctcggggtcacctattgtgaacagggagggaaagatagttgggctatatggtaatggagtagtcacaacaagtggaacctatgtatctgcgattgcacaagcaaaagcatcacaggaaggtcccttaccggaaattgaagatgaagtttttagaaaacggaatctcaccatcatggaccttcaccccggctcagggaaaacccgaagatacttgccagccatagtacgagaagctattaagagaaaactgaggacgctgatcttagcccctacgagagttgtcgcctcagaaatggcagaagcacttaaaggaatgccaatacgatatcaaacaactgctgtaaaaagtgaacatactggaaaagaaattgtagatcttatgtgtcatgcaacctttaccatgcgtctattaagccctgtcagagtccctaactacaacatgattataatggatgaagcccactttacggacccaagcagcattgccgctagaggatacatatctaccagggtcggtatgggtgaggctgcagcaatctttatgacagcgactccacccggatccgtagaagcattcccccaaagtaatgccgtaatccaagatgaagaacgagacataccagagcggtcctggaactcaggttacgaatggataactgattttcccgggaaaactgtatggttcgtgcctagtataaaatcaggaaatgacatagctaattgcttacgaaagaatggaaaaagagttatccaactttcgagaaagaccttcgataccgaatatcagaaaactaaaaataatgattgggattacgtagtaacgacagacataagtgaaatgggggccaacttccgtgctgaccgagtcattgatccacgtcggtgcctaaaaccagtaatcttaaaagatggacctgaaagggtaatactcgcaggaccaatgccagtaactgtcgcgagcgcagcccaacggcgaggaagagttggaagaaaccataacaaagagggcgatcaatatatttatatgggtcaacctctgaataatgatgaagaccatgcccattggactgaagcaaagatgctcttagataacataaacactcccgaaggtatcattcccgcactgtttgaaccagaacgagaaaaatcggcagctatcgatggtgaataccgactccgcggagaagcaagaaaaacttttgtcgaactaatgagaagaggagacctacctgtttggctatcttacaaagttgcttctgaagggttccaatattctgaccggagatggtgcttcgacggagagcgtaataaccaggtgctagaagaaaatatggatgtggaaatatggacaaaggaaggagagcgaaagaaattgagacctagatggcttgatgcgagaacctattccgaccccctagctctgcgagaatttaaagaatttgccgccggcagaagatcggttagtggggatcttattttagaaattgggaaattaccccagcacttaacgcaaagagctcaaaatgcgctcgataacctcgtaatgttacacaattcggaacaaggaggtagggcataccgccacgccatggaagaactcccggacactatagaaactctaatgctactcgcccttatagctgtattaaccgggggcgtgaccctattctttcttagcggtaggggactaggaaaaacttcgatagggcttctttgtgtaatggcgtcgtcagttctcttatggatggcctcagtagagccacattggatagcagcctcaatcattctagagttcttcttgatggtacttttaattcctgaaccggatagacaaagaactccacaagacaaccagttagcatacgtagtaattggactcctgtttatgatattaaccgtagcagccaacgaaatgggtctgttagaaactactaagaaagatctgggaataggttatgtagcggtagagaaccaccaccacgcggcaatgcttgatgtcgatctgcatccagccagtgcctggacattatatgcagtggccacaacaattattacacctatgatgaggcatacaatcgaaaatacaacagcaaatattagcttaaccgctattgctaatcaagcggcaatactaatgggactcgataaagggtggccaatatcaaaaatggacattggtgtaccattattagcactaggatgttatagtcaagtaaacccattaacattaacagccgcggttctcatgctcgttgcacattatgctattataggtccaggtctacaagcgaaggcaactagagaggcacaaaaacgaactgcagctggcatcatgaagaatccgactgttgacggcattgtggcgattgacttagaccctgtcgtgtatgatgccaaatttgagaaacaattggggcagataatgttacttattctatgtacttcacagatattattgatgcggaccacatgggcgctatgtgaaagtattacactagcaacagggcctctaaccacgttgtgggagggaagtccgggaaagttttggaatacaactatagcagtatctatggcaaacatcttcagaggatcatacctagcaggggctggattagcattctcgttaatgaaatcgctaggtgggggtagacgaggcacaggtgcacagggagaaacccttggagaaaaatggaaacgacagctaaatcagttatccaaatcggaatttaacacatataaaagatcagggattatggaggtagatagatccgaggcaaaggagggactaaagagaggcgaaacaacgaagcatgctgtatcccgggggactgcgaagctaagatggtttgttgaaaggaacctagtaaaacctgaaggtaaggttatcgatttaggatgtgggaggggcggatggtcgtactattgcgcgggcctgaagaaggtaacagaggtcaaaggatacacaaaagggggtcccggacacgaagaaccaatacctatggccacgtacgggtggaaccttgtgaaactacactctgggaaggatgttttctttatacccccagaaaaatgcgatacgcttttatgtgacataggagaatcgtcacctaaccccactatcgaagagggtagaactctgagggtactgaaaatggttgaaccgtggctgaggggaaatcaattttgtataaaaatcttgaatccctatatgcctagcgtggttgagactctagaacaaatgcagcgaaaacatggcggtatgttggttagaaatcccctatccagaaactccacgcatgagatgtactgggtaagttgcggcactggcaacatagtctctgcagtcaatatgacctctcgaatgcttctaaataggtttactatggcgcataggaagcccacatatgaacgagatgtcgaccttggtgcgggcacaagacatgtagcagttgaacccgaagtagctaatctcgatattatcggtcaacgtatcgaaaatattaaacatgaacataaatccacatggcattacgatgaagacaacccatataaaacctgggcctaccatggctcgtatgaagtaaagccatccggatcggccagcagcatggtcaacggagtagtcaagttattaacgaaaccatgggacgtaatacccatggttacacaaatcgctatgaccgacaccaccccttttggacagcaaagggtatttaaagaaaaagtggacacacgcacccctaaagctaagagaggtaccacccagattatggaggtaactgcgaggtggctatggggatttttatcaaggaacaagaaaccaaggatatgcacgagagaggagtttaccaggaaagtcagatcaaatgctgctattggtgcggtcttcgtagacgaaaaccagtggaacagcgcaaaagaagccgtagaagatgaaagattctgggatctggtacaccgcgaaagggaattgcacaagcaaggcaaatgcgcaacatgtgtttataatatgatgggcaagcgtgagaagaaactaggggagttcggaaaagccaaagggagcagggcaatatggtatatgtggcttggagccagatttcttgagtttgaagcgctagggtttatgaacgaagatcactggttttcccgggagaactctttgagcggtgtcgaaggagaaggacttcataaacttggatatatcctgagagatatatcgaaaataccagggggaaatatgtatgccgatgatacggctggctgggacactagaataacagaagatgatctacaaaatgaggcgaaaataacagatataatggaaccggaacacgcattactcgcgaaagcaatctttaaactaacatatcaaaataaggttgtccgagttcagagaccagccaaaaacggaactgtaatggacgtaataagcagaagagatcagagaggatcagggcaagtaggaacctatggcctaaatacgttcaccaacatggaagctcaattaatacggcagatggaatcagaaggcatattttcaccatcggaactggagacacccaatctcgctgaaagagtcctagactggctagaaaaatatggagtagaacgtctgaaaagaatggccataagtggagacgattgtgtagtcaagcctatagatgatagattcgctacggctttaactgccttgaatgatatgggtaaagttcgcaaggacatacctcaatgggaaccatctaaggggtggaacgactggcaacaagtgccgttctgctctcaccactttcatcaactcattatgaaagatggaagggaaatcgtagtgccctgtcgcaatcaggacgaacttgtaggtagagctagggtgtcacaaggggctggttggtcactcagagaaacggcatgcctcggaaaatcttatgcgcaaatgtggcaattaatgtatttccataggcgagaccttcgtttagctgccaatgcaatatgtagcgcagttccagtagactgggttcctacatcacgcaccacatggagcatacacgctcaccatcaatggatgaccacagaagatatgctatccgtctggaatagagtatggatagaagagaatccctggatggaggacaaaactcacgtttcatcatgggaggatgtcccttatcttggaaaaagagaagatcaatggtgtggttctttaatcggcttaacagcacgagcaacttgggccaccaatatacaagtggcgataaatcaagtcaggaggctcataggaaacgaaaattacttagactacatgacgagcatgaaaagatttaaaaatgaatctgatccggaaggagcactttggtaa

SEQ ID NO: 22058 - RNA, 9879 nt, synthetic construct
  misc_feature 1..9879: note = derived and/or modified CDS sequence (opt6) from DENV-1__KC762643__SS-prME
  source 1..9879: mol_type = other RNA
tccgtaacaatgttattaatgctaatgcccacagcattagcatttcacctgaccactcgaggaggagaaccacacatgatagtatcaaaacaagagcgaggaaaatcattattgtttaaaacaagcgctggtgtaaatatgtgcacattaattgcaatggacttaggtgaattatgtgaagacacactaacatataaatgcccccgaataacggaagcagaaccagatgatgtagactgctggtgtaatgctactgacacctgggtaacgtatggaacatgctctcagacaggcgagcatagaagggataaaaggagtgttgcattggcacctcacgtcggattaggactcgaaactcgtactgaaacttggatgtcaagtgaaggtgcatggaaacagatccagcgggttgagacctgggctttaagacaccccggattcacagtgatggcactctttctagcccatgcaataggaaccagtataacacaaaaaggcatcatattcatattgcttatgctggtaacacctagtatggcgatgcgctgtgtcgggataggaagtcgagattttgtcgaaggtttatctggggctacttgggtcgacgtcgttttagaacacggctcgtgcgtaacaacgatggcaaaagataaacctacattagacattgagctacttaaaaccgaggttacaaaccctgcagtgctcagaaaactttgtatagaagctaaaatatcaaacacaacaactgattccaggtgtcccacacagggcgaagccaccttggtggaggaacaggatgctaactttgtctgtagaagaacattcgtcgacagaggatggggaaatggatgcggattatttgggaaaggatctcttattacatgcgcaaaattcaaatgtgtaacgaagctagagggtaaaatcgttcagtatgaaaatctgaaatatagcgtaatagtaactgtacatactggggaccaacaccaagtaggcaacgaatccacagagcacggaacaacggctacaatcactccccaagcgccaacaacagaaattcaattgactgactacggggctctgacgctcgattgtagtccacgaaccggacttgactttaacgagatggttctactcactatgaaagaaaagagctggctagtacataaacaatggtttttagatttacctcttccatggacttcgggagcctcaacatcacaagaaacatggaatagacaagacttactggtcacgtttaaaacagcccatgcaaagaaacaagaagtagtcgtgctagggagtcaagaaggagcaatgcataccgccttgaccggagcgacagagatacaaacctcgggtacaacaacgatatttgcaggacaccttaagtgtaggttaaaaatggacaaactaactttaaaagggatgtcatatgtaatgtgtacaggttcattcaagttagaaaaggaagtagcagaaactcaacacggtacagtcctagtacaaataaagtatgagggaacagatgcaccatgcaaaataccattttcaactcaagatgagaaaggcgttacacagaatggtcgtctaataacagcaaatcccatagtaacagacaaggagaaaccggttaacatcgaggcggaaccgccatttggagagagctatatagttataggagccggtgaaaaggcattaaaattgtcatggtttaagaaagggtccagtatagggaagatgtttgaagcaacagcacgtggagccaggagaatggctattctaggcgacaccgcatgggacttcggaagcataggcggagtattaacaagtgtaggcaagttagtgcaccaaatctttggtacagcatatggagtattgttcagtggggtttcttggacaatgaagatcggcataggagttctcctaacctggttgggacttaacagtagatcgactagcctcagcatgacttgcatagccgtaggcctagttacactgtatttaggggtaatggtgcaagccgactcgggttgtgtaatcaattggaaagggagagaactcaaatgcggatcaggtatcttcgtgactaatgaagtccatacgtggaccgaacaatacaaattccaagcagattcaccgaaacgattatccgcggcaataggcaaggcatgggaagaaggcgtatgtggtataagatcagctacacgacttgaaaatataatgtggaagcagataagtaatgagttgaaccatatactattagaaaacgatatgaaattcacagtggtagtaggagacgtggcaggaatattagcccaaggtaagaaaatgatacggccacaacctatggagcataaatatagctggaagtcatggggcaaagctaaaattataggagccgatgtacaaaacacgacgtttattatagatggaccaaacacacctgaatgtccagatgaccaaagagcctggaatatctgggaagtcgaggactatggattcggtatatttacaacgaacatatggttgaaactgagggactcttacacgcaagtgtgtgatcaccgacttatgagcgcagcaatcaaagactcaaaggctgttcatgccgacatgggatactggattgaaagcgagaaaaatgaaacttggaaattagcacgtgcatctttcatagaggttaaaacttgcatatggccaaaaagtcacacattatggtcaaatggagttttagagtctgaaatgatcataccgaaaatttatggaggccccacaagccaacacaattaccgccccggttactttactcaaacagctggtccttggcacttaggaaagctagaactagatttcgacctatgcgaggggacaacagtagtagtcgacgaacactgtggaaacagaggtccatcacttagaaccactacggtaacgggaaaaataatccatgaatggtgttgtagatcctgtactcttcctccactacgatttcgtggtgaagacggctgttggtatggaatggagatccgtccggtaaaagagaaagaagaaaatttagtaaagtcaatggttagtgcaggttcaggcgaagtcgatagtttctccctagggctcctatgcataagcattatgatagaagaagttatgagaagccgatggtcacgtaagatgttaatgacaggtacattagctgtattctttttattaataatggggcaactaacgtggaacgatcttattagattatgcataatggttggagctaatgcaagcgaccgtatgggtatgggaacaacttatctagcactaatggcaacatttaaaatgcgaccaatgttcgcagtcggattgttgttccggagactgacatcgagagaggttttattattaacaataggcttgtcgcttgtggcaagtgtagaattaccgaatagtctggaggaattaggtgacgggctagcaatgggtattatgatactgaagctcctgacggattttcaaagtcaccaactatgggcaaccttattaagcctgacattcataaaaacgacgttttccctacactacgcatggaaaactatggcaatggtgctcagtatagtaagtttattccctctctgtctatcaaccacgtctcagaaaacaacttggcttcccgtattattagggtctttaggctgtaagccattgacaatgtttttaatagccgaaaacaaaatatggggtcgaaaatcttggccattaaacgaaggaataatggcggtgggaatagttagcattttactatcgagtttgctcaaaaatgatgtgcctctagcaggccctctgatagcgggaggaatgttgatcgcgtgttatgtcatttcgggatctagcgctgacttgagtttggaaaaagcagccgaagtttcatgggaagaagaggctgaacactctggtgcgtctcataacattctagtagaagtacaagacgatggtacaatgaaaattaaagatgaggaacgggacgatactctaacaatactgcttaaagcgacacttctagccgtaagtggagtctacccacttagcatccctgcgacactattcgtatggtacttctggcagaaaaagaaacagaggtctggagtcctgtgggatacaccaagtcccccggaagttgaaagagcagtgcttgacgatggaatctatcgaataatgcaaagaggattattgggacggtcacaagtcggggtaggagtatttcaagaaaatgtgttccatacaatgtggcatgtaactagaggagcggtcttaatgtatcaaggaaaaagacttgaaccatcatgggcgtctgtcaagaaagacctaattagctacgggggtggatggagattgcagggttcatggaacactggagaggaagtacaggtaattgctgttgaacctgggaagaatcccaagaatgttcaaacagccccgggtacattcaagacgccggaaggtgaagtaggcgcaatcgccttagatttcaaacctgggacgtctggtagtcctatagtgaaccgagaaggaaaaatcgtcggattatatggtaatggagtagtaactacttcaggaacatatgtttcggctatagcgcaagccaaagcatctcaggaggggcccctgccagaaattgaagatgaggtgtttaggaaaagaaatttaactattatggatttacatccaggatcagggaaaacaaggcgatatttacctgcaatagttagagaagcaatcaaaagaaaacttagaacgctaatactagctcctacacgggtagttgcgagtgaaatggcagaagcactaaaagggatgccaatacgctatcagacaacagcagtcaagtctgagcatactggcaaggagattgtcgatcttatgtgccatgcaacatttactatgagacttttatcaccagttagggtccctaattataatatgataatcatggacgaagctcattttacagatccatcaagtatagcagccagaggatatatttcaactcgtgtaggcatgggtgaagctgctgcaatcttcatgactgcaacacccccaggcagcgtagaggcatttccgcagagcaatgcagtaatacaagatgaagaaagagacataccagagcggagttggaactctggatatgaatggattacagatttcccagggaaaactgtctggtttgtacctagtataaagtcaggtaatgacatcgcaaattgtctgcggaagaatggaaaaagagtaatccaattaagtcgcaagacgtttgatactgaatatcaaaagacaaagaacaatgattgggactacgtagtaactacagacattagcgaaatgggagcgaattttcgcgcagacagagtaatcgatccaaggagatgtttgaagccagtaatcctaaaagatggcccagaaagagttatcctagctgggcccatgcccgtaactgttgcaagtgcggctcaaagaagggggagagttggacgaaatcacaacaaagaaggagaccagtatatatacatgggacaaccattaaataatgatgaggatcatgcccactggacagaggctaaaatgttacttgataacatcaatacacctgagggaataatacccgcgttgtttgaaccggaacgtgagaaatcagccgcaatcgacggagaatatcggttacgaggtgaagccagaaagacatttgtagaactcatgagaagaggtgatctaccggtctggcttagctacaaagtagcttctgaaggttttcagtatagtgaccgtcgctggtgctttgacggggaacgtaataatcaggttctggaagaaaacatggatgtagaaatttggacgaaagagggcgaaagaaagaaactacggccacgttggcttgatgcacgcacatacagcgaccccctagcattacgcgaatttaaggaatttgcagcaggtcgaagatctgtgtcaggtgaccttatactcgaaatcggtaagctcccgcagcatctaacccaacgagcgcaaaacgctttagataatttggtaatgttacataatagtgagcaaggcggcagagcctatcgccatgcaatggaggaactacctgatacgattgagacgttaatgttactagctttaatagcggtgctaacgggcggcgtaacattgttctttctgtccggaagaggactaggaaaaacgagtataggattactatgcgtaatggcatcaagtgtactcctatggatggcatcagtagagccacattggatagcagcctcaatcatattagaatttttcctaatggtactgcttataccggagcctgatagacagagaactccgcaagataatcaattagcgtatgttgtgattggactattgtttatgattctaactgtcgccgcgaacgagatgggcctattagaaaccaccaagaaagatcttgggatcgggcatgtagcagtcgaaaatcaccatcacgcggcaatgctcgatgttgacttacatcccgcgtcagcttggactctatacgccgtagcaacaacgattataacaccaatgatgcgacatactattgagaacacgacagctaatatctcgttaaccgctatagccaatcaggcagctatcctaatgggattggataaaggatggcccatatctaaaatggacatcggtgtgcccttattagctctgggctgttatagccaggtgaatccattgactttaacagctgctgtcctcatgttagtcgcacactacgccataattggacctggtttacaagcaaaagcaactagagaggcacagaagcgcactgctgcaggcattatgaagaatccaacagttgatgggatagtagcaattgacttagacccagtcgtatatgacgctaaatttgaaaaacaattaggacaaataatgctgcttattttgtgtacatcgcaaattctgctcatgagaacgacatgggctttatgcgagagtattacattggcgaccggaccgctgacaacgctttgggagggaagcccaggaaagttttggaatacaaccatcgcagttagtatggcgaacattttccgaggaagttatttagcgggggcaggattggcgtttagccttatgaaatcactaggcggcgggagaagggggacaggtgctcagggagaaactttaggggaaaaatggaagaggcaactaaaccaactgtcaaagagtgaatttaatacatataaaaggagcggaatcatggaggttgataggtcggaagcgaaagagggattgaaacgaggagaaaccacaaaacatgcggtctctcgaggcactgctaaattaaggtggtttgttgaaaggaacctggtaaagccggaggggaaagttatagatctcggctgtggaaggggaggatggtcttactattgtgccggcctcaaaaaggtaacggaagttaaaggatacacaaagggaggacctggacatgaagaacctattcccatggcaacttacggctggaatctcgtgaaactgcacagcgggaaggatgtattcttcatacctccggaaaaatgcgatacacttttgtgtgatatcggcgaaagtagtccgaaccctacaatcgaagaaggtcgaactctaagagtacttaagatggtagagccgtggctaagaggcaatcaattttgcatcaaaatcttgaatccttacatgccctcagttgtagaaacattagaacaaatgcaaagaaagcacggtggaatgttagtacgaaaccctttatcccggaactcaactcacgaaatgtattgggtctcctgtggtaccgggaatattgtctcggcagttaacatgactagcagaatgctactaaatcgatttacaatggctcataggaagccgacatatgaacgcgatgtcgatctgggtgctgggaccagacatgttgcggtagagccagaagtagcaaaccttgatataattggccaaaggatagaaaatataaaacatgaacataagagcacatggcattatgatgaagacaacccctacaaaacgtgggcctatcatggatcctacgaggtcaagccatcagggtcagccagctctatggttaatggtgtagtaaaattattaacaaaaccctgggatgttataccaatggtgacgcaaatagccatgactgacactactccttttgggcaacaaagagtctttaaggagaaagtagataccagaacacccaaggctaagcgaggcactacacaaataatggaagttactgctcggtggctttggggtttcttatctagaaataagaaaccaaggatatgtactcgtgaggagtttattcgaaaagtaagatctaacgctgcaataggtgctgtctttgttgatgagaaccagtggaactccgctaaagaggcggttgaggacgaacgtttctgggaccttgtacatcgggaaagggagcttcataagcaagggaaatgcgcaacctgtgtttataatatgatgggaaaaagagagaagaaactgggagaatttggaaaagcaaagggatctcgagcgatatggtatatgtggttaggagctagatttcttgagttcgaggctttaggatttatgaacgaggatcattggtttagccgagagaatagtttgtcgggagtagaaggcgagggattacataagctcggatatatactacgggacatatcaaagataccaggtggcaatatgtatgcagacgatacagcgggatgggacacccgcataaccgaggatgacctacaaaatgaagctaaaataacagatattatggaaccggaacatgcacttctcgccaaggcgatattcaaactcacctaccagaataaagttgtaagagtacaaagaccagccaaaaatggaacagtaatggacgtaataagtcgcagagatcaaagaggtagtggtcaagtagggacgtatggactaaatacttttacaaatatggaagctcaactaatcaggcaaatggaatctgagggtattttcagtccttccgagttagaaacgccaaatctagctgaacgggtactggactggttagaaaaatatggagtagagaggttaaaacggatggctatctccggcgatgattgtgtagtcaagccaatagacgatcgttttgctacagccttaaccgcgttaaatgacatgggaaaggtccgtaaagatattccgcagtgggaaccgtcaaaaggatggaatgattggcaacaagtacctttttgcagccatcactttcaccaacttataatgaaagatggaagggaaatagtcgtaccctgcagaaatcaggacgaacttgtcggtcgtgcaagagtcagtcaaggagcaggctggagtctaagagagacagcttgcctaggaaaatcatatgcacaaatgtggcagttaatgtatttccatagacgtgatttgcgattagcagctaatgcaatatgtagtgctgtcccagtggattgggttcccacatcaaggacaacttggtcaatacatgctcatcatcaatggatgacaacagaagacatgttaagtgtctggaatagagtatggatcgaagaaaatccatggatggaagataaggcacatgtttcatcctgggaagacgtaccatatcttgggaagagggaagaccaatggtgcggatcgttaattggtcttacggctcgtgccacatgggcaacaaacattcaagtagcaatcaaccaagttcggagactgatcggcaacgaaaattatttggactatatgacatctatgaagagatttaaaaatgaaagtgacccagaaggggctttatggtaa

SEQ ID NO: 22059 - RNA, 9879 nt, synthetic construct
  misc_feature 1..9879: note = derived and/or modified CDS sequence (opt6) from DENV-1__KC762651__SS-prME
  source 1..9879: mol_type = other RNA
agcgttacgatgctatttatgttattaccaacagctttagcttttcatctaacaactagaggaggagaacctcacatgatagtaagcaaacaagaacgcgggaaatccctacttttcaaaacttccgccggtgtaaatatgtgtacattaattgcaatggatttaggagaattgtgtgaagatactatgacgtataaatgcccaagaataactgaaactgaaccagacgacgttgattgttggtgtaacgctacggaaacatgggtaacttatggtacgtgctcgcaaacgggagaacacagaagagataaaagaagtgtagctttagcaccgcacgtgggattaggcctagaaacacgcacagaaacgtggatgagttcagagggagcgtggaaacaaatacagaaagtagaaacatgggcactacgacatcctggatttacggtgattgctcttttcttagcacatgctatagggacaagtattactcaaaaaggaataatatttatcttattaatgttagtgacaccatctatggcaatgcgctgcgtcgggattggtaaccgagatttcgtcgaaggactatcaggagcgacatgggtagacgtggtactggaacatggaagttgcgtcactacaatggccaaagataaaccgaccttagatatagaattgctaaaaactgaagtgaccaatccagccgtacttagaaaactctgcatagaagcaaaaatatctaacactacaactgattctcgctgtccgacgcaaggtgaagctacccttgtggaagaacaagatactaatttcgtatgcagacgaacattcgtagacagaggatggggaaacggctgtggactatttggaaaaggaagccttattacttgtgcaaaatttaaatgtgtaaccaaactcgaaggaaaaatagtccaatacgaaaaccttaaatattcagttatagttacagtacataccggagaccaacaccaggttggtaatgaaactacggaacatggtacaaccgcaactattacaccacaagcgccgacaagcgaaatacaactcacagattatggagcattaacactagactgctcaccgagaacgggattggatttcaatgaaatggttcttctaactatgaaagaaaaatcatggctggttcataaacaatggttcttggatctaccattgccatggaccagtggagcctcgacctcgcaagaaacatggaacagacaagacctacttgtaacttttaaaacagcacatgccaagaaacaggaagttgtagtattaggtagtcaagaaggagcgatgcatacagcactgaccggagcaactgaaattcagacatccggtacaactacaatttttgcgggccacttaaaatgccggcttaaaatggataaattaacactaaaaggtgtttcttacgtgatgtgcactggaagtttcaaactagaaaaagaagtggctgagactcaacatggcacagtattagtacaagtcaaatacgaaggaacagatgcaccatgcaaaataccattcagttcacaagacgaaagaggcgtcatacaaaacgggagactaataactgcgaatcccattgttacagacaaagaaaagcccgtaaatatagaagccgagccacccttcggagaaagctatatcgtcgtaggtgctggtgaaaaggcactaaaactgagttggtttaagaaaggctcatcaataggcaaaatgtttgaagcaacagcccgaggagccagaagaatggctatattaggtgatacagcttgggattttggatctataggaggagtgttcacatcggtaggaaaattagtacaccagatttttgggactgcttacggagtcctgttctctggagtttcttggacgatgaaaatagggattgggattctgttaacatggttgggtcttaactctagatcaacttccctatcaatgacatgtattgcagtcggtatggtaactctgtacctgggagtaatggttcaggctgattcaggatgcgtcataaactggaaagggcgtgagctcaaatgtggtagtggtatttttgtcacaaatgaggtacatacatggactgaacaatataaattccaagctgactcacctaaaaggcttagcgcagcgattggaaaggcatgggaagaaggtgtatgtggaatcagaagtgcaactagattagaaaatataatgtggaagcaaattagcaatgagttgaaccatattttactagaaaacgacatgaaattcacagttgtagtgggagacgtatctggtatcctagcacaagggaagaaaatgataagaccacaaccgatggagcacaaatacagttggaaatcctggggtaaagctaaaattatcggagccgatgtacagaacacaacatttattatagacggaccgaatacgccggaatgtccggataatcaacgagcctggaatatttgggaagttgaagattatggatttggagtctttacaacaaacatttggctaaaattacgtgactcatatacacaagtatgtgaccacaggttaatgagcgctgcaataaaagatagcaaggcagtacatgcagatatgggatactggatagaaagcgagaaaaacgaaacttggaaactcgaaagagcatcattcatagaagtaaaaacctgcatatggccgcgatcgcatacattatggtcaaatggagtactcgaatctgaaatgatcattcccaaaacatacggtggccccgtgagtcagcacaactatagacccggttattttactcaaacggcggggccatggcatttaggaaaactagagttagattttaatctctgcgaaggcacaactgtagtcgtagatgagaattgcggtaatcgtggcccgagcttacgaacaactactgtaacgggtaagattatccacgaatggtgttgtcgatcatgtaccttacctcctttgcgctttaagggcgaggatggttgctggtatggaatggaaataaggccggtaaaagaaaaagaagagaatcttgttaagtccatggtgagtgctggatcgggtgaagtcgatagtttttccctcggtcttttatgtatctcaattatgatagaagaagtgatgagaagcagatggtccggcaaaatgttaatgacaggtacacttgcggtctttttgctcttaacaatgggacaactaacgtggaatgatctcatacgactctgcattatggtaggtgccaacgcatctgacatgatgggtatgggaacaacttaccttgctttgatggcaacattccgtatgagaccgatgtttgctgttggattactgttccgtcggcttacaagtcgagaagtcttattattgacagttggtttgtcgttggtcgctagtgtagaactcccaaacagccttgaagagttaggcgacggtttagctatgggtataatgatgctaaaattgctaaccgattttcagtctcaccaactatgggcgacactactatcgctaacattcgtgaaaacggcgttcagcttacattacgcttggaaaacaatggcgatgattttatctatagtcagtttattccctttatgtttgtcaactacaagccagaaaactacttggttacccgttttattaggatcactagggtgtaagccactaacgatgttactgataaccgaaaataaaatttgggggagacgatcttggcccctcaatgagggaattatggcgatagggatagtatctattcttctgtcatccttactcaaaaacgatgttccattagccggtcccttaatagcaggcggaatgttaattgcatgctatgtaatatcagggtcctcagctgacctttcactggaaaaagcagctgaagtgtcttgggaagacgaggcagagcactctggtgcctcccataacatcctagtagaagttcaagatgacggcacgatgaaaatcaaggatgaagaaagggatgacactttgacaatcttactcaaagcgacattgttagcaattagtggagtataccccatgagcataccagctaccttattcgtatggtatttttggcagaagaagaaacaaagaagcggagtactctgggacaccccaagtccaccagaagtcgaaagggcggtgcttgacgacggcatctacaggattctacaaagagggctattaggaagatcccaagtgggtgtaggagtttttcaggaaggagtatttcatacaatgtggcatgtaacaaggggcgcagtgttgatgtatcaaggaaaaagattggagccgtcatgggcaagtgtcaagaaagatctcattagctatgggggtggatggagatttcaaggatcttggaacacaggagaagaagtacaagtgatagcagttgaacccggcaaaaatcccaaaaatgtacaaaccacacccggtacgtttaagacctctgaaggtgaagtaggcgccatagcattagacttcaaaccgggcacaagcggttcccccatcgtcaatagggaaggcaaaattgtaggattatatggaaatggcgtagtaactacatcaggaacatatgtctctgcgattgcacaagctaaagcatctcaggaaggaccacttccagagatcgaagatgaggttttccgaaaaagaaaccttacgattatggacctccacccaggaagcggcaaaacccgcagatatcttccagctatattgcgcgaggcgataaaaagaaaactaaggaccctagtattagccccaacacgtgttgtagcttcggaaatggcggaggctttaaaaggtatgccgattaggtaccaaacgacggcagttaaatccgaacacactgggaaagagatcgttgacttaatgtgtcacgccacgtttacaatgagattactttcacccgtgagagtccccaactacaacatgataataatggacgaagctcactttactgatccagctagtatcgcggcaagaggttacatttcaacgagagtaggcatgggggaagctgctgcaatttttatgaccgcgactcccccaggctccgttgaggcctttcctcagtcgaacgcagtaattcaggatgaagagagagatataccagagcgtagctggaatagcggatatgactggatcactgactttccaggcaaaacagtgtggtttgtcccatcaatcaaaagcggaaacgatatagctaattgcctgaggaaaaacggaaagcgcgtggttcaattatcaagaaaaacgttcgacacagaataccagaagactaaaaataacgattgggactacgtcgtaacaaccgatatttcagaaatgggagctaactttcgagcagatagagttatagatcctcggagatgcctaaaacccgtaatattgaaagacggaccagaaagagtaatactagccggaccaatgccagtaactgtggcttcggctgctcaaagacgcggcaggatagggcggaatccaaacaaagaaggcgaccaatatgtgtacatgggacaaccgttaaacaatgatgaggaccatgcacactggaccgaagcaaaaatgctgctggataatataaatacaccggagggtattatcccggctctttttgaaccggagagagagaaatcagcagctattgatggcgaatacaggcttaggggtgaggctcgcaaaacatttgtagagcttatgcgtaggggcgacttaccagtctggctttcttataaagtagcatcagaaggattccaatattctgatagacgatggtgcttcgacggagaaaggaacaaccaggtcttagaagagaatatggacgtcgaaatatggactaaggagggagaaaggaagaaattgcgcccgcgatggcttgatgctagaacatattcagatcctttggcactgcgagagttcaaagagtttgcggcgggaagaaggtctgtttccggagatctaattctagaaattggcaaactaccacaacatttaactcaaaaagcacaaaacgcgctggataatttagtgatgcttcataactcggaacaaggaggcaaagcctacaggcatgcaatggaagagttgccggatacaatcgagactttaatgttattagctttgatcgcagtactaacaggtggcgtaactttatttttcttatcaggaagaggattgggtaaaacaagtataggacttctatgtgtgatggcatcttcggccctactctggatggcatcagttgaacctcattggatcgctgctagtatcatactagagtttttcttgatggtactcttaataccggagccggaccgccaacgcacgccgcaagataatcaactggcgtatgttgtgataggactcttatttatgatcctcacagtagcagccaatgaaatgggactactagagacaactaaaaaggatcttggcattgggcatgctgctgctgaaaatcaccatcatgcagctatgctagatgtagatctccacccagccagtgcgtggacgctatacgctgtagcaaccactataataacaccaatgatgagacataccatcgaaaacaccacagccaatatttctcttacggcaatagcgaaccaggcggctatactaatgggcctagacaagggatggccaatctctaaaatggatataggtgtaccgttactagcactcggctgttacagtcaagtaaatccgctgacgttaacagctgctgtattgatgttagtagctcattacgctattataggtcctgggctccaagcaaaagctacgagagaggcacaaaaacgaacagccgccggcataatgaaaaacccgacggttgatggaattgttgccattgacttagatccagttgtctatgacgcaaaatttgaaaaacagttaggacaaataatgttgctaatcctatgtacatctcaaatacttttaatgcgaactacatgggcgttatgcgagtccattacactggcaacgggtcctctaacaactctatgggagggatccccggggaaattttggaatacgacaatagccgtttcgatggctaatatctttcggggtagttacctggccggggcgggacttgcattcagcctcatgaaatcattgggaggaggaagaaggggcacaggagctcaaggagaaacattgggagagaagtggaagcgacagttgaatcaactgtcaaaatcagagttcaacatatataaaagaagtggtataatggaggtagatcgtagcgaggcaaaagaaggactaaagcgcggagaaacaacgaaacatgcagtgtcgcgcggaactgctaaattaagatggttcgttgaacgcaaccttgtaaaacccgaaggtaaagtaattgatcttggatgtggtaggggaggatggagttactattgtgcagggctgaagaaagtcacagaggtgaaggggtacaccaaaggtgggcccggtcatgaggaaccagttccaatggcgacttacggttggaatctagttaaattgcatagtgggaaagatgtatttttcaccccgccagaaaaatgcgacaccttattatgcgatatcggagaaagctcacctaatcccactatagaagaaggaagaactcttcgtgtattaaagatggtcgaaccctggctacgaggcaatcaattctgtatcaagattctaaacccatatatgccatcggtagtagaaaccctggaacaaatgcaacgaaagcacggtggaatgcttgttagaaatcctctatcgcgtaactcgacgcatgaaatgtactgggtaagttgtgggactggcaacatcgtatccgcagttaatatgacgtcaagaatgttgctaaatcgttttacaatggcgcatcgaaaacccacatatgaaagagacgtggacttgggggcagggacaagacatgtagcagtagaaccagaggttgcaaatttggatatcataggtcaaaggatagaaaacatcaaaaacgaacataaaagtacatggcattacgacgaggacaatccgtacaaaacatgggcataccacggatcttatgaagtaaaaccttctggcagcgcatctagtatggtgaacggtgtagtcaggttactaacaaaaccatgggacgttattccgatggtaactcaaattgcaatgactgataccaccccgtttgggcaacaacgagttttcaaagaaaaagtcgatactagaacgccaaaagctaaaagaggtacggcacagataatggaagttacggcgaaatggttgtggggattcctttcacgaaataagaagccaaggatctgtaccagagaagagttcacgagaaaggtgcggtccaacgcagctattggtgctgtattcgtagatgaaaatcagtggaactctgcaaaagaagccgtggaagacgaacgattttgggaccttgtacaccgagaaagggaattgcataaacaaggaaaatgcgcaacatgcgtgtacaacatgatgggaaagcgtgagaagaaattgggagaatttggaaaagccaaagggtcaagagctatctggtatatgtggctaggtgcgagattcttggagtttgaagcacttggatttatgaatgaggaccattggttttcaagagaaaattctttatctggtgttgagggagaagggctacataaacttgggtatatactccgtgatatttcaaagattcctggcggaaacttgtacgcggatgatacagcaggttgggacacccggatcactgaagatgatttacagaatgaagcgaaaataactgatattatggaacctgaacatgccttattagcaacatcgatatttaaattaacataccaaaacaaggttgtacgtgtccaaagaccagctaagaatggcactgttatggacgtcatatcaagacgtgatcagagaggaagcgggcaagttggaacctatggactaaacacattcactaatatggaagcacaactcatccgtcaaatggaatcagaagggatcttcagcccctctgagctggaaacaccgaatttagcgaaaagggtgcttgattggctagaaaaacatggcatagaaagactaaaaagaatggcaatctctggagatgactgtgtggttaagccaatagatgaccgcttcgccacggcgcttacggcactcaacgacatgggtaaagttaggaaagacatcccacaatgggaaccgtcaaaaggatggaatgactggcaacaggttccgttttgttcgcaccattttcatcagctcataatgaaagacgggagggaaatagttgtgccttgtcgaaatcaggacgaactaattggcagagccagagtcagccaaggagctgggtggtcgttgagagaaacagcatgccttggtaaatcatatgcacaaatgtggcagctgatgtattttcatcgcagggatttacgacttgcagcaaacgctatctgctctgcagtaccagtggattgggtacctacgagtaggacaacctggagcatacatgcccatcatcaatggatgacgaccgaggacatgctgagtgtctggaatcgtgtatggatcgaggaaaatccatggatggaagacaaaacacatgtctcatcttgggaagatgtgccttaccttggtaagagagaggaccagtggtgcggctcactaataggtttaacggctagagcaacttgggcttcgaacattcaagtagctataaaccaagtccgcagactaatagggaacgaaaattatctagattatatgacaagtatgaaaagattcaaaaatgaatccgacccggagggtgcattatggtaa

SEQ ID NO: 22060 - RNA, 9879 nt, synthetic construct
  misc_feature 1..9879: note = derived and/or modified CDS sequence (opt6) from DENV-1__KC762653__SS-prME
  source 1..9879: mol_type = other RNA
agcgttaccatgttattaatgctattaccgacagcattagcatttcatctaacaacaagaggaggagaaccacacatgatagtatccaaacaagaacgagggaaaagtctcttattcaaaacaagtgcaggagtaaatatgtgtacactaatagcgatggatttaggagaactttgtgaagacaccatgacttataaatgtccgagaataactgaaacagaaccagatgatgtagactgttggtgtaatgcgaccgaaacatgggttacctacggtacttgttatcaaacaggagaacaccgcagagacaaaagaagtgtcgcattagcaccgcatgtaggtttaggattggaaaccaggactgaaacttggatgtcctctgaaggcgcatggagacaaatacaaaaagttgaaacgtgggcactacgtcatccaggcttcactgtcattgctctgttccttgctcacgcaattggcacttcaataactcagaaaggcataatctttatactactaatgttagttacgccaagcatggcaatgaggtgcgtaggtatagggaatagagactttgtagaaggcctttcaggcgcgacttgggtagatgtggtcttagagcacgggtcatgtgtaaccacaatggcaaaagacaaacccacacttgacattgagctcttaaaaacggaagtgacgaacccggcagtcctacgaaaattatgtatagaggcaaaaatctcgaatacaactacagatagccgatgcccaacccaaggagaggctaccctcgtagaagaacaggataccaactttgtatgtagaagaacttttgtcgatcgtggttggggtaatggatgtggattattcggcaaaggatctttaatcacgtgcgcgaaatttaaatgtgttactaagctagaagggaaaatagtgcaatatgaaaatttaaaatacagcgttatagtaacagtccataccggtgatcagcaccaagttggtaatgagactactgaacacggaactactgctacaataacaccccaagcgcccacaagtgagatacaattaaccgattacggagcacttacactggactgttcccctaggacgggtttagatttcaacgagatggtgctcctaactatgaaagagaaaagttggctcgtacataaacaatggtttctagaccttcctctcccgtggacttcaggagctagcacttcgcaagaaacgtggaatagacaagacttattagtgaccttcaaaactgcccacgcgaagaaacaagaagtggtagtattaggatctcaagaaggagcgatgcatactgctttaactggtgccacagaaatacagacgtcaggaactacaactatttttgcaggtcatttgaaatgtcgcctaaaaatggataagttaactcttaaaggcatgtcatacgtgatgtgtactggatctttcaaacttgaaaaagaagttgctgaaacacaacatggtacagttctagttcaagtaaaatatgaaggtactgatgcaccttgtaaaataccattctctagtcaggacgaaaaaggagtaactcaaaacgggagactaattacagctaatcccatagttactgataaggagaagccagtaaacatagaagcggaacctcccttcggagagtcatatttggtggtaggcgctggggaaaaggcattaaaactctcttggtttaagaaaggctctagcataggaaaaatgtttgaagccactgcaagaggtgcaaggagaatggcaattctaggtgatacagcctgggattttgggtcaataggcggcgtgtttacttcggtaggtaagctgatacaccaaatctttggtacagcttatggtgtactcttttctggcgtttcctggaccatgaagattggaattggcatcttactgacttggttgggattaaactcgcgttcaacatcactctctatgacttgcatagcagtcggtatgataacattgtatcttggagtaatggtacaggcagattctggctgcgtcataaattggaaaggtagagaactaaaatgtggttcagggatctttgtcacaaatgaagtgcatacttggacggaacaatataaattccaagcagatagccccaaacgtttaagcgccgcaatcggaaaagcctgggaagaaggtgtatgcgggatccgttccgcaacgaggctggaaaatattatgtggaaacagataagtaacgagttaaatcacatattgttagaaaatgatatgaaatttacagttgttgtaggtgaagtaaacggaatcctagctcaaggcaagaaaatgataaggcctcaacctatggaacataaatattcgtggaaatcttggggaaaagctaaagttatcggtgctgacgttcagaatacaacatttatcatagacggaccaaatacaccagaatgtccagataatcaacgcgcatggaatatttgggaagttgaggactacggttttggaatatttacaactaatatctggttgaaacttcgcgattcttatacacaggtttgtgatcatagattaatgagcgccgccataaaggatagtaaagcagttcacgccgatatggggtattggatcgaaagcgagaaaaatgaaacgtggaaattagcacgagccagttttatcgaggtaaaaacctgtatttggcccaaaagtcataccttatggagtaatggagtactggaaagcgaaatgataattcccaaaatatatggtggacctatttcccaacataactatcgtcccggatactttacccaaacggccggtccatggcacctcggcaaacttgaactagactttgaattgtgtgaaggtaccacagttgtagttgatgaacactgtggaaacagaggcccgtcattaagaacaaccacggtaacgggaaaaattattcacgagtggtgctgtcggtcctgtacattgccaccgctaaggttcaaaggtgaagatgggtgctggtatggtatggaaatacggcctgttaaagagaaagaagaaaatttagtaaagtctatggtgtcggcggggagtggcgaagtcgattcattttcgcttggattattatgtatttcgataatgatcgaggaagttatgcgttcacggtggagccgaaaaatgctaatgacgggaaccttggcagtgttcttgctcttgacgatgggtcaattaacctggaatgatctaatacgtttatgcataatggtgggagctaacgcaagtgataaaatggggatgggaacgacatatctcgcattgatggccactttcagaatgcgaccaatgctagcagtaggtctgctattccgccggctgacgtcgagggaagtattactgctaaccgttggactcagtttagtagcgtcggtagagttaccaaattcattagaagaattgggggacgggctggcaatgggaataatgatgctgaaactactaactgatttccaaagtcatcagttatgggcagctttgttatcattaacctttgtaaaaacaacattatctctacactatgcatggaagacaatggccatgattctgtcaatcgtaagtttatttccgctctgtctatccacaaccagtcagaaaactacatggcttcctgtgctacttggttcattgggttgcaaacctctcaccatgttcctgataacagaaaacaaaatatggggaagaaaatcatggccattgaatgaaggtatcatggcagttgggattgtgtcgattttactttcaagcctgctaaagaacgacgtaccccttgcagggcctttgatagcaggaggaatgttaatagcgtgttatgtaatttctgggtcctcagctgacctgagcttagagaaagcagctgaagtgagttgggaagaagaagcagaacattccggagcatcgcataacatattagtagaagtacaagatgatgggactatgaagataaaagacgaagagagagatgacacactgacgattctactcaaagcgactctcctagccatttcaggagtatatccaatgtctattcccgccacattatttgtttggtacttttggcaaaagaagaagcagcgatcaggggtcctgtgggacacgccgtctccgcctgaggtagaaaaagcagtcttagatgacggaatttataggatacttcaaaggggactcctcggtaaaagtcaagtaggagtcggagtatttcaagaaggagtattccacacaatgtggcatgttacgcgtggcgctgtattaatgtatcaaggcaaaaggttggaaccgagttgggcttctgtcaagaaagacttaataagttatgggggaggatggcgtttccaaggaagttggaacaccggagaagaagttcaagtaatagctgtagaaccaggtaagaatcccaagaatgttcaaacggctccaggcacatttaaaacgcccgaaggtgaagtcggggcaatagctttagattttaaaccaggaacgtcgggtagtccaattgttaatcgtgagggcaaaattgttggactgtatggaaacggtgtagtaacaacatccggaacctacgtgtcagcgatagcacaggctaaggcaagccaagaaggaccactaccagaaatagaagatgaggtattccgcaaaagaaacctaacgataatggatcttcatcctggaagtggaaaaacacgacgttacctccctgcgattgttagggaagcgataaaacgaaaacttagaacattagtactagcccccactagagtagtagcgtccgaaatggcggaagcattaaaaggtatgcccatacgttaccaaacaacagcagtgaaatctgaacacacaggcaaagaaatcgttgacttaatgtgccacgcaacttttactatgagattactatcgcctgtgagagtgccaaattacaacatgataataatggatgaagctcactttacagacccagcatccatagctgcaaggggctatatttccacacgagtaggaatgggagaagccgcagccatttttatgactgcgaccccaccaggtagcatggaagcctttccgcagtcaaacgcagcgatacaagacgaagagagggatatcccagaacgatcgtggaacagtggttatgactggatcactgattttccggggaaaactgtatggtttgtcccaagcattaaatcaggaaacgacatagcaaattgcctaagaaagaatggaaaaagggtaatacaattatcgagaaaaacatttgatacagaatatcagaaaacgaaaaataatgattgggactatgttgtaacaacagatattagcgaaatgggagcaaatttcagggcagatagagtaatagaccctcgtcgctgtctgaaaccagtcatactaaaggacggtccagaaagggtcatattagcagggccaatgcctgtaactgtggcttcagctgcacaacgtagagggagaataggaagaaatcaaaataaggaaggggaccaatacatatatatggggcagccactcaataacgacgaagaccatgcacattggacagaagcaaaaatgctgctggataacattaacacaccagagggaatcatacccgcactattcgaacccgaacgagagaaaagtgcagcgatcgatggagaatataggttgaggggtgaggctagaaaaacgtttgtcgaattaatgcgtaggggtgatctaccagtatggctcagttataaagtagcttcggaagggttccaatacagtgaccgtcgctggtgttttgacggggagagaaataatcaagttctcgaggaaaacatggatgttgaaatctggaccaaagaaggcgagcgaaagaaattgagaccgaggtggttagacgcgaggacgtattccgaccctctcgcacttagagagttcaaagagttcgcagcgggtcgtagatcagtaagtggggacctaatacttgagatcgggaaactaccacaacacctaacccaacgagcacaaaatgcgctggataatttagtgatgttacacaactcggagcaaggaggcaaggcttaccgccatgcaatggaggaattgcctgacacaattgaaacgttaatgctattggcgctgatagcagtactaactggaggagttacactctttttcctcagcggaaggggtttgggtaaaacatccattggcctactttgtgtaatggcgtcaagcgcactattgtggatggcttcagtagaaccacactggattgcagcctcaatcatcttagaatttttcctgatggtgttgctaataccggaaccggatcgacagcgaactcctcaagacaatcaacttgcttatgtggttattggtctcctattcatgatattaacagtcgcagctaatgagatggggttactcgagacaactaagaaagacttgggaatcggacacgcagccgcggaaaaccaccaccacgctgcaatgttggatgtagatctgcatccagcaagtgcgtggacattatatgctgtagctacaactattataactcctatgatgaggcacactatagagaataccactgcaaacataagtttaaccgctatagccaatcaagcagcaatactgatgggattagacaaagggtggccaatctccaaaatggatatcggtgtcccgctcctagcattaggttgctatagtcaggtaaaccccttgacactaactgcagcagtactgatgctcgtagctcattatgcaatcatcggaccgggccttcaagctaaggctacaagagaagcccaaaaacgtaccgcagctggcataatgaagaatccaacagtagacggcatcgttgctatcgatttagatccggtagtttatgatgcaaaattcgagaaacagctaggtcaaattatgttattgatcttgtgtacttctcaaattttactcatgcgtacaacctgggccctatgtgagagtataacattagcaaccggaccattaacaacgttatgggaagggtcacccggtaaattctggaacacgaccatagcagtctccatggcaaacatctttcgggggtcctatttggcgggagctggcctagctttctccttaatgaaaagtttaggaggcggaaggcgcggaacaggggcccaaggagaaactcttggtgaaaaatggaagagacagttaaaccaattatcaaaaagtgaatttaacacatataaaagatccggaattatggaggtagaccggagtgaggcaaaggaaggactgaaacgcggtgaaacaacaaagcacgcagtaagccgaggaacggcgaagttgcgatggtttgtcgaacgaaacttagtaaagccagaaggtaaagtaattgatttgggttgtggtcgtggtggttggtcctattactgcgctggtctaaagaaagttacagaagtcaaagggtacaccaaagggggaccaggacacgaggaacccataccaatggcaacatacggctggaatctagtaaagctccatagcggaaaagatgtatttttcactccgcccgaaaagtgtgatacactgttgtgtgatataggggaatcatccccgaaccctacgatagaagagggaaggacattaagagtattaaaaatggtagaaccatggctcagaggaaatcaattttgtattaaagtattaaatccttatatgccatcagtcatcgaaaccctagagcagatgcaaaggaaacatggtggaatgttggtaagaaatcctttgtcgcgcaacagtactcatgaaatgtattgggtaagctgtggcacaggaaatattgtttccgcagttaatatgaccagtcgtatgttattaaacagattcacaatggcacataggaagcctacgtacgaacgggatgtcgatctaggagcagggaccaggcacgtggctgtggagccagaggttgcaaatttagatataattggccaaagaatagagaacatcaaaaatgaacacaagtccacttggcactatgacgaagacaacccttataaaacatgggcctatcatgggtcctatgaagtgaaaccttctggtagcgcatcatccatggtaaacggtgtagtacgtcttctcacgaagccttgggacgtcatcccaatggtaactcaaatagcaatgacagacacaacgccttttggtcaacaaagggtattcaaagaaaaagtggacacgagaacaccaaaagctaaaagaggaacagcacaaataatggaagtaacagctcggtggctgtgggggttcctgtccagaaataaaaagcctagaatctgcacgagagaggaatttacgcgcaaagtcagatcgaacgcagcaattggagccgtattcgttgatgaaaaccaatggaactctgcaaaggaagcggtcgaggatgaaaggttttgggatctcgtccatagagaacgtgaactgcataaacaaggcaagtgtgccacatgcgtttataacatgatggggaagcgagagaagaaactcggagagttcggaaaagccaaaggatcaagggctatatggtatatgtggttaggggcacgatttttagagtttgaagccctcggcttcatgaatgaggaccattggttttctagggaaaattcattaagtggagtggaaggtgaaggactccacaaattaggctatattctacgggatatctcaaaaatacccggcgggaatatgtatgcagacgatacagcaggctgggacaccagaataacagaagacgatctacaaaatgaggcaaagattactgatataatggaaccagaacacgccttactagcgaccagtatttttaagttgacctaccaaaacaaggtcgtacgagtccaaagaccggccaaaaatggtacagtaatggatgtcatatcgagacgggatcagcgtggcagtggacaagtaggaacatatgggctaaatacatttactaacatggaggcacaactaatacgacaaatggaaagtgagggaatatttacacccagtgaattggaaacaccaaaccttgccgagcgagtacttgactggttagaaaaacacgggatcgaacgattgaagcgtatggcaatcagcggcgatgattgtgtagttaaacctattgacgaccgtttcgcaacagccttgaccgcattaaatgatatggggaaggtacggaaagatatcccccaatgggaaccttctaaaggttggaacgattggcagcaagttcccttttgtagtcatcatttccatcagctaataatgaaggatggacgggaaatagtcgtaccatgccgcaatcaagatgaacttgttggtcgagcccgagtaagtcagggtgcgggatggtctttaagagagacagcatgcctcgggaaaagctacgcacaaatgtggcaattaatgtattttcatcgccgtgacctacgcctagcggctaatgcgatctgtagtgcggttccagtggactgggtcccaacatcacgaacgacatggagtatacatgcacatcatcaatggatgactacagaggatatgctctcggtgtggaacagagtatggatagaagaaaatccgtggatggaggataagacacacgtatctagctgggaagatgtaccatatctcggcaagcgtgaagatcaatggtgcggaagtctcattggattgactgctagagctacgtgggcaacaaatatacaagtagctattaatcaggtacgaagattaatcggtaacgaaaattacctcgattacatgacgtcaatgaaaaggtttaaaaatgaatccgaccctgaaggagcactgtggtag

SEQ ID NO: 22061 - RNA, 9879 nt, synthetic construct
  misc_feature 1..9879: note = derived and/or modified CDS sequence (opt6) from DENV-1__KC762640__SS-prME
  source 1..9879: mol_type = other RNA
tctgttactatgttgttgatgctactaccaactgcactggcatttcatttaacgactagaggaggagaacctcatatgattgtctcaaaacaagaaagaggtaaatcgctactatttaaaacatcagcgggagtaaatatgtgcactctaattgcaatggatttgggcgaactttgcgaagacaccatgacatataaatgtccaagaattactgaaactgaacctgacgatgttgattgctggtgtaatgcgactgaaacctgggtaacatacggtacgtgttcacaaactggtgaacatcgacgagacaaaagaagcgtggccttagcaccccacgtcggtttaggcctggaaacaaggactgaaacatggatgtcatcggaaggggcttggcgtcaaattcagaaagtagaaacatgggcactgcggcatccaggatttaccgttattgccctttttctagcacatgcaataggcacaagcataacacaaaaaggaattatatttattttgctaatgctagtaacaccatcaatggcgatgcggtgtgtaggtataggaaatagggattttgtggaaggactttctggtgcgacatgggtcgatgttgttttagaacatggtagctgcgtaaccactatggcaaaagacaaaccgacattagatattgaacttttaaaaacagaggttacaaacccagctgttttacgaaaattatgcatagaggcgaaaatatcaaatactaccactgactcacgatgcccaacacagggagaagccacattagtagaagaacaagacacgaattttgtttgtcgcagaacgttcgttgatcgagggtggggaaatggatgtgggctttttggcaaagggagtctcattacttgtgcaaagtttaaatgcgtcactaaacttgaaggcaagattgtacaatacgaaaatttgaaatacagtgtcatagtaacggttcatacaggcgatcaacatcaagtaggcaacgaaactaccgagcatggaacaacggccacaattaccccacaggctccgacctcagaaatacagttgacggattatggagctttaacgttagattgtagcccacgtacaggactagattttaatgaaatggtgctactcaccatgaaagagaaaagttggttagtccacaaacagtggttcctagacctacccttaccttggacaagtggagcaagcacaagtcaagagacttggaataggcaggatctattagttacattcaaaacagcgcacgctaagaaacaagaagtagtggtcctaggttcacaggaaggagcgatgcacacggctttaacgggtgctacggaaatccaaacgagcggtacgactacgatcttcgcgggacacttaaaatgcagactaaaaatggataaactcactctgaaaggggtttcctacgtaatgtgcactggtagcttcaaactagaaaaagaagtagctgagacccagcacggaacagtgctcgtacaggtaaaatacgaaggaacggatgcaccttgtaagattccattttccagtcaggacgaaaaaggagttacacaaaacgggagactaataacggcgaatccaatcgtgactgacaaagaaaaaccggtgaatatcgaagctgaaccaccatttggagaatcatacctagtagtaggggctggggaaaaagcattaaaattaagctggttcaagaagggtagttctattggaaagatgtttgaagcgacagctcggggtgctagaagaatggctattttaggagatacagcatgggatttcggatctataggaggggtttttacaagtgtagggaaacttatccaccaaatttttggaacggcttacggggtactattctctggcgtatcatggacaatgaaaattggtatagggattttactaacatggctcgggttaaactctcgatctacatcactatctatgacatgtattgccgtaggaatggtaacgttgtacctaggggtaatggtccaagcagacagtggatgcgttataaactggaaaggtcgagaactgaaatgcggtagtggaatttttgtgactaacgaggtgcatacatggacagaacaatacaaattccaagctgatagtcccaaaagattaagtgcggcaattggcaaagcctgggaagaaggcgtatgcgggataagatcagcaacccgactagaaaatataatgtggaaacaaataagcaatgagctaaaccacatacttcttgaaaacgatatgaagttcactgttgtcgttggtgaagtaaatggaatattagcgcaaggtaagaaaatgattcggccgcaacctatggaacataaatacagttggaagtcttggggaaaggcaaaagtaataggagcggacgtgcaaaacacaacatttataattgatggacctaatacaccagaatgcccagacaatcaacgcgcatggaatatttgggaggttgaagactatggttttggaatatttactacaaacatttggttaaagttacgtgattcttacacacaagtctgtgaccatagactgatgagtgccgctataaaagactccaaagctgtccacgccgatatgggctactggatcgagagtgagaaaaacgaaacttggaaactggctagagcatctttcatagaagtgaagacctgtatatggccaaagtcacatactctatggtccaacggagtactggaatccgaaatgattattccaaaaatatacggtggacccatttcccaacataactatagaccaggttacttcactcaaacagctggcccatggcatttgggtaaattggagctagattttgaactatgtgaaggaaccacggttgttgtagatgaacactgtggtaaccgtggccccagcttaaggactacaacggtaacaggcaaaattatacatgaatggtgttgtaggtcttgtacattaccaccattgaggtttaagggcgaggatggttgctggtatggcatggaaataaggccggtcaaggaaaaagaagaaaacctggttaaatctatggtcagcgctggttcaggagaggtcgatagtttttcattaggtcttctatgtatatcgatcatgattgaagaagtcatgagatcaaggtggtctcgtaagatgttaatgacaggaaccttggcagttttcctactactgacaatgggacaactaacttggaatgatctaattagactttgcattatggtcggtgccaatgcgagcgataaaatggggatgggaaccacatacttggcattaatggcaacatttcgcatgagaccaatgtttgccgttggtttgctattccggcgtttaacgtcaagagaggtattactactcacagtgggactatccctcgttgcctcagtagaactgcctaatagtttggaggaattaggtgacgggctcgcaatgggtataatgatgttaaagttacttaccgactttcaaagtcatcaactgtgggctgcattactatcactaacgttcgtaaaaactacattatcactacactatgcctggaaaactatggcaatgatattgtcgatagtttcgttattccctctatgtttatctacaacgagtcaaaagacaacttggcttcccgtgctattaggctcactagggtgcaaaccactcacaatgtttctaataaccgaaaacaaaatctggggaagaaaaagctggcccttaaatgaaggcataatggcagttggtatagtgtcaatactattaagttcgctcctaaagaacgacgtaccactagcgggaccattaatagctggaggaatgctaattgcttgttatgtaatatcaggttcatcggcggaccttagcctagaaaaagcggcagaagttagctgggaagaagaagccgagcactctggggcatcacataacatattagtcgaagtacaagatgacggcacaatgaaaataaaagatgaggaacgagatgacacacttactatcttgttaaaagcaacattattagccatttccggtgtgtaccccatgagtattccagcgacactgtttgtatggtatttctggcagaaaaagaaacaaagatcaggggtcttatgggacaccccatcaccaccagaagtagaaaaagcagtccttgatgatgggatctatcggattctacaaagagggctacttggaaaaagtcaagttggggtaggagtattccaggagggtgtgttccacactatgtggcacgtaactagaggcgcagttttaatgtaccagggaaaaaggctggaaccaagctgggcaagtgtgaagaaagatttaattagttacggtggaggatggagatttcagggaagttggaatacgggtgaagaagtccaggtaatcgctgtggaaccggggaaaaatcctaaaaacgtacagacagccccaggaacgtttaaaactccagaaggtgaagtaggagctatagccttggattttaaacccggtacttcaggctcaccaatagtcaacagggaaggcaaaatcgtcggtctatatggcaacggagttgtaacgacatcgggaacttacgtgtcggcaattgcccaggcaaaggcttcacaggagggaccactcccagaaatagaagacgaggtcttcaggaaacgtaatttgactataatggacttacatccagggtctgggaaaacaagacggtatttgcccgctatcgtaagggaggctattaagagaaagttgcggactttagtactagcacctacacgagtcgttgcatcagaaatggctgaagctcttaaaggaatgccgatcagataccaaacgacggcagttaaatcagaacacactggtaaagaaattgtagatcttatgtgccacgctacgttcacaatgagattacttagccccgttcgggtaccaaattataatatgattatcatggacgaggcacatttcactgaccctgcaagcattgccgcgcgcggatatataagtacaagagttggaatgggtgaagccgccgcaatcttcatgacagcgacacctccaggtagtatggaggcttttccccagagtaacgcagcgatacaagacgaagaaagagacatcccagagcgaagttggaactcaggatacgattggattacagatttcccaggaaaaacggtttggttcgttccaagtattaagagtggaaatgatattgcaaattgtctaaggaaaaacggcaaaagagtgattcaattaagtagaaaaaccttcgacactgagtaccagaaaaccaaaaataatgactgggattatgtagtcacaactgatataagtgagatgggtgcaaatttcagagctgacagagtaattgacccacgacgatgtttaaaaccggtaatcttaaaagatgggccagaacgagttatacttgcagggccaatgccagtaaccgtggcatcagcagcccaaagaagaggtagaataggacgaaaccaaaataaagagggcgatcagtatatatatatgggccaacctttaaataacgacgaagaccacgcgcattggactgaggctaaaatgctgcttgataacatcaatacaccagaaggcataataccagctcttttcgagccggaaagagaaaaatcagccgcaatagatggagagtacagattaaggggcgaagcacgaaaaacatttgtagaattaatgaggcgtggagatcttccagtatggctaagttacaaggttgcgtctgaaggttttcaatacagtgatagaagatggtgctttgatggagaacgaaacaatcaggttcttgaagaaaatatggatgtagaaatatggacaaaggaaggagaaaggaagaaattacgaccacgttggctagatgccagaacttactctgatccgctcgcacttcgcgagttcaaggaatttgctgctgggagaagaagcgttagcggagacctaatactagaaatagggaaattaccacaacacctaactcaacgcgcccaaaacgcactcgataatttggtgatgcttcacaactcagaacagggaggcaaggcatacaggcatgccatggaagaactaccagacacaatagagactttaatgcttctagcgttaatcgccgttctaactggcggcgtaacgttattctttttaagcggtagaggtctagggaaaacaagtatagggcttctgtgtgtcatggccagtagcgcactgttgtggatggcatctgtagaaccacattggatagcagcgagcatcattctcgagttctttctaatggttttactaatcccagaaccagacaggcaacggacgcctcaagacaaccaactcgcttatgtggtaataggcctactttttatgatactgacggttgcagcaaatgagatgggtctactagaaacaactaagaaagacctcgggataggacatgccgcagctgaaaatcatcaccatgctgctatgttagacgtcgatttgcatcctgcgtcagcctggacactgtacgctgtggcaacaacaataattactcctatgatgagacatactatagaaaatacaacagcaaatatatctctgactgcaattgccaaccaagcagctattctgatggggctggacaaaggttggccgatatctaagatggatattggtgtaccactgctggcattaggttgctactcgcaggttaatcctttgactttgactgcagcagttctaatgttagtagcccattatgcgatcataggcccggggctccaagcaaaagcaacaagagaggctcaaaaacggacagcagcgggaatcatgaaaaacccaacggtagacggaatagttgccatcgacctagaccctgttgtgtatgatgcgaaattcgagaaacaattaggccagattatgttattaatattgtgcacctcccagattcttttgatgagaaccacatgggcactatgtgagagcattacgttggcaaccggaccacttactacactgtgggaagggagtcctggtaaattttggaatacaactatagcggtatcgatggctaatatattccgagggtcatacttagcaggagccggactagcgttttctctaatgaaaagcctgggaggaggacgtcgaggtactggagcacaaggagagacactcggagaaaagtggaaacgacaattgaatcaattatcgaaatcagagtttaatacttacaagaggtcaggtataatggaagtagatcgttcggaagcaaaggaagggttaaaaagaggagaaacaacgaaacatgctgtctcacgggggacggctaaattacgatggttcgtggaacgaaaccttgttaaacccgagggtaaagtcatcgacttaggttgtggcagaggaggatggagttattactgcgccggtcttaaaaaggttaccgaagtaaaaggctataccaagggtggcccagggcatgaagaaccaataccgatggcaacttatggatggaaccttgttaaactttactcgggcaaagatgtctttttcacacctcccgaaaaatgcgataccctattatgcgacatcggtgagtcaagtccaaatccaactattgaagaaggcaggacgcttcgagtgctaagaatggttgaaccatggctaaggggtaaccaattctgcataaaagtactgaatccttatatgccaagcgtaatagagacactagaacagatgcaaagaaaacacggtggcatgttggttcgaaatcctctttctagaaactcgactcatgaaatgtattgggttagttgtgggacaggtaatatagtctctgcggtcaatatgacgtcacgaatgctattgaatcgcttcacaatggcacatagaaaacctacttacgaaagagatgtagatttgggagctggaacgcgtcatgtggcagtcgaaccagaggtcgctaatttagaaataataggtcaacgtatcgaaaacatcaaaaatgaacataagtccacctggcattatgatgaagacaacccttataagacgtgggcttaccacggatcatacgaagttaaaccctcaggtagcgcgtcttcaatggtgaatggggttgttagattactcacaaagccttgggacgtaatacccatggtgactcagatagcaatgacggacactacaccattcggccaacagagagtctttaaggaaaaagtagatacccgaacacctaaggccaaacgagggacagctcaaataatggaagtcacggcaagatggttatggggatttttaagtaggaacaagaaaccacgcatatgcacccgagaggagtttacgagaaaagtccgatctaatgcagcaataggagcagtttttgtagatgaaaaccaatggaactcagcaaaagaagctgttgaagacgaacgcttttgggaccttgttcatagggaacgagaattacataagcaaggcaaatgtgccacatgtgtctacaacatgatgggtaagagagagaagaaattaggagaatttggtaaagcaaaggggagcagagcaatttggtacatgtggctgggtgcaagatttctagaatttgaggctttaggatttatgaacgaagaccactggtttagcagagaaaattccctcagtggagtggaaggagaagggctacataagctcggatatattcttcgcgacatctcgaaaatacctgggggaaacatgtatgcagatgatactgcggggtgggatacacgaataactgaggatgatcttcaaaatgaggcaaaaataacggacatcatggaaccagagcatgccctactagcaacctcaatttttaaattaacatatcaaaacaaagttgtacgagtacagcgaccggccaaaaatggaacggttatggatgtcatctctaggagggaccaacgcggaagtggtcaagtgggtacttatggtctaaatacattcaccaatatggaagcccagctaataagacaaatggagtccgaagggattttcacgcctagtgaactggagaccccaaaccttgctgaacgagttctagactggctagaaaaacatggaatagaaagactcaagcgaatggccataagtggagacgactgcgttgtaaaacctattgatgatcggtttgcaaccgctctaactgcgttaaacgatatgggcaaagtgcgcaaggacatacctcagtgggaaccctctaaggggtggaacgattggcaacaagtacctttctgctcccatcattttcaccagttaataatgaaggacggacgggagatcgtcgtcccttgccgaaatcaggatgagctagtgggcagagcaagggtgtctcaaggagctggatggagtctacgagagaccgcatgtctaggaaaaagttatgcacaaatgtggcaattgatgtactttcatagaagggacttacggctcgcagcgaacgctatttgttcggccgtaccggtagactgggtaccaacatctagaacaacttggtcaattcatgcccaccaccaatggatgacaacagaagacatgctttctgtatggaatcgagtatggatagaggaaaatccatggatggaagacaaaactcatgtatcttcttgggaagacgtgccctacctgggcaaacgggaagatcagtggtgtggctcacttatcggattaactgctagagcgacatgggctacaaacatacaagttgcaataaatcaggtaagaagattaatagggaacgaaaattatttggactatatgacgtcaatgaaaagatttaaaaatgaatcggatccagaaggagccctttggtga

SEQ ID NO: 22062 - RNA, 9879 nt, synthetic construct
  misc_feature 1..9879: note = derived and/or modified CDS sequence (opt6) from DENV-1__KC762645__SS-prME
  source 1..9879: mol_type = other RNA
agtgttacaatgcttctaatgttaatgccaactgctctcgcgttccatttaaccacgagaggaggagaaccccacatgatcgtatcaaaacaagaacgagggaaaagtttgttatttaaaacatctgctggagtaaacatgtgtacactaatagctatggaccttggagagctatgcgaagatacattgacatataaatgtccacgtataacggaagcagaaccagacgacgtagattgctggtgcaacgcaacagatacttgggtgacatatggtacctgttctcaaacaggcgaacataggagggataaaagaagcgtagcgctcgccccacatgtaggactcggtctcgaaaccagaaccgaaacttggatgtctagcgagggtgcttggagacaaattcaaagagtagaaacgtgggcccttagacacccaggttttacggtgattgcgctattcttagcacatgccattggcacaagtatcactcagaaaggcatcatatttatattacttatgttagtaaccccgagcatggctatgagatgcgtaggcattgggtcacgtgattttgtagaaggcttatcaggtgcaacatgggtagacgtggtacttgaacacgggagttgtgtaacgactatggcaaaagataaacctacactagatatagaattgttaaaaactgaagtgacaaatcccgccgtattgcgtaaactatgcatagaggcaaaaatttcaaatacaaccactgattcgagatgtccaactcaaggtgaagccactttagttgaagaacaggacgcgaattttgtttgtcgacgcacattcgtagatcgtggttggggtaatggatgtggtttgttcggaaaaggcagcctaataacgtgtgcgaaatttaaatgcgtgaccaaacttgagggcaaaatcgtacagtacgagaatctcaaatactctgtgatagttaccgttcacacgggagatcagcatcaagtaggaaacgagtcaacagaacatggaacaacggcaacaatcacaccacaagcaccaaccacagagattcagctaaccgattatggtgcgctcacattagattgttcaccaagaacaggacttgacttcaatgagatggtattacttaccatgaaagaaaaatcatggttagtgcacaaacaatggttcttagacttgccacttccatggacctcaggcgcctctacaagtcaagaaacgtggaatcgtcaagacttacttgtcaccttcaaaacagcgcacgccaagaaacaagaagtagtggtacttggatcacaggagggcgctatgcatacagcactaacaggagctacggaaattcagacatctggaacgaccaccatttttgctggacatctaaaatgtagacttaaaatggataaattaacactcaaaggtatgtcatatgtcatgtgtaccgggagctttaaattggaaaaagaagtagcagaaactcaacacggcacggtcttagttcaaataaaatatgaaggaacagacgcaccttgcaaaataccattcagtacacaagacgaaaaaggagtaactcagaatgggcggctcattacggcaaacccaattgtcacagataaagagaaacctgtcaacatagaggctgaacctccattcggtgagtcgtatatcgtaataggtgcaggagaaaaagcactaaaactatcatggttcaagaaagggagttcgattggaaaaatgttcgaagccacagctagaggggctcgtagaatggctatactaggcgacaccgcttgggactttggctcaataggtggcgtcttcacgtcagtaggaaagctagttcaccaaatctttgggacagcatatggagttctcttctcaggcgtttcctggacaatgaaaataggtattggagtattattaacatggttaggcctgaactcaaggtccacatcattatcaatgacgtgtatagcggtgggtctagtcaccttatatttaggagtaatggtgcaagccgatagtggctgcgtaataaactggaaggggcgagaactaaaatgtgggtctggtatcttcgtaacgaatgaagtacatacctggacggaacaatataaatttcaggcagattcacctaaacgtctttctgcagcaatcggtaaggcttgggaggaaggggtgtgcggaataagatcggcaacgcgtcttgagaatattatgtggaagcagatcagcaacgaattaaaccatatattattagaaaacgacatgaaatttactgttgttgtaggtgatgtcgctggtatcctggcccaagggaagaaaatgatcaggccgcagccaatggaacataaatattcttggaaatcatgggggaaagcaaaaattattggagcagacgtgcaaaatacaaccttcataatagatggtccaaatacaccagaatgtccggacgaccaaagagcatggaatatttgggaagtcgaagattacggttttggcatttttactacaaatatatggcttaaacttagagacagttatacacaagtatgcgaccatagattaatgagcgcagctatcaaggacagtaaagcggtacacgcagacatgggatattggatagaatctgagaaaaatgaaacctggaaattagctcgtgcgtctttcatagaagtaaagacttgcatatggcccaagagtcatacactatggtccaatggggtactagaaagtgagatgattattcctaaaatctacggaggacctatttctcaacataactatcgaccggggtactttacacagacagccggtccctggcacctgggtaaattagagctagacttcaacctgtgcgagggcactacagttgtagtagatgaacactgcggtaataggggaccatccttaagaacaacgacagtcactgggaaaataattcacgaatggtgttgcagatcatgtacactacctcccctgcgatttcgtggagaagatggctgctggtacggaatggaaataaggccagttaaagagaaggaagaaaatttggtcaaaagtatggtttccgctggcagtggggaagtagacagtttttctctgggactgctttgtatttctataatgatcgaagaagtaatgcgctcacggtggagcaggaaaatgttaatgactggaactctcgcggtattctttctcctaatcatgggtcaactaacgtggaacgatttaatacgcctatgtattatggtaggtgcaaacgcgtctgatcggatgggtatgggtacgacctacttagccttaatggcaacatttaagatgagaccaatgttcgctgttggtttgttatttagaaggcttacatcgagagaagtacttctcctaactattggtctcagcttagtagcatcagtagagttgcccaactctcttgaagaattaggtgacggtctggccatgggtataatgatcttaaaacttttaaccgactttcagagccaccaactttgggctacgctattaagcctaacctttattaaaacaaccttctctctacattatgcgtggaagactatggcaatggttctgagtatagtttcgctattccctctctgcctctcgacgaccagccagaaaaccacgtggcttccagtattacttggttcattagggtgtaaaccgttaacaatgttcctaattgcagaaaataaaatatggggccgaaaatcttggcccctaaacgagggtatcatggctgttggaattgtaagtatactgttgtcatcattattaaagaatgatgtaccactcgcaggtcccttaatagccggcggtatgctaatagcatgttatgtgatcagtggatcgagcgctgatttgagtcttgagaaggctgctgaggtttcttgggaagaagaagcagaacatagcggagcttcacataacatattagtagaagtccaagatgacggaactatgaaaattaaggacgaagagagggacgacacattaacaatccttttaaaagcgaccttactagccgtatcaggtgtttatccactaagcatacctgcaaccttatttgtgtggtacttttggcagaaaaagaaacagcgatcaggagtactttgggatacaccatccccacccgaagttgagagagcggtacttgacgatggaatctatcgaattatgcaacggggactattaggacgatcgcaagtaggtgtcggtgtctttcaagaaaatgtctttcacacgatgtggcatgtgacccgaggagcagtactaatgtaccaaggcaaacgtttggagccctcgtgggcttcagtgaaaaaggatctaattagttatggagggggatggaggttacaaggcagttggaacaccggagaagaggttcaagtaatcgcggtagaaccaggcaaaaatcctaaaaacgtacaaaccgcccccgggacatttaagactcctgaaggcgaagtaggggctattgcactagactttaaacctgggacatccgggtccccgatagttaatcgagaaggcaaaatagtaggcttatatggaaatggagtggtaacaacgagcggaacatatgtatccgcaattgcacaagcaaaagccagtcaggaaggccctctacccgagatagaagatgaagtattccgtaaaagaaaccttacaattatggaccttcatcccggctccgggaaaaccagacgttatctaccagccatagtcagagaagctattaagcgaaagctacgaactttaatattggctccgactcgcgttgtagcatctgagatggccgaagcattgaaagggatgccaatacgttatcagaccactgccgtgaaatcagaacacaccggaaaagaaatcgtagatttgatgtgtcatgcaacatttacaatgagactgttatcacctgtacgagttccaaactacaacatgataataatggacgaagcacacttcacagatccatccagtatagcagcaagaggctatatatcaactagagttggaatgggagaggctgcagctatcttcatgacggccacgccacctggaagtgtcgaagcatttcctcaatcaaatgcagtgatacaagacgaagaaagagacatacctgaacgatcatggaactctggatatgaatggataacggactttccgggaaaaaccgtttggttcgtaccaagtattaaatctggaaatgatattgctaattgtttaaggaaaaatgggaaaagagtaattcaattatctagaaaaacctttgacactgaataccagaagactaaaaacaatgactgggattatgtggtaacgaccgatatttcagagatgggagcaaatttcagagccgatcgagtaattgatcctcgcagatgcttaaaacctgtgatactcaaggatggccctgaacgtgtaattttagctggaccaatgccagtcacggtagcttcagctgcacagcgccggggaagagtgggtcgaaatcataacaaagaaggcgatcaatacatctacatgggtcagccattaaataatgatgaggatcatgctcactggacagaagcgaaaatgctgttggataacataaacacaccagaaggaataataccagcactcttcgaaccggaaagggaaaaatctgccgcaatagacggcgaatatcgattgcgcggtgaagcgagaaaaacattcgtagaacttatgcgtcgaggtgacctaccagtatggcttagttacaaagtagcatctgaaggtttccagtactctgatagaaggtggtgttttgacggtgagcggaataaccaggtattagaagaaaatatggatgttgagatatggactaaagaaggagaacgcaaaaagctaagaccaaggtggctagatgccagaacgtactctgatcctctagcgttgagagaatttaaagaatttgcagctggtaggagatctgtgtctggtgatctgatcctcgaaataggaaaacttccacaacacctgactcaacgcgcccagaatgccctagataatctagtaatgttacataactcagaacaaggaggtcgagcatatcgacatgcaatggaagaacttccagacacaattgaaacgctaatgttactcgctttgatagctgttttaacaggtggcgtaacactatttttcttaagcgggaggggcttaggaaaaacgtcaataggcctgctctgcgttatggcctcttctgtactattatggatggcgagtgtacaaccacattggatagcagcatcaatcatcctagagttctttttaatggtcctcttaattccagaacctgatcggcagcgtacaccacaagataatcaactagcatacgtggtaataggtctgttgtttatgattctaacggttgctgctaatgaaatgggattacttgaaacaacgaagaaagacctaggaatcggccatgtcgcggtggaaaatcaccaccacgccgccatgcttgatgttgacctccatccggcatcagcatggacattatatgcagtcgcgactactatcatcacaccaatgatgagacacacaatagaaaatacaaccgcaaacatctcattaactgcaatagcaaatcaagcggccatccttatgggtcttgacaagggatggcccatctccaaaatggacataggggtccctctactagctttaggatgctatagccaagtaaatcccctaactttaacggcagcagtacttatgctagtagctcactatgccattataggtcctggtcttcaggcgaaagcaactcgtgaagctcaaaaacgaacagctgcaggaattatgaaaaatcctactgtagatggtatagtagctatagatctagatcctgtagtatacgatgcaaaatttgaaaaacaattggggcaaatcatgcttcttatcttatgtacgagtcaaattttactaatgaggacaacatgggccttatgcgagtccatcaccttagcaaccggacccctaaccacactttgggaaggatcacctgggaagttctggaatacaacgattgccgtatcgatggccaatatttttagaggttcgtacctagctggagctggactagctttttctctcatgaagtcgttagggggtggaagacgagggacaggtgcacaaggtgaaaccttgggcgagaaatggaaaaggcaactgaatcagctaagcaagtctgagttcaatacttacaagagaagtggcatcatggaggtagaccgaagtgaagctaaagaaggtctcaaacgaggagagacaacgaagcatgctgtaagcagaggtacggccaaactcagatggtttgtcgagagaaacttggttaaaccggaaggaaaggtaatagatttaggatgcggtcgcggcggctggtcgtattactgtgcaggactaaagaaagttacagaagtgaaaggatatacaaaaggagggccaggacatgaagaacctattcccatggctacctacggatggaatcttgtaaaattacatagtggtaaagatgtgttctttatacccccagagaaatgcgacactctcctgtgtgatataggagagtcgagcccaaatcccactatagaagaagggaggacgttacgtgtattaaagatggtcgaaccatggctacgcggaaatcaattttgtattaaaattctaaatccgtatatgcctagcgtagttgaaaccttagaacaaatgcaaagaaaacacggcggaatgttagtccgaaatccactaagccgaaattccacacacgaaatgtattgggtaagctgcggaactggaaatattgtatcagcggtgaatatgactagcagaatgctactgaatagatttactatggcccatcgtaaacctacttatgaacgtgacgtagacctaggcgcaggaacgagacacgtagctgtagagccagaagtggcaaatttggacattattggccaaaggatagaaaatataaaacatgaacataagtctacatggcattacgatgaagataatccttataagacttgggcgtatcacggaagttacgaagttaaaccaagcggaagcgcgagttcgatggtaaatggcgtggtaaagctactaacaaaaccatgggatgtcatcccgatggtgacgcagattgcaatgacagacacaactccgttcggacaacaaagagtttttaaagaaaaagtagatacacgaactcctaaagcaaaacgtggtactacacaaatcatggaagttacggcaaggtggttatggggattcctgtcgaggaacaagaaacccaggatatgtaccagggaagagttcacacggaaagtaagaagcaatgccgccataggcgcagtattcgtcgacgaaaatcaatggaactctgcgaaagaagcagtagaagatgagcggttttgggatcttgttcatcgagaaagagagctacataaacagggaaaatgtgcaacatgtgtttataacatgatgggaaaaagagagaagaaactaggcgaatttggaaaagccaaaggctctagagccatatggtatatgtggctaggtgcccgttttctagagtttgaagcgctcggttttatgaatgaggaccattggttctcacgcgaaaattcattaagcggagtagaaggagaagggctacacaagctcggctatatattacgagatattagtaaaatacccggtggtaacatgtatgcagatgacaccgctggttgggataccagaattacagaagatgatttacagaatgaagcaaaaataactgacattatggaacctgaacacgcacttttagcaaaggcaatctttaaattaacataccaaaataaagtcgttagggttcaaagacctgccaagaacggaactgttatggacgtcatatcacgtagagatcaacgaggcagcggtcaagtagggacgtatggtctaaataccttcactaatatggaagcacaattgatccgacaaatggaaagcgagggtatattctcacccagtgaacttgaaacacctaacttggcagaaagggtattggattggttagagaagtatggtgttgaacgcctaaaacggatggcaatttctggagatgattgcgttgtaaagcctattgatgacagatttgctaccgcgctaactgcactgaatgatatgggaaaagttaggaaggacatcccgcaatgggaaccgtcaaagggatggaatgactggcaacaagtaccgttttgtagtcatcatttccaccaactaattatgaaagatggacgagagatagtcgttccatgcagaaatcaagatgaattggttggacgagcgagggtctctcaaggtgcagggtggagcctaagagaaaccgcttgcttaggaaaaagttatgcccaaatgtggcagttaatgtattttcatagacgagatttaagacttgctgcgaatgcaatatgcagcgccgtcccagttgattgggttccaacatcgaggactacttggtcaattcacgctcaccaccaatggatgacaacggaagacatgttatctgtttggaacagggtatggatagaggaaaatccatggatggaagacaaaactcatatcagctcatgggaggacgtgccgtacttaggtaagagggaggatcaatggtgcggctcactgataggtttaacggcacgcgccacttgggcaaccaatatacaagtagcgataaaccaggtaagaagactcataggtaatgaaaattatttggattatatgacatcaatgaaaagattcaaaaacgaatcagatccagaaggagcattatggtag

SEQ ID NO: 22063 - RNA, 9879 nt, synthetic construct
  misc_feature 1..9879: note = derived and/or modified CDS sequence (opt6) from DENV-1__KC762628__SS-prME
  source 1..9879: mol_type = other RNA
tccgtcactatgcttttaatgctgttaccgacggcattagcatttcacttaactacgaggggtggtgagccacacatgatagtaagtaaacaagaacgaggtaaatccctgttatttaaaacttctgcgggtgtcaacatgtgtactcttattgctatggatctcggagagttgtgcgaagatacaatgacatataaatgtccacgaataactgaaacagaacctgatgatgtagactgctggtgcaatgcgactgaaacttgggttacctatggtacatgtagtcaaactggagaacaccggagggataaaaggtcagttgcattagcaccacacgttggattgggactagaaacacgaacagaaacctggatgtcaagcgaaggagcatggagacaaatacaaaaagtagaaacgtgggctctacgacatccaggttttacagtcatagcattatttctggctcatgcaataggaacctctatcacacaaaaaggaatcatattcatactactaatgcttgtaacgccaagtatggctatgaggtgtgtaggaatcggcaacagagatttcgtagagggcttgagcggcgcaacttgggtagatgtggtgttggagcatggctcctgtgtaaccacaatggcaaaagacaaaccaacattagatatcgaattactaaaaactgaagtcacaaacccagcagtgctcagaaaactatgtatcgaggccaaaataagcaatactactacagactcaagatgtcccacgcaaggggaagcaacattagtcgaagaacaagatacaaacttcgtatgtagaagaacattcgtagatcggggatgggggaacggctgtggtctttttggtaaagggagtctcatcacgtgtgcaaaattcaaatgtgtaacaaaactggagggcaaaatagtacaatatgagaatctgaaatactccgtgattgtaacggtacacaccggagatcaacatcaggtcggtaatgaaacaacagaacatggaaccacggcaacaatcacaccacaagccccgacatcggaaattcaactgactgactacggagcgttaactctcgactgttccccgcgaaccggattagattttaacgaaatggtattattgacaatgaaagaaaagtcatggctggtccataagcaatggtttctagatcttcctttaccttggacttcaggagcgagcacaagccaagaaacttggaaccgacaagatttgttagtaacatttaagacagcgcatgcaaagaaacaagaggtggtagtactagggagtcaagagggagcaatgcatacagcgctcaccggcgcaacggaaattcaaacgtcaggaactacaaccatctttgcgggtcacttaaaatgtcgtttaaaaatggacaagctaacgttaaaaggtgtaagctatgtcatgtgtacggggagctttaaattagagaaagaagtagctgagacccaacatggtacagtattagtccaagtaaaatatgaaggaacggatgctccatgtaaaataccattttcttcacaagacgaaaaaggcgtgacacaaaacggacgactaataactgcaaatccaatagtgacagacaaggaaaaaccagtaaatatagaagccgagccaccatttggagaaagctatttagtggtcggtgccggtgaaaaggctttaaaacttagttggtttaagaaaggttcaagtataggaaagatgtttgaggcaactgctagaggagctcgtcgcatggcaattttaggagatacagcatgggatttcggaagtataggtggagtattcacttcagtgggaaaactcattcatcaaatattcggaacagcctacggggtactgtttagtggagtttcatggacgatgaagataggaataggcatattactaacatggctagggctaaattcaagatcgaccagtttatctatgacttgcatagcagtcggaatggtgacattataccttggcgtaatggtgcaggcggattctggctgtgtcatcaactggaaggggagggagctgaaatgtggaagcggaatattcgtaacaaatgaagttcatacttggacagagcaatataaattccaagcggactccccgaagcggctgagtgcggcaattggaaaagcctgggaagaaggagtatgcgggattagatcagcaacaagattagagaacataatgtggaaacagatatctaacgaacttaaccacatcctgctagaaaacgacatgaaatttactgtagttgtaggtgaagtaaatggcatattagcacagggcaagaaaatgatacgtcctcagccgatggaacacaaatatagctggaaatcatggggtaaagcaaaggtaataggcgcggacgttcaaaacacaacatttatcatagacggaccaaatacgccagagtgtccggataaccagagagcttggaacatatgggaggtagaggattatggattcggaatattcacgacaaatatttggttgaaactaagagattcctacacacaagtatgtgaccatagattaatgtccgcagcaataaaagatagcaaagctgtacacgcagacatgggatactggatagaatcggagaagaacgagacatggaaactagctcgcgctagcttcatagaagtgaaaacttgtatctggccaaagtcacatacactgtggtcaaatggagtattggaatcagaaatgattatacctaagatatatggcggacctatatcacagcacaattatagacctggatactttacacagacagcaggcccatggcacttggggaaacttgaattggactttgagctgtgcgagggaacaacagtagtagtggacgaacattgtggatctcgaggacccagcttaagaacaactactgtaacgggaaaaataatccacgaatggtgttgcagatcgtgtaccctaccgcccctaagatttaaaggagaagatggatgctggtatgggatggagattagacctgtcaaagaaaaagaagaaaatctagtaaagtcgatggtcagcgcaggttctggcgaagttgattcgttctcactaggactgctttgtatgtcgataatgattgaagaggttatgcgtagcagatggtcgaggaaaatgctaatgacaggaacactagcagtattccttttattaacgatgggccaactaacatggaatgatttaatccgattatgtataatggtaggcgcaaatgcttctgataaaatggggatgggcacaacacatttagcactgatggcaacctttagaatgcgacccatgttcgcggtgggcctgctatttcgacgtttgacctcacgtgaggtattgttattgactgtcggactatcattagtggcctcggtagaactccccaactcgttggaagaattaggggatggtttagcaatgggaataatgatgttaaaattgctaactgattttcaatctcaccaactctgggccgcattactatctcttacgtttgttaagaccactttatcattgcattacgcctggaaaacgatggctatgattttgtcgattgtaagcctttttccactgtgtctctcgacaacaagtcagaaaactacttggcttcctgtgttacttggctcactgggttgcaagccgcttacaatgtttctaattacagaaaataagatctgggggcgaaaatcctggccgctaaacgaaggtattatggccgttggtattgtgagtatcttgctttcttcacttctgaaaaatgatgtacctctcgcgggcccactcatagctgggggcatgctaatagcttgttatgtcatcagtggatcaagtgccgacctttctttagaaaaagcagcagaagtatcctgggaagaagaagcagagcattcaggagcatcacataatatccttgtcgaggtacaagatgatggcaccatgaaaataaaagatgaggaacgtgatgacacacttacaatattacttaaagcaacgttactcgcaatctccggagtgtatcctatgtcgattccagctactctgtttgtatggtatttttggcagaagaaaaagcaacgttcgggagtcttatgggacaccccaagtccaccagaagtcgagcgagcagttcttgacgatggcatctaccgtatactccaacgcgggttgttaggcaaatcacaagtcggggtaggagtatttcaagaaggagtatttcacaccatgtggcacgtcacacgaggtgccgtcttaatgtatcaagggaagcggctcgagccatcctgggcatcggtgaagaaagacttaatatcatatggaggaggatggagatttcagggatcctggaataccggagaagaagtacaggtgatagcggtagaaccaggtaagaaccctaaaaatgtacagactgcacccggcacgtttaaaacgcctgagggcgaagttggagccatagctttagactttaaacctgggacatcagggtcacctatagtcaatcgcgaaggaaaaatagtaggattgtacgggaacggcgtagtcacgacatcaggtacctatgtcagtgctatagctcaggccaaagcaagtcaagaaggacctttaccagagatcgaagatgaagtcttccgtaaaagaaacttaaccatcatggatctccatccagggagcgggaagaccagacgctacctacctgccatcgtacgtgaagcgataaaaagaaaactaaggaccttagtgcttgctccaactcgcgttgtggcgtcagaaatggctgaggctttgaaaggaatgccgatacgataccaaacaacggctgtcaaaagtgaacacactggaaaagaaatagtagatctaatgtgccacgcaacctttacgatgcgattgctatctccggttcgggttcctaactacaacatgataataatggacgaggcgcattttactgatccagcctccattgccgcaagaggctatataagtacaagggtagggatgggggaggccgcagcaatattcatgacagcgacacctccaggcagcatagaagcctttccgcagtctaacgccgctatccaagatgaagaacgtgatatacctgaacgaagctggaactcggggtacgattggatcacagactttccaggaaagacagtgtggtttgtaccttctattaaaagcggtaatgatatagctaactgccttaggaaaaatggcaaacgagtcatacaactctctagaaaaacatttgatacagagtatcagaaaaccaaaaacaatgattgggattatgtagtaactaccgacatatcggaaatgggcgccaattttcgcgccgatagggtgattgatcccaggagatgcctaaaacctgttatactaaaggacggaccagaaagagtaatattagcgggacctatgccagtaacagtggcttcggcagctcagcgtagaggacgaataggaagaaatcaaaacaaagaaggagatcaatatatctatatgggacaaccgctgaacaatgacgaagatcacgcccattggactgaagcaaaaatgttactagataacatcaatacaccagaaggaatcataccagctctcttcgaaccagaacgagagaaaagcgcagccatcgacggtgaatatagattaagaggcgaagcgcgcaaaacttttgttgaattaatgagaagaggtgatctcccagtttggttaagctataaagttgcgagtgagggatttcaatattccgaccgacggtggtgctttgatggcgagagaaacaaccaagttctagaagaaaatatggacgtagaaatatggacaaaggagggcgagagaaagaagttaagacccaggtggttagatgcaagaacatacagtgatccattagcccttcgtgaatttaaggagtttgcagcgggccgcagatcggtgtccggtgacttgattctagaaataggcaaattaccacaacatttgactcaacgagcacaaaatgcactcgataatttagttatgctacataattctgaacaaggtggaaaagcatatcgccacgcaatggaagaactacctgacacaatagagacgctaatgctcctagcattgattgctgttctcacgggaggggttacattgtttttcttatccggaagaggactgggcaaaacatcaataggactgctatgcgtgatggcttcttccgcgcttttgtggatggcctcagtagagccgcattggattgccgctagtattatattagagttctttctgatggtactcttaatcccagaaccggatagacaaagaactccgcaagacaatcaattggcttatgtcgtcattggattattattcatgatcctcactgttgcggcaaatgaaatgggattattggaaactacaaagaaggatctaggtattgggcatgcagctgcggaaaaccaccaccatgctgcaatgctagacgttgatttgcatccagcaagtgcatggaccctgtatgccgttgctacaactattatcacacccatgatgcgtcacacaatagaaaatacaacagctaacatatctctaaccgcgattgctaatcaggcggcaattttaatgggattagataaagggtggccaatcagtaaaatggacattggagtcccactactagcgctaggttgttattcgcaagtaaaccctctgactctgacagcggctgtactaatgcttgtagcacattacgcaataattggccctggtctccaagccaaggctacacgagaagcacagaagaggactgcagcaggtatcatgaagaaccccactgtcgacggaatagtcgcaatagatttagatcccgtggtttatgacgctaaatttgaaaaacaattgggccaaataatgttattaatattatgtacgtcacaaatactattgatgaggacgacatgggcactgtgcgaaagtatcacgcttgctaccggtcctttaacaacactctgggagggcagcccggggaaattctggaatacaactatcgctgtatcgatggcgaatatttttcgcgggtcctaccttgctggcgctggtctagcattctcacttatgaaatcgttaggaggaggtagacgaggtacaggagcgcagggagaaacattaggcgagaagtggaaacggcaactgaatcagctgtcgaagtcagaatttaatacttacaaaaggtcaggtattatggaggtagataggtctgaagctaaagaaggactaaaacgcggagagaccacaaaacatgcagtatcaagagggacagctaaactaaggtggtttgtagagagaaatttagttaaaccggaggggaaagtgatcgaccttggctgcggacggggtgggtggagttactactgcgctggtttgaagaaagtgacggaagtcaaaggttatacgaaaggagggcctggacatgaggagccaatcccgatggctacgtacggatggaatctagtaaagctccatagcggcaaagacgtatttttcaccccaccagaaaaatgtgatacattactatgcgacataggtgaaagcagcccaaaccccacgatagaagagggtaggacattacgtgtcttaagaatggtggagccctggctaaggggaaaccaattttgtattaaagttctgaacccatatatgccttcagtaattgaaacgctagaacaaatgcaaagaaaacatggaggaatgttagtgcgcaacccattatcaagaaattcaactcatgaaatgtattgggtgagctgcggcacaggtaacatcgttagtgcagtaaacatgacatcaagaatgcttctaaaccgatttacaatggcacataggaagccaacatacgaaagagatgtggacctgggtgcgggaactcgtcacgtagccgtcgagccagaagtagcaaatctcgatataataggccagaggatcgaaaacatcaaaaatgaacataaaagtacatggcattatgatgaagacaatccgtataaaacatgggcctatcatggatcatacgaagtcaaaccatctgggtcagcctcaagtatggtaaacggagtagtgagattgttaacaaaaccatgggatgtcatccctatggttactcaaatagcgatgacagataccacaccatttgggcaacaaagggtattcaaggaaaaagtagacacaaggacgccaaaagcaaaacggggcacagcacaaattatggaagtgaccgcgcgttggctatggggctttttgtcgaggaataagaaaccacgtatttgtacccgagaagaatttactcggaaggtcaggtcgaatgcagcaatcggtgcagtgtttgtagacgaaaatcaatggaactcggccaaagaagctgtcgaagacgagagattctgggacttagtgcatagagaaagagaattgcacaaacaaggtaaatgtgccacatgcgtttataatatgatggggaaacgtgagaagaaattgggagagtttggtaaagcaaaaggctcacgcgcaatatggtacatgtggcttggagcacgttttctggaatttgaagcactaggttttatgaatgaggatcattggttttctcgagaaaactccttgagtggtgttgaaggtgaaggtctacacaaactaggatatatactgagagatataagtaaaattcctggaggcaacatgtatgcagacgatactgcagggtgggatacaagaattacagaagacgatttacagaacgaagctaaaattacggatatcatggaaccggagcatgccctacttgccacctcaatatttaaactcacttatcaaaacaaagtcgttcgtgtacagcgaccagccaaaaatggaacagtaatggacgtgataagccgccgagaccagcgcggaagcggacaagtaggtacctacggacttaatacgtttacgaacatggaagcccaattgatcagacagatggagtccgaagggatatttactccctctgaactcgagacgccaaatctagcggagcgcgtccttgattggctcgagaaacacggtattgagcgcttaaaaaggatggctataagtggcgacgattgtgtcgtaaaacctatcgatgatcgctttgctacagctctaacggccttaaacgacatgggtaaagtaaggaaagacatcccacaatgggaaccatcaaaaggatggaatgactggcagcaggtcccattttgttcacaccattttcatcaactcatcatgaaagacggtagagaaatcgtggttccatgccgaaatcaggacgaactcgtaggtagagcaagagtatcacaaggggcaggatggtcattaagagaaactgcatgtctgggaaaatcatacgctcagatgtggcaactaatgtatttccacagacgcgacctacgactcgcagcgaacgctatctgcagcgctgttcctgtagactgggtaccaaccagccggacgacatggtctattcacgcacaccaccagtggatgacgacagaagatatgttatcagtttggaatcgtgtttggattgaagaaaacccatggatggaggataaaactcatgtatcatcctgggaagacgtaccttatcttggaaaacgagaggatcaatggtgcggcagtctcatagggcttactgccagagccacatgggctactaacattcaagtagcaattaatcaagtccgacgtcttatagggaatgaaaattatttagactatatgacttcaatgaaaagatttaagaacgagagcgatcccgaaggcgcactttggtaa

SEQ ID NO: 22064 - RNA, 9879 nt, synthetic construct
  misc_feature 1..9879: note = derived and/or modified CDS sequence (opt6) from DENV-1__KC762624__SS-prME
  source 1..9879: mol_type = other RNA
tcagttactatgttattaatgttaatgcccactgcactagcattccatctaacaacaagagggggagaacctcacatgattgtatcaaaacaagaaaggggtaaaagccttttattcaaaacctccgccggtgtaaatatgtgtaccttaattgcaatggatttaggtgaactttgtgaagacacccttacttacaaatgcccaagaattacggaagcagaacccgacgacgttgattgttggtgtaatgctacagacacctgggtgacttatggaacctgttcacaaaccggtgaacatcgaagagataaaagatctgtcgccttagcacctcacgtgggccttggacttgaaacgcggacagaaacatggatgagttcagagggggcctggaaacaaattcaaagagttgaaacatgggcattacggcacccggggtttactgtaatcgccttattcttggcacacgcaatagggacttccataacccaaaaaggaataatctttatattactaatgctggtaactccgtcgatggctatgagatgtgttggcattggcagtcgagactttgtagaaggattgagtggggcaacatgggttgatgtagtacttgaacatggaagttgtgtaacaacaatggccaaagataaacctacactagacatagaactcttaaaaacggaggtgactaaccccgcagtacttaggaaactatgcattgaggccaaaatctccaacaccacaactgactctcgttgccccactcaaggtgaagctaccctcgtagaagaacaagatgcaaactttgtatgcagaagaacttttgttgacagaggatggggcaatggttgtggactgtttggcaaaggctcactcataacatgtgccaaattcaaatgcgtaacaaaattggaaggaaaaattgtacaatatgagaatttaaaatatagcgtgattgtcacagttcacacaggagatcaacaccaagttgggaatgaatcaacggaacatggaactacagcaacaataacaccccaagcaccaacaacagagatacaactaacagattatggcgcacttacattagactgttcccctaggaccggactggatttcaatgaaatggtcctactaaccatgaaagagaaaagctggctagtccacaaacagtggttcctagacttaccgttaccatggaccagtggtgcatcaacatcccaagagacatggaatagacaggatcttctagttacatttaaaactgcgcatgccaagaaacaagaagttgttgtattaggtagtcaggaaggagcaatgcatacggcactcactggtgcaaccgaaattcaaacctctggaacaaccactatatttgcgggccacctaaaatgcaggttaaaaatggacaaattaaccttaaaagggatgagctacgttatgtgcacaggatcatttaaattagagaaagaagtggccgaaacccaacacggcacagtactggtacaaattaaatatgaagggacagatgcaccgtgcaagataccattctcaacacaggatgaaaaaggggtcacccagaatgggagattaataacagccaacccaatagtcaccgataaagaaaaaccagttaacatagaagcagaaccaccattcggagaatcttatatcgtaataggggccggagagaaagcgctaaaattgtcgtggttcaaaaagggttcgagtataggaaagatgtttgaagcaacagctcgaggcgcccggcgcatggcaatcttgggcgatactgcctgggattttggaagcataggtggagtgttcacttcagtgggaaagctagttcatcaaatttttggaactgcttatggcgttttattcagtggagtcagttggactatgaagatcggtataggtgtacttctgacctggttaggtctaaactcaagaagtacaagtttaagcatgacttgtatagctgtaggacttgtaacattatacttaggagtaatggtacaagcagattcgggatgtgtgattaactggaaaggcagagaattaaaatgtgggtcgggaatattcgtcactaacgaagtccacacttggacggaacagtacaaatttcaggcagacagtccaaaaagactaagcgctgccataggaaaggcttgggaagaaggagtctgcgggattcgatcagcgactagattagaaaatataatgtggaaacaaataagtaacgaattaaatcatattttattggagaacgatatgaaattcacagtggtagtaggagatgtagctggaatactagcacagggtaagaaaatgattaggccacagccaatggaacataaatatagctggaaatcctggggaaaagctaaaattattggcgcggatgtgcaaaacactacttttataatagatggcccgaatactccagaatgcccagatgatcaacgagcgtggaacatctgggaagttgaagattatggattcgggatctttacaacaaacatatggcttaaattacgcgatagttatacacaggtttgcgaccatcggttgatgtcggcagctattaaggattccaaagctgtccatgcggatatgggatactggatcgaatctgagaaaaatgaaacatggaaacttgctcgtgcctcattcattgaagtaaaaacttgtatatggccgaagtcgcacacattgtggagtaacggagttttagagagcgagatgatcattcccaaaatatacggaggcccgacaagtcaacacaactacagacccggatattttacacagactgcaggaccctggcaccttggaaaacttgagttggattttgatttatgtgaaggaacaacagtcgtggtcgatgagcactgtggaaacagaggtccaagcctaaggactactactgtaacaggaaaaattatacatgaatggtgttgcaggtcttgcactctaccacccttgaggtttagaggtgaagacggttgctggtacggtatggaaataaggccagtaaaggaaaaagaggaaaacttggtcaaatctatggtgagtgctggtagcggagaagtggattctttctcgttagggctactgtgtataagtattatgatagaagaagttatgcgatcaaggtggagcagaaagatgttaatgacaggcacgttggccgtattctttttactcattatgggtcaactaacgtggaacgacttgatcaggttatgtataatggtaggagcaaacgcatcagatcgcatgggtatgggaactacgtatttggcactaatggctacttttaaaatgcggccaatgttcgcagtaggtctattatttcgaagactgacgtctagagaagttctcctgctcacgataggactcagtctagtagcatctgtagagcttcctaactcattggaagaactaggagacggactagctatgggaataatgatacttaaacttttgactgattttcaatcgcatcaactttgggcaacgttgttatccctaactttcattaaaacgacattctcgcttcactacgcatggaaaaccatggcgatggtgctatcaatagtgagtctttttcctctatgtttatccacaacgagtcagaaaacgacttggctaccagtattgctaggaagtctcgggtgcaaaccattaacgatgtttttaattgctgaaaacaagatctggggacgtaaatcttggccacttaacgagggtataatggcagtaggcatagtgagtattttattatctagtctacttaaaaatgacgtcccactagcaggaccactaatagcaggagggatgctgattgcatgttacgtaatcagcggcagtagcgctgatttatccttagaaaaagcggcagaagttagctgggaggaagaagctgaacacagtggcgcgtcacataatatattggtagaagtacaagatgatggaaccatgaaaataaaggacgaagagagagacgatactctaacaatcttactgaaagctaccctattagccgtctctggtgtttaccccttgtcgatacccgcgacgctctttgtatggtatttttggcaaaagaagaaacaacgtagcggagtcttatgggacacgccgtccccaccagaagttgaaagggctgtattagacgatggaatttacagaattatgcaacggggtctacttggaagatcgcaagttggtgtgggcgtatttcaagaaaatgtgttccatacaatgtggcatgttactagaggtgcggtattaatgtaccaagggaagagactggagccttcatgggcaagtgtcaagaaagatctaatttcctatgggggcggttggaggctccagggaagctggaataccggggaagaagtccaagttattgcagtagaaccggggaaaaatcccaaaaatgtacaaactgctcctggaacgttcaaaactccagaaggagaagttggtgcaattgcattggattttaaacctggcacgagtggctcgccaatcgtcaatagagagggcaagatagtaggcttatatggcaatggcgtagtaacaacgagtggaacttatgtaagcgcaatagcacaagctaaagcgtcacaagagggccctttgcctgaaatagaagatgaagtatttaggaaaaggaatcttaccataatggaccttcatccaggatcagggaagacacgacgatatttgccggctattgtccgggaagcaataaaaaggaagttacgaaccttaatactagcacctacccgtgttgtcgcttcagagatggctgaggctttaaaaggaatgcccatacgctaccaaacaactgcagttaagtcagaacatacaggaaaagaaattgttgatttgatgtgtcatgctacgttcacaatgcgtttactatctcctgttagggtacccaattacaatatgataataatggacgaagcgcatttcactgatccctcgagtattgcagcacgaggatacatatcgacccgagtcgggatgggtgaggctgcagctatctttatgaccgctactccacctggttcggtagaagcatttccccaatctaatgcagttatacaagatgaggagcgagacataccagagagatcctggaacagcggctatgaatggatcactgatttcccagggaaaaccgtatggtttgtaccttctataaagagcggcaacgacattgcgaattgtctcaggaaaaatggaaaacgggtaatacagctatctaggaaaacatttgataccgaataccaaaagacgaaaaataacgattgggactatgtagtcacaacggacatttcagaaatgggagcgaatttccgagccgatcgagtaatagatcctaggaggtgtctcaaaccagtaatccttaaagacggtcctgagagagtaatactagctggccctatgccagttacggtagcaagcgcggcccaaagacgcggacgagttggacgcaatcataataaagaaggtgaccaatacatatatatgggacaaccacttaataatgatgaagatcacgctcactggacagaagctaaaatgctgttggacaacattaacacgcccgaaggtatcatacctgcattatttgaacccgaaagggaaaaatcggcggccatagatggggagtatcggttaagaggagaagcaagaaaaactttcgtcgagttaatgcgaagaggggatctacccgtgtggttaagctataaagttgcctccgaagggttccagtattcagatagacgatggtgctttgacggtgagcgaaacaatcaagtgctcgaagagaacatggatgttgagatatggactaaagagggagaaaggaagaaactaagacctcgatggcttgatgcaagaacatacagtgaccctctcgctttacgtgaatttaaagagtttgctgctgggcgacgatcggtatcaggcgacctcatactcgaaattggcaaattaccacaacatctcacgcaaagagcccaaaatgctttagataaccttgtaatgttacataattcagaacaaggcgggagagcataccgacacgctatggaagaactacccgatacaattgaaacccttatgctactcgctttaatcgcggtattaacaggtggagtcaccctgttcttcctctcgggccggggcctgggaaaaacgtcaatcggactgttgtgcgttatggcaagctccgtattattatggatggcatccgtggagccgcattggatagcagcctccattattcttgaatttttcctcatggtcttattgattcccgaacccgaccgacagcggactcctcaagataatcaactagcctacgtggtaattggattactattcatgatcctaacagtggcagctaacgaaatgggcttgttggagacaaccaagaaagacttaggtatagggcatgttgcagttgaaaaccaccaccacgcggcaatgcttgacgtagatttacacccggccagcgcgtggactctttacgcggtcgcaacaacaattataacccccatgatgcgtcacaccatcgaaaacacgactgccaatatctcgttgactgcgatagcgaatcaggcagcaattttaatggggttggacaaaggctggccaataagtaaaatggatataggagtgcctcttcttgctcttggatgttatagtcaagtaaatccacttactttaacggccgcagtgttaatgttggttgcacattatgctattattggacctggcttgcaggctaaagctacacgcgaagcacagaaaagaacagctgctggcataatgaaaaatccgactgtagacggaattgttgctatagacttagatcctgtagtgtatgatgcaaaattcgaaaaacagttaggtcagataatgttgctgattctatgcactagccaaatactgttaatgcgaaccacatgggctttgtgtgaatcaatcacgttagctacaggacccttaacaacactatgggaagggagcccaggcaaattctggaatacaactatagcagtatcgatggcaaatattttcagaggttcgtatctagcaggggcaggattggcattttctctaatgaaaagtttgggtggaggccgcaggggtactggggcacaaggggaaacgcttggggaaaaatggaaacgacaattgaatcaactaagcaaatccgaatttaatacctataaacgaagtggtataatggaagtagatagatctgaagcgaaagaaggattgaagagaggggaaacaacaaagcatgctgtgtctcgagggacggcgaaattgagatggttcgttgagcgcaacctggtaaagcctgaaggaaaagttattgacctaggttgtggacgtggaggctggagttactattgtgcagggctcaagaaagttacagaagtgaaagggtacaccaaagggggtccaggacatgaagaacccattcccatggctacttatggctggaacttagtgaagctgcactccgggaaagatgtattctttatacctccagagaaatgtgatacattgttgtgcgatatcggggaatccagtcccaatccaactatcgaggaaggtcgaacactaagggtactaaaaatggtagaaccgtggttaagaggaaaccagttttgcatcaagatactgaatccttatatgccgtcggtcgttgaaactttagagcaaatgcaaaggaagcatggagggatgctagtaagaaatcctctaagccgaaatagcacccacgaaatgtattgggtatcttgtggaacaggtaacatcgttagtgctgtaaatatgacatctcgaatgctcctaaacagatttaccatggcgcaccggaaacctacgtatgaaagagatgtggatttaggagcaggcactagacatgtggccgtcgaaccagaggtggcaaatttagatataataggtcagcgaatagaaaacataaaacatgaacacaaaagtacatggcactatgatgaagataacccatacaaaacgtgggcttatcatgggtcttatgaagtcaaaccctcagggtctgcttcttcaatggtaaacggagttgtaaagctgctaaccaaaccgtgggatgtaatacctatggttacacaaatcgctatgactgacactacacctttcggtcaacaacgcgttttcaaagaaaaagttgatacaaggacgcccaaagcaaaaaggggtacgacacaaattatggaggtaactgcaagatggttatggggtttcttatcaagaaataagaaaccacgcatctgcaccagagaagaatttacaagaaaggtacgatcgaacgcagctataggcgccgtgttcgtagatgagaatcaatggaatagcgcaaaggaagccgtcgaagacgagaggttctgggaccttgtacacagggaaagagaattacataaacagggaaaatgcgcaacatgtgtatataacatgatgggtaaacgggagaagaagttaggagaatttggtaaagcgaaaggtagccgtgcaatctggtatatgtggctcggcgcaagattcctagagttcgaagcacttggttttatgaatgaagatcattggtttagcagggaaaatagtctgagtggcgtagaaggcgagggactacataagttgggttatattttaagagatatatctaagatacctgggggtaatatgtacgcagatgatacagccggttgggacacaagaataacagaagatgacctacagaacgaggcaaaaataacagatattatggagccggaacacgctctattagcgaaagcaatatttaagttaacgtatcaaaataaggttgttcgggtgcaaagaccggcgaaaaatggtaccgtcatggacgttattagccgacgagaccagagaggatcgggtcaagtaggcacatatggtctaaacacttttacaaatatggaagcacaattaataagacagatggagtcagaaggaattttctcgccaagtgaattagaaacaccaaatttagccgaaagagtgctcgattggttggagaaatatggagtcgaacggttaaaacgaatggctatctctggagatgattgtgtagttaaaccgattgatgaccgatttgcaacagcgctcacagcactaaatgacatgggcaaagtccgcaaagatattccacaatgggaaccaagcaaaggatggaacgattggcaacaagtaccattttgctcgcatcacttccatcaattaataatgaaagatggccgcgaaatcgtcgtcccttgtcgcaatcaagatgaacttgtaggccgagccagggttagccagggcgcgggctggagcttaagagaaacagcatgtttgggaaaatcgtatgctcaaatgtggcagttaatgtattttcataggagagatttaagacttgctgcaaatgccatatgctcagcagtacctgtcgactgggtgccaacgagcagaactacatggtcaattcatgcacatcatcaatggatgacgactgaagacatgttatccgtctggaaccgtgtgtggatcgaagagaatccgtggatggaggataaaacacacgtctcaagttgggaagatgtaccttatttgggcaaacgagaagaccaatggtgtggttcacttatagggttaactgcaagagcaacttgggctacgaatattcaagtagcgataaatcaggtaagaagattaataggcaatgaaaactatttagattatatgacaagcatgaaaagattcaaaaatgaaagcgatcccgaaggagctctttggtaa

SEQ ID NO: 22065 - RNA, 9879 nt, synthetic construct
  misc_feature 1..9879: note = derived and/or modified CDS sequence (opt6) from DENV-1__KC762644__SS-prME
  source 1..9879: mol_type = other RNA
tcagtgacgatgctcttgatgcttatgccgacagccctggctttccatttaactacaagagggggagaaccccatatgattgtgagcaaacaagaacgtggaaaaagtctgctctttaaaacaagcgcaggggtaaatatgtgcacactaattgcaatggacttaggagaactctgcgaagatacactcacatataagtgtccacgaatcacggaagcagagcctgatgatgtagattgctggtgtaacgctacagacacctgggttacatacggaacttgttcccaaacaggcgaacaccgaagagacaaaagatcggtagctctggcaccacatgtcggtttgggcctagaaacccgtacagaaacgtggatgtcctctgaaggtgcatggaagcaaattcaacgcgtagaaacatgggcactaaggcatccagggtttacagtaatcgcactgtttcttgcacacgctattggaacatcaattacccaaaaaggcataatttttatacttctaatgcttgtgacgccaagtatggcgatgcgatgcgtcgggataggtagccgtgacttcgtcgaaggattatctggtgcaacctgggtagacgtagtactagaacacggaagttgcgtaaccactatggcaaaggacaagcctaccctagacatagagctactaaaaactgaagtaacaaacccagctgtactcagaaaattgtgtatcgaagcaaaaattagcaatactacgacagatagccgatgtccaacacaaggagaagcaaccctagtagaggagcaagatgccaactttgtatgtcggaggacctttgtcgacagaggttggggaaatgggtgcggtttatttgggaaaggttctctaattacatgtgcgaagtttaaatgcgtaacaaaattagagggaaagatagtacaatatgaaaatctcaagtacagtgtgatagtaactgtccacaccggagatcaacatcaggtaggcaatgaatcaacagaacacggaacgacagccacgattacaccccaagcaccgaccacagagatacagcttacagattatggtgcacttaccctagattgtagtccacgtacaggtctagattttaatgagatggtcttacttactatgaaagagaaaagttggcttgttcacaaacaatggtttttagatttgccccttccctggacaagcggagcgagcacttcgcaagagacttggaacagacaagatttattggtgacattcaaaaccgcgcatgctaagaaacaagaagtggtagttttaggttcccaagagggagctatgcatacagcgctaacaggtgcgactgagatccagacatcgggtactacaactattttcgctgggcacctaaaatgtcgactaaaaatggataaacttacattaaaaggcatgagttatgttatgtgtactgggtcatttaaacttgagaaagaagtagcagaaactcaacacggaactgtgttggtccaaatcaagtacgaaggcactgacgctccgtgcaagataccatttagtacacaggatgaaaagggtgttacacaaaacggacgtctcataacagctaaccccattgtgacagacaaagaaaagcccgtaaacatagaggctgaaccaccatttggcgaaagctacatagtaattggagcgggagaaaaggcattaaaactaagttggtttaagaaaggttcatctattggcaagatgttcgaagcaactgcaaggggagctcgaagaatggcaatattaggtgataccgcgtgggacttcggatccataggtggcgtatttactagcgtaggaaaattagtacatcagatatttggaacagcatacggggttctattctctggagttagctggactatgaaaataggcataggagttctattaacctggttaggtctcaatagccgatccaccagcttaagcatgacctgcatcgccgtcgggctggtaactctctatctcggagtaatggtacaggcagactcgggatgtgtaataaactggaaaggtagagaattaaaatgtggaagcggcatctttgtgactaacgaagtccatacctggactgaacagtataaattccaagctgatagtcctaaacgattaagtgcagctataggaaaagcgtgggaagaaggtgtatgcggtatacggagcgcaactagactcgaaaacataatgtggaaacaaatctctaatgaattaaaccatatattacttgaaaatgacatgaaatttacagtagtggttggagacgttgcgggtatcttagctcaagggaaaaagatgatcagaccccagccgatggagcataaatatagttggaaatcctggggtaaggccaagataataggtgcagatgtgcaaaatacaacattcataatagacggccccaacactccagagtgcccagatgatcaacgtgcatggaatatctgggaggtagaagattatggctttggcatattcacgacgaacatttggctgaaattacgtgacagctatacacaggtgtgcgatcatcgtctaatgagcgcagcgattaaagacagcaaggcagtacacgcagatatggggtattggattgaatctgagaagaatgaaacatggaaacttgctagagcgtcatttatagaagtgaagacttgtatatggccgaagtcacatactctatggagtaatggagtactagagagcgaaatgattataccaaaaatatacggaggaccaatatcacaacacaattatcggccaggatatttcacacagactgcaggaccttggcacctaggaaaattagagctagactttgacctttgcgaaggaacaactgttgtcgttgatgagcattgtggaaatcgaggaccatccttaaggacaacaacagtcactggaaaaataattcacgaatggtgttgccgttcatgtactctgccacccttaagatttcgaggagaggatggatgctggtacgggatggaaataagaccagtaaaagagaaggaagaaaacctagtaaaatcaatggtttctgccggatctggagaggtagacagtttttcattaggacttttatgcatcagcattatgatcgaggaagtaatgcgttccagatggagcagaaaaatgcttatgacaggtacgctagcagtattcttcttactcatcatgggtcagctaacctggaatgatttaataagattatgtataatggtaggtgcgaacgcctcagatcgaatgggaatgggtactacatacttagcattgatggcaacatttaaaatgcgacctatgtttgcagtaggtttgctattcagaaggctaacctctagggaagtactgttactaaccattggtcttagtcttgtcgcttcagtagaactcccaaatagtttggaagaactaggtgacggactggcaatgggtataatgattttgaaattacttacagattttcagtctcaccaattatgggcaacactgttgtctctaactttcattaaaactacatttagtctacactacgcgtggaagacaatggctatggtactatccatagtttctctatttccattatgcctgtccacaacatcacagaaaacaacatggcttcccgtgctgctaggatcactcggctgtaagcctttaacaatgtttctaattgccgaaaataagatttggggtcgtaaaagttggccattaaatgagggcataatggcagttgggattgtatccattttactaagcagcttacttaagaatgatgtaccactcgcaggtccattgatcgcgggaggtatgcttatagcatgctatgtaatttcaggttcatctgcagacctttccttggaaaaggcagcagaagtttcatgggaggaagaagcagaacatagtggtgcttcccataacatattagtggaagtccaagatgacggaacgatgaaaataaaggatgaagaaagagatgacactttaacaatcctactcaaggcaactttacttgctgtaagtggcgtttatcccttatccatccccgcaaccttgttcgtatggtacttctggcagaaaaagaaacaaaggagcggcgtattatgggacaccccaagtcccccagaagtggagcgagcagtattagacgatggtatctatagaattatgcaacgtggattattaggtcgaagccaagttggggttggagtttttcaagagaatgtgttccatacaatgtggcacgtaacaagaggagcagtactcatgtaccaagggaagagattggaaccctcctgggctagcgtcaagaaggatttaatatcatatggtggtggctggcgactacaagggtcatggaatacaggagaagaagtacaagttattgctgttgaaccgggtaaaaaccctaagaacgtccaaacagcgccgggtacatttaaaacaccagaaggagaggtgggtgctatcgctctcgattttaaaccaggtacaagtggcagtccgattgtaaacagagaaggaaagatagtaggcctttacggtaacggcgtcgtaacaaccagtggtacatacgtgtctgccattgcacaagccaaagcaagtcaggagggccctttaccagaaatagaagacgaggtcttccgtaaaagaaatctgactattatggatttacatccaggatcaggcaaaacccgacgttacttacctgctattgtcagggaagccattaaacgaaaacttagaacactaatcttggcacctacgagagttgttgcatcagagatggcggaagcacttaaaggaatgccaatacgatatcaaacaaccgcggttaagtctgaacataccggaaaagaaatcgttgacttaatgtgtcacgcgactttcacaatgagattattatccccggtgagggtccctaactataacatgataatcatggatgaagcccatttcactgatccatcttcgatagctgccagaggatatatatccacaagagtagggatgggagaagcagcagcaatattcatgacagcaactccgccaggatctgtagaggcgttcccccagtcaaatgccgtcatccaggatgaggaacgagatataccagagaggtcgtggaatagcggttatgaatggatcaccgattttccaggaaaaacagtatggtttgttccaagtattaaatcgggcaatgatatagctaactgtttaaggaaaaatggcaaaagagtaatccaactcagcagaaagacatttgatacagaatatcagaaaactaaaaacaatgactgggattacgtagtaactacagacatttcagaaatgggagccaattttcgggcagatagggtaatagatcctcgacgttgcttaaaaccagtcattctaaaggatggaccagaacgcgttattctggccggacctatgccagttacggttgccagcgctgcccaaaggagagggagagttggacggaatcacaataaagaaggcgaccagtacatatacatgggccaaccgctaaacaatgacgaagatcatgcacattggacggaagcaaaaatgctcctggataacataaatacccctgaaggaatcataccagcgctttttgagccagaaagggagaaaagtgcggcaattgatggagagtatcgactgcgtggagaagcacgtaagacttttgtagaactaatgaggagaggcgacctccccgtatggctgtcctataaagtcgcatctgaaggctttcagtacagcgatcgtcgctggtgttttgacggcgaacgaaacaaccaagtacttgaagaaaacatggatgtcgaaatatggacaaaagaaggagaaaggaagaaattgcgaccacgttggttagatgcacgaacatactcagaccccttagcgttaagagaatttaaggagtttgctgctggacgaagatcggtgtctggcgatctaatcttggaaatcggtaaactcccacagcatctgacccaacgagctcagaatgctctagataatttagtgatgctccacaattcagaacagggaggaagggcgtatagacatgcaatggaggaactacctgatactattgaaaccttaatgctcttagcattgatagccgtattaacgggcggagtaaccctatttttcctaagtggtcgaggactaggaaaaacttcgattgggttattatgtgttatggcaagctccgttctcttatggatggcttcagtagaaccacattggatcgctgcaagtatcatattagagtttttcctaatggttttgctaatacctgagccggatcgccaaagaaccccgcaagacaatcaattggcgtacgtggttataggcctactatttatgatactcacggtagctgctaatgaaatgggtctactagaaacaactaagaaagacctaggaattggccacgtagcagtggaaaatcatcaccatgcagcaatgttagatgtggacctacatcctgcctccgcctggaccctttatgcggtcgcaaccacaattataacgcccatgatgcgtcatacaatagaaaataccaccgccaatatctctttaacagcaatcgcaaatcaggctgccatattaatgggattagacaaaggttggcctatttcaaaaatggatataggagtacctttgttagcattgggatgttattcgcaagttaacccgttaacgctgacagcagctgtacttatgctagtagcacattatgcgatcataggaccaggactacaggcgaaagcgacacgtgaggcacagaaaagaaccgctgcaggaattatgaaaaatccgactgtggacggaatcgttgctatagacttagatccagtagtatacgatgcgaaatttgaaaaacaattagggcagattatgctactaattttatgtacaagtcaaatattattaatgcgtacaacatgggcactatgtgaaagtataactctagcaacaggaccccttacaacattgtgggaggggtcaccaggcaaattttggaatacaacaatagctgtaagtatggctaacatatttagaggaagctacttggccggtgccggtttagcatttagtctaatgaaatcattgggaggtggtcgtcgcggtacgggagctcaaggtgaaacgcttggggagaagtggaaacggcaattaaatcagcttagcaagagtgagttcaatacttacaaaagaagtggcataatggaagtagatcggagtgaggcaaaggagggtttgaaacgaggtgagactacaaaacacgctgtatccagaggtacagctaaactgcgatggtttgtggaaaggaatcttgtaaaacctgaaggaaaagttattgatcttggctgtggtcgaggtgggtggtcatattattgtgctggtttgaaaaaggtaacagaggttaaaggctatactaaagggggacccggtcatgaggaaccaatcccaatggctacatacggatggaacttggttaaattacattctggcaaggatgtattctttatacccccagaaaagtgtgatacattactatgtgacatcggagagtcttctcccaacccaactatcgaagaaggtcgtactctccgtgtattgaaaatggtagagccatggttacgaggtaaccagttctgtattaaaattctaaacccatatatgccttcagtagtcgagacgctagaacaaatgcaaaggaaacatgggggcatgcttgtacggaaccctttatcaagaaatagtacacacgaaatgtattgggtttcttgcggtacgggaaatattgtatctgcagttaatatgacgtcacgtatgttactaaatcggttcacgatggcccacagaaagccaacatacgaaagggacgtagacctcggcgcaggtacacggcacgtagctgtagagcccgaggttgctaatttggatataatagggcagagaatagaaaatataaaacatgaacataagagtacttggcattatgatgaggataatccatataagacatgggcctaccacggttcatacgaagtaaaacctagcgggtcagcatcatctatggtaaacggcgtcgtgaaacttctaacaaaaccttgggatgtaatacccatggtgacacaaatagcaatgacggacaccacaccatttgggcaacagagagtattcaaagaaaaggtagatacacgcactccgaaagcaaagcgaggaacaacacagataatggaagtaaccgcaagatggttatgggggtttttaagtagaaataagaaaccacgaatatgtactagggaggagttcacacgaaaagtaaggtcaaatgcagcgattggagctgtatttgttgacgaaaatcaatggaactcggctaaagaggctgttgaagacgaaagattctgggatttggtccatagagagagagagttacataaacaggggaagtgcgcgacgtgtgtatataacatgatgggcaaaagggagaaaaagctaggagaatttgggaaagccaaaggaagcagggcaatatggtacatgtggctaggcgcaaggtttctcgaatttgaggctttaggatttatgaatgaagaccattggttctcgcgtgaaaactcattatcaggagtagaaggggagggattgcacaaactaggatacatattaagagatatatcaaaaataccaggcggtaatatgtatgccgatgatacagctggatgggacactaggattaccgaggacgacctgcaaaatgaagctaagatcacggacataatggagcccgaacatgcactattggctaaagcgatattcgaattaacttatcaaaataaagtcgttcgtgtacaacgaccagccaaaaacggtacagtcatggatgtaatatcgaggagagaccaacgcggttcaggccaggtaggtacgtatggactcaatacatttactaatatggaggctcagctgattaggcaaatggaatcagaaggtatattttcaccttctgaattggaaactccaaacctggcggaacgggtcttagactggttagaaaaatatggagtagagcgattgaaaagaatggcaatatcaggggacgattgcgtcgtcaaaccgattgacgaccggtttgccactgcacttactgcgctgaacgacatggggaaagtcagaaaagacataccccagtgggaaccatccaagggttggaatgactggcaacaagtaccattttgtagtcaccatttccaccaacttataatgaaggacggcagagaaatcgtggtaccatgtagaaatcaagatgaattggtcggtagagcacgtgtgtcgcaaggagcaggatggtcattaagagaaaccgcttgtctaggcaaatcatacgctcagatgtggcaattgatgtattttcatagaagggatctacgtcttgcagccaatgcaatatgttccgctgtaccggtagactgggtcccaacctcacgaacaacctggtctattcatgcccaccatcaatggatgacaacagaagatatgttaagcgtgtggaacagggtatggatcgaagaaaacccctggatggaagacaaaacacacatttcatcatgggaagacgtaccttatttagggaaacgtgaagatcaatggtgtggatccctaataggcctcacagcgagggcgacatgggcaactaatatacaagtggctataaaccaggtacgtcgtttaataggaaatgaaaattatctagactatatgacctctatgaaacgatttaaaaatgaatccgatcccgaaggcgcgctctggtaa

SEQ ID NO: 22066 - RNA, 9879 nt, synthetic construct
  misc_feature 1..9879: note = derived and/or modified CDS sequence (opt6) from DENV-1__KC762630__SS-prME
  source 1..9879: mol_type = other RNA
agcgtaaccgttttatttatgctcttaccaactgctttagcattccacctgacaacaaggggaggtgaacctcacatgattgtctcgaaacaagaaagagggaaaagcctcttgtttaaaacaagtgccggggtcaatatgtgtacattaattgcgatggacttgggggaactctgcgaagatacaatgacctacaaatgccctaggattactgagactgagccagatgatgttgattgctggtgcaatgcaacggaaacatgggtaacctatggtacgtgttcacaaaccggggaacatcgaagggacaaacgatctgtcgccctggcaccacacgtagggctgggacttgaaactcgtacagaaacatggatgtcgtccgaaggcgcctggaaacagatacaaaaagtcgaaacctgggcgttgaggcacccgggattcacagttatagccttattcttagcacatgccataggtacatccatcacccaaaaaggaataatttttatattattaatgctagtcacaccgtccatggctatgagatgtgtcggaataggtaaccgagattttgtcgagggtttaagtggagctacatgggtcgatgtagtattggagcatggaagttgcgtaacaacgatggccaaaaataaacccaccctggacatagaactacttaaaactgaagttacaaacccggctatactaagaaaactgtgtatagaagcaaaaatatctaataccacaacagatagtagatgtcctacccaaggggaggccactcttgtagaagaacaagacacaaattttgtatgtcgcaggacctttgtagatagaggatggggcaacggctgtggcctgtttggtaaggggagtttgattacatgtgcaaagttcaaatgtgttactaaattagaaggaaaaatagtacagtatgagaatctaaaatattcagtaattgtaacagtccatacaggagatcagcaccaagttggaaatgaaaccacggaacatggaactacggcaattataacaccccaagcccctacaagtgagatacagttgacagattatggagctttgacactcgactgttccccaaggacagggctagactttaatgaaatggttttattaacaatgaaagaaaaatcatggctcgttcacaaacaatggtttctcgatcttccgcttccctggacatctggcgcctcaacgagccaagaaacctggaatcgacaagacttattagtaacattcaaaactgcacacgctaaaaagcaagaggttgtagtgctgggatcacaagagggagcaatgcataccgcactcaccggcgctacggagatacaaacctcaggaacgacgacgatattcgcaggacacttaaaatgtcgattgaaaatggacaagctaacactaaagggcgtatcatacgttatgtgcactgggtccttcaagctggaaaaagaagttgcagaaactcagcacggcacagtccttgtacaggtaaaatatgaaggtacagatgctccgtgtaagatacctttttcaagtcaagatgaaaaaggggtaatacaaaatggtcgactgattacagctaatccaatagtaacagataaggaaaaacctgtcaatatagaagcagaaccacctttcggcgagagttatatagtagtaggcgctggagagaaagcgctaaaactgagttggttcaagaaaggatcgagtataggcaagatgttcgaggctacagcacgaggtgcacgaagaatggctatcctcggtgacaccgcatgggatttcggctccattggcggtgtttttacaagtgtagggaaactcgtgcaccaaatattcgggacagcttatggtgttctctttagtggagtatcatggacgatgaagatcggaattggaatattgttaacatggctaggcctaaattctagaagcacaagtttatccatgacatgtattgcggtgggtatggtaacgctatatttgggtgtgatggttcaagcagatagtgggtgcgtaataaattggaaaggtagagaactcaagtgcggttcggggatattcgtaactaatgaagttcacacatggactgaacaatacaaattccaagccgattcccctaagagactctcagcagccataggaaaagcatgggaagaaggtgtttgtggcattagaagtgccaccagattagagaatattatgtggaaacaaataagtaatgaattaaaccacattctcttagaaaatgacatgaaatttaccgtcgtagtaggcgatgtatcaggaattttagctcaaggtaagaaaatgataagaccgcaaccaatggagcataaatattcatggaaaagctggggaaaggcgaaaataattggcgcggatgtgcaaaatacaacatttatcattgatggtccaaacacgcccgaatgcccggacaatcaaagggcgtggaatatctgggaagtggaagactatggattcggaatcttcacaactaatatatggttaaaacttagagatagctacacgcaggtatgtgatcatcgtttgatgtccgcagcgataaaagacagcaaagcagtgcacgccgatatgggatattggattgagtctgagaaaaacgaaacctggaaattagccagagcaagttttatagaagtaaaaacttgcatttggcctaaaagtcatacattgtggagcaatggagtactcgaaagcgagatgataatacctaaaatttacggaggcccggttagccaacacaactacagacctggatatttcacacagacagccggaccgtggcacttaggaaagctggaacttgattttgacttatgcgaaggcacaacagttgtcgttgacgaaaactgtggaaacagaggaccgagtttacgaactacgacagttacgggtaaaacaatacacgaatggtgctgtcgatcctgcactttaccacctcttcgatttaaaggagaggacgggtgctggtacggaatggagatacggccagtaaaagaaaaagaagaaaatcttgtgaaaagtatggtttcggcaggctcaggtgaagtagacagctttagtctgggcctcctatgcataagtattatgatagaagaagtcatgcgttcacgatggtctagaaaaatgttaatgacagggaccttggctgtctttctgcttcttacaatgggacaattgacttggaatgacctcatcagactatgcattatggtaggagcaaacgctagtgacatgatgggaatgggaacaacctacttagcattaatggcaacattccgtatgcgccctatgtttgctgttggacttcttttccgccgccttacatctagagaaatattactattaacggttggattaagtttagtggcatcagtagaattgcccaattcattggaagaattgggagatggtttagctatgggtataatgatgttaaaactgttgacagatttccaaccccaccagctttgggcaactttattaagccttacatttgttaagacaacactctctttgcactacgcttggaaaacaatggctatgattttatcaatagtatctctcttaccattgtgtctaagcacgactagccagaaaactacttggcttccagttctcttgggaagtttagggtgtaagcctctaacaatgtttctgataacagagaacaaaatatggggtagaaggagctggccactgaacgagggaataatggcaattgggatagtaagcatactattatcatctttactaaagaacgacgttccattagctggtcctctgatcgcagggggaatgttaatagcatgttacgtcatatctggatcttcagcagatctaagtctagaaaaagccgcagaagtctcatgggaagatgaggcggaacatagcggggccagtcacaacatattagttgaagtccaagacgatgggacgatgaaaataaaggatgaagaaagagatgacaccttgacaatcttgctaaaggcaacattactcgtaatcagtggagtttatccgatgtctgtaccggctactttattcgtctggtacttctggcaaaagaagaaacagcgatcaggcgttctttgggatactccatcaccaccggaagttgaaagagcagtcctggataatggaatttatagaatcttacaacgcggcttactgggacgaagtcaagtaggagtaggtgtatttcaagagggggtattccatacaatgtggcacgtaacaagaggtgcggttctaatgtatcagggaaaaaggttagaaccatcttgggcaagcgtcaagaaagaccttatctcctatggtggaggttggaggtttcaaggcagctggaatactggtgaagaagtccaggtaattgccgtagaaccaggcaaaaacccgaagaatgtgcaaacgactcccggcacatttaaaaccccggaaggcgagattggtgcaatagcactagacttcaagccggggaccagtggttcgccaattgtaaatagagaaggaaaaatagtaggcttatacgggaatggcgtggtaacaactagcgggacatacgttagtgctatagcccaagccaaagtaagccaagagggaccactaccagagattgaagatgaagtgttccgaaagaggaatcttacaattatggatctacatcctggtagcggtaaaacccgcaggtatttaccagcgattgtaagggaggcaataaaaaggaaacttagaactctagtcctagcgccgactcgagtagtagcgagtgaaatggcggaagcattaaagggtatgcctattagatatcaaacaacagcagttaagtctgagcatactggaaaagaaatagttgaccttatgtgccatgcaacatttaccatgagactcctaagcccagtcagagtaccaaattacaacatgattatcatggatgaggcacattttactgatccagcatcaattgctgctagaggttacatatctacgcgagttgggatgggtgaagctgcagccatatttatgactgcaactccaccaggctcagtcgaagcctttcctcaaagcaacgccgtgattcaagacgaggaacgggatattccagaacgaagctggaatagcggatatgaatggatcactgattttccaggtaaaacagtatggtttgttccatctataaaatctggtaacgacatagctaactgtcttaggaaaaatgggaagagggttgtacagctaagtaggaagactttcgatacagagtatcagaagactaaaaacaatgactgggattatgtcgtaacaactgacataagcgagatgggagcgaattttagagctgacagggttatagaccctcgaaggtgcttaaagccggtaatattaaaagatggtcccgaacgagtaatcctcgcaggtccgatgccagtaacagtagctagcgcggctcaaagacgaggcagaataggacgtaatcccaataaagaaggggatcaatacgtttatatgggtcaacctcttaataatgacgaggatcatgcacactggactgaagcaaaaatgttactagataatattaatacacctgaaggtataataccagctttattcgaacctgagagagaaaaatccgctgcaatcgacggagaatatagattacggggtgaagcacggaagacttttgttgaattaatgcgtagaggtgatctcccagtttggctaagctacaaagttgcgtcagaaggattccaatacagcgatagaagatggtgttttgatggagaaaggaacaaccaagtactcgaagagaatatggacgtagagatttggactaaagaaggggaaaggaagaaacttagaccacgttggctcgatgcacgaacatattcagaccctctagcattgagagagtttaaagagttcgcagccggaagaaggagcgtctcgggcgacctcattctagagatcggaaaacttcctcaacatttgactttaaaagctcaaaacgctttagacaatttagtaatgctacataattcagaacagggtggaaaggcttatagacatgcaatggaagaactacccgacacgatagaaactttaatgttgctggccttgattgcagtcttaacgggaggcgttacactatttttcctaagtggtagaggactaggaaagacgtctatcgggcttctttgcgtcatggcaagttcggcattactatggatggctagtgtcgagccccactggattgctgcctcaatcattttagagttcttccttatggtcttgctaataccggaaccagacagacagagaacacctcaagacaaccaattggcatacgtggtcataggtcttctatttatgattctcacagtggcagccaatgaaatgggactgctggaaaccactaagaaagatctgggtattggtcatgccgctgctgaaaaccatcatcacgcggctatgctcgatgttgatcttcatcctgccagtgcatggacactatatgcggtagccaccacgataatcacgccaatgatgcgacatacgatagaaaacaccactgccaatatcagtttaacagcaatcgcaaaccaagcagcgatacttatgggtttagataaagggtggccgatttctaagatggacataggagttcctctcctggctcttggatgttattcccaggtaaatccactaaccttgactgccgccgttctcatgttagttgcacattacgcgatcataggccctggtttgcaggcgaaggctactagagaagcacaaaagaggaccgctgcgggaattatgaaaaatccaacagtggatggaattgtggctatagatcttgatcccgtaatttatgatgctaaatttgaaaaacagctgggacaaatcatgttactgatactatgtaccagccaaatacttctaatgcgtactacatgggccctatgtgaatccattaccctagctacaggcccgctaacaaccttatgggaaggtagccctggaaaattttggaacactacgattgcagtttcaatggcgaacatcttcaggggttcctatctagcaggagcagggttagcattttcactcatgaagtcattaggaggaggtagaaggggcaccggtgctcaaggtgaaaccttgggagagaagtggaaaagacaattaaatcaattgagtaagtcagagtttaacatttataaaaggagtggcataatagaagtagacaggagcgaagccaaagaggggttaaaaagaggagaaacaacaaaacatgctgtatcacgtgggactgcaaaattacgatggttcgtagaacgcaatctagttaagcccgaaggaaaggtaattgatctaggatgtgggagagggggttggtcgtattattgcgctggtttaaagaaagtaactgaagttaaaggatacacaaaaggcggacccggacatgaagaaccgattcctatggcaacgtacggatggaacctcgttaaattacattccggcaaagacgtatttttcaccccaccagaaaagtgcgatactttattgtgcgatattggcgaatcgtcaccgaatccgacaatcgaggagggtagaacactaagggtgctaaaaatggtggaaccgtggctacggggaaatcaattctgtatcaaaatcttaaatccatatatgccctctgtagttgagaccctagaacaaatgcaaaggaaacatggtggaatgttagtccgaaatcctctcagtcgaaattcgacacatgaaatgtattgggtgagttgtggaacagggaacatcgtctcggcagtcaacatgacttctagaatgttgctgaatagattcacgatggcccaccgaaaaccaacatacgaacgagatgtcgatttaggcgccggaacaagacatgttgcggtagaaccggaagtagcgaacctagatataatcggacaacgtatcgaaaatattaaaaacgaacataaatcaacttggcattacgatgaagacaatccttataagacatgggcctatcatggatcatatgaggtcaaaccgtctggttcagcatcaagtatggtcaatggagtagttagattactaaccaaaccatgggacgtaattcccatggtcacccaaatagcaatgacagatacaaccccttttggccaacaacgcgtattcaaagaaaaagtggacacccgtacaccaaaagctaaacgaggaaccgctcaaatcatggaagtgacagcacgatggttatgggggttcctctcaagaaataagaaacctagaatatgcacacgagaagagtttacaagaaaggttaggtctaatgcggctatcggagctgtcttcgtcgacgaaaaccagtggaactccgcgaaagaggcagtagaggacgagagattttgggatctagtacacagagaaagagagttacataaacaaggtaaatgtgcgacatgcgtatataatatgatgggaaaaagggagaagaaattgggagagtttggtaaagccaaaggttcaagagcgatttggtatatgtggttaggcgcaagatttttagaatttgaggcacttgggtttatgaacgaagaccactggttcagtcgtgaaaacagcctcagtggggtggaaggggaagggcttcacaaattaggatatatcttgagagacatatcgaaaataccaggagggaatatgtacgcagacgataccgccgggtgggatactcgaataaccgaagatgatttgcaaaatgaagcaaagattacggacataatggagcctgagcatgccctattggccacatcgattttcaaattaacttatcaaaataaagtagtaagagttcagagaccaggtaaaaatggaacggtgatggacgtaatatcccgaagagatcaacgtgggagtggccaagttggcacttatggactcaatacctttactaatatggaggcgcagctaatacgacaaatggagtcagaaggcatattttcgccgtcagagcttgaaacacctaacttagctgaaagggtattcgactggttagagaagcatggaatagaaaggctaaaaagaatggcgatttccggggacgattgcgtcgtcaaaccaatagacgacagatttgcaacagcattaacagccctgaacgatatgggtaaagttagaaaggatattccacaatgggaaccatctaaggggtggaatgactggcaacaagtcccattctgtagtcatcatttccatcaattgataatgaaagacggacgagagatagtagttccatgccgaaatcaagatgaattggtaggaagggcaagggtgtcacaaggtgctgggtggtcgttgcgtgaaactgcctgtcttggtaaatcatatgctcagatgtggcaactaatgtatttccaccgacgtgatttgagactagctgctaacgcaatatgcagcgcagtacctgttgattgggtaccaacaagtagaacaacatggagtattcatgcacatcaccagtggatgaccacagaagacatgttatctgtatggaacagagtttggatagaagaaaacccatggatggaagataaaacgcatgtgtcatcatgggaagatgtaccctatttaggtaaacgagaagatcaatggtgcggttcgctaattgggcttacagctagagctacttgggcaaccaacatacaagtagcaatcaatcaagtacgaagacttataggaaatgagaactatttagattatatgacttcaatgaaacgcttcaaaaacgagtctgatcccgaaggtgcactctggtaa

SEQ ID NO: 22067 - RNA, 9879 nt, synthetic construct
  misc_feature 1..9879: note = derived and/or modified CDS sequence (opt6) from DENV-1__KC762641__SS-prME
  source 1..9879: mol_type = other RNA
tctgtaaccatgttattaatgttaatgccaaccgctctagcattccaccttacgacaaggggaggagaaccacacatgattgtttcaaaacaagaaagggggaaaagtttgctattcaaaacgtcggcaggggtaaatatgtgcacgctaatcgcaatggacttaggagaattatgcgaagatacactgacatacaaatgtccgaggataaccgaagctgaaccagacgacgttgactgttggtgtaacgcaaccgacacctgggtcacctatgggacgtgcagtcaaacaggggagcaccggcgtgataaaaggtcagttgctttggcaccacatgtagggttaggattagaaacccgtacagaaacttggatgagtagcgagggggcgtggaagcaaattcaacgggttgagacatgggcgctaagacaccctggcttcactgtaatagcgttatttctcgcccatgctataggtacatcaataacacaaaagggaataatatttatactgttaatgctagttaccccaagcatggcaatgagatgcgtaggcatcggaagtagagatttcgtggaaggactaagtggtgcaacctgggtagacgtagttcttgaacatggtagctgtgttacaacaatggcaaaagataagccaacgttagatatagaactcctcaaaacggaagttacgaacccagcggtcctacgaaagttatgcattgaagccaaaataagcaatacaacgaccgacagcagatgtcctacgcaaggggaagccacgttggtcgaagaacaagacgctaattttgtttgtcgaagaacattcgtggatagaggatggggaaatggctgtggcctctttggaaaaggtagcttgataacctgcgcgaaattcaagtgtgttactaaattagaaggaaaaattgtacaatatgagaatctaaaatactctgtcattgttactgttcatactggagatcaacaccaagttggcaatgaaagcaccgaacacgggaccactgcgacgattacaccacaagcaccaacgactgaaatccaactgaccgattacggcgcgttgaccctagattgcagtccacgtactggtttagattttaacgaaatggtacttttgactatgaaggagaaaagttggcttgtacacaaacaatggttcctggacctacccctgccctggacatctggggcgagcactagccaagaaacatggaacaggcaagacctcctagttacatttaaaacagcacatgccaagaaacaagaagttgtcgtgctgggcagtcaagaaggtgcgatgcacacagccttgacgggggcgaccgaaatacaaacatctggtactaccacaatcttcgcgggccacctgaaatgtcggcttaaaatggacaaattgactttaaaaggcatgtcctatgtgatgtgtaccgggtcatttaaattggaaaaagaagttgctgaaactcaacatggaacagttcttgtacaaataaaatacgaggggacggatgcaccctgtaaaatacctttttcgacacaagatgaaaaaggtgtaactcagaacgggaggcttattacagctaatccaatagtcaccgataaggaaaaaccggtcaatattgaggcagaacctccatttggagaaagctatatagttataggcgcaggggaaaaagccttgaaattaagctggttcaagaaaggatcttcaatcgggaaaatgtttgaagccaccgcacgtggagcacgccggatggctatcttaggtgatacagcttgggacttcggttcaattggaggcgtatttacaagcgtaggaaagctagtacatcagatctttggaacggcttatggagtacttttctcaggagtttcgtggacaatgaagattggcataggagtactacttacctggcttggtcttaatagtagatcgacttcattgtcaatgacatgtatagctgtgggcctggttactctctatctcggagtaatggttcaagctgattctggctgtgttatcaattggaaagggcgcgaattaaaatgtggatcaggtatatttgtcaccaacgaagtgcatacttggacggaacagtataaattccaggctgattcacctaagagactaagtgctgccataggcaaagcatgggaagaaggagtgtgtggaatacgttccgccactagattagagaatattatgtggaaacaaataagtaacgaactcaatcatatacttctggaaaacgatatgaaattcacggtcgtcgttggtgatgtcgctggcattctcgcccagggcaagaaaatgattcggcctcaacccatggaacacaaatacagttggaaatcatggggcaaagctaagataataggtgcagatgtccagaatacgacatttataatagatgggcccaacacaccggaatgtccggatgatcaaagggcgtggaatatatgggaagttgaagattatgggtttgggatatttacaacgaacatatggttaaagttaagggattcatacacacaagtctgtgatcacagacttatgtcagctgcaataaaggacagtaaagcggtgcatgcggatatgggctattggatagaaagcgagaaaaatgaaacttggaaattagcaagagcatcatttatagaagtcaagacctgcatctggcctaaaagccacacattatggtcgaatggcgtacttgaatcagaaatgattattcctaagatctatggaggtccaatctcccaacataactataggcctggatactttacacaaacagcaggtccatggcacttaggtaaacttgaattagattttgacctatgtgaaggtacgacagttgtagtagacgaacattgtggaaaccgaggaccatcactacgcacaacgacagtcacagggaaaattattcacgaatggtgttgtcgatcctgtaccctacccccattacgatttagaggagaagatggttgctggtatggtatggaaatacgtcctgtcaaagaaaaggaggagaacctggttaaaagtatggtatcagcaggaagtggcgaagtagactccttctctctggggctgctatgtatttcaataatgatagaagaggtcatgaggagccgatggtcgagaaaaatgttaatgaccggaacattagctgtattctttttattaataatgggtcaattaacctggaatgacctaatacgactatgtattatggttggagcaaatgctagtgacagaatgggaatgggaacaacatatttagctctaatggctacgtttaaaatgagacctatgtttgcagtaggacttcttttccgcagactcacttctcgtgaggttttactgctcacgatagggctatctttagttgctagtgtagaattaccaaatagcttagaagaattaggggatggtttggcaatgggcataatgattctaaagttactaactgattttcagtctcatcaattgtgggcaacgcttcttagcctaacgttcattaagactacattcagcttacactatgcatggaaaacgatggccatggtcctaagtatagtgtctttatttccattatgcttgtcaacgaccagtcagaaaacaacatggttacccgtattgttaggctcgctgggttgtaaaccactcaccatgttcctaatagcggaaaataaaatatggggtcggaaatcatggccgttaaatgaaggtataatggcagtagggatagtaagtatccttttaagctctctacttaagaacgatgtacccctagcaggtccccttattgcaggagggatgttaatcgcatgttatgtaataagtggaagcagcgcagacctctccttagaaaaagctgctgaagtttcatgggaagaggaggcagaacacagtggggccagtcataacatactcgtagaagtgcaagacgatggtaccatgaagataaaagatgaggagcgagacgataccctaacaatactcctcaaagcaacgttgctcgcagtttctggggtatatccactatcaataccagctactttgttcgtgtggtacttttggcaaaagaagaaacagagaagtggtgttttatgggacacaccatccccaccggaagtagaaagggccgtactagatgatggaatctatagaattatgcaaagaggtctattaggcagatcccaagttggggtaggcgtgtttcaggaaaacgtattccatactatgtggcatgtgacaagaggggcagtccttatgtaccaaggcaaaaggttagaaccaagctgggcttcagtcaagaaagatctaatctcatatggaggaggatggagactacagggatcatggaacacgggggaggaggtacaggttatagcggtggagcctggtaaaaaccccaaaaacgtacaaacggcgccagggacctttaagacaccagaaggagaagttggggcaatagcgttagatttcaaaccgggtaccagtggatccccaatcgtaaaccgagaagggaagatcgtagggctctatggtaatggagttgtaacaacatcaggcacctatgtatcagcgatagcacaggccaaggcgtcacaagaggggcctttacccgagattgaagatgaggtttttcggaagagaaacctcacaatcatggatttacatccaggtagtggaaaaacaagacgatacctacctgctatagttcgagaagccattaaaaggaaattacggaccttaatattagctcctactagagtagtggcgtcggaaatggcggaagcactcaagggaatgcctattagataccaaacgacagccgtaaaatccgaacacacaggcaaagaaatagtagatttgatgtgtcatgccacgtttacgatgagactattaagtccagtaagagtaccaaactataacatgataattatggatgaagctcatttcacagacccgagcagtattgcagctagaggctacatatccacccgagttggaatgggagaagccgctgcaatatttatgacggctacccctcccggttctgtggaagcatttccccagagtaatgccgtaatacaagacgaggaaagagatattcccgaacgatcctggaatagcggttatgaatggataactgatttcccgggcaaaaccgtttggttcgttccgtccattaaatcaggcaacgatattgcaaactgtctacgtaagaatgggaagcgagtaatacaattaagtcgcaaaacattcgatactgaataccagaaaactaaaaacaatgactgggactatgtagttactactgatataagtgaaatgggtgccaatttcagggctgaccgtgttatagatccacgcagatgtttaaagcctgtcatattaaaggacggaccagagagagtaattctcgcaggcccaatgccggtaacagtagcaagtgccgcccaaagaagaggtcgagtaggaagaaatcataataaagagggtgaccagtatatctatatgggccagccattaaacaatgatgaagaccatgcacattggacagaagcaaaaatgttgttagataatattaatactccagagggtattataccggccctctttgaacccgaacgagaaaaatcggcggctatagatggggagtatagacttagaggggaagcaaggaaaacattcgttgagctaatgagacgaggagatctaccagtgtggctgtcatacaaggttgctagcgaggggtttcagtactcagatcgtcgatggtgcttcgatggagaacgaaacaatcaagttttggaagaaaatatggatgtagaaatatggaccaaagaaggcgagagaaagaagctgaggccaaggtggttagacgcaagaacctactctgacccgttagcattgagagagttcaaagaatttgcggccggaagaaggtcagtatcgggtgatttaatcttagagattgggaagctcccgcagcatttaactcaaagggcgcaaaatgccctagacaacttagttatgttgcacaacagcgaacaaggaggccgtgcatacagacatgcaatggaagaattacctgatactatcgaaactttaatgctactagcgctaatagcggtccttactgggggcgtgacactctttttcttatccggacgaggtctcggaaaaacatctataggattactctgtgtaatggcttcgagtgttctactatggatggcatcagtggaacctcattggatagctgctagcattatcttggagttcttcttaatggtattgttaattcccgagccagatagacaacgaactccgcaggataatcaacttgcgtatgtagtaataggactgttattcatgatattaaccgtaacagcaaacgaaatgggtctgcttgaaacaacgaagaaagacctggggattggtcatgtagcagtggaaaatcaccaccacgctgcgatgctagatgtagatttacaccctgccagtgcttggacactatacgcagttgcgacaactatcatcacgcctatgatgcgccataccatagaaaatacgacagcaaacatttcactaactgcaatagccaaccaggcagctatattgatgggtttggacaagggatggccaataagtaaaatggatataggagtccctttattggctttaggctgctattcccaagtaaacccattaacgttgactgcagctgtcctcatgctagtggcgcattatgcgataataggaccaggattacaagctaaagctaccagagaagctcaaaagagaacagctgctgggataatgaagaatcctactgtggatggcatagtagctatagatttagatccagtagtgtatgatgcgaagtttgaaaaacagctaggtcaaataatgctactgatcttatgcacgtcccagattctactaatgcggacaacgtgggcactttgcgaaagtattacactagcaactggaccattgacaaccctttgggaaggatcaccagggaaattctggaacacaactatagcagtaagcatggctaacatatttagaggaagttatttagctggcgcaggattagcattcagtttaatgaagtcattagggggcgggagacgaggaactggagcacagggagagacgttaggagaaaaatggaaaaggcagttaaatcaactttctaaaagtgagttcaatacttacaaaagatcaggtataatggaagtagatagaagtgaggctaaagaaggcctaaaaaggggtgaaacgacaaagcacgctgtatcacgtggtacggcgaaattaagatggttcgtagagagaaatctagtaaaaccagaagggaaggtcattgatttaggatgtggacgtggcggatggtcttattattgtgctggtctaaagaaagtaacagaggtaaaaggatacactaagggtggtccaggacacgaagaaccaattccgatggcaacatatggatggaatctcgtaaaattacatagtggtaaggatgtattctttataccacccgaaaaatgtgatactctgctgtgtgacataggtgaatcctcaccgaatccgactattgaagaaggtagaacattaagagtcttgaaaatggttgagccatggttacgaggtaatcaattctgcatcaaaatcctgaacccatatatgccatcagttgtagaaacgctagaacaaatgcaacgaaagcatggaggaatgttagtcagaaaccccctctctagaaatagcacccacgaaatgtattgggtaagctgcggcactggtaatatagtttcagcggtgaacatgacatctcgaatgcttcttaatcgctttacaatggcacataggaaacccacatatgagagggatgtggatctaggtgccggaacacgtcacgtagcagtcgaaccagaggtagcaaacttggatattattggacaacgcatagagaatattaaacatgaacataaatcaacatggcattacgacgaagataatccttataaaacatgggcttaccacggatcctatgaagtaaaaccctcaggatcagcgagcagcatggtaaatggagtggtaaaattgcttacaaagccttgggacgtaatacctatggtaacacagatagcgatgactgacactacaccttttggtcaacaaagggtttttaaagagaaggttgataccagaactccaaaggcgaaacgtggcacaacgcaaataatggaagtcactgcccgttggttatggggatttttaagccggaataagaaacccagaatctgcacaagggaagagtttacaaggaaagtaagaagcaatgcagcaattggtgcagtattcgttgatgaaaaccagtggaactcagcaaaggaagctgtagaagacgagcggttctgggacttggttcaccgggaacgagaattacataaacaaggtaaatgcgcaacatgcgtatataatatgatgggaaaacgagagaagaaattaggcgaatttggaaaagctaaagggagccgagctatatggtatatgtggttaggagcaagattcctagagtttgaagcgttaggcttcatgaacgaagaccactggttttcgagggaaaatagtcttagtggagtagaaggagagggactccacaaactaggttacattctgagggatatatccaaaatacctggtggaaatatgtacgcggatgacacggctggatgggacactagaattacggaagatgacttgcaaaatgaggcaaaaatcactgatataatggagcctgaacatgcgttattagccaaagccatatttaaactaacatatcagaataaagtggttcgggtacaaagaccggccaaaaatggaacagttatggacgtaatcagtagacgagatcaacggggatccggacaagtgggtacatatggtctaaatacatttaccaatatggaggcacaactgataagacaaatggaaagtgagggtatttttagtccgtctgaattagaaacgcctaatctggcagaaagagttctagattggctggaaaaatatggtgtagaacgtttaaagagaatggcaataagcggtgacgactgtgtagtgaaaccaatagacgatcgctttgcgacagcgttaacggccttaaatgacatgggcaaagtacgaaaggacatcccccagtgggaaccaagtaaaggatggaacgattggcaacaagttcctttttgctctcatcacttccatcaattgattatgaaagatggacgagaaatcgtggtaccatgcaggaaccaagacgaattagtaggaagggctcgtgtcagccaaggagcaggttggtccttgcgagagacggcgtgtctaggaaagtcgtacgcacaaatgtggcaacttatgtacttccaccgtagagatcttagattagcggcaaatgcaatatgcagcgcagtccctgttgactgggtacctacatccagaacaacgtggagtattcatgctcaccaccaatggatgaccactgaagacatgctatctgtttggaatagagtatggatagaagaaaatccctggatggaggataaaactcacatcagttcatgggaagatgtcccctacttagggaaacgggaagatcaatggtgtggtagcttgattggtctaactgcccgcgcaacatgggcgactaacatacaggttgccataaatcaagttcgtaggctaataggcaatgagaactatttagactatatgacaagtatgaaaagatttaaaaatgaaagcgatcctgaaggcgcactatggtag

SEQ ID NO: 22068 - RNA, 9879 nt, synthetic construct
  misc_feature 1..9879: note = derived and/or modified CDS sequence (opt6) from DENV-1__KC762648__SS-prME
  source 1..9879: mol_type = other RNA
agtgttacgatgctactgatgctgatgccgaccgcattggcttttcatctgacaactcgaggaggagaaccacatatgattgttagcaaacaagaaaggggaaaaagtctactatttaaaacgtctgctggagtcaacatgtgtactctgatagcaatggatttgggggaattgtgtgaagataccctgacatacaaatgccctcgaataactgaagcagaaccagatgatgtggactgttggtgtaatgccacggacacttgggtgacatacgggacatgtagtcaaacgggagaacacaggcgtgataaacgttccgtcgcgttagcgccacatgtcggtctcgggttagaaactcgaacggaaacctggatgagtagtgaaggggcctggaaacagatacaaagagttgaaacgtgggcattaagacaccctgggtttaccgtcatcgctttattcttagcacacgctataggcacaagcattactcaaaaaggaataatattcatccttttgatgctcgtcactcctagcatggccatgagatgcgtaggaattggaagtagagactttgtggagggattgtcgggagcaacttgggtagacgttgtgcttgaacatggaagctgtgttacaacaatggccaaagacaaaccaacattagatatcgagttattaaaaactgaagtaaccaacccggcagtacttcgtaaactttgcatagaggcgaaaatctcaaataccacaacagactcgaggtgtcccacacaaggagaagctacactcgtagaagaacaagatgcaaatttcgtttgtcgacgaacgtttgtagatagaggctggggaaacgggtgtggactatttggcaaaggaagcctaatcacgtgtgcgaaatttaaatgtgtgaccaaattagaggggaaaatagtacaatacgagaacctaaaatactctgtaatagtaactgtacatacaggcgaccaacatcaagtcggaaatgaaagtacagaacatggcacgacggcgaccattacgccgcaagcgccaacaacagaaatacagctaacagactatggagccctaactctagattgtagtcctagaactggtttggactttaatgagatggtattgctgacaatgaaagagaagagttggctagttcacaaacaatggtttctagatttaccattaccgtggacttcaggagcatctacttcccaagaaacctggaatagacaggaccttttagtaacatttaaaacggcacatgcgaagaaacaagaagtagtcgtgctgggttcgcaagagggagcaatgcatacagctctaactggtgctacggagatacagacaagtggtacaacgacaatattcgcaggacacctaaaatgccgattaaaaatggacaaactcacactcaaggggatgtcttacgtaatgtgcacgggcagctttaagctagaaaaagaagtagccgaaacccagcacggaacagtactggttcaaataaaatatgaaggtacagatgcaccatgcaaaatcccgttcagcacccaggacgagaaaggagtaacccaaaatggccgactgataactgctaatccaatcgtaacagataaggaaaaacccgttaatatcgaggcggaacccccttttggagagtcatatattgtaatcggcgccggcgaaaaagcactaaaattgtcgtggtttaaaaagggtagctcaatcggtaaaatgttcgaagcaaccgctagaggtgcgagacgtatggcgatattaggagacacagcatgggacttcggatctataggcggggtgtttacaagcgtgggtaaattagtacatcagatatttggtactgcctatggagtactatttagcggagttagttggacaatgaaaataggtattggtgtgctattaacatggctaggcttaaatagcaggtcaacgtccttgtctatgacttgcatcgctgtaggcctagtaacattatatttaggtgtaatggtacaagctgatagtggctgcgttataaattggaaaggacgggagctgaaatgtggcagtgggatattcgttacaaacgaagttcatacatggaccgagcaatataaattccaagcggacagcccgaagagattgtcggctgctataggaaaagcatgggaagaaggagtatgtggtatcagaagtgcaactagactagaaaatataatgtggaaacagataagtaatgaattgaaccacatactcctggagaatgatatgaaattcacagttgtagttggtgatgtagcgggtatactcgcccaagggaaaaagatgataaggccacaaccaatggaacacaagtactcatggaaaagctggggaaaggccaaaattattggagcagatgtgcagaacactaccttcataatagatggaccgaacactccagagtgcccggatgaccaaagagcatggaatatttgggaagtagaagactatggcttcggtatattcacaactaatatttggctcaaattacgtgattcatatacacaggtttgtgatcataggctaatgagtgctgcaattaaagactcgaaagcggtacatgcggacatgggatattggattgaatcagaaaagaatgaaacgtggaaattagctcgcgcatctttcatagaggtaaagacttgtatttggcccaaatcacacacactatggagcaacggagtgctggaatccgaaatgatcattccaaaaatttatggagggccgatatcacagcataattaccgtcctggttacttcacacaaacagctgggccatggcacttaggtaagttagaattagattttgatctatgtgaaggtactactgttgtcgtggacgaacactgtggaaaccgtggaccaagtttaaggacaacaactgtaaccgggaaaataatacatgagtggtgttgtcgttcatgtactttacctccactgcgctttagaggcgaagatggatgttggtacggtatggagatacgtcctgttaaagagaaagaagagaacttagtaaaatcaatggtttctgcaggaagcggagaggtggactccttcagcctggggttattgtgcataagtattatgatagaagaagtgatgcggtcaaggtggtccagaaagatgctaatgacgggaacactagccgtattcttcttgttaattatgggacagcttacatggaacgacttaatcagattgtgcataatggtaggtgctaatgctagcgaccgaatggggatgggaacaacgtaccttgctttaatggcgactttcaaaatgagacccatgtttgcagttggactactatttagacgactaacgtcccgtgaagtgctccttctaactataggactcagtcttgtagcttcggtggaattaccaaacagcttagaagaactaggcgatggactcgcaatgggaataatgatcttaaagttactaactgattttcagagtcaccagttatgggcaacccttttatcccttacattcatcaaaactacttttagcctgcactacgcttggaaaactatggccatggttctgagtattgtttccctcttcccactgtgtctgtcaactacatctcagaaaacgacatggctcccggtactgctcggctcgctggggtgtaagccactgactatgtttctaatagcggaaaacaagatttgggggagaaaaagctggccactgaatgagggtataatggctgtgggcatagtttcaatactactctcatcgctcctgaaaaatgatgtacctctagcgggtccattaatagctggtggaatgttgatagcatgctatgtaatatcagggtcaagtgcagacctaagtttggagaaagcggctgaagtatcatgggaagaagaagctgaacactctggcgcatctcataatatcttagtggaggttcaggacgacgggaccatgaaaataaaagacgaagaaagagatgatacactaacaatactattaaaagccactcttttagcagtaagtggagtttacccattgtcaattcctgcaacattattcgtatggtacttctggcagaagaagaaacaaagatccggggtactttgggacacccccagtccccctgaagtggaaagggccgtactagacgatggaatctacagaatcatgcaacgaggactattaggccgctcacaagtaggagtaggtgtatttcaagaaaatgtattccatacgatgtggcatgtaacacgaggcgcagtattaatgtatcagggtaaacgtctagaaccaagctgggctagcgttaagaaggacctgatatcttacggtggtggatggagattacaaggaagctggaatactggtgaagaggtacaagttatcgcagtagaacccggcaaaaatccgaagaatgttcaaacagcacctggtacattcaaaacccctgaaggggaagtcggggcaatagcactagattttaaaccaggtacatcgggttcaccaatcgtaaaccgcgagggcaaaatagtaggtttatatggtaacggagtggtaactacaagcggaacctacgtgtcagctatagcacaagcaaaagcctcgcaggaagggccactgcctgaaatagaagatgaagtcttccgaaagcgaaatctcacaataatggatttacatcctggttccggcaaaacccgccgatacctaccagcaattgttagggaggctataaaacggaaactaaggacgctaatactggcccccacccgagtagttgctagcgaaatggctgaagctctcaagggtatgccaatacgataccagacgacagcggtaaagagcgaacacacgggtaaagaaatagttgatttaatgtgtcacgcgacgttcacaatgaggctactatctccggtgcgggtacctaactataatatgataataatggatgaagcccactttacagacccatcctcaatagcggccagggggtacatatccactcgcgtaggcatgggcgaagcggcagcaatcttcatgacagcgactcctcccggttcagttgaggcgttcccacaaagtaacgcggtgattcaggacgaagaaagggatatcccagagagatcatggaactcaggatatgaatggataaccgattttcccggaaaaacagtatggttcgtaccatcaatcaaatccggaaacgatatcgcgaattgtttgcgtaaaaatgggaaaagagtaattcaactatcgagaaaaacgtttgatacggaatatcagaagactaaaaataatgattgggactacgtagttacaactgatatatcagaaatgggggcaaacttcagagcggaccgggtaattgacccacgaagatgcctaaaacctgttatacttaaagatggtcctgaaagagtcattttagctggtcctatgccagtcacggttgcatcggcagcacagcgtagaggtcgtgttgggagaaaccacaataaagaaggagaccagtacatttatatggggcaacccctaaataacgatgaggaccatgcacattggactgaagctaaaatgttactagacaatataaacactccagagggcattataccggcgctctttgagcctgagcgcgagaaaagtgcagcaatcgatggcgaatacagactacggggtgaggctagaaaaacgtttgtagaacttatgagaagaggcgacctaccagtatggctatcttacaaagtagcttcagaaggattccaatactcagatagaagatggtgttttgacggcgaacgaaacaaccaagtactagaagaaaatatggacgtggaaatctggactaaggaaggcgaaagaaagaaactcagacctcgttggttagatgctagaacttactcagatccattggctctaagagagttcaaagagttcgcagctggcagaaggagtgtatctggcgacttgatattagaaattggcaagttgcctcagcacttaacccaacgagctcagaatgccctagacaatttagttatgctacataattcagaacaaggcgggagggcgtatcggcacgcaatggaagaacttccagatacaatagaaacgttaatgctactagcgttaatcgcagtgctaacaggcggagttacattattctttctatcaggtagaggcttaggaaaaacctcaataggtttattatgtgttatggcatcctccgcactgttatggatggcgtctgtcgaaccacactggatcgcagctagcataattttggagttcttccttatggttttacttataccggaaccagataggcaacgtacgccacaagacaatcagcttgcttatgtagttatcggactattattcatgatactgacagtagctgctaatgaaatgggacttttagaaacaactaagaaagacttagggataggacatgttgcggtagaaaatcaccatcacgcagcaatgctggatgttgacctacatcccgcgagtgcatggacattatacgcagtcgcaactacgataattacaccaatgatgagacatacaatagaaaataccaccgcaaacattagccttactgcaatcgccaaccaagcagccattctaatggggcttgataaaggctggccaatcagtaaaatggacattggagttccactacttgcattgggatgttatagtcaggttaaccctttgacattaacagctgcagtcttgatgttagtagcacattatgctattattggccctggacttcaggcgaaagcaactagagaagcacaaaaacgtactgcagcagggattatgaagaatccaacagtagacggaatagtagcaattgatcttgatcctgtagtttatgatgccaaattcgaaaagcaattgggacagatcatgttactaatactatgtacatctcaaatacttcttatgaggacaacttgggccttgtgcgagagcatcacgttagctactggtcccctcacaacactgtgggaagggtcgccaggaaaattttggaatacaacaattgcagtaagcatggcaaacatattcagaggttcgtatttagccggtgccggtcttgcattttcattaatgaaaagtttaggtgggggtagaagagggacgggagctcaaggagaaactttgggcgagaaatggaaaaggcaactaaatcaattatccaaatcagaatttaatacctataaaaggagtgggattatggaagtggacagatccgaagcaaaagagggattgaaacgaggggaaaccaccaaacacgcagtatccagagggaccgcaaaattacgatggtttgtagaaagaaatcttgtcaaaccggaaggaaaggtcatcgacctaggttgtggtagaggaggatggtcctattattgtgccggcttaaagaaggttacggaggttaaaggatacacaaaaggaggtcctggccatgaagaacctattccaatggcaacctatggatggaatctcgtgaaattacactcggggaaagacgtcttctttattccacctgaaaaatgcgacacactcttatgcgatataggagaatcaagcccgaatccgactatcgaagaaggacgcacattgagagttctgaaaatggttgagccatggctacgcggcaatcagttttgcataaaaatattgaatccttatatgcctagcgtagtagagactttagaacaaatgcaaagaaaacacggtggtatgttggttcgaaatccattgtccagaaatagtacccacgaaatgtattgggtaagttgtggtacgggaaatatagtctcagcggtaaatatgacgtcgagaatgcttctaaacaggtttacaatggcacacaggaaacctacgtatgagcgtgacgtagatctaggagcaggaacacgtcatgtagctgttgaaccggaggtcgcaaacttggatatcataggccaaagaatcgaaaacataaaacatgaacataaatctacatggcattacgacgaagataacccatacaagacatgggcatatcacggaagttatgaggttaagccttcgggaagtgcatcgtccatggtaaacggggtagttaaactacttaccaaaccatgggatgtcattcctatggtaacgcaaattgcgatgactgacactactccgtttgggcagcaacgagtatttaaagaaaaagtagacacacgaactcctaaggccaaacgaggaacgacacagataatggaagttacagctagatggctctggggatttctatctagaaacaagaaaccgagaatatgtacgagggaagaatttacaaggaaagtaagaagcaatgcagcaatcggggcggtctttgtggatgaaaaccaatggaactccgctaaagaagcagttgaggacgaaagattttgggacctagtacatagagaaagagagttacataaacaaggcaaatgtgcaacatgtgtatataacatgatgggtaaacgagagaaaaagctcggcgagttcggcaaagcaaagggttcaagagcaatatggtatatgtggttaggggctcggtttctggagttcgaggccttaggtttcatgaatgaagaccactggttttcacgcgaaaattcactttctggcgtcgagggggagggcctacacaaactcgggtacattttaagagacatttctaaaatacctgggggaaacatgtatgccgacgatacagccggatgggatacacggattacagaagatgacctgcaaaatgaagcaaaaataaccgatattatggagcccgagcatgcattactagctaaagctattttcaagttaacctatcaaaataaagtagtaagggtgcaaagacctgccaaaaatggaacagtgatggatgtcatttcaaggcgggatcagagaggctccggtcaggttggtacctatggcctaaatacctttacgaacatggaggcacaactcatcagacaaatggaatcggaagagatattttcaccttcagaattagaaactccgaatttggcagaaagagttctagactggctggaaaaatatggggttgaaaggctcaaacgaatggcgatttctggagatgactgcgttgtaaaacccatcgatgacagatttgcaaccgctttgacagcgttaaatgatatgggaaaagttaggaaagatataccacaatgggagccctcgaaaggttggaatgattggcaacaggtgccattttgttcccatcattttcatcaactaattatgaaagacgggcgcgaaatagtggttccatgtcgaaatcaagatgaattagtaggtagagctagggtaagccagggagcaggttggtctttgagagaaacagcatgcctgggtaaaagctatgctcagatgtggcagcttatgtatttccatagaagggatttaaggcttgcagcaaatgctatttgctctgcagtgcctgtggactgggtccctacctctaggacaacctggagtatacatgcacatcaccaatggatgacgaccgaggacatgttaagtgtatggaaccgcgtatggattgaagaaaatccatggatggaagataagacacatatttcttcatgggaagatgtaccttatttgggaaaacgtgaggaccaatggtgtggcagcttaatcggcttaacagctcgagcaacatgggcaacgaacatacaagtagcaatcaatcaagtgagacgtctaataggaaacgaaaattatctggattatatgacgtctatgaaaaggttcaaaaatgaatctgatccggaaggagcactatggtag

SEQ ID NO: 22069 - RNA, 9879 nt, synthetic construct
  misc_feature 1..9879: note = derived and/or modified CDS sequence (opt6) from DENV-1__KC762622__SS-prME
  source 1..9879: mol_type = other RNA
tcagtaactatgcttctcatgctgatgccaacagcactcgcattccacctcacaacacgcggaggggaaccacatatgattgtctcaaaacaagaaagggggaaatcattactatttaaaacctctgctggagtgaatatgtgtacattaatcgcaatggatcttggggaactatgtgaggatactctaacctataaatgtccaaggataacagaagcggaaccagacgatgtcgattgctggtgcaatgcaactgacacttgggttacttacgggacgtgctcacaaactggtgaacataggcgagacaaacgatccgttgcacttgcaccgcacgtgggtttgggattagaaacgagaaccgaaacctggatgagtagtgaaggtgcatggaaacaaatacaacgagtagaaacgtgggcattaagacatccgggattcacagtaatggcgcttttcttagcacatgcaataggtacatcaatcactcaaaaaggtatcatatttattctcctgatgctcgtcaccccttcgatggcaatgagatgcgtagggataggaagcagggattttgtagaaggattaagcggtgccacttgggtagatgtagtactggaacacggaagctgtgtaactacaatggctaaagataaacccaccttagatattgaacttcttaaaacagaagttactaatccagccgtactaaggaaattgtgcattgaagccaaaatatcaaatacaacgacagacagccgatgccccacacaaggagaagcgacgctggtagaagaacaagacgcaaacttcgtatgcaggaggaccttcgtggaccgaggatggggaaatggctgtgggctatttggcaaaggcagtctaattacttgcgcgaaattcaaatgtgtgactaaacttgaaggtaaaatcgttcaatatgagaatttgaaatattcagtaattgtcactgtacacacaggtgaccagcaccaggtaggtaatgagtctacagagcatggcacaacagcaactattactccacaggcaccgactacggaaattcaacttactgattatggggcacttacgcttgactgttcaccacgaacaggcttggacttcaatgaaatggtactattaaccatgaaagagaaaagctggttagttcacaaacaatggttcctcgacttacccctcccgtggacgagtggagcatctacaagccaagaaacatggaatcgacaagatctacttgtgacttttaaaacagcccacgccaagaaacaagaggtagtagttttgggctctcaagagggtgccatgcatacagctctgacaggtgcaacagaaatacaaacctcggggactaccactattttcgcgggtcatctgaaatgtcggctaaaaatggataaattgacacttaaaggtatgagttatgtaatgtgtactggaagttttaaacttgagaaagaagtagctgagactcagcatggcaccgttttagttcaaataaaatatgagggaaccgacgctccttgcaaaatcccttttagtacccaagacgaaaaaggtgtcacccagaacggtagactaattacagcaaacccaatcgtgacagataaagaaaaaccagtaaatatagaagcagaaccaccattcggagagtcatacatcgttataggagcgggggaaaaagcgttgaaactttcatggtttaagaaaggttcgagcataggaaaaatgtttgaggcgacagctcgcggggcgaggcgcatggcgattttaggtgacaccgcttgggacttcggatctataggaggggtgtttacatcagttggaaagttagtgcaccaaatctttggtaccgcatatggggttctttttagcggagtttcatggacaatgaaaattggtattggtgtactactaacgtggttaggtcttaattcccgatcaacaagtcttagcatgacatgtatcgcggtaggactcgtaaccttatacctaggagtaatggttcaagctgattcaggttgtgtaattaattggaaaggccgggaattgaagtgcggatctggtatctttgtgacaaacgaggtccacacatggacagagcagtacaaattccaggcagacagtcctaagagactttcagctgcaatagggaaggcttgggaggagggcgtatgtggaatcaggtcagcgaccagactggaaaacataatgtggaagcaaataagtaacgaactaaaccatattcttctagaaaatgacatgaagttcactgtggtagtaggggatgttgcaggcatattagcacaaggcaagaaaatgatcagacctcaacccatggaacataaatattcgtggaaaagctggggcaaagcaaaaatcataggtgcagacgtccagaacactacctttataatcgatgggccaaatacgccggaatgtcctgacgaccaacgagcttggaatatttgggaagtcgaagactacggatttggaatatttactacaaacatatggcttaaactaagagactcatatacacaggtatgtgaccaccggttgatgagtgctgctatcaaagactcgaaagcagtacatgcagatatgggttattggatagaaagtgagaaaaatgaaacttggaaactagctcgagctagctttatagaagtaaaaacttgtatttggcccaaatctcatacgctctggtccaatggggtcctagaaagtgaaatgataataccgaaaatttatggaggtcccacaagtcaacataattatcgccctggttatttcacgcaaacagcaggtccatggcatctaggtaaactggaattagacttcgacctgtgcgagggaaccactgtcgtcgttgacgagcactgtggtaacagaggtccatcgcttcgtacaactacagtaactgggaaaataattcatgaatggtgttgtagaagctgtaccttgccacctttgaggtttagaggagaagacggatgctggtatggcatggaaatcagacccgtgaaggagaaggaagaaaaccttgtgaaaagcatggtgtctgctggctctggagaagtagatagcttttcattgggacttttatgtatttcaatcatgatcgaagaggtcatgaggtcgaggtggtctagaaaaatgttgatgaccggaactctcgcggtatttttcttactgataatggggcagctaacctggaacgatttaataagattatgtattatggttggtgcaaatgcttctgacagaatggggatgggaactacatatttagctttaatggcaacatttaaaatgagaccgatgttcgctgttggattattatttagacgactgacaagcagagaagttctcctactcacgataggtctatcgctggtagcaagtgtagaattgccaaactccctggaggaactgggagacggtttggccatgggtataatgatactaaaattattgacggatttccaatcgcatcagctgtgggccaccctcctgagtctaactttcataaaaacgacgttttcactccattacgcttggaagactatggcgatggttctaagtattgtgtcattgttccctctttgcctgagcacgacttcccagaaaactacatggttgcctgtactacttgggagcttagggtgcaaacctttaacgatgtttttaatagcagaaaataagatatggggtcgcaaatcatggcccttgaacgaagggatcatggcagtaggcatagtttcaatcctactatcaagcctccttaaaaatgacgtaccgcttgcgggtccattgatagcagggggcatgctaatagcctgctatgttataagtggtagttccgctgatttatcgttagaaaaggccgcagaagtttcctgggaagaagaagcagagcatagtggtgcatctcacaacattctggtagaagttcaagatgatggtaccatgaaaataaaggacgaagaacgagatgatactttgacaatattacttaaagccacattgctagctgtaagcggcgtctacccgttatcaattcctgcaactttatttgtctggtatttctggcagaagaagaaacaaagaagcggagtattgtgggacacaccgagtccccctgaagtagaacgtgccgttctagatgatggaatttataggattatgcaaagaggtctacttggcagatcacaagttggcgtaggtgtattccaagaaaacgtttttcacacgatgtggcatgtaacaagaggagccgttcttatgtatcaggggaaaagattggaaccttcgtgggcttccgtcaagaaagacttgatttcctatgggggtggatggcggctacaaggatcatggaacacaggagaagaagtacaggtaatagcggttgaaccaggcaaaaatcctaagaacgtccaaacagcacccggcaccttcaaaacgcctgagggagaagtcggtgcgattgcactggattttaaacctggcacgtcaggctcaccaattgtaaatagggagggaaagattgtcggactctacgggaatggagtcgtgacaacctcaggaacatatgtaagcgcgatagcacaagccaaagcatcacaagagggacccttaccagagatcgaagatgaagtatttcggaaacgaaatttgactataatggacctccacccgggaagtggaaaaaccagaaggtatttgcctgctattgttcgagaagcgataaaacgaaaattaagaacactcatactagctcctactcgtgttgtggccagtgaaatggcagaagcactaaaaggaatgccaattagataccaaactacggcagtaaaatctgaacacacgggtaaagaaatcgtcgacctaatgtgccatgctacattcactatgcgcctcttgagtcccgtcagggtccccaactataacatgattattatggacgaggctcatttcaccgatcccagctctatcgcagcacgcggttatatatccaccagggtaggaatgggcgaagctgcggctatcttcatgactgctacacctcctggttctgtagaagcatttccgcaatcaaatgctgtcatacaagatgaagaacgggatatccctgagagatcgtggaactcgggatatgagtggattactgattttcccgggaaaacagtctggtttgtaccatcaataaagtcaggtaatgacatagcaaactgtttgaggaaaaatggcaagcgtgtgatacaactctcgagaaaaacattcgatacagaatatcaaaagaccaaaaacaacgattgggactatgtagtcacaacagatatatcagaaatgggcgcaaactttagagccgatagggttattgatcccagacgatgtttaaaaccagtaatactaaaagatgggcctgagcgagtaatattggcgggtccaatgccagttacagtagcaagtgctgcgcagcgaagaggaagagttggcagaaaccacaataaagaaggtgatcaatacatatacatgggacagccgctaaacaacgatgaagaccacgctcactggactgaagcaaaaatgctgttagataacataaacacaccagaaggtattattcccgcgttatttgagccagaaagggaaaaatcggctgctatagacggggaataccgtttgcgaggagaagctagaaaaacattcgtggaattaatgagacgcggggatcttcccgtctggttgagttacaaggttgcttctgaaggtttccaatactcagatagaaggtggtgttttgacggcgaacggaataaccaggtcctagaagaaaatatggacgtcgaaatatggacaaaagaaggtgagagaaagaaattgaggcctagatggctagacgcaaggacgtatagcgacccacttgctctgcgagaatttaaagaatttgctgccggacgtcgatccgtgagcggtgatctcatcctcgaaatcggtaaactaccacaacatctaactcaacgagcccaaaacgctttagataatctagtaatgttgcataattccgaacaaggtggtagagcatacaggcatgccatggaagagttacccgatacaatagagaccttaatgctgctcgcgctaatcgcagttctaaccggaggagtgacactatttttcttgtcaggtagagggttaggaaaaaccagtatcggcctcttatgcgttatggctagtagtgtactcttatggatggcatcagttgagccacattggatagctgcctctattatcctggagttctttcttatggttttactcattccagaacccgacagacaacgtacaccccaggacaaccaactagcatatgtagtcataggattactctttatgatacttaccgtagcggcgaacgagatggggctattagaaacaactaaaaaggatctaggaatcggtcacgtagctgtagaaaatcaccatcacgccgccatgctcgatgtcgacctacacccagcatcagcgtggacattatatgcagttgctacaactatcataactccgatgatgaggcatactatagaaaatacaactgccaacatttcactcacagcaatagcaaaccaagctgcaattctaatgggattagataaaggatggcctatctcaaaaatggatataggagtgccattattagcactcgggtgttatagccaagtaaacccactaacattgactgctgcggttctaatgttagtggcacactatgcaataattggccctggccttcaagcaaaggccacacgtgaagctcagaagagaactgcggcaggtatcatgaaaaatcccactgttgacgggatagtcgcgattgatcttgatccagtagtgtatgatgctaagttcgaaaaacaactgggccaaataatgttacttatcttgtgcactagccaaatattattaatgagaacaacatgggcattatgcgaatctatcaccttagcaacaggacctttgacaacattatgggaaggaagtcctggtaaattttggaatacaacaatcgcagtcagtatggcaaacatattcagaggttcgtacttagcaggggcaggattggccttcagcttaatgaagagtttaggaggtggtaggagaggaacaggtgcacaaggcgaaacactaggggaaaaatggaagagacaactaaatcagctcagtaagtcagaatttaacacttataaacgatctggaataatggaagtggatcgctcagaagcaaaggaaggcttgaaacgtggagaaactacaaaacatgctgtctcccggggcaccgctaaactcagatggtttgtcgaaaggaatcttgtaaaacctgaaggaaaagttattgacctgggatgtggtagaggcggttggtcctattactgtgcagggcttaagaaagtaacggaagtaaagggatatactaaaggcggtccgggacacgaggaacctattccgatggcaacatatggatggaatttagttaaactgcactcaggtaaagacgtatttttcataccgccggaaaaatgcgatacactgttgtgtgacataggggaaagtagtcctaatccgacaatagaagaaggtagaactttaagagtactgaaaatggtcgaaccatggttaagaggaaatcaattctgcatcaaaatactaaacccctatatgccgtcagtagtcgaaacgctagaacaaatgcagagaaaacatggaggaatgttagttaggaacccactcagtagaaatagtactcatgaaatgtattgggtctcttgcggtaccggaaatatcgtctccgctgttaacatgacgagtcgaatgctcctcaatcgattcactatggcacaccggaagcccacatatgaacgtgatgtggacctaggtgctggaacaagacatgttgccgttgaacccgaggtagctaatcttgacataatcggtcaaagaatagagaacataaaacatgaacataagagcacgtggcattacgacgaggataatccttataaaacttgggcataccatggatcttacgaagttaagcctagtggcagtgcgtcatctatggtaaatggagttgtaaaactcttaacgaaaccgtgggatgtaattccaatggtaacacaaatagctatgacagataccacgccctttgggcaacaaagagtctttaaagagaaagttgatacaagaactcccaaagcgaagcgtgggacaacgcaaataatggaagtcacggctcgttggctatggggctttctatctcgtaataagaaaccgagaatctgtactagagaagaatttataagaaaagtacgtagcaacgctgccattggagcggtcttcgtagatgaaaaccaatggaactcagcaaaagaggccgtcgaggacgaaagattctgggacttagtacatcgtgaaagagaattacacaaacagggaaaatgtgccacttgcgtgtataacatgatgggcaagcgagagaagaaactaggtgaatttggtaaagccaaaggctcaagagcaatatggtacatgtggctaggtgcaagattcctcgaatttgaagcacttggatttatgaatgaagatcactggttttcccgagaaaattcactctccggcgtcgaaggcgaaggactacataaattaggatatattttaagggatattagtaaaattcctggaggtaacatgtatgctgacgatacagcagggtgggatacgaggatcaccgaggatgatttacaaaacgaagctaaaataacagatattatggagccagaacacgccctactagccaaagctatatttaagttaacataccagaacaaagtcgtgagagttcagcgtcctgccaaaaatggcacagtaatggatgtaatctcgcgacgggaccaaaggggtagtggacaagttggcacctacggattaaatacattcactaacatggaagcacaattaatcagacaaatggaatctgaagggattttcagcccaagcgagttagagaccccaaatttagcagagagagttctagactggttagaaaaatacggagtagaaagactgaaacgtatggcgatctcaggagatgattgcgtagtcaagcctatcgacgacaggtttgcgactgctttgaccgctttgaatgacatggggaaagtaagaaaagatatcccacagtgggaaccctcaaaaggatggaatgactggcaacaagttccattctgcagccaccatttccaccagcttataatgaaggatggaagggagatagtagtaccatgtagaaatcaagatgaactcgtaggaagggcccgcgttagccaaggcgcaggttggtcgctcagagagacagcatgcctgggaaaaagttatgcacaaatgtggcagcttatgtatttccacaggcgagacctgcgattggctgccaatgccatatgctcggcggtaccggttgattgggttcctacttctagaacaacctggtccatccatgctcaccatcaatggatgaccacggaggacatgctatccgtgtggaaccgggtatggatagaggaaaatccatggatggaagacaaggcgcacgtaagtagctgggaggatgtgccataccttggtaagcgagaagaccaatggtgcggaagtctaattggactaacggcaagagccacttgggcaacgaacattcaagttgccataaatcaggtaagaaggttgatcggaaatgaaaattatctagactatatgactagcatgaagaggtttaaaaatgaaagcgatccggaaggagcactatggtaa

SEQ ID NO: 22070 - RNA, 9879 nt, synthetic construct
  misc_feature 1..9879: note = derived and/or modified CDS sequence (opt6) from DENV-1__KC762629__SS-prME
  source 1..9879: mol_type = other RNA
tcagtaacaatgctcttaatgttaatgccaactgctcttgcttttcatttaacgactcgcggaggggaacctcatatggtagtatcaaaacaagaacgtgggaaatcactcttatttaaaacctcagccggggtgaatatgtgtacattgattgctatggatcttggagaactgtgtgaagacactttaacatataaatgtccaaggattacggaagcagaaccagatgatgtggattgttggtgtaatgcgaccgatacctgggtaacttatggaacgtgtagtcaaaccggtgaacacaggagagataaacgttcggtcgctttggcaccacatgtgggccttggacttgaaacaaggacagaaacatggatgtcatccgaaggagcttggagacaaatacaacgagtagaaacatgggcgctccgtcatcccggatttacagtgatagctttatttttagcacatgctataggaacatcaatcacacaaaaaggaataatatttattctattgatgctagttactccgagcatggcaatgcgctgcgtaggaattggtagtagagattttgtggaagggttatcaggcgcaacatgggtagacgttgttctcgaacatggaagttgcgtaacaacaatggcgaaagataaacccactttggatattgaattactcaaaacggaagttacaaatccagcagtcctacgaaaattatgtattgaggccaaaattagtaacacaactactgacagtaggtgcccaactcaaggggaggctaccctagtagaagaacaagatgctaattttgtatgtagacgcacgtttgttgatcgcggttggggaaatggatgtggtttatttgggaaaggttctttgataacctgtgcgaaattcaaatgtgtcaccaaactggaaggaaaaatagtgcaatatgaaaatttaaaatatagtgtaattgtcaccgtgcatacgggagatcaacaccaagtcggtaacgaatctacagagcatggtacaactgctaccattactccgcaagcgccaacaactgaaattcaattaacagactatggtgcgctaacattagattgctcgcctaggacagggcttgactttaatgagatggtcttactaacaatgaaagagaaaagttggttagtacataaacagtggttcctagatttacctttaccttggacgtccggagcttccacctcacaggagacttggaaccgacaggatctattggttacatttaaaactgctcatgccaagaaacaagaggtagtggttctggggtctcaggaaggagcgatgcatactgcgctgacaggcgccaccgagatacaaacgagcggaacaaccacaatattcgcgggacacttaaaatgtaggttaaaaatggacaaactaacgcttaaaggtatgtcttatgtaatgtgtacagggtcgtttaaactcgaaaaagaagttgcggagacacaacacggcactgtattagttcaaataaaatatgaaggcactgacgctccttgcaaaattccattctcaacgcaagacgaaaaaggagtaacacaaaatggaaggctcatcacagcaaacccaattgttacagacaaagagaaaccagtaaatattgaggctgaacccccatttggcgagtcatacattgttatcggagccggggagaaaactctaaaattatcttggttcaagaaagggtcaagtatcggaaaaatgttcgaagcgacagcaagaggcgcccggagaatggcaatactaggcgacacagcatgggactttgggtccatcgggggagtctttacctcagtagggaaactggtacatcaaatatttgggaccgcatacggtgtactgttttcaggagtctcttggactatgaaaattgggataggagtcttgcttacttggttagggctaaatagtaggtcaacatcactaagcatgacttgtatagctgtcgggttggttacgttgtacttaggtgttatggtccaagcggacagtgggtgcgttatcaattggaaagggcgagagctaaaatgcgggtccggcatatttgttacaaacgaagtccatacctggacagaacagtataaatttcaagcggacagccctaaaagattatcagcagctattggaaaagcctgggaagaaggtgtatgtggtattcgttctgccactagactggaaaacattatgtggaaacaaatatctaatgaattgaatcatatacttttagaaaacgatatgaaatttacagtggtggttggtgatgtcgcaggcattctcgctcaaggcaagaaaatgataaggccgcaaccaatggaacacaaatattcatggaagtcatggggtaaagcaaaaatcataggagcagatgtccaaaatacaacttttataatcgatggccctaacacgcctgaatgcccggatgatcagcgcgcgtggaacatttgggaagtagaagattacggttttgggatttttacaacaaacatatggttgaaattgagagatagctatactcaagtatgtgaccatagattaatgtccgctgccattaaagattcaaaggccgttcatgcagacatgggctattggattgaaagtgagaaaaatgagacatggaaattagcgcgagcatcgttcatagaagttaaaacgtgtatttggccaaaaagtcacacgctctggagtaacggcgtattagaatcagaaatgataatcccaaagatatacggcgggccaataagccagcataattacagacccggatactttactcaaacagcgggaccatggcatttgggaaaacttgagcttgattttaacttatgtgaaggcacaactgtagtagttgatgagcattgcgggaacagaggaccatcgttaagaacaacaactgttacaggaaagataatacatgaatggtgctgtcgaagctgtacgctgcctcccctaaggtttagaggagaagacggttgttggtacggtatggaaataagaccagtaaaggagaaggaagaaaacctagtaaaatcaatggtatccgcagggtctggagaggttgacagtttttcgctgggattattatgtataagcataatgattgaagaggtaatgagatctagatggtctcgtaaaatgctcatgacaggtacattggctgtatttttccttttaataatggggcaactcacgtggaatgacctcattagattgtgcataatggtgggagcaaatgcctcagacagaatgggaatgggtacgacctatcttgcacttatggccacgtttaagatgaggccaatgttcgcggtcggtctcctgtttcgacggttgacctcacgtgaagtacttctattaaccatcgggttgagcttggtagcaagtgtggagctaccaaattccctagaagaactgggagatggattagctatgggtatcatgatccttaaacttctaacagacttccaatcacatcaactatgggctactttattatcgctgaccttcattaaaacaacgttttctctacattacgcatggaaaaccatggcgatggttctgtcgatagtatcacttttcccactatgtctgagcactacatctcagaaaacaacctggctccctgtattgctcggctctcttggatgcaaacccctgactatgtttttaattgctgaaaataaaatatggggacgaaaaagttggccattgaatgaaggtattatggcagttggaatagtatcaattttactttcgtcactacttaagaacgatgttcctctagccggtcctctaattgcgggtggcatgcttatcgcttgttatgtcatttcaggttcttccgcagatctatcattagaaaaagccgctgaagtatcgtgggaagaagaagcagaacacagtggagcgtcgcacaacattctagttgaagtgcaggatgacgggacaatgaaaattaaagacgaagaaagagacgacacgttaacgattcttctgaaggctacattactagccgtttccggggtttatccgttatcaataccagccacactctttgtttggtatttttggcagaagaagaaacaaagatctggcgtattatgggatacgccgagtcctcctgaagtagaaagagcagtattggatgacgggatttatagaataatgcaaagaggccttttagggcgatctcaggttggtgtcggggtatttcaagagaatgtctttcacactatgtggcatgtaacaaggggagcagtccttatgtatcagggaaaaagactcgaaccatcatgggcatccgtgaagaaagacttaataagttatggtgggggttggaggcttcaaggatcctggaacacaggagaagaggtacaggtaatcgcggtggaaccaggcaaaaaccctaaaaacgtacaaacggcacccggaacctttaaaacgcctgaaggagaagtaggtgccattgctttggattttaaaccgggaacatctgggtcacccattgttaaccgagagggaaaaattgtcgggctttacggaaatggggttgtgacaacctctgggacttacgtgagcgcaatagcccaggcaaaagcgagtcaggaagggccactaccagagattgaagatgaagtcttccgaaaaagaaatttgactataatggaccttcatcccggaagcggaaaaacgagaagatatttgccggcaatagtcagagaggcaatcaaacggaaacttagaaccctaatattagcaccaacaagggttgttgcaagtgaaatggcagaagcgttgaagggaatgcctatccgatatcaaacaaccgctgtaaagtctgagcatactggcaaagagatcgtagaccttatgtgtcatgccaccttcacgatgaggttattgtccccggtacgagttccaaactacaatatgataattatggatgaggctcattttactgatccctcaagcatcgcggcaagaggctatatttcaacaagagtaggaatgggggaagcggcagcaatcttcatgacagcaactccacctggcagtgtagaggcttttcctcaatcaaatgcggtaatacaggacgaagaaagagatatcccagagagatcatggaactcaggctacgagtggataacagattttccaggcaagactgtttggtttgtaccatcaatcaaaagtggaaatgatatagctaattgcttacgtaagaatgggaaacgggttatacaactatcaaggaagacatttgacacggaataccagaaaacgaaaaacaacgactgggattatgtggtcacaacggatataagtgaaatgggggcaaattttagagcagaccgagtcatcgacccacgacgatgcttaaaacccgtcattctaaaagacggccccgaacgagtaatattagcaggaccaatgccagtaactgtggcatcagcagcgcagagacgaggtagggtaggccgaaaccacaataaggaaggagaccaatatatatacatgggccaaccactaaataacgatgaggatcatgcccactggacagaggctaaaatgctactagataacatcaatacaccggaaggtataataccagcgctatttgaacctgagagagaaaaatctgctgcgattgacggagaatacaggttaagaggggaagctagaaaaaccttcgtcgaacttatgagacggggagacttaccagtttggctaagttataaagttgcaagtgaaggttttcaatactctgatcgaagatggtgtttcgatggcgaaagaaataaccaagtccttgaagaaaacatggatgttgagatatggactaaagagggcgaacgaaagaagctgcgccctagatggttagatgcaagaacgtactcagacccacttgctctacgtgaatttaaagaatttgcagcaggtcgacgatcagtttcaggtgacctaatcttggaaattggaaaattaccccagcatcttacacagagggcccagaacgcactagataacttagttatgctacacaacagtgagcaaggcggacgggcataccgacatgctatggaagaactacctgatactatagaaacccttatgttgttggcacttattgcagtccttacagggggtgtcacattattctttttatccggcagaggtctgggtaaaacatcaataggacttttgtgtgtaatggcatcatctgttcttctttggatggccagtgtggaacctcactggatagcagcatcaataattcttgagttctttctaatggttctcttaattcccgaacctgaccgacaaagaactcctcaggacaatcaattagcctatgtagtaataggcttattattcatgattctaacggttgcagctaacgaaatgggcctactagaaactaccaagaaagacctcgggataggccatgtagctgtagaaaatcaccaccatgccgcaatgttggatgtagatctccacccggcttcagcttggacgctctatgccgttgcaactacaatcataacgccgatgatgcgtcatacaatagaaaatacaacagcaaatatatcccttacagcgattgccaatcaagctgccatactaatgggattagataaaggctggccaatctcaaaaatggatataggggtgccattgttagcattaggctgttactcccaggtgaacccactgacgttgacagcagccgtccttatgcttgtagcacactacgcaattattggaccgggattacaagcaaaggcaacaagagaagcacagaaaagaaccgcagcaggaattatgaaaaatcccacggtcgatggcatcgtcgccatagaccttgatccagtagtgtatgacgcaaaattcgagaaacagttgggccaaataatgttacttatactttgcacctcacaaatactactaatgagaacaacatgggcgctttgtgaatctataacactagcgacagggcctctgacaaccttgtgggaaggctccccgggaaaattttggaataccactatcgcagtatctatggccaatatattcagggggagttacttagcaggagcaggtttagcattttcactaatgaaatcactagggggaggccgacgagggacaggagcacaaggagagacactcggagaaaaatggaaacgtcaattaaaccaactcagcaaatccgaatttaacacttataaaagaagcggaataatggaagtcgaccgaagcgaggcaaaagaagggttgaaaaggggtgaaactacgaaacatgctgtatcgagaggaacagcaaaattaagatggtttgtagagagaaatttagttaaacctgaaggcaaggtaatagatttaggctgcggcagaggtggatggtcatattactgtgctggactaaagaaagtaacagaagttaaaggttacactaagggaggacccggtcatgaagaacctataccgatggcgacttacggttggaatttggtgaaacttcactccggcaaagatgtcttctttatcccgcctgagaaatgtgatactctgctatgtgatataggagaatcgtcacctaacccaacgatagaagaaggtcgaactttacgggtcctgaaaatggtagaaccgtggctaaggggtaatcagttttgcataaagatactaaatccatatatgccaagtgtagtagaaactctcgaacaaatgcagcgtaaacatggaggcatgttagtaaggaacccgctatcgagaaattctacacacgaaatgtattgggtatcatgtggcacagggaatatagtttcagcggtcaacatgaccagcagaatgcttttaaacaggtttacaatggcgcatagaaaaccaacctacgaaagagacgtagacctaggcgctggaactagacacgttgcagttgaaccagaggtagcgaacctagatatcatagggcaacgaatagagaacattaagcatgaacacaaatcaacctggcattatgacgaagataatccttacaaaacgtgggcataccacggatcttatgaagtaaaaccttcaggatctgcctcatctatggtcaatggcgtcgtaaaattactgaccaaaccctgggatgtcatcccaatggtcacacaaatagcaatgacagacaccacaccttttggtcaacagagagtgttcaaagagaaggtggacaccagaacacctaaagcaaaacgaggtacaacacaaataatggaagtaacagcaagatggctttggggttttcttagtcgcaacaagaaaccccggatctgcacaagggaagagtttacacgaaaagtcagatcaaacgctgctatcggcgcagtatttgttgacgaaaaccaatggaatagtgctaaagaagcagtcgaagacgaaaggttctgggatctagtacatagggagcgtgagctacacaaacagggaaagtgcgcgacttgcgtatataatatgatgggaaaaagagagaagaaattaggagaatttgggaaagccaagggtagtagagcaatatggtatatgtggttaggtgctaggttcttagaatttgaagcgttaggtttcatgaatgaggaccactggttttcacgggggaatagcctgagtggtgtagagggtgaaggattgcacaaattaggatatatactacgcgatatatctaaaattccgggaggaaacatgtacgcagacgacactgccggatgggacaccagaattactgaagacgatctacaaaatgaggctaaaataactgacattatggagcctgaacacgcgttactggcaaaagcgatttttaaattaacttatcaaaataaagtagtacgtgttcaaagaccggccaaaaatggaactgttatggacgttatctcccgaagagaccaaagggggagtggccaagtcggaacatatggattaaacacctttacgaacatggaggcgcaactcatcagacaaatggaatcagaaggaatcttcagtccttcagaactggaaactcctaacctggctgagagggttctagattggctagaaaagtatggtgtagagaggttaaagcgtatggcgatcagtggcgatgattgtgtggtgaaacctatagatgaccgttttgcaacagcactaacagcacttaatgatatgggaaaagtacgtaaagatataccacagtgggaaccaagtaaaggatggaacgattggcaacaagttcccttctgctctcatcactttcatcaattaatcatgaaagacgggcgcgaaatagtcgtgccgtgtcgcaaccaggatgaactcgtcggcagagctagagtcagtcaaggagcaggttggagcctcagagaaacagcatgtcttggtaagagttatgcacagatgtggcaacttatgtatttccataggcgggacctcagactggcggctaacgctatttgtagtgctgttccagttgattgggttcctacatcacgtaccacatggagtatacatgcacatcaccaatggatgactaccgaagatatgctttcagtttggaacagagtttggattgaagaaaatccctggatggaggacaagactcatataagctcatgggaagatgtaccatacttaggcaagcgagaagatcagtggtgcggctcacttataggactgaccgcccgcgctacgtgggcaactaacattcaagttgcaataaatcaggtaaggcgtctgataggaaatgaaaactacttggattacatgacgtcgatgaagcgctttaaaaatgaatcagatccagaaggggccctgtggtaa

SEQ ID NO: 22071 - RNA, 9879 nt, synthetic construct
  misc_feature 1..9879: note = derived and/or modified CDS sequence (opt6) from DENV-1__KC762627__SS-prME
  source 1..9879: mol_type = other RNA
agcgttactatgcttctaatgttaatgcctaccgctctggcttttcatttaacgacacgaggtggcgaaccacatatgattgtttcaaaacaagaacgtgggaaaagtttattgtttaaaacttcggctggagtaaatatgtgtacgctaatagcaatggatttaggtgaactttgtgaagacacgttaacttataaatgcccacgaattacagaagcagaaccagatgatgtggactgttggtgcaatgccactgatacttgggtaacatacggaacttgttcccaaacgggagaacatagaagggacaaacgatcagtcgcgttggcaccacatgtgggattaggacttgaaacacggacagaaacgtggatgagttcagaaggagcgtggaaacaaatacaaagagtagagacatgggcgttgcggcatcctggatttactgttattgccctttttctagcacacgccatcggaacgagcataacacaaaaaggtataatctttatattactaatgctagtaactccgagtatggcaatgcgatgtgtgggaataggctcccgagattttgtggaaggtttatccggcgccacctgggttgatgtcgttctggaacatggtagttgcgtaactacaatggcaaaagacaaacccactctcgacattgaattattgaaaaccgaagtgacgaatcccgctgtgttaaggaaactttgcatagaagctaaaataagtaataccactaccgactcgaggtgtcccacacaaggagaagcaacactggtcgaagaacaagacgccaattttgtatgcagacgaactttcgtggacagaggttggggaaacggatgcggtctctttggaaaagggtctctgatcacttgtgccaaattcaaatgtgttactaaactcgaaggaaaaatagttcaatacgaaaatctaaaatatagcgttattgtaacagttcatactggagaccaacaccaagtaggaaatgaatctaccgaacatgggactacagctacgataacacctcaagcaccaacaacagagatacaactaactgattatggagcattgactttagattgttcgccaagaacaggtttagatttcaatgaaatggtattactcacaatgaaagagaaaagctggctagtccacaaacaatggtttttagaccttcctctaccgtggacctcaggggcctccaccagccaagaaacctggaaccggcaagacctcctagttacatttaagacagcacatgccaagaaacaagaagtggtcgtgctcggatcacaggagggggcaatgcatacggcgttaactggggctacagaaattcagacgtctggcactaccacaatatttgccggtcacttaaaatgtcgcttaaagatggataagttaaccttaaagggtatgtcttacgtgatgtgtacgggttcgttcaagctggaaaaggaagtagccgagacacaacatggtacagtacttgttcaaattaaatacgaaggcacggacgctccctgtaaaatacctttttcaactcaagacgagaaaggagtgactcagaatggacgacttattactgcaaatcctatagtaacagataaagagaagccagttaatatagaagccgaaccaccatttggggagagctatattgtaattggcgccggggagaaagctctaaaattatcctggttcaagaaaggcagcagtattggcaaaatgttcgaagcaacagccagaggcgctagaaggatggctattttaggggatacggcatgggatttcgggagcataggaggcgtctttacgtcagtaggtaaattaatacatcaaatattcgggacagcatatggtgtgttattcagtggagtctcttggacgatgaaaataggaataggggtattactaacatggctgggactcaatagtagaagcacatcattatcaatgacatgcattgcagtgggtctggtaactctttatttgggagttatggtgcaagcagactccggatgtgtaataaattggaaaggccgcgagttaaaatgtggttcgggtatattcgtgacaaatgaagtacatacttggacagaacagtataagtttcaggctgactctccaaaaaggctctcagcagcaattggcaaggcatgggaggaaggtgtatgcggaatacgttcagcaacaaggttagaaaacataatgtggaagcaaattagtaacgagctaaatcatatcctgttggaaaatgatatgaaatttactgttgttgtgggtgatgtggcagggatattagcccaaggtaagaagatgatccgaccacaaccgatggaacataaatattcatggaagagttggggaaaagcaaaaataattggagcagatgtacagaacactaccttcattattgatggtccaaacactccagagtgtcccgatgaccaaagggcctggaacatttgggaggttgaggattatggctttgggatatttacgacaaatatttggctcaaacttagagactcatatacgcaagtatgtgatcatagactaatgagcgcggctattaaagatagtaaagcggtccatgcagacatggggtattggatagaatccgagaaaaatgaaacgtggaaattagctagagcgtcctttatagaagtaaaaacttgtatctggccgaaatcacacacactttggtccaatggggtattagaatcggagatgattatcccgaaaatatacgggggacccatctcccaacacaactacaggcctggctatttcacacaaaccgccggtccgtggcacttaggtaagctggagttggactttgatttgtgcgagggaacgacggtagtagtcgacgagcactgcggcaaccgtggaccctctttaaggaccacaactgtaacaggtaaaatcattcacgaatggtgctgccggtcctgcacattaccaccactgaggttcagaggcgaagacggatgttggtacggaatggagattagacctgtgaaggaaaaagaggaaaacctagttaagagcatggtaagtgcagggagcggagaggtagattcatttagtctaggcttactatgcatatctatgatgatagaggaagttatgcgctctaggtggtcgcgtaaaatgctaatgaccggaacattagcagtcttcttcttgctaataatgggacaactcacgtggaacgacctaataagattatgtattatggtaggggctaacgcatctgacagaatgggaatgggtacaacgtatcttgcgctaatggcgacgtttaaaatgcggccaatgttcgccgttggactcttatttcggcgtcttacaagtcgagaagtactacttttaactattggcctaagtctagtagccagcgtcgaattgccaaattcactcgaggaacttggagatggcttagcaatggggattatgatactgaaactattaaccgattttcaaagccaccaactatgggccacattgttgtcactcacatttatcaaaactacatttagcctacactatgcatggaagaccatggcgatggtgttgagtatagtctcactcttcccgctatgcctaagtacaacgagtcagaaaaccacttggctgccggtacttctgggttcactaggatgtaaaccacttacgatgtttctaatagcagagaataagatatggggtagaaagagttggccgctaaatgaaggaattatggctgtaggcattgtatcaatcttactttcttcactacttaaaaatgatgtgcctctagctgggcctctaatagctggtggaatgctaatcgcatgttacgtaatcagtggctcatccgccgacttatcactggaaaaggctgccgaagtaagttgggaagaagaagccgagcatagcggtgccagccacaatatcctagtggaggtacaagacgacgggactatgaaaattaaagacgaggaaagagacgatacccttacaattttacttaaggcaacattactagcagtttcaggggtataccctttgtcaattccagcaactctctttgtgtggtacttttggcagaaaaagaaacaacgctctggcgttttatgggataccccgtcaccacccgaagttgaaagagctgtactcgatgatggtatatatcgcataatgcagagaggcctattaggacgctcccaagtgggtgttggagtattccaagagaacgtattccatactatgtggcatgtaactcgaggagctgtgttaatgtaccaaggtaagagactcgagccttcgtgggcatctgttaagaaagacttgatatcttatggcggaggatggcgattacaaggaagctggaacactggagaagaagtccaggtcattgctgtcgaaccgggtaaaaatccgaagaacgtacagacagcacctggaacattcaaaactcctgaaggtgaagtcggtgctatcgctctagatttcaaacccggaacatcgggatcacccatagtaaatcgcgagggaaaaattgtaggtttatatggcaatggagtagtaactacatctggcacatatgtcagcgcaatagcgcaagcaaaggcgtcacaagaagggccgctcccggagattgaagacgaagtgtttcgtaaaagaaacttaaccataatggatctgcaccctgggtcaggcaaaacgagaagatacctacccgctattgtcagagaagccattaaaaggaaactccgaactctcatattagccccaactcgtgttgtcgcaagtgagatggcagaggctttgaaaggaatgccaattagatatcaaactactgctgtcaaatcggaacatacggggaaggaaatagtagatttaatgtgtcatgcaacatttacaatgcgactactttcccctgtaagagttcccaactacaatatgataatcatggatgaggcacatttcacagatccatcgtctatagcagcaagaggatatatatcaactagagtaggaatgggagaagcagcagccatctttatgactgcaactcctcctggtagtgtcgaagcattcccccaaagcaatgcggtaattcaagatgaagaaagagatataccagaaaggtcttggaactcaggttatgagtggataactgacttccctggaaaaaccgtttggtttgtacccagtataaaatcgggcaacgacatagcaaattgtctaaggaagaatggaaaacgagtaatacaactaagtcgtaaaacatttgatacagaatatcaaaagaccaagaataacgactgggattacgtagtaacaacggatataagcgagatgggagcgaattttagagccgatcgcgtaattgatcctaggagatgtttgaaacccgtaatcttaaaagatggtccggaacgagtcatattggcgggtcctatgccagtcactgttgcgtctgctgcgcagcggagggggagggttggacgcaatcacaacaaagaaggtgaccaatatatctatatgggtcaacctcttaataacgatgaagaccatgctcattggaccgaagcaaaaatgctcctagataacataaatacaccagaaggcataatacctgcgcttttcgaaccagaaagggagaaaagcgctgcaattgatggcgaataccgactaagaggtgaagctaggaaaacattcgtagaacttatgcgtagaggagacttgcctgtctggttaagctacaaagtagcctcagaggggtttcagtattcagacagacgttggtgttttgatggagaaagaaataatcaagtactcgaggaaaacatggatgtcgaaatatggacaaaagagggggagagaaagaaattacgacctcggtggttagacgcgcgtacatattctgatccactagctctcagagaatttaaagagttcgccgcagggcgcagaagcgttagtggagacctaatattagagataggtaaacttccacaacacttaacacaaagagcccaaaatgcactagataatctagtaatgttgcataacagcgaacaaggaggacgagcctacaggcacgcaatggaagaattacccgatacgatagaaaccctcatgttgttagcattaatagctgtcttaacagggggtgtaacgctattctttctatcaggacgcggcttaggaaaaacgtctattggactactctgtgtgatggcctcaagtgtcttattatggatggctagtgttgagccacattggatagccgcttctattatactagagttctttctaatggtattattaataccagagcctgacagacagaggacaccacaagataatcaattagcgtatgtagtaataggactgctatttatgatattgacagtagcagcgaatgaaatgggtttattagagacaactaaaaaggacttgggtataggccatgtagcagtagaaaatcatcaccacgctgcaatgttggatgttgatctgcatccagcaagtgcgtggacgctatatgcagtggctacgactatcataactcctatgatgcgtcacactatcgaaaacacgacagcaaatattagcttaaccgcaattgctaatcaagccgccattctaatgggcttagataaaggttggccaatctcaaaaatggacataggcgtaccactgctcgcactaggctgttactcgcaggttaacccattgacactaacagcagccgttctcatgttagttgcccattatgctattatcggacctggtcttcaagcaaaagctactcgagaagctcagaaaagaacggccgcaggtataatgaaaaatccaactgtcgacggtatcgtagctatagatctagatcccgtggtatatgatgcaaaattcgaaaaacagctgggccaaataatgttattaatactttgcacatcccaaatcctgttaatgcggacaacatgggcgttatgcgaaagcatcacgttggctacaggccctttgacgactctatgggaaggatcgcctggaaaattctggaacacaactatcgccgtttcaatggcaaatatttttcgtggctcttacctcgcgggagcgggcttggccttctcattaatgaaaagtttaggtggaggccgaaggggcacaggagcgcaaggagaaacactaggagaaaaatggaaacgacaattaaatcaattgtcaaaaagtgaatttaacacgtacaaacgttccggcataatggaagttgaccgctcggaggcaaaagaaggactaaagcgcggtgaaacaaccaaacacgcggttagtcgtggcacggcaaaactaagatggttcgtggaaaggaatttagtaaagccagagggaaaagtgatagaccttgggtgcgggagaggcggttggagttattattgcgctgggctcaagaaagtaacagaagtgaaaggttatacaaaaggagggccaggacatgaggagcctataccgatggccacatatggttggaacttagtaaaactccactcaggtaaagacgtcttctttattccacccgaaaaatgcgacacgttgctatgtgacatcggcgaaagcagccctaatcctaccatcgaagaaggcagaactctaagagtcttaaaaatggtagagccgtggctccggggaaatcaattttgtataaaaatattaaacccttatatgccttcagtagtcgagacactggagcaaatgcagaggaaacatggaggaatgttagtaagaaatcctctaagccgtaattccactcatgagatgtactgggtgtcatgtggaactggaaatatcgtaagcgcagtcaatatgacatcaagaatgctcttgaatcgatttacgatggcacatagaaaaccgacatacgaacgcgacgtcgacttaggggctggaacaagacatgttgctgtcgaaccggaggttgctaacttagacatcattggacaacgtatagaaaatataaaacacgaacataaatcaacctggcattatgatgaagataatccatataaaacctgggcataccatggaagttatgaagtcaagccctcaggatcagcatcaagtatggtcaacggagtagttaaactgttaaccaaaccctgggatgttataccgatggtgacacagatagcgatgacagacacgacaccttttgggcagcaaagagtattcaaagaaaaagtagatacgagaacccccaaggcaaagagagggacaacccagataatggaagtaactgctagatggctttggtcttttctatctagaaacaagaaacctagaatatgcactagagaagagtttacacgaaaagtccgatcaaatgctgcaataggagccgtttttgtagatgaaaatcaatggaactctgcgaaggaagctgttgaagatgagcgcttttgggacctagttcacagagaaagagagttgcataaacaaggtaagtgtgctacatgtgtctacaatatgatgggcaaacgcgaaaagaaattaggcgaatttggtaaagcaaaaggaagcagagctatctggtatatgtggttaggggcacgatttttagaatttgaagcgcttggatttatgaacgaagaccattggttctccagagagaactcactgtcaggggttgagggagaaggtctgcacaaattaggatacattttacgagatattagcaaaataccagggggcaatatgtacgcagacgatacagcaggatgggacacccgaataaccgaagatgacctacaaaatgaagcgaagataacagatataatggaaccggagcatgctcttttggctaaagccattttcaagttaacgtatcaaaataaagtagttagggtacaaagaccggcgaagaacggcactgtaatggacgtgataagtagacgagaccagcgaggtagtggtcaggtaggaacatacggtttaaatacatttacaaacatggaagcacagttaattagacaaatggaaagcgaaggaatattttcaccaagtgaattagaaacaagtaatttagctgaacgtgtacttgattggctagaaaaatatggtgttgaacgtttaaagagaatggctattagcggagatgattgcgttgtaaaacccattgatgataggtttgcaactgcgttgactgccctgaacgacatgggaaaggtgcgtaaagatataccgcagtgggaaccatcaaaaggatggaatgactggcagcaagtacccttttgttcccatcattttcatcagctaataatgaaagatggccgcgagatagtagtaccttgtagaaaccaagatgaattggtaggccgagcgcgagtcagccaaggagccggttggagcttaagggaaactgcgtgtttaggcaagtcatatgcgcaaatgtggcaattaatgtattttcaccgtcgtgacttgagactcgctgcgaacgcgatctgttcagcagtaccggtcgactgggtaccaacaagtagaacaacatggagcatacatgcacatcatcaatggatgacgacggaagatatgctatctgtctggaatagggtttggattgaagagaatccttggatggaagataaaacacatataagttcttgggaagacgttccatatctaggaaaacgagaggaccaatggtgtggatccctaataggtctaaccgctagagcaacttgggccactaatatacaggtagctatcaaccaggtaagacgtcttataggtaatgaaaattacttggactatatgacgagtatgaaaaggtttaagaatgaatctgacccagaaggagcattatggtaa

SEQ ID NO: 22072 - RNA, 9879 nt, synthetic construct
  misc_feature 1..9879: note = derived and/or modified CDS sequence (opt6) from DENV-1__KC762647__SS-prME
  source 1..9879: mol_type = other RNA
agtgtaacaatgctgcttatgcttacacctactgccttagcttttcacttaacaactcgaggtggggaaccgcacatgatcgtaagtaaacaagaacgagggaaaagtcttctattcaaaacatctgccggagtcaacatgtgtacactaatagccatggatttgggagaattatgtgaagatactcttacctataaatgtccaaggattacggaagcagaacctgatgatgtagattgttggtgtaacgcgactgacacgtgggtaacttatggaacatgttcacaaaccggagaacaccgtagagacaaacgctctgtcgcgttagctccacacgtgggactagggttagaaactcgaacagagacttggatgagcagcgagggggcatggaaacaaattcaaagagttgagacatgggcattaaggcatccgggcttcacagtgatcgcattattcctagcacatgctatcgggacgagcataactcaaaaaggaataatattcatcttgctaatgctagttacaccaagtatggccatgagatgtgtaggaataggtagtcgggatttcgtcgaaggcttatccggtgcaacatgggtagacgtcgtacttgagcacggctcctgcgtaactacaatggccaaagacaaacccacgttagacatcgagctattaaaaaccgaagtaacgaaccctgcagtactacgaaaactatgtatcgaggcaaagattagcaatacaacgacagattcaagatgtcctacgcaaggagaagcgacactcgttgaggaacaagacgctaactttgtttgcagaagaacatttgtagatcggggttgggggaacggatgcgggcttttcggcaagggctcattgataacatgcgctaaatttaaatgtgttacaaaactagaaggaaaaatagtacaatatgaaaacttaaaatacagcgtaatagtgactgtgcacactggagaccaacaccaagtaggaaacgagagtaccgaacatggaaccacggcgacaataacccctcaagctccaactacagaaatacaattaacagactatggtgcactgaccctggactgcagccctaggacgggattagattttaatgaaatggtcctattaacaatgaaagaaaaatcatggctagtccacaaacaatggtttctcgacttaccactgccctggacttccggggctagtacatcgcaagaaacatggaatagacaagatctattagttacgtttaaaaccgctcatgctaagaaacaagaagtggtagtattgggatcccaggaaggggcaatgcacacggctttaacaggtgcaacagaaatccagacatcaggtaccacaacaatcttcgcgggacatttaaaatgtagattaaaaatggacaaactcactctgaaagggatgtcgtatgttatgtgtacaggttcgtttaagttagaaaaagaagtcgctgaaacgcaacatggaactgtcctagtgcagattaaatatgaaggcaccgatgcaccatgcaagatacctttctcgacgcaagatgagaaaggggttacacaaaacgggcgtttgattacagccaacccaatcgtcactgataaagaaaaaccagttaatatagaggctgagcccccttttggagaatcttacatagttataggcgcgggcgaaaaagcattaaagttatcttggttcaagaaaggtagttccataggcaaaatgtttgaagccacagctaggggtgcaagaaggatggctatactaggagacacagcttgggactttggatctatagggggtgtcttcacttctgttggtaaactggttcaccaaatatttggtacagcctatggagttctgttttcaggtgtgtcgtggacaatgaaaataggcataggagttctattgacttggcttggactaaattcgcgttcaacatcgctatcgatgacttgtattgctgtaggcttagttacactgtatctcggggttatggtgcaagcagattctggttgtgttattaactggaaagggcgagaattaaaatgtggtagtggtatattcgtaacgaatgaggttcatacatggacagaacaatacaaattccaggccgattcaccaaaaaggttgagtgctgccataggcaaagcatgggaagaaggtgtatgtggaatcaggagcgcgacacgcttagaaaacataatgtggaaacaaatctctaatgaattaaaccatatattgctagaaaatgacatgaagtttacggttgtagtaggggatgtggcaggtattttagcgcaaggcaagaaaatgatacgaccgcaaccgatggaacataagtacagttggaaaagctggggaaaggcaaagataataggggcggacgtacaaaatacgacatttataattgacggacccaatacacccgagtgtcctgacgaccaacgcgcatggaacatatgggaagtcgaagattacggatttggtatatttacaaccaatatttggttgaaattaagggattcatacacacaggtttgtgaccatagactgatgtcagctgcgattaaggactcacgcgctgtacacgctgatatgggttattggatagaatcggagaaaaatgaaacttggaagctggcccgtgccagcttcatcgaggtaaaaacatgtgtatggcccaagtcacatacgttatggtccaatggagtattagaatctgaaatgattattccaaagatttatggtggtcccatctctcaacataattatcgccctggttattttactcagactgccggaccatggcacttaggaaaattagagctcgattttgacttatgtgagggcacaacagtagttgtagatgagcactgtggtaacaggggcccatcattgcgtacgacaacagttacaggcaagataatacatgaatggtgttgtagatcatgcacactaccgccgttacggttcagaggcgaggacggttgttggtacgggatggaaatacgtccggtcaaagaaaaagaggaaaatctagtaaaatcaatggtaagtgccggcagcggcgaggttgatagttttagcttgggcctactatgcatttcaatcatgatcgaggaagtaatgcgatcaagatggtcccggaaaatgttaatgacaggcactctcgcagtcttcttcttgttaattatgggacaattaacatggaacgacctgatacgactctgtataatggtaggcgcgaatgcatctgaccggatgggcatgggtactacatatctcgctcttatggcaacttttaaaatgcgacctatgttcgcagtcggactattatttagaagattaacaagtagagaggtattgcttctgactatagggttaagtttagtagcgtcggttgaattacctaatagtctagaagaattgggtgatggccttgcaatgggtattatgatcctcaaattacttactgatttccaatcacatcaactatgggctacattattatcgctaacttttataaagacaactttttcactacactacgcatggaagacaatggctatggtattatccatagttagtttatttcccctatgtctatctactacttcacagaaaactacttggctaccggtgttgttaggttcactaggatgtaaacccttgacaatgttccttatagcagagaataagatctggggcagaaaaagttggcccttgaatgaaggaataatggcagtaggaattgttagtattcttctatcatcgctgctaaagaacgatgttcctttagcagggccattgatagcaggagggatgctaatagcatgttatgtcatctctggcagcagcgcggatttgagcttagaaaaagcagctgaggtctcttgggaagaagaagctgaacactctggagcctcgcataatattctagtagaagtccaggatgatggaacaatgaaaattaaggacgaggaaagggacgacacattaaccattttactaaaagcaacattattggctgtatcaggtgtttacccgttatctatccctgcaacgttgttcgtgtggtacttttggcaaaagaaaaagcaacggagtggtgtactttgggataccccatcaccaccggaagtagagcgcgctgttcttgatgatggaatatacagaattatgcagaggggtctactaggacggagccaagtcggcgtaggggtatttcaagaaaacgtgttccatacgatgtggcatgtaacgagaggggcagtcctgatgtatcagggaaaaagattggagccatcgtgggcatcagttaagaaagatttaatttcatatggtggtgggtggagattgcaaggctcatggaacacgggagaagaagtacaagttatagcagtagaaccaggtaaaaaccccaaaaatgtgcaaactgcaccaggtacttttaaaacgccagaaggcgaagtaggagctatagcattggactttaagcctggaacatcaggctcacctatagtaaatagagaaggaaagattgtaggattatacggtaacggagttgtcaccacgtctggaacatatgtttcagctatcgctcaagcaaaagctagtcaagagggcccactaccagaaatcgaagatgaggtcttccgaaaaagaaacctcactatcatggacttacacccaggttctggaaaaacaaggcgctatctaccagccattgtgagagaagcaatcaaaaggaaactcagaacactcatcttagccccgacgagggtagttgcatccgaaatggccgaagccctaaagggaatgcctataagatatcagactacagctgtcaagtcggagcacactggtaaggaaattgttgatctaatgtgtcacgcaacattcacgatgcgactattatctcccgtgagagttccgaattacaacatgattattatggatgaggcacactttactgaccctagcagtattgcggcacgtggttacataagtactcgagtaggaatgggagaagcagcagctatattcatgactgcaacaccaccaggtagtgtcgaagcgtttccgcaatcgaatgcggttatacaggatgaagaaagagacatcccagagaggagctggaactcagggtacgaatggattacggactttcctggtaaaacagtgtggtttgtgcctagcataaaatcgggaaatgacatagctaattgtctaaggaaaaatggcaaaagggtaatccaacttagccgaaagacttttgacacagaataccagaaaactaagaataacgactgggattatgttgtcaccactgatataagtgaaatgggagcaaatttccgagctgatagagtcatagacccgagaagatgtttaaaaccagttattttaaaagacggaccggaacgagttatattggccggacctatgccagtaacagtggcaagtgcagcccaacgacgtggtcgggtaggtagaaaccataataaggagggtgatcaatatatctacatgggtcaacccttaaacaacgatgaagatcatgcacactggacagaagcgaaaatgctcctcgacaacataaatactccagaaggaatcattccagcattatttgaaccagaaagagagaaaagtgcggcaattgatggtgaatatcgattacgcggggaagcacgtaaaacttttgtagagctaatgagacggggagatttgcctgtttggctaagctataaagtagcatcggaaggtttccaatactcagacagaagatggtgttttgatggtgaaagaaataatcaagtactagaagaaaatatggatgtagagatatggacgaaagaaggcgaaagaaagaagctaagacccaggtggttggacgcgagaacatactccgatccacttgcattaagagaatttaaagaatttgccgctgggagaaggtcggtaagtggggatctgatcttggaaatagggaaattacctcaacacttaacacaaaaggcacaaaacgcattagataaccttgttatgttgcataattcagagcagggaggacgtgcatacagacatgctatggaagaactgcccgatacgatagaaacattaatgcttctagctcttatcgcagttcttacaggaggagtcacattattcttccttagtggccgaggtcttgggaaaacctcaataggacttttatgtgtaatggcctcatcagtattgttatggatggcttcagtcgaaccacactggatagcagcatccattatattggagttctttctaatggtgcttctaattcccgaacctgatagacagaggacaccacaagataatcaactagcatacgttgtaataggtctcctcttcatgatactgacagtcgctgcaaacgaaatgggtttattagaaacgaccaagaaagatctgggcatagggcatgtagctgttgagaatcatcaccatgcagcaatgttggatgtagacctgcatccagcttctgcgtggacactatacgctgtggcgacaactattatcacacccatgatgagacatactatcgaaaacacgacagctaatatttcgttgactgccatagccaatcaagctgctattcttatgggactcgataaaggatggccaattagtaaaatggatattggtgtacctctcttggcacttggatgttattcccaagtaaatccgttgacactaactgcggcagttctgatgctcgtagcccactacgcgataatcggaccaggtttgcaagctaaagcgactcgtgaggcacagaaacgtacagctgctggcataatgaaaaacccaacagtcgacggtatagttgctatagacttggatccagtcgtatatgacgccaagttcgaaaaacagttaggtcaaattatgttactaatcctctgtacaagccaaatcttgttaatgcgaacaacgtgggctctgtgtgaaagtatcacacttgcaacgggaccacttactaccctgtgggaagggtcacccggcaagttttggaacacgacaatagcagtgagcatggcgaatatttttaggggctcatacctggccggagcaggtttagcattttctttgatgaagtcattagggggagggagaagagggactggagcacaaggggaaacattaggagagaagtggaaacgacaattgaaccaacttagtaaatctgagtttaacacttacaaacggagtggaataatggaagtggatcgatcggaggcaaaagaaggattaaaacgcggtgaaacaacgaaacacgctgtatcaagagggacagccaaactcaggtggttcgtcgaaaggaacctagttaaaccagaaggaaaggtgatagatctaggttgtggacgtggcggttggagttactattgtgcaggattaaagaaagttacggaggttaaaggctatacgaaaggaggaccgggacacgaggaacctataccaatggcaacatacggttggaatctggtcaaactccatagtggtaaagacgtattctttatacctcccgaaaaatgcgatacactattatgtgatatcggggagtcctctccaaaccctacaattgaggaaggaaggacgctaagggtcttaaaaatggtggaaccatggttaagaggaaatcagttttgcataaaagttttaaatccatatatgccgagcgtggtggaaaccctagagcaaatgcaaagaaagcatgggggcatgctggtgagaaacccactcagtagaaattcaacacacgaaatgtattgggtatcctgcgggacaggaaatatagtatctgcagtaaatatgacaagcagaatgctactgaaccgcttcacaatggcccatagaaaaccgacgtacgaacgtgacgttgatcttggagctggaacacgacacgtcgctgtggaacctgaggttgcaaacctagatataattggacaaagaattgaaaacattaaacacgaacacaaatcgacttggcattatgatgaagacaacccatataagacatgggcataccatggctcgtatgaggttaaaccttctggaagtgcgtcaagtatggtgaacggagtggttaaattgttaaccaagccgtgggacgtaattccgatggtaacgcaaatcgcaatgacagatactactccatttggtcaacaacgagtattcaaagaaaaagtagatacaagaacgccaaaagcgaaaagaggaacgactcaaattatggaagtgacagccagatggttatggggttttctatcaagaaataagaaaccaaggatatgtactagagaagagttcactagaaaagtacgatccaatgctgcgattggtgccgttttcgttgacgaaaaccaatggaactctgccaaggaagccgtcgaagacgaacgattttgggaccttgtacatagggagagagaacttcataaacaaggtaagtgtgcgacctgtgtatacaacatgatgggtaaacgtgagaagaaactaggagagttcggaaaagcaaaaggatcaagagcaatatggtatatgtggctcggagcaagatttttagaatttgaagcgcttggcttcatgaatgaggatcattggttcagtcgagaaaatagtctatccggagtagaaggggaaggtttgcacaaattgggatacatattacgagacattagtaaaatcccgggcggtaacatgtacgcagacgataccgccggctgggacactagaataacagaagatgatctccaaaacgaggctaaaataaccgacataatggaacctgagcacgcattactggctaaagcaattttcaaactgacttaccaaaacaaggtggtaagggtacaaaggccagctaaaaacgggactgtgatggacgtgatatcaagacgggatcagagagggagcggccaagtcggaacgtatggattaaatacattcacgaacatggaagctcagttaataaggcaaatggaatcagaggggatcttcagcccaagtgaactagagacacctaatttggctgagagagtactggactggctcgaaaaatacggagtggagcgattaaaaaggatggcaatatctggtgacgattgcgttgtcaaaccgattgacgatagattcgccacagctttgacagctttaaatgacatggggaaagttcgaaaagatattccgcagtgggaaccctctaaagggtggaatgactggcaacaggtacccttctgctcacatcattttcaccaattgataatgaaagacggaagagaaatagtcgtgccgtgtagaaaccaagacgaacttgtgggtagggcacgagtaagtcaaggagcaggatggagcctcagagaaccggcgtgtctaggtaagtcctacgcacagatgtggcaacttatgtactttcatagaagagatctcagactagcggcaaatgcgatctgctccgctgttcctgtagactgggttccaacctcgcgaacaacttggtcaattcatgcacaccatcaatggatgacaacggaagacatgttatcagtatggaatagggtatggatagaggaaaatccatggatggaagataaaacccacataagcagttgggaggatgtaccttacttaggcaaacgagaagatcagtggtgcggctcactaattgggctgaccgcacgagccacttgggcaacaaacatccaagttgcaattaatcaagtgcgcagacttatcgggaacgagaattacctggattacatgaccagcatgaaacgatttaaaaatgaatcagatccagagggtgctctatggtaa

SEQ ID NO: 22073 - RNA, 9879 nt, synthetic construct
  misc_feature 1..9879: note = derived and/or modified CDS sequence (opt6) from DENV-1__KC762639__SS-prME
  source 1..9879: mol_type = other RNA
tcagtaacaatgctcttgatgctgactccaacggctcttgcatttcatctcactacgaggggaggggagccccacatgatcgtgagcaaacaggaaagaggaaagagcttgttatttaaaacatcggccggtgtaaatatgtgtacattaattgcaatggatttaggagaattatgcgaagatactttaacgtataaatgtccaagaataacagaggcagagccggatgatgttgattgctggtgtaatgcaactgacacgtgggttacctacggcacttgctcacaaaccggtgaacacagacgagacaaacgttcagtggcattagcgcctcacgttgggctgggtttagaaactcggacagaaacgtggatgtcgtcagaaggagcatggaaacagattcaaagagtagaaacatgggcattaagacatccaggttttactgtaattgcgctatttttagcccacgctattggaacaagtataacgcaaaaagggataatattcatactgttgatgcttgtaacgccaagcatggcaatgagatgtgttggaataggatcgagagatttcgtagaaggactaagcggcgctacatgggtcgatgttgtcctcgagcatgggtcctgtgtcacgacaatggctaaagacaaaccaactttagatatagaactgcttaaaacagaggtcacaaatcccgctgtcctcaggaaattgtgtatagaagcaaaaatttcaaacacaactacagactcacgctgtccaacccagggcgaagcaacgctagtggaagaacaagacgcaaatttcgtttgtcgacggactttcgtggacagaggttgggggaatggctgcggtctatttggtaaaggatcattaataacatgtgctaaatttaaatgcgtaaccaaattggaaggtaaaatagttcaatatgaaaatctgaaatattctgttatagttactgtacacacgggtgaccaacaccaagtgggcaatgaatctacggagcatggcactacggccaccataacacctcaagcaccaacaacagaaatacagttaacagattacggggctttaactttggattgttcacctagaacgggactggattttaacgaaatggtattactaacaatgaaagagaaatcttggttggtacataaacaatggtttctagatctccccttgccatggacaagtggcgcatccacctcacaagaaacatggaatcgacaagacctgctggtcactttcaaaactgcccatgccaagaaacaggaagttgtagtacttggaagccaagagggggctatgcatactgcgcttacaggtgcaacagagatacaaacctcaggtacaactactatatttgcaggacacttaaaatgtagactaaaaatggataagctaacactaaaaggcatgagttatgtaatgtgcacaggatcatttaaattagaaaaagaagtcgcggaaacccaacatggtactgtccttgtgcaaattaaatatgaaggaacggacgctccgtgcaaaatacctttttctacacaagatgagaaaggggttacacagaatggtcgcttgatcactgcaaatcccatagttacagataaagaaaaaccagtgaacattgaagctgaaccaccttttggagaaagttatatcgtcataggtgctggagaaaaggctttaaaactctcatggtttaagaaaggaagctcgataggaaaaatgttcgaagctacagcccgaggggcccgcagaatggcgatcctaggagatacggcatgggatttcgggagcataggtggcgtgtttacgtcagtcggtaaactcgtccatcagatttttgggacagcctacggggtcctattcagtggagtaagttggactatgaaaataggaataggagtactattaacctggctcggtttaaactcaagatctacaagtctgtcaatgacatgcattgctgtcggacttgtgacattatatctaggagtaatggtacaagccgacagtggatgtgtaataaactggaaaggaagggaattaaaatgtggaagcggtatctttgtaacaaatgaagtacatacttggacagagcagtacaaattccaagctgattctccgaaaagattgtcagctgcgatagggaaagcgtgggaggaaggagtatgcggtatcaggtcggcgacacggttggaaaatataatgtggaaacaaatatcaaacgaattaaatcatatacttctcgagaatgacatgaaatttacagtggttgtaggagatgtagctggaatccttgcgcagggtaagaaaatgatacgaccgcaaccaatggaacataaatattcttggaaaagctggggtaaagcaaaaataataggagctgatgttcagaacactacgtttataatcgacggaccaaatacaccagaatgtccggatgatcaacgagcatggaacatatgggaagtcgaagattacggatttggaatttttactactaacatttggttaaaacttcgagacagttatacacaggtctgtgatcatcgattaatgtcagctgcaatcaaagattcgagagcagttcacgctgacatgggatactggatagaatctgagaaaaacgaaacttggaaattggcacgggcaagtttcatagaagtaaaaacctgtgtatggcccaaatctcataccttatggtctaatggagttcttgaaagcgaaatgatcatacctaaaatatacggtggtccgatatcgcaacacaattatagaccagggtattttacgcaaacggcaggaccatggcatttgggaaaactagaattggactttgacctatgcgaaggaacgacggttgtagttgacgagcattgcggcaacagaggtccgtccctcagaactacaactgtcacaggcaaaattatacatgaatggtgttgtcggtcatgtacacttccacctttaagatttcgcggagaggacggctgttggtacgggatggaaataagacctgttaaagaaaaggaagagaatctggtaaaatcgatggtaagtgcaggaagtggagaagtagacagctttagtcttggactcctatgtataagcattatgatcgaggaagtaatgagatcccgttggagcagaaaaatgttaatgacaggaactttagcagtcttctttttgctaataatgggtcaactaacatggaatgatttaatacggctttgcataatggtaggcgctaacgccagcgatcgaatgggaatgggaactacgtaccttgcactaatggccacatttaaaatgcgtcctatgtttgctgtaggcttgctattccggcgcttgacttctcgcgaagttttgcttctcacgatcggcttatcgttggtagcaagtgtcgaattacctaacagtttagaagaacttggtgacggattggccatggggataatgatattgaaactcttaacagacttccaatcacatcaactttgggcgaccttattgtctttaacattcattaagacaactttcagtctacactacgcatggaagacaatggcaatggttctatctatagtctcactctttcctttgtgtttaagcaccacatcgcagaaaactacttggttacctgtattattaggctcacttggatgtaaacctttgacgatgtttctcatagcagagaataaaatatggggtcgaaaatcgtggccgctcaacgaaggcataatggcagtgggcatagtatcaatcctgctatcatcattgctgaaaaatgatgtacccctagcgggaccactaatagcaggagggatgcttattgcatgctacgtcatttcaggatcaagtgcagacttatccctagaaaaagcggctgaagtaagttgggaagaagaggctgaacattccggcgcgtctcacaacattcttgtcgaagtccaggacgatggaacaatgaagatcaaagatgaagaaagagacgatactttgactatattattaaaagcaaccttgttagcagtatcgggagtataccctttaagtatacccgcaacactcttcgtctggtacttctggcagaagaagaaacaacgaagcggagttctatgggatacaccctctccacccgaagttgaacgtgcagtattagacgatggaatctatagaataatgcaaagaggattacttggtagatcgcaagtgggagtaggagttttccaggaaaacgttttccataccatgtggcatgtaacaagaggagcggttttaatgtatcaggggaaaagactagaaccatcatgggcgagtgttaagaaagatctaataagttacggtggaggctggcggctacaaggctcttggaacacaggagaagaagtacaagtgatcgctgttgaacctggcaaaaacccaaagaatgtccaaacggcacctggcacttttaaaacacctgaaggggaagttggagcaatagccctagacttcaaaccagggaccagtggaagtccaatcgtaaatagagaagggaaaatagtgggactgtatggaaacggggtagtaacgacttcgggaacgtacgtttcagcaattgctcaggcgaaagcgtcacaggaaggacccttaccggaaatagaggatgaagtttttcgcaagcgtaatttgacaattatggacctgcatcccggatcaggaaagacaaggaggtacctccctgcgattgtaagagaagcgataaaacgtaaattaagaacccttattcttgcaccaactagagtggttgctagtgaaatggcggaggctttgaaaggcatgccaataaggtatcagacaacagcggttaagtctgagcacacgggaaaagaaatcgtagacttaatgtgccatgcgacatttacgatgcgtctattatcaccagttcgagttcctaactacaatatgatcatcatggatgaagcgcattttacagatccaagtagcatagcagcgagaggatatatttccacgagagtaggcatgggagaggctgccgccatattcatgacagccaccccaccaggttcagtagaagcattccctcaatctaatgcagtaatacaagatgaagaaagagacattcctgaacgctcatggaactctggatatgaatggataacagactttcctggcaaaactgtgtggtttgtaccctcaatcaaatccggcaatgacattgcaaattgtctaaggaaaaacgggaaacgagttattcagcttagtcggaagacttttgatacggagtatcagaaaaccaaaaacaacgactgggattatgtcgtcacaacagacatatctgaaatgggagcaaatttcagggccgatcgtgtaattgacccaagacgatgtctaaaacccgtaatattgaaggatggacctgaacgtgtaatactggcaggacctatgccagtaactgtagctagcgctgcgcaaagacgtggcagggtaggaaggaatcacaataaagaaggagaccaatacatttatatgggccaacctttaaataacgatgaagatcacgcacattggacagaggctaagatgcttttagataatataaatactccagagggtattataccggctctatttgaaccagaaagagagaaaagcgcagctatcgacggcgaatacagactccgaggagaagcgaggaagacttttgttgaattaatgcgtagaggggatctaccagtatggctatcctataaagttgcttcagaaggattccagtactccgaccgtcgatggtgttttgatggggaacgaaacaatcaagttttagaagaaaatatggacgtcgagatatggactaaagagggagaacgtaagaagttgagaccaagatggctcgacgcacgtacgtactcagacccgcttgcacttcgtgagttcaaagaatttgcggccggtagacgttctgtttcaggagatctaatcttagaaataggtaaactgccgcaacaccttacccagaaagctcaaaatgcattagacaatctcgttatgttacataatagtgaacagggcggacgtgcctacagacacgccatggaggaattacctgatactatagagacgttaatgcttctggccctaatcgcagtactaacaggaggggtaacgttattctttctcagtgggcgtggtctaggtaagacctcgataggactactttgtgtcatggccagcagcgtactgttgtggatggcaagcgtagagccccactggattgcagccagtatcatcttagagttctttctgatggtactactaataccagaaccagacagacaacgtacaccgcaagacaatcagctggcttatgtcgttatcgggctgttgtttatgatcctaacggtagcagccaacgaaatgggactactcgaaaccactaagaaagacctaggtattgggcacgttgcggtagaaaaccatcatcacgctgctatgctcgatgttgaccttcatcccgccagcgcatggaccctgtatgcagtcgcaacaacgataattactcctatgatgaggcatactatagaaaacacgacagcgaacatctctctaacagcaattgctaaccaggctgctatcctaatgggcctagacaaggggtggcctatatcaaaaatggacatcggtgtcccattattggctttaggttgctacagccaagtaaatccgttgacactaaccgctgctgttttaatgcttgtagctcattatgccataatagggccgggattacaggcaaaagctactagagaagctcagaagcgaacggctgctggaattatgaaaaatccaacggtggacggaattgttgcaatagatttagatccagtggtatatgatgcaaagtttgaaaaacaactaggtcagatcatgttactaatactatgtacatctcaaatacttcttatgagaactacttgggcattatgtgagtctattactttagcaacaggacctttaacaactctctgggaagggtcgccaggaaaattttggaatacaacaattgccgtcagcatggccaacatatttcggggatcttatctggctggtgctggactagcatttagtctaatgaaatctcttgggggtggacggcgaggtaccggtgctcagggggaaacactaggtgaaaaatggaaacgccagctaaatcagctatcaaaatcagaatttaatacgtataagcgttctgggattatggaagttgatcgatccgaagccaaagaaggactgaaacgtggtgagacaacgaaacacgctgttagtagggggaccgcgaaattgcgatggtttgttgaaaggaacttagtaaaacctgagggtaaagttattgatcttggttgtggtagagggggttggagctattattgcgcaggtctaaagaaagtcacggaagtcaaaggctacacaaagggtggtccaggtcacgaagaacctatacctatggccacttacggatggaatctagtaaaattacatagcgggaaagacgtattctttatccctccggagaaatgcgatactttactttgtgatataggagaaagctctcctaaccctacaattgaagaaggaagaaccctcagagtattaaaaatggtcgagccctggctaagaggcaatcaattttgtataaaggtactcaatccctatatgcctagcgtggtggagaccttagagcaaatgcaaaggaaacatggaggtatgctagtcagaaacccattatcacgtaactcgacccatgaaatgtattgggtatcatgtggaacagggaatatcgtatcagcagtcaatatgacgagtcgaatgttactgaaccgattcactatggcccataggaaaccaacatacgaaagagacgtcgatctaggagcaggaacgcgacacgtagctgtagaacctgaagtagcgaatcttgacatcataggacaacgaattgaaaatataaaacacgagcataaatctacatggcattacgacgaagacaatccatataaaacttgggcttatcatggaagttatgaagtaaaaccatccggttccgcctcatccatggttaatggagtagtaaagttgttaacaaagccttgggatgtcatacccatggtgacacagattgcaatgactgatacgaccccgtttggacagcagcgagtatttaaagaaaaagtggataccagaacaccgaaggcgaaaagaggcacgacccaaattatggaggtaacggcaagatggttatggggatttctaagtagaaacaagaaaccccgaatttgcactagggaagaatttacaagaaaagtaaggtcgaacgcagctataggagcagtgttcgtagacgagaaccaatggaacagcgcgaaagaagccgtagaagacgaaagattttgggatctcgtccacagggaaagggaattacataagcaaggtaagtgtgcaacatgtgtatacaacatgatgggtaagcgggagaaaaagctaggcgagtttggaaaagccaagggtagtcgcgctatatggtacatgtggttgggagctaggtttctcgagttcgaagccttaggattcatgaatgaggaccattggttctcgagagagaatagcctttcgggagtagaaggagaagggcttcacaaattgggatacattttgagagatataagcaaaatcccaggaggtaatatgtatgctgatgatactgccggttgggatacacgaatcacagaggacgatttacaaaatgaagctaaaataaccgatattatggagccagaacacgcacttctggctaaggcaatatttaagctcacctaccaaaacaaagtcgtccgggtacaacgaccagccaaaaacggaacggttatggatgtaataagccgacgcgatcaacgaggtagcggacaagttggaacatatggtctaaatacgttcacaaacatggaagcacaattgataagacaaatggagagtgagggcatattttccccatctgaattagagacgcccaaccttgcagaacgagtgttagattggctagagaagtatggagttgagagactaaagcgtatggcaataagcggtgatgattgtgtagtgaaaccgatagatgatcgcttcgcaacagctctgacagccttgaatgacatgggcaaggtaagaaaagatataccacaatgggaaccatcaaaaggctggaatgattggcaacaagtccctttctgtagtcatcatttccaccaattaattatgaaagacggacgagaaattgtcgtaccatgccggaaccaagacgagctagtaggtagggcccgggtgtctcaaggggctggatggtcgctccgagaaacagcgtgcttaggaaaaagttatgctcaaatgtggcaactaatgtacttccaccgtagagatctgagattagcagcaaatgcgatttgtagtgccgtgccagtagactgggtaccaacgagccggacaacatggtccattcatgcgcatcatcaatggatgactaccgaagatatgttgagtgtttggaatcgggtatggatagaagaaaatccatggatggaagataaaacccacatcagttcatgggaggatgtaccgtatttgggaaaaagagaagatcaatggtgtggcagtctaataggtctgacggcgcgagcaacatgggcaacgaatatacaagtagctataaatcaagtgcgccgcttaataggaaacgagaattatctcgattatatgaccagcatgaaaagatttaaaaacgagtcagatccagagggagcactgtggtaa

SEQ ID NO: 22074 - RNA, 9879 nt, synthetic construct
  misc_feature 1..9879: note = derived and/or modified CDS sequence (opt6) from DENV-1__KC762642__SS-prME
  source 1..9879: mol_type = other RNA
agtgttacaatgctacttatgttgatgccaacagcacttgcgtttcacttaacaacaaggggtggggaaccacatatgattgtctcgaaacaagaacgaggaaaatcattgctgttcaaaacaagcgcgggtgtaaacatgtgtacacttatagcaatggacctcggggaattgtgtgaagataccttaacatataaatgtcctcgaataactgaagcagaaccagatgatgtcgattgctggtgtaacgcaacagacacttgggtaacatacggaacttgcagccaaactggagaacataggcgtgacaaacgtagtgttgcacttgcaccacacgttggactcggactagaaacaagaacggagacttggatgagcagtgaaggtgcatggaaacaaatccaaagagtagaaacttgggctctcagacatccaggatttaccgtgatagctctcttcctagcacacgcaataggaacatccattacacaaaagggtataattttcatattgttaatgttagtaacgccttctatggcaatgagatgtgtaggaattggatcgagagatttcgttgagggtctatctggagcaacgtgggtcgacgttgtacttgaacatggttcatgtgtcaccactatggcgaaagacaaaccgacacttgatatagaacttctcaaaactgaagtaaccaatccggcagttttacgaaaactttgtatagaagcaaaaataagcaacactactacggattcgcggtgcccaacacaaggagaagctacactggtagaggaacaggatgccaacttcgtctgcagaagaactttcgtagacagaggatggggaaatggctgcggactttttggtaaaggaagcctcataacatgtgctaaatttaagtgtgtcacaaagctggaaggaaaaatagtacaatatgagaacctcaaatattccgtaattgtaactgttcacacaggcgaccagcatcaagtgggtaatgaatctacagagcacggcacgacagcaaccataacacctcaagccccaactactgaaatacaattgaccgattatggtgcgttaacgttggattgttcaccgagaaccgggttagacttcaatgaaatggtacttttaactatgaaagagaaaagctggttagtccacaaacaatggttcttagacctaccgctaccatggacttcaggtgcatcaacaactcaagaaacatggaatcgacaggatcttctggttacgttcaaaacagcacacgctaagaaacaagaagttgtcgttctagggtcccaagaaggcgccatgcatacagctttaaccggagcaaccgaaatacagacgtctgggactactacaatatttgcaggacacttaaaatgccgcctcaaaatggataaacttacattgaaaggcatgtcatacgtaatgtgcacaggatcgttcaaacttgagaaagaagtagccgagacgcaacatggtacggtattggtccagatcaaatacgaaggtactgacgctccctgcaagattcctttctctacacaggatgaaaagggagtgacacaaaatggtagattaataaccgcaaacccaatagttaccgacaaggaaaaaccggttaatatagaagccgagcctcccttcggtgaaagttatattgttattggtgccggtgaaaaagcattaaaactaagctggtttaagaaaggttcttcaatcggaaaaatgttcgaagccactgcacgcggcgcacgcaggatggcgattctaggcgatacagcttgggatttcggatccattggaggggtatttacctcagtaggaaagttagtacaccagattttcggaacagcatatggcgtcctcttcagtggggtcagttggactatgaagataggcattggtgttctacttacttggttaggtctcaactctagatctaccagtctttccatgacctgtatcgcagtcggcctagtcaccctgtaccttggagtaatggtccaagccgattctggttgtgttataaactggaaaggtagagagttaaaatgcggatcgggaatatttgttaccaatgaagtacacacatggactgaacagtataaatttcaagccgatagtccgaaaagattgtctgcagctattggaaaagcatgggaggaaggagtatgtggaataagatcggcaacaagattggagaacattatgtggaaacaaatatccaacgaacttaatcatatattactggaaaatgacatgaaatttacagttgttgtaggggacgtagcgggcattttagcacagggtaagaaaatgatacgaccccaaccaatggaacataaatactcttggaaaagctggggtaaagcaaaaataatcggtgccgatgtacaaaacactaccttcattatcgacggcccaaatacacctgaatgcccggacgaccagcgagcctggaatatatgggaagtagaagattatggattcgggattttcacaaccaatatatggctaaaattacgtgattcgtatacccaagtctgcgatcaccggctaatgagtgcagctattaaagacagcaaagcagtacacgcagacatgggatattggatagaatctgagaaaaatgagacatggaaattggcgagggcaagttttatagaagtaaaaacttgtatatggccaaagtcccacaccttatggtcaaacggtgtactggaaagtgaaatgatcattccaaaaatatacggaggaccaatatcgcaacacaactacagaccaggatattttacacaaactgccggaccatggcacctaggcaagttagaattagattttgatctctgcgaaggaactacagtcgtggttgatgaacactgcggtaatagaggcccctcacttcgtacaacaactgtcacgggcaagataattcacgaatggtgctgcagaagttgcacgctaccaccactgagatttagaggtgaagatggatgttggtatggaatggaaattaggccggttaaagaaaaagaggaaaatcttgtaaaatctatggtaagcgccggttctggggaagtcgattcatttagtctcgggttgctgtgcatctctataatgatagaagaagtcatgcgatcacgatggtccagaaagatgttaataacaggaacattagctgtattcttcttactcataatgggccaagtaacatggaatgacctaacaaggctatgtattatggtcggagccaacgcatctgataggatgggcatgggtactacatatttagccttaatggctacatttaaaatgcgccctatgtttgcagtgggtctgctatttcgaagattaacctctcgagaagttttacttctaacgatagggttgtctttagtagcatctgtggaattaccaaatagtcttgaagaactcggcgatggcttagcgatggggataatgattctaaaacttttaactgattttcaatcccatcaactatgggctacactcttgagtttaacatttataaagaccacattcagtctacattatgcttggaaaactatggcaatggttctatcaatagtaagtctgttccccttgtgtttaagtactacatcccagaaaacgacttggttacctgtgttactcgggtctttgggatgcaagcctctcacaatgtttctgattgcagaaaacaaaatctggggtagaaaatcatggccacttaatgaaggaattatggcagttggaattgttagtatcctgctatcttctttgcttaagaacgatgttccactagccggcccattgattgcgggtggcatgcttatagcttgttacgtaatatctggaagttcagctgacttgtctttggagaaagcggccgaagtaagttgggaggaagaagcagaacactcgggagcatcgcacaacattcttgttgaggtacaggatgacgggactatgaagataaaggatgaagagagagacgatactcttactatactattaaaagcaacactgctcgctgtgtcgggcgtttatcctcttagcatcccagctaccctgttcgtctggtatttttggcagaaaaagaaacaacggtcaggagttttatgggatacaccatctcctcccgaagttgaacgagccgtcttagacgatggaatatatcggataatgcaaagaggtttgttaggccgatctcaggtcggagtaggtgttttccaagaaaatgtatttcatactatgtggcacgtaacaagaggggctgtgttgatgtaccagggaaaaaggctcgagccaagttgggcatcagtcaagaaagatttaataagttatggaggtggctggaggttgcaaggcagctggaatacaggcgaagaagtacaagttatagctgtagaaccaggcaaaaatcccaaaaacgtacagaccgcaccaggaacttttaaaactcctgaaggtgaagttggagcaattgcgttggattttaaacccggtacgagtggttcacctattgtaaacagggaaggaaaaatagtagggttgtacggtaatggagtagttacaacttcaggcacttatgttagtgcaatagcacaggcaaaagcatcgcaagaaggtcctcttcctgaaatcgaggatgaagtatttagaaaaaggaatctcacaatcatggacttacatccaggaagcggaaaaacaagaagatacttacctgccattgtcagagaggccataaagagaaaactacggacgcttatacttgcgccaacacgcgtggtagcgtccgaaatggcagaagcacttaagggtatgccgatacgctaccagacgaccgcagtcaaaagtgaacacactggaagagaaatcgtggatctaatgtgccacgcgacctttactatgaggctactttcgccagtaagggtccctaactataacatgataataatggatgaggcgcactttacagatccatcatcaattgcagcccgaggttatatttcaacgcgtgtcggaatgggggaagcagcagcaatatttatgacagccacaccacccggaagtgtcgaagcgttcccacagagtaacgccgtaatacaagacgaggaaagggacatccctgaaagatcatggaactccggatacgaatggattaccgacttcccaggtaagaccgtgtggttcgtaccttcaataaagtctggtaatgatatcgccaattgcctaaggaaaaatggaaaaagagtaatacaattatcaagaaagacttttgacacggaataccaaaagaccaaaaacaacgattgggattatgttgtaacaacagatatatcagagatgggtgcgaactttagagctgatagggtgattgatccaagacggtgtttaaaaccagtaatattaaaagatggtcctgaacgagtaattctggcaggaccaatgcctgtaacagttgcttcagctgctcaacgaagaggtcgtataggcagaaaccacaataaagaaggtgatcaatacatatatatgggacaaccattaaataatgatgaagaccacgcacactggacggaagcaaagatgctactagacaatatcaataccccagaaggtataattccagcattatttgagcccgagcgcgagaaaagtgcagctatagacggtgagtatagattgagaggagaagcgcgaaaaacttttgtagagctcatgcggagaggagatctaccagtctggctgtcttataaagtagcatctgaaggtttccaatattccgatcgacgatggtgcttcgatggagaaagaaacaatcaagttctcgaagaaaatatggatgtggagatatggaccaaagaaggcgaacgcaagaaattacggccaaggtggttagatgcccgaacatactctgatccactggcactccgagaatttaaagagttcgcggcgggccgtcgctctgtatcaggtgacttgattttggagattggaaagctccctcaacatttaacccaacgcgcccagaatgcattggataatcttgttatgttacacaactcggaacaaggagggagagcataccgccacgctatggaagaacttccagacacgatcgaaactctgatgctacttgcgttgattgccgtattaacaggaggtgttacactattctttttaagcggccgggggcttggaaagacctcgatagggcttctatgcgttatggctagcagtgttctcctctggatggcaagcgtagaaccacactggatagctgcatcaatcatattagaatttttcttgatggtactactaataccggaaccagatcgacaaagaactccgcaagataatcaactagcgtatgtagtcatcggcctcctgttcatgatactcaccgttgccgctaatgaaatgggcttattagaaactactaagaaagatctgggaatagggcacgtcgctgtggaaaaccatcatcatgcggccatgctagatgtagacttacaccctgcatcagcctggactctgtatgctgttgcaactacaataataacgccgatgatgagacatactattgaaaatacaactgcgaatatatccctaacagcaatagcgaaccaggcagctatactaatgggactagacaaaggctggccgatcagcaagatggatattggcgttccccttcttgcattgggctgctattctcaagtaaatcctctaacactcacggccgctgtactcatgttggtagcgcactacgcgatcattggaccaggactacaagcaaaggctacaagagaggctcagaaaagaactgcagctggaatcatgaaaaatcccacggtcgacgggatagtagcaatagacctagatccagtcgtatacgatgctaaatttgaaaaacaactcggtcaaataatgttattaattctgtgtaccagtcaaatcctactgatgcgaactacgtgggctctttgcgaatcaattacactggctacaggaccgctaacaaccctctgggaaggtagcccagggaaattctggaatactactatagctgtatcgatggccaacatatttagagggagttacctagcaggggcaggtttagccttttctttaatgaaatcactcggtggaggaagacgtggaaccggggcacaaggtgaaacattgggggaaaagtggaaaagacaactaaatcagctctcaaaatcggaatttaatacatataagagatctggaattatggaagttgatcgatcagaagccaaagaagggttaaaaagaggagaaacgaccaaacatgctgtcagcagaggtacagcgaaactaagatggtttgtggaacgaaacttggtcaaacctgaagggaaagtcatagatttaggatgtggtcgtggaggttggagttactattgcgcaggtctaaagaaagtcactgaagtcaaaggatacactaaagggggtcctggacacgaagaacctatacctatggctacctacgggtggaatctcgtaaagctgcattccggaaaggatgttttctttataccgcctgagaaatgtgacacattgctctgtgatatcggggaatcctcacccaatccaaccatagaagaagggcgaacattaagagtacttaaaatggtagaaccatggttacgtggcaaccaattctgtatcaaaatacttaatccctacatgccatcagtggtggagacgttagaacagatgcaaaggaaacatggcggaatgctggtaaggaatcccctgtcgagaaacagcacgcatgaaatgtattgggtttcttgtggaacaggaaacattgttagcgcggtaaacatgacgagtagaatgttacttaaccgatttactatggcccacagaaaaccaacctacgaacgcgatgttgacctcggagcagggactaggcatgtcgccgtcgagcccgaagtagctaaccttgacatcataggccaacgaatcgaaaatataaaatacgaacacaaatccacctggcattatgacgaagataatccatacaaaacctgggcatatcatgggagttacgaagtgaaaccaagtggaagcgcgagctcaatggtgaatggagtagtgaaacttcttacgaaaccctgggatgtaataccaatggttacacaaatagccatgaccgatacgacacccttcggtcaacaacgtgtttttaaggagaaggtcgatacgagaacacccaaagcgaaaagaggtacggctcagataatggaagtaaccgccagatggctttggggattccttagcagaaataagaaaccaagaatctgtactagggaagagttcacgcgaaaggtacggtccaatgcagctattggtgcagtattcgttgacgaaaaccagtggaacagcgcaaaggaagctgtggaagacgaacgcttttgggacctcgtacaccgggaaagagaattgcacaaacaaggtaaatgtgcaacttgtgtatataatatgatgggaaaacgcgaaaagaaacttggggagttcggtaaggcaaaaggaagtagagcaatttggtatatgtggcttggtgcgagatttttagaatttgaagcactgggtttcatgaatgaagaccattggttctctcgagaaaattctttgtcaggtgttgaaggtgaaggcttacataagttaggatatatcttgagagatataagcaaaataccaggcgggaatatgtatgccgatgacacagccggatgggatacgaggatcactgaagacgacttacaaaatgaagctaaaataacagatattatggaacctgagcacgcacttttagccaaggctgtgtttaaactcacgtatcaaaataaagtggtacgcgtacaacgccctgccaaaaatggcactgtaatggatgtaatatccagaagagatcaaagaggatcaggacaagtaggtacgtacgggttaaatacatttactaacatggaagcacaattaataagacagatggagtcagaggggatattctcgccctcagagttagaaaccccgaacttagcagagcgcgtcttgtactggctagaaaagtatggagttgagaggttaaaaaggatggcaatttcaggagatgattgtgtagttaaacctattgacgatcgtttcgcaacggccctgacagctttaaacgatatggggaaagtcagaaaagacatacctcagtgggagccaagcaaaggttggaatgattggcaacaagttccattctgctctcaccattttcaccaattgattatgaaagatgggcgagagatagtagtaccttgcagaaatcaggacgaattggtgggacgggcgagggtctctcaaggagcaggttggtcactccgggaaacggcatgcttaggaaaatcatatgctcagatgtggcaactaatgtatttccatcgcagggatctaaggctagctgcaaatgcgatatgttctgcagtcccagttgattgggttccaaccagccggaccacctggtcaattcacgcccaccaccaatggatgaccacagaagacatgctatctgtatggaatagagtatggatcgaagaaaatccctggatggaagataagactcatatcagttcatgggaagatgtaccctatttgggcaaaagagaggatcaatggtgtggctcattaattggtctaacggcaagagcaacttgggctaccaacatacaggttgccattaaccaagttcgaagattgattggtaacgagaactatctagattatatgacttcaatgaagaggtttaagaatgagagtgatccagagggtgctttgtggtaa

SEQ ID NO: 22075 - RNA, 9879 nt, synthetic construct
  misc_feature 1..9879: note = derived and/or modified CDS sequence (opt6) from DENV-1__JQ915077__SS-prME
  source 1..9879: mol_type = other RNA
tccgttacaatgctactgatgttacttcctactgtactaactttccatttaacaacacgtggaggagaaccccatatgattgtgtcgaaacaagaacgaggaaaatccttactattcaaaacgagtgccggtgtgaatatgtgtacgttaatagcaatggacttgggggaattatgtgatgatacaatgacctacaaatgccctcgaataacagaaacagaacctgacgatgtagactgctggtgtaacgcgactgaaacgtgggtcacatatggaacatgtagccaaacgggtgaacaccgtcgtgataaacgaagcgtcgcgctagctccccatgtgggacttggtcttgaaactcgcaccgaaacgtggatgagctcagaaggggcatggaggcaaatccaaaaagtagaaacatgggcattgaggcatccaggattcacagtaattgcattatttctagctcatgctatcgggacctcaataacccagaaaggaataatcttcattctattaatgttagtcactccttcgatggcgatgagatgcgtaggaataggaaacagggattttgttgaaggtctatcgggggcaacctgggtagatgttgtcttggaacacggctcttgtgtaacaacaatggcaaaagacaaaccaaccctggatatagaactgcttaaaaccgaagttacaaacccagcagtattaaggaaactatgcatagaagccaaaatctcgaatacaacaaccgatagcagatgccctactcaaggagaagcaactctagttgaagaacaagacaccaacttcgtgtgtcgaagaacgttcgtggacagaggatggggtaacggttgtggactatttggcaaaggaagtctaatcacgtgcgctaaattcaagtgtgtaacgaaacttgaaggaaaaatagtgcaatatgaaaatttgaagtacagtgttattgttacggtacatactggagaccaacaccaagtaggcaatgaaaccactgaacatgggactatagcgactataacaccgcaagcgcctacttctgaaattcagctaacagattatggagcacttacacttgattgctctccaaggaccggactggacttcaatgaaatggttttattaactatgaaagaaaaatcatggctagtacataaacaatggttcctagatctacccctaccatggacaagcggcgcatctacaagtcaagaaacatggaatagacaagacctcttagtcacattcaaaacagcacatgcgaaaaagcaggaagtggttgtcctaggaagccaggaaggggcaatgcacactgcattaacgggagcaaccgaaattcaaacaagtggcacaacgacaatattcgctggacacttaaaatgcagactaaaaatggataaattaacactgaaaggaatatcgtatgtaatgtgcactgggagtttcaagttggagaaagaagtagctgaaacacagcacggcactgttttagtacaagttaaatacgaaggcaccgacgcaccttgcaagatcccattctcttctcaagatgaaaaaggcgtcacgcagaatggaagattggtcacagcaaatccaatagtgacggataaagagaaaccagtgaatattgaagcagagcctccattcggtgaaagttacatagtagtaggggcgggtgagaaagcacttaaactatcgtggttcaagaaaggatcttccattggtaaaatgtttgaggcaacagctagaggagccagacggatggccatactaggagatacggcctgggactttggatccatagggggtgtattcacaagtgtaggcaaacttgttcatcaaatcttcggtactgcatacggtgttttgttttcaggagtatcttggacgatgaaaattggtatagggattctcttgacatggttaggtttgaacagccgctcaacttcgctaagtatgacttgtatcgctgtgggcatggtaaccctatacttaggcgtcatggttcaagcagactcaggatgcgttataaattggaaaggtagagaattaaagtgtgggtccggcatttttgttacaaatgaagtccatacatggacagaacaatacaagtttcaagccgattctccaaaaaggctaagtgccgcaatcgggaaagcatgggaggaaggtgtttgcggaatcagaagcgcaacaagattagaaaatattatgtggaaacaaatctcaaatgaattgaatcatatactcttagaaaacgatatgaaattcaccgtagtcgtaggcgatgtctccggaatactcgctcaaggaaagaaaacgataagacctcaacctatggaacacaaatacagttggaaatcatggggaaaagccaaaatcatcggggctgatgttcaaaatactaccttcattattgatggcccgaatacgccagagtgtcctgatgaccaacgtgcctggaacatatgggaagtggaagattatggatttggaatattcactacaaacatatggctaaaacttagagattcttacacccaggtgtgcgaccacagactcatgtcagctgcaataaaggattcaaaagctgttcacgccgacatgggctattggatcgaatcagagaaaaacgaaacatggaaattagcgagagcaagttttatagaagtaaaaacatgtgtgtggccaaaaagtcacaccctatggtcaaacggggtccttgagtcagaaatgatcattccgaagatttatggcggtccaatttcacagcacaactacagaccaggttattttacacaaacagctgggccgtggcatctaggtaagttagaattagatttcgacctatgcgagggcacaacggtagtcgtggatgagcattgtggaaatagaggaccctctttaagaactacgacagtcacgggtaagataatccatgagtggtgttgtcgctcttgcactttaccgcccttgcgatttaagggtgaggatggatgctggtacggaatggaaattagaccggtaaaagaaaaagaagaaaatttggtaaaaagcatggttagtgctgggagtggagaagttgattctttttctctaggtctgttatgcatcagcataatgatagaggaagtaatgcgttccaggtggtcaaggaagatgctgatgacaggaacattagtagtgtttttgttgctcacgctagggcaactaacatggaacgatctcataaggctatgtattatggtaggagccaacgctagtgataacatgggtatgggcactacatatctagcccttatggctacgtttcggatgcgaccgatgttcgcagttggactcctctttcgtagattaacaagtcgtgaagtcttattactaactgtcggacttagtcttgtggccagtgtagagctaccaaactccctggatgaactaggcgacggtctagctatgggaataatgatcttgaaactacttactgattttcagtcgcaccaactctgggcgattctactaagtttaacttttgttaaaaccacattatccttacattatgcgtggaaaacaatggctatgatcctatcaattgttagtctcttgcctttatgtctcagcacaacatctcagaagacaacctggttgcccgtgctcttgggttcgctagggtgcaaaccattaaccatgtttttaattaccgaaaataaaatatgggggagaaagtcatggccgttaaatgaaggaataatggctgtaggaatagtatcaatcttactttcatctttgctaaagaatgacgtaccattagccggacccctaatcgcgggtggaatgcttatagcatgttatgtcattagcggatcctctgcggacttatcattagaaaaagcagcaaaagtgagctgggaagaagaagctgagcacagcggtgctagtcacaacatattggtagaaattcaggacgacgggaccatgaagataaaagacgaggagcgtgatgacactataaccattcttttaaaagcaacccttctagcgatttcaggagtataccccatgagtattcccgctactcttttcgtatggcatttctggcagaagaagaaacaaaggtcaggagtattatgggatacaccttcaccaccagaagtcgaaaaggcagttttagatgacggaatatatagaatacttcaaagaggtttgctaggtagatcccaagttggtgtaggagtatttcaagaaggcgtgttccatacgatgtggcacgtaacaagaggagcagtactaatgtaccaaggaaaacgattagagccgagttgggcatcagttaaaaaggacctaatttcttacggaggaggatggcggtttcaaggatcttggaatacaggagaagaggttcaagtgatagctgtcgaaccaggcaaaaatccaaagaatgtccaaacagcacccggcacatttaagacgtcagagggtgaagtaggggcaatagcgttagattttaaacccgggacatcaggaagcccaattgttaatagggaggggaaaattgttggactttacggaaatggtgtcgtcacaacttcagggacatatgtgtccgcgatcgcgcaagccaaagctagccaggagggaccattaccagaaatagaagatgaagtatttcgcaagagaaacttaacaatcatggatttacatccagggtcaggcaaaacaaggcgctatcttcctgcaatagttagagaagcaataaaaagaaaactacgaactttagtattagcaccgacaagagtagtggcatcagaaatggctgaggctttgaaaggtatgcccataagatatcaaacaacagcagtgaagtctgagcacacaggtaaagaaatcgtcgatttgatgtgtcacgcgacatttactatgagactattatcacctgtacgagttccaaattataatatgattataatggatgaagcacactttacggatcctgcttccatcgcagcgagaggctatatatctacccgagttgggatgggagaagcggcagcaatatttatgaccgcaacaccacctggcagcgtagaagcatttccgcaatcaaacgcagtaattcaagatgaagagaaggatataccggagcggtcatggaacagtggctacgattggattacggactttcccggaaaaacagtatggttcgtaccatcaataaaaagcgggaacgacatagcgaactgtcttcgtaagaacggaaaacgtgtcattcagttaagccgtaaaacattcgatacagagtatcagaagactaaaaacaacgactgggactacgtagttacaaccgacatcagtgagatgggtgctaattttagggctgatagagtaatagatcctcgaaggtgtctaaagcccgtcattcttaaggatggcccagaacgagtaattcttgctggtcccatgcccgtcacagttgcttcagcagcacaaagacgaggcagaatagggcggaatcaaaataaggaaggtgatcaatacatctatatggggcaaccattaaataacgacgaagatcatgctcactggactgaagcaaaaatgttattggacaacataaatacaccagaaggaattataccagcattatttgaacccgagagagagaaaagtgcggcaatagatggagaatatagattaagaggagaagccagaaaaacctttgtcgagctaatgaggagaggggatcttccagtatggctaagctacaaagttgcatctgaaggatttcaatatagcgacaggaggtggtgttttgatggagaacgaaacaatcaagtgttagaggaaaacatggatgtagaaatttggacaaaagaaggagaacgtaagaaactaagaccgagatggctagatgcacgaacgtacagtgatcctttagccttacgtgagttcaaagagttcgccgcagggagacgaagtgtaagtggagacttaatacttgaaattggtaaattaccgcagcacttgacacaaagagcacagaacgctctagataatctcgtaatgttacataattctgagcaaggaggaaaagcctataggcatgctatggaagaattaccagacactattgaaacaattatgctattagctcttattgcggttttgaccggaggtgtgacactattctttctttctggacgtggtctcggaaaaacgtctattgggttactctgcgtaacatcaagtagcgtccttctatggatggcatctgtggaacctcactggatagcagcgtctataatattagagttcttcttgatggttcttctaatcccagaaccagaccgtcaacgtacaccacaagataatcaactcgcctacgtagtaatcgggttattattcatgatattgactgttgccgccaatgaaatgggattgttagaaacaaccaagaaagacttgggaataggtcacgcagctgcagaaaaccatcatcatgcagcaatgttggacgtagaccttcacccggcatccgcatggacattgtacgctgtcgccacgactataataacgcctatgatgaggcatacgatagaaaacaccactgcgaatatttcactcacagcaattgctaaccaagctgccatattaatgggactagataaaggatggccaataagcaaaatggacataggcgtaccactcctggcactcggttgttattctcaagtaaatccattaacgctcacagctgccgtgctcatgctggtagctcactatgcgataataggacctgggctacaagccaaagcaactagggaggcccaaaagagaacagcagcagggataatgaaaaatccaacggtggatggaattgttgctatagatcttgatccagtagtgtacgacgcaaagtttgaaaagcaattgggccaaattatgcttcttatactgtgtacgtcgcagatcctgctaatgcgcactacgtgggcactttgcgagagcatcacactagctactgggccgttaaccactctatgggaaggctctccaggcaagttctggaacacgacgatagccgtgtctatggcaaatattttcaggggatcttatctagctggggcaggtttggcttttagtttgatgaaaagcctagggggcggtcgcagaggcacaggtgcgcagggagaaaccctgggcgaaaagtggaaaagacaactaaatcaactgagtaaaagtgaatttaacacttataaacgctcgggcattatagaagtggatagaagcgaagcaaaagagggtttgaaaagaggtgaaaccactaagcatgcagtatcccgcgggactgcaaaactaagatggtttgtagaaagaaatttagttaagccagaagggaaggtgatagatctaggctgcggtagaggtggttggagctactactgtgcaggtctaaagaaagtgacagaagtcaaaggttacaccaaaggaggtcctggacacgaagaaccaattcctatggcaacttacggttggaacctagtcaagctacactctggaaaagatgtgttcttcatcccgccagagaaatgcgacaccctattatgtgatatcggagaatcctcacccaaccccacaatagaagaagggcgaacgctacgtgtacttaaaatggttgaaccatggctaagagggaatcaattctgtataaaaatacttaatccctacatgccttcggtagtagagacactggagcaaatgcaaagaaaacatggtggaatgctagtacgcaatcccttatctagaaattccacacatgagatgtattgggtctcatgcggtactggcaatatagtgtctgcggtgaacatgacttcgaggatgctgctaaatcgttttacaatggcacatagaaagccgacttatgaacgcgacgttgacctaggagcgggtacacgacatgtcgcagtagagccagaggttgccaatctagatataattggacaaagaattgaaaacatcaaaaacgaacataaatcaacatggcattatgacgaagataatccctacaaaacatgggcataccatggtagttatgaggtgaaaccaagcggttcagcatcaagtatggtcaacggagtagtacgtcttctgactaaaccgtgggacgttatacctatggttacgcagatagccatgactgatactacaccattcgggcaacaaagagtcttcaaagaaaaagtcgacacgagaactcccaaagcgaaacgtggcacagcgcaaatcatggaagtcaccgctaaatggctttggggattcctatcacgaaacaagaaaccccgaatctgtacccgtgaagaatttacaagaaaagtaaggtcaaacgctgcaataggcgccgtatttgttgacgaaaaccaatggaactctgcaaaagaggcagtagaggacgaaagattctgggaccttgttagacgagaacgagaattacataagcagggcaaatgcgccacatgtgtatacaacatgatgggaaaaagagagaagaaattaggcgagttcggaaaagcaaaaggttcgagagctatctggtacatgtggttaggcgctagatttctcgaatttgaagcattggggttcatgaacgaagatcactggttcagccgagaaaattcgctatccggagtagaaggagaaggtctacataaattggggtatatattgcgagacatatcgaagatacctggagggaatatgtatgctgatgacacagcgggctgggatactagaatcacggaagatgatttacaaaacgaagcgaaaataactgatataatggaacccgaacatgcgttgctcgctacaagcatatttaaactaacgtatcaaaacaaagtagttagagtgcagaggcccgctaaaaatggcacagtcatggacgtcatttcaagaagagaccagcgagggtctggacaagtcggtacttacggcctaaatacatttacaaatatggaagcccaattaatacggcaaatggaaagtgaaggaattttctcaccatccgaactcgaaaccccaaatttagctggcagagtcctcgactggcttgagaagcatgggaccgagcgtctaagaagaatggctatatctggggatgattgtgtagtgaagcccattgacgacagattcgcgacagcgcttactgcactaaatgatatgggcaaagtaagaaaagatattccacaatgggaaccatcaaagggttggaacgattggcaacaagtacctttttgctcccatcattttcatcaattaataatgaaagatggaagggagatcgtggtcccgtgtagaaaccaggatgaactggtcggtagggcgcgagtctctcaaggcgcggggtggtcattacgtgaaaccgcctgtttggggaaaagttacgcacaaatgtggcaattgatgtattttcataggagggacctacgattagcagccaatgctatttgtagcgctgtacccgtcgattgggttccgacaagtcgcactacatggtccattcacgcgcatcaccagtggatgacaactgaagatatgctatcagtctggaatagggtgtggatagaagaaaatccatggatggaagataaaacgcacgtaagttcatgggaggatgtaccataccttggtaaaagggaggaccaatggtgtggaagtctaataggcctcacggcacgtgcaacgtgggcaactaacatacaagtagcaataaatcaggtgagaagactgataggaaatgaaaattatctggattatatgacaagtatgaagagatttaaaaatgagtccgaccctgaaggcgccctatggtga

SEQ ID NO: 22076 - RNA, 9879 nt, synthetic construct
  misc_feature 1..9879: note = derived and/or modified CDS sequence (opt6) from DENV-1__JQ915079__SS-prME
  source 1..9879: mol_type = other RNA
agcgtgacaatgttacttatgttgcttcctacagtactaacatttcacctaacaacgcggggtggagaacctcatatgattgttagtaaacaagaaagaggcaagagtttgcttttcaaaacgtctgcgggtgtgaatatgtgtacacttattgcaatggatctaggagaattatgcgatgatactatgacgtacaaatgcccaaggataacagaaactgaacctgatgatgttgactgttggtgcaatgcaacagaaacatgggtaacttatggaacatgcagtcaaacgggcgaacacaggagagataagagatcggtagcattagcccctcacgtaggattgggattagaaacgagaacagaaacatggatgtcatcggaaggtgcgtggagacaaattcaaaaagtagaaacatgggcattaaggcacccgggttttacagtaattgcgttatttctagcacacgcgataggaacatcaatcacacaaaagggaatcatattcatactgctaatgttagttacaccatcaatggctatgagatgcgtgggtataggaaatagagatttcgtagaaggcttaagtggggcaacatgggtagatgtggttctggaacacggttcatgcgtaaccacaatggctaaagacaaacctacgctagatatcgaattgttaaaaactgaagttacaaatccagccgtcttgaggaaattatgcatagaagctaaaatatccaataccacgacagattcaagatgcccaacgcagggtgaagctaccctagtagaagaacaagatacaaacttcgtatgtaggagaacatttgtagatagaggatggggcaacgggtgcggattattcgggaaagggtctttaatcacgtgcgcaaaattcaagtgtgtgacaaaattggaaggaaaaatcgttcaatacgagaaccttaagtatagtgtcattgtaacggtacacaccggagatcaacatcaagtaggaaatgagacaactgagcatgggacgattgctacaattacaccacaagcgcctacatctgagatacaactaacagattatggtgcattaactttagactgcagtcccaggaccggactagattttaatgagatggtgttactaaccatgaaagagaagtcctggttagttcacaagcagtggtttctagatcttccacttccttggaccacaggtgctagcacaagtcaagaaacttggaatagacaggatctacttgtaacatttaaaacggcccacgcaaagaagcaagaggtggtagtcttaggttcccaagaaggagccatgcacactgcactaacaggagcaactgaaatccaaacaagtggaacaacaactatattcgctggtcatctaaaatgtagactcaagatggacaaactgacattgaaaggaatctcatatgttatgtgtacgggtagtttcaaattagaaaaagaagtcgctgaaactcaacatgggacagtgttagttcaagtaaaatatgaaggtacggatgcgccatgtaaaattccattctcttcgcaggacgagaaaggtgtaacacaaaatggacgtttagtaacagcaaacccgattgtaacagacaaggaaagaccggtaaatatcgaagcggaaccaccgttcggggaaagttacatagtagtaggtgcgggtgaaaaggcattaaaattgtcatggttcaaaaagggttcttccattggaaaaatgttcgaggccacagccagaggagcgagaaggatggcgatattaggagacacagcttgggactttggttcaattggcggagtttttacgtcagtgggaaagctcgtacaccaaatatttggcacggcatatggagtcttatttagtggagtatcctggaccatgaaaattggaataggaattttactgacttggctcggtctaaatagtagatctacaagtctaagtatgacgtgtatcgcagtcgggatggtcacattataccttggtgttatggttcaagctgatagcggatgtgtaattaactggaagggaagggagctcaaatgtggatcaggtatattcgttactaatgaagtacatacatggactgaacaatacaaatttcaggcagactcgccaaaaagattgtcggctgccatcggaaaagcatgggaagagggagtttgcggtatacggtcggctaccaggcttgaaaacataatgtggaaacaaatatctaatgaattaaatcacattctacttgaaaatgacatgaaattcacggttgtcgttggagacgtaagtgggattctagcccaaggtaaaaagactattaggccccaacctatggaacacaagtatagttggaaaagttggggaaaagctaaaataattggtgcagacgtgcaaaatactacatttataatagatggacccaatactcctgaatgtccagatgatcagcgagcatggaatatttgggaagtcgaagactacggatttgggatattcaccactaacatttggttaaaactaagagatagctatacacaggtgtgcgatcaccgattaatgtcggcagccattaaagattccaaggctgttcacgcagatatgggttattggatagagtcagaaaagaacgaaacatggaagttagctcgagcttcttttatagaggtcaaaacatgtgtatggccaaaatcacacaccttgtggtcaaatggggtactggagagcgagatggtgataccgaaaatatatggaggaccaatatctcaacataattatcgacccggctattttactcagacagcagggccatggcacctcgggaagttggaattagattttgatttatgtgagggaacaacagtagttgtagacgaacactgtgggaacagggggccaagtttacgaaccaccacagtcacaggtaaaataatacacgaatggtgttgtcgaagttgcacgctaccaccactaagatttaaaggggaagatggatgctggtacggtatggagatacgacccgtaaaagaaaaagaagaaaacctagttaaatccatggtgtcagccggaagtggcgaggtagacagtttctcacttggattattatgtatatctattatgatagaagaggtaatgaggtctaggtggtcaaggaaaatgctaatgacaggaacccttgtggtcttcttgttactaacattggggcagttaacatggaatgatcttataagattatgcataatggtcggagccaacgcatccgataatatgggaatgggcacaacttatctggcattgatggcaacctttcgcatgcgtccaatgtttgcagtgggattattgtttcgcagattaacctctagagaagttctattactgacagtaggtctctctttagttgcaagcgtagaattacctaactcactagacgagctcggggatggcttagcaatgggtataatgatcttgaagctgctcaccgattttcaatcacaccagttgtgggccacactcctctcattgacctttgttaagactactctgtccttacattacgcctggaaaactatggccatgatcttatcaattgtaagcctacttccattatgtttgagtactacaagccagaaaaccacctggttaccagtcttactgggttcacttggttgcaagcccctaacaatgttcttaattaccgagaataagatctggggcaggaagtcttggccgttaaatgaagggataatggctgttgggatagtttcgatacttttatcaagtttattgaaaaatgatgttccattagcaggacctcttatagcagggggtatgttaatcgcctgttatgtaatctcaggatcatcggcagatttaagtctagagaaagcagctaaagtatcttgggaagaagaggcagaacactcaggtgctagtcataatattttggtagagatacaggacgatgggacaatgaaaatcaaagacgaagaaagagatgacacaataacaatattattaaaagccacgttattagccataagtggggtttatccgatgagtataccggcaacattatttgtttggcacttctggcagaaaaagaaacaaaggagtggtgttctatgggacactccatcacccccggaggtcgaaaaagcagtcttagacgatggaatttatagaatactgcaacgtggattacttggtagatcgcaagtaggagtaggtgtctttcaagaaggcgtctttcacacaatgtggcacgtcactagaggtgcagtcttaatgtaccagggtaaaaggctcgaaccgtcctgggcctcggtcaagaaagatctgattagttatggaggaggatggcgattccaaggatcgtggaacatgggtgaagaggtccaagttatagctgtcgagccgggaaagaatcccaaaaatgtccaaacagccccaggtaccttcaaaacgagtgagggagaagttggagctattgcattagactttaaaccaggtacctcgggtagtcctattgtaaacagagagggaaaaatagtagggctttacggtaacggtgtagtaaccacatcaggtacctatgtcagcgcaattgcacaagcaaaagcaagccaagagggccctcttccagagattgaggatgaagtgtttcgaaagcgcaatttaactataatggacttgcatcctgggtctggcaagactaggagatacttgccggcgatagttagggaggcaatcaagcggaaattgagaacgttagttttggctcctaccagggtagtggcgtcagaaatggcagaggcattaaaaggtatgccaatccggtatcagaccactgcggtgaaatctgagcatacaggtaaggaaatagtggacctcatgtgccatgcaacgttcacgatgcggctgctatcacctgtaagagtaccgaattataatatgataatcatggacgaggctcatttcaccgatccagcatcgatagcggcaagaggatacatatcaactcgagtaggaatgggtgaagccgcagcgatctttatgacggctactcctcccggatcagtagaggcattccctcagagcaacgcagtaatacaggatgaagaaaaagatataccagaaagaagttggaactccggttatgattggataacagattttccaggaaagacagtatggtttgtgccatcgattaagagcggaaatgatatagctaattgtctcaggaaaaatgggaaacgagtcattcaattgtcaagaaaaacattcgatactgaatatcagaaaactaaaaacaatgactgggactacgtggtaacaacagacatttctgagatgggagcaaattttcgcgcagatcgtgttatagatccgcgacgctgtttgaaacccgttattttaaaggatggaccagaacgggtaatattagcagggcccatgcctgttacagtcgcgtcagcggcccagagacggggtagaataggtagaaatcagaataaggaaggagatcagtatatatacatgggccagccattaaataacgacgaagatcatgcacattggactgaagcaaagatgcttttagataatataaatactcctgaaggaattatccctgcattattcgaacctgagagagaaaaatccgcagctattgacggtgaatatcgtttgaggggagaggctcgaaaaacgttcgtggaactgatgcggagaggtgatttgccagtatggttgtcatataaagtagcaagcgaaggatttcaatactctgatagacgttggtgtttcgatggagaaaggaataaccaagttttagaggagaatatggatgtagaaatatggactaaggagggagaacgcaagaaactaaggccgaggtggttagacgccaggacatatagcgaccccttagcactaagagaatttaaggaatttgcagcaggcagacgctccgtaagtggggacttaatattagagatcggtaaattgccgcaacatttgacacagagagcacaaaacgcactggacaacttagtaatgttacataatagtgaacagggaggaaaggcttatagacacgccatggaagaactgcccgatacgatagaaacaataatgctcctagccttaattgcagtcttgacagggggagttacattgttctttctaagtggacgtgggttaggtaaaacgagtataggcttactatgtgttacatcatcatcagcattattatggatggcctccgtcgagccgcattggattgcagcttcaatcatacttgaatttttcttaatggtattacttatcccagaaccggatcgccaaagaacgcctcaagataaccagttagcgtacgtagttataggtcttctatttatgattctaacagttgcagcaaatgaaatgggtcttctagaaaccacaaagaaagacctgggaattggacatacagcggcagaaaaccaccatcatgcagctatgctagatgtcgatctgcacccggcatctgcgtggacgttatatgccgttgccacaacgataattacacccatgatgagacataccatagaaaacacaactgcaaacatatctctgacagcgatagcaaaccaggctgcgattttaatgggtctcgataagggatggcctatttcaaagatggatatcggagttcccttactagcgttagggtgttactcgcaagttaaccctctgacattaacggctgcagttctcatgcttgtagcccactatgctatcataggaccagggttacaggcgaaagcaacccgagaggcccaaaaacgtacggctgcgggtataatgaagaacccaactgttgatggaattgtcgcaatagatcttgacccagtggtttacgacgcaaagtttgaaaagcaactgggacaaataatgctactaatactctgtacatcccaaattctgttaatgagaacgacatgggcgttatgtgaatcaattacgctagctacaggtcctttaacaacgctatgggagggttcacctggaaaattttggaatactacgattgcggtcagcatggcgaatatatttcgaggttcatacttggcgggagcgggattagcttttagtttgatgaaatcattaggagggggacgacgtggtactggtgcacaaggcgaaacgcttggtgaaaaatggaaacgacaattaaaccaacttagcaagtctcaattcaatacatacaaaaggagtggaatcatcgaagtggatcggagtgaggcaaaggaagggctcaagagaggggaaacgactaaacatgctgtaagtcgagggacagcgaaattacgttggttcgttgaaagaaacctagtaaagcccgagggcaaagtgatagacctcggatgcggacggggcggttggtcttattactgtgcaggacttaagaaagtaactgaggtcaaggggtacacgaaaggtggcccaggtcacgaggaaccaataccaatggcgacctacgggtggaatttagtgaaactacattcaggcaaggatgtattctttataccacctgaaaaatgtgatacacttctttgcgacataggcgagtcaagtcccaatccgacaatagaagaagggcgtactcttagagtacttaaaatggtcgaaccttggctccgcggtaatcaattttgtataaaaatactaaatccatatatgccaagtgtggttgaaactttagaacagatgcagaggaaacatggaggcatgttagtccgaaaccctttatcgagaaacagtacacacgagatgtactgggtatcatgtggaacaggaaatatcgtgtctgcggtaaacatgacttcccgaatgttactaaataggtttacaatggcacatagaaagccgacctatgaaagggatgtagacttgggagctgggactaggcacgttgcagtcgaacccgaagtagccaacctagacattatcgggcagaggattgaaaacataaagaacgaacataaatctacttggcactatgatgaagacaatccgtataaaacatgggcttatcacggttcttatgaggtgaagccttcaggttctgcaagttcaatggtcaacggggtagtaagattattaaccaaaccttgggatgttataccaatggtaacacaaatagcgatgaccgacactacacctttcggacagcaaagagtgttcaaggagaaagtagacacacgaacccctaaagctaaaagaggaactgcacagataatggaggttaccgcaaaatggttgtggggctttttaagtcgaaacaagaaaccacgtatatgtactagagaagagttcactcgaaaggtgcgtagtaacgctgcgatcggcgcggtattcgttgatgagaatcagtggaacagtgcaaaagaagccgtggaagacgaacgtttctgggatttagtaaggcgtgaaagagaactccataagcaaggaaagtgtgcgacgtgtgtatacaacatgatgggtaagcgtgagaagaaactaggagagtttggtaaagcaaaaggtagcagagcaatctggtacatgtggttgggagctcgcttcttagagtttgaagccctaggctttatgaatgaagatcactggttctcaagggaaaattcactgagtggggtggagggcgaaggtttgcacaaacttgggtatatcctaagggatatatcgaaaataccaggtggcaatatgtatgctgacgacactgccggctgggatacacggataactgaggaagatttacaaaatgaggcaaaaatcaccgacattatggaaccggaacacgcgttgttagctacctccatattcaaactaacttatcaaaacaaagtagtcagagttcagaggccggccaaaaatggcactgtaatggacgtaataagcagacgtgatcaacggggatctgggcaggtaggaacctacggattaaatacctttacaaacatggaagctcaacttatcagacaaatggaaagtgagggaatattttctccaagtgagttagaaaccccgaaccttgcggggagggtattagactggctcgagaaacatggtatagaaaggttaagacgaatggcgatttctggcgatgactgcgtagtgaaacctatagacgacagattcgccacagcacttacagcccttaacgatatgggtaaggttcgaaaggacataccacaatgggaaccatctaaaggatggaatgactggcaacaggttcctttttgcagccaccattttcaccagctaataatgaaggatggcagagaaatagtagtgccatgcaggaatcaggacgaacttgtaggacgcgcaagggtaagtcagggggcgggttggtcactaagagaaaccgcatgcttagggaaaagctacgcacaaatgtggcaactaatgtacttccacaggcgcgatcttaggttagcggctaacgctatatgctcagccgtgccagtagactgggtaccaacgtccaggacgacttggtcaatacatgctcatcatcaatggatgactactgaagatatgctcagtgtgtggaatagggtctggattgaagagaatccttggatggaagataaaactcacgtttcttcatgggaggacgtgccctacctaggcaaaagagaggaccaatggtgcgggagcctaataggattaactgcaagagcgacttgggctacgaatattcaagtagccataaaccaggtacggcgattaataggcaatgaaaattacctagactatatgacatctatgaaaaggttcaaaaatgagtccgaccctgagggagcactgtggtaa

SEQ ID NO: 22077 - RNA, 9879 nt, synthetic construct
  misc_feature 1..9879: note = derived and/or modified CDS sequence (opt6) from DENV-1__JQ915080__SS-prME
  source 1..9879: mol_type = other RNA
agtgtgacaatgctactaatgttattaccgacagtattgacgtttcatctcacaacacgcggaggggagccccatatgattgtttcgaaacaagaaaggggaaaatccttactgtttaaaacttcagctggagtaaatatgtgcactctgatagctatggatttaggggaactttgtgatgacacaatgacttataaatgtccaaggataacggaaacagaacctgacgacgtggactgttggtgtaatgcgacagagacatgggtcacttatgggacatgtagccaaacaggagaacaccgtcgggataaacgcagtgtagcattggctccacacgtaggattaggtctagagactcggactgaaacttggatgagctcggaaggagcgtggcgacaaatacaaaaagtggaaacttgggcgctccggcacccaggatttacggttattgctctttttctggctcatgcaattggtactagcattacacaaaaaggtataatcttcatacttctaatgctagtaacaccaagcatggcaatgagatgtgtaggaatcggtaatcgagatttcgtcgagggcctgagcggagcaacttgggtcgatgttgtactggaacatggaagctgtgtcaccactatggcaaaagataaaccaacattagatattgaattactaaaaactgaagttacaaaccccgcagttctacgaaagttatgtattgaagcaaaaatatcaaataccacaacagattcaagatgccctactcaaggagaagcaacgttggtagaagaacaagacaccaattttgtctgtaggcgtacctttgtagatcgtggttggggaaatggttgtggattattcgggaaaggttcattaataacctgcgcaaagttcaaatgcgtaactaaattagagggaaaaatagttcagtatgagaaccttaaatattctgtaatagtaacggtgcatactggcgatcaacaccaggtaggaaatgaaacgactgaacatggaacaattgcaacaattacaccgcaagcgccaacgagtgaaatccaactaacggattatggagctttgacattggattgttccccaagaacagggttagactttaatgaaatggtactcttaacaatgaaagagaaatcatggctcgttcataaacaatggttcctggacctacccttaccgtggaccactggagcatcgacaagtcaagagacttggaaccggcaagatttgctcgtaacttttaagactgcacacgccaagaaacaagaagtcgtagtactaggatcacaagaaggggccatgcacaccgcattaactggggctacagaaatacaaacaagtggaacaacaacaatctttgcggggcacttgaaatgtagattaaaaatggataagttgacattaaaaggcatttcatacgttatgtgcaccgggagctttaaattagagaaggaggttgcggagacgcaacacggaacagttcttgttcaagtcaaatacgaaggcacagatgctccttgtaaaataccattctcgtcacaagatgagaaaggtgtcactcaaaacgggagattggtaacggcaaacccgatagttacggacaaggaacgtccagtaaatatagaagcagaaccaccatttggagagtcttacatagttgtaggggcaggagagaaagcactaaaacttagttggttcaaaaaggggagcagcataggcaaaatgtttgaagcaacagctaggggagcaagacgtatggccatactaggagatacggcatgggattttgggtcgatcggtggagtatttaccagtgttggtaagctagtacatcaaatctttggcacagcatatggagtactattttctggagtcagctggaccatgaaaatcgggataggtatattactaacttggctcggacttaactcaagatctacatctctatcgatgacatgtatcgctgtgggaatggtaactttatatcttggcgtgatggtgcaagcggattctgggtgtgtcataaactggaaaggtagagaattaaaatgtgggagtggtatattcgtaaccaatgaggtccacacgtggactgaacaatataagtttcaagcggatagccctaaaagactgagcgcagctataggtaaggcttgggaggaaggcgtttgtgggattcggtcagcaacccgattagaaaatattatgtggaaacaaattagtaatgaattgaaccacatacttttagaaaacgatatgaaattcacagtagtagtcggtgacgtaagtggcatattggcccaagggaagaagacaataagacctcaacctatggaacataagtattcatggaaatcttggggaaaggcaaaaataataggtgctgatgttcaaaatacaacgttcataatcgatggacccaatactccggagtgtcccgatgaccaaagagcatggaatatatgggaagtagaggattatggcttcggaatattcactaccaacatttggttaaaacttcgtgattcgtacactcaggtgtgcgatcacagattgatgagcgcagcgataaaagactctaaagcagttcatgcagacatgggttactggatagaaagtgagaaaaacgagacatggaaattagcacgggcatcctttatcgaagtaaaaacatgtgtatggcccaaatcccatacattatggtcaaacggagttctagaaagtgagatggtaatccccaaaatctatggtgggcctataagtcaacacaattaccgcccaggctatttcacacagactgccggaccttggcacctcggaaaattggaactagattttgacttatgtgagggtacaacagtagtagtcgatgagcactgtggaaataggggacccagcttacgaacaaccacggtaacgggaaaaatcatacatgaatggtgttgtcggtcttgtacccttccaccattaagattcaagggggaggacgggtgctggtatggaatggagattaggcctgttaaagagaaagaagagaatttagttaaaagcatggtcagtgctgggtccggagaagtcgatagtttcagtcttggtctactttgcattagtattatgatagaagaagtaatgaggtctagatggtctcggaaaatgttgatgacaggaactctcgtagtgtttctactcttaacgttaggacagttaacctggaatgacttaataagactttgtataatggttggagcaaacgccagtgacaatatggggatgggaacgacgtatttagctttaatggctacgttccgaatgagacctatgttcgccgtaggtttactttttcggagattgacatcacgagaggtattgttactgacagtaggcctttcgttggttgcgtcggtggaactccctaatagcttagatgaactaggtgacggactagctatggggataatgatcctcaaattgctgacagattttcaaagtcatcagttatgggcgacgttgcttagcttgactttcgtgaaaacaaccctgtctttacactatgcatggaaaaccatggcaatgatcttgtcaattgtcagtctcttgcctctatgtcttagcacaacgtcccagaaaactacctggctccctgtattactggggtccttaggttgcaagcctttaaccatgttcctgatcacagaaaacaaaatatggggaagaaaatcatggccgttaaacgagggtattatggctgtggggatagtatccattcttttaagctcattactcaaaaatgatgtgccactagctgggccccttatagcaggagggatgttaatagcctgctatgtaattagcggttcgtcggcggatttgtcattagagaaagcagcgaaagtttcatgggaagaagaagcagaacactccggagcatctcataatatattagtagaaatacaggacgatggcacgatgaaaattaaggatgaggaacgagatgacacaattacaatcctactaaaggccacacttttagctatctctggagtgtatccgatgtcaataccagctacactattcgtatggcacttttggcagaaaaagaaacaaagatctggagtgctatgggatacacccagcccgcccgaagttgaaaaagcagttctcgatgatggcatttaccgaatactgcaaagagggctacttggtagatctcaagtaggtgtaggtgtttttcaggaaggggtattccacaccatgtggcatgtcactagaggggcagtactcatgtatcaagggaaacggttagaaccttcatgggcgtcggttaagaaagatttaatttcatatggtggcggctggagatttcagggatcatggaacatgggtgaagaagttcaggtgatagctgttgagcctgggaaaaatcctaaaaatgtacaaacggcccctggaacatttaaaacgtcagaaggagaagtaggcgctatcgcacttgatttcaaaccaggcacttctggatcaccaatagtaaaccgggaaggaaaaatcgtcggtctgtatggtaacggcgttgtcacaacatcagggacgtacgttagtgctatagcgcaggcgaaggcatcgcaggaaggtcccttaccagaaatagaagacgaggttttccgaaaacggaacttaacaatcatggacttgcatcccggcagtgggaagacacggaggtatctaccagctatcgtaagagaagccatcaagaggaaactgcgaaccctagttttagcaccaacgagggtagtagcatcggaaatggcagaggctttaaaagggatgcctatccgttatcaaaccacggccgtaaaaagcgaacatactggaaaagaaatagtagatttaatgtgtcatgcgacttttacaatgagattactttcccccgtaagagtccctaattataacatgataataatggatgaagcacattttaccgacccagcaagcattgccgcgcgtggttacattagcactcgggtaggtatgggagaagcagctgccatattcatgactgccactcctcctggctcggtagaagcattcccccagagcaacgcggtgatacaggatgaagaaaaagatattccggaaagatcgtggaatagcggatatgattggataacagattttcctggcaagacagtatggttcgtaccttccatcaaatctggtaacgatattgctaattgtctacgcaaaaacggtaaaagagtcatccagctatccagaaaaacatttgacacagaatatcagaagaccaaaaataacgattgggattatgttgttacgacagacataagcgaaatgggggcgaattttagagcagatagagtcatcgatccaagaagatgcttgaaacccgtgatactaaaggatggaccagaaagagtaatacttgccgggccgatgcctgtaacagtagcatcggcagcccagcgaagaggacgaataggaaggaaccaaaataaagaaggagaccaatatatatatatgggccaaccactaaataacgacgaagatcatgcacattggaccgaagctaaaatgttattggacaacataaacacgccagaaggaatcattccagcactattcgagcctgagcgtgaaaaatcggcggcaattgacggtgaatatcgactcaggggagaggcacggaaaacatttgtggaacttatgcgccgcggagacctaccagtgtggttatcgtataaagtggcgagcgaaggattccaatattcagatcgcagatggtgcttcgatggggagcgcaacaaccaggtactagaagagaatatggacgtggagatctggacaaaagaaggagaaagaaagaaactaaggccccgttggttagatgccaggacatactccgatccattagcattaagggaatttaaagaatttgcagctggtcgtagatcggttagtggagatttaattcttgaaataggtaaactaccacaacatctaactcaacgtgcacagaatgctctagacaatctcgtaatgttacataacagtgaacagggaggcaaagcatatcgtcatgcaatggaagaactaccggacacaatcgaaactataatgttattggccctcatagcagtattgacaggcggtgttacattatttttcctaagcgggaggggacttggaaaaacgagtataggtctcctttgtgttacatcatcctcggccttattatggatggcaagcgttgaaccacattggatcgctgcaagcatcattttagagttctttctaatggttttactaattccagaaccggataggcaaagaacaccgcaagataatcagctagcatatgtggtaataggtttattatttataatactgacggtagctgcgaacgaaatggggctacttgaaactactaagaaagatctaggtattggccatacggcagccgaaaatcatcaccatgccgcaatgctggatgtcgacctccatccagcatctgcatggacgctatatgccgtggcaacgacaataataacacccatgatgcgccataccattgaaaatacgaccgccaatatatctcttacggcgatagcaaaccaagcggcaatcctgatgggacttgacaaagggtggccaatatctaaaatggatattggtgtccccctgttagcactaggctgttactcacaagtaaaccctttaacattaacagcagctgtattaatgttggtcgcacattatgcaataattggtcccggcctccaagcaaaggctacacgtgaagcccagaaacgaaccgctgcaggaatcatgaaaaacccaacggtagatggaatagtcgccatagatttagatcctgtagtttacgacgccaaatttgaaaagcaacttggacaaataatgctactcatactgtgcacgtcacagattctactcatgagaacaacttgggcactatgtgagtcaattacactagccacagggcctcttactactttatgggaaggttccccaggaaaattttggaacacaaccatcgccgtttcaatggcaaatatattccgtggtagctacttagcaggggccgggcttgctttctccttaatgaaatcattgggaggtggcagaagaggaactggggctcaaggtgaaactttaggagagaagtggaaaagacaactcaatcagttatcaaaatcccaattcaatacatataagagaagcggtataattgaggtggatagaagtgaggcaaaagaaggcttaaaaagaggggaaaccacaaaacatgcagtatccagagggacagcaaaactacgatggttcgtagaacgaaatttagtaaaacccgagggtaaggttatagatttaggatgtggtaggggcggttggtcatattactgcgctggactcaagaaagtaactgaagtaaaagggtacacaaaaggaggacccgggcatgaggaaccaattcctatggctacatatggatggaatctggttaaactccactcaggaaaggacgtctttttcattcctcccgaaaagtgcgatactctgttatgtgatattggtgagtcatcccctaatccgaccattgaagaggggagaacattgcgagttctgaaaatggtcgaaccatggttgcgtggaaatcaattttgcattaaaatattaaatccatatatgccaagcgtagtagaaacactcgagcaaatgcaaaggaaacatggtggaatgctggtcaggaaccccttaagccgaaactctacacatgagatgtattgggtatcgtgtggcacaggcaacattgttagcgctgtcaatatgacttcacgaatgcttttaaatcgatttacgatggcgcaccgaaaacctacatatgaacgagacgtagatctcggtgcggggacccggcatgtagcggtcgagccggaagtggcaaatctcgatataatagggcaaagaatagagaacatcaaaaacgaacataagagcacatggcattacgatgaagataatccatacaagacatgggcatatcatggaagctatgaagtaaaacctagtggaagcgcttcctctatggttaatggggtagtgcgattgcttactaagccgtgggatgtaattcccatggtaacacaaattgcaatgacggatacaaccccattcgggcaacaaagagtatttaaggaaaaagtagacacgcgaacccccaaggctaaacgaggcacagctcaaattatggaagtaacagcaaaatggttatggggctttctttcccgaaataagaaaccgaggatctgcacacgggaggaatttacaaggaaagtacgaagcaatgcagccatcggtgcggtattcgttgacgaaaatcaatggaactctgcaaaagaagctgtagaagatgaaaggttttgggatcttgtcaggagagaaagagagctacataaacaaggaaaatgcgctacatgcgtatataatatgatggggaaacgggagaagaaattaggtgaatttgggaaggccaaaggatccagggcaatatggtatatgtggttgggagcccgattcctggaatttgaagctcttggtttcatgaatgaagatcattggttttctagagaaaactccctatctggagtggaaggggaaggtctccacaaactcggatatattcttagggacatatctaagattcctggaggaaacatgtatgcagacgacacagctggttgggacacaagaattactgaggaagacctgcaaaacgaagcaaaaataacggatataatggaaccggaacatgcgctattagcaacgagtatcttcaaattgacctaccaaaataaggtagttagagttcaacgaccggcaaagaatggaaccgttatggatgtaatcagcagacgggaccaacgtggttcgggtcaggttggaacgtatgggcttaatacatttacgaacatggaagcccaactgattaggcaaatggaaagtgaaggcatcttttcacctagtgaattggaaaccccgaatctagccggaagagtactcgactggttagaaaagcacggtatcgaaagactgcgaagaatggccatttccggggacgactgtgtcgtaaaaccaatagacgatagatttgctactgctctcactgcgctaaatgacatgggcaaagttagaaaggatatacctcaatgggagccgtcaaagggttggaacgattggcaacaggtcccattctgttcacaccactttcaccaattaataatgaaggatgggcgtgaaattgtagttccatgtcgaaaccaagatgagttggtaggaagggcaagagtaagtcaaggggccggttggtctctccgtgaaactgcttgccttggtaaatcctacgctcaaatgtggcaactaatgtattttcacagacgagatttaagacttgcagcgaacgctatatgctcagccgttccagtcgactgggttcctacatcaaggactacttggagtattcatgcacaccaccaatggatgactacagaagatatgctatctgtctggaatcgagtttggatagaagaaaatccgtggatggaggacaaaactcatgtaagtagttgggaggatgtaccttatctcgggaaaagagaggatcaatggtgtggctctcttatcggattaacggcccgtgcaacttgggccaccaatattcaagtagccattaatcaagttaggagattaattgggaatgagaattatctagactacatgacctctatgaaaaggttcaaaaatgaaagcgatccagaaggggctttatggtag

SEQ ID NO: 22078 - RNA, 9879 nt, synthetic construct
  misc_feature 1..9879: note = derived and/or modified CDS sequence (opt6) from DENV-1__KJ755855__SS-prME
  source 1..9879: mol_type = other RNA
tccgtgactatgctcctaatgttgatgcctacggctctagcgttccacttgactacaaggggaggagaaccgcacatgattgtatcaaaacaagaacggggaaaaagcctgttgtttaaaacaagtgctggagtaaatatgtgtacactaatagcgatggatctgggtgaactctgtgaagacaccatgacatacaaatgccctagaataacagaagcagaacccgatgatgtggattgctggtgtaatgctactgacacgtgggtcacatacggtacatgcagtcagaccggtgaacataggagggataaacgtagcgttgcactagcaccacatgtaggtttaggtctggaaacaagagccgaaacatggatgtcgtctgaaggcgcttggaaacaaattcaacgtgttgaaacatgggcactaaggcacccaggctttactgtgatagcactattccttgctcatgcaataggcacttcaataacacaaaaagggataatttttatactattaatgttagtaacgccctctatggcaatgcgatgtgtagggataggttcaagagatttcgttgaaggcctaagtggcgctacatgggtagatgtagaactggagcacgggagttgtgtcactaccatggcaaaagataaacccacgctagacattgaactgctaaaaacagaggtcacgaatccggcagttcttagaaaactctgtattgaggcaaaaatctcaaacacgacaacagattctcggtgcccaacacaaggagaggcaacattagtagaggaacaagatgcaaattttgtgtgtcggagaacatttgttgatcgcggatggggcaatggatgtgaactgttcggtaaaggtagcttactaacttgcgccaagtttaaatgtgtaacaaaactcgagggtaaaatagtgcaatatgaaaacttgaaatattcagtcatagtaacggtacacattgcagctcaacatcaggtaggaaacgaaagcactgaacatgggacaacggcgatcataacaccacaggcaccaacgacagaaattcaactaactgattacggagcactaacattggactgcagtccacggacaggcctagattttaacgagatggtcttattgacaatgaaggaaaaatcatggttagttcacaaacaatggtttctggaccttcccctcccatggacatctggtgcatccacatcacaggaaacttggaatagactattcctcttagtgacgttcaagacagcacacgctaagaaacaggaagtagtagtactgggatcacaagaaggagcgatgcatacggctctaactggagcaactgcattacaaaccttcggtactaccactatatttgcaggacatctgaatatcagactgaaaatggacaagctcaccctgaagggaatgtcttatgttatgtgcactggcagctttaaactcgaaaaggaagttgccgagacacagcatggtaccatattggtacagatcaagtatgaaggtactgatgcaccttgcaagattccattttctacccaggatgaaaaaggagtgactcaaaatgggcgattaataactgccaacccaatcgtaacggacaaggaaaaaccggttaacatagaagccgaaccgccattcggtgaatcatacatagttattggagcaggggaaaaggcattaaagctaagttggtttaagaaaggttcaagtattggcaagatgttcgaagccaccgcaagaggggccagaagaatggctatactaggtgacacagcctgggatttcggcagtataggaggtgtatttacaagtgttggaaaacttgtccatcaaatattcggaacagcgtatggagtacttttctccggcgtcagctggactatgaagatagggatcggtgttttactaacttggctgggattaaattcgcggtccacaagtttaagtatgacctgtatagccgtgggtttagtgacactttacctaggagtaatggtgcaggcagattctggatgcgtaatcaactggaagggccgcgagttaaaatgtggaagtggtatttttgttacaaacgaagttcacacttggactgaacaatacaaattccaagcggacagcccaaagcggctttctgctgcaatcggtaaggcttgggaagaaggtgtttgcggaattagatcagcaacaaggttggaaaatataatgtggaaacaaatcagcaacgagttaaatcatattttattagagaatgacttaaaatttacagttgttgtgggtgacgtagcgggcatcttagctcaagggaaaaagatgatcaggccccagcctatggaacataagtattcgtggaaaaattggggcaaagcaaaaattattggtgcagatgtacaaaattcaacatttattatagatggacctaatacccccgaatgctctgacgaccagcgggcctggaatatttgggaggttgaggactacggattcggaatatttacgaccaacatctggttaaagctacgtgatagctacacccaggtgtgtgatcatcgactaatgtcagcagccataaaagactcaaaagccgtacatgcagatatgggttactggattgaatcagagaaaaacgaaacatggaagttggcaagagcgagctttattgaagttaaaacgtgtacttggccaaaatcgcacaccttatggtcaaatggagtattagagagtgaaatgatcattcccaaaatatacggaggaccgatttcacaacataattactcgcccggatattttactcaaacggccggaccttggcatttaggcaagctcgagttagacttcgacctctgcgagggtacaacggtcgtggtcgacgaacactgtggtaaccgcggaccctcactaaggactactactgttaccggcaaaattatacatgaatggtgctgtcggagctgcacattaccacccttacggtttagaggagaggacggttgctggtacggaatggaaatccgacccgtaaaagaaaaagaagagaatctagtcaaatcaatggtgagtgctggtagtggagaagttgtttcattaagtttaggattattatgcatatcaattatgatagaggaagttatgagaagtcggtggtccaggaagatgttgatgacaggaacgcttgcagtattctttaggaaaatccgtggtcaactaacttggaacgatctcattagattatgtattatggtgggcgctaatgcttccgacagaatggggacaagaacaacatacctcgccctaatggcaacatttaaaatgcggccaatgttttctgtaggtctcctttttaggcgactaacaagtagagaagtgctattgttaacgattggattgagcctagtagctagtgtagaattaccaaattcgttagaagaactcggagttttattggccatgggtataatgattctaacattattgaccgactttcagtctcaccaactatgggcaacattattatcaatgacatttataaagacaacattttctctccattatacttggaaaacaatggcaatggtcctctcgattgtatccttatttccattatgcctgagtactacatcccaaaagacaacatggctaccagtcttactaggaagtctaggttgcaagccactaacaatgtttctaattgcggagaacaaaatatgggggcgaaagtcttggcctttgaacgagggtataatggctgtcggcatcgtttccattttgttgtcatcattattgaaaaatgatgttccattagcaggaccactgattgcaggcggcatgttaatcgcttgttatgttatttcaggatcaagtgctgacttaagccttgagaaagctgctgaagtgagctgggaggaggaagcggagcattccggagcaagccacaatatcttagtagaggttcaagacgacggcacaatgaagataaaagacgaagaacgggacgacacactcaccatcttgttaaaagccaccttacttgccgtaagtggcgtttatcctctaagcatccccgccaccttattcgtatggtacttttggcagaagaaaaagcaaaggagcggggtattgtgggatactcccagtcctccaaaagtcgaaaaagccgtactggacgatggcatttataggattatgcagagaggtttactcggtcgttcccaagtaggggtgggggtatttcaagaaaatgtgtttcataccatgtggcacgtaacaaggggcgcagtcctcatgtatcaagggaaaagattagaaccctcttggggtagagtcaagaaagacttgataagttatggaggtggatggggattaaaaggctcatggaacacgggagaggaagtacaggtaatagcagttgaaccaggcaaaaatccgaagaacgtacaaacggctccggggacatttaaaactccagaaggagaggtcggagccatcgcactcgattttaaaccgggaacatctggatccccaatagttaacagggaaggcaaaattgtaggtctttatggaaatggagttgttacgacttcaggcacatatgtcagtgctatagcacatgcgaaagcatcacaagaaggccctttaccagagacagaagttgaggcattcagaaaaagaaatttaacgattatggatctacatccaggtagtgggaagacgaggcgatatttaccagcaatcgttagggaagcaattaagcgtaagatgagaactttgatcttggctccaacgagagttgtagcatctgaaatggcagaggctttgaaaggcatgcccattagataccagacgactgccgttaagagtgaacatacaggaaaggaaatcgtagatttaatgtgtcatgcaacatttacaatgaggcttctcagtccggttcgagtaccgaattataatatgataattatggacgaggctcactttacggacccctccagcttagcggcacggggttatatatcaacaagagttggcatgggcgaagctgcagcaatattcatgactgccaccccgccaggctctgtcgaagcgtttccacaaagtaacgcagtaatacaggatgaggagcgagacattcccgaacgctcttggaactctggatacgagtggatcacagatttccctgggaaaacagtctggttcgtaccatctataaaagccggtaatgatattgcgaattgtttaagaaagaatggtaaacgagtaattcagctgtcgcgcaaaaccttcgacactgaataccagaaaactaaaaataatgattgggactacgtagtaacaactgatatatcggagatgggtgcaaattttccagcagacagggtaatagaccctcggcgatgtctaaatcctgtgatacttaaggacggacccgaaagggtgatactggccgggccaatgccagtaacagtcgctagtgcaaaccaaaggagagggagaataggtcgcaatcataacaaagagggagatcaatatatatacatgggccaaccgttaaataatgacgaggatcacgcacactggacagaggcgaaaatgctacttgataatattaatactccagaaggaatcataccagcattattcgagccagaaagggaaaaatcagcggcgatagacggagaatatagattacggggtgaagcaagaaaaacgttcgtagaactaatgcgaagaggagatcttcctgtttggttatcgtacaaagtcgcatccgaaggatttcagtatagcgacagaaggtggtgttttgatggagaaagaaacaaccaagtattagaagaaaatatggacgtagaaatctggacaaaagaaggagaacgaaagaaacttcgaccacgatggctagatgctagaacatacagtgatcccttggcactccgtgagaagaaagagttcgcagctggtagacgatcagtatcaggtgaccttattcttgagattggaaaattaccgcaacaccttacacaaagagctcaaaatgcattagataacctagtaatgctacacaactcggagcaaggaggaagggcatatcggcatgcaatggaggagttgccggataccatagagacgttaatgctgttggccttaatagccgtattaacaggtggggtcaccctgttcttcctgagtggaaaagggctaggaaaagcaggaaatggattactatgtgtaatggcctctagtgcgctcctctggatggctaacgtagaaccccattggattgcagcttctattatactagagttctttcttatggtattactgataccagaaccagaccgacaaagaaccccacaagacaatcaactagcttacgtcgtaatcagacttttatttatgatcttgacagtagcggcaaacgaaatgggtttacttgaaactacgaagaaagacctcggaatcggtcatgctgctgttgaaaatcatcaccacgcagcaatgttagatatagatctgcatcctgccagtgcatggactctttatgcagttgctaccacaataattacgcccatgatgcgccatacaattgaaaatacgacagctaatattagtttaacagctattgcgaaccaggctgctatattaatgggtcttgataaaggatggcctatttcaaaaatggatataggagtccccttacttgcattggggttcctaagtcaagtcaatccattaacacttaccgccgcagttctaatgttagtagcgcattatgcaataattggccctggattacaagccaaggcaacaagagaagcacaaaaacgcacagccgccggaattatgaaaaatcccacaatagatggtattgtcgcaatagaccttgatcctgtcgtgtatgatgcaaaatttgaaaaacagttaggtcagattatgcttttaattctgtgcacatcgcaaatcttgttgatgcggacaacatgggccctatgtgagtctatcactttagctaccggacctttatcacccctatgggaagggagtcccgggaaatcatggaatactactatagcagtatctatggcaaacatattcagaggcagctatcttgccggggcgggattagcttttagcttaatgaaaagccttggtggcggacgaagagggacaggtgcacagggtgaaactttaggagaaaagtggaaacgacaacttaatcaactatctaagacagagttcaacacatataagaggtcaggtatcatggaggttgataggtcagaagctaaagaaggtctaaaaagaggagaaacaacaaagcacgctgtatcaagaggaactgcaaaactacgatggtttgtggaacggaatctggtaaaaccggaaggcaaagttattgacctgggatgtggtagaggtggttggtcttactattgtgctggtttaaagaaagtctctgaagttcgcggatacactaagggaggacccggacatgaggaaccaataccaatggcaacatacggttgggacctcctcaaacgatgctctggaaaggagttcttcttcatacctccagaaaaatgtgatagtttcttgggtgacataggggaatcttctccaaaccctacgattgaagaaggaaggacggtgcgcgtgctaaagatggttgagccatggttacgagggaatcaattctgtattaaaatattaaatccctacatgccgagcgtagttgagacattggaacaaatgcaaagaaagcatggtggaatgctagtacgcaacccactttccagaaattccactcatgagatgtattgggtgtcgtgtggtactggcaatatagtgtcagctgtcaacatgacaagtcggatgcttctgaatagatttaccatggcacataggaagccgacatacgagagagatgtcgatttgggagccggaacccgccacgtcgctgtcgaaccggaagttgctaaccttgacataattggacagcggatagaaaatatcaagcatgaacataaatcgacctggcattacgacgaagataacccatacaaaacttgggcatatcacggaagttatgaagtaaaaccaagcggtagcgcttcttcgatggtaaacggagtagtcaaacttttgactaaaccatgggacgtgattcccatggtaacccaaatagcaatgaccgatacaactccatttggtcaacaaagggtattcaaagagaaagtggatactcgcactccaaaagcaaaaagaggtacagctcagatcatggaagtgacagcccgctggttatggtcctttctaagccgcaataagaaaccacgaatatgcacgagggaagagttcacacgaaaggtgaggtcaaacgcagcgataggcgcagtatttgtcgatgaaaatcaatggaactctgcgaaagaagccgtagaagacgatcgcttttgggatttagtacatagagagcgtgaattacataaacaaggaaaatgtgcgacatgtgtgtataatatgatgggaaagcgagaaaagaaacttggagagtttggtaaagcaaaaggctcaagagcaatatggtatatgtggctaggcgccagatttcttgaatttgaggccctaggatttatgaatgaagatcattggttttcccgggaaaattccctgtcgggagtagaaggtgaagggcttcataaactaggatatattctacgggatatctctaaaatacccggtggaaacatgtacgcggacgatactgcaggatgggacacacggattaccgaagatgatttacaaaatgaggcaaaaataaccgatataatggaaccagaacatgcattactagcaaaaagtatattcaaattaacatatcaaaacaaagtagtaagagttcaaagaccagccaaaaatggaactgtaatggatgtgatttcaagaagagaccaacgcggcagtggccaggtaggtacatatggcctaaatacattcacgaatatggaagcacaactgattaggcaaatggagagcgaggaaatattcagtccaaatgagttggagaccccaaacctcgcagaaagagtattagactggttagaaaaatatggcgtggaaagactgaaacgtatggcgattagcggggacgactgtgtagttaagcctattgatgacagatttgcaaccgcgttaaccgcgttaaacgatatgggaaaagtcaggaaagatattcctcaatgggaaccctctaaggggtggaatgattggcaacaagtgccattctgctcacatcacttccatcaacttgtaatgaaggacggcagagaaatcgtagtgccttgtagaaaccaagacgagctagttggtcgtgctcgagtgagtcagggagccggatggagtctccgagaaaccgcatgcctagggaaatcatacgcacagatgtggcaattaatgtattttcaccgaagagatttaagacttgccgccaatgcgatctgctctgcagtccccgtcgactgggtacccacttcaaggaccacttggtcaatccatgcacaccaccaatggatgactacggaggatatgcttagcgtctggaaccgtgtgtggattgaagaaaatccatggatggaagacaagactagagtaagcagttgggaagatgtcccatacttaggcaaacgcgaagatcagtggtgcgggagtttaataggactaactgctagagctacatgggcgacaaatatacaggtcgctataaaccaagttaggcgtttaattggcaatgaaaattacagcgattatatgaccagtatgaaaagatttaaaaacgagtccgaacccgaaggggcactatggtag

SEQ ID NO: 22079 - RNA, 9879 nt, synthetic construct
  misc_feature 1..9879: note = derived and/or modified CDS sequence (opt6) from DENV-1__KF289073__SS-prME
  source 1..9879: mol_type = other RNA
agtgttactatgctattcatgcttttaccaacggcgctcgcgtttcatttaacaaccaggggaggtgaaccacatatgatagttagcaaacaagaacgcggtaaatcccttctatttaaaacttctgcaggcgtgaacatgtgtaccttaatagcaatggatctaggtgaactgtgcgaagacacaatgacatataaatgtccaagaatcactgaagcggaaccagacgatgttgactgctggtgtaatgcaaccgatacatgggtcacatacggaacttgttcacaaacaggagaacatagacgagacaaaagatcagtagccttggcaccacacgtcgggttaggattagagacaagaacagaaacgtggatgtcgagtgagggagcatggaaacaaatacaaaaagtggaaacatgggcattgcgtcacccaggcttcacagttatagctttattcttagcgcacgctataggaacgtcaatcacccaaaaaggtataatttttatccttctaatgctagtgacaccttctatggctatgagatgtgtaggaatcggaaatagagattttgttgaaggtctgagcggggcaacttgggtggatgtagtgctagaacatgggagttgtgtgacgactatggccaaaaataaacccactttagatattgagctattaaaaactgaggtaactaaccctgctgtgctcagaaaattatgcattgaagcaaaaatatcaaaaactacaactgatagtcgatgtccgacacaaggcgaagcgacattagtagaagaacaagatgcgaacttcgtttgtaggagaacttttgtcgatcgtgggtgggggaatggctgtggtctgttcggcaaagggtctttactaacctgtgcgaaattcaaatgcgttactaaattagaaggcaagatcgtgcaatatgaaaatttgaaatattcagtaatagtaactgtccatacaggcgatcaacaccaagtgggaaatgagacaacggaacacggtacaatagcaacaattacaccacaagctcctacatctgaaatacagttaactgattatggagcactaacacttgactgtagtcctcgtacgggcctagattttaacgaaatggtcctcctaacaatgaaagagaaaagctggctagtccataaacagtggtttttggacctacctttgccgtggacaagtggagcttctacatcacaggagacatggaaccgacaagatcttctggttacgttcaagacagcccacgccaagaaacaagaagtagtggtacttggatcgcaggaaggagcaatgcataccgcgctaacgggcgcaacggaaatacaaacatctggtacaacaacaatatttgccggacacttaaaatgccgtctaaaaatggataagttaactctaaagggcatgtcatacgttatgtgtacaggttccttcaagctcgaaaaagaagtagcagaaacccaacatggaacagtacttgtacaagtgaaatatgagggtacagacgccccttgtaaaatcccaatatctactcaggatgaaaagggagtaacacaaaacgggcgcttaattacagcgaatcccattgtgacagacaaagaaaaacctgtaaacatagaaactgaacccccgttcggtgaatcatacattgttattggagccggtgagaaagccctgaaattatcatggtttaagaaagggtcgtcgatcggaaaaatgtttgaagctactgcgagaggagctaggaggatggctatattaggagacactgcatgggacttcggtagcataggcggcgtgttcacaagcgttggtaagctggttcaccaggtttttggaacagcttacggagttttattcagtggcgtttcttggaccatgaagatcggcattggggttctattgacgtggttaggcttaaattcacgaagcacgtcactaagtatgacttgtattgcagtaggaatggtgacgctgtacttaggcgtgatggtccaggcggactccggatgtgttattaattggaaaggccgagaactaaagtgtggatcgggtatattcgtaactaatgaagttcatacttggacagaacagtacaaattccaggcggactctccaaagcggctaagtgccgccatcgggaaggcatgggaagaaggagtgtgcggaataagatctgcaactcgactcgagaatatcatgtggaagcaaataagtaatgaactaaaccatatcctattagagaatgatatgaagttcaccgtagtagttggtgacgctaatggaatacttgcacaaggtaagaaaatgattcgacctcagccaatggaacacaagtatagctggaaaagttggggaaaggcaaaaatcataggtgcagacattcaaaatacaacttttataattgatgggccggatacccccgagtgtccggacgaccatcgagcctggaatatatgggaggtggaagactatggttttggaatctttacaacaaatatatggttaaagttaagagactcatatacccaaatgtgcgaccatagattaatgtctgccgcaataaaagatagtaaggcagtccacgccgacatgggatattggattgagtcggagaaaaatgaaacttggaaacttgcccgtgcttccttcatcgaagtcaaaacctgtatatggccaaaatctcataccttatggagcaacggtgttttagaaagcgaaatgattatacctaaaatctacgggggacctatttcacagcataactatagacccggttattttacgcaaacagcaggaccatggcatttgggcaaattggaactagattttgatttatgtgagggaacgacggtagtagtagatgagcattgtggaaatcgtggtccgtcacttcgaactacaacggtaacaggaaaaatcatacatgaatggtgttgtaggtcatgtaccctaccaccactaaggttcaaaggggaagatggatgttggtatggaatggaaataagaccggttaaagaaaaagaggaaaaccttgttcgcagtatggtaagtgctggttctggagaggtagacagtttctccttaggtttactctgcgtatctattatgatagaggaagtaatgcgtagcagatggtcaagaaaaatgctcatgactggaacactagcagtattcttactactaattatgggacaattaacatggaacgatttaataaggctatgtataatggtcggtgcaaacgcgagtgatagaatgggaatgggaacaacatatttagcacttatggctacatttaagatgcgccccatgtttgcggtaggtttgctattcagacggttgacgtcaagagaggtattgttattgacaatcggactttcgttagtagcatcagttgaattgccaaattctctagaagaacttggagatggtcttgcaatgggaattatgatgctaaaactcttaactgactttcaaagtcaccaactatggacaaccttattaagtcttacatttattaaaaccactctaagcctcgattatgcttggaaaacaatggctatggtcctaagtattgtttcacttttccccttatgcctcagtacaacctctcagaaaacaacctggctaccagtacttctgggttcattcggatgcaaaccattaacaatgttccttattacagaaaataaaatatggggaagaaaatcctggcccttaaatgaaggtattatggcagttggaatagttagcatcctactatcgtctctattgaaaaacgatgtaccactggcaggcccgttaatagcgggtggcatgctcatagcatgttatgtgataagcggctcatccgcagatttgtcattggaaaaggcagcagaagtatcttgggaagaggaagctgaacacagtggggcctcgcataatatattagtagaagtgcaagacgacggcaccatgaaaataaaggatgaggaaagagatgataccctgaccatattattaaaggcaacattactggcggtctcgggtgtgtatccaatgagtataccagcaactctattcgtttggtatttttggcagaaaaagaaacaaagaagtggagttttgtgggatacacccagtccaccggaggtagaaagggcagtattagacgatggaatatatcgaatattgcaaagaggcctcttgggacgcagtcaagttggtgttggagtttttcaagacggagtctttcacacgatgtggcatgtgacacgaggtgccgttttaatgtatcaaggaaagagactggaaccatcatgggcatcggtgaagaaagaccttatcagttacggaggaggctggagatttcaaggatcctggaatatgggagaagaagtacaagtaattgcagtcgaaccgggtaaaaatcccaaaaatgtacaaaccacacctgggacattcaagactccagaaggagaagtgggagcgatcgcgctagactttaaacctggaacttcagggagtccaatagtgaatcgcgagggcaagattgttggattgtacggcaatggggttgtaaccacaagtgggacttacgtatctgctatagcacaagctaaagccagtcaggaaggaccactacctgagattgaagacgaggtatttagaaaaagaaatctaactataatggacttgcatccaggctcaggaaaaactagaagatatctaccagcaattgtacgagaagccataaaaagaaaactcagaactctgatacttgctccaactagagtagtagcgagtgaaatggcagaggcattaaaaggaatgcccattcgttatcaaacaacagcagtcaaaagtgaacacactggacgagaaatagttgacctgatgtgtcacgccacatttacaatgagattactatcaccggtaagagtacccaactataacatgatcataatggacgaagcgcatttcacagaccccgcgagtatagctgcacgagggtacattagcaccagggtcggtatgggagaagcggcggccattttcatgacagccactcccccaggctcagtggaagcatttccacaatcaaacgcagtaatccaagatgaagagagagacattcctgagaggtcgtggaacagtggatacgattggattacagattttccaggtaagacagtatggtttgtgccgtcgatcaagagtggtaacgacatagcgaattgcctaaggaaaaatggaaaacgtgttatccaattaagtagaaaaacattcgacacggagtatcagaaaaccaaaaataacgactgggattatgtagttactaccgacataagtgaaatgggagcaaattttcgcgcagatcgggttatagaccccagacgctgtcttaaaccagttatattaaaggacggccccgagagggtcatactagcgggccctatgccagtgactgtggcttccgcagcacaacggagaggaagaataggccggaaccaaaataaagagggagaccagtatgtttatatgggtcagccgcttaataatgatgaagatcacgcacattggactgaagcaaagatgctactggataacataaatacccccgaaggtatcattcccgctctatttgaacctgaacgtaagaaatctgcagctatagatggggaatacagattacgcggagaggcaagaaagactttcgtggaattgatgcgacggggcgacctaccggtctggctctcatataaagttgcttcagaaggatttcaatattctgacaggagatggtgtttcgatggcgaaagaaacaatcaagtactcgaagagaatatggatgttgagatatggactaaagaaggagagagaaagaagttacgacctagatggctagatgcaagaacatattcagatcccttagccctgagagaatttaaggagttcgcggccggaagacgctcagtcagtggcgatcttatattggaaattggcaaattaccacagcatttaacacttagagcacaaaaggcattggataatctcgtcatgctccataattctgaacaaggtgggaaagcgtacagacatgccatggaagaattgcctgatactatagaaactctaatgttactagcacttattgcagtgttaaccggtggagtgacattgttctttcttagtggtaaaggtctaggtaaaacgtctataggcttgctgtgcgtgatggcctcatcagctctcctatggatggcatcagtagaaccacactggatcgcagcttcgataatactagagttctttctaatggtactactgatcccggaaccggacagacaacgtacaccacaagataaccagcttgcttatgtagtaatcggacttctatttatgatactaactgttgcggctaatgagatggggctgcttgaaactaccaagaaagatctaggcataggtcatgttgcagctgaaaaccatcatcatgcaacaatgttagatgtagatttacgaccggcgtcagcatggacactatacgcagttgcaacaacgatcattaccccaatgatgcgtcacacaatagagaatacaaccgccaatatatcattaaccgcgatcgcaaaccaggcagcgattctaatggggcttgataagggatggccgataagtaagatggacattggtgtaccgttactagctttaggatgctattctcaagtcaatcctttgactttgacggcggcagttctaatgctagttgcacattatgccattataggaccgggactacaagccaaggctactcgggaagcccaaaagcgaacagcagcggggattatgaaaaatcctacagtggacggaatagtcgcaattgacttagatcctgtcgtatatgacgcgaaatttgaaaagcagttggggcaaatcatgcttttaattctttgtacttcacagattttgcttatgagaaccacttgggcgttatgtgagtcgatcactttagctactggccctctaacaacgctgtgggaaggaagtcctggaaaattttggaacacaactatagctgtatctatggcaaacatatttagaggaagttacttggcaggagcaggtttagcattttcattgatgaaaagtctagggggtgggcgtaggggtaccggagcgcaaggtgaaacactgggtgaaaagtggaaacgccaacttaaccagctcagtaagtcggaatttaatacatataaacgttccggaattatggaagtagatcgttcggaagcaaaagagggattgaagagaggtgagacaactaaacatgcagttagtcgcggaacagcaaaattgcgatggttcgtggaaagaaatttggtgaaacccgaaggaaaagttatcgatctaggatgcggaagaggaggctggtcatattactgcgcaggactcaagaaagtaacagaagtgaaaggatataccaaaggaggtcctggtcatgaagaaccgattccgatggcgacttacggttggaatcttgtaaagctacattcgggcaaagacgtattcttcactccacctgaaaaatgcgatacattactgtgtgacataggagagagctctccaaatcccacaatagaggaaggtaggactctcagagtgttaaaaatggtagagccttggcttcgaggcaatcaattctgtataaagatattaaatccgtatatgccctcagttgttgaaacattagaacaaatgcaacgtaagcatggaggtatgctagtccgtaatccccttagcagaaattctacacatgagatgtattgggtatcttgtggtacggggaacattgtgtccgcagtaaatatgacatcaaggatgttgttgaatcgattcacaatgacacataggaaaccaacatatgagagagacgtcgatcttggagcaggcacaagacatgtggcagttgaaccagaggttgcaaacctggatatcataggccaacgcatagaaaacatcaaaaatgaacataaaagtacgtggcattatgatgaagataacccctataagacctgggcttatcatggcagttatgaagttaagccttcaggcagtgcatcgagtatggttaacggcgtggtacgcctactaacgaaaccatgggatgttattcctatggtaacccaaattgcgatgacagatacaacgccattcggtcagcagagggttttcaaagagaaagtcgatacaagaacaccacgggcaaaaaggggtaccgcacagattatggaagtgacagctaagtggctatggggatttctatcacgtaacaagaaacccaggatatgcacccgtgaagagtttacaagaaaggtaaggagtaatgcggccatcggagctgtatttgtagacgaaaatcaatggaatagcgcaaaagaagcagtagaagatgaaagattctgggacttagttcatagagagcgagaactccataaacaaggtaaatgcgcaacatgtgtgtacaacatgatgggtaagcgagagaagaaactaggagagttcgggaaagcgaaagggtcgagggcaatatggtacatgtggctaggtgctcggttcttagaatttgaagcattaggatttatgaacgaagatcattggttttcgagagaaaattctttaagtggcgttgaaggcgaaggtctacataaactgggatacatactgagagatattagtaaaatccccggtggaaacatgtatgcagatgatacaacggggtgggacactaggatcacagaagacgacttacaaaatgaggctaaaattacagatatcatggaaccagaacatgctttgttagcaacatcgatttttaaattaacataccaaaataaagtcgtgagggttcagcgacctgctaaatcgggtacagtaatggatgtaataagcagacgagatcagcgagggagcggacaggtgggtacatatggtcttaatacgtttactaatatggaagtacaattaataagacagatggaatcagagggaatatttctaccatccgagcttgaaaccccaaacttagcagaaagggtccttgactggctagaaaagcatggagtggagagacttaaaagaatggccatttctggggatgattgtgtggtaaaacctactgatgatagattcgcaacagcattaacagcgctgaacgacatgggtaaggtacgtaaggacataccgcagtgggagccttcaaaaggctggaacgattggcaacaagtgcctttttgttcgcaccactttcatcaactgataatgaaagatggacgagaaatcgtagtaccctgtcgcaaccaagatgaacttatggggagggcaagagtaagccaaggtgcgggatggtcccttagagaaacagcatgccttggaaaatcgtacgcgcaaatgtggcaattaatgtatttccataggcgtgatctcagattagccgctaacgccatttgtagtgcggtgccggttgactgggttcccacgagcagaacaacatggtcgattcatgcacatcaccagtggatgacgactgaagatatgttgagtgtttggaatcgagtatggatagaagagaatccatggatggaagacaagacccatgttagctcatgggaggatgtaccttatttggggaaaagagaagatcaatggtgcggttcgttaataggattaaccgcacgtgctacctgggctactaatatccaagtcgccataaaccaagttagacgacttattggaaatgaaaattacctagactatatgacgagcatgaagagatttaaaaatgagagtgaccctgaaggagcactatggtaa

SEQ ID NO: 22080 - RNA, 9879 nt, synthetic construct
  misc_feature 1..9879: note = derived and/or modified CDS sequence (opt6) from DENV-1__JQ915072__SS-prME
  source 1..9879: mol_type = other RNA
agtgttacaatgcttttaatgcttctgcctacagtattaacgttccatctcactactagaggaggtgagccacacatgatagtaagtaaacaagagagaggaaaatcgttacttttcaaaacgtcagctggggtgaatatgtgtacacttatcgcaatggacttaggagagttatgcgatgatactatgacatataaatgtccaagaataactgagacagaaccggacgacgtcgactgctggtgtaatgcaacagaaacgtgggtcacatatggtacctgttcgcaaacaggcgagcatcgccgcgacaaaaggagtgtagcactagcgccacatgtggggctaggtctagagactcggacagagacatggatgagcagcgaaggagcgtggcggcaaattcaaaaagtagaaacatgggcactaagacacccgggttttacagtaatagctttgtttcttgcgcatgcaattggaacatcaatcacgcaaaaaggcatcatttttatcttactgatgcttgtaacaccttcaatggcaatgagatgcgttggtataggcaatagagacttcgtagagggattaagcggggctacatgggttgatgttgtactcgaacacggcagttgtgtaacaaccatggctaaggataaacctacgttggacatcgaattactaaaaaccgaggtaacaaacccagcagtgttaagaaaattatgtatagaagcaaaaataagcaatacaactacagatagtcgatgtcctacacaaggcgaggcaaccttagtagaagaacaagatacgaacttcgtgtgtcgtcgaacgtttgtagacagaggctggggtaatgggtgtggtttatttggaaagggatccttgataacttgtgccaaattcaaatgcgtgacgaagttagaaggaaagattgttcaatatgaaaatttaaagtattccgtaatcgttacggttcatacgggagatcaacatcaggtcggtaacgagacaacagagcatgggacaatagcaacgataacccctcaagcaccgacatctgaaattcaattaacagattacggggcactaaccttggattgtagtccgagaacaggactagactttaatgaaatggttttacttactatgaaagaaaaatcttggttagttcataagcagtggtttcttgatctaccacttccttggacaacaggagcaagcacgtctcaagaaacctggaatcggcaggacttacttgtgaccttcaaaacagctcatgccaaaaagcaggaagtcgtagttctaggtagccaagaaggggcaatgcatacagctctgacaggcgctacggagatccaaacatccggtacgactacaatttttgccggtcatttgaagtgccgtctgaaaatggataaacttactttgaaaggaatctcatatgtaatgtgcacagggtctttcaaattagagaaagaagtagcggagacccaacatggcacggtgttagtacaagtaaaatatgaaggtacagatgccccctgcaaaatccccttctcctcgcaagatgagaaaggagtcacgcaaaacgggaggttagtgacagctaatccaattgtcacggataaagaaaaaccggtcaatatagaagccgaaccaccatttggagaaagttatattgtcgtaggagccggcgaaaaggctctgaagctctcttggttcaagaaaggaagctctattgggaagatgtttgaagctaccgcacggggcgcccgtcgtatggcgatcttgggtgatacagcatgggatttcggatcgattggtggtgtatttacatctgtcggtaaattagtacatcagattttcggaactgcctacggagttctttttagtggagtttcctggacaatgaagattggtataggtattttgctaacttggttaggactaaattccagatcaacgtctctctcaatgacgtgtattgccgtaggaatggtaacgctatatttaggcgtaatggtacaagctgattccggatgtgtcataaactggaagggaagagagctgaagtgcggttccggaatctttgtaacaaacgaggtacatacatggacggaacaatataaatttcaggcagactcccctaaacgtctctcagcagctataggtaaggcatgggaagagggcgtatgcggaataagaagcgcaacacgtcttgaaaatattatgtggaaacaaatatcaaacgaactaaatcatatattattagagaacgatatgaaattcacagtcgtagttggcgatgtgagcggaatactagctcaggggaagaaaacaatacgcccccagccaatggagcataaatacagttggaagtcatggggaaaagcaaaaatcataggcgctgatgtgcaaaacacaacatttatcatcgacggaccaaatacaccagaatgccctgatgatcaaagagcatggaatatctgggaagttgaagattacggattcgggatctttaccactaatatttggttaaaattaagagattcatacactcaagtttgtgaccatcgtttaatgagtgctgcgataaaagactccaaagcagtacatgctgatatgggatattggatcgaatctgagaaaaatgaaacctggaagctggcgcgcgcatcctttattgaagtaaaaacatgtgtctggccgaaatctcatacactatggtcaaatggtgtgttagaatcggaaatgatcatccctaaaatatatggagggcctatatcgcagcataattacagaccagggtattttacccagacagcaggtccttggcatttaggaaaacttgaattggatttcgacttatgtgagggaactacagtagtcgtggacgaacattgtgggcaccgaggacccagcttaaggaccactaccgtaactggaaagataattcacgagtggtgctgcaggagctgtacgctcccacccctcaggttcaaaggagaggacggatgttggtacggaatggaaattagacctgtcaaagaaaaagaagagaacctagtaaaatctatggtgtcagctggtagtggagaagtggattcttttagtttaggactcttatgtatatcaataatgatagaggaagttatgaggagccgctggtcacgtaaaatgctaatgacaggtacattggtagtatttttattgctaactttgggccagttaacgtggaatgaccttattaggttgtgtataatggtaggcgctaatgcatcagacaacatgggcatgggtacaacttatttggcacttatggcaacctttagaatgaggccaatgttcgctgtaggattactatttagaagactaacaagtagagaagtgctcttattaacagtaggattatcgctcgttgcatcagtagagctaccaaattcattagatgagctaggtgacggtctagcaatggggatcatgatacttaaacttttaactgactttcagtcacatcaactttgggcgactctattgagtttaaccttcgtaaaaacaacgctatctttacattatgcatggaaaacgatggctatgattctttccattgtatcactattaccactctgtctatccactacaagtcagaaaactacctggttaccggtcttgctagggtcactcggttgtaaaccactaaccatgtttcttatcacggaaaacaaaatatggggacggaaaagttggccactcaatgaaggcatcatggcggtggggatagtgtcaatccttctcagctcattattgaaaaatgacgtccctctagccggccccttaatagccggtggtatgcttatcgcatgttacgtcatatccggatcttctgcggacctatccctagaaaaagcggcaaaagtctcatgggaagaagaagctgagcacagtggagccagtcacaacatattagtcgaaatccaagacgacggaacgatgaagataaaggatgaggagagagatgacacgataactattttgcttaaagccactctgctcgcaatatcgggcgtatatccaatgtcgataccagctaccttgtttgtctggcatttctggcagaagaaaaagcagaggtcaggtgttttatgggatacacctagcccaccagaggtagaaaaagcagtacttgacgacggtatttatcgcattctacagcggggactacttggtcgttctcaagtaggtgtaggagtatttcaagagggcgtattccataccatgtggcacgtcaccaggggagcagtacttatgtatcaaggaaaacgtttggaaccgtcttgggcttcagttaaaaaggacttaattagttatggcggtggatggcgtttccaaggatcatggaacatgggggaagaagtccaagtaatagctgttgaaccaggtaaaaatcccaaaaatgtacaaacggcccccggcactttcaagacatcagaaggtgaagttggcgctatagcgctagattttaaaccaggaacttctggatctccaatagttaatagagagggcaaaatagttggactatatgggaatggagtagtaacaacaagcggaacttacgtgtctgccatcgcacaagctaaagcatcacaggagggaccactaccagagatagaagatgaagtatttaggaaaagaaacttgactataatggatctacaccccgggtcgggaaaaactagaagatacctaccagccatcgtcagagaggctattaaaagaaaattaagaaccctagtattagccccaactagagtagtagcgagcgaaatggcagaggctttaaaaggcatgccgatccgttaccaaacgactgctgttaaaagcgaacataccggtaaagaaattgtggatttaatgtgccatgcaactttcaccatgaggctactatcaccagttagagttccgaactacaacatgattattatggatgaagcacattttacagatcctgcttcaatagcggcaagaggctatatctccacacgcgtcggcatgggagaagcagctgcaatcttcatgacagcaactccacctggaagtgtagaagcatttccacagtctaacgccgtaatacaagacgaagaaaaagacattcctgaacggagctggaatagcggatacgactggataacagatttccctgggaaaactgtctggtttgttccatcaattaagagtggaaatgatattgcgaactgtctccgtaagaacggaaagcgagtaatacagttgtcccgaaagacgttcgatacagagtaccagaaaactaaaaacaatgactgggattacgtagtgacgacagatatatctgaaatgggcgctaatttcagagctgatcgagtgatagaccccaggcgatgcttgaaaccagtcatacttaaagacggaccggaacgggttatactggccgggccgatgccggtaacagtcgcatcagccgcacaaagacgtggaagaataggccgtaatcaaaataaagaaggcgatcaatatatttacatgggtcagcctcttaataatgacgaagaccatgcccattggactgaggcgaaaatgctcttagacaatattaacacgcccgagggcataatccctgccctatttgaacccgaaagagagaaatcggccgccattgatggagagtaccgtcttcgaggagaagcgcggaaaacattcgtagaactaatgagaagaggcgacttgccggtgtggttgtcgtataaggtggcgtcagaaggatttcaatattcagaccgacgttggtgcttcgacggagaacgcaacaatcaagtactagaagagaacatggacgtagaaatatggactaaggaaggagaacgaaagaaactaagaccccgctggttagacgctagaacatactctgatccacttgccttaagggagtttaaagaatttgcagccggacgtagaagcgtttccggcgacctaatcctcgaaatcggtaaactacctcaacacttgacgcaacgagcccaaaacgcacttgacaatcttgttatgttacataatagcgagcagggaggtaaagcatatagacacgccatggaagaattgcccgacacaatagagacaataatgcttctagcattaatcgctgtattaacaggaggagtgacactcttctttttaagcggccgtggtctaggaaaaaccagtataggcctattatgcgttacaagcagtagtgcattattatggatggcaagtgtagaaccacattggattgccgcatctataattttagagttcttcttgatggtattgctaataccagaaccagaccgacagcgaacgccacaggataatcaattagcatatgtagtaatcggattgctctttatgattctgacagtagcagcgaatgaaatgggcttgctagaaacaactaagaaagatttaggtataggccatacagcggcagaaaaccatcatcacgcagcgatgctagatgttgatcttcatccagcctccgcgtggacactatacgcagttgcaacaacaataatcacccctatgatgagacatacaatagaaaatactacagctaatattagcttgactgccatagcaaatcaagctgcgatacttatgggccttgacaaaggatggcctatatccaaaatggatataggcgttcccttactcgcactaggatgttacagccaggtcaatcccctaactttgactgctgcagtattaatgctagtggcacactatgccattatagggccaggattgcaagccaaggcgactagagaagcacagaagcgcacagctgcagggataatgaaaaacccaacagtagatgggatagtagcaatagatttagacccggttgtgtacgatgcgaaatttgaaaaacaattaggacaaataatgttgctaatactatgcacatcccaaatactgttgatgagaacaacatgggctctatgtgagagtataactcttgccacaggaccattaaccacattatgggaaggaagcccaggaaagttctggaatactacgatagccgtctcgatggcaaatatatttaggggaagttatcttgccggtgcaggtttagcattctctttgatgaaaagtctcggtggaagtagaagaggcacgggagctcaaggcgagactctgggcgagaagtggaaaaggcaattaaatcaattatctaaaagtgaatttaacatatacaaaagaagtggaataatagaggtagacagatccgaggctaaagaaggacttaaaagaggtgagacgacaaagcatgctgtttcaaggggcactgcaaagttacgatggtttgtggaacggaatctagtgaaacctgaaggaaaggtaatagatttgggatgcgggagaggtggatggagttactattgcgccggactcaaaaaggtcactgaagtaaagggatatacaaaaggtggaccaggccacgaagaaccaattccaatggctacttacggatggaatctagtgaaacttcactcaggcaaagacgtcttcttcattccaccagagaaatgtgataccctgctctgcgatataggagagagcagtccaaatccaacaatcgaggaaggtcgaacgttgcgtgtccttaagatggtagaaccctggttacgtggcaatcaattttgcataaaaatactaaatccttacatgcctagtgtagtagaaactttagaacagatgcaaagaaaacacggaggaatgcttgttcgtaatcctttatcgagaaacagtacccatgaaatgtattgggtgagttgtggaacgggaaatatagtatcagcggtaaacatgacatcacgaatgttattaaaccgcttcactatggctcaccggaaacctacgtatgaaagagatgtagacctgggagccggaactaggcatgtggcggtggaacccgaagtggcaaatcttgacataattggacaacgaatcgaaaatatcaaaaatgaacacaaaagcacttggcattacgatgaggataatccatacaaaacgtgggcgtatcacggctcatatgaagtcaaaccatcagggagtgcgagctcaatggtaaacggagtagtcaggttacttactaaaccatgggatgttataccaatggttactcagattgcaatgacagatacgactcctttcggccaacaacgcgttttcaaagaaaaagttgacactaggactccaaaagcaaaaaggggaacggctcaaataatggaggtgacagctaaatggttatggggtttcctaagccggaacaagaaaccccgaatttgtacccgcgaagagttcacaagaaaggtgcgtagcaacgcagccataggtgcagtcttcgtagacgaaaatcaatggaactcggcgaaagaagcagtcgaagatgaacgattctgggacttagtgcgacgggaacgcgaattacacaagcaggggaaatgcgcaacgtgcgtgtacaatatgatgggtaaaagagagaagaaactaggggagttcggcaaagctaagggctctagagcaatttggtatatgtggttgggagcaagatttctcgagttcgaggcccttggttttatgaatgaagaccactggttttcgcgagaaaactctttgagtggggtagagggagaaggtttacataaacttggttacatcttacgagatatatcaaagataccaggaggaaacatgtacgccgatgataccgcgggctgggatacgaggattacggaagaagacttacaaaatgaagccaaaattacggacataatggaacctgaacatgctttactagccacaagtatatttaaactcacataccagaacaaagtcgtgcgagtgcaaaggccagctaaaaatgggacagtaatggacgtgatttcgaggagagatcaacgcgggtccggccaagtagggacatacgggctcaacacgtttacgaatatggaagcacaattaattcgacaaatggagtcagaaggtatattctcgccatctgagctcgaaactccaaatctcgccgggcgggtgttggattggctagaaaaacacggaatagaaagactaaggcgcatggcaatatctggtgatgattgcgtagtcaaacccatagatgacagattcgctacagcccttacagcattaaatgatatgggaaaagttcgcaaagacatcccccaatgggaacccagtaaggggtggaacgactggcaacaagttcccttttgttctcatcatttccatcaactcataatgaaagacggacgggaaattgtagtaccttgtagaaatcaggacgaattggttggtcgtgcaagagtaagtcagggtgctggctggagcctgagagagacggcttgtctaggaaagagctatgcacaaatgtggcaactgatgtattttcatcgaagagacttacgactcgctgcaaatgccatatgttcagcagtgcctgttgattgggttccaacaagccgcacaacgtggagtatacatgcccatcatcagtggatgacgacggaggacatgctaagtgtttggaaccgagtttggattgaagaaaatccctggatggaagacaagacacatgtaagtagttgggaggatgtaccgtatttgggcaaaagggaggatcagtggtgtgggagtctcatcggattaacagctcgagcaacttgggccacaaatatacaagtggctataaaacaggttcgaagattaataggaaatgaaaactatcttgattatatgacttcgatgaaacgattcaaaaatgagtccgacccagaaggagcactatggtga

SEQ ID NO: 22081 - RNA, 9879 nt, synthetic construct
  misc_feature 1..9879: note = derived and/or modified CDS sequence (opt6) from DENV-1__JQ915071__SS-prME
  source 1..9879: mol_type = other RNA
agtgtcactatgttgctaatgcttctacctacggttctaacatttcatttaacaactagaggaggagaaccccacatgattgttagtaaacaagaacgaggtaaaagtttactattcaaaaccagcgcaggagtgaacatgtgtactttgattgcaatggacttgggcgaattgtgtgacgacaccatgacctacaaatgtccgagaattacagaaaccgaacctgacgacgtggattgttggtgcaatgctaccgaaacgtgggtcacctacggtacatgtagccaaaccggagaacacagaagagataaaaggtcagttgcactagcaccccacgttgggttaggtttagaaacgaggacagaaacgtggatgagcagcgaaggcgcatggaggcaaatacaaaaagtggaaacttgggcccttagacatccagggttcactgtaatagccttgtttctcgcacatgcgataggtaccagtataacacaaaaaggtataatttttattcttctaatgttggttacaccgagcatggccatgcgttgcgtcggaataggcaaccgcgatttcgttgaagggttaagcggtgctacgtgggtcgacgtagtattagaacacgggtcttgcgtaacaacaatggcaaaagataaaccaactttagatattgaactcctcaaaaccgaagtaacaaatcccgcagttttgcgaaaattatgcattgaagcaaaaatttctaacactacgacagattcaaggtgtcccacgcaaggagaagcaacactggttgaagaacaagatacaaatttcgtttgccgcagaacttttgtagacagaggatggggaaatggatgtggtctctttggaaaaggaagtctaataacttgtgcaaaatttaaatgtgcgacaaaattggaaggcaaaattgttcaatatgaaaacttaaaatatagtgtgatagttacagtccatacaggtgatcaacaccaagtaggaaatgaaacaaccgaacatggaacaatagcgacaattacgccacaagcaccaacttctgaaatacaactgacagattacggagctttaacattagactgtagcccaagaacagggctagacttcaacgagatggtcctactgaccatgaaagagaaaagttggttagtacacaaacaatggttcctggacctaccactaccatggacaactggcgcttcaaccagtcaagaaacttggaatcggcaggacctattagtaaccttcaaaacggcgcatgctaagaagcaagaagtcgttgttctgggatcacaggaaggggctatgcacacagcgttaacaggagcaactgaaatccaaacgtcaggaaccacaacaatttttgcaggacacttaaaatgtcggttaaagatggacaaattgactttgaaaggcatatcgtatgtgatgtgtaccggatcatttaaactggaaaaagaagttgcggaaacgcaacacggtactgtattggtacaagttaaatatgaaggaaccgacgcgccatgtaaaatccccttcagtagccaagatgaaaagggtgttacacaaaacgggagacttgtaacggctaaccccatcgtaacggataaggagagacccgtcaacattgaagctgaacccccattcggggaatcatatatagttgtcggagcaggggagaaagccttgaaactatcatggtttaaaaaggggagcagcataggtaaaatgtttgaggcaacagctcggggagcaagaagaatggcgattcttggtgatacagcatgggatttcggtagtataggaggggtatttacatcagttggaaaacttgtgcatcagatatttggtaccgcctatggtgtactattttcgggtgtgagctggactatgaagattggcataggtatcttattaacttggctaggattaaactcacgaagcacctcattatccatgacatgcattgccgtaggtatggtaactttatatctaggagttatggtccaagcagactcaggatgtgtaataaactggaaaggcagagaattgaaatgcggttctggaatctttgtaaccaatgaagtccatacgtggacggagcaatataagtttcaagctgactctccaaaacgtttatctgctgcaataggcaaggcttgggaagaaggtgtatgcggtatacgatcagcaactagattggaaaatataatgtggaaacagataagtaacgaactgaatcatatcttattagagaatgacatgaaattcacagtagttgtaggcgatgtgtctggcatcctcgcacaggggaaaaagacaataagaccacaaccaatggagcataaatactcatggaaatcgtggggaaaggcaaaaattatcggagctgatgtacaaaatacgacgtttataattgacgggcctaatacgcctgaatgccctgatgatcagagagcttggaatatatgggaggtagaagattatggctttggaatattcacgaccaacatatggctaaagctgcgtgatagttacactcaagtttgcgaccatagattaatgtctgctgcaataaaagactcaaaagcagtgcacgcagacatgggctactggattgaaagtgagaaaaatgagacatggaaattggccagagcatcgttcatcgaagtaaaaacatgtgtgtggcccaaaagtcatacgttatggtcaaacggagtactagaatcagaaatgattataccgaaaatatatgggggtccaatttcgcaacacaactacagaccagggtatttcacacaaaccgctggaccttggcacttaggaaaactcgaacttgattttgacctatgtgagggaacaaccgtagtagttgacgagcattgtggtaatagaggcccaagccttagaaccaccacagtcaccggcaagattattcatgagtggtgttgcagatcatgtacattacctccactccgattcaaaggtgaagatggttgctggtacggtatggaaataagacctgttaaagaaaaagaggaaaacttagtcaaatctatggtaagcgcaggatcaggagaagtagatagctttagtctaggactactatgcatatcaattatgattgaggaggttatgaggtcaagatggtcgcgcaaaatgctcatgacaggtacccttgtggtctttttgctcctaactcttgggcaattaacgtggaatgacctaattaggctgtgtataatggtcggggcaaacgcatctgataatatgggtatgggcaccacatatttagcccttatggccacattcagaatgagaccgatgtttgcggtaggattattatttcgtcgactcacgtcacgagaggtactcttactaacagttggcctaagtctagtagctagcgtagagcttccaaatagcctggatgaactcggagacggtctagcaatgggaataatgatcctcaaactgctaaccgacttccaaagccatcaattatgggccaccttactgtcattaactttcgtgaagacaactctttcactacactatgcgtggaaaactatggcaatgattttatcgatagttagcttactacccttatgcttatctacaacctcacagaaaaccacatggctacctgttctccttggtagcctcggatgtaaacctttaacaatgtttcttattacagagaataaaatatggggtagaaaatcgtggccacttaatgaaggaataatggccgtaggcatagtatcaatattactttcaagtctactcaaaaatgatgtcccattagcaggacccttaatcgcgggtgggatgctcattgcatgttacgttatatcaggaagctcagcggatttaagtttagaaaaagcagcgaaggtatcatgggaagaagaggccgagcattctggtgcaagtcataacatcctagtagaaatccaggatgacggaactatgaaaattaaagacgaggagagagacgatactatcactatactcctcaaagctacccttctagcaatcagcggcgtttatccgatgtcaataccggctacactgtttgtatggcatttctggcagaagaagaaacaaagaagtggggtgctatgggatacaccaagtccgcctgaagtagagaaagccgtgctcgatgatggaatatatcgtattctacagagagggcttttaggacgttcgcaagtgggggtgggtgtttttcaagaaggagtgtttcataccatgtggcatgtaaccagaggagcagtattaatgtatcaagggaaacgtcttgaaccatcttgggccagtgtcaagaaagacctgatatcatatggagggggctggagattccagggaagttggaacacaggagaggaggtccaagtaatagccgttgaacccggcaaaaatcccaaaaacgtgcagaccgccccgggcacattcaagacgagcgaaggtgaagttggagcaattgcactagacttcaaacccggaacaagtggttcaccaatagtaaacagggagggtaagattgtaggattatatggcaatggtgttgtaacaacatctggaacgtatgtaagtgctatagcacaagcaaaagcaagtcaggaaggtcctttaccagagatagaagatgaagttttcagaaaaagaaacttaacgataatggatttacatccaggctccggtaaaaccagacgatacttgccagcgatagttagagaggcaatcaagcgtaagttaagaactttagtactcgctcctacaagggtggttgcatccgaaatggcagaggctttaaaaggaatgcctataaggtatcaaacaacagcggtaaaatccgaacacacagggaaagagatagtagacttaatgtgccacgcaactttcaccatgagattacttagtccggttagagtgccaaactataatatgataataatggacgaggcacacttcacagatcccgcatctatagcagcccggggttacatctcaacgagagtaggaatgggcgaagcagcagcaatttttatgacagccactccacccggatctgtagaggcattcccacaaagtaatgccgtaatacaggatgaagagaaagatatccctgaacggtcctggaactccggatatgattggattacagacttcccagggaagactgtatggtttgttccatcgatcaaatcgggaaatgacatcgcaaattgtttaaggaaaaatgggaaaagagttattcaactaagcaggaagacctttgatactgaataccaaaagactaaaaacaacgactgggattatgtggtaacgacagatatctcagaaatgggtgcaaatttcagggctgaccgagtaatcgacccgcgacgttgtttgaaaccagttatccttaaggatggacccgaacgggtcatactagcgggacctatgcccgttacagtagcgtcagcagcacaacgtagaggtaggatcggccgaaatcaaaacaaagagggagatcagtacatttacatgggacaaccactaaataacgacgaagaccacgcacactggaccgaagcaaaaatgctccttgacaatataaatacacccgagggcataataccagcgctattcgaaccggaaagagagaaaagcgctgctatagatggtgaatataggttgagaggggaagcacgaaaaacctttgttgaactaatgcggagaggcgatctgccagtgtggctaagttacaaagtggcaagtgaaggattccaatacagcgacagacgatggtgctttgacggagaacgtaataatcaagtgttggaggaaaatatggatgtagagatctggactaaagagggagaaaggaagaaattaagacccaggtggctagatgcgcgtacatattcagatccgctagccttaagagagttcaaagaatttgcagcgggtagaagatcggtatcaagtgacctaatactagaaatcggaaaattaccgcagcacctgacgcagcgcgctcagaatgcactagataatttagttatgctccataattcagagcaaggaggaaaggcttatcggcacgccatggaggagctacccgatactatcgagaccataatgctattagcgctaattgcagtattaaccggcggggttaccttattctttttatcgggcagaggtttaggtaaaaccagcattggactactatgcgtaacatccagtagtgctctcttatggatggctaatgtcgaaccgcactggattgctgcaagtattatcttggagtttttcttaatggtactcctaatacctgaacctgacaggcagcgaacccctcaagacaaccagttagcctatgtagtaataggccttcttttcatgattttaacagtagcagccaacgaaatgggattattagaaacaacaaagaaagacctaggtataggtcatacggccgccgaaaaccatcatcatgcagcaatgctagatgttgatttacatcctgcatccgcatggacactttatgctgtcgcaacaacgataattaccccgatgatgcggcatacaattgaaaatacaactgctaatatatcgttaactgcaatagccaaccaggctgcaattctaatgggattggataaagggtggcctatttctaaaatggatattggagtgccactcttagcgttgggatgttattcacaagtaaacccccttactttaacagcggcagtcttgatgctagtagcacattatgctataataggaccaggtctacaggcaaaagccacaagagaagcgcagaaaagaactgcggccgggatcatgaaaaacccgacagttgatggaattgtagcaattgatttggatcctgttgtctatgacgcaaagttcgaaaaacaactcggtcaaataatgttactaatcttgtgtacttcccaaatacttctcatgagaacaacttgggctttgtgtgaaagtataacgttggcaacaggacctctaacaaccctgtgggaagggtcgccggggaaattttggaatactacaatagctgtctctatggctaacatattcagaggttcatacttagccggtgcaggtttagctttctcccttatgaaatcactaggtggtggtagacgaggaacaggtgcacaaggtgaaactttgggcgaaaaatggaaaagacaattaaatcaactgtcgaaaagtgagtttaacacgtataagagaagcggcataatagaagtcgacagaagtgaagcaagggagggcctcaaaagaggagaaacaacgaaacacgcagtatcaagaggcactgcaaaattgaggtggtttgtcgaacgtaatctggttaagccagaaggaaaagtgattgacctgggatgtgggcgtggtgggtggtcatattactgtgccggactcaagaaagtaaccgaggttaaaggatatactaagggcggacccggccacgaagaaccaataccaatggcaacttacggttggaacctagtaaaattacatagcggaaaagacgtattctttatacccccagaaaagtgcgatacccttctgtgtgatataggggagtcttcacctaaccccacgatagaagaaggaaggacattacgagtactcaaaatggtagagccatggttgaggggtaatcaattttgcataaaaatactcaacccgtacatgccttcagttgtagaaacactggaacaaatgcaaaggaaacacggaggaatgcttgtacgaaatcccctatcacgtaacagtactcacgagatgtactgggtaagctgtgggactggaaacatagtttccgcggtgaatatgacaagtagaatgctactaaacagatttacaatggcacatagaaaaccgacatacgaacgtgacgtcgatctaggtgcgggtacaaggcatgttgcagtcgaaccggaagtagccaatctggacattatagggcaaagaatcgaaaacatcaaaaacgaacacaaatcaacatggcactatgatgaagataacccatacaaaacgtgggcataccacggtagttacgaagttaagccttctggaagcgcatcatcaatggtcaatggagtcgttagattactgactaaaccttgggatgttattccgatggtcacgcaaatcgctatgacggacacaaccccatttggtcagcaaagggtatttaaagaaaaagtagacacgcgcacgccgaaagctaaacggggcacagcgcaaataatggaagttacagcaaaatggctctgggggttcttatctcgaaataagaaacctcgaatctgtacacgagaggagttcactagaaaagtcaggagcaatgcagcaataggtgcggtcttcgtcgatgaaaaccagtggaactctgcaaaggaagcagtcgaagatgaaaggttctgggacttagttagacgggaaagagaactgcataagcaaggaaaatgcgccacatgcgtatataacatgatggggaaacgagagaagaaattaggagagtttggtaaagcgaagggtagccgcgcaatatggtacatgtggctaggtgcaagattcttagagttcgaggcgctcggctttatgaatgaagaccattggttttcaagagaaaacagcctatctggagtggaaggtgagggtcttcacaaactaggctatatactacgagatatatcaaagataccaggaggtaatatgtacgcggacgatactgccggatgggacaccagaatcactgaggaggacttacaaaatgaagcaaaaataacagacataatggagccagaacacgccctactggcaacatcaatttttaaattaacataccagaataaagttgttagagttcaacgcccggctaaaaatggaactgtgatggatgtcattagtagaagagaccaaagaggttcaggacaagtcggtacttatggactaaatacattcacgaatatggaggcacaactaatccgacaaatggaatcagagggaatattctctccatcagaattggagactcctaacctagctggcagagtactagactggctggaaaaacatggaattgagcgactacgacgtatggcgataagtggggatgactgtgtagtaaagccgatagatgacagatttgccaccgctttaacggctctaaatgatatgggaaaagttagaaaagatattccacaatgggagccatcaaaagggtggaacgactggcaacaagtacctttctgctctcatcactttcaccaactcattatgaaagacggaagagagattgtcgttccatgtcgcaaccaagatgaattagtgggcagagcaagagttagccaaggtgcgggatggtcactgagagaaaccgcatgcttaggcaagtcttatgcacaaatgtggcaacttatgtactttcacaggagagacctacgtttggcggctaacgcgatatgctctgcagtaccggtcgattgggtgccaacatcgcgaaccacgtggtcaatccatgcgcatcatcagtggatgacaacagaggatatgctctcagtttggaacagagtttggattgaggaaaatccatggatggaagataaaacgcatgtatcgtcatgggaggacgtcccatacctaggaaagagagaagaccagtggtgtggtagcctcataggcttaacagcacgcgcaacatgggcgactaacattcaagttgccatcaatcaggtgaggaggttaataggaaacgaaaattatttggactacatgactagcatgaaaagatttaaaaatgaaagtgacccagaaggggcactgtggtaa

SEQ ID NO: 22082 - RNA, 9879 nt, synthetic construct
  misc_feature 1..9879: note = derived and/or modified CDS sequence (opt6) from DENV-1__JQ915073__SS-prME
  source 1..9879: mol_type = other RNA
tcagtgacaatgctacttatgttactcccgacagttctcacattccatctaacaacacgtggtggggaaccacacatgatcgtctctaaacaagaaagaggaaagagcttattattcaaaacatctgccggagtgaacatgtgtactttgattgctatggatctaggagaattatgcgatgacaccatgacttataaatgtccaagaattactgagaccgaaccagacgatgtcgattgttggtgcaatgctacggaaacatgggtgacatatgggacatgttttcaaacaggagagcatcggcgagataaacgaagtgtcgcgttagcccctcacgtaggattaggactagaaacaagaacagaaacctggatgtcttcggaaggggcatggagacaaatacaaaaagtggaaacatgggctctaagacacccgggttttactgtcatagccttattcttagcccacgcaataggaacttcaataactcaaaaaggaattatattcatccttttaatgctagtgacaccaagtatggcaatgagatgcgttggcataggaaatagagattttgttgagggactatctggtgcaacttgggtagatgtagtcctagagcacggatcatgtgttactaccatggctaaagataaacctacgttagatattgagttacttaaaacagaagtaactaacccagcagtactccgtaaactttgcatagaagccaaaatatcaaacacgacaaccgatagccggtgtccaactcaaggtgaggcgactctggttgaagaacaagacactaattttgtatgccgacgtacctttgtagataggggctggggtaacggatgtggattgttcggtaaaggaagtcttataacttgtgctaaatttaaatgtgtcacaaaactcgaaggaaaaatagtacaatatgaaaatttgaaatattcggtaattgtaacagtacatacaggagatcaacatcaagttggaaatgaaacaacggaacatggtactatagcaaccatcactccacaagcgcctacttcagaaatacaattaacggattacggggcgcttaccttggattgcagtccaagaactggcctagactttaatgaaatggtactacttacgatgaaagagaagtcttggttggtacataaacaatggtttttagatctacccttaccatggacgacaggagcatcgacatcacaagaaacttggaacaggcaagatctcctagtaacattcaaaaccgcacatgccaaaaagcaagaggtggttgtcttaggatcacaagaaggtgcaatgcatactgccttaactggagcaacagaaatacaaacatcagggactacaactatttttgcaggccatctaaagtgtcgattaaaaatggataaattaacgctaaaaggaataagttacgtcatgtgcactggaagttttaagttggaaaaagaggtggcagaaactcaacacggaacggtacttgttcaggtaaaatacgaaggaacagatgctccgtgtaaaataccatttagtagtcaagacgaaaaaggagtaacacagaacggaagacttgtaacagcgaatcctatagtaacagataaagaaaaacctgtgaacatagaagcggaaccaccgttcggagagagttatattgttgtcggtgcgggcgaaaaagccttaaagttatcgtggttcaagaaaggaagtagtataggcaaaatgttcgaagcaactgcgcgtggggcacgacgaatggcaatcctaggtgataccgcttgggatttcggtagtataggcggcgtatttacgagtgtcggcaaactggtacatcaaatctttggtaccgcctacggagtgctgttttcaggtgtatcatggactatgaaaatcggtattggaatacttcttacatggcttgggctcaactctcgcagcacgtctttgtccatgacatgtatagccgtcggcatggttactctatatctcggcgtaatggtacaagccgattcaggatgtgtaataaactggaaaggtcgggaattaaaatgtgggtccggtatatttgtaaccaacgaggtacatacatggacagaacaatataagttccaggcagattcccctaagagattaagtgctgcaattggtaaggcttgggaagaaggcgtatgtgggataagaagcgcaactcggcttgaaaatataatgtggaagcagatcagtaacgaactaaatcacatcctattggagaacgatatgaagtttactgtcgtagtgggagatgtaagtggtatattagctcaaggaaagaaaaccatccggccccaaccaatggaacacaaatactcttggaaatcatggggaaaagctaaaataatcggtgcagatgtccaaaacacaacttttattatcgacggtccaaatacacccgaatgtccagatgatcaacgagcctggaatatatgggaagtagaagattacggatttggcatctttactacaaatatttggctgaagctaagagactcgtacacgcaggtttgcgatcaccgtttaatgagcgcagcaataaaagattcgaaggctgttcacgccgatatgggctattggattgaaagtgagaaaaatgaaacctggaagttagctagagcttcatttattgaagtgaaaacatgcgtatggcctaaaagtcacacgttgtggagcaatggcgtacttgagagtgaaatgattataccgaaaatttatggaggcccaatatcacaacataactacaggccaggttactttacccagacggccggaccttggcatttaggtaaattagagttggactttgacttatgcgaaggtactacggtcgtagtagacgaacattgtggtcatcgagggccatccttacgaacaaccaccgtgacgggtaaaattatacatgagtggtgctgtagaagttgcacactgcccccattgagatttaagggcgaagatggctgttggtacggaatggaaatacgtccagtgaaggaaaaagaagaaaatcttgtaaaaagtatggtatccgcgggaagcggcgaagtagattcatttagccttggattgctgtgcataagtataatgatagaagaagtgatgcgatcgaggtggagtcgaaaaatgctaatgacgggaactcttgtagtcttccttttactaaccttaggccagctaacgtggaatgacttgattagactatgtatcatggttggtgcaaatgcctcggataatatgggtatgggaacaacttatctggcattaatggcaacattccgcatgcgccccatgttcgcagtaggattattgttcagacgattaacaagcagagaggtgctattattaactgtaggactttctttagtagccagcgtcgaactccctaatagtctagatgagttaggagatggcttggctatgggaattatgattttaaagttattaacagacttccagtctcatcaattgtgggcaacccttctatcgttaacttttgtaaaaaccacactgtccctacactatgcatggaaaaccatggctatgatattatctatagtatcgcttttaccactatgcctttccaccacgtctcagaaaactacatggctccccgtactgttgggaagtctaggatgcaaaccactcactatgtttttgatcacggaaaacaagatctggggaagaaaatcttggccgctaaacgaaggtattatggcggtaggtatagtgtctattctgttatcctctctcctcaaaaacgacgtaccattagctggacctttaattgcaggaggtatgcttattgcctgctacgtaataagtggctcatcagcagatctaagtcttgaaaaagctgcaaaagttagctgggaggaggaagcagaacattctggcgcgtcccataacatcctggtagaaatccaagatgatggtacaatgaagatcaaagacgaggaaagggatgatacgattacaatactattaaaagctacactgctagctatatcaggtgtatatcctatgtcgatacccgctacattattcgtatggcatttttggcagaagaagaaacaacgatctggtgttctctgggatacaccatctccccctgaagtagaaaaagctgttctggatgatggaatttatcggattttacaacgaggattacttggccgatctcaggtgggagtcggagtattccaagaaggagtttttcacaccatgtggcacgtgactcgtggggccgtcctcatgtatcaaggaaaacgtctggagccatcctgggctagcgtgaagaaagatctaatttcctatggcgggggttggagatttcaaggaagctggaatactggtgaagaagtgcaagtcatagcagtcgaacctggcaaaaatcccaaaaatgtgcagacaaccccagggacattcaaaacttccgaaggagaagtaggcgcaatagcccttgactttaagccaggaacatcaggatcaccaatcgttaatagagaaggaaagatagtaggattatacggaaacggtgtcgtcacaacctcaggaacatatgtatctgctatagcccaggctaaagcatctcaggaaggacctttaccagaaatagaagacgaagtctttcgtaaacgaaatctaactataatggatttacatcctggttcgggcaaaactcgaagatacctgccagctatagtaagagaagctataaaaagaaaattgagaacgttagtgcttgcgccaacaagagttgttgcaagtgaaatggctgaagcactaaaaggtatgcccataagatatcaaacgaccgcggtaaaaagcgaacacacaggcaaggaaatagttgatcttatgtgtcatgctacgttcactatgcgattgttgagccctgtaagagtacctaattacaacatgataatcatggatgaggctcatttcactgatccagcttcaatagcggcaagaggatatatcagcactagagtaggcatgggggaagcagccgctatctttatgactgccacacctcctggttcggccgaagcgttcccacaaagcaacgcagttatacaagatgaggagaaagacataccagaaagatcgtggaactccggatatgattggataacagattttccagggaagacggtttggtttgttcccagcataaagtcaggtaatgatatagccaactgtctacgtaaaaacgggaaaagagtgatacaactttctcgaaaaacatttgacactgagtatcaaaagaccaaaaataatgactgggattacgtggttaccactgatatcagcgagatgggtgcaaacttccgggcggatcgtgtgatagaccccaggaggtgtttaaaaccagttatactgaaagatggaccagagagagtcattctagcaggaccaatgccggttacagtagcgtcagcagcgcaacgcaggggtcgcataggaagaaaccagaataaagaaggtgatcaatatatatatatggggcaacctttgaataatgacgaagaccatgcgcattggactgaagctaaaatgctattggataacatcaatacacccgaaggaatcattcctgccctttttgaaccagaacgcgagaaatcagccgctattgatggcgaataccgtctgcgtggagaagccagaaaaacgttcgtagaacttatgagacgcggcgacctacccgtatggctaagctacaaggtagcctccgagggattccaatacagcgatcgtaggtggtgcttcgatggagagcgaaacaaccaagtgttagaagaaaatatggacgttgagatatggactaaagaaggagaaaggaagaaattacgaccaagatggctagatgcccgtacttatagcgacccactagctttaagagaatttaaagaatttgccgcgggtcgaaggagtgtatcgggcgatttaatccttgaaataggcaaattaccccaacatttaacgcaaagagcacaaaacgctttagacaatttagttatgttacacaattctgagcaaggaggaaaggcttaccgacacgccatggaagaattacctgacacgatagaaaccataatgctactcgctttaatagccgtgctcaccggaggcgttaccctattctttctcagtggcagaggactaggaaagacaagcattggcctactgtgcgtaacttcaagtagcgcactgttatggatggcgagtgttgaaccccattggatagcagcatcaataatactggaatttttccttatggtactattgatacctgaaccggaccgacaaagaacaccacaggacaaccaactggcatatgttgtcattggattattatttatgatactcactgttgcagcaaatgaaatgggactactagaaacaacaaagaaggatctgggtataggccatacggccgccgaaaatcaccaccatgccgcaatgctagacgttgatttacatcccgcatcagcttggactctatatgcagttgctacaaccataatcactcctatgatgaggcataccatagagaacactacagcaaatataagccttacagcaattgctaatcaagcagcgatactaatggggttagataagggatggcctatatccaaaatggacattggagtaccacttctagcactagggtgttactcacaagttaatccgttaactttaacagcagccgttcttatgctagtagcacattacgcaataataggtcctggactgcaagccaaagccacaagagaagcccagaaaagaactgcggcaggcatcatgaaaaacccaaccgtagatggaatagtggctatagatcttgatccagtagtatatgatgctaaatttgaaaagcaattaggtcaaataatgctactaatattatgcacatctcaaatacttttaatgcggacgacttgggcgctttgcgagagcatcacgttggcgaccggccctcttacaactttgtgggaaggatcccctggcaaattctggaacactactatagccgtatcaatggccaatatatttagaggatcatatttagctggtgccggtctagctttttcactaatgaaaagtctaggagggggacgacgagggacaggagctcaaggtgaaacccttggagaaaagtggaagcgacaattaaatcagttgagtaaatctgagttcaatacatataaaagatcaggaatcattgaagttgatagatcggaagcgaaagaaggactaaaaagaggagaaacaacaaagcatgctgtttcacgcggaacagctaagttaagatggtttgtagaaagaaatttagtcaaaccagaaggaaaagtcatagacctgggatgtggaagaggaggatggtcatattactgtgcaggactgaagaaagttaccgaagttaaaggatatactaagggtggtccgggtcacgaagaaccaattcctatggctacttatggatggaaccttgtaaaattgcactctggtaaagatgtattctttattccacctgaaaaatgcgacacgttgttatgcgacattggagagagctccccaaacccaacgattgaggagggacgcaccctaagagtcctaaaaatggttgaaccctggctcaggggaaatcaattttgtattaagatattaaacccctatatgccttccgtcgtagagaccttggaacagatgcaaagaaagcatggcggaatgcttgtgagaaaccctttatctcgaaattcgactcatgaaatgtattgggtaagttgtgggaccggtaacatagtaagtgctgtaaatatgacctctagaatgctcttaaatagattcactatggcacataggaaacctacttatgagcgcgacgtagacttaggcgctggaactcgccatgtagcagttgaaccggaagtcgctaacttagatattattggtcaaagaattgaaaatattaaaaacgaacataaaagcacttggcattacgacgaagacaatccttataaaacgtgggcctatcatggttcatacgaagtaaagccctcgggctcagcatcctcaatggtgaatggggtcgtaagactccttacaaagccatgggatgtgattccaatggtgacacaaattgcgatgacagacactacacctttcggacaacagagagtgttcaaagaaaaagttgatacgaggacacctaaagctaaacgtggcacagcccaaatcatggaagtaacagcaaaatggctttggggatttttatccaggaataagaaaccacgaatatgtacaagggaagagttcacgcgtaaggtaaggagcaatgcggctatcggcgctgttttcgtcgatgaaaatcaatggaacagtgccaaggaagcagtagaagatgaaagattctgggacctggtaagacgggaacgcgagttgcataaacaaggaaaatgtgctacatgcgtttataacatgatgggaaaacgagaaaagaaattaggagagtttggtaaggccaaaggaagtcgagccatttggtatatgtggttaggtgcaaggttcctggagttcgaagcgttgggttttatgaacgaggaccattggttttccagagagaactcactaagtggggttgagggagaagggctccataaattgggatacatcttacgcgatatctctaagatacctggagggaatatgtacgcagacgatacagcaggctgggacacacgaatcactgaagaagacttgcaaaatgaagcaaaaattactgatattatggaacctgaacatgccttattagccacgtcgatatttaaactaacttaccaaaataaagttgtgagagtacaacggccagccaaaaacggtacagttatggacgttatatcgaggcgagatcaaagggggtcaggtcaagttggaacatacggcctaaacactttcaccaacatggaagcccaactgatacggcaaatggaatccgaaggaatattttcacctagcgaattagaaactcctaaccttgcaggacgagttttagactggttagaaaaacacggtattgaaagattacgacggatggcaattagtggagatgactgtgtagttaagcctattgatgatcgatttgctaccgcccttacggcattaaacgatatgggaaaagtacgaaaggatatacctcaatgggaaccttctaaaggttggaacgactggcaacaggtaccattctgctcacaccatttccatcaacttattatgaaagacggacgagagatagtggtaccatgtcggaaccaagacgaattagtgggtcgggcgcgtgtatctcaaggtgccgggtggtccttgagagaaaccgcttgtttaggcaagagttacgcacaaatgtggcaactcatgtactttcacaggcgcgacctccgcctcgcggcaaacgcaatatgcagtgcggtgccagtggattgggttccgacttctcgtacaacgtggagcatacatgctcaccaccaatggatgactacggaagatatgctctcggtatggaacagagtgtggattgaagagaatccatggatggaagacaagacccatgtatcctcatgggaagatgtcccatatttagggaaaagggaagaccaatggtgcgggagtctaatcggtctaactgcgagagcaacgtgggctacaaatatccaagtagcgataaaccaggtacgacgattgatcggcaacgaaaattacctggactatatgacgtccatgaagagatttaagaatgagtcagatcctgagggtgcgttatggtaa

SEQ ID NO: 22083 - RNA, 9879 nt, synthetic construct
  misc_feature 1..9879: note = derived and/or modified CDS sequence (opt6) from DENV-1__JQ915075__SS-prME
  source 1..9879: mol_type = other RNA
tcggtaacgatgctactaatgttactgcctacagttttaacttttcatttaactactagagggggagaaccacatatgatagtgtccaaacaagaacgaggaaaatcactgttgttcaaaacttctgctggggtgaatatgtgcacactgatagctatggatcttggagaactgtgtgatgacacgatgacatataaatgccctagaataacagaaacagaaccggatgatgtcgactgctggtgtaatgcaacagaaacatgggtcacgtatggtacttgttcacaaaccggtgaacatagacgcgacaaaaggtccgtagctcttgcaccccatgtaggtcttggtttagaaactaggacagaaacatggatgtcatccgaaggggcgtggcgccaaattcaaaaagttgaaacctgggctttacgacatcccgggttcacagttatagcattattcctggcacacgcaataggcacaagtatcacccaaaaaggtataatattcattttgctaatgttggttactccatctatggctatgcgatgtgtaggcattgggaatagagacttcgtagaagggttgagcggagcaacatgggtcgatgtagttctcgaacatggtagttgcgttacaacaatggcaaaagataaaccaactttagatattgagttacttaaaactgaagtaacaaatccagcagtcttaagaaaactatgcatagaggcgaaaataagtaatacaacaacagactcgcgatgtcctacccaaggagaagcaacgttggttgaagaacaagacactaatttcgtatgtcgtcgtacattcgttgacaggggctggggcaacggatgtggattatttggaaaaggttcgttaattacttgtgcaaaatttaaatgcgcaactaaattagaaggtaaaattgttcaatacgagaatttaaaatattctgtcatagtaactgttcacacaggggatcaacaccaagtaggaaatgaaacaacggagcatggtacaattgctacgatcaccccacaagcacctacctcggaaatacaactaacagattatggtgcccttacattggactgctcacctagaaccggactcgattttaatgaaatggtcttattaactatgaaagaaaaatcttggttagtacataaacaatggtttcttgacttacccttaccatggacaacaggcgcctcaacaagccaggaaacgtggaacagacaagatttgttagtgacatttaaaactgcacatgcaaagaaacaagaagtcgtagttttgggatcgcaggaaggagctatgcataccgcattaactggagctacagaaatccaaacgagtggaactacaactattttcgccggacacctaaaatgcaggcttaaaatggacaaattaacattaaaaggtataagttacgtcatgtgtacgggctcttttaaactagaaaaagaagttgcagaaacacaacatggcactgtattagttcaagtaaaatatgaaggaactgatgcaccatgtaaaataccttttagtagccaagatgaaaaaggggtaacacaaaatggaaggttagtaaccgcaaacccaatagtcaccgataaagagagacctgtaaatatagaagctgaaccaccattcggcgaatcatacatagtggtgggtgccggtgaaaaagccttaaaattatcctggttcaagaaaggaagtagcataggcaaaatgtttgaagcaactgccagaggagcaagacgtatggcgattttaggagatacagcatgggactttggttcaataggaggggtctttacatctgttggcaaactggtacaccaaattttcggcacagcttacggagttctattttccggtgtgtcgtggacgatgaaaatcgggatcggaatattacttacctggttaggattgaatagtcgatccacatcgttatcaatgacatgcatagctgttggcatggttaccctctacctcggggtaatggtgcaagcagatagcggttgcgttatcaactggaaaggcagggaattaaaatgcggaagtggaatatttgtaaccaacgaagtccacacgtggacagaacagtataaatttcaagctgacagcccgaaacggctatccgcagctatcgggaaggcttgggaagaaggagtttgcggaataagatcagccacccgtctcgaaaacatcatgtggaaacagatttcgaatgaattaaaccatattttattggaaaatgatatgaaatttacggtggttgtcggagatgtaagtggaatattagcgcaagggaaaaagacgatccgtcctcaaccaatggaacacaaatatagttggaaatcttggggtaaagcaaagataataggggcagatgttcaaaatacaacctttataatagacggccctaacactccagaatgtccggacgatcaacgagcatggaatatttgggaagtcgaggactatggatttgggatttttactacaaatatttggcttaaattgagagattcgtacacccaagtgtgtgatcacagactaatgtcagcggcaattaaagattccaaggccgtacacgcagacatgggatattggatagaaagcgagaaaaatgaaacatggaaactagcacgggcgtcttttatagaagtaaaaacgtgtgtttggcccaaatcacatactttatggtcgaatggggttctggaaagcgaaatgatcataccgaagatatacggtggtccaatttcacaacacaattaccgtcccggatactttacacagacagcaggaccttggcacttaggaaaattggaactagattttgacttatgtgaggggacgacagtagttgtagatgaacattgtggaaatcgaggtccttcgctgagaacaaccactgttacgggcaagattattcatgaatggtgctgccgttcctgtacactaccaccccttcgctttaagggagaagacggctgttggtacggtatggaaattaggcccgtaaaagagaaagaagagaacctagtaaaaagcatggtttcagccggctcgggtgaagtcgactcattttccttgggtcttttgtgtatatccataatgatagaagaagttatgcggtcaaggtggagtagaaaaatgttgatgacaggtacgctagtcgtatttttactcttgaccttaggccaactaacttggaacgacctaattcgtctttgtattatggttggagcaaatgcatccgataatatggggatgggaactacgtatctagcattaatggcaacgttcagaatgcgtcccatgtttgctgttggactgctattccggagattgacatcacgcgaggtattgcttctgacagttggattaagcctagttgcatcagtagaactgccaaatagtctcgatgagctaggtgatggccttgctatgggaataatgattttaaaattactaactgatttccaatcacatcagttatgggcaacacttttatcgctcaccttcgtgaaaactacattatcactacattacgcatggaaaactatggcgatgatcctatccatagtatcactgttcccactttgcctgagtactacctcgcagaaaacaacatggctacccgtacttttaggttcgttgggttgtaaaccactaacaatgtttctcataactgaaaataagatatgggggcgtaaatcatggccattgaatgaaggaattatggctgttggtatagtgagtattcttttatcctcactgctcaaaaatgacgttccgttagccggcccacttatagctgggggtatgcttattgcttgttatgtgataagtggtagttccgccgacttgagtcttgaaaaagcagcgaaagttagttgggaagaagaggcagaacatagcggtgcttcacacaacatattagtagaaatacaggatgatggtacgatgaaaataaaagatgaagaaagagacgatacaatcacaattctacttaaagcgactctactagccatttccggtgtatatcccatgtcgataccagcgactttattcgtttggcatttctggcagaagaagaaacaaagatcgggagttctttgggacaccccttcaccaccagaagtagaaaaagcggtattagacgacggaatataccgaatattacagcgtgggctactcggtcgttcacaagttggagtaggagtctttcaagaaggagtctttcataccatgtggcacgtaacgcgaggtgctgtgctaatgtatcaaggtaaaagactggaaccgagctgggcatctgtaaagaaagatctaataagctatggtgggggctggcgctttcaaggctcttggaacacgggtgaagaagttcaggttatagctgtagagccaggcaaaaatcctaaaaatgtgcaaactgccccgggcatctttaaaaccagtgaaggggaagtcggagccattgctttagattttaaaccagggacttctggaagcccgatcgttaatcgagaaggtaaaatagttgggctttatgggaatggagtcgtcacaacgtcaggaacatacgttagtgcaatcgcccaagccaaagcatctcaggaaggtccgttacctgaaatagaagatgaagtatttagaaaaagaaacttaacaattatggacctccatcctgggtccggaaaaactcgaaggtatttaccagcaattgttcgcgaagccataaaaagaaaactacgcactttggtattggctcccactagagttgtagccagtgaaatggccgaagcccttaagggaatgccaatacgctatcagaccactgcagtcaaaagcgaacatactggtaaagaaatagtggatcttatgtgtcatgctacattcaccatgaggctattgtcacctgtgagagttccaaactataacatgataataatggatgaagcacattttaccgaccccgcatcgatagctgcgagaggatatatatccacaagagtcggcatgggtgaagcagcggccatttttatgactgccactccgcctggtagcgtagaagcgtttccccaaagtaatgcagttattcaggacgaagagaaagatattccagaaagatcttggaactctggatacgattggatcacagattttccaggaaaaacagtgtggtttgtaccaagtattaaaagcggaaatgatatagccaattgcttgaggaaaaatggaaaacgtgttatccaattgtcccgcaaaactttcgatactgaatatcagaaaaccaaaaataacgactgggactatgtggtaacgacggacatctcagaaatgggggccaattttagggcagacagagtcatagatccacgccggtgtttaaaaccggttatattaaaagacggacctgagagagtgatattagctggtccaatgccagtgactgtagcttcagcagcccaaagaaggggtcgaataggacgcaatcaaaataaggaaggagatcaatacatctatatgggacaaccactcaataatgatgaggaccatgcacattggactgaagctaaaatgttacttgataacattaatactccggaagggatcattcctgcattatttgaacccgagcgagaaaagtcagctgctattgacggagaatatagacttcgcggggaggccagaaaaacttttgtcgagcttatgcgtagaggggacctcccagtttggctatcttacaaagtagcatcagaaggcttccaatattcggacaggaggtggtgctttgatggagaacgcaataaccaagtccttgaggaaaacatggacgtagaaatatggacaaaggaaggcgaaaggaagaaacttagacctaggtggttagatgctcgtacttatagtgatccactagcacttagggagtttaaggagtttgcagctggtaggcgatctgtaagctcggatttaatacttgagattggaaagttaccacaacatttaacacaaagagcccaaaacgcactagacaatctagttatgttacataattccgagcagggtggaaaggcctaccgtcatgctatggaggagttgccggatactattgagaccattatgctattagctcttattgccgttttaacagggggagtcaccctattctttctgagtggaagaggccttgggaaaacgagtattgggttactatgtgttacttcgtcttcagctttactatggatggcaaatgtagaaccccattggatagcagcatcaattattttggagttctttcttatggtattgttaataccggaacctgatcggcaaagaacaccacaggataatcaactggcctatgtcgtaatcggtttactctttatgattctaacggtggcagcgaatgaaatgggtttacttgaaacaaccaagaaagatttaggaattggtcatacagcagccgaaaaccatcatcatgctgccatgttagatgtcgatctacatcctgcttcagcctggaccttatacgctgtggcgacaacaatcattacccccatgatgcgtcatactatagaaaataccacggccaatatatctctaactgcaatggcaaatcaggctgctatcttaatgggcttagacaagggctggccaataagtaaaatggatatcggggtgcctcttttggctctaggatgttattctcaagtaaatccgctgacgctgacagcagcagttttgatgttagttgcacattatgcaatcataggtccgggcctccaagcaaaagcgacgcgtgaagcacaaaaacggacagctgctggtatcatgaaaaatccaacagtagacggaattgtagcgatagacctggatccagttgtttatgatgctaaatttgaaaaacaattggggcaaattatgttacttatcttatgtacaagccaaatcttgttaatgaggacaacttgggcactatgtgaatcaataactttagcaacgggacccttaaccacgctatgggaagggtctcctggcaagttctggaatactacaatcgcagtgtctatggctaacatttttagaggaagttatctagccggagcagggctagcgttttctcttatgaaatcactgggtggtgggagaagaggaaccggagctcaaggcgaaacactaggggaaaaatggaaaaggcaattgaaccaactttcaaaatctgaatttaatacctacaaaagatcgggtataatagaagtcgatcgctctgaagctcgtgaaggtctaaaacgaggcgaaactacaaaacatgcagtcagccgaggtacagcgaaactaagatggtttgtagaaagaaacctagttaagccagaagggaaagtcatagaccttggctgtggtaggggcggctggagttattactgtgctgggctcaagaaagttacggaggtgaaagggtatacaaaaggaggaccggggcacgaagaacctatcccgatggctacatacggttggaatttagttaaactccactccgggaaagatgtgttcttcatacctcctgaaaaatgtgacacattattatgtgatatcggagaaagttctccaaatccgacaatcgaagaaggacggacactccgagtactgaaaatggtagagccatggttgcgaggcaatcagttctgcatcaagatccttaatccctacatgccgagtgtagtcgaaacattggagcaaatgcagcgcaaacatggtggtatgttagttaggaaccctttgagcaggaactcaacgcatgagatgtattgggtaagctgtggaacaggaaacatcgtatcagccgttaacatgacaagccggatgttattaaatagatttaccatggcgcaccgaaaacctacctatgaaagagacgtcgatctgggcgcaggtacgagacatgtagctgtagaaccggaggttgccaatcttgatattatcggacaaaggattgaaaacatcaaaaatgaacataaaagcacttggcactacgacgaagataacccctataaaacatgggcataccatggaagttacgaagtaaagccatcgggatcggcgagcagtatggtaaacggcgtagttcggttacttacaaaaccttgggacgtaataccaatggtaacacaaatagcgatgaccgatacaaccccttttggacaacaaagggtatttaaggaaaaagtagatacccgaacacctaaagcgaaaagaggtaccgcacagatcatggaagttacggctaaatggttatggggatttttgagtagaaacaagaaaccgcgtatttgcacacgtgaggagttcactagaaaagtgaggagcaatgctgccattggggctgtttttgttgacgagaaccaatggaactctgcaaaagaagcagtggaagatgaaaggttttgggacttggtgaggagggaacgagaactccacaagcagggaaagtgcgcgacttgcgtatataacatgatgggaaaaagggagaaaaagttaggcgagtttggtaaagcaaaaggcagccgtgcaatttggtatatgtggcttggcgcaagattcttagagttcgaagcactaggctttatgaatgaggatcactggttttcacgggaaaacagcttaagcggagtggagggagagggtttacataagctaggatacatactgagagatatctcgaaaataccaggaggaaacatgtatgctgacgacactgctggatgggacactcgcataacggaagaggacttacagaacgaggcgaaaattacagatattatggaacctgaacatgcattgttggcgacaagtatattcaaacttacctaccaaaataaagtggtgagggttcaaaggccagctaagaacggaacagtaatggatgtaatatcaagacgagaccaaagaggatcaggacaagtgggaacttatggtctaaatacttttacaaacatggaggctcaattgattaggcaaatggagtcagagggaatttttagtccaagtgagctagagacgccaaatttagctggaagagtgttagactggttagagaaacatggaatagaacggctacggagaatggctatatcgggagatgattgcgtagtaaaacctattgatgatcgatttgcgactgcactcactgcgttaaatgatatgggaaaagtaaggaaagatataccccaatgggaaccgagtaaagggtggaatgattggcaacaggtaccattctgctctcatcattttcaccaattaatcatgaaagatggtcgagaaattgtagtaccctgtcgcaaccaagatgagcttgttggacgtgcaagagtaagtcaaggtgctggttggtcgttgagggaaaccgcgtgtttgggtaaaagctatgctcaaatgtggcagttaatgtacttccatcgtagggacttacgtcttgcagctaacgcgatctgcagtgcggtgccagtagattgggtaccgacttcaagaacaacatggtcaatacatgcgcatcatcagtggatgactaccgaagacatgttatctgtttggaatcgtgtttggatagaggaaaacccttggatggaagataaaactcacgtatcatcatgggaagatgtaccttatttagggaaaagagaagatcaatggtgcggcagcctaatagggcttacggcacgcgcaacttgggcgactaatatccaagtcgctatcaatcaagtaagacgtttaataggcaatgaaaattacttagattatatgacctccatgaaaagatttaaaaacgagagtgacccagagggtgcgctatggtag

SEQ ID NO: 22084 - RNA, 9879 nt, synthetic construct
  misc_feature 1..9879: note = derived and/or modified CDS sequence (opt6) from DENV-1__JQ915076__SS-prME
  source 1..9879: mol_type = other RNA
agtgtcacaatgctactcatgttattgcccactgttctgacttttcatcttacaactcgaggaggggaaccgcatatgatagtctcaaaacaagagagagggaaaagtctattatttaaaacgtcagcaggggtcaatatgtgtacgctcatagctatggaccttggtgaactctgtgatgacacaatgacttacaaatgccccagaatcactgaaacagaacccgatgacgttgactgttggtgtaatgctacagaaacgtgggtgacatatggcacttgtagtcaaacaggggagcataggagagataaaagaagtgtggcattggcaccccatgtagggctaggtctagagactcgaacagaaacgtggatgtcatccgaaggagcatggagacaaatacaaaaagtggaaacatgggccctcagacatccagggtttactgtaatagcgttatttttggcacatgccattggaacgagcatcacgcaaaaagggatcatctttattttactgatgcttgtaacaccatcgatggccatgcgctgtgtaggaataggaaatagagatttcgtagagggactgtctggagcgacatgggtagatgtcgtattagaacatggctcatgtgttacgacaatggcaaaagataagccaacactcgatattgagctattaaaaacagaagtaacgaatcccgctgtcctaagaaaattatgtattgaagcgaagatttccaatacaaccacggactcaaggtgccctactcaaggggaagcaaccctagtcgaggaacaggacaccaattttgtatgtagacgcacctttgtagatcggggctggggtaatggatgcgggctgtttggcaaaggctcgttaattacttgcgcgaaatttaaatgtgtaactaaactcgagggaaaaatcgtacaatatgaaaacctgaaatacagtgtaattgtaacagtacatactggagaccaacatcaagtcggtaatgagactacggaacatggcactatagccacaattacgcctcaagcgccgacatcagaaattcaactgacggattatggtgcgcttacgcttgactgctccccaagaacaggtcttgattttaacgagatggttctcctaacaatgaaggagaaaagctggctcgtacataaacaatggtttttagatttaccacttccctggacgaccggagctagcacatctcaggaaacgtggaatagacaagacctgttagtgacatttaaaacagcacatgcaaagaaacaagaagttgttgtcttaggaagtcaggagggagcaatgcatacggcgttaacaggtgctacagagatacaaacgtcgggaacaacaactatattcgcagggcaccttaagtgccgactgaaaatggacaagctgactctgaaaggaatgtcctatgtaatgtgcaccggatcatttaagttagaaaaggaggtcgcagaaacacagcatggcactgtgttagtgcaagtgaaatatgaaggtacagacgcaccctgcaaaataccatttagctcacaagacgaaaaaggcgtaacgcaaaacgggagactcgtcacagccaatccaattgtaaccgacaaagaaaagccagttaacatagaagcagagccaccctttggtgaatcatatattgtagtaggagctggcgaaaaggcattaaaactatcctggtttaagaaaggctcatctatcggtaaaatgttcgaagcaactgcgagaggagcgaggagaatggcaattctcggggataccgcctgggatttcggttcaattggaggggtgtttacatctgtcggaaaacttgtgcaccaaatattcgggactgcctacggggttttgtttagtggtgttagttggacaatgaaaattggaataggtattcttctaacgtggcttggtctaaattcacgttctacgtcattaagtatgacatgtattgcggttggaatggttacactatatttaggggtaatggtgcaagcagactcaggctgcgtaataaattggaaaggacgagaacttaagtgtggatccggtatattcgtgactaatgaagtccatacatggacggaacagtataagtttcaggccgattcaccgaaacgactttcagctgcaattggaaaggcatgggaagaaggcgtatgtgggattcgatctgcaacaagattagaaaatatcatgtggaagcaaattagtaatgaactaaatcatatactactagaaaatgacatgaagtttaccgtagttgtgggcgatgtatcgggtattttggcacaaggcaagaaaacaatccgtcctcagccaatggaacacaaatacagttggaaaagttggggcaaagccaaaataataggagccgatgtccaaaatacgacctttattattgacggtccgaacacgcccgaatgtccagatgaccagcgcgcatggaacatatgggaagtagaagattacggctttgggatattcacaacaaacatatggttgaaattaagagacagctatacacaagtgtgtgatcatcgtctaatgtcagcagctatcaaagattctaaggctgttcatgctgatatgggttattggattgaaagcgagaaaaatgaaacatggaagctggctagagcgagcttcatagaagtaaagacatgtgtatggccaaaatctcatacactttggtccaatggagtattagagtccgaaatgatcatacctaagatatacggagggcctattagtcaacacaactatcgaccaggatacttcacacaaacggcaggcccgtggcatttaggtaagttagaacttgacttcgatttatgtgaaggaacaactgtagtagtagacgaacactgtggacacagagggccatcactaagaaccaccactgtgacaggtaagattatacatgaatggtgctgtcgaagttgtacactgccaccattaagattcaagggggaggacggctgttggtacggaatggaaatacgaccagttaaagagaaggaagaaaatttagtaaaatctatggtatcagcaggatccggtgaagtagactcgttcagcttaggtttattatgtatttcaatcatgattgaggaagtaatgcgctctcggtggagtaggaaaatgctaatgaccggaacacttgtcgtattcttactcttaaccttggggcaattaacttggaatgatttgattcgtttatgcatcatggttggagctaatgcttctgacaacatgggtatgggcaccacctacttagccttgatggctacattccgaatgagacccatgttcgcagtcggactcttgtttcgacgattgacaagtagagaagttctactattgactgtgggattatcactggtagcatcagtcgaacttcctaattccctggatgaacttggagacggtttagcaatgggaataatgatcctcaaattgttgactgatttccaatcacaccaactatgggccactttactttcgctcacatttgtaaaaacaacactaagcctacactatgcctggaaaactatggcgatgatcttgtcaattgtgagccttcttcccctctgtttgtctacaacttcacagaaaacaacatggttacctgtattactggggagtttggggtgtaaacctttaacgatgtttttgattacagaaaacaaaatatggggacgaaagtcatggccacttaacgagggcattatggctgtagggatcgtctcgatacttctcagttccctactcaagaacgacgtacctctagcaggaccgttaatagctggcgggatgctaatcgcctgctacgtcatctccggcagtagtgccgacctaagtctagagaaagcggcgaaggtgtcttgggaagaagaagcagagcactcaggagcatctcacaatatcctagtcgaaatacaagatgatgggacgatgaagataaaagatgaagaacgggacgacacgataacaattcttttaaaagcaacactcctagcaatcagcggagtatatccgatgtcaatacctgccacgctctttgtctggcatttttggcagaagaagaaacagaggtccggtgtcctgtgggatactccatcaccacccgaagtcgaaaaagctgtactagacgatggtatctatagaatactacagagaggtttattaggtcgctcccaagttggtgtcggcgtgtttcaagagggcgtatttcatactatgtggcacgttaccagaggagcagtattaatgtaccaaggaaaacgtctcgaaccaagctgggcttctgtaaagaaagacttaatatcgtacggagggggctggagattccaaggatcgtggaatacaggagaagaagttcaagtgatcgcagttgaaccaggcaaaaatccgaagaacgtgcagacggcacccggaacatttaaaacttccgaaggtgaagtcggtgctatcgcccttgacttcaagccgggaacttcaggaagcccaattgtaaacagagaaggtaagatagtagggttatacggaaacggagtagtaacaacgagcggaacctacgtgtcggcaattgctcaagcaaaaacaagccaagaaggacctcttcccgagatagaagacgaagtattccgaaaacgtaatttaacaataatggatttacatccaggttcggggaagacaagaaggtatcttcccgctatagtacgcgaagcgatcaaacgaaagctaagaacgttagtgctagctcctactagagtagtcgcctcagagatggcagaagccttaaaagggatgccaatcagataccaaacaaccgcagtaaaaagtgaacacacggggaaagaaatagtagatctaatgtgccacgcaaccttcacaatgagattgttaagccctgtaagggttcccaattacaatatgattattatggatgaagcacacttcaccgaccccgcatcgattgcagcaaggggttacatcagtacaagggttggtatgggcgaagctgctgctatatttatgactgcaacaccacccggctcggtagaagcatttccccaatccaatgctgtcatacaagatgaagaaaaggatatacccgaacgaagttggaatagcggatatgattggattaccgatttcccaggaaaaactgtttggtttgtacctagtataaagtccggtaatgatatagccaactgtctcaggaaaaacggcaaaagagttattcagttatcgcgaaagacgtttgacactgaatatcagaaaaccaaaaataacgactgggattatgtggtaactactgatatctccgaaatgggagccaactttcgtgctgacagagttatagatccaaggagatgtttgaaaccagttatattaaaagatggaccagaaagagttatattagccggacctatgccagttacggtagcaagcgcagcccagaggcgaggaagaatagggaggaatcagaacaaggaaggagaccagtacgtgtatatgggacaaccactaaacaacgatgaggatcatgctcattggaccgaagcgaaaatgctgctggataatataaatacgcccgaaggaatcatccctgctttatttgaacctgaacgagaaaaatcagctgcaattgacggcgaatacagattacgtggtgaagctagaaaaaccttcgtagaattaatgcgccgtggagatctcccagtatggttaagttataaagttgcatccgaaggttttcaatattctgatcgtaggtggtgctttgacggagaaaggaacaatcaagttttagaagagaacatggatgtagaaatttggaccaaagagggagaaagaaagaaactacggccccgatggctcgacgccagaacctatagtgatcctttagcgctaagagaatttaaagaatttgcggcggggagacgatctgtaagtggagatttaatattggagataggtaaattacctcagcacctaactcaaagagcccaaaatgccctagataatctagtaatgttacataattcagaacaaggaggtaaagcataccggcatgcaatggaagaactaccagatactatagaaaccatcatgctattagcacttatagctgtactgactggaggcgttacattattctttctatcagggcgaggactcggtaaaacctcaatcggacttctatgcgtaacgagttcaagtgcactcttatggatggcatccgtggaaccccattggatagcagcaagtatcatcctcgagttctttttaatggtgttgttaatcccagaaccagatcgacaaaggaccccacaagataaccagctagcttatgttgtaattgggttactattcatgattttaactgtagctgccaacgaaatgggactacttgaaacaaccaagaaagatttgggaataggccacacagctgcggagaaccaccatcatgcggcaatgttagatgtagatctacatccagctagcgcgtggactctatatgcagtagcgactacaataataacacccatgatgagacacaccatagaaaacactacagcaaatatttctttgaccgccatagccaatcaagccgcaatcctaatgggccttgataaaggttggccaatttcaaagatggatataggcgtgccccttctcgcactaggttgctactcccaagtaaatccgctaaccctaaccgcagcggttttaatgctagtagcccattatgccatcataggacctggtctgcaagcaaaggcaacgagagaagcccaaaaacgtacagcggcaggaataatgaaaaacccaacagtggacggaatagtcgctatagatcttgatccagtagtatacgacgcaaagtttgaaaaacaattgggtcagattatgttgctaattttgtgtacaagtcaaattttgctaatgagaactacttgggcgttgtgtgagagtattacattggcgaccggaccactaacaactttatgggaggggtcgccgggaaaattttggaatacaacaatagcggtctctatggcaaatatctttaggggatcatacctagcgggggcaggactagcgttcagtctaatgaaatctttaggaggcggtaggaggggcacaggggctcaaggggaaactttgggtgaaaagtggaagcgtcaattgaaccagttaagcaaaagtgaatttaacatttacaagaggagtgggataattgaggtagacagatcggaagctaaagaaggattaaaaagaggtgaaacaacaaaacatgctgttagtcgaggcacagccaaactacggtggtttgtagaaaggaacttagtaaaacctgagggcaaagtaattgatctcggctgcgggcgcggaggttggagttactattgcgcaggactaaagaaagttactgaagtaaaaggttatacaaaaggaggccctggtcacgaagaacctatccctatggctacttatggatggaacctggtaaaactacattccggaaaagatgtcttctttatacctccggaaaaatgtgatacattattgtgtgatataggcgaaagttcaccgaacccaaccatagaagaaggtagaaccttacgggtgctaaaaatggtagaaccgtggttaagaggcaatcaattctgtataaaaatattaaacccttatatgccatcagtagtagagacgcttgaacagatgcagcgcaaacatggcggaatgctggttagaaatccactttctagaaattcaacccatgaaatgtattgggtatcttgcggtactggcaatatcgtatctgccgtaaacatgactagcagaatgctactaaatcgttttacaatggcacaccgaaaaccaacctatgaaagggacgtggatttaggagcaggaacacgtcatgtagccgttgaacccgaagtagctaacttggacattatagggcagaggatagagaatatcaaaaatgagcataagagtacatggcattatgacgaagacaatccttataagacgtgggcctatcacggtagttatgaagttaaaccatccggatccgctagctcaatggtaaacggcgtggtaagactactaacaaagccatgggatgtcataccgatggtaacccagatagcaatgactgatacaacaccattcggacagcaaagagtttttaaagaaaaagttgatacacgcaccccaaaagcaaaaagaggtacagctcaaataatggaggttaccgctaagtggttatggggatttttatcgagaaacaagaaacccagaatttgtacgcgtgaagagttcacacgcaaggtaagaagtaacgcagctataggagcagtattcgtcgacgagaatcaatggaactcggccaaggaggctgttgaagatgaaagattttgggaccttgttcgaagagaaagagaactgcacaaacaagggaaatgtgcgacatgcgtatataatatgatggggaaacgagaaaagaaactaggcgaatttggtaaggcgaaaggaagtcgggcgatttggtacatgtggctgggtgctagatttctagaatttgaagctcttggtttcatgaatgaagatcattggttttctagagaaaacagcttatccggagttgagggagaaggcttacacaagttaggctacattctgcgagacatcagcaagataccaggtggaaatatgtacgcagacgacaccgcaggctgggatacacgaataacagaagaggaccttcaaaacgaagccaaaataacagacattatggaaccagagcacgcccttcttgctacgtctatctttaaacttacatatcaaaataaagtagtcagggtacaacgaccggcgaaaaatggaactgtaatggacgtgataagtagaagggatcaaagaggcagcggacaagtaggaacttatgggctcaacacttttaccaatatggaagcacagttaatccgtcaaatggaatccgaaggaatctttagtccatcagagctagaaactccaaacctagcaggccgagtcttagactggttagaaaaacatggcattgaaagattaaggcggatggcgattagcggagatgattgcgtggtcaaaccaatcgacgataggttcgcaactgccctgaccgcgttgaacgatatgggaaaggttcggaaagatatacctcagtgggaaccaagcaaaggttggaatgactggcaacaggtaccattttgctcccatcatttccaccaattaataatgaaagacgggagggagatcgttgtaccgtgtagaaaccaggacgagttggttggacgcgcccgggtcagtcaaggagcaggttggtccctaagagagacggcgtgcttgggcaaaagttatgcacagatgtggcagctcatgtactttcatcgtcgcgatttgagattggcagcaaacgccatatgttcggcagtgccagtcgattgggtgcctacaagcagaacgacttggtcgatacacgcacatcaccaatggatgacgacagaagacatgctatcggtctggaatagagtatggattgaagagaatccttggatggaagataaaactcacgtaagctcatgggaggatgtaccgtacttaggtaagagggaagatcagtggtgtggatctttaatcggtctcaccgctagggctacttgggctacaaacatacaagttgcaataaatcaggtgcgcagactaatcggcaatgaaaactatcttgactatatgaccagtatgaaacgatttaaaaatgaatcagatccggagggagcactctggtga

SEQ ID NO: 22085 - RNA, 9879 nt, synthetic construct
  misc_feature 1..9879: note = derived and/or modified CDS sequence (opt6) from DENV-1__KF289072__SS-prME
  source 1..9879: mol_type = other RNA
agcgtaactatgttattgatgcttttgcctactgcattggcatttcatttaacgacgagaggaggagaaccccatatgattgtttcaaaacaagaaagaggaaaatcattattgtttaaaacaagcgcaggggttaatatgtgcacacttattgcaatggacttgggtgaactatgtgaagacaccatgacctataaatgcccgagaatcacagaagcagaacctgacgacgtagattgctggtgtaacgctactgatacgtgggtaacctatggcacatgttcccaaactggtgaacacagaagagataaaagaagtgttgcattagcgccacacgttggattgggattagaaacgcgaacggaaacctggatgtcttctgaaggagcttggagacaaattcaaaaagttgaaacatgggctcttaggcatccggggttcactgtgatagcattatttttagcgcacgctatcggtacaagtattacacaaaaaggcattatattcattttgcttatgttagtaactccgtcgatggcgatgagatgtgtagggatcggaaatagagatttcgtggaaggtctttctggcgcaacttgggtcgatgttgtacttgaacatggaagctgtgtaaccacaatggccaaaaataaacctacactagatattgaattactaaaaaccgaagtgactaatcctgctgtactaagaaaactatgcatagaagctaaaatctccaatacaacgacagattcaagatgtccaacacaaggtgaagccacacttgtagaagaacaagatgctaatttcgtttgtcgcagaacgttcgttgatcgaggatggggaaacggatgtggattattcggtaaaggatccttactcacgtgtgcaaaatttaaatgtgtgacaaaacttgaaggtaaaattgtacaatatgaaaacctcaaatactcagtcatagtcaccgtacacactggcgatcaacaccaggtaggcaacgaaaccacagagcatggcacgatagcaactataacaccacaggcaccaacatctgagattcagttaactgattatggggctttaacactcgattgcagcccacgtacaggattagatttcaacgaaatggtactattaacgatgaaagaaaaatcttggttagtccataaacaatggtttcttgatcttccattaccttggacaagtggagcaagtacgtcacaagaaacatggaatcggcaggatttgctagtcacgttcaaaactgcacatgctaagaaacaggaagttgtggtattgggatcacaggagggcgctatgcatacagcattaactggtgcaacggaaatacaaacaagtggaacgactacaatattcgcagggcacctaaaatgtagattaaaaatggataaattaacactcaaaggggtatcctatgtgatgtgtactgggagtttcaaattagaaaaagaagtagcggaaactcaacacggtacagtactcgttcaagtgaaatatgaaggtacagatgcaccctgtaaaatacctatatcaacacaggacgaaaaaggcgtgacacaaaatggtcgactaattactgcaaatccgatagtaacggacaaagaaaaacccgtaaacattgagaccgaaccaccattcggagaaagttacatagttattggtgcaggcgaaaaagcattaaaattgagttggttcaagaaaggtagcagtattggaaaaatgtttgaagcaactgctcgaggagcgcgcaggatggcaatattaggagatactgcgtgggatttcggaagtatcggtggtgtttttacatcagttggaaagctagttcatcaagtttttggtacagcctacggtgtattattcagcggagtatcttggaccatgaaaattggaattggtatattattaacttggctcggcttaaacagcaggtcaacctctctatcaatgacttgcatcgctgtcgggatggtaacattatatctaggagtaatggtacaagccgatagcggatgtgtaataaactggaaaggcagagaactaaaatgcggttcgggcatattcgttactaacgaagtacatacctggacagaacagtataaattccaagccgactccccaaaaaggctatcagcagcaatcggcaaagcatgggaagaaggagtatgtggtatcaggagtgcgaccaggcttgagaatatcatgtggaaacaaattagcaatgaactgaaccatatcttacttgaaaacgatatgaaatttacagtagtcgtaggagatgcaaacggtatacttacacagggtaagaaaatgattagaccacaacccatggaacacaagtacagctggaaaagttggggcaaagccaaaataattggggccgatacacaaaatacaacattcattattgatggacctgatacaccagaatgtccagatgaccagcgtgcctggaatatttgggaagtggaggattatggctttggggtatttaccacgaacatatggctaaagctgagagatagttacacccaaatgtgtgaccatagacttatgtcagcagcaataaaagatagcaaagcggtccatgccgatatgggatactggatagaatccgagaaaaatgaaacatggaaattagctcgagcatctttcatcgaagtaaagacatgcatttggcctagatctcatacgctatggagtaatggcgtactcgaaagcgaaatgatcattcctaagatatacggcggaccaataagccaacataactatagacccggatattttactcagacagcaggaccctggcatctgggaaagctggaattagactttaacttatgcgaaggtaccactgtagttgtggacgaacattgtggaaacaggggaccaagtttacggaccaccacggttacaggaaaaataattcatgaatggtgctgtagatcgtgtactctccctcccttaaggtttaaaggtgaagacggttgttggtatggcatggaaattaggcctgtaaaggaaaaggaagaaaatctggttagaagtatggtgtcggcagggtcgggagaagtagacagctttagcctaggtctactgtgtgtgtcaataatgatagaagaggtcatgcgatcaagatggagtcgaaaaatgctcatgacaggaacgttagcagtattctttttattgataatgggacaattaacgtggaatgacctaataagactctgtataatggttggcgccaatgtctcagaccgtatgggtatgggcactacttatttagctttaatggctacgtttaaaatgaggcccatgtttgccgtaggtcttctcttccgcagattaaccagcagagaggttctccttttgacaattggactatcattagtagcgtccgtagaacttcctaattccttagaagaattgggtgatggcctagcaatggggatcatgatgttaaagctactaacagattttcaatcacaccaattatggacgactcttctctcactaacttttattaaaacaacactaagtctagactatgcatggaagacaatggcaatggtacttagtatagtatctctattcccactgtgtctgagtacaactagccagaaaacaacatggttgcctgttctacttggctcatttggttgtaagcccttgacaatgttcttaataacagaaaacaaaatctggggcagaaaatcttggcctctaaatgagggcatcatggctgtaggtatagtctctatcttactatcatcgttacttaaaaacgatgtccctttagcaggtccattaatagctggtggaatgctaatagcatgttatgtcatatctggaagtagcgcagacttatccttagaaagagcagctgaggttagttgggaagaagaagctgaacactccggagcctctcataatatattagtggaagtccaagatgacggaactatgaaaataaaagatgaagaacgtgatgataccctaacaatactactaaaagccacacttttagcagtaagcggcgtatacccaatgtccattccagcaactcttttcgtatggtacttctggcagaagaagaaacaacgaagtggtgtgttatgggatactccctcacctccagaggtggaaagagcagtacttgacgatggaatctataggatattacaaagggggctattgggacgatcacaggttggtgtgggagtgtttcaagatggggtttttcacacgatgtggcacgtaacaagaggagcggtccttatgtatcaaggtaaacgactggaaccaagttgggcaagtgtcaaaaaggatctgatcagctatggcggcgggtggcgctttcaaggcagttggaatacaggagaagaggtccaagtaatagcggtagaaccaggcaaaaatcctaaaaacgtacaaaccaccccgggtacttttaaaacgcctgaaggcgctgtaggtgcaatcgcgcttgactttaaacctggaacaagtggcagccctatcgtcaatagagagggcaagattgtaggtctatacggtaatggagtggtaaccacctcaggcacatatgtgtccgcaatcgcacaagcaaaagcaagtcaagaaggaccactacccgaaattgaagatgaagtattcaagaaacgaaatctgaccattatggatctacatcctggatctggaaaaactcgtagatacctccctgcaatagtccgtgaagcaatcaaaagaaaactacgaacactgatcctagcgccaacaagagtcgttgcgtcagaaatggctgaggccctgaaaggaatgcccattcgttatcaaactacagcggtgaaatcagaacatacaggaaaagaaatagttgatctaatgtgccatgcgaccttcactatgagattactttctccggtgagagtacctaactacaatatgatcataatggacgaagcccattttaccgatccggcatccattgccgccagaggatacatctctacaagggtcggaatgggcgaagcggccgcgatattcatgactgccactccacccggatcagtagaggcttttccacagtccaacgctgtaatacaagatgaagaaagagacataccagaaaggtcatggaactcaggttatgactggataactgactttcctggaaaaaccgtgtggttcgtgccaagtataaaatccggaaatgatatcgcaaattgcctaaggaaaaatggtaaacgcgtcatacaattgagtcgtaaaacttttgatacagagtatcagaaaactaagaataatgactgggattacgttgttacgacagacatctcggaaatgggagcaaatttcagagcagatcgtgtaatagatccacgacgatgcctcaaacccgtgatacttaaagatggccctgaacgcgtaatattagcaggaccaatgcctgtaacagccgcatcagctgcacaacgcaggggaaggataggtagaaatcaaaacaaagaaggcgaccaatatatttatatgggacagccgcttaacaatgacgaagatcacgcacattggacggaagccaagatgctattagataatataaatacaccagagggcataataccagccctattcgaacccgaaagagaaaagtctgccgctattgatggagaatatcgacttagaggagaggcacgtaaaacttttgttgaattaatgcgtcgtggggatttaccggtatggctgtcttataaggtcgcatcagagggatttcagtactcagatagacgatggtgtttcgacggagaacgaaataaccaggtgttagaggaaaatatggatgtcgaaatatggacaaaagaaggagagagaaagaagctcaggcctcgatggttagatgctcgaacttactcagatcctcttgccctaagagagttcaaggagtttgcagcgggacgcagaagcgtctcgggcgatctaatcctagagatcggtaaactgccgcaacatcttactcttagagcacaaaacgctctagacaacttggttatgcttcataattctgaacagggcggcaaagcgtatagacatgcaatggaggaactacctgacacgatagaaactttaatgctccttgctttaattgcagtacttaccggcggagtaacactcttctttttaagtgggaaagggttgggcaagacgagtataggattattatgcgttatggcttcaagtgtattactatggatggcttcagttgaacctcattggatagccgcgagtattatactggagttctttctcatggtactactaattcctgaaccagacaggcagagaactcctcaagataatcaactagcatacgtagtcattggattgctgtttatgatattaaccgtagccgcgaatgagatgggactactagaaacgactaagaaagacctgggaattggccatgtagtagccgagaaccaccatcacgcaacgatgcttgatatagatttacaccctgcgtccgcatggaccctctatgccgtggcaaccaccataataacacctatgatgcgacatacgattgaaaacacaactgcaaacataagcctgaccgcgatcgccaatcaggcagcaattttgatggggttagacaaaggttggccaatcagcaaaatggatatcggcgtaccgttactcgcactgggttgttattcacaagttaatcctttaactcttaccgcggctgtacttatgctagttgcccattacgctataattggaccaggacttcaggcaaaagcgacgagagaggctcagaaaagaacagcagctgggattatgaagaaccccactgtagatggaatagttgctatcgatttagaccctgtggtctatgatgcaaaattcgagaaacagttaggacaaataatgctattaattttgtgtacgtcacaaattctactaatgagaactacgtgggctctctgcgaaagtattacgttagcgacaggaccattaacgacattatgggaaggcagtccaggaagattttggaatacaactattgccgtctccatggctaatatatttcgaggatcatatctggctggagctggtcttgctttttcattgatgaaatcattaggcggaggacgaagaggaacaggggctcagggggaaacacttggggaaaaatggaaaaggcaacttaatcaacttagtaagagtgagttcaacacatacaaaagatccggaattatggaagttgatcgaagtgaggcaaaagaaggtctaaaaagaggtgaaacaactaagcatgccgtaagtaggggaacggctaagttaaggtggttcgtagaacgaaatttagtaaagcccgaaggaaaggtaattgaccttgggtgcggtcgaggagggtggtcgtattattgcgccggcttaaagaaagtaaccgaagttaaaggatacacgaagggtggtcccgggcacgaggaaccgataccaatggcgacatatggttggaatatcgtaaagttacactcaggacgagatgtatttttcacaccaccagaaaaatgtgatacattattatgtgacattggagaaagcagtcctaaccctacaatcgaagaaggtcgaacgctaagggtactaaaaatggttgaaccttggttaagaggcaatcagttttgcattaagattcttaatccatatatgccaagtgtagtagaaactctagaacagatgcaacgtaagcatggcggaatgctcgtccggaatccattgtcgaggaactccactcatgaaatgtactgggtgtcatgcggaactggaaacattgtgtcagctgtaaacatgacaagcagaatgctacttaatagattcacaatgacgcaccgaaaacccacatacgaacgcgatgttgatctaggagcgggcactcgtcacgtcgcagttgaacctgaaatagcgaatcttgacataattgggcaaagaattgaaaatattaaaaatgaacacaagtccacatggcactatgatgaagataatccttacaaaacgtgggcatatcatggatcctacgaggttaaaccctcggggagtgccagtagcatggttaatggtgttgttcgcctcctaaccaagccatgggatgtaatacccatggtaacgcaaatagccatgactgataccacgccatttggccaacaacgagtctttaaggaaaaggtagacactcgaacgcccagaccgaagagaggcactgcccagatcatggaagttacagctaaatggctatgggggtttttatcgaggaataagaaaccacgaatatgtactagagaagagttcactcgcaaggttagatctaatgctgctataggagcagtctttgtcgatgaaaatcagtggaactcggcgaaagaggcagtggaagatgaacgcttctgggacctggtacatagagagagagaactccacaagcaaggcaagtgcgccacatgcgtatataatatgatgggcaaaagagagaagaaattaggagagttcggaaaggctaaagggagtagagctatttggtatatgtggctaggggcacgctttttagagttcgaagccctcggttttatgaatgaagatcactggtttagtagagaaaattcactaagtggagttgaaggggagggactacataaattgggatacatattaagagatataagtaagattccgggaggtaacatgtatgccgacgatactgcaggttgggatactagaatcacagaagatgacttgcagaatgaagctaagattaccgatataatggaaccagaacacgcactactagccacaagcattttcaaactaacgtatcaaaataaggtcgttagagtacaacgacctgcaaagtctggaacagtgatggatgtaatttctaggcgagaccagcgaggctctggtcaagtgggaacctatggactaaatacatttacaaacatggaagtccaacttattaggcaaatggaatcagagggaattttcagcccatcagaattagaaaactccaacctggctgagcgggtactagactggttagagaagcacggtgtcgaaagactaaaacggatggccattagtggagacgactgcgtggtaaaacctaccgatgatcgatttgctacggccttaacggccctcaatgacatgggaaaagtacgtaaagatattccgcaatgggaaccatcaaaaggctggaatgactggcaacaagtacctttttgctcccaccatttccaccagcttataatgaaagacgggcgtgaaattgtggttccgtgtaggaaccaagatgagctagttggaagggcaagggttagccaaggagcaggatggtctttaagagaaacagcatgcctaggcaaatcttatgcacaaatgtggcaattaatgtatttccacagaagagacttgaggttagcagcaaatgcaatctgctcagccgtcccagtagattgggttccaacatcgcgaacgacctggagtatacatgcccatcaccaatggatgacgactgaagatatgttaagtgtgtggaaccgagtctggatagaggaaaatccttggatggaggataagacacacgtgtcaagctgggaagatgtcccctatttgggcaaacgcgaagaccaatggtgtggctcactgatagggctcacggcgcgagcaacgtgggccaccaacattcaagtcgctataaatcaagttagacggctaatcggaaacgaaaattacttagattacatgacaagtatgaaaagatttaagaacgagagtgactcagagggggcattatggtaa

SEQ ID NO: 22086 - RNA, 9879 nt, synthetic construct
  misc_feature 1..9879: note = derived and/or modified CDS sequence (opt6) from DENV-1__JQ692085__SS-prME
  source 1..9879: mol_type = other RNA
tcagtaactatgctcttaatgttattaccaactgcattagcatttcatctaacaactcgaggaggagagccacacatgatagtatcaaaacaagagcgcggtaaaagcctacttttcaaaactagcgctggtgtaaatatgtgtaccctaatagcaatggatcttggtgaattgtgcgaggatacgatgacttacaaatgtcctagaattactgaagcggaaccagacgatgtcgactgttggtgtaatgcaacagatacatgggtcacatacggtacatgttcacaaactggggaacatagaagagacaaacggagtgtggctttggccccacatgttggacttggtttagaaacgcgaacagagacgtggatgagcagtgaaggagcttggcgtcaaatccaaaaagttgagacgtgggcgctgcgacatcctggtttcacagtcatagcactatttttggcacacgccataggaacaagtataacccagaaaggtattatttttatacttttgatgcttgtaacaccaagcatggcaatgcgttgtgtaggaattggaaatagggacttcgtcgaagggttatctggagcaacgtgggttgatgtagtacttgaacacgggagttgcgtgacaacgatggccaaaaataaaccaaccttagatatcgaattattaaaaactgaagtaacaaaccctgcagtcttaagaaaattatgtatagaggcaaaaatatcaaataccacaacagattcaaggtgccccacacaaggagaagctactttggtcgaagaacaagatgcaaactttgtttgtagaagaacattcgtagatagaggatggggtaacggctgtggtttgttcggtaaaggtagtttactaacatgcgcgaaattcaaatgtgtaactaaactagagggaaaaatcgtgcaatacgaaaacttgaaatacagcgtgatagtgaccgtacatactggggatcagcatcaagtcggaaacgagacgaccgaacacgggactatcgcaactataacaccacaagcacccacaagcgagatacaactgacagactatggagccctcacgttagattgctcaccccgaacgggtctagattttaatgaaatggtgctgctaactatgaaagagaaaagctggttagtacacaaacagtggttcctcgacttaccattaccatggacaagcggggctagtacttcacaagagacttggaatagacaggatctcttagttacttttaaaaccgcccatgcgaagaaacaagaagtagttgtcttaggatcgcaagaaggagcaatgcacactgctttgacaggagcgacggagatacaaacttcaggtacgactacaatattcgcaggtcatctaaaatgtagacttaaaatggataaattaacactgaaaggagtatcatacgtaatgtgtaccgggagtttcaaactagaaaaagaggtcgcggagactcagcatggcactgttctagtacaggttaaatatgaggggactgacgcaccatgcaagatccctatttcgacccaagacgaaaaaggtgtaacacaaaacggacgtctaataactgctaatccaatcgtaacagataaagaaaaacctgtcaatattgaaacagaaccaccctttggtgaatcttatattgttataggggcaggcgaaaaagcccttaaattatcttggtttaagaagggatctagtataggaaaaatgttcgaggcaaccgcaagaggggcaagaagaatggcgattctaggcgatacagcttgggactttgggagtattggtggagttttcacgtcggtgggaaaattagttcaccaggtgtttggaaccgcctatggtgttctattttcaggcgtatcatggacgatgaagataggaataggaatcctcctaacgtggcttggattaaacagtcgatcgacatcgctttccatgacgtgcattgctgtaggcatggtcacattatatttgggagtgatggtacaggcagactcaggttgtgtaattaactggaagggaagggaattgaaatgtgggtcaggcatatttgtgacaaatgaagtacacacgtggactgaacaatataaatttcaagccgattcccctaaacgattatcagccgccatcggcaaagcatgggaagaaggagtttgtggcatacgctcagccacgagattagagaacataatgtggaaacagatatcaaatgaacttaatcatatattgcttgaaaatgacatgaagtttactgtagtagttggagatgcaaatggtattctgacgcaaggcaagaaaatgattcggccgcaaccaatggaacacaagtactcctggaaaagttggggaaaggcgaaaattataggggctgatacccagaatactacattcataatagacggtccagatacaccagaatgtcctgatgatcaaagagcatggaacatatgggaagtagaagattacggcttcggggtattcaccacaaatatctggctaaaactacgagactcatatacacaaatgtgtgaccacaggctaatgagcgcagccataaaagactcgaaagcagtacatgcagatatgggatactggattgagagcgaaaagaacgaaacctggaaacttgcgagagcatcttttatagaggtaaagacttgtatttggccacgaagtcataccttatggagcaacggcgtattagagtccgaaatgataataccgaaaatatacggaggacctatctctcaacataattacagaccggggtacttcacccaaaccgcgggaccatggcatctaggcaaattggaattagactttaatttatgcgaaggtacgacagtagtggtggatgaacattgtggcaaccgcggcccgagcttacggacaaccaccgttacaggaaagataatacatgaatggtgttgccgctcatgtaccctacccccgttaagatttagaggcgaagacgggtgttggtatggcatggaaattcgacccgtaaaagagaaagaagaaaatctagtacgaagtatggtaagtgcagggtcaggagaagtagattcgtttagtttaggtttactttgtgtatcaataatgattgaagaagttatgcgatcaagatggtcgcgcaaaatgttgatgacagggactttagcagtcttctttttattaatcatgggtcagcttacatggaatgatctaataaggctatgcattatggtaggagctaatgtcagcgatcgcatgggtatgggaacgacatatcttgccctaatggccacatttaagatgagacctatgtttgcagtaggcttgctattcagacgattaacatccagagaagttttacttttgacaataggactttcccttgtagccagcgttgaacttccaaacagcttagaagaacttggagacgggcttgcaatgggaattatgatgttaaaattactcaccgatttccagagtcatcaactctggacgactttattaagtttaacgttcataaaaacaaccctaagcctcgattatgcatggaagactatggccatggtactatcgatcgtcagcctattccccctatgtctttctactacaagccaaaagactacatggctacctgtactactaggatcttttggctgcaaaccactcacaatgttcctcatcacagaaaacaaaatatggggaagaaaatcatggcccttaaatgaaggcattatggcagtcgggatagtgtcaatactgctttcgagcttgttgaaaaacgatgtgcctctcgccggtccgcttatcgctggaggtatgttaattgcatgttatgtaatatctggttcaagcgccgatctatcattagagcgagcagcagaagtatcatgggaggaggaagcagaacattccggagcatctcacaatatcctggtagaagtacaggatgacggcaccatgaaaataaaagatgaggaacgtgatgatacattgactatcctcctaaaggccacactattggctgtttcaggagtgtatccaatgtccataccagctacattgtttgtctggtatttttggcaaaagaagaaacagcggagtggagtattatgggatacaccgagtcccccagaagtagaacgtgcggtactagatgacggtatatatagaatcctacaacgagggctgttaggccgctcacaagttggcgtaggtgtatttcaagatggcgtctttcatacaatgtggcacgtaacacgaggagctgtcttaatgtatcaagggaaaagactggaaccctcatgggcttctgtgaaaaaggacctaataagctatggaggcggatggagatttcaaggatcatggaataccggagaagaagtgcaagtgatagccgtcgagccaggcaaaaatcctaaaaatgtgcaaacaacacccgggactttcaaaacaccagaaggagccgtaggcgcaatagctctcgattttaaaccaggtacatcgggatctcctattgttaacagagaagggaagattgtgggtctatacggtaacggcgtggtaacaacaagtggcacatacgtatctgcgattgcacaagccaaagcctctcaagagggcccactgcccgaaattgaggatgaggtatttaagaaacgaaatctaacgataatggacttacatccaggtagcgggaaaactagaagatacttaccggcaatagtgcgggaagcaatcaagcggaaattaaggactcttattttagcaccgacacgagtagtagccagcgaaatggcagaagcgctgaaggggatgccaattcgttaccaaacgactgcagtcaaaagcgaacacacaggcaaagaaatagtagaccttatgtgccacgcaaccttcactatgagacttttatcaccggtaagagtgcccaactataatatgattataatggatgaagcacatttcacagatcctgcgtcaatagcagcacgaggatatataagcacaagggtgggaatgggtgaggcggccgcaatttttatgacagcgacacccccaggatcagtagaagcgtttccacaatcaaatgcagtcatacaagacgaagaaagggatatcccagaaagatcgtggaactcaggttatgattggataacagattttcctggaaaaactgtgtggttcgtacctagtataaaatctggcaatgacatcgcaaactgcctacggaaaaatggtaaacgggtaatacagctgtcccgcaaaacgttcgacactgagtatcagaaaacgaaaaacaacgattgggattatgttgtcacaacagacataagcgagatgggtgccaattttcgcgcagaccgagttatagatccacgtcgatgtttaaaaccagtaatcctaaaggatggcccggagagagtaatacttgccggaccgatgcctgtaactgcagcctccgctgctcaaaggagaggaagaataggaagaaaccaaaataaagagggagaccaatatatttatatgggacaaccgcttaataacgatgaagaccacgcgcattggactgaggccaagatgttactggacaacataaacacccctgaaggtataataccggctttatttgaaccagaacgggaaaaatcagcagctatagacggtgaatatagactccgaggtgaggcacggaagacctttgttgaactgatgcgacgaggtgatttgcccgtatggttaagctataaggtagcaagcgaaggatttcaatattcagaccgaagatggtgctttgatggggaacgtaataatcaagtattggaggaaaacatggacgttgaaatatggacaaaagaaggagaaagaaagaaactcagaccaaggtggttagacgcgagaacatattccgatccattagcgctaagagaatttaaagagtttgctgcaggtaggcgatcagtgtccggagacttaatactggaaataggaaaactcccacaacatttaacactccgtgctcaaaacgcacttgacaacctggttatgttacataattctgagcaaggaggaaaagcatacagacatgcaatggaagaacttccagacacaatagaaacattgatgttgttagctttgatagcagtattaacaggtggcgtgaccttattctttctaagtgggaaagggctgggtaagacttcgatagggttattatgcgtgatggcaagtagtgtcttattatggatggcgagcgttgaaccgcattggattgccgcatcgatcatcctagaatttttcctaatggttcttttaattccggagcccgaccgacagcgcacaccgcaagataatcaactggcctatgtagtaataggtttactctttatgatcctgactgtagcagcgaatgagatgggattattggaaacaacgaagaaagacctcggaattggtcatgtcgttgcagaaaatcatcaccatgcaactatgctggacatagatttacaccctgcgagtgcatggacattgtatgccgtagcaaccacaataattacaccaatgatgcgtcacactattgaaaacactacagcgaacatttccttgaccgccatagctaaccaagctgcaatattaatggggctggataaaggctggccaatctctaagatggatataggggtacccttactggccctgggctgctactcacaagtaaatccattaacgctcacagcagcagtactaatgttagtagcacactatgcgataataggtcccggattacaggcaaaggctacccgagaagctcagaaaaggactgccgcagggattatgaaaaatcctacagtagatggaattgtggcaattgatttagacccagtcgtatacgatgccaaattcgaaaaacaactaggacaaattatgttactcatattgtgcacatctcaaatacttttaatgaggacaacttgggcgctttgtgaatcaattacgctagcaactggaccattaactacactctgggagggaagtccaggaagattttggaacactaccattgctgtaagtatggcaaatatattcagaggctcgtatctagccggtgcagggcttgctttcagcttgatgaagagtctgggcggaggtaggagaggaacaggagctcaaggagagacattgggagaaaaatggaaacgacaattaaaccaattaagcaagagcgagtttaatacctacaaaagatccggtatcatggaagtggaccgctcagaagcaaaagaaggactaaaacggggagaaacaaccaagcatgctgtaagcagagggactgctaaattgcgatggtttgtggaacgaaatttagtgaaacctgaaggaaaagtgatagatctagggtgcggtagaggcggatggtcatattattgtgcgggactaaagaaagtcactgaagtaaaaggttatacaaaaggagggcccggccatgaagaaccaatcccaatggctacttatggatggaacatagtcaaattgcacagtggaagagacgttttcttcacacctcccgaaaaatgtgacactttactgtgtgacataggagaaagttcgccaaaccccaccatcgaagaaggcagaacactaagagttcttaaaatggtagaaccgtggttacgtggaaatcagttctgtattaaaattttaaatccgtacatgccatccgtggtagaaacactggaacaaatgcaacgtaagcacgggggcatgttggttcgaaacccattaagccgtaattcaacacacgagatgtactgggtatcgtgcggtacgggtaacatagtcagtgcagtaaacatgacaagtagaatgctcttaaatcgttttacgatgacccatcgaaagccaacctatgaaagagatgtagatctaggagcaggcacaagacatgtagccgtagagcccgaaatcgctaacttagacatcattggtcagcgcattgagaatattaaaaacgaacataaatccacttggcattacgatgaagataatccttacaaaacatgggcctatcatggtagttacgaagtcaaaccaagcgggtcagcatcgtccatggtaaatggcgttgtaaggctccttacgaaaccatgggatgtcatacctatggtaacgcaaatagccatgactgacacaacaccatttgggcaacaaagagtctttaaagagaaggtcgatacaagaacgccaagacccaaaagaggcactgcccaaattatggaggtcactgcgaaatggctttggggatttctatcacgaaataagaaaccacgaatatgcacacgagaagaatttacaagaaaagtacgcagtaacgcggctgttggagccgtttttgttgatgaaaaccaatggaacagtgctaaagaggcggtggaggacgagcggttttgggatctagtccatcgagaaagagaactccacaagcaaggaaaatgcgcaacatgtgtgtacaacatgatggggaaacgcgagaagaaactaggtgaatttggcaaagcaaaagggtctagagctatatggtacatgtggttaggggcccggtttctagagttcgaagcattaggatttatgaatgaagatcattggttctcgagggaaaactcgttatcaggcgtggaaggtgaaggtttacacaaactcgggtatatcctccgcgacatcagtaagatccctggtggtaatatgtatgcggacgatactgctggctgggatacacgcataacagaagatgatttgcagaatgaagctaaaataacagatattatggaacctgagcatgcattacttgctacatcaatatttaagctaacataccaaaataaagtcgtaagggtacaaaggccagctaaatcgggcactgtcatggacgttatatcacgacgtgaccaaagaggatcgggtcaggtcggaacgtatggtctaaatactttcacaaatatggaagtacaactaataaggcaaatggaatcagaaggaatattttcgccaaacgagctggaaaactcaaatcttgctgagagggtacttgattggctggaaaagcacggtgtcgaaagattaaagcgaatggctatttcaggagatgactgcgtggttaaacccacggatgatcgattcgccaccgcactgacagcgctaaatgacatggggaaagtacgtaaagacataccacaatgggaaccctctaagggatggaacgactggcaacaagtcccgttctgctcgcatcatttccatcagctgataatgaaagacggaagagagatagtagtaccatgtcgaaatcaggatgaattagtaggacgagcaagagtttcccaaggggctgggtggagtctaagagagacggcttgtcttggaaaaagttatgcgcagatgtggcaattaatgtacttccaccggagagatctacgccttgcagctaatgctatatgttcagcagtccctgttgactgggtcccaacttcacgcacaacgtggtcaatacacgcgcaccatcaatggatgacgactgaagatatgctctctgtgtggaatagagtttggatagaagaaaatccctggatggaagacaaaacgcacgtcagtagctgggaagatgttccataccttggaaagcgagaagaccaatggtgtggctctttaataggcctaacagcacgtgccacatgggcaactaacatacaggtagcaataaatcaagtacgccggctgataggaaatgaaaattatttagattatatgaccagcatgaaacgttttaaaaacgaaagtgatagtgaaggcgctctatggtaa

SEQ ID NO: 22087 - RNA, 9879 nt, synthetic construct
  misc_feature 1..9879: note = derived and/or modified CDS sequence (opt6) from DENV-1__JQ917404__SS-prME
  source 1..9879: mol_type = other RNA
agcgtcactatgctattgatgctattaccaacagcattagctttccacttgacaacaagaggtggggaacctcatatgatagtaagtaaacaggagagaggcaaatcactgttattcaaaacaagtgctggagtaaatatgtgcacactaatagcaatggacctaggtgagctgtgcgaagacacaatgacatataaatgcccacgaattacagaagcagagccggacgatgtagactgttggtgcaatgctacagatacatgggtaacatacggaacgtgtagccaaactggtgaacatcgtagagataaacgatcagtagctcttgcaccacacgttggtctaggtttagaaacaaggactgaaacttggatgtcgtcagaaggagcatggaggcaaattcaaaaagttgaaacatgggccctaagacatcctgggttcacagtcatagctttattcttagcacatgcaataggtacctccataacgcaaaaaggtattatatttatcttgctaatgttagtaacgccatctatggcaatgagatgtgttggaattggtaatagagacttcgtagaagggttatctggcgcaacatgggtcgacgtagtgttagagcatggatcatgtgttacaaccatggccaaaaataaacccacgttggatatagaattgctcaaaacagaagtgactaacccggcggtacttcgaaaattatgtatcgaagcgaaaatatctaatacgacgaccgatagcagatgcccaacccagggagaagccacgttagtggaagaacaagacgcaaattttgtatgccgtagaacgttcgttgacagaggctggggaaatggatgtggtttgtttggcaaaggatcactattaacttgtgccaaatttaaatgtgttaccaagttagaaggtaagatagtccagtatgagaacttaaaatattccgtaatagtcaccgtgcatacaggagatcaacaccaagtaggaaacgagaccacagaacacggtacaattgctacaatcacgccgcaagcgcccacaagtgaaattcagttaacggattatggagccctgaccctagactgtagtcctagaacaggactagattttaatgaaatggtgctgctaacaatgaaagagaaaagttggttggtccacaaacagtggtttctagacctaccactaccgtggacatccggagcttcgacatcacaagaaacatggaatcgacaggacttgttagttacgttcaaaacagctcatgctaagaaacaagaagtggtagtgctaggatcacaagagggtgctatgcacacagctctaacgggcgcgacggaaattcaaacaagtggaacaaccacgatttttgctggacatttaaaatgcaggctaaaaatggataaacttacgctaaagggagtatcatatgttatgtgcacgggtagtttcaaactcgagaaagaggtagcggaaacgcaacacggtacagtattggttcaagtgaaatacgagggcacggatgcaccctgtaagatcccaatcagtacgcaggacgaaaagggagtgactcaaaacggtagactaataacagcgaaccccatagtcactgataaagaaaaaccggtaaatatagagacagaacctccatttggagaaagctatatcgtgattggggcgggcgagaaggcattaaagctaagttggtttaagaaaggatcatcaataggaaaaatgtttgaagcaacagcaagaggggcaagacgaatggccattttgggagataccgcttgggatttcggaagcatcggaggggtgttcactagcgtcgggaagttagtccaccaagtattcggaacagcgtatggtgttttgttctctggtgtaagctggacgatgaagataggcataggcatcctactaacttggcttggattaaattcaagaagcacttcactaagcatgacgtgtatagccgtagggatggtaacactatacctgggtgttatggtccaggcagattctgggtgtgtaatcaactggaaagggagagagttgaagtgcggatctggtatattcgttacaaatgaggtacacacatggacggaacagtataaattccaggcagactctcccaagaggctctctgcagctattgggaaagcatgggaagaaggtgtttgcggaatccgcagtgccacgcgcttagaaaacataatgtggaagcaaataagcaacgaattaaaccatattctgttggaaaatgacatgaaatttacagtagtggtaggggatgcgaatgggattcttactcaaggaaagaaaatgattcgaccgcaaccgatggaacacaaatatagctggaaatcgtgggggaaagcaaaaataattggtgctgacactcaaaacaccaccttcataattgatggacccgatacccctgaatgcccagacgatcaacgggcatggaacatatgggaagtagaagactatggattcggggtctttacgacgaatatatggcttaaactgcgagattcgtacacgcagatgtgcgatcacaggctaatgagtgcagccataaaagactcgaaagcagtccacgcagatatgggatattggatcgaaagcgaaaagaatgaaacctggaaattagctcgagcaagttttatagaagtgaaaacttgtatatggccaagaagtcacaccttgtggagtaatggagtactagagtcagaaatgataatcccaaaaatatatggaggtccaattagtcagcataattatcgcccgggatatttcacgcaaacggcaggaccttggcaccttggtaaactagaattagattttaacctatgcgaagggacaacagtagtggtagatgagcactgcggaaacagaggtccgtccttgagaacaaccaccgtcacaggaaaaataatacatgaatggtgttgcaggtcatgcacattaccaccactgcgatttcgaggagaggacggatgttggtatggtatggagataaggccagtcaaagaaaaagaagaaaatttggtaagatcaatggtcagtgccgggtctggagaggtagactccttttctttgggactattatgcgtaagtatcatgatcgaggaagtaatgagatcgagatggtcaagaaagatgcttatgaccggcacattagctgtgttctttctattaataatgggacaattaacttggaatgacctaataagactatgtataatggtaggagcaaatgtaagtgaccgaatgggaatgggaaccacttatctagcattaatggctaccttcaagatgcgtccaatgttcgcagtaggactattatttagaagactaacgtcaagggaggtactgttattgacaataggtctaagtctagttgcaagtgtagaattaccaaacagtctagaagaattaggggatgggctagcgatgggcataatgatgttaaagttacttacagattttcaatcgcaccaattatggacgacattactatctttgacttttattaaaacaacacttagcttagattacgcatggaaaacgatggctatggtcttatcaatagtaagtttgtttccactttgtttatctacaacatctcaaaagacgacgtggctgccagtattattagggagctttggttgcaaaccactcacaatgtttcttataacagaaaataaaatctggggacgaaaatcctggcctctaaatgagggcataatggcggttggtatagtatcgatactattaagttccttactcaaaaacgatgtgccgttagcagggcctctaatagctggtggaatgctcattgcgtgttatgtcatatcggggtcgtcagcagatttaagtttagaacgagcggccgaagtgagttgggaagaagaggctgaacactccggagctagtcataatattctggtagaagtccaagatgatggcacaatgaagataaaagacgaggaaagagacgacacgctaacgatattgctaaaagccaccttacttgccgtttccggtgtttatcccatgtcaatacctgcaacattgtttgtatggtatttttggcagaagaagaaacaaagatcgggagtactatgggatacgccaagcccaccagaggtagaaagagcagtgttggatgatggtatatacagaatactgcagagaggattactaggtaggtcacaagtgggagtgggggtattccaagatggtgtatttcatactatgtggcatgtcacaaggggagccgtattgatgtatcaaggtaagaggctcgagccttcttgggcgagcgtaaagaaagatctaatctcatatggtggaggctggcggttccaaggatcctggaatacgggtgaagaagtgcaagtaatagcggtagagccagggaaaaatcccaaaaatgtgcagaccactcctggcacatttaagacaccagaaggggaagtgggcgcaattgcgttagattttaagcccggaaccagcggatcccctatagttaatagagagggtaagattgtaggactatacggtaatggagtcgtaaccacttctggtacatatgtttccgcaatagctcaggcaaaagcgtctcaggagggtccgctacctgaaatagaggatgaggttttcaagaaacggaacttaaccattatggacttacaccccggatcaggaaaaactaggagatatttaccagcaatagtaagagaagcgattaaaagaaaacttcgcacactgatactcgcaccgacaagagtagtggcctctgaaatggcagaagcactaaaaggcatgcccataagatatcaaactactgcggtgaaaagcgagcatacgggaaaagaaatcgttgatctaatgtgtcacgcaacatttactatgcgcctgctttcaccagtgcgagtcccaaattataatatgataattatggatgaggcccacttcacagaccccgcatctattgcagcacgaggttatatatccacccgagtggggatgggtgaagctgcagcaattttcatgactgcaacaccacccggtagtgtggaagcatttcctcaatcaaacgccgtaatacaagatgaggaaagagatatcccagaacgttcatggaactctggctatgattggataacagacttccctggcaaaacggtatggtttgttccaagtataaagagtgggaatgatatcgcaaattgcttgaggaaaaacggtaaaagagttatccaattaagtcgaaaaacatttgatacagaataccagaaaaccaaaaataacgattgggactatgtagtaactaccgatataagtgaaatgggtgccaattttcgtgctgatcgagttattgatcctcgaagatgtctaaaacccgttatactgaaggacggacctgaaagggtcatcctagcaggtccaatgcctgtaacggccgcatcagcagcccaacgaagagggagaattggacgaaatcaaaacaaagaaggggatcaatatatatatatgggacaaccattaaacaatgacgaggaccatgcgcattggactgaggctaagatgctattagacaatattaacacaccagaaggaattattccagctttatttgaacctgaaagagagaaaagcgctgcaattgacggtgaatataggctgcgcggtgaagcaaggaagacctttgttgagctaatgcggcgaggcgatcttccagtatggctatcctataaagttgcatcagaagggttccaatactcagatcgaaggtggtgctttgatggggagaggaacaaccaagtattagaagaaaatatggacgtagaaatttggacacgcgaaggcgaacgaaagaaattaaggccaaggtggttagatgcacgaacctattcagacccgttggctctgcgagaatttaaagaatttgcagctggacgaagatcggtctctggagatttaattttggagattgggaaactaccacaacacttaacattaagagcacaaaatgcccttgacaatctggtaatgctgcataactcggaacaaggaggaaaagcgtacagacacgcaatggaggaattacccgatacgatcgaaaccttaatgctcttagcattgatcgccgtcctaaccggtggagtaacactatttttcttgtcagggaagggtttgggcaaaaccagcatcggattattgtgcgtaatggcgagctctgtgttactatggatggcgagtgtcgaacctcactggatagcggcaagcataatattagaatttttcttaatggttttactcatacccgaaccagaccgacaaagaacaccacaagataatcaactagcatacgtagtcattggactattatttatgatacttactgtagccgcgaacgaaatggggttgctcgaaacaaccaagaaagacttaggcattggacatgtcgtagcagaaaaccatcatcatgcaactatgttagacatcgatctacacccggcatcagcatggaccttgtatgctgtagcaaccacaattatcactcctatgatgaggcatactatcgagaatactacagccaatatatccttaaccgcaattgccaaccaagcggcaatactcatgggactagataaaggctggcctatttccaaaatggacataggagtccccttattagcactcgggtgttactcccaagtcaatccattaacgctaactgcggcggtgctaatgcttgtggcacattatgcaattataggaccaggcctacaagccaaagcgactagagaggcacagaaaagaacggcagcagggataatgaaaaatccaaccgttgacggaatagttgctatagacttggatccagttgtttacgatgccaaatttgaaaaacaactggggcagattatgctattaattttatgtacttctcaaatccttctgatgcgaacaacatgggcattatgtgaaagcattacactagctactggcccacttacgactctctgggaaggaagtcctggacgattttggaatacaacgatagcggtaagcatggcaaacatatttcgaggaagttacctagccggtgctgggcttgcgtttagtcttatgaaatcattagggggtggacgtaggggaacaggagcccaaggagaaacattaggcgaaaaatggaagagacaattaaatcaattatcaaaatccgagttcaatacctataagcgaagtggaataatggaagtagatcggagcgaggctaaagaaggacttaaacgaggagaaacgacgaaacatgccgtgtctcggggtacagctaagttgagatggtttgtagaacgcaacttagttaaaccagaaggtaaagtaattgatttaggatgtggtagaggtggctggtcttattattgcgcaggactcaagaaagtcactgaggttaagggatatacaaaaggagggccggggcacgaagaaccaatacctatggcgacttatggatggaacatcgtgaagttacactccggaagagacgtatttttcacaccccctgaaaaatgcgacactctgctatgtgatattggggaatcgagtcccaatccaacaatcgaagaaggaaggactctcagggtcctgaaaatggtcgaaccttggctgagaggaaaccaattttgcataaaaattttaaacccatacatgccttcagtggtcgaaacattagaacaaatgcaaagaaagcatggcggtatgttggttcgaaacccactatccaggaactcaacacacgaaatgtattgggtatcatgtggaactgggaatattgtatcagccgtaaacatgacgagcagaatgctgctaaatcgattcacgatggctcatcgtaaaccgacctacgaaagagatgtagacttgggagctggaaccagacacgtcgcagtagagccggaaatagctaaccttgatattatagggcaacgcattgaaaacataaagaacgaacacaaatctacttggcactatgacgaagacaacccttataaaacatgggcgtaccatggcagctacgaagttaaaccctctggtagtgcctcgtccatggtaaacggcgtggtcaggcttttaactaagccgtgggacgttatacccatggtcacccaaatagctatgacggatacgacacctttcggacagcaaagagtgttcaaagaaaaagtcgatacgaggacaccgagaccaaagaggggcactgcgcagataatggaagtaacagctaaatggctttggggttttctgtcaagaaataaaaagcccagaatatgtactagagaggaatttacacgtaaggtccgctcaaatgctgctataggagcagttttcgttgacgaaaatcaatggaactcggctaaagaggctgttgaagacgaacgattttgggatttggtacaccgtgaaagagagctacacaagcaaggaaaatgtgcaacatgtgtgtataatatgatgggcaaaagggaaaagaagctcggggaatttggaaaagctaaaggatccagagcgatctggtatatgtggctgggtgcaagatttctcgaatttgaagctctaggctttatgaatgaagaccattggttttcaagggaaaattctctctcaggtgttgagggagaagggctccataaactcggctatatcttacgtgatataagtaaaattccaggaggaaacatgtacgccgatgacactgcgggatgggatacacggataactgaagacgatttacagaatgaggccaagattactgatataatggagcctgagcacgcattgctagcgacttcaatctttaaactaacctatcagaacaaggtcgtgcgtgtacagagaccagctaagtctgggacagtaatggatgtcatttcacgtcgcgatcaacgagggagcggacaggtaggaacttacggtcttaatacatttaccaatatggaggtacaattaataaggcagatggagtcagaaggaatctttagtccttcagagctcgaaaactccaatctagcagaaagggtacttgactggcttgaaaaacatggggttgaaagattaaagcgtatggcaatcagtggggacgattgtgttgtgaagcctactgacgaccgttttgctacagcccttaccgcactcaatgacatgggaaaagtacggaaggatatcccgcaatgggaaccaagcaagggttggaacgactggcaacaagttccattttgctcacaccacttccaccaattaatcatgaaggacggtcgtgagattgttgttccctgtaggaatcaagatgagttagtaggtcgagcgcgagtttcacaaggagccggatggtcattacgtgaaacagcctgcctggggaagtcatacgcacaaatgtggcaacttatgtacttccaccggcgagacttgagactggctgcaaatgcgatttgctcagcagtcccagtaaactgggtacctacttccaggacgacatggagcattcatgcacatcaccaatggatgacgaccgaggatatgcttagtgtatggaaccgggtctggatagaggaaaatccttggatggaagataaaacgcacgtctctagctgggaagacgttccatatctgggaaagagagaagatcagtggtgtggctcactcataggattgacggcaagggcaacatgggctacaaatatacaagttgccatcaatcaagtccggcgtttgataggaaatgaaaattatctggattacatgacatctatgaaaagattcaaaaatgaatccgaccccgaaggggcactatggtaa

SEQ ID NO: 22088 - RNA, 9879 nt, synthetic construct
  misc_feature 1..9879: note = derived and/or modified CDS sequence (opt6) from DENV-1__GU370048__SS-prME
  source 1..9879: mol_type = other RNA
tcagtaacaatgcttctaatgttaatgcctacagcattagcatttcatctaacaacaagaggaggtgaaccgcacatgatagtatccaaacaagaaagaggtaaatcactattgtttaaaacatccgccggtgttaatatgtgtacattaatagcgatggacttgggagaactgtgtgaagacacgctcacctataaatgtcctcgaataacagaagctgagccagacgacgtagactgttggtgtaatgcgaccgatacttgggtaacctacggaacatgttcgcaaacgggtgaacatcgtcgagataaacgaagtgtagcattggccccacatgtaggtctcggattagaaactagaacagaaacttggatgagcagcgagggtgcttggaaacaaatacaaagggtagaaacatgggctttaaggcatccgggattcacggtgatagccctctttctagcacacgcaattggaacttccataacgcaaaaaggaatcatattcatactattgatgcttgttacaccctcaatggccatgagatgcgtcggcatcggaagcagagattttgtggaaggacttagtggggccacctgggttgacgtagtactcgaacatggatcctgtgtgaccacgatggccaaagacaaacccacattagatatcgaattacttaaaaccgaagtaactaatccagcagttttaagaaaattatgcattgaggctaaaatctcaaacacaactacggacagccgttgtccaactcaaggcgaagctacgttagttgaggagcaagatgctaatttcgtgtgtagaaggactttcgttgaccgtggctggggtaatggatgcggtttatttggcaaaggatctctaattacatgtgcaaaatttaaatgcgtaacaaaattagaaggtaaaatagtccaatacgaaaatttaaaatactcagtgatagtaactgttcatacaggcgatcaacatcaagtcggcaatgaaagcaccgaacatggaacgactgcaaccataacaccacaggcgccaaccacggagatacaactaaccgattacggggcgttaaccttagattgttcgccgagaacaggtcttaatttcaatgagatggttttattaacaatgaaagaaaaatcttggttagttcataaacaatggtttctagacttacctctcccctggacgagcggtgcatccaccactcaagaaacgtggaaccgtcaagatttgcttgtcacatttaaaacggcccacgccaagaaacaggaagtcgtagtgttaggcagtcaagaaggggctatgcatacagcactgactggtgctaccgaaattcagacgtcagggactacaaccatttttgcaggccacttaaaatgtcggcttaaaatggataaactaacgcttaaaggaatgagttacgtgatgtgtactgggagcttcaaactcgaaaaagaagttgcggagacacaacatggaacggtcctagttcaaatcaaatatgaaggaacagatgcaccctgtaaaataccattctcaactcaagatgaaaaaggtgttacccagaatggacgacttataacggcgaatcctatagtaaccgataaagaaaaacctgtgaacatagaagctgagccaccgtttggtgagtcctatattgttattggtgctggtgaaaaagcgctaaaacttagttggttcaagaaaggaagttctatagggaaaatgttcgaagcaacggctagaggggcccgtagaatggcgatacttggtgacaccgcatgggatttcggaagtataggaggagtgtttacaagtgtaggtaaattagttcaccagatttttggaacggcttacggtgtactctttagcggagtatcttggacgatgaaaatcggcataggtgtgttacttacttggctagggctgaatagcagaagcacatcgttatctatgacttgcatagccgtaggacttgtgaccctctatctaggggtcatggtacaggccgattctggatgcgtgataaattggaaaggaagagagttaaaatgtggatctgggattttcgtaactaacgaagttcatacatggactgagcaatacaaatttcaggctgacagcccaagaaggctttcggcagccataggcaaggcttgggaggaaggagtctgcggaatcagaagcgctactaggttagaaaacataatgtggaaacaaatatcaaatgagcttaatcacatcctattagaaaacgacatgaaatttactgttgtcgtcggggatgtagcaggaatcttagctcagggtaagaaaatgataaggccacaacccatggaacacaaatatagctggaagagttggggaaaggcaaaaatcataggtgcagacgtacaaaacactacttttatcatagacggacctaatacgcccgagtgcccagacgaccagagggcttggaatatttgggaagtggaagactatggctttggtatttttacaacgaacatttggttaaaactacgtgattcttatacccaggtatgtgaccacagattaatgagcgcggccatcaaagatagcaaagccgttcatgcagacatgggatattggattgagagtgagaaaaacgaaacttggaaactagccagagcaagtttcatcgaagtaaaaacttgtatctggccaaagtctcataccctttggtccaacggtgttctggaatcagaaatgataatcccgaaaatctatggagggccaatatcgcaacacaattatcgaccaggctatttcacacaaactgccggtccatggcaccttggaaaacttgaacttgatttcgatctgtgcgaaggaacaacagttgtcgtagacgaacattgtgggaacagggggccttcactgcgcacaacgactgtaacaggcaagattattcatgagtggtgttgccggtcctgcactctacctcctttaagatttaggggagaggatggttgctggtacggaatggaaatacgcccagtcaaagaaaaagaagagaacctagtcaaatcaatggtcagtgctggttcaggagaagtggattctttctcgttaggattactatgtatatccataatgatcgaggaggtaatgcgctcacgatggtcgaggaaaatgcttataacgggtactttggcggtctttttcctattgataatgggtcaggtaacctggaacgacttaattcggctatgcattatggtgggtgctaacgcttcagatcgaatgggaatgggaactacatatttagcattgatggcgacctttaaaatgcgccccatgtttgctgtaggattgcttttcagacgactcactagcagagaagtcctcctgttaacaataggtctatctctagtagcctcagtggaattaccaaactcactagaagaactgggagatggcctggcgatggggattatgatactaaaactattaacagactttcagccccatcagctatgggcaactctactatcattaacctttattaaaactacctttagtttgcattacgcctggaaaactatggctatggtattaagtatagtttcactatttccgctttgcttaagtactacgtcacagaaaaccacttggctacctgttttactggggtcactcggatgcaaacctctgactatgttcttaattgcagaaaacaaaatctggggccgtaagagttggccactaaacgaaggcataatggctgttggtatagtatcaatactcctctcttcattactgaaaaatgatgtaccattagcaggaccattaatcgcaggaggaatgcttattgcatgctatgtaatatctggttcgtcagcagatctcagtcttgaaaaggcagctgaagtaagctgggaagaagaagcagagcactcaggagcaagccataatatcctagttgaggtacaagatgatgggacgatgaagattaaagatgaggaaagggatgacactctaactatcttattgaaagcaaccttattagccgtcagtggtgtatatccgctaagcattccagcaacgctattcgtttggtacttttggcaaaagaagaaacaaagatctggagtgttatgggacacacctagtcctccagaagtagaacgggccgtactcgatgacggtatatacagaatcatgcaaaggggcttattaggccgatcacaagtaggcgtaggagtgtttcaggaaaacgtgttccatacaatgtggcatgtcactaggggagcagtacttatgtaccagggaaaaagattggaacctagctgggctagcgttaagaaagatctaatatcatacgggggcggatggcgtctgcaaggatcatggaatacaggtgaagaagtacaagttatagctgttgagcctgggaaaaatcccaaaaatgtacaaacagctcccggaacatttaaaacccctgaaggcgaagttggtgcaatcgcgttagattttaagccaggcacatcaggctcaccaattgtaaacagagaaggaaagatcgtgggtctatacggcaacggagtagtaacaacaagtggtacgtatgtttcggctatagctcaagctaaagcatcgcaagaaggtccattaccagagattgaagatgaagtattcagaaaaagaaatctaacaattatggacctacatcctggatctggaaagacaaggcgatatctaccagcaatcgtacgagaagcgataaaacggaagctcaggacactgatactagcaccgaccagagttgtagcaagtgaaatggctgaagccttgaagggaatgccaattcgatatcaaacaacagcagtgaagtcggaacatacggggaaagagatagtggacctaatgtgtcatgcaacgtttacgatgcgcctgctctcccccgtacgagtaccaaattacaacatgataatcatggatgaagcccatttcaccgatccttcctcaatagcagcaagagggtatataagtacccgcgttggcatgggagaagccgcagcgatttttatgacagcgacaccgcccggaagtgtggaggccttcccacagagcaacgcagttatccaggatgaggaaagagacatcccagaacgctcgtggaatagtggatatgaatggataacagactttccaggaaaaaccgtatggtttgttccttctataaagtcgggtaatgacatcgcgaactgcctcaggaaaaatggaaaacgagtcatacagctctcacgcaaaacgttcgacacggaataccaaaagactaaaaataatgactgggattacgtcgtaacgacagacatttccgaaatgggagctaattttagagctgacagagtcatcgatccacgaagatgtctaaaacctgtaattctcaaagacggacctgagagagtcattttggcgggtccaatgcctgtaaccgtggctagtgctgcgcagagaagaggaagaataggacgcaaccataacaaagagggcgatcaatatatttacatgggccaacctttgaataatgacgaagatcacgcacattggacagaagccaaaatgttactagataacatcaacacccccgaagggatcatccccgcactatttgaaccggaacgggaaaagtctgctgcaatagacggcgaataccgcttaaggggagaagctagaaaaacattcgttgaactaatgcgaagaggcgatctaccagtatggctttcctataaggtcgcatctgaagggtttcaatatagcgacaggcgctggtgtttcgacggagaaagaaataaccaagtattagaagaaaatatggatgtagaaatctggacaaaagagggagaaagaaagaaactcagacctagatggctggatgctcggacttatagtgacccattagcactgagagagtttaaagaatttgctgctggccgaaggtcggtctcaggtgatcttatacttgagataggaaaacttccacagcatctaacacagcgtgcgcaaaacgcactagacaatctagttatgctacataactccgagcaaggcgggagggcatatcggcatgcaatggaagaactaccagatactatagaaacacttatgctattggcgttaatagctgttcttactggtggtgtgacattattctttttaagtggacgtggactaggcaaaaccagtatcggattattatgtgtaatggccagtagtgtccttctatggatggcatccgtggaaccacactggatagcagcttcgataatactagagttctttttgatggtcttactaatcccagaacccgatagacaacgtacgcctcaagacaatcaattagcatatgttgtcataggattactattcatgattttaaccgttgcagcaaacgaaatgggattgttagaaactacgaaaaaggacttgggaattggacatgtggcagtggaaaatcaccaccacgcagcaatgctagacgtagatttgcacccagcatccgcgtggaccttatatgcagtagcgactacaatcattactccaatgatgcgtcatacgatagaaaatacaactgccaatataagtttaacagcaattgcaaaccaggcagctatattgatgggactcgacaaaggatggcctatatctaaaatggatatcggcgtaccgttattagcactgggctgttacagccaagttaaccctcttacactcacggcagctgtcttaatgttagtagcacattacgcaataattggtccgggactgcaggctaaagcaactagagaagcgcagaaacggacagcagcgggaattatgaaaaatcccacagtagatggtatagtagctatagacctagatccagtggtgtacgacgcaaaatttgaaaaacagctaggacaaataatgctacttatactttgtacttcacaaatactgttaatgcgaacaacctgggctctatgcgagtctatcaccctagcgacaggtccgcttacgacgttatgggagggttctcccggtaaattttggaataccacgatagcggttagcatggcaaacatatttcgagggtcctatcttgcaggggcaggcctagccttctcattaatgaagtcgcttggagggggacgtcgaggaacaggagcccaaggagagacattaggggagaaatggaaaagacagttaaaccaactttcaaaatccgaatttaatacttataaaaggagtgggatcatggaagtagatagaagcgaagcaaaagaaggattaaaaagaggtgaaactacaaaacatgcagtgtccagggggacagctaagctacgctggtttgttgaacgaaacctcgtaaagcctgaaggtaaggtgatcgacttagggtgtgggaggggaggatggtcttattactgtgcaggtttgaagaaagtgacagaagtcaagggatatactaagggtggaccgggacatgaagaaccgattccaatggcaacttacggatggaatcttgttaaactacacagcgggaaggatgtgttcttcatacctccagaaaaatgcgacacgctattatgtgatattggagaatcttctcccaatccgacgattgaagagggaagaacacttcgggtacttaaaatggtcgaaccatggctacgcggcaatcaattttgtataaaaatactaaacccgtacatgccatctgtagtagaaacattagagcaaatgcagaggaaacacggaggcatgttagttagaaaccctctatcccgcaattccacacatgaaatgtactgggtaagctgtggtacaggtaatattgtatcagccgttaatatgacctcacgcatgctactgaatagatttactatggcacatagaaaaccaacatacgaaagagatgtagatttaggtgccggaacgaggcacgtggcagttgagcccgaagtcgcaaatctcgatatcataggtcaaagaattgaaaacattaagcatgagcacaagtcaacgtggcattatgatgaggataacccttataagacatgggcataccacggatcttatgaagtaaaacccagcggaagtgcatcttcaatggttaacggcgttgttaaattactaacaaaaccttgggatgtaatacccatggttacgcaaattgccatgacagatacaacaccattcggtcaacaaagagtcttcaaagaaaaagtagatactagaacacctaaagccaaaaggggcactgcacaaataatggaagtcacggcgagatggttatgggggttccttagccgaaacaagaaaccacgtatatgtacgagagaagaatttactcgaaaggttcgtagcaatgcagcgataggagcagtatttgtggatgaaaaccagtggaacagcgccaaagaagctgtggaagatgaaagattttgggacctagttcacagagagcgtgaactccataaacaaggaaaatgcgccacatgtgtctacaacatgatgggaaaaagagagaagaaactaggagagtttggtaaagcgaagggatcgcgcgcgatctggtatatgtggctcggtgcaagattcttagagtttgaagccttgggattcatgaatgaggatcactggttttcacgagaaaactctctgtcgggggttgagggagaaggccttcataaacttgggtatatattgcgggacatttctaaaataccagggggaaacatgtatgctgatgatacggcgggatgggacacaagaataacagaagatgatttacagaatgaggccaagataacagatataatggaaccggaacacgcgttgttagctaaggcaatattcaaactaacctaccaaaacaaagtagtgcgtgttcaacgccccgccaaaaacggaacagttatggatgtaatatcacgaagagatcaacgtggaagcggacaggttggaacatacgggttaaacacgttcactaatatggaagcacaactaattcgacagatggaatccgagggaatattctctccatccgaactcgagactcctaatttggcagaaagagttctgtactggttagagaagtatggtgttgagcgcttgaagcgcatggcgatatccggggatgattgcgtagttaaacctattgatgaccgttttgcgactgcactcaccgctttaaacgatatgggaaaagtacgaaaagatataccacaatgggaacctagtaaaggttggaatgattggcaacaagtaccgttctgttcccatcactttcaccaactgataatgaaagatgggagagaaatagtcgttccttgcagaaaccaggatgaactcgtgggtagagcacgggtgtcacaaggagcaggatggagtttaagggaaacagcatgtttaggaaagtcttatgcacaaatgtggcaattaatgtactttcacagacgcgatcttagactggcagctaacgcgatatgctcagcagtaccagtagactgggtacccacaagtcgtacaacttggtcgattcacgcacatcatcaatggatgacaacagaggacatgttgtcagtatggaatagagtttggatagaggaaaacccatggatggaagataaaacacatatctcgagttgggaagacgtcccatacttaggaaaacgtgaagaccaatggtgtggtagtctcataggattaaccgctagagccacatgggcgaccaacatacaagtcgcaattaaccaggttaggagattaataggtaacgaaaattatctggactatatgacatctatgaaacgcttcaaaaatgaatctgatcctgagggtgcactttggtaa

SEQ ID NO: 22089 - RNA, 9879 nt, synthetic construct
  misc_feature 1..9879: note = derived and/or modified CDS sequence (opt6) from DENV-1__KM403627__SS-prME
  source 1..9879: mol_type = other RNA
tcagtaactatgctcttgatgttacttccgactgcattagcatttcatttaactacccgcggtggagaaccgcatatgatagtaagtaaacaagaaagaggaaaaagcctgttgtttaaaacgtctgcaggggttaatatgtgtactttgattgcaatggacctcggagaattatgtgaggacacaatgacctacaaatgccccagaataactgaagcagaacccgacgacgtcgactgctggtgtaatgctaccgacacttgggtgacctacggtacttgtagtcaaactggagaacatcgaagagacaaacgatcagtagctttagcccctcacgtaggtttgggacttgagacgagaactgaaacatggatgtcatcagagggagcttggaggcaaatacaaaaagttgaaacatgggcgctaagacatcccgggttcaccgtgatagcattatttttggctcatgctataggtacctccattacgcaaaaaggtataatatttatacttctcatgctcgttacaccgtcaatggcaatgagatgtgtcggaattggaaatagggattttgtagagggattaagcggagctacgtgggtagatgttgtgctcgaacacggcagctgtgttacgaccatggccaaaaataaacctacattggatatcgaactattaaaaaccgaagttacaaacccggcagtattgaggaaactctgtatcgaagcaaaaataagtaacacaacaaccgattctaggtgccctacccaaggagaagcaaccctcgtcgaggagcaagacgcaaattttgtttgtcgacgcacgtttgttgaccgcggatgggggaatgggtgtggtctattcgggaaaggcagcttactcacgtgtgcaaaatttaaatgtgtaacaaaactagaagggaagattgtccaatatgaaaatttaaaatacagtgtgatcgttactgttcatacaggggatcaacatcaagttggtaacgaaacgacggaacatggtacaatagcaacgataacaccacaagcacctacatcagaaatccaattgaccgactacggggctctgactttggactgctctcctagaaccggattagattttaacgaaatggtattgctaacgatgaaagaaaagagctggctggtacacaaacaatggtttttggacctaccattaccatggacatctggcgctagtacaagtcaagagacctggaatcgtcaagacttgctagtcacgttcaagacagcccatgcgaagaaacaagaagttgtagtacttggatcacaagagggagctatgcataccgcattaacaggtgcgaccgaaattcagacaagtggaactacgacgatcttcgcaggacacttaaaatgtcgactcaaaatggataaattaacgttgaaaggagttagctacgttatgtgcacggggagtttcaagttggaaaaagaggtagcggagacacagcatgggactgtgttagtacaggtaaaatatgaaggtacagatgctccgtgtaaaatcccaatcagtactcaggacgaaaaaggcgtaacccaaaacgggagattgatcacagctaatcccatcgtcacagataaagaaaaaccagtaaacatagaaacggaacccccttttggtgagagctatattgtgataggggcgggagaaaaagccctcaaactaagttggtttaagaaagggagctcaataggcaaaatgtttgaagcaacagccagaggggcacgtagaatggcaatattgggtgatacagcatgggatttcggatctataggaggggttttcacaagtgtcggcaaacttgtccaccaagtgttcggcacggcatatggtgttctattttccggggtgtcttggacgatgaagataggaatagggattctacttacatggttaggacttaacagtaggtccacaagtctatccatgacttgcatcgcagtgggaatggtcacactatacctaggagtcatggttcaagctgactcgggatgtgtgataaattggaaaggacgagaacttaaatgtggatccggaatattcgtgactaatgaagttcatacatggacagagcaatacaaattccaggctgattctccaaaaagactaagtgctgcgattggaaaagcctgggaagaaggagtttgcggaataagatcggccacgagattagagaatatcatgtggaagcagatatcaaatgaattaaatcatattctactagaaaacgatatgaaattcactgtggttgtaggcgacgccaacggtatacttacacaagggaagaaaatgataaggccgcaaccgatggaacataaatacagttggaaatcctggggaaaagcgaaaataatcggtgcagatatacaaaatacaacgtttataatagacgggccagatacgcctgagtgcccagacgatcaaagagcatggaacatctgggaagtagaagactacggtttcggtgtattcaccacaaacatatggctaaaattgagggacagttatacccaaatgtgtgatcacaggcttatgtcagctgcaattaaagatagcaaagcggtacacgctgatatgggatactggatagaaagcgagaaaaatgaaacatggaagctagctagagctagtttcatagaggtaaaaacctgcatatggccccggagccataccttatggtctaacggagtgcttgagagtgaaatgattatcccaaaaatatatggagggccaatatcacaacataactatcgaccagggtactttactcaaactgcgggtccttggcatcttggtaaattagagttggattttaacctttgtgaaggaacgacagttgtagtagacgaacattgtggaaataggggaccaagtctaagaacgacaactgttaccggtaagataatacacgaatggtgttgtcggtcatgcacacttccacccttaagattccgaggtgaagatggatgttggtacggaatggaaataagaccagtaaaagaaaaagaagagaatttggtaaggagtatggtatcggccggaagtggcgaagtagattccttcagtttaggcctattatgtgtatccattatgattgaagaggtaatgcggtctcgctggagtcgaaaaatgttgatgaccggaacgcttgcagtattctttttgttaataatgggtcagttaacatggaacgatcttataagattatgcataatggtcggcgccaatgtctctgatagaatgggaatggggactacgtatcttgccttaatggcgacctttaagatgagacctatgttcgctgttggactattatttagaagattgaccagtcgagaagtcttacttctgaccataggactatcacttgtagcctccgtagaacttccaaattcactagaagaactgggagacggtttagctatgggtataatgatgcttaaattgctaaccgacttccagagtcaccaactatggacaacattgttgagcctaacatttatcaaaaccacgctaagtctagattacgcgtggaaaacaatggctatggtattaagtatagtaagcctctttcctttgtgcctctctacaacatcacaaaagaccacatggcttccagttctattgggatcttttggttgtaagccactaactatgttcttgataaccgagaataaaatatggggccgcaaaagctggccgctgaacgaaggtataatggcagtaggcatagtcagtattctgctatcgtcgctactcaaaaatgatgtacccctagcggggcctctaatcgctggaggtatgttaattgcctgttatgtgatcagcgggagctctgctgacttatcgcttgagagagcagccgaagtatcatgggaggaagaagcagaacattccggtgcgtctcataatattctggttgaggttcaggatgacggcactatgaaaataaaagatgaggaaagggacgatacactaacgattttacttaaagccacactcttagcagtctcaggcgtatatccaatgtcaataccagcaactttattcgtatggtatttctggcagaagaagaaacaaagaagtggcgtgttgtgggacacaccttcaccaccagaagtcgaaagagccgttctcgatgatggcatatatcgcattcttcaacgtgggcttctcgggagaagtcaagttggagtgggagtctttcaagatggtgtctttcatacaatgtggcatgtaaccagaggggccgttttaatgtaccagggaaaacgattagaaccttcctgggcatcggttaaaaaggatctgatttcttacgggggtggatggcgtttccagggaagttggaatactggagaagaagtacaagtcattgctgttgagccaggcaagaatcctaaaaacgtccaaactacaccaggcacttttaagacacccgaaggtgaggttggtgcaatagcacttgattttaaacccggaacaagcggatcaccaatcgttaatagagaaggaaaaatcgtagggctatatggaaatggggtagtgactaccagtggaacgtatgtaagtgcgatcgcacaggcaaaggcaagtcaagagggtcctcttccagagatagaagacgaagtgtttaagaaaagaaaccttaccataatggacttgcatccaggttccgggaaaacccgtagatatctaccagcaatagtgagagaagccattaagagaaaattaagaacactaatactagctccaacacgagtagtggcgtcagaaatggctgaagcgctaaaaggtatgcctatccgatatcaaacaacagctgtaaagtccgaacatactggcaaagagatagtggacctaatgtgccatgctaccttcaccatgcgactcctgtcccctgttcgagtacccaattacaacatgataattatggatgaagcacatttcacagatccagcatcgatcgctgcaaggggatatatatcgacaagggttggaatgggagaagctgccgcaattttcatgaccgcaacgccacccggtagcgtcgagtccttcccgcaatcaaacgcggtgattcaagacgaagagagagacattcctgaacgatcatggaactcagggtatgactggattacagatttcccgggaaagactgtatggtttgtgcctagcattaagagcggcaatgacatagccaattgtttgcggaaaaatggtaagcgggtaatacaactatcgaggaaaacttttgataccgagtaccagaaaactaaaaataacgactgggattatgtcgtgacaacagatataagtgaaatgggtgcaaattttagggcagatagagttatcgatccgcgcagatgtctgaaacctgtcatattgaaagatgggccggaaagagtgatccttgcagggccgatgccagttacagccgcatcggcagcacaaagaagaggaagaataggaagaaaccaaaataaagaaggagatcagtatatatacatggggcaaccgctaaataatgatgaagatcacgctcactggacagaggcaaaaatgttattggataacattaacacaccggagggcatcataccggcattatttgaacccgaaagagaaaagagcgctgcgatagacggagaatatcgccttcgtggggaagcaagaaagacatttgtagaactaatgagaaggggagatctcccagtatggctatcgtacaaagtagcatctgaaggttttcaatattcagacagaagatggtgttttgacggtgaacgcaacaatcaagtcttggaggaaaacatggacgttgagatatggaccaaagagggggaacggaagaaattacgcccgaggtggctagatgctcgtacttactcagatccattagcattgcgagaatttaaagaatttgccgcaggacgcaggtcagtttctggagatttgattctagaaattggtaaactaccacaacatttaactctaagagctcagaatgcattagacaacttagtgatgctacacaactcagaacagggaggaaaggcttatagacacgccatggaagaactaccggatacaattgagacgcttatgttactagcacttatcgccgtacttacagggggagtaacgctattctttctcagtggtaagggactaggtaaaacctctatcgggttattatgtgttatggcttcatcagtattattatggatggcaagcgtagagccgcattggattgccgcaagcattatactcgagttctttttgatggtactattgattcccgaacccgatcgacagagaacgcctcaagataaccaactggcatacgtcgttattggactactttttatgattttaacagtagcagccaatgaaatgggacttctagaaacaacgaagaaagacttgggtatcgggcatgtggtagcagaaaaccatcatcacgcaactatgttagacatcgaccttcatccagcatctgcatggacgctttacgcagtcgcaaccacaatcataacaccaatgatgaggcataccatagaaaacacgacagctaacatttcactgacagcaatagcaaaccaagcagcaatcttgatggggttagacaaaggatggccaatcagtaaaatggacattggagtacccctcttagcattaggttgttatagccaggtgaatccattgacgttaactgcagccgttctgatgctagtggctcattacgctataataggtccgggtctacaagctaaagcgaccagagaagcacaaaagcgaacagccgcgggcatcatgaagaacccaacagtagatggaatagtcgcaattgatttagacccagtagtttatgatgctaaattcgaaaagcaactgggacagattatgctgttaatattatgcacgtcacaaattttactcatgagaaccacctgggcactgtgtgaatcaataacactggctacgggcccgttaacaactctatgggagggaagccccggtaaattctggaatacaactatagccgtaagtatggccaatattttcagaggatcttacttagccggtgctggactggcattctcgcttatgaagagtctaggtggcggaaggcggggaacaggcgctcaaggcgaaaccctaggagagaaatggaaaagacaattaaatcaactctccaagagcgagtttaatacgtataagagatcaggtataatggaggttgatcgatcagaagctaaggagggcctaaagcggggtgagacaacgaaacatgccgtcagtagaggaactgcaaaattgcgatggtttgtcgagagaaatttggttaaaccggagggtaaagttatcgatcttggttgtgggaggggagggtggtcatactattgtgccggtttaaagaaagttacggaggtcaaaggctacacaaagggcggtcctggtcatgaagaaccgatcccgatggcaacatacggatggaatatagttaaactacactcagggagagatgtattctttaccccaccggaaaaatgtgatacattattatgcgacataggagaatccagtccaaaccctactatcgaagaaggaagaacattaagggtattaaagatggtcgagccatggctgcggggtaatcaattttgtatcaaaatactaaatccttatatgccttcagtggttgaaactttagagcaaatgcaaagaaaacatggtggcatgttagtaaggaacccgctcagtcgtaactcaactcacgagatgtattgggtatcctgtggaacaggtaatattgtatccgcggttaatatgacgagccgaatgttacttaatagatttacaatggcacatagaaaacctacatatgaaagagatgtagacttgggagcaggaacaagacacgtcgccgtggaacccgaaatagcgaatttagacataataggccaaagaatagaaaatatcaaaaatgaacataaatctacttggcattatgacgaagataatccatataaaacctgggcctaccatggaagttatgaagttaaaccatcgggatcagcgagcagtatggtcaatggtgtagtcagactacttacaaagccgtgggatgttattccgatggtaacacaaatcgcgatgacagacacaaccccatttggtcagcaacgagtttttaaggaaaaggtagatacacgaacgcccagaccaaaacgaggtaccgcccaaattatggaagtcacagcaaaatggctgtggggctttttatcgcgaaacaagaaaccaaggatatgtactcgagaagaatttacgagaaaagtcagatctaacgcagccataggggcggtgttcgtggacgaaaatcaatggaacagcgctaaggaagcagtagaagacgagcgcttttgggatctagtacatagagagcgagaattgcataaacaaggaaaatgcgccacatgtgtttataatatgatgggtaagcgtgagaagaaattaggagaatttggcaaagcaaaaggatctagggcaatttggtatatgtggctaggggcaagattcctggaatttgaggccttaggttttatgaatgaagaccactggttctctagggagaatagtctctctggtgtcgaaggagaaggacttcataaattaggatacatcttacgggatatttctaaaatccctggtggtaatatgtatgcagacgataccgcaggttgggatacaagaataacagaagacgatctccaaaatgaggcgaaaatcacagatataatggaaccagaacacgctttacttgcaacctcaatatttaaattaacgtatcagaacaaagtggttcgggtacaaagacccgcaaaatccgggaccgtcatggatgtgatatcaagaagagaccaaagaggaagtgggcaagttggtacctatggccttaatacgtttacaaacatggaagtacaactaataaggcaaatggaatctgaaggcatattttcaccgtcggaattagaaaattccaacctagcggaaagagtactggactggctagaaaaacacggagttgaaaggttgaaacgtatggcaattagcggtgatgattgcgtcgtaaaacctaccgacgatagattcgcaacggcactaacggcattgaatgacatgggaaaagtaagaaaagacataccccaatgggaaccatcaaaaggctggaacgattggcaacaggttccgttttgttcccaccactttcatcagctaattatgaaagacgggcgagaaatcgttgtaccatgtcgaaaccaagatgaactcgttggaagggcaagagtcagtcaaggagcgggctggtcattgcgtgaaacagcttgtctaggaaaatcctatgcacaaatgtggcaattaatgtacttccatagacgagatctcaggctagcggcgaatgcaatatgtagtgctgtaccggtaaactgggtccccacaagtagaaccacttggtcaatacacgcacaccatcaatggatgactactgaagacatgctatctgtgtggaatcgtgtctggatagaagagaatccctggatggaggataagacccatgtcagttcatgggaagacgttccctatttaggaaaacgagaagaccaatggtgcgggtctctaattgggctaactgctcgcgctacatgggcaacaaatatccaggttgcaataaatcaagtgcgacggctgatagggaacgagaactatctagattacatgacctctatgaaaaggttcaagaatgaatcagatcctgaaggtgcactatggtaa

SEQ ID NO: 22090 - RNA, 9879 nt, synthetic construct
  misc_feature 1..9879: note = derived and/or modified CDS sequence (opt6) from DENV-1__KM403584__SS-prME
  source 1..9879: mol_type = other RNA
tcagtaactatgttattgatgcttctaccaacagcactggcatttcacctgactacaaggggtggcgaacctcacatgatagtatcaaaacaagaaaggggtaaaagtttactatttaaaacgtccgctggcgtgaacatgtgtactttgattgcaatggacttgggcgaactctgtgaagacacaatgacttataaatgtccaaggataacagaggcggagccagatgatgttgactgctggtgtaacgccacagacacgtgggtcacgtatgggacatgctctcaaacgggtgaacaccgcagagacaaaagatcagttgcgttagctccacacgtaggattaggcctggaaactcgcacagaaacttggatgtcctcagagggtgcgtggcgccaaatacaaaaagttgagacatgggcgctccgacaccctgggttcacagtgatagctttgttcctagctcatgctataggaacaagtataacacaaaaaggaattatatttatattactcatgttagttaccccaagcatggcaatgcgttgtgtcggaatcggaaacagagattttgttgaaggtcttagtggagcaacgtgggttgacgttgttttagagcacggtagttgcgtaacgacaatggccaaaaataaaccaacattagacatcgaactgttaaaaacggaagttactaatccggcagtattacgaaaattgtgcattgaggccaaaatttccaatactacaacagacagccgttgtccgacgcaaggtgaagcgaccctagtagaggaacaggatgctaactttgtttgcaggcgaactttcgtggatcgaggttggggtaatggctgtgggttattcggtaaaggtagcttattgacctgtgccaaatttaaatgcgttactaaattagaaggcaaaatagtacagtacgaaaatttgaaatatagcgtgattgttactgttcatactggagatcaacatcaagtagggaatgaaaccacagagcatggaacaatagcaactatcacaccacaagcacccacttctgaggtacagttaacagactacggagctttaacacttgactgcagtcctagaacaggtctggatttcaatgaaatggtattacttactatgaaagaaaaatcgtggttagtccacaaacaatggttcttagaccttcccttgccctggacaagtggtgctagcacatctcaagaaacttggaatagacaagatctcttagttacgtttaaaacagctcacgccaagaaacaggaggtagtagtattaggaagtcaagaaggtgctatgcatacagcactcactggcgcgacggaaatccagacgagtggcacaacaactatattcgccggtcatttaaaatgccgtctcaaaatggacaaattaaccttaaaaggcgtaagctatgtaatgtgtaccggatcttttaaactagaaaaagaagttgcagaaacccaacatggaacggttttggtacaagtaaaatatgaaggtaccgatgctccatgtaaaatacctatctcaacacaagatgaaaaaggagtaacccaaaacggacgattaataactgcaaacccaatcgtaactgataaagaaaaacctgtaaatatagaaacggaacctccatttggagaatcatacatcgtaatcggggctggggaaaaagcgctcaaattaagttggtttaagaaagggtcatcgattggtaaaatgtttgaggccactgcgagaggagcacggcggatggcaattttaggggatacagcatgggacttcggcagcataggtggtgtgtttacctccgtaggcaagctagtacatcaagtctttggtacagcgtacggagttcttttctcaggtgtatcatggacaatgaaaataggtattggcattctattaacttggcttgggctaaattcacgatcaacatcactcagtatgacgtgcatagcagtaggtatggttacactatacctaggggtaatggtacaagccgacagtggatgcgttattaactggaagggtcgggaattaaaatgtggttctggcatatttgttacaaacgaagtacatacttggaccgaacagtacaaatttcaagcagatagtcctaaacggctaagcgccgcaataggaaaggcttgggaagaaggagtttgcggaataagatcagcaactagactcgaaaacattatgtggaaacaaatatcaaacgagttgaaccatatattactggaaaacgatatgaaattcacggtagttgtaggagatgcatatggaatactaacgcagggtaagaaaatgattaggccacaacccatggagcacaagtacagttggaagtcatggggtaaagccaagataataggtgctgatacccaaaacacaacatttataatcgatggtcctgatactcctgaatgcccggatgatcaacgagcatggaacatatgggaggttgaagattatggattcggggttttcactacgaacatttggctgaaactacgggactcatatacacaaatgtgtgatcatagactgatgtctgcggcaataaaggacagtaaagctgtacacgccgacatgggatattggatagaaagtgagaaaaatgaaacatggaaattggccagggcctcatttatagaagtcaaaacttgtatctggcccaggtctcatacactatggtccaacggggtattagaatcagagatgattataccaaaaatatacggagggccgatttcacaacacaactataggccaggatatttcacccaaacagccgggccttggcatcttggaaaactggagcttgatttcaatttatgtgaaggcacaacggtggtagtagacgaacactgtggaaacagaggtccgtcactaagaacaactactgtaaccggcaaaataattcatgagtggtgttgcagatcatgtactctacctccgttacgatttcgaggagaagatggatgctggtatggaatggaaataagaccagtcaaagagaaagaagaaaatttagtaagatctatggtatcagcaggctctggagaagttgactctttctctcttggacttctatgtgtatctataatgattgaagaagtcatgagatcacggtggagtcgcaagatgttgatgacaggaacattagctgtcttctttctactaataatggggcaacttacatggaatgacttaatccgattgtgtataatggttggtgctaatgtcagcgatcgaatggggatgggaaccacatacttagcactaatggctaccttcaaaatgagacccatgtttgctgttggccttctctttagaaggctaacaagtcgagaagtgctactattaactataggtctatctttagtagcgagcgtggaacttcctaattcattagaagaattaggagacggattagcgatgggaatcatgatgctaaaacttttaacggattttcaaagccaccagctttggacaacactcctttctcttacatttattaaaactacactatctctagattatgcctggaaaacaatggcaatggtcttgtccatagtgtcgttgtttccattgtgtttgtcgacaacatcacagaaaaccacatggttaccggtactattgggttcgtttggatgcaaacctttgacgatgttcttgataactgaaaataaaatttggggtcggaaatcgtggcctttgaatgaaggcattatggcagtagggattgtatccatccttttgagtagcttattgaaaaatgacgtaccactggcaggaccattaatagcaggaggaatgttaattgcttgctatgttatatcggggtcatcggcggatctaagtctagaaagggctgctgaagtttcatgggaagaggaagccgagcattcaggcgcttcccacaatatacttgtcgaagttcaagatgacggcacaatgaaaattaaagacgaagaaagggatgataccttgacaatattgctaaaagcaacattgctagccgtctccggcgtttatcctatgagtataccggctaccttatttgtatggtatttttggcagaagaagaaacaaagatccggagtattatgggatacaccatcacctcctgaggtagagagagctgtattggatgatggtatatataggattttacaaagaggcctattgggtagatcacaagtaggagtgggagtttttcaagacggagtatttcacactatgtggcacgtcaccagaggagcggtattgatgtatcaaggtaaaaggcttgaaccttcctgggcttccgttaagaaagatctcatttcttatggaggaggatggagattccaaggctcatggaacaccggagaagaggttcaagtaatagctgttgagcccggtaaaaaccccaaaaacgtacagacgacgcctggaacctttaaaacccctgaaggcgaggtcggtgctatagcgctagatttcaaaccagggacttccggaagtcctatcgttaatagggaaggtaaaattgtgggactctatggtaatggtgttgtgactactagcggcacgtatgtaagtgccatagcacaagcaaaagcctcccaagaaggtcctttacctgaaatagaggacgaggtctttaagaaaagaaatttaactataatggacttgcatcctggctcgggtaagacacggagatacctacctgcaatagtacgcgaagcgattaaacgtaaacttcgtacactaattctagcacccaccagggtagttgcaagtgagatggctgaagcattaaaagggatgccaatcaggtatcaaacaacggctgtaaagagtgagcatacggggaaagaaattgttgacttaatgtgtcatgccacctttaccatgcgactattgagccccgtaagggtacccaattataacatgattataatggatgaagcccattttacagacccagcatcaatagctgcgagaggctatattagcaccagggtcggtatgggtgaagcagcagcaatctttatgactgctactcctcccggaagtgtggaggcttttccacaatccaatgccgtaatacaagatgaagaacgtgatattcctgaaagatcgtggaactcaggatatgactggatcaccgattttcccggaaaaactgtttggttcgtgccatccataaaaagcgggaatgatatagccaattgtctaaggaaaaacggtaaaagagtaatacaactctcaagaaagacattcgacacggaatatcagaaaaccaaaaataacgattgggattacgtagtaacaacagacataagtgaaatgggtgcaaacttccgcgccgatcgagttattgatccccgaagatgtctcaaacccgtaatactaaaggacggtcctgagagagtgatactcgcaggtcccatgcctgtaacggcggcgtcagcggcacaacgacgtggaagaattggacgtaatcaaaataaagaaggggatcaatatatctacatgggacaaccactgaataacgacgaagatcatgcgcattggacagaggctaaaatgctactagacaacatcaatacacctgaaggaattatccctgctctcttcgaaccggaaagagaaaaatctgctgcaatagacggagaatatagactgcgaggtgaagctcgcaaaacttttgtagagctcatgcggcgtggagacttgccagtgtggctatcttataaagtagcgagtgaaggattccaatattctgatagaagatggtgttttgacggggagcgaaataaccaagtacttgaagaaaacatggatgtagaaatatggacaaaggaaggcgaacgcaagaaactaagacctcgttggttagatgctcgaacatattcggatccgttagcattgcgagaatttaaagagttcgcagcgggaaggagaagtgtaagtggtgaccttatacttgaaattggaaaattgcctcaacatttaacattaagagcacaaaacgctttggataacttagttatgctacataattcagagcaaggagggaaagcatatagacacgccatggaagaattaccagataccattgaaactttaatgctgcttgccttaatagccgttcttacaggcggagtgactttattcttcctgtctggaaaaggactcggaaaaacatcaatagggctactctgcgttatggcctcgagcgttctgctctggatggcatcagtcgaaccccactggatagcggcgagtatcatattagagttctttttaatggtattacttatcccagaacccgatagacagaggacaccacaagacaatcagttagcatatgtggtaataggtttattgtttatgatactaactgtggcggccaacgagatgggtttattagaaactactaagaaagatctagggataggacatgtcgttgcagaaaatcatcatcacgccaccatgttggatatagatctccatcctgctagtgcttggaccttgtacgcggtcgccactacaataataacgcctatgatgaggcatactatagaaaacaccacagctaatatttcactaacagcaatagctaatcaagcagctattttaatgggcttagataaaggatggccgatttcgaaaatggatattggagtaccactactagccttaggctgttattcgcaagtgaacccacttaccctcactgctgcggtcctaatgttagtagctcactacgcgataatcgggccaggcttacaggcaaaggcaaccagggaagctcagaagagaacagcagcaggaataatgaaaaatccgacagttgatggaattgtagccatcgatttagatcctgtcgtttacgacgctaaatttgaaaaacaacttgggcaaataatgcttttaatactttgcaccagtcaaatattattaatgcggacgacttgggcattgtgtgaatctatcactttagcgaccggtccattaactactttatgggaaggatcaccggggagattttggaacactactatcgcagtatcaatggctaacatatttagaggaagttatttagccggcgctggtttggcattctcattaatgaaatcattgggaggaggtcgcagaggtacaggagcgcaaggagaaactttaggagaaaaatggaaaagacagttgaaccaactatcgaaatccgaatttaacacctacaaacgtagcggtataatggaagtagatcgatcggaagcaaaagagggtatgaagagaggggaaacaacgaaacatgcagtctcccgtgggaccgccaaacttaggtggttcgtagagcgaaacctggtaaaaccggaaggaaaggtcatagatctaggctgcggtcgaggtggatggtcctattactgtgccgggctcaagaaagtaaccgaagttaaaggatatactaagggcggacccggccacgaggaacccataccgatggcaacttatggatggaatatcgtaaaactgcattcagggcgcgatgtgttctttacaccaccagaaaagtgcgatacattattgtgtgacataggtgaatcctctccaaatcccacaatagaagaaggccgaactttgcgagtgctaaaaatggtagaaccttggctaagagggaatcaattttgcataaaaatcttaaatccatatatgccatcagtggtagaaacgctggagcaaatgcagagaaaacatggtggtatgctagttagaaaccctttgtccaggaactccacccatgaaatgtactgggttagctgtggaacaggtaatattgtatcagctgttaacatgacaagtaggatgctactgaaccggtttacaatggctcacagaaaaccaacatatgaaagagacgttgatctaggggcaggaacacgtcatgttgctgtagaacccgagattgcgaatcttgatatcatcggacagagaatagagaacataaagaatgaacacaaatcaacttggcattatgacgaggataatccatataagacatgggcataccatggaagctacgaagtgaagccgagcggaagtgcatcttcgatggtcaacggagtagtccgtcttcttactaaaccgtgggatgtcataccgatggttactcaaatagctatgacagataccactccttttggtcaacaacgtgtttttaaggagaaagtcgacacaagaactcctagacctaagagaggaacagcgcagattatggaggtgacagccaaatggctctgggggtttttgagcagaaacaaaaagcctcgtatatgtacaagggaagagtttacccgtaaagttcgaagtaatgccgcgataggcgcagtatttgtggatgaaaaccaatggaactcggctaaagaagccgtagaagacgaacgattctgggacttagttcatagagaaagggaactgcacaaacagggtaaatgcgcaacatgcgtttataacatgatggggaagcgagaaaagaaacttggagagttcggaaaggccaagggaagccgtgccatatggtatatgtggctaggcgctagatttcttgaatttgaagcattaggctttatgaatgaagaccactggttttcacgtgaaaattcactttcaggcgtagagggagagggcctccataagctagggtacattttaagggacatctcaaaaataccgggtggaaacatgtatgctgatgataccgctggatgggatacacgaatcactgaagacgatttgcaaaatgaagcgaaaataactgatataatggaacccgagcacgctctcctcgcgacatcgatttttaagctcacttatcaaaacaaggtagttagggtacaaagaccggcaaaatccggaaccgttatggatgtgatatctaggagagaccagagaggttctggccaagttggaacttacggactcaacacctttacgaacatggaggtgcagcttatccggcaaatggagtctgaaggaatatttagcccatccgaattggaaaacagtaacttggcggaaagagttttagattggttggagaagcacggcgtagaacggcttaaaaggatggcaatatctggtgacgactgtgttgtaaaacccactgacgatagatttgctactgctctcacggcactaaatgacatgggaaaggtacgtaaagacataccccaatgggagcccagtaaaggatggaatgattggcaacaagtaccattctgttcacaccattttcatcaattgatcatgaaagacgggagagaaatcgtagtcccttgtaggaaccaagacgaacttgtgggacgtgcacgggttagtcaaggagcaggctggtctttaagagaaacagcttgtctagggaagagttacgcacaaatgtggcagctcatgtattttcatcgacgtgatttacggttagctgcaaacgccatttgttcggctgtacctgtgaattgggtcccaacatcaagaacaacttggtctatccacgcacaccaccaatggatgacaacagaagatatgctgagcgtttggaatagagtgtggatagaagaaaacccatggatggaagataaaacacatgtctcatcatgggaagatgttccttatctaggcaaaagagaagatcaatggtgcgggtcactaattggattaaccgcacgagcgacatgggccacaaatatccaagtagcaattaaccaggtaagaagacttatcggaaacgaaaattatttagattacatgacctcaatgaaaagatttaaaaatgaatcggaccctgagggagcgttatggtaa

SEQ ID NO: 22091 - RNA, 9879 nt, synthetic construct
  misc_feature 1..9879: note = derived and/or modified CDS sequence (opt6) from DENV-1__KM403633__SS-prME
  source 1..9879: mol_type = other RNA
tcagtcactatgctcttaatgcttttacctactgcattggcatttcatctgactacaagaggcggcgaaccacacatgattgtatccaaacaagaaagaggtaaatccttactttttaaaacctcggcaggcgtaaatatgtgtacacttatagcgatggacttaggagagctttgtgaagacaccatgacatacaaatgcccaaggataacagaagcagagccagatgatgttgattgttggtgtaatgcaacggatacatgggtgacttatggaacttgttcccaaacaggcgagcatcgaagagacaaacgatctgtagcgctagcacctcacgtaggattaggtttagaaacaaggacagaaacttggatgagctcagaaggtgcgtggcgtcaaatacaaaaagttgaaacatgggcgttaaggcacccgggattcacagtgatagctttatttcttgctcatgctatcggtacaagtataacgcaaaaaggcataatctttatactccttatgctagtaacgccatctatggcaatgagatgcgtagggattggaaaccgggatttcgtcgaaggcttatctggggcaacgtgggtcgatgtagtattagagcatggctcatgcgtaacgactatggccaaaaataaaccaacgctcgacattgagctacttaaaactgaagttacgaaccctgcagttttacggaaattatgcatagaagctaaaatatcaaacaccaccactgacagcagatgcccaactcaaggagaagcgacgctagtcgaagaacaagacgcaaactttgtatgtagaagaacgtttgtcgatagaggctggggtaacggatgcggattgtttggcaaaggctctcttctcacatgtgcaaaatttaaatgcgtgactaaattggaaggtaaaattgtacaatatgagaacctaaaatattcagttatagttaccgtccacacaggcgatcaacatcaagttggaaacgaaaccaccgaacacggaaccatagcgaccataacaccccaagcacctacatctgaaattcaattaactgattatggggcgttaaccctagattgcagtcccaggaccgggctagattttaacgaaatggttttacttaccatgagggaaaaatcatggttagttcacaaacagtggttcctcgacctaccgctcccatggacatcaggcgctagcacgtctcaagaaacatggaacagacaagaccttttagttacctttaaaacagcacatgccaagaaacaagaagttgttgtactaggatcacaagaaggagcaatgcacacggcattaaccggcgcaactgaaattcagacaagtggaaccaccactatttttgcgggacatctaaaatgcagattaaaaatggataaactaacactaaaaggagtgtcttatgtcatgtgtaccgggagtttcaaattggagaaagaagttgcagaaacgcagcacgggaccgtcctagttcaagttaaatacgaaggaacagacgcaccttgcaaaattccgattagcacacaagatgaaaaaggagtcacccaaaatggtaggctgataactgcaaatccaatcgtgacagacaaagaaaaaccagtgaatatagaaaccgaaccaccttttggagaatcttatatagtcataggtgccggtgaaaaagcactcaaattatcatggttcaagaaaggtagttcaattgggaaaatgtttgaggcaacagctcgaggtgcacgacgtatggccatacttggagatactgcttgggatttcggatccataggtggagtctttacctcggtaggaaaattagtccatcaagtatttggcaccgcatatggcgtactgtttagcggagttagttggactatgaaaatcggaataggtatcttgcttacatggttgggcttaaatagtagaagtacctcactaagcatgacatgtatagctgtagggatggttaccctttatctgggagtaatggtacaagccgattctggatgcgttattaactggaaagggcgtgaattaaaatgtggtagcggaatttttgtgacaaatgaagttcatacctggacagaacaatataaatttcaggcagattctccgaaaagattgagtgcggctataggcaaagcatgggaagaaggtgtatgcggcataaggtcagcgactcgtttagaaaatattatgtggaaacaaatatcgaacgagctcaatcatatattacttgaaaatgatatgaaatttacagtagtagttggagatgcgaacggaatacttacacagggtaagaaaatgatcaggcctcaacccatggaacataaatacagctggaaatcctggggaaaagctaaaataataggggctgatacacaaaacacaacttttataatagatggaccagacactcctgaatgtcctgacgatcaaagagcctggaatatctgggaagtcgaagattacgggttcggtgtgttcactacaaatatatggctaaaacttcgagatagttatacacagatgtgtgatcatcgattaatgagcgcagctataaaagatagtaaagcagtacatgcggacatgggatactggattgaaagtgagaaaaacgaaacctggaaattggctcgcgctagctttatagaagtgaaaacttgcatatggcctcgttcacatacgctatggagcaatggcgtattagaaagtgaaatgattatcccaaaaatttacggtgggccgatttctcaacataactacagacctggttatttcacacaaaccgcggggccctggcacctaggtaaattagaattggactttaacctatgtgaaggaacaacagtagtggtagacgagcactgtggtaaccgaggcccttctttgcggacgacaactgtgacggggaaaatcatacacgaatggtgttgtcggtcatgcacattaccaccactgagattcagaggagaagatggatgttggtatggtatggagataagacccgtcaaagagaaggaagagaatcttgttcgttccatggttagtgccggttcgggagaagtcgactcatttagcttaggcttgttatgcgtcagtataatgatcgaagaagttatgagatccagatggtcacggaagatgctcatgactgggacgttagctgtattctttctactaatcatgggacaactcacatggaatgacttaattcggctatgtattatggtaggtgcaaatgtcagtgacagaatgggcatgggcacaacctatctagcactaatggccacattcaagatgagacccatgtttgcagtaggtctactattcagacgtctaacttcaagagaagtactattactaactattgggttaagccttgtcgctagtgtagaactcccaaattccctcgaagaattaggagacggcttagccatgggaattatgatgctaaaattgttaacagacttccaaagtcaccaactatggactacattactttcactgacattcattaagacaacactcagcctagactatgcttggaaaacaatggctatggttttaagcattgtttctttgtttcccctatgtttatctactacttctcagaaaacaacttggctcccggtgttactaggctcgtttgggtgtaaaccattaactatgtttttaatcactgagaacaagatatggggcagaaaaagctggcctttgaatgagggaatcatggccgtgggtatagtgtcgatccttttgtcttcactcttgaaaaacgatgtcccattagcaggtcctctgattgccggcggtatgctgatcgcatgttatgtaatctcgggttcttcggctgatctatctttagaacgtgcagctgaggtaagctgggaagaagaagcggaacattcaggtgcgtcccataacatattagttgaagtgcaggatgacggtacaatgaaaataaaagacgaagaaagagatgatacattgacgattttactgaaggctacattactcgcagtttcaggagtatacccaatgtcaattcccgcaacgttgttcgtatggtatttctggcagaagaagaaacaacgaagtggcgtcctgtgggatacaccgtcgcctccagaagttgagcgcgctgttctggacgacggtatatacagaatcctacagagaggtcttctcggccgttcacaggttggtgttggtgtgttccaagatggagtattccatactatgtggcacgtcactcggggcgccgtactcatgtatcaaggtaaacgtttggaaccgtcatgggcatcggtgaagaaagaccttattagctatggtggtggatggagatttcaaggttcgtggaacactggtgaagaggtgcaagttatcgctgttgaacccgggaagaaccccaaaaatgtacaaacaacacccggcacattcaaaacacctgaaggggaagtaggtgcaatagcacttgatttcaaaccaggcacaagcggaagtcctatagtaaacagggaaggaaaaatagtcgggctctacggcaacggtgtggttacaacatctgggacatacgttagtgctattgcacaagcaaaagcatcacaggaaggacccctgccagaaatagaggacgaagtcttcaagaaacgaaacctaactatcatggaccttcacccaggaagtgggaaaactagacgatatttacccgcaatagtcagggaagcgataaaaaggaaattaaggacattaatacttgcaccgacaagagtagtcgcatcggaaatggcagaagcacttaaaggtatgccaatccgctaccaaacaacggcggtcaaatcggaacacaccgggaaggagattgtagatttaatgtgtcacgcaacttttactatgcgattactatcccctgttagagtgccaaattataacatgattatcatggacgaagctcatttcaccgatccggcaagcattgcagcacgtgggtacatttccaccagagtagggatgggtgaagcggctgctatttttatgaccgcaactccgcctggtagtgtagaggcttttcctcaatcaaatgcagtaatacaagacgaagaacgtgatatacctgaacgttcatggaactccggatatgactggatcactgacttcccgggtaaaactgtatggttcgtccccagtattaaatccggaaatgatattgccaattgtttaaggaaaaatggaaagagagtcattcaactttcccgcaagacttttgataccgagtaccagaaaactaagaataacgattgggattacgttgtaacaactgatatttcagaaatgggagctaactttcgcgcagatagagttattgacccacggagatgtctgaaacccgtcattttaaaagatggtccagaacgagtcatactagccggaccaatgcctgtaacagcggcatcggctgcacagagaagaggcaggattggccgaaatcagaacaaagagggcgaccaatatatttatatgggccagccattgaataatgatgaggatcacgcacactggactgaagcaaagatgttattggacaacattaacactcctgaaggaatcatcccggcattatttgaacctgaaagagagaagagtgctgcaatagatggtgagtataggcttagaggggaggcaagaaaaacttttgtggaattaatgaggagaggcgatcttccagtttggttatcttacaaagtagcaagcgagggatttcaatactcagatagaagatggtgtttcgatggagagagaaataaccaagtattggaagaaaacatggatgttgaaatctggacaaaagagggagaaaggaagaaacttagaccacgctggttagatgcaagaacttacagcgacccgttagcactaagggagttcaaagaatttgcggcgggacgtcgctcggtgtcaggcgatctgatattagaaataggaaaactaccacagcacctaactttacgtgcgcaaaacgctctagataacctcgtgatgctgcataatagcgagcaaggcggtaaagcatacagacatgccatggaagaactccctgatacaattgaaacattgatgctattagcattgattgcagtattaacagggggtgtaacactattctttctgagcggaaagggtcttggaaaaacaagtatagggttgctttgcgttatggcctcctcggtcttattatggatggccagcgtagaaccacattggattgctgctagcattatactagagttctttttaatggtattgctaatccctgaacctgatagacaaagaacaccgcaggacaatcaactagcgtatgttgtgataggccttctatttatgattctcactgtcgcggctaacgaaatgggactactggaaacaactaagaaggacctaggtataggccatgtggtagctgaaaatcatcaccacgctactatgctagatatagatttacatccagcatcggcttggaccttgtatgctgtagccactacaattataaccccaatgatgagacatacgatagaaaacacaacggctaatataagcctaactgcaattgcaaatcaagcagccatccttatggggctcgataaaggatggccgataagtaaaatggatataggagtaccattactggcactaggctgctactcacaagttaatccattgacattaactgcggcagttctcatgttagtggcccattatgcgatcatagggccgggattgcaagccaaagcaacgcgcgaggctcagaaaagaacagcggcagggatcatgaagaatcctacagtagacggcattgtggcaattgatttggatcccgttgtttacgatgccaaatttgaaaagcagctgggacaaataatgctattgattttatgcacaagccagatactgcttatgagaaccacatgggccctatgtgaatctattaccctggccactgggcctctaaccaccctgtgggagggtagcccaggcaagttttggaatacgacgatagcggtgtctatggccaatattttcaggggatcctacctggcaggagcaggtttagcctttagtctgatgaaatctttaggagggggaagaagaggaacgggagcccagggggaaacgcttggcgaaaaatggaaaagacaattgaatcagctgagtaaaagcgaatttaacacatataaaagatcaggaataatggaagtggaccgtagtgaagctaaagaaggactaaaacgtggcgagaccacaaaacacgccgtttcgcgcggaaccgcgaaacttaggtggtttgtcgaaaggaatttagttaaaccagagggaaaagtaatagacctcggatgtggccgaggtgggtggagttactattgtgcaggtctaaagaaagttactgaagttaaaggatacacgaaagggggtcccggacacgaagaacctatacccatggccacctatggatggaacattgtaaaattacacagcggcagggatgtgtttttcacacctccagaaaaatgtgatacattactatgcgatataggagagtccagcccaaatcctactatcgaagagggcaggacgttgcgagtgcttaaaatggttgagccatggttaagaggaaaccaattctgtattaaaatcctcaatccatatatgccttcagttgtagagacgcttgaacaaatgcaacgaaaacacggaggtatgttggtaagaaaccccctatcccgaaattcaacacacgaaatgtattgggtatcctgtggaactggtaacatagtttctgcggtaaacatgacaagtagaatgctattaaacagattcaccatggcccataggaagccgacctatgaaagagacgttgatcttggtgctggaactcggcacgtagcggtcgaacctgaaatagcaaatttggatattataggccagcggattgaaaatataaagaacgaacataaaagcacatggcactatgatgaagataatccttataaaacatgggcataccatggatcttatgaagttaaacccagtggcagtgcaagctccatggtaaatggagtagtaagattactgaccaagccatgggatgttattccaatggtgacacaaatagcaatgacggacactactccgtttggacaacagagagtctttaaagaaaaagttgatactagaactccgcgaccgaaacgaggaaccgcacaaataatggaagtaacagccaaatggctatggggattcttgtcccggaacaagaaaccaagaatatgtacccgggaggaatttacacgcaaggtacgcagtaacgcagctataggagcagtcttcgttgacgaaaaccaatggaactctgctaaagaagctgtggaagatgaaaggttctgggacctagtacaccgagagagagaactccataaacaaggaaaatgtgcgacttgcgtatacaacatgatggggaagcgcgagaagaagctaggtgagtttggcaaagctaaaggtagtagagctatttggtatatgtggctaggagctcgtttcctagaatttgaagcattgggttttatgaatgaagatcactggtttagtagagagaatagtctatctggtgtagagggcgaaggtcttcataaacttggctatatattacgtgatattagcaaaataccgggcggcaatatgtatgccgacgatacagcaggatgggatacacgtataaccgaagacgatctacaaaacgaagccaaaataacggacataatggaaccagaacacgcactgcttgcaacatccatctttaaattaacttaccaaaataaagtagtaagggtacaacggcctgctaaatcaggtactgtaatggatgttataagtagacgagaccaacgaggaagtggtcaggttggaacgtatggcttaaacacgttcacaaatatggaagtacaattaatacggcaaatggaatcagaaggcatattcagcccatcggaacttgaaaattctaatttagctgagagggtattagattggttagaaaaacacggagtagaacggctaaaaagaatggcaataagtggagacgactgtgtagtcaaaccaaccgatgaccgttttgccacagcgcttaccgcactcaatgatatgggaaaagttagaaaggatatcccgcagtgggaaccctcaaaaggctggaatgactggcaacaggtaccattttgttcacaccatttccatcaactaataatgaaggatgggagggaaatagtagtaccatgtaggaatcaagacgagctggtcggcagagcaagggtaagtcaaggcgcgggatggtcgctccgagaaactgcatgtttaggaaagtcgtatgcacagatgtggcaattaatgtatttccatagacgggatttacgccttgcggctaacgcaatatgtagtgcagtgccggttaattgggtacctacgtcaagaacaacatggtcgatacacgcacaccatcaatggatgaccacggaagatatgctcagtgtatggaacagagtatggatagaagagaacccctggatggaagacaaaacccatgtaagcagctgggaagacgtaccctatctcggcaaacgagaagaccagtggtgcggctcacttatcggattgacggcaagagcgacatgggcgacaaatatacaagtagcaataaatcaggtccgaagactgattggaaatgaaaattatctggattacatgacatcaatgaaaagatttaagaatgagtcagatccggaaggcgcattgtggtga

SEQ ID NO: 22092 - RNA, 9879 nt, synthetic construct
  misc_feature 1..9879: note = derived and/or modified CDS sequence (opt6) from DENV-1__KM403592__SS-prME
  source 1..9879: mol_type = other RNA
tctgttacaatgttgttgatgttactccccactgcgttagcttttcacttaaccactagaggaggtgaacctcacatgatagtttctaaacaagaacgggggaaatcattactcttcaaaacttcagcgggagtcaacatgtgcactttaattgcaatggatctgggtgaactatgcgaagataccatgacgtataaatgcccgcgaatcactgaagcagaacctgatgacgttgattgttggtgcaacgcaactgatacatgggttacatatggaacctgttcgcaaaccggtgaacacagacgagacaaaagatccgtcgcactcgcgccccatgttggactgggactagaaactcgaacagaaacatggatgagttcagaaggtgcatggcgacaaatacaaaaagtagaaacatgggccctaagacatcctggatttacagttatagcactattccttgcacatgccataggcacaagcataacacaaaaaggtattatctttatactacttatgttagtcacaccttcaatggcgatgcgatgcgtaggtataggtaaccgagatttcgttgaaggcttatcaggtgcaacgtgggtggacgtcgttctagaacatggatcctgcgtaactacaatggcgaaaaacaaaccaaccctagatattgaacttttaaaaacagaagtgacaaatccagctgtccttagaaaattgtgtattgaagcaaaaatctcaaacaccacaactgactctagatgtcctactcaaggagaagcaaccttagtggaagaacaagacgcaaacttcgtctgtagacgtacattcgttgaccgaggctggggtaatggttgtgggctatttggtaaaggcagcttacttacatgcgcaaaattcaaatgtgtaacaaaactagaaggaaaaatcgtccagtacgaaaatctcaaatactctgtgatagtcactgttcataccggcgatcaacaccaagtaggaaatgaaaccacagaacatggtactattgcgacaataactcctcaagcccctacgtccgagatacagttaaccgactatggggcactgacattggactgcagccctagaactggcctagattttaacgaaatggttctactgacgatgaaagaaaaatcatggctagtacataaacaatggttcctagatttacctctaccatggacgagcggggcctcaacaagtcaagaaacatggaaccggcaagacctattagttacatttaaaacagctcacgcaaagaaacaagaagttgtagttctaggaagccaagagggagcaatgcatactgctctgacaggagctacagagatccaaaccagtggtacgactaccatttttgcaggtcatcttaaatgtaggttaaaaatggataaactaactttaaaaggggtttcatatgttatgtgcacaggaagttttaaattagaaaaagaagtcgccgaaacgcagcacggaacggtattagtgcaagtaaagtatgaagggaccgacgcaccatgtaagatacccataagtacgcaagacgaaaagggcgtagcccaaaatggacggttaataacagcgaatccgatagtaacagataaagaaaaacccgtcaatatagaaactgaacctcctttcggggaatcctatattgtgatcggtgccggcgagaaagcacttaaattatcatggttcaagaaaggatcgagtattggaaagatgtttgaagcaactgcgcggggcgccagacgtatggctatattaggcgatacggcatgggacttcgggagtataggaggagttttcacaagcgtaggtaagttggtccaccaggtcttcggtactgcttacggagttctattcagcggggtgagttggacaatgaagataggaataggaatcttactgacttggctaggcctaaattctcgctcaacgagtctttccatgacgtgtatagccgtaggtatggttacactatacttaggagttatggttcaagccgactcaggatgcgtgattaactggaaaggccgagaactaaagtgtggtagcggcattttcgtaacaaacgaagtacatacctggactgaacagtataaatttcaagctgactccccaaaaagattatctgcagccatcgggaaggcttgggaagagggtgtctgcggaattagatcagcaacaaggttggaaaatataatgtggaagcaaatatctaatgaactgaatcacatcttattagaaaatgacatgaaatttacagtagtagtaggcgatgcaaacgggatattaacgcaaggtaaaaagatgatacgaccccaaccaatggaacacaagtacagttggaagtcttggggaaaagccaaaataattggagcagacacacaaaacacaacgtttataattgatgggcccgacactccagaatgccctgatgaccaaagagcctggaacatatgggaagtagaagattacggattcggagtatttacaacaaacatttggctgaagctgagggacagctacacacagatgtgtgatcacaggctaatgagtgccgctattaaagatagcaaagcggtccacgctgacatgggatattggatagaatcagagaaaaatgaaacatggaaattagcccgagccagttttatagaagtcaaaacatgtatatggccacggtcacatacactatggtcaaacggcgtactagagagtgaaatgataatacctaaaatttacggtggtcccatatcgcagcataattaccgaccaggatactttacccaaaccgcaggcccttggcatttaggaaaactcgagctagatttcaatctctgtgaaggtacgacagtggtagtggacgaacattgtgggaatagggggcccagtctaaggacaacaacggttactggaaagataatccacgagtggtgttgtagaagttgcactctccctcctcttaggttcagaggtgaggatggttgctggtacggtatggaaataaggccagtaaaagaaaaagaagaaaatctggttcgctcgatggtatcagccggaagcggtgaggtagacagcttctcactcggtctgctatgtgtctctataatgattgaggaggtaatgagatcacgttggtcacgaaaaatgttaatgacaggtaccctagcggtgttctttcttttaataatgggacaactaacctggaatgatcttgtacggttatgcataatggtaggcgcaaatgtatcagaccgtatggggatgggtactacatatcttgcattaatggctacattcaaaatgagacctatgttcgcagtaggactcctttttagacggctaacaagtagagaagtgcttctacttaccattggactaagtttagttgcttcagtagaactaccaaactctctagaagagttgggggacgggttagctatgggcattatgatgcttaagctgcttactgattttcagtcacatcaactctggacgacacttttgtcactaacatttataaaaactacgctaagtcttgattatgcatggaaaacaatggcgatggttctttcaattgtctccctatttcctctatgcctaagcacgactagccagaagactacgtggctacccgtgttattaggatcttttggatgtaaacccttgacgatgttcctgattaccgaaaataagatatggggcagaaaaagttggccacttaacgaaggaataatggcagttgggattgtaagcatactgttatcatcactactcaaaaatgatgtaccgctagctggaccactaattgcaggaggcatgcttattgcatgttacgtaataagcgggtcatcagccgacctcagccttgaaagagctgcagaagtttcatgggaagaagaagcagagcattcgggagcatcgcataacatattagttgaggttcaagacgatggtacaatgaaaattaaggacgaggagcgggatgacacactcactatactgctaaaagcgacgctcttggcggtctcgggagtgtatccaatgtctattcctgctacattatttgtctggtatttttggcagaagaagaaacaacggagcggtgtcctatgggatacaccgtctcctccagaggtcgaacgagcagttcttgacgatggcatttatcgtatcttacagcgaggattactcggcaggtcgcaggtaggcgtaggagtatttcaagatggagtattccacaccatgtggcacgttacaaggggtgctgttctcatgtatcagggaaaacgactagaaccaagttgggctagcgtcaaaaaggacctaatatcgtacggcggaggatggcgatttcaaggttcatggaacactggggaagaagtccaagtcatcgcagttgaaccgggcaaaaaccctaagaatgttcagacgatgccaggaacttttaagactccagagggagaagtcggagcaattgcattagatttcaaacccggaacaagtggatcaccgatagttaatagagagggaaaaatagtagggttgtatggaaatggcgtagtgacaacatcgggtacctatgtaagtgcaatcgcacaagcaaaagctagtcaggaaggcccattgcctgaaatcgaagacgaggtatttaaaaagaggaacttaactataatggatttacaccccggcagtggaaaaactaggagatatctgcctgccattgttagagaagccatcaaacgtaaattgcgaaccttgattctcgcaccaacaagagttgttgcatcagaaatggcggaagctctaaaaggtatgccgattagataccaaacaactgctgtaaaaagtgaacatacaggcaaagaaatcgtggatctaatgtgccatgctacattcactatgcgcctcttaagccccgtcagagtgccgaattacaatatgattataatggatgaagcccacttcacggaccctgcttcgatagctgcgaggggctatatatctacgcgcgtaggaatgggtgaagccgctgcgatattcatgaccgcaacgcccccgggttcagtagaagcatttccacagtcgaatgccgtcatacaagatgaagaaagagacattcctgaacgaagttggaactcaggctacgactggataactgattttccaggcaaaacggtctggttcgttccatccattaaaagtggtaatgacatagcgaattgcctaaggaaaaatggaaaacgggtcattcaactatccaggaaaactttcgataccgaatatcagaaaacgaagaataatgattgggattacgtagtgacaacagatattagtgaaatgggcgcgaatttccgagcagacagagtaatagatccgagacgttgtctgaaacctgttattcttaaagatgggcctgagagggtgattttggctgggccaatgccggtcacagcggcctcagcagctcaacgacgtggaagaataggccgcaatcaaaataaggaaggggatcaatacatatacatgggtcaaccgcttaataatgacgaagatcatgctcactggactgaagcaaaaatgcttctagacaacattaacacacctgaaggaataatacctgcattattcgaaccggaaagagagaaaagtgctgcgatcgacggtgaataccgactaagaggcgaagcgcggaaaacgtttgttgagctaatgcggagaggagacctacctgtatggctatcatacaaggtcgcaagtgagggctttcaatattctgaccgcagatggtgtttcgatggtgagagaaataatcaagttctcgaggaaaacatggacgtggagatatggacaaaggaaggagaaaggaagaaattgagaccaagatggttagacgcaagaacctactcagatcccctagcgctccgagaatttaaagagttcgctgcagggaggagatcagtgtcaggagacctcatcttagaaataggaaaattacctcaacacttaactcttagagcccaaaatgcgctcgacaatttagtcatgttacacaactctgagcaaggtggtaaggcttataggcacgccatggaagaattaccagacacaattgagaccttaatgctacttgctttaatagcagttctaacaggaggcgtgaccctcttctttctaagtggtaaaggtttaggtaaaacgtcgattggcttgttatgtgttatggcaagcagtgtgctcttatggatggcgtcggtcgaaccacattggatcgcagcatccattatactggagttcttcttaatggtactattaatccctgaacctgatcgtcagaggacacctcaagataatcaattagcatacgtagtcataggcttactgtttatgatattaacagtagcagcaaacgagatgggtttattggaaaccacgaagaaagatctaggaattggccatgtggtagcagagaatcaccaccacgccaccatgctagacatagatctccacccagcatcggcctggaccctttacgctgttgctacaacgataataactccaatgatgagacacacaatagaaaatacaacggccaatatcagcctaacagcgattgctaatcaagcagcaattctcatgggattagataaaggctggccaataagtaagatggacataggagtaccattacttgccctgggttgttactctcaagtaaacccgctaacattaacagcagctgtactgatgttagtcgcgcattatgctataataggcccaggtttacaggcaaaagccacaagggaagcccaaaagcgcacagcagcaggaattatgaaaaaccccaccgtagacggaattgttgccatagatcttgacccagtggtttatgacgctaaatttgaaaaacagctcggccaaatcatgttgctaattttatgtacgtcacaaatccttttaatgcgtacaacgtgggcgttgtgtgagtccataaccctagcaaccggacccttgacaacgctatgggaaggctccccaggtaaattttggaatacaacgatagcagtatctatggccaacatatttcgaggttcatacttagcaggggctggtttagctttcagcctaatgaaatcgcttggaggagggagaaggggaacaggcgcacaaggtgagacattgggtgaaaaatggaagcgacaattgaatcaactatcaaagtctgaatttaatacatataaacgttcaggcataatggaggtagatagatctgaagcgaaggaaggactcaagagaggggaaacgacaaagcatgctgtatcgaggggcacagctaagctaagatggtttgtcgagagaaatcttgtaaagccagaaggaaaagtgatcgatttgggatgcggaagaggagggtggtcatactattgtgcagggctcaagaaagtaacagaagtaaagggttacacgaaaggaggaccaggccacgaggaaccgatcccgatggcaacatatggttggaatattgtaaaattgcattcgggaagagatgtatttttcactccacccgagaaatgcgacaccctcttgtgcgatattggtgaatcatccccgaatccaactattgaagaaggaaggacactccgagttctcaaaatggttgagccatggctacgaggaaaccaattttgtatcaagatattgaacccgtatatgccgtctgtagtagagacattagagcaaatgcagcgaaagcacggtggaatgttggtgcgaaacccgttgagccggaacagcacgcacgaaatgtattgggtcagttgcgggactggaaatatagtcagtgctgtaaacatgacgtcaagaatgttgctaaatagatttactatggcgcatagaaaacctacatacgaacgagatgtagatctaggggctggtacaagacatgtagctgttgaaccagagatagcaaatcttgatattattggacaaagaatcgaaaacatcaaaaatgaacacaaatctacctggcattacgatgaagacaatccttataaaacttgggcctaccatggctcatatgaagtaaagccatcagggagcgcctcatcgatggtaaatggggtcgtacgtttattgacaaagccatgggatgttatcccaatggttacacaaattgcaatgacagacacaacaccttttgggcagcaaagagtttttaaagaaaaggttgacacccgaacacctagacccaaaagaggaacagcacaaattatggaagttactgccaaatggctatggggatttttatcaaggaataagaaacctagaatttgtactagagaggagtttacccgaaaggtcagatcgaacgcagcaataggagccgtatttgtagacgagaatcaatggaactctgcgaaagaagctgtcgaagatgaaagattttgggacttggtgcatcgtgaaagagaattgcacaaacaaggcaagtgtgcaacatgtgtatacaatatgatgggaaaacgagagaagaaattgggggagttcggaaaagcaaaaggatctagagcaatatggtacatgtggctcggagcacgtttcttagagttcgaagcattaggctttatgaatgaagatcattggttttcaagagaaaatagcctttccggtgtggagggtgaaggtcttcataaattaggatatatcttaagagatataagcaaaataccaggtggaaatatgtatgcggacgacactgctggatgggatactcgcataactgaagatgatctacagaatgaagcgaaaatcacggatataatggaaccagaacacgcactattggctacttccatatttaagttaacctatcaaaacaaggtagtgagagtccaaaggccggcaaagtccggaacagttatggatgtaatctcccgtagagatcaacggggcagtgggcaagtcggaacgtatggtctaaataccttcactaacatggaggtacaactaatcagacaaatggaatcagaaggaatatttagtccaagcgaacttgaaaattcaaacttagcagagcgggtattagactggctagaaaaacatggtgtcgaaagattaaaacgtatggctataagtggtgacgattgcgtggtaaaaccaacagatgacagatttgcaacagctttaactgcattaaatgatatgggaaaagtaagaaaagatatcccgcagtgggagccaagtaaaggatggaatgactggcaacaagtccccttctgttcgcaccattttcatcaacttattatgaaagacgggagagaaattgtagtcccatgtcgaaatcaggatgaacttgttggcagagctagagtatcacagggagcaggctggtctttaagggagaccgcatgtcttggaaagtcttatgctcaaatgtggcaattgatgtacttccacaggcgcgatttaagattagctgcaaatgcaatttgttccgcagtaccggtaaactgggtccctaccagtagaacaacttggtcaattcatgctcatcaccaatggatgacaactgaagatatgttaagtgtctggaatagagtctggatagaagaaaacccttggatggaagataaaacacatgtctcaagttgggaagatgtaccgtacttgggcaaacgagaagaccaatggtgtggttcgttaataggactaacagcacgagctacgtgggctaccaatatacaagtagccatcaaccaagtaaggcgactaatcggtaacgagaactatttagattatatgacgagtatgaaacgctttaaaaatgaatctgatccagaaggggcattgtggtaa

SEQ ID NO: 22093 - RNA, 9879 nt, synthetic construct
  misc_feature 1..9879: note = derived and/or modified CDS sequence (opt6) from DENV-1__KM403593__SS-prME
  source 1..9879: mol_type = other RNA
agcgtaacaatgctattgatgctccttcccacggcgctcgcatttcatctaacaactagaggtggtgaaccccatatgatcgtttccaaacaagaaagaggtaaatcactcttatttaaaacgagcgcaggagtaaatatgtgtactttgattgccatggacttgggagaactttgtgaagatactatgacatacaaatgtccgagaataacagaagctgaaccagatgatgttgattgttggtgcaatgcgacagacacatgggtcacgtacggcacatgcagccaaacaggagagcatagaagagataaaagatcagtggcacttgcaccccacgtaggactaggcttagagacccgtacggagacatggatgtcgagcgaaggtgcctggaggcaaatacaaaaagtcgaaacgtgggccctcagacatccaggtttcactgtcatcgcattattcctggctcatgcaattggaacatccattacgcagaaagggataatattcatattattgatgttggtaactccttcaatggcaatgaggtgcgtgggtatagggaatcgagactttgtagaaggcttatcaggtgcaacttgggtagatgtcgtattagaacacggatcatgcgtaactacaatggcgaaaaacaaacctactttagatattgaactattgaaaacagaagtgacaaatcccgcagtattaagaaaactatgtatcgaagctaaaatatcaaacacaactacagactcacgatgtccgacacaaggagaagctaccttagtagaagaacaagatgctaatttcgtgtgtaggaggactttcgtcgataggggatggggaaatggttgtgggctctttgggaagggttcactgctaacctgtgcaaaattcaagtgtgtgacaaaactagagggaaaaatagtacagtatgagaacttaaagtactcagttatcgtaactgttcacactggcgatcaacaccaggtaggaaatgaaacaactgaacacggaacaattgctacaatcactccacaagcaccaacatctgaaatccagctgacagactatggggctctaacgttagactgctcccctcgtacaggtctagattttaacgagatggtcttattgacgatgaaagagaagtcgtggcttgtccataaacagtggtttttagatcttccacttccctggacatctggcgctagtacatcgcaagaaacttggaatagacaagatttgctagtgacatttaaaacagcacatgctaagaaacaggaagtcgtagttttaggaagtcaagaaggtgcaatgcatacagctcttactggggcaactgagatacaaacttcagggacaacaacaatctttgcaggtcatttgaaatgtaggttaaaaatggataaattaactttaaaaggagtatcctatgttatgtgcaccggaagtttcaaacttgaaaaggaggtggcagagactcagcacggaactgtgctggtacaagttaagtatgaaggaactgatgctccctgcaagattccaatatcaacccaagatgaaaagggtgtagcacagaacggaagactgattacggctaacccgatagttactgataaggagaaacccgtaaacattgagaccgaaccaccttttggtgaaagctatatcgtgattggtgctggagagaaggctctaaaactgtcttggtttaaaaagggttcaagcattggtaaaatgtttgaagctacagcaagaggagcgagacgtatggctatactcggggatacggcctgggattttggatcaattggtggagtattcacatcggtaggtaaacttgttcatcaggtctttggaactgcatatggagtactctttagcggagtaagttggaccatgaaaattggaataggaatattactaacctggttgggtcttaattcgcgcagcaccagtttatcaatgacatgcatagctgtcgggatggttacactatatttgggcgtgatggtacaggcggattccggatgcgttatcaattggaaaggacgcgaactaaagtgtggttccggtattttcgttacgaatgaagtacatacatggacggaacaatataaattccaagcagatagcccaaaacgactctctgctgctataggaaaggcatgggaggaaggcgtatgcggcatacgaagtgctactagattggagaatataatgtggaagcaaataagcaacgaattaaatcacatccttctggaaaatgacatgaaatttaccgttgtagttggagatgcaaacgggatattaacacaaggcaagaaaatgatacgtccacaacccatggaacataaatatagctggaaatcatggggtaaagctaaaatcataggtgcagacacacagaatacgacctttattattgacgggcccgatacacctgagtgtcccgacgatcagagagcgtggaatatttgggaggttgaagactatggttttggagtatttacaactaatatttggcttaaactgagggatagttacactcagatgtgtgaccatagattgatgtcagcagctataaaagactcaaaagcggtgcacgcagatatgggctattggattgaaagcgagaaaaacgaaacctggaagttagcccgagcttcattcatagaggtaaaaacatgtatatggcccagaagtcatacattatggagcaacggagttttggaatcggagatgataatacctaaaatctacggtggacctattagccaacacaattataggccaggatattttacgcaaactgctgggccttggcatcttggaaaacttgaattagattttaacttgtgtgaagggacgacagtagttgtcgacgaacactgtggtaataggggaccctctctgagaactaccacagtaacaggaaaaataatacatgaatggtgctgccggagctgcacgctgccaccacttaggtttaggggcgaagacggatgttggtacggaatggaaatcagaccggtcaaagaaaaagaagaaaatctagtacgatctatggtttctgcaggttctggagaagtagactcattctcattgggattactatgcgtttctataatgatcgaagaagtcatgagatctaggtggagtcgaaaaatgttgatgactggcacgctagctgtcttctttttattgattatgggacagcttacttggaacgatttaataagactgtgcattatggtaggtgcaaacgtatccgatcggatgggcatgggaacaacatatctcgctttaatggcgacattcaaaatgaggccaatgttcgcagtgggcctgttgttcaggagattgacctcccgagaagtattattacttacaattggtctttctttggtagcaagtgtagaattaccaaatagtttggaagagttaggagacggtcttgcaatggggataatgatgttaaaacttttaacggacttccaatcgcaccaattgtggacgactttgctatcgctgacttttataaagacgacgctaagtttagattatgcctggaaaaccatggccatggtactaagtattgtctcactttttccactttgcctctcgacgacgagccagaaaacaacttggttacctgtactactagggtcttttggatgtaagccgctcacaatgtttttaattactgaaaataagatatggggcagaaaatcatggccattaaatgaaggcataatggctgtcgggatagtgtctatcctacttagctccttactgaaaaatgacgtgccgctagcaggacctttgatagctggtggtatgctaatcgcttgctacgtaatctccggctcaagtgcagatttgagtcttgaacgcgcagcagaagtatcatgggaagaagaagcagaacatagcggagccagccacaacattttggtcgaagttcaggatgatggaacaatgaaaattaaagacgaagaacgagatgatactctaacgattttgctgaaagctacactgctagctgtaagcggcgtatatcctatgtccatacccgcaacactatttgtgtggtatttctggcagaaaaagaaacaaagaagtggggttttatgggataccccaagtccacccgaagtcgagcgggcagtcttagacgacggtatttatcgaatactccaaagaggtcttttaggacggtcacaagtgggagtaggggtatttcaagatggcgttttccacactatgtggcacgtcactagaggggcagtcctcatgtaccagggaaaacgactcgaaccctcctgggcaagcgtaaagaaagacttaatatcatacggaggtggatggcgattccaaggaagctggaatacgggtgaagaagtccaagtgatagctgtagagccgggtaagaatcctaaaaatgtccaaacaacacctggaacatttaaaacccctgaaggagaagtgggcgcaatcgcactagatttcaagccaggaaccagtggatcaccaatagttaatcgagaaggaaaaatcgtgggcttgtatggcaacggtgtcgtcacgacaagtgggacctatgtaagtgccatagctcaagcaaaggcaagccaagagggaccgttacctgagatagaggatgaagtattcaagaaacgaaacctaacaattatggacttacatcctggtagtggtaaaactcgcagatatttaccggcaattgtacgagaagctataaaaaggaaactaaggaccttaattcttgccccgacacgagttgtagctagcgagatggcagaagcgctaaagggaatgccaatacgatatcagactacagcagttaaaagtgaacatactggaaaagagatagtagatcttatgtgccatgcaacttttactatgagattgctttctccggtacgtgttccgaattataatatgataataatggacgaagcacattttacagatcctgcatctatcgcagccagagggtatatatcaacccgagtgggtatgggcgaagctgcggccatctttatgacagcaacaccacccggcagcgtcgaagcctttccccaatctaatgctgtaatacaagacgaagagagggacatccccgagagatcttggaactcaggctacgattggataactgattttccaggtaaaactgtatggtttgttccttcaatcaaatcaggaaatgatatagcaaattgtttaaggaaaaatgggaaacgagtaattcaattatcgcgtaaaacctttgataccgaataccaaaagactaaaaacaatgactgggactatgttgttactactgacatatcggaaatgggggcaaattttagagcggatagggttatagaccctcgccgctgtctcaaacctgtaatactaaaagatggacctgaaagagtaattctggcaggacccatgccggtaacagcagcgagtgcagcacaacgacgaggaagaatagggcgaaaccaaaataaggagggagatcaatacatctatatgggacaaccactgaacaacgacgaagatcatgcacattggaccgaagcgaaaatgctattggataacatcaacaccccagaaggtatcattccagccctttttgaaccagaacgggaaaaatcagcagccatagatggcgaatatcgcctccgcggagaagcaagaaaaacattcgtggaattgatgagaagaggagatctacctgtatggttatcttataaagtagcttctgaaggtttccaatactcggatcgacgttggtgttttgacggcgagcgtaataatcaagtgcttgaggaaaacatggatgtggagatctggaccaaggagggagaacgcaagaaattacgcccaagatggttagatgctcgtacctattctgacccattggcactcagagaatttaaagagttcgcagcaggacgacgaagcgtaagcggcgatctcatacttgaaataggaaagttaccacaacacctcacactaagagcacaaaatgctttagataatctcgtaatgctacataactccgagcaaggtggcaaagcatacaggcatgcaatggaagaattgccagatacgatagagacgttaatgttgcttgccctcattgcagtactaacagggggagtaacattatttttcttatctggtaagggcctgggtaaaacttcgatcggcctattgtgtgtaatggcaagtagtgtcttgttatggatggcaagcgtagagccacattggattgctgcttcaataattttagagttcttcttaatggtactattaataccagaaccggaccggcagaggaccccacaggataatcaactggcatacgtggtcataggcctacttttcatgatattaactgtagcagcaaacgaaatgggattacttgagacaaccaagaaagacttaggaattgggcatgtcgtggcagaaaatcaccaccacgccacaatgcttgatattgacttacacccagccagcgcatggacattatacgcagttgccacaacaataataacaccgatgatgagacataccatcgaaaacacgactgctaatatttcattaaccgccatagcaaatcaagcagcgatcctaatgggactagacaagggttggcctatatccaaaatggacattggcgtgccattgttagctctaggatgttatagtcaagtaaatccgttaacactcaccgctgctgtcctgatgttggtggcccactacgcgattataggacctggtctacaggccaaagctacgcgagaggctcaaaagagaacagctgctggaattatgaaaaatcccacagtcgacggaatagtagccattgatttggatccagtcgtatatgatgcaaaatttgaaaagcagttagggcaaatcatgttgttaatcttgtgcacgagtcaaatattgttaatgagaacaacatgggcactatgtgaatcaattacactagccacaggaccactaacaactctatgggaaggtagtcccggaaaattctggaacactacaatagcagtctcgatggcaaatatatttcgtggctcttatctagctggcgccggactggcattctcattaatgaaaagtttaggcggaggcagaagaggtaccggagcacagggcgaaacattaggagaaaagtggaagcgtcaactgaatcaactatctaaaagcgagttcaacacgtataaaagaagtggaataatggaagtagatagatctgaagcaaaagaaggtctcaaacgaggcgaaactacaaaacatgctgtttcacgaggtacagccaaacttagatggttcgtggagagaaacctagttaaacctgaaggcaaagtgattgatctggggtgcggcagaggtgggtggtcatattattgtgcaggtttgaagaaagtgacagaagtaaaaggttacacaaaaggaggacccggacacgaagaaccgattccaatggcaacctacggatggaacatagtcaaactgcacagtggacgagatgtatttttcacgccgccagaaaaatgtgacacattactttgcgacattggtgaaagctcacccaatccaaccatcgaggaaggaagaactctaagagtccttaaaatggtagaaccatggctacgaggaaaccaattctgtattaaaattttgaatccttatatgccgtcagtagtagaaacactggaacaaatgcagcgaaaacatggcggaatgttagttagaaatcctttaagtagaaatagcacccatgaaatgtactgggtgagctgtggtacaggaaatatagtatcggcggtaaacatgacgagtcgaatgctattaaacagatttacgatggcacacaggaagccaacttatgaacgcgatgtcgatttaggagcaggtaccaggcatgtggcggtagaacctgaaatagcaaatctcgacatcataggtcaaagaattgaaaacatcaagaatgaacataaaagtacgtggcattatgacgaagataatccatataaaacctgggcataccatggctcatacgaggttaaaccttctggatcagcttctagcatggtcaacggagtcgtaagactcttaacaaaaccatgggatgttataccgatggttactcaaattgcaatgacagatacaacaccattcggccagcaaagggtcttcaaagaaaaggtcgacaccagaacgcctagacccaaaagaggtacagcacaaataatggaagttacggcgaaatggctttggggatttttgtctagaaataagaaaccacgcatatgtacaagagaagagtttactagaaaagtgcggtcaaatgcggcgatcggggcggtattcgtggatgaaaatcaatggaatagtgcaaaggaagccgtagaggatgaaagattctgggatttggtccacagggaacgtgagttacataaacagggcaaatgcgctacctgtgtgtacaacatgatgggaaaaagggagaagaaattaggagagttcggtaaagcaaaagggagccgggcgatatggtatatgtggttaggagcacgatttttagaatttgaggcattaggtttcatgaacgaagatcattggttttcgagggaaaatagtttgtctggggttgagggcgaaggattacataaactgggatatatactaagagatatatcaaaaatcccaggtggtaacatgtatgctgatgatacagcgggatgggacacaagaattaccgaagacgatctccaaaatgaagccaaaataacggacattatggaaccagaacatgcactacttgcaacatccatatttaaattgacatatcaaaacaaggtagttcgagttcaaaggccagctaaatccggaacagtcatggatgtcatatcaagaagagatcaacgaggatcgggacaagttgggacatacggacttaacacgttcaccaatatggaagtacaattaattaggcagatggaaagcgagggcatattttctccctcggagctcgaaaacagtaatttagctgagagggtattagattggctggaaaaacacggtgtggagcggctaaagcgcatggcgattagcggtgacgattgcgttgtaaaacccaccgatgacaggttcgcaaccgcgctaacagctctcaatgatatgggaaaagtaagaaaggacataccccaatgggaaccaagtaaagggtggaacgattggcagcaagttccgttctgttcacatcatttccatcaacttattatgaaagacggaagggaaattgtagttccctgccgaaatcaagatgaactcgtcggcagggcaagagtctcacaaggagcgggatggtctctcagggagacagcatgtcttgggaagagttatgcacaaatgtggcaactgatgtactttcatagacgcgatcttcgattagcggcaaacgcaatctgcagcgcagtaccagtcaattgggtaccgacgtcacgaactacatggtccattcatgcacatcatcaatggatgaccacggaagacatgcttagtgtttggaatagagtttggatcgaagaaaacccatggatggaggataaaactcatgtctcttcatgggaagacgtaccatatttggggaaaagagaagatcagtggtgcggctccctaataggtctaaccgcaagggctacttgggcgacaaacatacaagtggcaataaatcaagtgagacgactgattggaaatgagaattacttggattatatgacgagtatgaagagatttaaaaatgaatctgatccagaaggggcactatggtaa

SEQ ID NO: 22094 - RNA, 9879 nt, synthetic construct
  misc_feature 1..9879: note = derived and/or modified CDS sequence (opt6) from DENV-1__KM403603__SS-prME
  source 1..9879: mol_type = other RNA
tcagtaaccatgttattaatgctcttaccgactgcgctcgcatttcacttgactactcggggaggtgaaccgcatatgattgtgtccaaacaagaaaggggtaaatcgttattgtttaaaacttccgccggtgtgaatatgtgtacattgatagcaatggacctgggcgaattatgcgaagacaccatgacctataaatgccctcggataacagaagctgaacccgacgatgtcgactgctggtgtaatgctacggatacatgggtaacatatggaacctgctcccagacaggcgaacatagacgcgacaaaagatccgtagctttagcgccccatgtaggtctaggcctagaaacaagaacagaaacatggatgtcatcggaaggagcatggcgtcaaatccagaaagtcgaaacatgggctttaaggcatccaggttttacagtaatagcactctttttggcacatgcaataggcacgtcaataacacaaaaaggaataatatttatactcctaatgttggtcactccttccatggcgatgcgatgtgtgggtatcggaaaccgtgattttgtcgagggtttatccggcgctacatgggttgatgtagtcctagagcacggatcgtgtgtgactactatggcgaaaaacaaaccgaccttagacattgaactattaaaaacggaagtaacaaatccagcagttctcagaaaattgtgcattgaagccaaaataagcaatacgacgaccgattctcgttgtcccactcaaggagaagctacgcttgttgaagaacaagatgcaaactttgtttgtaggagaacatttgtagatcgtgggtggggaaacggctgcggactattcgggaaaggatctttgctaacgtgcgcaaaatttaaatgtgtaacgaaattggagggcaaaatagtacagtacgaaaatttaaaatatagcgtaatcgtaacagtccacaccggggatcagcaccaggtaggaaatgaaaccaccgaacatggtacaattgcaacaataacaccacaggcacctacatcagagatacaactaactgactatggagcactaactctggactgtagccctcgcacgggactagatttcaatgaaatggtactattgacaatgaaagagaaaagttggttggtacacaaacagtggttcctggatttaccactgccatggacatcaggggcatccacatcacaggagacttggaatcgacaagatttattagtaacctttaaaacggctcatgctaagaaacaagaagttgtcgtactcggaagtcaagaaggcgcgatgcatacagcgctaacgggggccaccgaaattcaaacaagcggtacgacaacgattttcgccggacatttaaaatgtcgtttaaaaatggataaactcacattgaaaggtgtatcatacgtaatgtgtaccggcagctttaaacttgaaaaagaggtagcagaaacacaacatggaacagtcctagtgcaagtaaaatatgaaggtacggacgcaccctgcaaaataccgatcagcacacaagacgaaaaaggtgtaactcagaacggtaggttaataactgcaaatcctatagtaacggacaaagagaaacctgtaaatatcgaaacagagccaccttttggtgaatcttacatcgttatcggagccggagagaaagctctcaaactgagttggtttaagaaaggatcctcaattggcaaaatgtttgaagcaacagctagaggagcgagaagaatggcaatattgggggacaccgcttgggatttcggttcgattggtggcgtattcacaagtgttggaaaattagttcaccaggtatttggaactgcttatggggttctatttagcggcgtatcgtggaccatgaaaatagggataggcatattacttacctggttaggccttaactccagatcaacttcgctaagcatgacctgcatagcggtagggatggtaactctctatctaggagttatggtgcaagcagatagcggctgtgttattaattggaaaggacgcgagctgaaatgcggttcaggcattttcgttaccaacgaggttcacacatggactgaacagtataaattccaagctgattccccaaaacgtctctcagctgcaataggtaaagcatgggaagaaggagtatgcggaattagatctgcaaccagactagaaaatatcatgtggaaacaaatatcaaacgaacttaatcacattttgctagaaaacgatatgaaatttaccgtcgtagtaggagatgctaacggtatcttaacacaaggcaagaaaatgattagacctcagccgatggaacataaatattcatggaaatcgtggggaaaagcaaaaataattggagccgacactcaaaataccacattcataattgacgggcctgacacacctgaatgccccgatgatcaacgcgcttggaatatctgggaagtagaggactacggattcggggtgtttactaccaacatttggcttaaattaagggatagttatactcaaatgtgcgaccatagattgatgagcgcagcaattaaagatagcaaagcggtccatgcggatatgggatactggatcgaaagcgagaaaaacgaaacgtggaaattagcaagggcatcttttatagaggtaaaaacttgtatctggccaaggagtcacactctttggagtaatggagttttggagagcgaaatgatcataccaaaaatatatggtggtccgatctctcaacacaactatagaccgggttactttacccaaacagcagggccttggcacctcggaaagttagaattagatttcaacctctgtgaaggaacaacggtcgtagttgatgaacactgtggaaatcgtggaccaagtttgcgcactactaccgttactggaaaaataattcacgagtggtgctgtagatcctgcacactacctccactaagattccgaggtgaagatggatgttggtacgggatggaaataagaccagtgaaagaaaaggaagagaatctagttaggagcatggtaagtgctggatcgggggaagtcgatagtttttcgttaggtcttctttgtgtgagcataatgattgaagaagtaatgaggtcacgttggtctaggaaaatgctgatgaccggcacattagctgtgttctttctactcatcatgggacaactcacgtggaacgatttgatcagactatgcataatggttggtgctaacgtaagcgacaggatggggatgggaacaacctacttagccttaatggcgacatttaaaatgcgaccaatgttcgcagtaggacttctcttcagaagacttacaagtagagaggtcttgctactcacaataggtttgtccttagtagcatcagttgaattaccaaactcgctagaagagttaggcgatggcctggcaatgggaataatgatgctgaaactattaacggacttccagagtcaccaattgtggaccacattactatcattaacctttattaagaccacgctgtcactagactacgcatggaaaacgatggcgatggttctcagtatagttagtttatttcccctatgtttatcgaccacgtcacagaaaacgacctggttacctgtgctgttaggatcatttgggtgtaaaccactcacaatgtttttaattactgagaataaaatttggggtcggaaatcctggccactgaatgaagggatcatggctgtcgggatcgtttccatactcctaagtagtttacttaaaaatgatgttcctctggcaggtccacttattgcagggggaatgctaatagcatgttatgtcataagtggctcaagtgccgacctttcactcgaacgtgcagccgaagtaagttgggaagaggaggctgaacattcgggcgcatctcacaatattctcgtagaagtgcaggatgacggtacaatgaaaattaaggacgaagaacgagatgatacactcactatcctcttgaaggcgactttgttagctgtctcgggtgtctacccaatgtcaataccagcaacattatttgtatggtacttttggcaaaagaaaaagcagcggagtggagtactgtgggacactccaagccctcctgaagtagaacgagcagttcttgatgacggtatttatcgtatattacaaagaggcctattgggaagatcacaagttggagtgggagttttccaagacggtgtgttccatacaatgtggcatgtcaccagaggtgcggtgctaatgtaccaaggaaaaagattggagccaagttgggcttcagtaaagaaagacctgatcagttatggcggtggatggagatttcaaggtagctggaatacaggagaggaagtacaagttatagctgtggaaccgggtaaaaacccgaaaaatgtccagaccacaccaggtactttcaaaaccccagaaggcgaagtcggtgcaatcgcacttgatttcaaacctggtaccagcggttcacctatagtaaaccgtgaagggaagatagtaggcttgtacggaaatggagtcgtaacaacaagtggtacttatgtatcggctattgctcaagccaaagcgtcacaagaaggacccctcccggaaattgaagatgaagtatttaagaaaaggaatcttacgattatggatctacacccaggtagtggaaaaacaagacgatatctaccagccattgtgagagaggcaattaagcgcaaactacgaacattaattctagcacctacacgagttgtggcctcagaaatggctgaagccctgaaaggaatgccgataaggtatcaaacgacagcggtaaaatccgagcacacaggcaaggaaatagtagatttaatgtgtcatgccactttcactatgagactattatcccctgtgagagtcccgaactataacatgataattatggatgaggcacacttcacagacccagcatcaatagcagcacgaggatatatctcaactcgcgtaggcatgggcgaggctgcagcaatatttatgactgcaacaccaccaggaagtgttgaagcattcccgcaatcaaacgccgtaatacaagacgaagaaagggacataccggagcgttcatggaactcaggatatgattggattactgatttcccaggcaaaaccgtatggtttgtaccatcaattaaatccggtaatgacatagcgaattgcttgaggaaaaatggtaaaagagtgatacaactatcgagaaaaaccttcgatactgaatatcagaaaacaaagaataatgactgggattatgtggtgaccactgatatttcggaaatgggagctaatttcagagcggaccgggttatagatccaagacgttgcttaaaaccagtgattttaaaagatggtcccgaacgtgtaatactggcgggtccaatgcctgttacagctgcatcagctgctcaacgacgcggcagaataggtagaaatcagaataaagaaggcgaccagtacatttatatgggacaaccgttaaataacgatgaagaccatgcgcattggacagaagcaaaaatgcttttagataatatcaatacaccagaaggtatcataccggctttatttgaacccgaacgtgagaaaagtgcagcaatagacggggaatatagattgcgtggggaagcccgcaaaactttcgttgaactaatgagacgaggcgatttgccagtgtggttaagttacaaagttgcgagtgaaggtttccaatatagtgataggcgatggtgttttgatggcgaacgtaataaccaagtattagaggagaatatggatgtagaaatttggacaaaagaaggagaacgcaagaaattacgcccaagatggctcgatgctagaacctatagcgacccattagctttacgggaatttaaagaatttgcagcggggagacgttcagttagtggtgatcttattttagaaattggtaaactaccacaacacttaacattaagagcacagaatgctctcgataatttagtaatgttacacaactccgaacaaggaggaaaagcataccgtcacgctatggaagaattgccggatacgatagaaactctaatgttgctcgctcttatcgccgttctaacaggaggagtaacactattctttttaagcggaaaaggactaggcaaaacaagcataggattactatgcgtaatggcaagcagcgtattattgtggatggcttccgttgaaccccactggatagcagcaagtatcattctagaatttttcctgatggtactattaattccagaacccgatagacaaaggacaccacaggacaatcaactagcctatgtagtaataggactactatttatgatcctcacagtagcagcgaacgaaatgggtcttttggaaactactaaaaaggatctaggaattggtcatgtagtagctgaaaatcaccatcatgcaactatgttagacatagatctacacccggctagtgcctggacactctatgcggttgctaccaccataataacaccgatgatgagacacacaatagaaaatacaacagcgaacatatccctcactgccatagctaaccaagcggccattttaatgggtttggataaagggtggccaattagtaagatggatataggtgttccgctcttggccctaggttgttatagtcaagtaaatcctctaaccctaacagcagctgttctcatgttagtagcacactatgctattatcggacctggattgcaagcaaaagcaaccagagaagcgcaaaaacgcacagctgctggtattatgaaaaacccaactgtagatggaattgtagccattgatttagatcctgttgtatatgacgctaaattcgaaaaacaattggggcaaatcatgttattaatattatgtaccagtcaaatcttacttatgcgtacaacatgggcgttatgtgaatccataacattagcgacgggacctctaaccacactatgggaaggttctccaggaaaattttggaatactactatagctgtgtcaatggcaaacatctttcgaggtagttacttggctggagccggtcttgcgttttcgctaatgaagacgcttgggggaggaagacgtggaaccggggcgcagggagaaacgctaggggaaaagtggaagcgacaactcaaccagttatcaaagtcggagttcaacacatataaacggtcagggataatggaagttgatagatccgaagccaaagaggggctaaaacgaggagaaacaacaaagcacgcagtctctaggggcacagcgaaattaagatggtttgtagaacgcaatttggtaaagcctgagggcaaagtgatagatttaggctgcggcagagggggatggtcttattactgtgcaggtctaaagaaagtgacagaagtaaaaggctatacgaaagggggtccaggccacgaagaaccgatacctatggctacatacggttggaacatagtaaaacttcacagcgggagggacgtattcttcactcccccagaaaaatgcgacacacttctatgtgacattggtgagtcctctccgaatccgaccatagaagaaggaagaacactgcgggtattgaaaatggttgagccatggttaagaggaaatcaattctgcataaaaattctaaatccatacatgccaagcgtcgttgaaacacttgaacaaatgcaaaggaaacacggagggatgttagtcaggaacccgctatcgaggaactcaactcacgaaatgtattgggtttcctgtggcacaggcaatatagttagcgcagttaacatgacgtcacgtatgttattgaatagattcactatggcacatagaaagcccacttatgaaagagatgtagacttaggagctggcactagacacgtagcggtagagccggaaatagctaacctagatattattggacaaagaatcgaaaatatcaagaacgagcacaaatccacttggcattacgacgaagataatccttacaaaacttgggcctatcatggatcgtatgaggtgaaaccctccggcagcgccagttcaatggtcaacggggtcgttcgtctcctaacaaagccatgggatgttataccaatggtcactcaaatcgcaatgaccgacacaactccttttggtcagcaacgtgtattcaaagagaaagtcgatacccgaacgcctcgaccaaagcgcggtaccgcacaaataatggaagtaacagctaaatggttgtggggatttttgtcccgcaataagaaacctcgcatctgtacacgcgaagaatttacaagaaaagtacgaagcaatgcagccatcggagccgtatttgttgatgaaaatcaatggaacagcgcaaaagaagcagtagaagatgagcgtttttgggatctggtgcatcgcgaaagagaactacataagcagggtaaatgcgctacatgcgtatacaatatgatgggaaaacgagagaagaaattgggggaatttgggaaagccaaaggcagcagagctatatggtacatgtggttaggagctagattcttagaatttgaggctttaggctttatgaacgaagaccattggttttctcgagaaaattcattaagtggcgtagagggagagggactgcataaattaggatacatattgcgtgacataagtaaaataccaggaggaaacatgtatgcggatgataccgcaggatgggacactagaataacagaagacgacttacaaaacgaagctaaaatcaccgacataatggaaccagaacacgctctactagccaccagtatattcaaattaacataccaaaacaaagttgtacgggttcaaagacctgctaaaagtggaacagtgatggacgtaataagtcgaagagatcaacgaggatctggacaggtagggacatatggcctaaatacatttacaaacatggaggtacaactgatcaggcagatggagagtgagggtatattttcacccagtgaacttgaaaactcaaacctagctgaacgagtcttagattggctcgagaagcacggcgtagaacgacttaaacgtatggccataagcggcgatgactgcgtagtcaaacctacagacgatcgcttcgctactgcacttacggctctaaacgatatgggtaaggtaaggaaagatattccccaatgggagccatcaaaaggatggaatgattggcaacaagttcctttctgtagccatcatttccatcaattaataatgaaagatggaagagagatagtagtgccttgcagaaaccaggatgaacttgtcggccgcgcgcgtgttagtcagggagctgggtggtcactaagggaaacagcgtgtttaggtaaatcatatgctcagatgtggcagttaatgtactttcatcgaagagacttgcgtttggctgcgaacgcaatttgcagcgcagtgcccgtgaactgggtaccaaccagcagaactacgtggtctatacacgcgcaccatcaatggatgaccactgaagacatgctcagcgtttggaatcgagtgtggatagaggaaaacccttggatggaagataaaacgcatgtgagctcctgggaagacgtaccgtatttgggaaaaagagaagatcagtggtgtggaagtttaatcggccttacagctagagctacatgggcaactaacatacaggtagctattaaccaagttcggcgtctaatagggaacgaaaattatttagattacatgacttcgatgaaaagatttaaaaatgagtctgacccggagggtgcgttatggtaa

SEQ ID NO: 22095 - RNA, 9879 nt, synthetic construct
  misc_feature 1..9879: note = derived and/or modified CDS sequence (opt6) from DENV-1__KM403585__SS-prME
  source 1..9879: mol_type = other RNA
agtgtgaccatgttacttatgttattacctactgctttagcattccacttaacaacccgtggtggtgaacctcacatgatcgtaagtaaacaagaaagaggtaaatcgctgttattcaaaacgtcggccggagtcaacatgtgcacattaatcgcaatggatttaggagaactatgtgaagatacaatgacatacaaatgtccgaggatcacagaagcagaaccagatgatgtggactgctggtgtaacgccactgatacgtgggttacttacggtacttgttcccaaacgggagaacataggcgagacaaaagatctgtggcattagccccacatgtagggttaggtttagaaaccagaactgaaacatggatgtcaagtgaaggagcctggagacaaatacaaaaagtagaaacatgggcgctacgtcacccgggattcactgtcatagcattatttctagctcatgcaataggaacgagtataactcaaaaaggaataatctttatattactaatgcttgttacaccatctatggcaatgaggtgtgttggcattggaaacagggattttgttgaaggcctaagtggggccacatgggttgatgttgtgctggaacacggatcctgcgtgacaacaatggcgaaaaataaacctacactagatattgaactgctaaagaccgaggtaaccaacccagctgtcctaagaaagttatgtattgaggcgaaaatatcaaacactactacagactcaagatgccctacacaaggcgaagcaacacttgtagaagaacaagacgcaaatttcgtctgtcgtagaactttcgtagatcgaggctgggggaacggttgtggattgtttggcaaagggagccttctaacatgtgcaaagtttaaatgtgtgacaaaactggaaggacgcatagttcaatatgaaaacttaaagtacagtgtaatagtgacagtacacaccggtgaccaacaccaagtcgggaatgaaaccacagagcacggaactattgccactataacaccgcaagctccaacgtcagaagtgcaattaactgattatggagcactgaccttggactgttcgccgagaaccggtctggatttcaatgagatggtattattaaccatgaaagagaaaagctggttggtccataaacaatggtttttagacctaccattaccatggacatctggtgcgtcaacgagccaagaaacatggaatagacaagatttgctagttacattcaaaaccgcacatgctaagaaacaagaagtagtagtgctaggttcacaagaaggggctatgcatacggctttaacaggcgcaacagagattcaaacatcagggacaactacaatctttgcgggacacctgaagtgccgattaaaaatggacaaattaactctcaaaggtgtatcgtacgtaatgtgtacgggatcctttaaactagaaaaggaagttgccgaaacacagcatgggacagtcttggttcaagttaaatatgaaggaacagatgctccttgtaagataccaatatccacacaagacgagaaaggtgtgacgcagaatggtagactgataacagctaatcctatcgtcacggacaaggaaaagcctgtaaatatagagacagaaccgccgtttggagagtcttacatagtaatcggtgccggcgaaaaggcgcttaaattatcatggttcaagaaaggttcgtcaattgggaaaatgtttgaagctactgcgagaggcgctagaagaatggcaatattaggagatacagcttgggatttcggtagcatcggcggagtattcacgtcagtcggaaaattagtacatcaagtattcggtacggcatatggtgtactattcagcggtgtcagctggacaatgaagatcggaataggcatcctactaacctggttgggattaaactcgagaagcactagcttgagtatgacgtgcatagctgtcggtatggtaacgctatatctcggcgtgatggtacaagctgattcaggttgcgttatcaactggaaaggtagagaattgaagtgcgggtccggaatattcgtcactaacgaagtgcatacttggaccgagcaatataaattccaagcagactccccaaaaagattaagcgccgcaataggaaaagcatgggaggagggtgtgtgcgggatccggagtgccaccaggttagaaaacattatgtggaagcaaatttcgaacgaactcaatcacatactcttggagaatgatatgaaattcaccgtcgtagtgggagatgcatatggcatactgactcaaggcaagaaaatgatacggccgcagcccatggagcataagtactcctggaagagttggggaaaagccaaaataataggcgctgacacgcagaatacgactttcataattgatggaccagatacaccagagtgccctgacgaccaaagagcttggaatatttgggaagtggaggattatgggttcggggtatttacaacaaacatatggctaaaacttcgagactcctatacccaaatgtgtgatcatagacttatgtcagctgctatcaaagactctaaagctgtgcacgcggatatgggatactggatagaaagcgaaaagaacgaaacctggaaattggcacgagcatcttttattgaagttaaaacttgtatatggccaaggtcacatactctatggtctaatggagtactcgaatcggaaatgatcatacctaagatatatggtggcccaatatctcaacataattaccggcctggttactttacccaaacggctggtccttggcacctcggcaaactggaactagattttaatttatgtgaaggtactacggtagtagtagacgaacattgcggtaaccgaggaccgagccttagaactactacagtaacgggcaaaataattcacgaatggtgctgtcgaagttgtacattaccgcctctacgatttcggggagaagatggctgttggtacgggatggagatacgcccggtaaaagaaaaagaagaaaacttagttcgaagtatggtatccgctggtagtggtgaagtggattcattctcattaggattgctatgcgtaagtataatgattgaagaagtaatgcggagtaggtggagtaggaaaatgttaatgactggtacattagctgttttctttttattgataatgggacaacttacttggaacgatttaatcagactttgcataatggtaggtgctaatgtatctgaccgaatgggtatgggaaccacataccttgccctcatggcgacgtttaaaatgcgacccatgtttgctgtagggcttttgtttcgtaggttgacaagtagggaggtgttattattaaccataggcctatcattagtagcctcggtcgaacttccaaattctttagaagaactaggagacggattggcaatgggcataatgatgttaaagctacttactgatttccaaagccatcaactttggactaccctactcagcttaacatttattaaaactaccttaagcctagattatgcatggaaaactatggccatggttttgtcaatagttagcctctttccattatgtctctcaacgacctcacaaaagacaacatggctacctgtgttattaggatctttcgggtgtaagccactaacaatgtttttaattacagaaaataaaatttggggaagaaaatcttggcccttaaatgagggcataatggcagtaggtatcgtctccatcctcttaagttcattactcaaaaatgacgtaccgttagcaggcccactaatagccggcggaatgttaatagcgtgttacgtgattagtggatcctcggcggatttgagtctggaacgtgcagcagaagtctcatgggaagaagaagccgaacacagcggcgcaagccataacatactcgtagaagttcaagatgatggaacaatgaaaattaaagacgaggaacgggatgacaccttaacaatattattaaaggcaactctattagctgtatccggggtatatcctatgtcaattccggcaactctttttgtttggtatttttggcagaaaaagaaacaacggtcgggagttctgtgggacacaccaagtccgcccgaagtcgaacgtgcggtcctggatgacgggatctatagaattttacagcgaggcttgttaggcagatcacaggtaggtgtcggggttttccaagacggagtttttcataccatgtggcatgttacaagaggtgcagtgttaatgtatcaaggtaaacgactggagccctcctgggcatcggtgaagaaagatttaatcagctatggtggtggatggaggtttcaaggcagctggaatacgggggaagaggttcaagtaatcgcggtagaaccaggcaaaaatcccaaaaacgtacaaactacacctggtacgtttaaaacacctgaaggtgaagtgggcgccattgctctagatttcaaaccaggtacatcaggaagccctatagtgaatcgtgaaggcaaaattgtaggactatatggaaatggtgtcgttacaaccagtggaacctatgtctccgcaatagcccaagcaaaagcctctcaggaaggtcccctacccgagatagaggatgaagtttttaagaaacgtaaccttaccataatggatctgcacccaggaagtggtaaaactagacgctatcttccggcaatagtgagagaagctataaaaaggaaactaagaacactaatcttagcaccaacacgagttgtagcatcagaaatggcggaagccttaaaaggtatgccaattagataccagacaacggcagtgaaatctgaacacactggaaaagaaatagtggatctcatgtgccacgctacctttactatgagacttctatcaccggttcgcgtacccaattataatatgataataatggacgaagctcatttcacagaccccgcaagtatcgcagcgagaggctatatatcgactagagtaggcatgggagaggctgcggcaatctttatgacagccacacctccaggctctgtagaagccttcccacaaagcaatgctgtaatacaagatgaagaacgagacatacccgaacgctcctggaacagcgggtatgactggatcacagactttccagggaaaactgtttggtttgtgcccagcataaaaagtgggaatgatatcgccaattgtttaaggaaaaatggcaagagagtgatccaattatccagaaaaactttcgatacagaataccagaaaacaaagaacaatgactgggactatgtcgtgacgacagatataagtgaaatgggcgctaattttagagccgacagggtgatagatccacgcagatgtcttaaaccggttatattaaaagatggccctgagcgtgttatattagccgggccgatgccggttacagccgcttcagcagcccaaaggagaggaagaattggaagaaatcaaaacaaagaaggtgaccaatatatatatatgggtcaaccgttaaataatgatgaagaccacgcacactggactgaagccaaaatgttacttgataacataaatacacccgaaggtatcataccagcattgttcgaaccagagagagagaaatctgctgcgattgatggagaatatcgacttagaggggaagcgcgcaaaactttcgtagagcttatgagaaggggagacttaccagtatggttgtcatataaagttgcatctgaagggttccaatattctgatcggagatggtgttttgacggagagagaaataatcaggtgttggaagaaaacatggatgtggaaatctggactaaagaaggagaacgcaaaaagttgagaccaagatggctcgacgctaggacgtattctgatccactagcattaagagagttcaaagagttcgctgccgggcggcgctcggtaagtggagacctgatcctagaaatcggtaaactacctcaacacttgactctgcgcgctcaaaatgcactagataacctagtaatgttacacaatagtgagcagggaggtaaagcataccgtcatgctatggaagaactgccggatacaatagaaactctgatgttactcgcactaattgcggtactcacaggaggagtaacgctattctttttatccgggaaaggacttgggaagacaagtatcggacttttgtgtgtaatggcgtcgagtgtcttattgtggatggccagcgttgaaccgcactggatagccgcttcaatcatattagagttcttccttatggtattgctgataccagaacccgatagacagaggacgccacaagataatcaattagcatacgtagtgattggattgttattcatgattctaacggtagctgccaacgagatgggattactagagacaactaagaaggatctgggcatcggccatgtagttgcagaaaaccaccatcatgccacaatgctagatattgatctacaccccgcgtcggcctggacattatatgcagtagcaactacaattataactcccatgatgcgacatacaatagagaatacaacggcaaatatatcgcttacagcaattgcaaatcaagccgcgattcttatgggtttagataaaggttggcctatcagcaaaatggatatcggagttcctttactagctttaggctgctactcacaagtgaacccgttaacattaacagccgcagtattgatgctagtagcccattatgcaataattggacccggattacaagcgaaggcgactagagaagcgcaaaagcgtacagcagctggtataatgaaaaatcctactgtcgatgggatcgtagcgattgatcttgacccggtagtctatgatgcaaaattcgagaaacaactaggacaaataatgttactaattctatgcacgagtcagatacttcttatgagaacaacatgggcactgtgtgaatcaataacactggcaacgggccccctcacaaccttatgggaaggtagcccagggcgattttggaacacaaccatagcggtgagcatggctaacatatttcgaggctcttacttagcaggggccggcttagcattcagtttgatgaaatctctgggaggaggtaggcgaggtacaggcgctcagggagagacgttaggtgagaaatggaagagacaactgaaccaactaagtaaatcagaatttaacacctacaaaaggtctggtattgttgaagttgataggtctgaggctaaagaaggcatgaaaaggggagagactacaaaacacgccgttagtcggggtaccgcgaaattacgatggttcgtagagcgaaacttagtcaagcccgaaggcaaagtaatagatcttggatgcggaagaggagggtggtcatattattgtgccggtctaaagaaagttactgaggtgaaggggtataccaaaggcggcccgggccatgaggaacctattccaatggctacatatgggtggaacattgttaaattacatagcggtagagacgtattcttcactccaccagagaaatgcgatactttactatgtgatataggagaatctagccctaacccaacaatagaagaaggtaggacacttcgagttttaaaaatggtagaaccgtggctccgtggaaatcaattttgtataaaaatattgaacccgtatatgccatctgtagttgaaacactagaacagatgcagagaaaacatggtgggatgctagtgcggaatccgctttcacggaactccacacatgaaatgtactgggtatcatgtggaacgggtaacatagttagtgcagtaaatatgacttcgaggatgttactaaaccgatttacaatggcgcatagaaaacctacttatgaaagagatgtagacctgggcgcaggtactaggcatgtagccgttgaaccagaaattgcaaatctagacataattgggcagcgtatagaaaatattaaaaatgaacacaaaagtacttggcactatgacgaagataacccatacaaaacttgggcctatcatggatcttatgaagtaaagccatccggttcagcatcttcgatggtcaatggtgttgttagactattaacgaagccatgggacgtaatccccatggtaacgcaaattgctatgacagacactacgccatttggccagcaaagagtatttaaagaaaaagtagatacccgaactccccgaccaaagagaggaacagcacaaataatggaagttacggcaaagtggctgtggggattcctaagtaggaataagaagccacggatctgcacgagagaagagtttacaaggaaagtacgttccaatgcagccattggagccgtctttgtagatgagaatcaatggaacagtgcaaaggaagctgtcgaagatgagcgcttttgggatcttgttcaccgggaacgagaacttcataagcaaggtaaatgtgcaacatgcgtctacaatatgatgggcaaaagagagaaaaagctaggcgagttcggaaaagctaaaggctcaagagcaatctggtacatgtggttaggtgctcgatttttagaatttgaggctttaggctttatgaatgaagatcattggtttagccgagagaactctctatctggagtcgaaggagaaggtctccataaactagggtacattctaagagacatctccaagatcccaggcggcaacatgtacgcagatgacacagcaggatgggatacgcgtattactgaagatgatttgcagaacgaagctaaaattacggatataatggaaccagagcatgcattgctagcaacgtccatctttaagctcacatatcaaaacaaagtagtccgcgtgcaaagaccagcaaaatctggcactgtgatggacgttataagccggagagaccaaagaggtagtgggcaagtcggaacttacgggttaaatacctttacaaacatggaagtccagcttatccgtcaaatggaaagcgaaggaattttcagtccgagtgaactagaaaattcaaacctagcagaacgggtgctcgactggttggagaaacatggtgtcgagagacttaaaagaatggctatctccggagatgattgtgtagtaaaaccaactgacgatagattcgccacagctctaactgccctgaacgatatgggaaaggtaaggaaagatatcccacagtgggagccaagtaaaggctggaacgattggcaacaggtccctttttgctcacatcacttccatcaattaataatgaaagacggacgggaaatagtggtgccctgtcgaaaccaagatgagttggtaggcagagctcgagtctcccaaggagcaggatggtctcttcgtgaaaccgcgtgtctagggaaaagttatgcgcaaatgtggcaattaatgtactttcacaggagagatctacgcttggcggccaacgctatatgctccgcggttcccgtcaactgggtacccacgagtagaactacatggagcatacacgcccaccaccaatggatgactactgaggatatgctgtccgtgtggaatagggtctggattgaagaaaacccttggatggaagataaaactcatgtatcatcatgggaagacgttccctatctcggtaaaagagaggaccaatggtgcggatctttaataggtctgacagctagggcaacttgggcaactaatatacaagttgcaatcaatcaagtacgaagactaattggcaatgagaattacttggactatatgaccagtatgaaaaggtttaagaatgaatcggacccagagggggctttatggtga

SEQ ID NO: 22096 - RNA, 9879 nt, synthetic construct
  misc_feature 1..9879: note = derived and/or modified CDS sequence (opt6) from DENV-1__KM403595__SS-prME
  source 1..9879: mol_type = other RNA
tcggtaactatgctcttgatgttattgccaacagctttggcatttcatttaacaacaagaggaggagaaccacatatgatagtaagcaaacaagaacgaggaaaatcgctactatttaaaacatctgcaggagtaaatatgtgtacccttatagcaatggatttaggagaattatgtgaagatacaatgacctacaaatgcccaagaataacagaagcagaaccagatgacgtagattgttggtgcaatgcaaccgacacttgggttacgtatggcacgtgttcgcaaacgggagagcacagaagagaccgtagatcagttgctcttgcaccccatgttggcctagggttggaaacgagaactgaaacatggatgagtagtgaaggtgcttggcgccaaattcaaagagtagaaacgtgggctttgcgacatcctggatttactgtcatagcgttatttcttgcacatgccataggcacttcaataactcaaaaaggcataatatttatattactaatgctagtaacgccgagcatggctatgagatgtgtagggataggtaatcgtgactttgtggaaggtttaagcggggcgacttgggttgatgtggtactggaacatggctcttgtgtaacaactatggccaaaaataaaccgacacttgatatcgaactattaaaaactgaagtaacgaacccagcagtactaagaaaactatgcatagaggcaaaaatctctaacacaacaactgatagtcgatgcccaacacaaggtgaagccacgttggtagaagaacaagatgccaattttgtatgcaggagaacctttgtggatagaggctggggcaatggttgtggattgtttggcaaaggcagccttttaacctgcgcgaaattcaaatgcgtaacaaaattggagggcaaaatcgtacaatacgagaacctaaaatacagcgttatagtaactgtacacaccggcgatcaacaccaagtagggaatgagacaacagaacatgggaccatcgctacaatcacgccacaagctccaacaagtgaaatacaattaactgattatggcgcactcactctggactgttcacccagaactggactagattttaatgaaatggtactattaacgatgaaagaaaaatcttggctggttcataaacaatggtttctcgatctaccattgccttggaccagcggagcgagcacatcacaagaaacgtggaatcgacaagacttactggttacttttaaaacagcgcacgccaagaaacaggaggtggtcgtactgggatcgcaggaaggcgcgatgcacacggctctaacaggagcaactgaaattcaaacatcagggactactactattttcgcgggccatctgaaatgtcggttaaaaatggataaactgactcttaaaggagtgagttatgtaatgtgcacaggatcatttaaattagaaaaagaagtcgcagagactcagcacgggactgttctggtacaggtcaaatacgaaggaacagacgcaccatgtaaaatcccaataagtactcaagacgagaaaggagtcactcaaaatggccgactaattaccgcaaacccaatagtaactgataaagaaaaacctgtaaatatcgaaatcgaaccaccatttggagaatcttatatagtaatcggtgcaggcgaaaaagcattgaaactaagttggttcaagaaaggttcatctataggcaaaatgttcgaagctacagctagaggcgccagaaggatggctattttgggggatacggcttgggattttggtagcattgggggtgtgtttacaagtgtgggtaaattggttcatcaagtgtttgggacggcctatggagtgttattttcgggcgttagttggacaatgaaaatagggataggcatattacttacatggctgggactaaattctcggagtacctcactaagcatgacttgcattgcagtagggatggttacgttatatttaggtgttatggtgcaggctgactctggctgtgtaatcaattggaaagggagagaactcaaatgcgggtccggaatatttgtaacaaacgaggtccatacgtggacggagcaatacaaatttcaagccgacagccccaaaagactatcggccgcgataggaaaagcatgggaagaaggagtatgtggcatacggtcggctacaagattagaaaatattatgtggaaacaaatctctaatgaattaaatcatatacttttagaaaacgacatgaaatttaccgtggttgtgggagatgcaaatgggattcttacccaaggcaagaaaatgataagaccgcaaccaatggaacataaatattcttggaaaagctggggtaaagccaaaatcataggcgctgatacccagaacaccacattcatcatagatggaccggacacacccgaatgtcccgacgaccaaagagcatggaatatctgggaggtggaagactacggattcggggtgtttacaacaaacatatggcttaaattacgtgactcttatacacagatgtgtgatcacagactaatgtcagctgcaatcaaagatagcaaagctgttcatgcagatatgggatactggattgaaagtgagaaaaatgaaacctggaaattagccagagctagtttcatagaagtcaaaacatgcatatggccacgaagccacaccttatggagtaatggagtattagaaagcgagatgataataccaaaaatttacgggggaccgatatcacaacacaattacagacctggttatttcacccagaccgcagggccttggcacctaggtaaattagaactagactttaatttatgcgaaggaactacggtcgtagtagacgaacactgtggaaaccgaggtcctagtctaagaacaactacggtaaccgggaaaatcatacatgaatggtgctgcagatcctgcacactaccaccattaagattcagaggcgaagatgggtgttggtacggaatggaaataaggcctgtaaaagagaaagaggagaatttagtccgttcaatggtcagcgctgggagtggcgaagtagacagtttctcattagggttactgtgtgtaagtataatgattgaggaagtgatgcgttcaagatggtctcgtaaaatgctaatgacgggaacactagccatatttttcttgctaattatggggcaattaacttggaatgatctcatacgtttatgcatcatggtaggtgccaacgtttcagataggatgggtatgggaaccacatacttagctttaatggctacatttaaaatgcgacccatgtttgcagtaggtctactttttagacgcctcacaagtcgagaagttttactattgacaatcgggttgagcctcgttgcaagcgtcgaacttcccaattccctagaagaattgggcgatggtttagcgatgggaatcatgatgttaaaactactaacagactttcaatcgcatcaactatggacaactttattaagccttacctttataaagacaacactaagtctcgattacgcttggaagacaatggcaatggttcttagtatagtcagcttatttccattgtgtttgtcaactacctcacagaaaaccacttggttacctgttctactaggatcatttggatgtaaaccactaaccatgttccttataactgaaaataagatttggggaaggaaaagctggccacttaacgagggcataatggcagtaggtatcgtatcaatcttgctttcaagccttttaaagaacgatgttccactagctggtcctctaatagctgggggaatgttgatagcatgttatgttatttcgggctctagtgcagacctgtcgttagaaagagcagcagaagttagctgggaagaggaggcagaacattcgggagcctctcacaacatactcgtggaggttcaagatgacggaacaatgaaaatcaaagatgaggaaagagacgacaccttaacaatcctactaaaagcaacattgttagccgtgagtggagtataccccatgagtataccagctacattattcgtttggtatttttggcagaaaaagaaacaaaggtcaggggtattgtgggatacaccaagtccaccagaagtggagcgagccgtcttagatgacgggatctaccgaatattacaacgaggcctattaggtagaagtcaggtaggagtaggtgtgttccaggacggtgtttttcacacaatgtggcacgtgactcgcggagcagtactgatgtaccaaggcaaaagattggaaccaagctgggcatccgtgaaaaaggacttaatatcttatggtggaggatggcgatttcaaggatcatggaacacgggagaagaagtccaagtaatagcggtcgagccgggcaaaaatcctaaaaatgtacagacaacacctgggacatttaagaccccagagggagaagtaggggcaatagccctcgatttcaagccgggcacgtcgggatcccctatagtaaacagggagggaaaaatagtcggattgtatggaaacggtgtcgtgacaacatcaggtacgtatgttagcgcaatcgctcaagcgaaggcttctcaggaaggccctttaccagaaatagaagacgaagtctttaaaaagaggaatttaacaatcatggacctacacccaggttccggtaaaacacggcgatatctccctgctatcgtgagagaagccataaaacggaaattacgaacattgattctagctccaacccgggtagtggcatccgaaatggcagaggctttgaaaggtatgccgatacgatatcagacgactgcggtcaaaagtgagcataccggaaaagaaattgttgatctgatgtgccatgctacatttacgatgcgcttactgtcacctgtacgagtaccaaattacaacatgattattatggacgaagctcattttactgacccggcttctattgcagctcgtggttacatctctacccgagtgggaatgggagaagcggcagctatatttatgaccgctacaccgcccggaagtgtcgaggcatttccccaaagcaatgcggtaatacaggacgaagaacgagacatacccgaaagatcttggaactccggttatgactggataacagactttccaggaaagactgtttggtttgtcccttcaataaaatctggtaatgacatcgcgaactgcctcaggaaaaatggcaaacgagtgattcagttgagtcgaaagactttcgacactgaataccaaaagaccaaaaacaacgattgggactacgttgtaactacggatataagtgaaatgggagctaatttcagggcagatcgcgtcatagatccgagaagatgcctaaaaccagttattttaaaagatggacctgaacgtgtaatattagcaggccccatgccagtgactgccgcgagcgcggcacagaggaggggtagaattggaagaaatcagaataaagagggagaccagtatatttatatggggcaacctttgaacaacgacgaagaccacgctcactggacagaagcgaaaatgttattagataacataaatacgccggaaggcatcatccctgcattatttgagccagaacgtgaaaagtcagcagcaatagatggcgagtatcgactacgtggggaagcaagaaaaacttttgtggaattgatgcgtcgaggagatctccctgtctggctttcatacaaagtcgcatcagaaggttttcagtacagtgacagacgatggtgttttgacggtgaaagaaataatcaagtactagaagaaaacatggacgtagaaatatggactaaagaaggagagaggaagaaattaagacccaggtggctcgatgcgcgaacatattcagatcccctagcgctccgtgaatttaaggaatttgctgcagggagaagatcggtcagtggcgatctaatactcgaaattggaaaattaccacagcatttaactttgagggctcaaaacgcattggacaacctcgtgatgctacataattcagaacaagggggtaaggcttataggcatgcgatggaagaactgccagacacaatcgaaacactcatgttgttagcacttattgcagttcttacaggcggagtgactctattcttcttatcagggaagggattgggaaaaacatccataggtttgctttgtgtaatggcctcgtcggtgcttctatggatggctagcgttgagccccattggatagctgcatccattatacttgaatttttcctaatggtattgttaattcccgagccagatagacaaagaacgccacaggataaccaattggcctacgtagttataggtttgctctttatgatactgaccgtagcagcgaacgaaatgggactgttagaaactactaagaaagatctgggcataggacacgttgttgcagaaaaccatcatcacgccacgatgcttgacatagatctacaccctgcaagtgcgtggacattatatgcagtcgcaactacaatcatcactcctatgatgcgacatactatagaaaacaccactgcaaatatttcgctaacagcaatcgcaaatcaagctgcgattctaatgggcttggacaaaggttggccgataagcaagatggacattggggtaccattgctagcactgggttgttattctcaagtaaacccgttgacactgacggctgctgtactcatgttagtagctcattatgcgataattggtccaggcctacaagcaaaagctacacgtgaagcgcagaaaagaaccgctgccggcataatgaaaaatccgacagtagatggaattgtcgcgatagatctggatcctgttgtatacgatgcaaaatttgagaaacagctaggtcagataatgttactaatactgtgcacatcacagatcttattaatgagaaccacctgggcattatgtgagtctattacactggcgacaggaccgttaacaacattatgggaaggatcccccggaaagttttggaatactactatcgccgtaagtatggccaatatatttagaggatcgtatcttgcgggagccggtctagcattttctcttatgaaaagtctaggcgggggaagaagaggaactggcgctcaaggagaaacgttgggtgaaaaatggaaaagacaattaaatcagctatccaaaagcgagtttaacacatacaaaagaagcggtataatggaagtagaccgctcggaagcaaaagaaggactaaaaagaggagaaacaacgaagcacgccgtgtcgcgaggtactgcaaaactcagatggttcgttgaacgaaatctagtgaaacccgaaggaaaagtcattgacctaggctgcggtcgaggaggctggagctactattgtgctgggctgaagaaggtgactgaagtaaaaggttacacaaaaggagggccaggtcacgaggaaccaattccgatggcaacttacggctggaatatagttaagttgcattcgggacgcgatgtattctttacaccacccgaaaaatgcgataccctcctttgcgacataggcgaatcgtcccctaatcccacgattgaagaaggaagaaccttaagagtcctaaaaatggtagagccttggcttagggggaatcaattttgcataaaaattttaaatccgtatatgccttctgtagtagagacgctcgaacaaatgcaacgaaaacacggtggaatgctagtaagaaatccattatctcgaaattcaactcatgaaatgtactgggtaagttgcggaacaggtaacatagtttctgcagtaaacatgacatctaggatgctactaaaccgattcacaatggctcatagaaagcctacatatgaaagagatgttgatctaggagccgggaccagacatgtggccgttgaacctgagacagcaaatctcgacataattggtcaacgaatcgagaacatcaaaaacgaacataagagtacttggcattacgatgaagacaacccgtacaaaacctgggcttaccatggcagttacgaagtgaaaccgtctggaagcgctagttcaatggtcaatggtgtagtgcgtcttctaacgaaaccctgggacgtcatccctatggttactcaaatagccatgacagatacaacacctttcgggcagcaaagagtttttaaagagaaagtagacactcgaaccccgaggcccaaacgcggtactgcacaaattatggaagtgacagctaaatggttatggggatttttgagcagaaataagaaacccagaatctgtacccgcgaagagttcactaggaaagtacggtccaacgccgcaataggtgctgtgtttgttgatgagaatcagtggaatagcgcaaaggaagctgtagaggacgaacggttttgggatctagtccacagagaacgagaactgcataaacaagggaaatgtgctacttgcgtatataatatgatgggtaaacgtgaaaagaaacttggggagttcggaaaggctaaaggatccagagctatctggtatatgtggctgggtgcgcgtttcttggagtttgaagcattagggtttatgaacgaagaccactggttcagcagagaaaatagtttgtccggggtagagggagaaggactccataaacttggatacatattgagggatattagtaaaattcctggaggaaatatgtatgctgatgacactgcgggatgggatactcgaattactgaggacgatctacagaacgaagcaaaaattacagatataatggaaccagaacatgctctcctagctacatcaatctttaagctaacttatcaaaataaagtagtgcgagtacaaagaccagccaagtcaggaactgttatggatgtaatatccaggagagaccaacgtggcagtggtcaggtaggtacttatgggttaaacacttttacaaatatggaagtgcagctaatacgtcagatggaatccgagggcattttcagcccgagcgagctggaaaattccaatttagcagaacgagtcttagactggctagaaaaacatggagtggaaagactgaaacgaatggcaatctctggtgatgactgcgttgtaaaaccgacagacgacagatttgctactgccttgacagctttaaatgatatgggaaaagtcagaaaagatataccccagtgggagccaagtaaagggtggaatgattggcaacaagtaccgttttgctcacatcatttccaccagttgataatgaaagatggaagagaaattgtagtcccatgcagaaatcaagatgagctagtcggtcgagctagagtatcgcaaggtgcaggttggtcactccgagaaacggcatgtctgggaaaaagctacgcacaaatgtggcagttgatgtattttcaccgacgcgatctacgactcgcagcgaatgcgatttgttcagctgtcccagtaaattgggtaccgacatcaagaacaacatggagcattcacgcacatcaccaatggatgacaactgaggatatgctctctgtatggaacagagtctggattgaagagaacccatggatggaagacaaaacgcacgtaagttcatgggaagatgtcccgtacctaggtaaaagagaagatcagtggtgcggatcacttataggattaacggcaagggcgacgtgggccacgaatatacaggtagctataaatcaagtgagaagattgataggcaacgaaaactatctcgattatatgacgagcatgaaacggtttaaaaacgaatccgacccagagggagctctctggtaa

SEQ ID NO: 22097 - RNA, 9879 nt, synthetic construct
  misc_feature 1..9879: note = derived and/or modified CDS sequence (opt6) from DENV-1__KM403604__SS-prME
  source 1..9879: mol_type = other RNA
tcggtaacgatgttactaatgttacttccgactgcgttggctttccacctaactacgcgaggcggagaaccacacatgatagttagcaaacaggaaaggggaaaatctttgctatttaaaacctcagcaggggttaacatgtgcacgttgatagcaatggatttgggagaattatgcgaagatactatgacttacaaatgcccgcgtataaccgaagctgaacctgatgacgttgactgctggtgtaacgccacagacacgtgggtcacgtatggcacctgtagccaaacaggagaacatcgaagagataaacgaagcgtagccttagcaccacacgttggtctaggattggagacacgaacagaaacttggatgtcttcagaaggtgcttggagacaaatacaaaaagtggaaacttgggcgttacgccaccctggcttcacagttatagcgctgttcctggcccatgcgataggaacttctataacgcaaaaaggcataatcttcatcctactcatgttagtaacaccaagtatggccatgaggtgcgtgggtatcggaaatagagattttgtagaaggactttctggagcgacatgggtagacgtagtattagaacatggctcatgtgtgacgacaatggctaaaaacaaaccaacattggacatagaattattgaaaacagaggtaaccaatcctgcagttttgagaaaattatgcatcgaggcaaaaatatctaatacgaccactgattctcgctgtccaactcagggagaagcgactctagtcgaggaacaagatgcaaattttgtttgtagacgaacctttgtggatagaggttgggggaatggatgcggtttgtttggtaaaggaagtttattaacatgtgcaaaatttaaatgcgtaaccaaacttgagggcaaaattgtgcaatatgaaaacctaaaatatagtgtaatagttacagttcacactggggatcagcatcaagtggggaacgagaccactgaacaaggtacaattgctactattactccacaggctcccacatctgagatacaattaacagattatggggctctcacgttggattgttccccgagaacaggattagattttaatgagatggtactacttacaatgaaagaaaaatcatggttggttcataaacaatggttcttggatctaccattaccctggacaagtggcgcatctacaagtcaagaaacttggaatagacaagatctcctcgttacatttaaaacagctcatgccaagaaacaagaagtagtagtgctagggtctcaggaaggagcaatgcacacagctttaacaggggccactgaaatccaaacgtccggaaccacaacaatatttgcagggcacttgaaatgtagactgaaaatggataaacttactctaaaaggcgtatcgtacgtaatgtgtactggtagcttcaaactagagaaagaagtagcagaaacacagcacggcaccgtcctagtacaagtaaaatatgaaggcaccgacgcaccatgtaaaatccctatcagtacacaagacgaaaaaggtgttacacaaaacggtcgactaataaccgcaaatccaatcgtcacagacaaagaaaaaccagtaaatatcgaaacggaacctccttttggcgaatcgtatatagtcattggagctggagaaaaggctttaaaactctcgtggtttaagaaaggatcatcaataggtaagatgttcgaggccaccgcacgcggtgctcgacgaatggcaattctcggggacacagcgtgggactttggttccattggaggagtattcacgagcgtgggaaaattagtccaccaagtatttggcactgcctatggcgtacttttctccggagtctcatggacaatgaagattggcatcggcatacttctaacctggttaggactgaatagtagaagcacatcgttaagcatgacttgtatagccgtcggcatggtaacgttgtatttaggggtaatggtacaagcagattcgggctgcgtaattaattggaaaggccgagaactaaaatgtggttccggcatttttgtaactaacgaagtccatacttggactgaacaatataaattccaagcagatagtcctaagaggctttcagcagcaataggtaaagcatgggaagaaggtgtttgcggaatacgaagtgcaacaagacttgaaaatataatgtggaaacaaatctctaatgaattaaatcatatcctattagaaaatgatatgaaatttacagtagtagtgggggatgctaacggaatactcactcaaggaaagaaaatgatacgaccgcagcctatggaacataaatattcttggaaatcgtggggtaaagcaaaaattatcggggctgatacgcaaaataccacgtttataatagatgggcccgatacaccagagtgtccagatgatcaaagagcatggaacatatgggaagtcgaggattatggtttcggcgttttcaccactaatatctggcttaaattgagagattcatacacacagatgtgtgaccaccgattaatgagcgcagcaataaaagactcaaaagctgtgcatgcggacatgggatactggattgaatcggagaaaaacgaaacctggaaactggctagagcttcctttattgaggtaaaaacatgcatctggcctaggagccacacactttggtccaatggtgtacttgaaagcgaaatgattataccgaaaatatatggcggtccgatatcacaacataactatcgacccggttattttactcaaactgcaggcccgtggcacttaggaaagctagaactagacttcaatctctgtgaggggacaactgtagtagtggacgaacattgtggaaaccgaggaccgagtctaaggacaaccacagttacaggcaaaataattcacgagtggtgctgcagaagttgtacgttaccgcccctaagattcagaggggaagatggatgctggtatggaatggaaattcgaccggtgaaagaaaaagaggaaaacttggttcgatcaatggtttcagcaggaagtggcgaggtcgactcgttctcgctagggttactatgcgtttccataatgatagaagaggtaatgcgatcgagatggtcccggaaaatgttgatgacaggtacactcgctgtattctttttattaattatgggccaacttacctggaatgacctaattagattgtgtatcatggtaggtgcgaatgtgagcgaccgaatgggtatgggaacaacttatttagccctaatggccacattcaaaatgagaccaatgttcgctgtgggactattgtttcggagactcacaagtcgtgaagtgttattattaacaattggcttgtccttggtagcatcggtggaattacctaacagtctagaagaattgggagacggactcgctatgggtattatgatgttaaagctgctaactgactttcaaagtcaccaattatggaccacactattatcgctaacgtttataaaaaccactctctcattggattacgcgtggaaaacaatggcaatggtgttgagtatagtatcgttatttcctttatgtctgagcacaacttcacagaaaacaacatggctgccggtcttactgggtagcttcggttgcaaacctttaacaatgtttctaattacagaaaataaaatatggggtaggaagtcttggccgctaaatgaagggatcatggcagttggtattgttagtatactcttaagttcattacttaaaaacgatgtacctctagctgggccactcatagctggaggaatgttaatcgcctgctatgtaatttccggatcttcggcagacctttcgctagaaagagcggcagaggttagctgggaagaggaagcagaacactcaggagcaagtcacaatatcctagtggaggttcaagacgacggaaccatgaaaataaaagacgaagaacgagacgatactcttaccattttactaaaggctacattactagccgtaagtggagtttacccaatgtcgatcccagcaacgttgtttgtctggtacttttggcagaagaagaaacaacgaagcggtgtgctctgggatacaccaagcccaccggaggttgagcgagctgtcttagatgatggcatatatcggatactacaaaggggcctactaggtcgatcccaagtgggcgtgggagtattccaggacggggtattccacacaatgtggcatgtgacgcgcggcgcagtattaatgtaccaaggcaaacgattagaaccatcatgggcctcagtaaagaaggatcttataagctatggtggtggatggagatttcaagggtcctggaacacaggagaagaagttcaagtaatcgcagtagaaccaggcaagaacccaaagaacgtccagacaactccaggcacatttaaaaccccggaaggtgaagtaggagcaatcgcgctagatttcaagcccggaacctctggatcaccaatagtaaatcgagaaggaaaaatagtaggattatatggaaatggtgtcgtcactacatcaggaacgtacgtctcagctatagcgcaggcaaaagcctcccaagaagggccactaccagaaattgaggatgaagtatttaagaaacgaaatttaacgatcatggatctgcaccctggcagcggaaaaacacgccgttacttgcctgcgatcgtgagagaggcgatcaaaagaaagctcagaacacttattcttgctccaacaagagtagtagccagtgaaatggctgaagccctaaaaggaatgcctattaggtaccaaaccacagctgtgaaaagtgagcacactggaaaggaaattgtagacttaatgtgtcatgcaacgtttacaatgagactactgtcgcctgtcagagtaccaaattacaatatgattattatggatgaggctcactttacagaccctgcgagcatagctgcgcgtggttacattagtacaagagtaggaatgggcgaagcagcggcaattttcatgaccgccactccaccaggaagcgtagaggctttcccacaatcgaatgccgttatacaagatgaggaacgtgatattccagaacggagttggaacagtggatatgactggattacagatttcccaggaaaaactgtctggtttgttccatcaataaagtccggtaacgacattgccaattgtctacggaaaaatggtaaaagagtgatccagttatcaagaaagacgtttgacacagagtaccaaaagactaaaaataatgattgggactatgtagtaacgactgacatctcagaaatgggggctaatttccgcgccgacagggtgatagatccccgccggtgcctcaaaccagtaatacttaaagacgggccggaaagagttatactagctggacccatgccagtcacagcagccagtgcagcacaaaggagaggtcgcatcggacgaaaccaaaacaaagagggggatcagtacatttatatggggcagccgttgaacaacgatgaagaccatgcacattggacagaagcgaaaatgcttctggataatataaatacgcccgaaggaattatccctgcattgtttgaacctgagagggaaaaatccgcagcaatagatggagaatatagacttcgaggggaagcaaggaaaactttcgtggaactcatgcggagaggcgatctcccagtatggctatcatataaagtcgcgagtgaaggattccagtatagtgatagaaggtggtgtttcgacggcgagagaaacaaccaggtactcgaagaaaatatggatgtagaaatatggactaaagaaggagagcgcaagaaactgagaccgcggtggctagacgctaggacctattcggacccattggcattaagggaatttaaagagttcgctgcgggacgacgcagcgtatctggtgacttaatactagaaataggtaagctcccacagcatctgacgttaagagcacaaaatgcattagacaacttggtaatgctacacaacagcgagcaaggaggtaaggcgtatagacatgcaatggaggagcttcctgatactatagaaaccttaatgttactggcacttattgcagttcttactggaggagtaaccctattctttctatcagggaaaggcctcggaaaaacaagtataggtttactttgcgtaatggcatcaagcgtgctgttatggatggctagcgtcgaaccacattggattgctgcctcgataatattggagttcttcttgatggtattgctcattccagaaccagacaggcaaagaactccacaagataatcagttggcatacgtagtgatagggctcctgttcatgatactaacagtagccgcgaatgaaatgggcttattggaaacaactaagaaagacttgggaataggtcacgtggtcgctgaaaatcaccaccatgccaccatgctagacatagatcttcatcccgcaagtgcatggacattgtatgcagttgctaccacgattataacacccatgatgaggcacaccatagaaaatacgactgcaaacatttcactaacagccattgccaatcaagctgccatattaatgggattggacaaaggatggccaatttccaaaatggatatcggagtaccactcttagctcttggttgctacagtcaggtaaatccacttactttgaccgccgccgtattaatgcttgttgctcattacgctatcattgggccagggttacaagccaaggcaaccagagaggctcaaaaacgcacagcagcgggaataatgaaaaatccgaccgtagacggtattgtggcaatagatttagacccagtagtatacgatgctaaattcgaaaaacagctaggtcaaattatgttactcatcctctgtacgagtcaaatactgttaatgagaaccacttgggcactgtgtgaatcgattactctagcgaccggaccacttaccacattgtgggaagggtcaccaggaaaattttggaatacgacgatagcagtttcaatggcaaatatattcagggggagttatttagctggagccggactagcgtttagtttaatgaagtcattgggagggggtcgacgtggaactggagctcaaggagagaccttaggcgaaaaatggaaacggcagctgaaccaactatcaaaaagcgaatttaacacttataagagaagtggaattatggaagtagacagatcagaagctaaagaaggacttaaacgaggagaaacaacaaaacatgcggtttcacgtggcacggccaaattaagatggtttgtagagcgtaacctcgtaaagccagaaggcaaagttatagatctaggctgcggacgaggaggatggagttattattgcgcgggtttaaagaaagtaacagaagtcaaaggatacacaaaaggcggccctggtcatgaagaaccaataccaatggcaacatatggatggaacatagttaaactccactcaggaagagacgtcttcttcaccccaccagaaaaatgtgatactctattatgcgacataggagaatctagcccaaaccccacgatcgaagagggcagaacactgagagtgctaaaaatggtggaaccatggctaagaggtaaccaattctgtataaaaattctcaacccttacatgccatctgtcgtagaaactttggaacaaatgcaaagaaaacacggaggaatgttggttagaaacccgctttctagaaactctactcacgaaatgtattgggtcagttgtgggactgggaacatagtcagcgcagttaacatgacaagtagaatgctattaaacagattcactatggctcataggaagccaacatatgaaagagacgtagacttaggagccggaactaggcatgtggcagttgaacccgaaatagcaaatcttgacataatcggacaaagaatcgagaacatcaaaaacgaacacaagagtacatggcattatgatgaagataatccctataaaacctgggcatatcatggatcatatgaagtaaaaccaagcgggtcggcatcgtcgatggtaaacggtgtagtacgccttttgacaaaaccatgggatgtaattcctatggttacgcagatagccatgactgatactacaccattcggccaacaaagggtatttaaagaaaaggttgacactcgaaccccgagacccaagcgtggtacggcgcaaataatggaagtaactgctaagtggttgtggggtttcttatcacgtaacaagaaacccagaatatgtactagggaagaatttaccaggaaagtgcgctccaatgcagctataggggcggtatttgttgacgagaatcaatggaacagtgctaaagaggctgtagaagacgagagattttgggacttagtacacagggaacgcgagttacataaacaaggaaagtgtgcgacttgtgtatataatatgatgggtaaacgagagaagaaactaggagaatttggaaaggctaagggatccagagccatatggtatatgtggcttggagcaagatttctggaatttgaagcccttggctttatgaacgaggatcattggttttcgagggaaaatagcctatccggggtcgaaggtgaaggtcttcataaactgggctacattctacgtgatattagtaagataccaggcgggaatatgtacgctgacgacacagcaggctgggacacacgtatcaccgaagacgacctacaaaatgaagctaaaataactgatatcatggagccggaacacgcattattagcaacgtcaattttcaaattgacttaccaaaataaggtcgtcagagtgcagagaccagcaaagagcggaactgtcatggatgtcatctcacgcagagaccaaagagggagtggtcaagtcggaacgtacggcctaaacacatttacaaacatggaagtgcaattaatcagacaaatggaatcagaagggatcttttcaccgtcagaacttgaaaattcaaatttggccgaacgtgttcttgactggctcgaaaaacacggtgtcgaaaggcttaaacgtatggcaataagcggagacgattgtgtggtaaaacccactgacgatcgattcgctactgcgttaatagccctaaacgatatgggaaaagttagaaaagatataccacaatgggagccgtcaaagggatggaatgactggcaacaagtccccttttgcagccatcatttccatcaactcataatgaaagatggacgcgaaatagtagtaccttgtcgcaatcaagacgaattagttggtcgagctcgagtgtcacagggtgcaggttggagtctacgagagacagcatgcctaggaaaatcatatgcgcaaatgtggcaacttatgtatttccatcggagagatttacgcttagcggcaaatgctatatgtagtgcggtaccagtcaattgggtgccaacatcacgaactacttggtcaatacatgctcaccatcaatggatgactacggaggatatgttatctgtatggaacagggtttggatagaagaaaatccatggatggaagacaagacacacgtatcttcctgggaagacgttccgtacctcgggaaacgcgaagatcaatggtgtggttcattaataggtcttacagccagagcaacatgggcaacaaatatacaggtagcgataaaccaagtaagacgtctaattggcaacgaaaactacctggattacatgacatcaatgaaaagatttaagaatgaatctgatcctgaaggagcattgtggtag

SEQ ID NO: 22098 - RNA, 9879 nt, synthetic construct
  misc_feature 1..9879: note = derived and/or modified CDS sequence (opt6) from DENV-1__KM403588__SS-prME
  source 1..9879: mol_type = other RNA
tcagtaacaatgcttctgatgttattacctaccgcgttggcattccacttaactaccagaggcggggaacctcatatgatagtaagtaaacaagaacgggggaaaagtttactgtttaaaacaagcgcgggagtaaacatgtgtacgttaattgcgatggacttgggtgaattatgtgaagatacaatgacatacaaatgcccacgtataacagaagcagaaccagatgatgttgactgctggtgtaatgctacggatacatgggtcacgtacggaacttgctctcaaacaggtgaacatcgtagggataaaaggtctgtcgctctagcaccccatgtcggcctaggcttggaaacgcgcactgaaacgtggatgagttcagaaggcgcatggcgacaaatacagaaagtggaaacgtgggcactaagacatccaggatttaccgtaatagcattatttcttgcgcatgcgataggcacatcaataacacaaaaaggcattatatttatcctgcttatgctagtgacaccatcaatggcaatgcgatgcgtcggtattgggaaccgtgacttcgttgaaggtttatcaggggcaacctgggttgacgtggtgttagaacacggtagttgtgtaacaactatggcgaaaaataaaccaacgcttgatattgaacttttaaaaacagaagtgacaaaccccgcagtactacgaaaattgtgcattgaggcgaaaataagtaatacaactacggatagcagatgccctacgcagggagaagccacattagtcgaagaacaagatgccaattttgtatgcagacggacatttgttgatcgagggtggggcaacggttgtggtctgttcggcaaaggatccctattaacctgcgctaaatttaaatgcgtgacaaaactagaaggcaaaatagtgcaatacgaaaatctaaaatatagtgtaatagtaacagtccacactggtgaccaacatcaggttggtaatgaaacgacagaacatggaacgatagccacaattacaccccaagcgcctacctcagagattcaacttaccgattacggagcccttacattagattgcagccccagaaccggtttggatttcaatgaaatggtattattgacaatgaaagagaaaagctggctagtacataaacaatggtttttagatttgccactcccttggacctcaggagccagtacctcccaggagacgtggaacagacaagacctattagtaacatttaaaacagcgcacgccaagaaacaagaagttgtggtcttgggctcacaagaaggtgctatgcatactgcattaacgggagcgacggagatacaaaccagcggaactacaacaattttcgcgggtcatttgaaatgcagactcaaaatgggaaaactgactttaaaaggggtaagttacgtgatgtgcacaggttcgtttaaactggaaaaagaagttgccgagacccaacacggtactgttcttgtacaagtaaaatacgaagggacggatgcaccttgcaaaatacctattagcacacaagatgagaaaggggtcacgcaaaacggaagattgatcactgcgaaccccattgtcacggataaagagaaacctgttaatatagaaacagaaccacccttcggagaatcatatatagtaattggcgcaggagaaaaagcacttaaactttcatggtttaagaaaggaagtagcataggaaaaatgttcgaagcaacggccagaggtgctcgccggatggccatactcggagatatcgcatgggattttgggtcaattggcggtgtgtttacaagcgtgggcaaattggtacatcaagtatttggaacagcgtacggagtgttattctcaggggtcagttggaccatgaaaatcggcatcgggatattactgacgtggttaggactaaacagccgatctacgagcctctctatgacttgtattgcagtagggatggtgacgttatacttaggagtaatggttcaagccgactctgggtgtgttataaactggaaaggtagagagctaaaatgtgggtctggcatattcgttaccaatgaagtgcatacatggacagaacaatataaatttcaggcagactcaccaaagagattaagcgcagctattggtaaggcgtgggaagagggcgtctgtggaatccgctcggccactcgcttagaaaatattatgtggaaacagatatctaatgaactgaatcatatattactagagaacgatatgaaatttacagtagttgtcggagacgctaatggaatattaacacaaggaaagaaaatgatacgtccacaaccgatggagcataaatattcgtggaaatcttggggaaaagcaaaaatcataggtgctgacacacaaaatactacttttattatcgacggacctgatacgccagaatgccctgatgatcaacgagcatggaatatttgggaagttgaagactacggatttggtgtttttacaacaaatatctggctaaaactccgcgacagttacacacagatgtgtgatcatcgattgatgtctgcggcgatacgagacagtaaggctgttcacgcggacatgggttactggatagaaagcgagaaaaatgaaacttggaaattagcacgggcctcctttatagaggttaagacatgtatttggccccgatcacacacactatggagcaatggtgtattagaaagcgaaatgatcatacctaaaatttacggtggccctatctctcaacataactatagaccaggttacttcacacaaacagctgggccatggcatttgggcaaattagagttagatttcaatttgtgtgagggcacgacagtagtcgtagacgaacactgcggtaatagaggtccttcactaagaactacgactgtaactggaaagattatacacgaatggtgttgcagatcctgtacattgcctcctttaagatttcgtggagaagatggttgttggtacggaatggaaatacgtccagtaaaagagaaggaagaaaacttggtcagatccatggttagtgcgggaagtggagaagtcgattcattttccttgggtttattgtgtgtaagcatcatgatcgaagaagttatgagaagtcgatggagcaggaaaatgttgatgacgggtacactagcagtattcttccttctaataatgggacaattaacatggaatgacttgatcagactgtgtatcatggtaggcgcaaacgtaagtgacagaatgggtatgggcactacatatctggccctcatggccacttttaaaatgaggccgatgtttgcggtcgggttattattcagacgattaacaagccgtgaagttttactattaacgattggattaagtctagtagctagcgtagaattacctaacagtctagaggaattaggcgacggactcgcaatgggcatcatgatgttaaagctcctgactgattttcaaagccatcagttatggacgacattactaagtctaacatttataaagacgactctatctttggattatgcttggaagacaatggcaatggtactaagcatagtcagcttatttcccctttgtctctcaacaacgtcacagaaaacaacctggttacccgttttactaggatccttcggttgtaaacccttaaccatgtttctcataacagaaaataaaatttgggggcgcaaatcctggcccctaaatgaagggatcatggcggttggaatagtaagcatcctgttatcatctctgctaaagaatgacgtaccactagcaggtccactaatagccggaggaatgttaatagcatgctacgtaataagtggtagttcagcagacctgagcttagaaagagcagctgaggtcagttgggaagaagaggccgaacacagcggcgcttcgcacaacattttagttgaggtgcaggatgacggcacaatgaaaataaaggacgaagagagagatgatactttaaccatcctactaaaagcgactctactagcagtaagcggagtatacccgatgtcaattccagctacactttttgtatggtatttttggcagaagaagaaacaaagaagcggagtgctgtgggacacaccctcacctccagaagtagaaagagctgtattagacgatggtatataccgcattctacaaagaggtctacttgggaggtcacaagtgggcgtgggcgtctttcaagatggcgtctttcatactatgtggcacgtgacaagaggggccgtacttatgtatcagggaaaaagactggaaccgagctgggcgagtgttaagaaagacctcataagttatggcggaggatggagattccagggtagttggaataccggggaagaagttcaagttatcgcggttgaacccggcaagaatcccaaaaatgtacaaaccactcctggcacctttaaaacacccgaaggagaggttggtgcaatagcattagactttaaaccgggaacaagtggctcccccatcgtgaatcgagaggggaaaattgtaggtttatatggtaacggagtcgttaccacttcgggcacttacgtctctgcaatcgcccaagcaaaggcttcccaagaaggtcctcttcccgaaatagaagatgaagtatttaagaaaaggaacttaacgatcatggacctccatccaggatcaggcaaaacccggcgttatcttcctgcaattgttagggaagccattaaaagaaagttgagaactctaatattagcacctacccgcgtcgtagcaagcgaaatggcagaggcacttaagggaatgcccatacgttatcaaacaacagctgtgaagagtgaacacacaggaaaagaaatagtagacttaatgtgtcatgcgacatttacgatgaggttattgagtcctgtacgagttcccaactacaacatgataatcatggacgaagctcatttcaccgacccagcatccatcgccgcaagaggttacattagtaccagagtaggaatgggcgaagctgcggccatatttatgacagctacaccgcctggctcggtagaggctttcccacaaagtaatgccgttatccaagacgaagaaagagatatcccagaaaggtcatggaacagtggatatgactggattactgactttcccgggaaaacagtctggtttgttcccagtataaagtcaggcaatgatatagcaaattgcctgaggaaaaacggaaagagagtgattcaactctccaggaaaacatttgatacagaatatcaaaagactaaaaataacgattgggactatgttgtaactaccgacattagtgaaatgggggcaaattttcgggccgatcgcgtaatcgaccccagaagatgtctaaaaccagttattctaaaagacggtcctgaaagggtaatccttgccggacccatgcccgtagccgctgctagtgcagcccagcgtagaggtagaatcggacgaaaccaaaataaagaaggggaccaatacatatacatggggcagccacttaacaatgatgaagatcatgcgcattggacagaagcaaagatgttgctagacaacataaatacgccagaaggtatcatccctgcactgttcgagccggaacgcgagaaaagtgcggcaatcgacggagaatatcgccttcgcggtgaggctcgtaaaactttcgttgaattaatgcggagaggtgatctgccagtatggctcagttacaaagtggcgtcagagggcttccaatacagtgatagaaggtggtgttttgacggcgagagaaataatcaagtgctcgaagaaaatatggatgttgaaatatggacgaaagaaggcgaaaggaagaaattgcggccacgttggttggatgcacgcacatacagcgatcccctggctctaagggaatttaaagagttcgccgccggaagaagatctgtttccggtgatttaattttagaaattggaaaactaccccaacatctaacactccgcgcgcaaaatgcactagataatttagttatgcttcataattctgaacagggcggaaaagcatatcggcacgcaatggaggagttaccagacacaatcgaaactttgatgttattagcactaattgccgtcttaactggcggcgtaacactattcttcttaagtggtaaaggtttaggaaagacatcgattggactgctatgtgttatggcatctagtgttcttttatggatggcaagtgttgaacctcattggatagcggcaagcataattcttgagtttttccttatggttttattgataccagaacccgatagacaaagaacgcctcaagataatcaattggcttatgtcgtaataggcctgcttttcatgattctaactgtagcagcgaacgaaatggggttattggagactactaagaaagatttaggtataggccacgttgtagcagagaatcatcatcatgctaccatgctagatatagatttacacccagcaagtgcttggacactctatgcggtagctactaccataatcactccaatgatgagacataccattgaaaatactacggcaaacatcagcctaactgctatcgcaaaccaagctgccatactcatggggcttgataaaggctggccaatatccaaaatggacataggagtccccttgttagcactcggatgctacagtcaagtcaatcctcttaccttaacagcggcagtacttatgttagttgcccactacgctattataggtccgggactgcaagcaaaagccacacgagaagcacagaaaaggacagcagccggcataatgaaaaatccgacagtggatggaatagtagctatagatttagatccagtagtttatgatgcaaagttcgaaaagcagctcgggcagataatgctattaattttgtgtacttcacagatactgctaatgcgcactacctgggcactgtgcgaatcaataacattggccacaggtccattaacaacattatgggaaggcagtcctggtaaattctggaatactacaattgccgtatctatggcaaacatatttcggggcagttacctcgccggtgcaggattggcgttcagcttaatgaagtcgctcggtggaggacgtaggggcactggagcccaaggagaaacactaggagaaaaatggaaacgccaactaaaccaactgagcaaaagtgagtttaacacctataagcgcagtgggatcatggaagtagatagatctgaggctaaagaaggtttaaagagaggagaaactactaagcacgcagtgtcaagaggaacagctaaattacgatggtttgttgaaagaaatctagtcaaaccggagggtaaggtaatcgacctcggatgtggacgaggaggttggtcgtattactgtgccggcctcaagaaagttactgaagtaaaaggctacacgaaagggggcccaggccacgaagaacccatacccatggccacctatggatggaacattgtgaaattgcactcaggaagagatgttttctttaccccaccagaaaagtgtgatacacttctgtgcgatattggtgaatcttcgccgaatcctacaatcgaagagggacgaaccctacgagttttaaaaatggtagaaccatggttacgcggaaatcaattttgtatcaaaattttaaacccttatatgccatccgtcgtagagactctagaacaaatgcaaaggaaacatggagggatgttagtaagaaatccgctatctaggaacagtacccatgaaatgtattgggttagttgcggtacaggtaatatagtatcagcagttaatatgacatcaagaatgttattaaatcgttttaccatggcgcatcggaaaccaacttacgagagggacgtggacctcggagccggtactcgtcatgtcgctgttgaaccagaaatcgcaaacctagatattattggtcaaaggatcgagaatattaaaaatgagcataaatcgacttggcactatgacgaagacaatccgtataagacgtgggcttatcatggaagctatgaagtgaaacctagtggatcggcttcatccatggttaatggtgtggtgaggcttctcactaaaccctgggatgtcataccaatggttactcaaattgcaatgacagacacaaccccatttgggcagcaacgtgtttttaaagaaaaggtggatacacgtacaccgaggcccaaaagaggtacggcccaaatcatggaggtaacagctaaatggctttgggggtttctttcacgcaacaagaaacctcgaatatgcacaagagaagagttcacacgaaaagtccgaagtaatgcagctatcggcgcagtcttcgtagatgaaaaccagtggaacagtgccaaagaagcggtagaagatgaacgattctgggatctggtacatagggaacgtgagttacataaacaaggaaaatgtgcaacatgtgtatataatatgatgggcaaacgtgagaagaaactaggagagttcggaaaagctaaaggaagcagagcaatctggtatatgtggcttggagcgagattcttagagttcgaggcgctaggctttatgaacgaagatcattggtttagtcgagagaacagtttatcgggagtagaaggtgagggacttcacaaattagggtatattttgagggacatttcaaaaatcccaggcggtaacatgtacgcagatgacacagctggatgggatactagaataacagaagatgatttacaaaacgaggcgaaaataacagatataatggaaccggagcacgcattattagcgacaagcattttcaaacttacatatcagaataaagtagtcagagtacaaagaccagcaaaatcaggtacagtaatggatgtaatctcacgtagagaccaacgaggaagtggacaagttggaacgtacggtttaaacacatttacaaacatggaagttcaacttataagacaaatggaatctgaaggcatatttagcccttctgaattagaaaactcgaatttggcggaaagagtattagattggttagagaagcatggtgtggaacgtcttaagaggatggctatatcgggtgacgattgtgtcgttaagccaacagatgatagatttgctacggcactaacagcgttaaatgatatgggcaaagtgcgaaaagacatcccacagtgggagccaagtaagggatggaacgactggcaacaagtaccattctgtagtcatcactttcaccaactcatcatgaaggatggacgggaaatagtggtaccgtgtcgtaatcaggacgagctagtaggtagagctagagtttctcagggggcgggatggagtcttagagagacggcatgcctaggtaagtcttacgcacagatgtggcaacttatgtattttcataggcgcgatctcaggctagcagcaaatgcgatatgttctgcagttccggtgaattgggttcccacaagtaggacaacctggtctatacatgcccatcatcaatggatgacaactgaagatatgttatctgtgtggaatagagtttggattgaagagaatccctggatggaagataaaacccatgtttcatcatgggaggatgtaccttatttagggaaacgagaagatcaatggtgtggatcacttataggacttaccgcacgagcaacatgggcaactaatattcaagttgcaataaaccaagtcagaagacttataggaaacgaaaattatttagactatatgacctcaatgaaaagatttaaaaacgagtctgatccagaaggggccttatggtag

SEQ ID NO: 22099 - RNA, 9879 nt, synthetic construct
  misc_feature 1..9879: note = derived and/or modified CDS sequence (opt6) from DENV-1__KM403605__SS-prME
  source 1..9879: mol_type = other RNA
tcagtaactatgttactaatgttattaccaacagcactagcgtttcacctaacaacaagaggtggcgaaccccatatgattgtatcaaaacaagaacgtggcaaatctttattatttaaaacgagtgcaggcgtaaatatgtgtacattaatagcaatggatcttggagaattgtgtgaagacactatgacgtataaatgtcctagaataaccgaagcagaacccgatgatgtggattgttggtgtaacgctacggatacctgggtaacttatggaacatgctctcagacgggcgaacatagacgcgataaaagaagtgtcgcgctagcaccacacgttggtttaggcttggaaacacgaactgaaacatggatgagttcggaaggcgcttggcgacaaatacaaaaagtagaaacatgggctctaagacaccctggtttcactgtaatagcattattcctggctcacgcaataggaacctcgataacccaaaaaggaataatattcatcttattaatgctggtaacgccaagcatggcgatgcgatgcgtaggaattggtaaccgagacttcgtcgaaggcctcagtggtgcaacatgggtagacgtcgtactagaacacggttcctgtgtgacaacaatggctaaaaataaaccgaccttagatattgaattactaaaaactgaagtaacaaatccggcagtgctgaggaaactctgtatagaagccaaaatttcgaatacaaccacagacagcagatgccctacacaaggggaagccacccttgtcgaagaacaagacgcaaattttgtatgccgacgaacattcgttgatcgtggttggggtaacggatgtggattatttggtaaaggttcactacttacttgcgcgaaatttaagtgtgttactaaacttgaaggtaagatagttcaatatgaaaatctcaaatattccgtaatagtcactgtacatactggagaccaacaccaagtcggtaatgaaaccacagaacatggaacaatagccacgattactccacaggctccaacaagcgaaattcaactaacagattatggtgcattaacattggattgttcgccacgaacaggactagattttaatgaaatggtattgctaactatgaaagagaaaagctggttagttcacaagcagtggttcttagacctccctctcccctggacaagtggagccagtacgtcacaagagacatggaatagacaagatttgcttgtcacgtttaagaccgctcatgcaaagaaacaagaggtcgtggtgctgggttctcaggaaggagcgatgcatacagcattaacaggagcaacagaaatacaaacatcagggacaaccactatttttgcggggcaccttaaatgtcgactaaaaatggataaactgaccttaaaaggagtttcctatgttatgtgtactgggtcctttaaactcgaaaaagaagtcgcagaaactcaacacggcacagtattagttcaagtaaaatacgaaggaacggatgcaccatgcaaaattcctatatctattcaagacgaaaaaggagtaactcaaaatggacgactaatcacagccaatccaattgttaccgataaagaaaagccagttaatatcgaaacagaaccaccatttggggagtcctacattgtaataggagcaggagaaaaagcactcaaactttcatggttcaagaaaggaagtagtattggcaaaatgtttgaagcgactgcacgtggtgcaagacggatggcaatattgggagatactgcctgggactttgggtcaataggcggcgtgtttacatccgttggtaagttggtacatcaggtctttggaaccgcttatggagtgctcttttctggcgttagctggaccatgaaaataggtataggaatcttattaacgtggctcggactaaattctcgatcaactagcttatcaatgacgtgtatagcggtaggaatggtgacattatatctaggggtaatggtccaagctgatagtggatgtgtgattaactggaaaggacgcgaattaaaatgtggatctggtatattcgttactaatgaagtccacacttggaccgaacaatataaattccaagcagattcgccaaaaaggttatcagccgccatcggtaaagcctgggaagaaggtgtatgtgggattcgttcagcaacccggctagaaaatataatgtggaaacaaattagcaatgaactgaaccatatactactggagaacgacatgaaatttaccgtagtcgttggagacgctaacgggattctaacacaagggaagaaaatgatccgtccacaaccaatggaacataaatactcatggaagagttggggaaaagcgaaaatcattggagccgacacccaaaacactacattcataattgatggcccagacacccctgaatgtcccgatgatcagcgcgcttggaacatatgggaagttgaagattatggattcggagtatttaccactaatatctggctaaaattgagggattcatatacgcagatgtgtgatcatagacttatgagtgcagctataaaagacagtaaggctgtacatgctgacatgggctattggatagaatcggagaaaaatgaaacttggaaattagcacgtgcttcgttcattgaggttaaaacctgtatatggcctaggagtcatacgctctggtcaaatggagtattggagtcggaaatgatcatcccaaaaatctatggcgggccaatcagtcagcataactatagaccgggatactttacgcaaacagccgggccttggcatcttggtaagttagaattagatttcaatctttgcgaaggtacaaccgtagtggttgacgaacattgtggaaacagaggtccttcactcagaacaacaacagttaccggaaaaataatccatgagtggtgttgccgttcgtgcacgctgcctccactaagattcaggggcgaagacggctgctggtacggcatggagataagaccagtaaaagagaaagaagaaaacttagtaaggtcaatggtctctgccggatcaggggaggtcgacagtttttccctaggtctcctttgcgttagtataatgatagaagaggtgatgaggtccagatggagtcgaaaaatgttaatgacagggacgctagccgtatttttcctcttaattatgggacagttaacatggaacgatctgataagattgtgcattatggtaggcgctaatgtgtcagatcgtatgggaatgggtactacatatctagcactaatggctacctttaaaatgcgaccgatgtttgcagtagggcttttatttagaagactaacatcacgggaagttctgttactaacgatcggactcagtttagtagcaagcgtcgaattgccaaactcattagaggaattgggggacggtttagcaatgggtataatgatgttaaaattgctaactgacttccaaagtcaccaattatggacgacgttactatcgctaactttcataaaaaccactttatcattagattacgcgtggaaaacgatggctatggttctcagtatagtatcactattccctctttgcctaagtactacaagtcagaaaaccacctggttaccagtattactgggttcatttggctgtaagcctttgactatgtttcttattactgaaaataaaatatggggaagaaaatcttggcccctgaatgaaggcataatggcggttggaatcgtatccatactactaagctcattactgaagaacgatgtaccgctcgcgggaccgcttatagcaggaggcatgctaattgcgtgttacgtaatctcagggtcatctgcggacctttcgttggagagggcggctgaagtaagttgggaagaagaagcagaacattccggagcctcacacaatattctagttgaagtccaagacgacggaacaatgaaaataaaggatgaggaaagggacgatacgttaaccatcttattaaaagcaacattgctagcagtaagcggtgtatacccgatgtcgattcccgcaacattatttgtctggtatttttggcagaagaagaaacagagatccggggttttatgggatacaccttcacctcccgaagttgagcgggctgtcctagacgatggtatatatagaatcctacaacgcgggttattgggaaggtcgcaagtaggcgtaggagttttccaggacggtgtttttcatacaatgtggcatgttacacgtggtgccgtactaatgtaccaaggaaaaaggttagaaccttcctgggcgtctgtcaagaaagatttaataagctacggtggagggtggagattccaaggatcctggaacacaggagaagaagtccaagtaattgcagtcgaacctggaaagaatccgaaaaacgtccaaacaacacctggtacatttaagaccccagaaggagaagttggagctattgcattagatttcaagcctggaacatcgggtagtccaatagtgaatcgtgaaggaaaaatagtaggcctttatgggaacggagttgttacaacaagtgggacttatgtgtcggcaatagcacaagcaaaggcttctcaagaaggacctttaccagaaatagaagatgaagtgtttaagaaaaggaatttaacaattatggatcttcatcctggttctgggaaaactcggaggtatctccccgcaattgttcgagaggccatcaaaaggaaattacgaactttgattctggcgccaacaagagtagtcgcgtctgaaatggcggaagccttaaaaggaatgcctataagataccaaaccacagctgtaaaatctgaacatacaggcaaggagattgtcgacctgatgtgccatgcaaccttcaccatgagattgctatcacccgtccgggtgccaaattacaatatgattataatggacgaggcacactttacagatccagcatcaattgctgcccgtggttacatttctacacgtgttggaatgggagaagcggcggctatctttatgactgccacaccacccggtagtgtagaggcatttccccaatccaatgctgttattcaagatgaagaacgggacatcccagaacgttcatggaactcaggctatgattggataacagattttccaggaaaaaccgtctggtttgttccctccataaaatcagggaacgacattgccaattgtcttaggaaaaatgggaagagggtgatccaactgagcagaaagacatttgacacagaatatcaaaagaccaaaaacaacgattgggactatgtagtgactactgacatctctgaaatgggagccaactttagggctgatagggtaattgacccgcgtcgatgtcttaaacccgtaatactaaaggacggtccagagcgagtaatccttgctggacccatgccagtaactgctgccagtgctgcacaaaggagggggcgcataggacgcaatcaaaacaaagagggagatcaatacatttatatgggacaaccactaaataatgatgaagaccacgcacactggacagaagcaaagatgctattagacaatattaatacccccgaaggtatcattccagctttatttgagccagaaagagagaaatcagctgccatagatggcgaatatcgacttagaggggaagcgcgaaaaacgtttgtagaattaatgagacgaggtgatttgccggtctggcttagctacaaagttgcttcagagggtttccaatacagtgatcgacgttggtgctttgatggcgaaaggaacaaccaagtattagaggagaacatggacgtggaaatttggacgaaagaaggagagcgaaagaaactgagacctcgttggctcgatgcacgtacttattctgacccattagcgctgagagagttcaaagagtttgcggcaggccggaggagtgtaagcggagatctaatacttgaaatcggcaaactgcctcagcaccttaccttacgagcacagaatgccttggataatcttgtgatgcttcataactcagaacaaggtggaaaggcttacagacacgctatggaagaactaccagatacaatagaaactctcatgttattagctttaatagcagtacttactggaggtgtgacactgtttttcctaagtggtaaagggcttggtaaaacatcaattggactactctgcgtaatggcatcatcggtcttactttggatggctagcgtagaaccgcattggattgcagcctcaattattctcgagttcttcttaatggttttgctaattccagaacccgacagacaaaggaccccacaagacaatcaacttgcatacgtcgtaattggattactttttatgatacttactgtagctgctaacgaaatgggactcctggagacaaccaagaaagatctagggataggacatgtagttgcggagaaccaccaccatgccacgatgttagacatagacttacaccctgcatcggcatggacactgtatgctgtggcgacaactataattacacctatgatgagacataccattgaaaatacaacagctaacatatcactgacagcaatagcgaatcaagctgctatattaatggggttagacaaaggatggccaatcagcaaaatggatattggcgtgcctttattggctttaggatgctatagtcaagtaaacccactaactttaactgcggcagtattaatgttggtggcccactatgccattataggacccggtttacaggccaaagctacccgagaagcacagaagagaaccgcagctggcataatgaaaaacccaacagtcgatggaatcgtagcgatagatttagatccagttgtatacgatgcaaaattcgaaaaacagttagggcaaataatgttattaatattgtgcaccagccaaatcttattaatgaggacaacatgggcattatgtgagtctataaccttggcaacaggtcctttaacgactctatgggaaggcagccctggcaaattttggaatacaactatagcggtatcaatggccaatatctttcgaggaagctacctagctggtgcgggtttagctttttccttgatgaaaactttagggggaggacgacggggcactggagctcaaggtgaaactttaggagaaaagtggaaaagacaactaaatcaattaagtaaatcagaatttaacacatacaaaagatcgggaatcatggaagtcgaccgtagcgaagctaaagagggattgaagcgaggtgaaaccactaagcatgccgtcagcagaggaaccgcaaaactcagatggtttgtagaacgcaacctggtaaaaccagaaggcaaagtgattgatttaggatgtggccgcggaggatggagctattactgcgccggccttaagaaagttacagaagtcaagggatacacaaaagggggaccaggccacgaagaaccaataccaatggctacctacggatggaacatcgtcaagttacattccggcagagatgtgttctttactcctccagaaaaatgtgataccctcctttgcgatattggcgaaagctcacccaacccaactattgaagaaggccgcactctacgtgtattaaaaatggttgaaccttggctgcgcggaaatcaattctgtataaaaatcctaaatccttatatgccatcagtggttgaaactttggaacaaatgcagcgaaaacacggagggatgttagtgcggaaccccttatcacgtaattccacacacgaaatgtattgggtgtcctgtggaaccgggaacatagtaagcgctgtaaatatgaccagtagaatgttacttaacaggtttacaatggcacatcgaaaaccaacctatgaacgcgatgtagacttaggagctgggacccggcacgttgccgtagaaccagaaattgcgaacctcgacataattgggcaacgcatcgaaaatatcaaaaatgagcacaaaagcacctggcattacgacgaggataatccgtacaaaacatgggcgtatcatggctcatacgaagtaaaaccaagtggatcagcatcttccatggttaatggagttgtaaggctcttaaccaaaccttgggatgtgatacccatggttacacaaatcgctatgactgacacaacgccttttggacagcaacgagtgtttaaggaaaaagtagataccaggacaccaagacctaaaagaggaactgctcagattatggaagtaacggcaaaatggttgtggggctttctttcacgaaataaaaagccacgtatctgtacacgagaagagttcactcgcaaggtacgttcgaatgcagccataggcgcagtttttgtagatgagaaccaatggaactctgcaaaagaagcggttgaagacgaaagattttgggatcttgtccatagagaacgagaattacacaaacaaggcaaatgtgccacgtgcgtttataatatgatgggaaaaagagagaagaaattaggtgaatttggaaaagcaaaaggaagtagagcgatatggtatatgtggttgggcgcaagattcttagaatttgaagcattaggattcatgaacgaagaccactggttttcgagagagaactcccttagcggagtagaaggtgaagggttacacaaacttggctatattctacgcgacatatccaaaatacctggaggtaacatgtacgccgacgacactgctggatgggatactaggatcacggaggatgacttgcagaacgaagccaagataaccgacataatggagccggaacacgcactactagcgacaagcatattcaaattaacttatcagaataaagtagtcagagtacagcgcccagcgaaatcaggaacagttatggatgtgatatctcgaagggaccaacgtggaagtggacaagtaggaacctacggattgaatacttttacaaacatggaggttcagcttataagacaaatggaatcggaagggatattcagcccatcagaattagaaaacagtaacctggcagaaagagtacttgactggctagaaaaacacggggtggaacgtttaaaaagaatggcaatcagtggagatgactgcgaagtaaaaccaacagatgatcgtttcgctactgccctcacagcactaaatgacatgggaaaagtacggaaagatataccacaatgggagccaagtaaaggatggaacgactggcagcaagtaccattttgtagccaccatttccaccaactaataatgaaagacggcagagaaattgtagtaccctgtcggaatcaagacgagcttgtagggcgagcaagagtgtcacaaggagcaggatggagcctaagagaaactgcttgccttggtaaatcttacgctcaaatgtggcaattaatgtactttcacaggcgagacctacgtttagcagcgaatgccatatgttccgcagtcccggtaaactgggttccgacctctaggactacttggagcatccatgcacatcaccaatggatgactacagaagatatgttaagcgtctggaatagggtatggattgaagaaaatccctggatggaagataagacccacgtatccagttgggaagacgttccgtacctagggaaacgggaagatcagtggtgcggtagtttaattggtttgacagctagggccacgtgggccaccaatattcaggtcgccatcaaccaagttaggcgattgataggcaatgaaaattaccttgattatatgactagcatgaaaagatttaaaaatgaatcagacccagaaggagcactctggtaa

SEQ ID NO: 22100 - RNA, 9879 nt, synthetic construct
  misc_feature 1..9879: note = derived and/or modified CDS sequence (opt6) from DENV-1__KM403606__SS-prME
  source 1..9879: mol_type = other RNA
agtgtcactatgctactaatgctgttgcccacagctctagcctttcacctcaccactcgcggaggagaaccacacatgattgttagcaaacaagaaaggggaaaaagcctcttatttaaaacttcagccggtgtcaacatgtgcacacttatagcaatggatttgggtgaactttgcgaagacactatgacgtacaaatgcccaagaattacagaagctgaaccagatgacgtagactgttggtgcaatgctacagatacatgggtaacttacggaacttgtagccaaaccggggaacatagacgagacaaaaggtctgtagctttagcaccacatgttggattgggcctggaaacaagaactgaaacctggatgagttcagaaggagcatggagacaaatacaaaaagtagagacttgggctctgcgccacccgggctttacagtcatagctttatttttagcgcatgcaataggaacaagcatcacccaaaaaggtatcatatttatactactaatgctagtcactccatcaatggctatgagatgcgttgggataggcaatcgagattttgtcgaaggtcttagcggtgctacgtgggtcgatgtagtgttagaacacgggtcttgtgtgacgaccatggccaaaaacaaaccaacactagacattgaactacttaaaacggaggtcacaaatccagcagtgttgagaaaattatgtatagaggcaaaaatctcaaatactacgactgattcaaggtgtcctactcaaggagaagcaactttggtagaagaacaagatgcgaattttgtatgtcggagaacgttcgtcgaccgagggtgggggaatggttgtgggcttttcggtaaaggtagcctactcacatgcgccaaattcaaatgtgttacaaaattggaagggaaaattgttcagtatgaaaatctgaaatatagtgtcatagtaacggtgcacacaggtgatcaacatcaggtaggcaatgagactacagaacatggaactatcgctacaataacacctcaagcacccacacttgagatacaattaacggactatggagcattaacattggactgcagtcctagaacaggattggacttcaacgaaatggttctcctgacaatgaaagagaaaagttggttagtacataaacaatggtttctcgatttacctttaccatggacatccggagcttcaacatcacaagagacctggaatagacaagacctccttgtcacatttaaaacggcacatgcgaagaaacaagaagtggtggtacttggctctcaagaaggagcaatgcatactgctctgacgggagccactgaaatccaaacgtcaggtacaacaacgatcttcgcaggtcatttaaaatgcagacttaaaatggataaacttactcttaaaggagttagctatgttatgtgtacggggtcgttcaagctcgagaaggaggtcgcagaaacgcaacatggaacagtcttagtacaagtaaaatatgaaggtaccgatgctccctgtaaaatacctattagcacgcaggatgagaaaggagtaacacagaatggaagacttataaccgcaaatccaatcgtaacagacaaggaaaagcctgtaaatatcgaaacagagccaccatttggcgaatcctatatagttataggcgcgggggaaaaggcccttaagttaagttggtttaagaaaggatcttctattggaaagatgtttgaagcaacagcacgaggcgcacggagaatggcaatattgggagacactgcatgggattttgggtctataggtggtgttttcacaagtgttgggaaattagtgcatcaggtatttggaaccgcatatggagttttgttcagcggagttagttggacgatgaaaattggtataggaattttattgacttggctcggactgaatagtagatctacgagcctatccatgacgtgtatagccgttggaatggttacattgtatttaggagtaatggtacaagctgattccggttgtgttattaattggaaaggtcgagaactgaaatgtggaagcggcatctttgtaaccaatgaagtacatacgtggactgaacaatacaagttccaagcagactctcccaaacggttatcagccgcaattggcaaagcctgggaagaaggtgtgtgtgggattcgcagtgcaacccggcttgaaaatataatgtggaaacagatatcaaatgaacttaaccacatacttttggaaaatgatatgaaattcacggttgtggtaggggacgcgaatggcatcttaacacaagggaagaaaatgataagacctcaacccatggagcataagtatagctggaaaagttggggaaaagcaaaaattattggagcagacactcaaaatacaacatttattatcgacgggcctgatacaccagagtgtccggatgaccaacgcgcgtggaatatatgggaggtagaagattacggattcggagtgtttacaacaaacatctggttgaaactaagagactcctacacacaaatgtgtgatcatagattaatgagcgcagctataaaggactctaaagcagtacacgccgatatggggtattggattgaatcagagaaaaatgagacttggaaactggcccgtgcatcatttatagaggtaaaaacatgtatatggcctaggtcccacacactttggtcgaacggtgttcttgagtcagagatgatcataccgaaaatctatggcggccctatatcacaacataattatagaccaggttattttacacaaacagcaggaccatggcatttaggcaaacttgaactcgattttaatttgtgtgagggaacaaccgtagtagtggacgaacactgtggaaacaggggtccatcgttgcgtactacaacagttaccggtaagataatacatgagtggtgttgcagaagttgcactctacccccacttagattcagaggagaggatggatgttggtatgggatggagataaggccagtaaaggaaaaagaagaaaatctagtcagaagcatggttagcgcaggatctggagaggttgatagtttttcattaggattactatgtgttagcattatgatagaggaggtaatgagatcccgttggagtagaaaaatgttaatgacgggcacattagctgtattctttctcttaataatgggccaattgacttggaacgatttaatccgtctgtgtattatggtcggggcaaacgtttctgatagaatggggatgggaaccacctatttggccttgatggcaacattcaaaatgagacctatgtttgctgtaggccttctctttagacgtttaacatcaagagaagtcttacttctgacgataggtctatccttagttgctagtgtcgagttaccgaatagtctagaagaactcggtgatggattagctatgggcataatgatgttaaaactcttaacagactttcaaagtcatcaactttggacaactctactatctctcacattcataaagacaacacttagcttagattacgcatggaaaacaatggcaatggtcttatcaattgttagcctgttcccattatgtttgtccacaacatcacaaaagaccacatggttaccggttctactaggtagttttggatgtaaaccactaacgatgtttttgatcacagaaaataaaatatggggaaggaaatcatggccgcttaacgaaggtatcatggcggttggcattgtttcgatcttactctcaagtctattgaaaaatgacgtaccgttagcaggaccattaatcgcgggcggaatgttaatagcatgctacgtaatcagcggtagttccgcggacttatcactagaaagagcagcggaagtatcatgggaggaggaagccgagcactctggagccagtcacaacatacttgtcgaagtgcaagatgacggaacaatgaaaataaaagatgaagaacgcgacgacactctaacaatattgctaaaagcgactctccttgcagtaagcggtgtgtacccaatgagcattccggcgacgctctttgtgtggtatttttggcagaagaagaaacagcgaagcggggtactgtgggatacgccatctccacccgaggttgagcgcgctgtactagacgatggaatctatcgtatattacagcgagggttgctcgggagaagccaagtaggagtgggagtattccaagatggtgttttccatacaatgtggcacgttactcgcggagccgtattaatgtaccaaggaaagaggctggaaccctcctgggcatctgttaagaaagatttaatctcgtatggcggagggtggaggtttcagggttcatggaatacaggagaagaagttcaagttatcgctgtagaacccggtaaaaatccgaaaaatgtccaaacgacacccggaacttttaaaacccccgaaggtgaagtgggagcgatcgcgttagatttcaaaccgggcacgagcggaagccctatagtcaatagagaaggaaaaatagtaggcctgtacgggaatggagtggttacaacatccggaacatatgttagtgctatcgcacaagcaaaagcgagccaggagggccctttacctgaaatagaagacgaggtttttaagaaacgaaatttaacaattatggatttacatccaggtagtggaaaaacccggcgatacctgcctgccatcgtaagagaagcaataaaacgtaaactccgcactttaatattagcacccactagggtagtagcatcagaaatggcagaagcacttaaaggaatgcctatacgttatcagaccacagcagtaaagagtgaacatactggtaaagaaatagttgatcttatgtgtcatgccacttttaccatgagacttctctcaccagttagagtaccaaattataatatgattataatggatgaggcacacttcactgatcctgcctccatcgcggcgcgaggatatattagtactagagtgggaatgggagaagcagcagcaattttcatgacagcgacacctccaggcagtgtagaggcttttccacaatcaaacgcggtaatacaggatgaagaaagagacattcctgaacgctcatggaatagcggttatgactggataactgatttcccggggaagacggtatggttcgtaccaagtataaagagtggaaatgatatcgcaaattgcttgcgtaaaaatggtaaaagagtcatacaactttcccgcaagacatttgataccgagtatcagaaaaccaagaacaacgattgggattacgtagtgacaacagatattagcgaaatgggtgctaacttcagagcggaccgagttatcgaccctagaagatgtctgaaaccagttatattgaaagacggacctgaacgtgtaatcctggctggtcctatgcctgttacagccgcaagtgcagcccaacgacgcggaagaatcggaagaaaccagaataaagaaggggaccaatatatatatatgggtcagccacttaacaacgacgaagaccatgcccattggaccgaggctaaaatgttactagataacattaataccccagaagggattataccggccttatttgaaccagagagagagaaaagtgcggcgatcgatggtgagtatcgcttgcgaggcgaagcgcgtaaaacatttgtagaacttatgagacgcggtgatttaccagtgtggttaagctataaagttgccagtgaaggctttcagtacagtgataggcgttggtgttttgatggtgaaagaaacaaccaggttctcgaagagaatatggatgtagaaatttggaccaaagaaggtgaacgtaagaaactgcggcccagatggttggatgcaagaacatacagcgatccattagctctacgtgaatttaaagaatttgcggcaggaagacggtcagtgtcgggagacctaatactagaaataggtaaattaccgcagcacctcactctacgagctcaaaatgcactagataacttagtcatgctacataactcggaacaaggcggcaaagcgtataggcatgcgatggaagaactacccgatacaatagagaccttgatgttacttgcactcatagccgtattgacaggaggagttacgttgttctttctatctggaaaaggtttgggcaaaacaagcatagggcttctttgtgtgatggcaagtagtgtgttattatggatggcatccgtcgaaccccattggattgcagcttcgatcatacttgaatttttcttaatggtattacttataccagaacctgacagacaaagaactccacaagataaccaacttgcatacgttgtgatcgggctattatttatgattctcacagtcgcagccaacgaaatgggattacttgaaactactaagaaagatctaggcattggacatgtagtagcagaaaatcatcatcatgctactatgcttgatatagatcttcatccagcaagtgcttggactctctatgccgtagcaacaacaatcataacacccatgatgagacacaccatagaaaatactacagccaacatatcgctcacggcaatagcaaatcaagcagccatattaatggggttggataaaggatggccaatcagtaaaatggacatcggcgtaccgctacttgctcttgggtgttatagtcaggtaaatccactaacccttacagcggcagtacttatgttagtggcacactatgcaataatcggaccgggactccaggcaaaagctacgagggaagcccaaaagagaacagctgccggaattatgaaaaacccaactgtagatgggattgttgcaatagatttagatccggtagtatacgacgctaagttcgaaaaacaacttggtcagataatgttattaatactgtgtacatcacaaatcctattaatgagaacaacttgggctttgtgcgagtcaataacgttggctacaggaccacttaccacgctatgggaggggtctcctggcaaattttggaacactactatagctgtctcaatggctaatatattcaggggaagttacttagccggagcaggactcgctttttcacttatgaaaacgctcggaggcggaaggaggggtacgggagctcagggtgagacgctcggggaaaaatggaaaagacaacttaatcaactttcgaaatcagaatttaacacttataaaagaagtggaataatggaagtggaccgatcagaagcaaaggaggggttaaaacggggtgagaccacaaaacatgcggtgagcagaggtaccgcaaaattaagatggtttgttgaaagaaacctcgtcaagccagaagggaaggtcattgatcttgggtgtggtcggggtgggtggtcgtactattgcgctggactgaagaaagtaaccgaagtaaaaggctacactaaaggaggacctggtcatgaggaacctatacctatggctacatatggttggaatatagtcaaacttcattctggaagagatgtattctttacccctccagagaaatgcgatacactattatgcgacataggtgaatcttctccaaaccctacaatagaagaaggcagaacactacgtgtattgaagatggtagaaccatggttaagaggtaaccaattttgcataaagattctgaacccatatatgccgtctgtagttgaaacccttgagcagatgcaacgcaaacatgggggaatgttagtaagaaatccgttaagccgaaatagtacgcacgagatgtactgggtttcctgtggaacaggtaacattgtatctgcagtcaatatgaccagtagaatgttacttaatcgctttacaatggcccatagaaaaccaacctacgagcgtgacgtagatcttggtgccggcacccgacatgtcgcagtagaacctgaaatagcaaatctggacatcatcgggcaaaggattgaaaacataaagaatgaacataagtcaacatggcactatgatgaagacaacccatacaagacctgggcgtatcatgggagctatgaagtaaagccaagtggatcagcaagttcaatggtaaatggagtagtgcgcttactaactaagccgtgggacgttatcccaatggtaacgcaaatcgcaatgacagacactacgcctttcggacaacagcgggtatttaaagaaaaagtagatacgcggacacccagacctaagcgagggactgctcaaattatggaagtaacagcaaaatggctctgggggtttctttcaagaaataagaaaccacgaatatgcacgagggaagaatttacaagaaaagtgcgatcaaacgcagctataggagctgtgttcgtggacgaaaatcaatggaactcagctaaggaagcggtggaggacgaacgattctgggatctagttcacagagaacgtgaactacataaacaaggcaaatgcgcaacttgcgtctataacatgatggggaaacgtgagaagaaattgggagaatttggaaaggccaaaggctctagagctatatggtatatgtggctcggtgccaggtttttggaatttgaggcattgggttttatgaacgaagatcattggttttcaagggaaaatagtttgtcgggtgttgaaggagagggactacataaattaggatatattcttcgggacattagtaagatccctggaggtaatatgtatgcggatgacactgcgggctgggatacacgcattacagaagacgatctacaaaacgaagccaaaataacagatataatggaacctgaacacgcccttttagccacttcaatatttaaattaacatatcaaaacaaagtagtaagagttcaacgtccggcaaaatctggtaccgtaatggatgtcatcagtagaagggatcagagaggaagcgggcaggtagggacctatgggctaaatacattcacaaatatggaagtacaacttataagacaaatggaatccgaaggaatcttttccccatcagaactggaaaatagcaacctagctgaacgagtcttagattggctcgagaaacatggcgtagagcgactcaaaagaatggcaatttcaggggatgactgcgttgtaaaacccactgatgataggtttgcaactgcactcacagcattaaatgatatgggcaaagttaggaaagatataccacaatgggagccatccaaaggatggaatgattggcagcaggtaccattctgctctcaccatttccatcagttaatcatgaaagacgggagagaaatcgtcgttccgtgccgtaatcaagatgagctagttggtcgagctcgggtgtcacaaggtgcgggatggtcattaagggagaccgcatgcctggggaagtcatacgcgcaaatgtggcaattgatgtatttccatagaagagacctccgtctggctgctaacgcgatctgttcagcggtaccagttaactgggttcccacaagtagaactacatggagtatccacgcccatcaccaatggatgacaaccgaagacatgctgagcgtctggaatcgtgtgtggatagaggaaaacccctggatggaagacaagacgcacgtatcaagttgggaagacgtaccttatttaggtaaaagagaagaccaatggtgtggatcactgattggtttgacagctagagcaacctgggcgacaaacatccaagttgctataaatcaggtcaggaggctgattggtaatgaaaattacttggattatatgacatctatgaagagattcaaaaatgaatcagatcccgaaggagcactttggtga

SEQ ID NO: 22101 - RNA, 9879 nt, synthetic construct
  misc_feature 1..9879: note = derived and/or modified CDS sequence (opt6) from DENV-1__KM403591__SS-prME
  source 1..9879: mol_type = other RNA
agtgttaccatgttgctaatgttgctcccgactgcactggcttttcaccttactacccgtggaggcgaacctcacatgatagttagtaaacaagaaaggggtaaatcactcctgttcaaaacctcagccggtgtcaatatgtgcactttaatagcgatggatctgggtgaactgtgtgaggataccatgacatacaaatgtccccgtattacggaagcggaacccgacgatgttgattgttggtgcaatgcgacggatacgtgggtaacatatgggacctgctcacaaacaggagaacaccgtagagataaaaggtcggtagcactggcacctcacgtagggctaggattagaaacaaggactgaaacgtggatgagttcggaaggcgcctggaggcagattcaaaaagtagaaacttgggctttacgacatccaggtttcactgtaatagcgttgtttttagcgcatgctataggtacgagcataacacaaaaaggaattatatttattcttcttatgttggttacgccatcaatggcaatgagatgcgttggcattggcaatagagattttgtggagggtttatcaggcgcgacatgggttgatgttgtcttggaacatgggagctgtgtaacaacaatggccaaaaataagccgactttagatatagaactactcaagaccgaagttaccaatccagctgtactacggaagttatgtatcgaggcaaaaatatctaacacaaccacagactccagatgccctacccaaggagaagctactttagtagaagaacaagacgccaattttgtatgtcgtagaacatttgttgatagaggttggggcaatggttgtggtctatttgggaagggatcattacttacatgtgcaaaatttaagtgtgtgactaagttagaaggcaaaatagtacaatatgaaaacctgaaatactctgtaatagtgaccgtccacactggggaccaacaccaagtcgggaacgaaacaaccgagcatggtaccatagcaacaattactccacaagcgccgacaagtgagatacaactaaccgattacggggccttaacattagactgttccccaagaacaggtttagactttaatgagatggtgctgctgacgatgaaggagaaaagctggttagtacataaacaatggtttttagatcttccacttccctggacaagtggtgcatcaaccagccaagaaacatggaatagacaggatttactcgttacgtttaagacagcacatgctaagaagcaggaagtcgttgttttagggtcccaagagggagcaatgcatacagctcttacaggcgcaactgagatacaaacaagtggaacaacaactatatttgccggacacctaaaatgtagactaaaaatgggaaaactcacattaaagggagtctcgtatgttatgtgtaccggcagcttcaaactcgaaaaagaagttgcagagactcaacatggcacagtattagtgcaagttaaatatgaagggacggatgcaccatgcaaaataccgatttctacgcaagacgaaaaaggtgtaactcaaaatggtcggctgataacggcaaatcctatagtaacagacaaggaaaaacctgtaaatatcgaaacagaaccacccttcggagaatcatatattgtcataggagcaggggagaaggctttgaaactatcttggtttaagaagggatcgtcaattggaaaaatgtttgaggccacagctcgaggtgcacgacgaatggcaatacttggtgacaccgcatgggactttggatcgataggtggtgttttcacgagtgtcgggaagttagtacaccaagtttttgggacagcatatggagtattattctcaggagttagttggaccatgaaaataggtataggtatattattaacttggctcggtcttaattcgaggtcaacttcactatcaatgacatgcatcgcggttggtatggtaacattatacctaggagttatggtacaagctgactcaggttgcgttataaattggaaaggacgcgaactaaagtgcggtagcggaatatttgtaacaaatgaagtacacacatggactgagcaatacaaatttcaggctgatagcccgaaaagattatcagcagccatcggaaaagcgtgggaagaaggagtctgtggaattaggtccgctacaagactagagaacattatgtggaaacagatatcgaacgaattaaaccatatcttgttagaaaatgatatgaaatttactgtagtagtaggtgacgccaacggaatacttacgcagggtaagaaaatgataaggcctcaacctatggagcacaaatactcctggaaatcttggggaaaagcaaaaatcattggtgcagatacgcaaaatactacgttcataatagatggacccgacacaccagaatgtccagacgatcaaagagcctggaacatatgggaagtagaagattatggatttggagtatttacaacgaatatatggctaaaattgagagatagctatacacaaatgtgcgaccatcgtctcatgtcagctgcaataaaggactctaaagcagtacacgcggacatgggatattggattgagtcggaaaagaatgaaacttggaaactggctcgagcatctttcatagaagttaaaacttgcatttggcccagatcacatacattatggtccaacggtgtgctagagagcgagatgatcatacctaagatctatggaggaccaatttcccaacataactataggccgggatattttacccaaacagccggaccttggcatttagggaaattggaactagactttaacctttgtgaaggcactactgttgtagtagacgaacattgtgggaacagaggtcccagtttgcgaaccacaacagtcacgggcaagataatacacgagtggtgttgcagaagctgcacgttacccccactcaggtttcgaggagaagatggatgctggtatgggatggagattagacctgtgaaagagaaagaagaaaatttggtcagatcaatggtatcggcaggaagtggggaagtagattcattctcactcgggttattgtgtgtcagcataatgatagaggaggtaatgaggtcaaggtggagccgcaaaatgttaatgacgggaacattagccgtgttctttttgttgataatgggccaactcacgtggaacgatttaatacgactttgcattatggttggcgcaaacgtatcagaccggatgggaatgggaactacctatcttgccctaatggccacctttaaaatgcgacccatgttcgcagtgggattactctttagacgattaacaagtagagaagtattactactaaccataggtctatcgctagtggcctccgtggaactcccaaacagcctcgaagaactcggtgatggacttgcaatgggaattatgatgctaaaactattaactgatttccaaagtcaccaactatggaccaccttattaagtttaacatttataaaaacaacactatctctggactacgcctggaaaacgatggcgatggtgctgtcgatagtgagcctatttccgttatgcctaagtactacctcacagaaaacaacatggctccccgttttattaggtagttttggctgtaaacccttgacaatgtttctcataacggaaaacaaaatatggggacgaaagtcatggcccttgaacgagggtataatggcggtaggcatagtctcgatacttctgagctcattactcaaaaatgatgtaccgctagcagggcccttaatagcaggaggaatgttaatagcatgctacgtaatatcaggatctagtgcagatctttcgttagaacgggcagctgaagtaagctgggaggaagaagcagaacatagcggagcatctcataacatccttgtcgaagtacaggatgatggcacaatgaagataaaggacgaggaacgagatgacacgctgacgatccttttaaaagcaacattattagctgtgtcaggagtctatccgatgagtattccagcaactttattcgtgtggtacttctggcagaagaagaaacaaagatccggcgtcctctgggacaccccatcaccacctgaagtggaacgtgcagttttggacgatggaatatacagaatccttcaaaggggtttgttaggtaggagtcaagttggtgtcggggttttccaagacggggtctttcatacaatgtggcatgtaacgaggggagcagtactaatgtaccaaggaaaacgcctggaaccatcgtgggcaagcgttaagaaagacctcatttcatacggaggaggttggcgatttcaaggatcatggaatacaggtgaggaagtacaagttattgcagtagagcctggtaaaaatcctaagaacgtccaaactacccccggtacgtttaagactcccgaaggggaagttggtgcaatcgctttggacttcaagccaggaacatcgggctcacccattgtgaacagagaaggaaaaattgttggcttgtatggcaatggtgtagttacgaccagcggtacatatgtgagtgccatagcacaggcgaaagcatctcaagaaggtccactacccgaaattgaagatgaagtctttaagaagagaaacttaactatcatggatctacatccaggttctggcaaaactaaacggtatcttccagctatagttagggaagctataaaaaggaaattgaggacgttgatattggcaccaactcgcgttgtagcttcagaaatggccgaagcgcttaaaggtatgccaattagatatcaaacgaccgccgttaaatcagagcacacaggcaaggaaatagtcgatttgatgtgtcacgctacgttcacaatgagattgctatcccctgtaagggtaccaaactacaacatgattataatggatgaagcacactttaccgatcctgcatcaattgcggcgagaggttatatctctactcgagttggaatgggcgaagccgctgccatatttatgactgcaactcctcccggctcggttgaggcctttccacaatcaaatgcagttatccaagatgaagaacgtgacattcctgaaagatcatggaactccggatacgactggataacagatttccccgggaaaaccgtatggtttgtcccctcaattaagtcaggcaatgacattgcaaactgcctaagaaagaatggcaaaagagtcatccaattgagcagaaaaacattcgacacggagtatcagaaaacgaaaaacaatgactgggactatgtagttacaacagatattagtgaaatgggagctaattttcgagctgatagggtgatagatcctcgaagatgccttaaaccagttattttaaaggatggtccagaacgagtgatcctagctggacctatgcctgttacagccgcgtcggcggcacaaagacgtgggcgaattggacgaaaccagaataaagagggggatcaatatatatatatgggacaacccctcaacaatgatgaggatcacgctcactggaccgaagcaaaaatgttactcgataatattaacacgccagaaggaatcataccagccctttttgagccagagcgagaaaagtccgcagccatcgatggagaatatcgtttacgtggtgaagcccgcaaaacttttgtcgaactaatgcgcaggggcgatttacccgtatggctatcgtataaagttgctagtgaaggatttcagtactccgatagacgttggtgttttgacggagaacgaaataatcaagtcttagaagaaaacatggatgttgaaatatggactaaagagggggaacgaaagaaactcagaccccgatggttggacgctaggacttattccgatccactcgctctccgagaatttaaagagttcgcagctggtcgtaggagcgtaagtggcgatctgatccttgaaatcggaaaattaccacaacatctaacgttacgcgctcaaaatgcactggataacttagtgatgctccacaactcagaacaaggaggcaaagcctatcgccatgcgatggaggaactaccagatacaattgaaacgctaatgttgttagcattaattgccgtcttgactggcggagtcacattattcttcctctctggtaagggcctaggtaaaacaagtataggactactatgcgtaatggcatcgtcagtattgttatggatggctagtgtggaaccacattggattgcggcgagcattatactagagttctttttaatggtattgttgattccagaacctgatagacaaaggacaccacaagacaatcagctagcatatgtagtcataggactgcttttcatgatactaacagttgcagctaacgaaatggggcttttagaaacaactaagaaagacctaggcataggacatgttgtagccgagaatcaccatcatgctactatgttagatatagacttacatccagctagtgcctggacgttatatgctgtagcaacgacaattataactcccatgatgcgacacacgattgaaaacacaacagcaaatataagtttaaccgctatagccaatcaggcagcaatactgatgggactagataaaggttggcctatctccaaaatggatataggtgtgcctttattagcattaggatgttacagccaagtaaatcctctaactctaacagcggcagtgttgatgttggttgctcactatgctataatagggccgggactacaagccaaggcaacaagagaagcccagaaacggacagctgcaggaataatgaaaaatccaactgtagatggcatagttgccattgatctagatccagttgtctacgatgcgaaatttgagaaacaattgggtcaaataatgttgcttatactatgcacgagtcaaattttattaatgagaacaacttgggctttgtgtgaatcaattacgctagcaaccggcccattaacgacactatgggaagggagtccagggaaattttggaatacaaccatagcagtaagtatggcaaacatatttagaggatcctacctagcgggtgctgggttagcattttcactaatgaaatcgttaggcggcggtcgtagaggtactggcgcacaaggagagacactaggagaaaaatggaaacgacagctaaaccaactcagcaaaagcgaatttaatacatacaagagaagcggaattatggaggtagatcgtagtgaggccaaagaagggttaaaaagaggggaaactactaaacacgccgtaagcaggggtacagcgaagctacgctggtttgttgaaagaaatttagtgaaaccagaaggcaaggtgatagatctaggctgcgggagaggaggttggtcgtattactgcgctggactaaagaaagtgacagaagtaaaaggatacacaaaaggaggcccaggacacgaggaacctatacccatggcaacttatggatggaatatcgtaaaattgcatagcggacgagatgtatttttcactccacccgaaaaatgtgataccttattatgtgatataggagagtcttcccccaatccaacaatagaggaaggacgaaccctgagagtgctaaagatggtagaaccttggctgaggggaaaccaattttgtataaaaatactcaatccatacatgccaagtgtggttgaaaccctcgaacaaatgcaacgaaaacacggaggtatgctagtacgtaatccattgtcacgcaacagcacacatgaaatgtattgggtcagctgtggtacaggaaatatagtatctgctgtcaatatgacttccagaatgctcctcaatcgattcaccatggcccatagaaaaccaacgtatgaaagggacgtagatttaggtgcgggaacacggcatgttgccgtagagcctgagatagcaaacttagatatcataggccaaagaattgagaacatcaaaaacgaacacaaatcaacctggcactatgacgaagataacccatacaagacatgggcttatcatggttcgtatgaggttaagccgtcaggatcggcgagttcgatggtcaatggagttgtccggctattaactaaaccttgggatgttatcccgatggtaacacaaatcgcgatgacagacacaaccccatttggacaacaaagagtcttcaaggagaaggtggacacgagaacaccacggccgaaacgaggtaccgctcaaataatggaagtgactgcaaaatggttatgggggtttttgagtagaaataagaaaccacgcatatgtacccgagaagaatttaccagaaaagtacgatctaacgctgctataggcgcggtatttgtcgatgaaaatcaatggaatagtgcaaaagaggcggtggaagatgagagattctgggatttagtacatagggaaagagaattacataaacaaggcaaatgcgcaacatgtgtgtacaatatgatgggaaagcgtgaaaagaagctaggagaatttggtaaggcaaaagggtctagagcgatatggtacatgtggttgggtgcgcggtttttagaatttgaagcattagggttcatgaatgaggaccattggttctccagagaaaacagcctttctggcgtagagggtgaagggctacataaactaggatacatacttagagacatctcgaagattcctggaggaaatatgtatgcagacgataccgcgggatgggacactcgtataacagaagacgatttacaaaacgaagcaaaaataaccgatattatggaacctgagcatgcacttcttgctacaagtatctttaaattaacgtatcaaaataaagtcgtacgagtccaaagacctgccaagtcaggcacagtcatggacgtcatatctcgacgagatcagagagggagtggacaagttgggacatatggacttaacacattcaccaatatggaagttcaattaatacgacaaatggaaagtgaaggaatattttctccaagtgaactcgaaaatagtaacttagcagaacgagttttagattggttggagaaacacggagttgagcgactaaagagaatggctatatcaggtgatgattgtgtagtgaagccaactgacgacagattcgccacagcacttacggcacttaatgatatgggaaaagtgcgcaaagatataccccaatgggaacctagtaagggatggaacgattggcagcaagtgccattctgtagccatcatttccatcaattaatcatgaaagatggccgtgagattgtcgttccgtgccgcaatcaagacgaactcgttggaagggcgcgagtatcacaaggcgcaggatggagccttagagaaacagcatgcttagggaaaagttacgcacaaatgtggcaattaatgtacttccatagaagggatctacgcttagcagcaaacgcaatctgctccgctgtaccagtgaactgggttcccacaagccgcacgacatggagtatacatgcacatcatcaatggatgacaaccgaggatatgctctcagtatggaatagagtatggattgaagaaaatccatggatggaagataagacacatgtaagttcatgggaagatgtgccctacctaggaaagcgtgaagaccaatggtgtggatctttgattgggttaactgcgagagcaacctgggcaactaacattcaagtggccataaatcaagtaagaagattaattggcaacgaaaactatctagactacatgacgagcatgaaaagattcaaaaacgaaagcgacccagaaggcgcactctggtga

SEQ ID NO: 22102 - RNA, 9879 nt, synthetic construct
  misc_feature 1..9879: note = derived and/or modified CDS sequence (opt6) from DENV-1__KM403607__SS-prME
  source 1..9879: mol_type = other RNA
tcggtcacgatgcttttaatgttgttacccaccgctttagccttccacttaacgactagaggtggtgaaccccatatgatcgttagtaaacaagagagaggaaaaagccttttattcaaaacatcggcaggagtcaatatgtgtactttaatcgctatggatttgggagagttatgcgaggacacaatgacatataaatgcccacgcatcaccgaagctgaacctgatgatgttgactgttggtgcaatgcaactgatacatgggttacatacggtacctgtagtcaaaccggggagcaccgaagagacaaacgatcagtcgctcttgcaccacatgtgggtctaggactggagactcgcaccgaaacctggatgagttctgagggcgcgtggagacaaatccaaaaagtagagacctgggcattacgccacccaggattcacagttattgctctatttctggcgcacgccattggaacatcaataacacaaaaaggcatcattttcatcctgttaatgttagtcacaccatccatggcaatgcgatgcgtgggaataggtaatagagatttcgtcgaaggtctctcaggtgcaacgtgggtggatgtcgtattagagcacggctcatgcgtaacgacaatggcgaaaaacaagccaacactcgatattgaacttctgaaaactgaagtcaccaatccagctgttttgagaaaattatgcattgaagctaaaatttcgaacacaaccacagattcaagatgccccacacaaggcgaagcgacacttgttgaagaacaagatgcaaatttcgtgtgcagacgaaccttcgttgatagaggttgggggaacggatgcggactctttggtaaaggtagccttttaacttgcgcgaagtttaaatgtgtcacaaaactagaaggcaaaattgtacaatatgaaaatttgaagtatagtgtaatcgtgactgtacatactggtgaccaacatcaagtaggcaacgaaacaacggagcatgggacgatcgctacgataactcctcaggcacctacaagtgagatacaacttactgattatggtgcattaacactagactgctctccaagaacaggactagatttcaatgaaatggtgcttctaactatgaaagagaagagttggcttgtgcataagcaatggttcctagacctaccattgccatggacaagcggggcgtcaacttcgcaagaaacgtggaacagacaagatctacttgtcacattcaaaacagcacacgcgaagaaacaagaagttgtagtattgggaagtcaagaaggtgcaatgcacactgcacttacgggcgccactgagatacaaacatcaggaaccactactatctttgctggacacttaaaatgtagactgaagatggacaaactaaccttaaaaggggtatcttacgttatgtgtacgggttctttcaaactagaaaaagaagtggccgagacgcaacatggaacagttttagtacaggtcaaatacgaaggcacggatgcaccatgtaaaatacccattagtatacaagatgagaaaggagtaacacaaaacggaagattaattacggcaaatcctatagtaacggataaggagaagccagtaaacatagagaccgaaccaccatttggtgagagttacatagtaataggggcaggagaaaaagctctaaaattatcatggtttaagaaaggttcttcgataggaaaaatgtttgaagctacggcgcgcggagcacgtcggatggccatcttaggtgatactgcttgggatttcgggagtatcggtggtgttttcacctcagtgggaaaattagttcatcaagtttttggaacagcctacggagtcctattttctggtgtatcttggacaatgaagataggcataggtatactcctgacatggcttgggctgaactcacggagtacgtcactttcaatgacctgcatagcagtaggaatggtaacgttgtacctaggtgtaatggtacaagcggattcaggttgcgtgataaattggaaaggcagagaactaaagtgtggctcgggaatatttgttacgaacgaagtacatacctggactgaacagtataaattccaagcagattcccctaaaagactgtcagccgccattggaaaggcgtgggaagaaggcgtctgtggaattagatcggcgacacgattagagaacataatgtggaaacaaatatctaatgagttaaatcatatattattggagaatgatatgaaatttacagtagtagttggtgatgcaaatggaatacttacccaagggaagaaaatgatacgacctcagccgatggagcataagtactcctggaagagttgggggaaagccaaaatcataggagctgacacacagaacacaactttcattattgatggcccggacacacctgaatgtcctgacgatcaaagggcatggaacatctgggaggtagaagattacggctttggagtatttacaacaaatatttggctcaagttacgcgattcatacacacagatgtgtgaccatcgtttgatgagcgctgcaatcaaagacagtaaagccgttcacgcagacatgggttattggatcgaatcagagaaaaatgaaacgtggaagctagcgcgtgcttcattcatagaggtcaaaacctgtatatggccccgatcccataccttatggagtaatggagttctagaatcggagatgatcattccgaaaatctatggaggaccgattagccaacacaattacagacccggatattttactcagacggcgggaccatggcacctaggtaaacttgaactggatttcaatttatgtgagggtacaaccgtggttgtggatgaacattgtggaaatcgaggcccttcacttagaacaactaccgtgaccggcaaaataatacatgagtggtgttgtaggtcctgtactttacctccattacgttttagaggtgaagacggatgctggtatggtatggaaataagaccagttaaagagaaggaagaaaatctcgtccgttcgatggtttcagcaggtagtggagaagtagattcattttcgttgggactgctgtgtgtcagcatcatgatagaagaagtaatgagatcaaggtggagtagaaaaatgttaatgactggtacactagctgtattcttcttattaataatgggccaattaacatggaacgacctaatacggttgtgtattatggtcggggccaatgtatcagatcgaatgggtatgggaacaacgtatttggcattaatggcaacctttaagatgcgtcctatgtttgcggtcggcctattattcagacgattgacgagtcgcgaagtcttactattaacgataggcctatcattagtggccagtgttgaattaccaaacagtttggaggaattgggggatggattagccatggggataatgatgttgaaattactaaccgactttcaaagtcatcaactatggacaactttattgtcactgacatttattaaaacaactttatcgttagattatgcttggaaaacaatggcgatggtattatctatagtttctctttttccactctgtctgtcaactacgtcccagaaaacaacttggttaccagtattattaggatcatttggatgcaaaccactaactatgtttttaattacagagaacaaaatatggggccggaaatcatggcctttaaacgaggggataatggccgttggaattgtatcgatactcctcagtagtctcctaaagaatgacgtaccattagcgggacctcttattgccggtggcatgttgatagcgtgttacgttatatccggatcaagtgcggacctatcgcttgagagagccgctgaagtaagttgggaggaagaggccgaacattcgggagcctcacataatatcctggtagaagtacaagatgacgggactatgaaaataaaagacgaagagagagacgatacactaacaatactccttaaagctacgctactagcggttagtggagtgtacccgatgagtataccagcaacattatttgtgtggtacttctggcagaaaaagaaacaaaggtcaggagtcctatgggacactccttcaccaccagaggtggaacgtgcagtcctagatgatggaatatacagaatccttcaaagagggctcttagggagaagccaagtaggcgttggggtatttcaagatggtgtttttcatacgatgtggcatgtaacacgaggcgcagtattaatgtatcagggcaaacggctcgagccatcctgggcctccgttaaaaaggatctaataagctatgggggaggttggcgcttccaaggttcgtggaacactggagaggaagttcaagtcatcgcagtcgagccaggcaaaaatcctaaaaatgttcaaacaacaccgggtacatttaaaactccagaaggggaagtaggtgctatcgctcttgattttaaacccggtacaagtggatcaccaatagtgaacagggaaggaaagattgttggtctatacggaaacggagtcgttaccacaagtggaacttatgttagtgcaatagcccaagcaaaagcatctcaagaagggcctttgccggaaatagaagatgaagtgtttaagaaacgtaatctcacaataatggatttacacccgggatcgggaaaaacgcgtagatatttaccagcaatcgtgagagaagctataaaaagaaaattaagaacactaattttagcaccaacacgagtagtagcttcggaaatggcggaagcattaaaaggaatgcccatacgatatcaaacaactgcagtgaaaagtgaacatacaggtaaagagatagtcgaccttatgtgtcatgcaacctttaccatgcgcctactaagccctgttagagtacccaactataacatgatcatcatggacgaagctcattttaccgatcctgcgagtatcgctgccagaggttacatttcgactcgggttggaatgggtgaagccgctgcaatttttatgacggccacacctcccggtagtgtcgaggcttttccccaatccaacgcagttatccaagacgaagaacgagacattccagaacgcagttggaatagcggttatgactggatcactgattttccaggtaaaacggtttggttcgtgccctcgattaaatcaggtaatgatatagcaaattgcctaaggaaaaatggcaaacgcgtaatccaacttagtagaaagacattcgacacagaatatcagaaaactaaaaacaatgattgggattatgtagtaaccactgatatatcggagatgggcgcgaacttccgagccgatcgggtaatagatcccagacgctgtttgaaaccagtaatactcaaagacggaccagagcgagtgatattggcaggtcctatgccagtaacggcagcgtcagccgcacaacggagagggagaattggaagaaatcagaataaggaaggcgatcaatacatttacatgggacagccactaaacaatgatgaagatcatgcccattggaccgaagcaaaaatgctattagacaacatcaatactcctgagggtatcataccagcacttttcgagccggagagggagaaaagcgctgcaatagacggtgaatataggttgcgaggagaagcaagaaaaacattcgtagaattaatgcgaagaggcgaccttccagtatggcttagttataaagttgcatctgagggattccaatatagtgaccgccgatggtgtttcgatggagaaagaaacaatcaagtcctcgaagaaaatatggatgtggaaatctggacgaaagaaggcgaaaggaagaaattacgaccaagatggttggatgcacgaacatacagcgacccactggctctacgagagtttaaagaatttgcagcgggacgaagaagtgtaagcggcgacttgatattagagattggtaaattgcctcagcacctaacactaagagcccaaaatgcgttagacaatcttgtaatgctgcacaattcggaacagggtggcaaggcttatcgacatgcaatggaagaactgcccgacacgatagaaaccctaatgttattagccctaattgctgttttaacaggaggggtcacactattctttctaagtggaaaaggtctcggtaaaacatctataggacttctctgtgtcatggcctcgtcggtgttactgtggatggccagcgtagaaccgcattggatagcagcatccataatcttagagttctttctaatggttttgctaataccagaacccgacaggcagcgtacaccgcaagacaatcaactcgcttacgttgtaattggtctgttattcatgattctgacagtggcagctaatgaaatgggattgttggagacgactaagaaagacctagggatagggcatgtagtcgctgaaaatcatcaccatgcgacgatgcttgatatagatttacatcccgcgtctgcatggacgttatatgctgtagcaacgacaataataacacccatgatgaggcacacaatcgaaaacaccacagccaacatatcactaacagcaattgccaatcaagctgccattttgatgggtttggataaaggttggccaatttcgaaaatggatattggagtgcctttattggcactgggttgttacagtcaagtaaatccattaacgctgacagcggctgtcttaatgcttgttgcacattatgccataattgggccaggcctacaagcaaaagccacaagggaggcacagaaaagaaccgcggcaggtataatgaagaatccaacagtggatgggatagtagcgattgacttagacccagtcgtttatgacgctaaattcgaaaaacaattaggacaaattatgctgttgatactatgtacatcacaaatattacttatgagaacaacgtgggcattatgcgagtccatcactctcgctacaggaccccttactacactctgggaaggatcgccaggaaagttctggaacaccacaatcgcagtatcaatggctaatattttccggggaagctatttggctggagccggattagcattttcattaatgaagacgttaggaggaggaagaagaggcaccggtgcacaaggtgaaacactgggggagaaatggaaacggcaattgaaccagttaagtaaaagtgagtttaatacatacaagcgcagcggcatcatggaagtagacagatctgaagcaaaagaaggacttaagaggggagaaacaacaaaacatgcagtaagccgaggtacggcgaagctccgatggtttgtcgaaaggaatcttgtaaaaccggaaggaaaagtcatagatttaggatgtggacgtgggggatggtcatattattgtgcaggtcttaagaaagtaactgaagtcaaaggatatactaaagggggtccagggcatgaagaaccgatacccatggcgacttatggttggaacatagttaaactccattcaggcagagacgtattctttacgccgccggagaagtgcgacacattactatgtgatattggggaatcttcacccaacccaacaatagaggaaggaagaaccctacgcgtgttaaaaatggttgaaccatggcttagaggaaaccaattctgtataaagatcctaaacccatatatgccatccgttgttgagacactggaacaaatgcaacggaagcatggtggaatgttagttaggaaccccttaagtagaaacagtactcatgaaatgtattgggtctcttgcgggacaggtaacatagtcagtgcagtgaacatgacttcgcggatgctattaaacagatttaccatggcccacagaaaacctacttatgaaagagacgtcgacctcggcgcaggtacgagacacgtcgcggtagaacctgaaattgcaaacttagatataattgggcaaaggatagaaaacattaaaaatgaacacaaatctacatggcactacgatgaagataacccatataagacatgggcttatcatggatcttatgaagttaaaccaagtggttcagcttcgtctatggtaaatggagtcgtccgactcttgactaaaccatgggatgtcataccaatggtgacgcagatagcgatgactgataccacaccctttggacagcaaagagtatttaaagaaaaggtggatacaagaacgccaaggccaaagcgaggcacagctcaaataatggaggtaacagctaagtggctctggggtttcctgtctcgaaataagaaaccccgaatttgtacaagagaagaatttacgcgaaaagtgagatcaaacgcagctataggtgcagtgtttgttgatgagaaccagtggaacagtgctaaagaagccgtagaagatgagcggttctgggatttagttcatagagaacgtgaattgcataaacagggaaaatgtgcaacgtgcgtttataacatgatgggaaaaagggagaagaaactcggagaatttggaaaagctaaaggaagtagagctatatggtatatgtggttaggagcgaggttcttagaatttgaggcactcggttttatgaacgaggatcattggttttctcgagaaaactcacttagtggagtagagggagagggtttacataagttagggtatatactgagggatataagtaagatacccggaggaaacatgtacgcagacgacactgcaggatgggacacccgaattacagaggacgacttacaaaatgaagccaagattacagatataatggagccagaacatgcattactggcaacatcgattttcaagctaacatatcagaataaagttgtcagggtacagaggccagctaagtcaggaacagtaatggatgtaattagtcgtagagaccaacgaggctcaggacaagtgggaacttatggtttaaatacttttacaaatatggaagtacaattgatccgtcaaatggagagcgaagggatttttagcccttcggaattagaaaactcaaacttggctgaaagagttctcgactggcttgagaaacacggggtcgaacgcctcaaacgcatggcaatatcgggagacgattgtgttgtgaaaccaaccgatgaccggtttgcaacggctctcacagcactaaatgatatggggaaagtgagaaaagacataccacaatgggagccttcgaaaggatggaatgactggcaacaggtgccattttgctctcatcattttcaccaattgattatgaaagatggaagagaaatcgtagtaccgtgtagaaatcaagatgagcttgtgggtagggcaagagtatctcaaggagccggatggagccttagggaaactgcatgcttaggcaaatcatatgcgcaaatgtggcaactaatgtattttcatcgacgagatctgcgcctagcggcaaatgcaatatgctcagcagtgccagtaaattgggtaccaacctctcgcaccacatggtccatacatgcacaccatcagtggatgactacagaagacatgctgtcagtctggaatcgagtatggatcgaagaaaatccatggatggaagacaaaacacacgtaagtagctgggaagacgtaccttacctaggaaaacgagaagatcaatggtgtggatcattaatcggactcacagccagagcaacatgggctacaaatatacaagtagcaataaatcaagtacgtcggttaattggaaacgaaaattatctggactatatgaccagtatgaaacgtttcaaaaacgaaagcgacccagaaggtgccctatggtga

SEQ ID NO: 22103 - RNA, 9879 nt, synthetic construct
  misc_feature 1..9879: note = derived and/or modified CDS sequence (opt6) from DENV-1__KM403581__SS-prME
  source 1..9879: mol_type = other RNA
agcgttacaatgttactcatgttacttccaacagcattagcattccatctaacaacaaggggtggtgaaccccatatgatagtgagtaaacaggaacgaggaaaatcattactttttaaaacaagtgcgggtgtaaacatgtgtacacttatagcaatggatttaggtgaattatgcgaagatacaatgacttacaaatgcccacgtattacagaagcagaacctgatgatgtagactgttggtgtaatgcaactgatacatgggtcacatatggaacttgttcccaaacaggagaacatcgacgagataggcgcagtgttgcattggctccacatgttggactcggactagaaacaaggactgaaacttggatgagcagtgaaggcgcatggcgacagatacaaagagtagaaacctgggccttaagacatccagggttcacagtcatagcactattcctcgcacacgcaattggcacaagtataacgcaaaaaggaataattttcatacttctaatgctagtaaccccttctatggctatgcggtgtgtaggaataggaaacagagatttcgtggaaggactctcaggggctacctgggtcgacgtagtactggaacatgggagttgtgtcaccacgatggccaaaaataaaccaactctcgatatagaattattaaaaaccgaggttacaaacccagcggtactgagaaaattgtgcatagaagcgaaaatatcgaacaccacaactgacagtcgttgtccgacgcagggagaagcgaccttagtagaagaacaagacgcaaattttgtatgccgacgtacgttcgttgataggggatggggtaacggatgtggattatttggcaaagggagtctcctgacatgtgctaaatttaaatgtgttactaaactcgaaggaaaaatagtccaatacgagaacttaaaatattcggtaatagtgactgttcacacaggcgaccaacaccaagtggggaacgagacaacagaacatggtacgattgcgacgattacaccgcaggcaccaacgagtgaaatacaacttaccgactatggagctttaacgttagattgttcccctagaacaggtctggactttaatgaaatggtgctacttacaatgaaggaaaagtcttggttggtccacaaacaatggtttttagacctaccactcccatggacgagcggagcatcaacatctcaagagacatggaatagacaggatcttctagtaacgttcaaaacggcccacgctaagaaacaagaagtggtagtactaggaagtcaagaaggtgcaatgcacacagccttaacaggagctactgagattcagacaagcggaacgactacaatattcgccggacatttaaagtgtagactaaaaatggacaagctaacactcaaaggtgtttcatacgtgatgtgtacaggatcgttcaaattagaaaaagaagttgctgagacacaacacgggactgtgttggttcaggtaaaatacgagggaactgatgccccttgtaaaattcctatcagcactcaagatgagaaaggtgtgactcaaaacggaagactaataacagccaatcctatcgtgaccgacaaagaaaagcccgttaatatcgaaacagaacctccgtttggagaaagttatattgttatcggggctggggaaaaagcattaaagttatcatggtttaagaaagggagttcaatcggtaaaatgttcgaagccactgctcgcggagcaagacgcatggcaatattaggagacaccgcatgggacttcggatctattggtggtgtttttacttcagtagggaaacttgttcatcaggtatttggaacagcatacggcgtcctattttccggagtctcatggacgatgaaaataggtataggaatacttctaacatggctaggacttaacagccgttcaacatcattgagcatgacatgtatagcagtaggcatggttacactgtatctgggtgtaatggtgcaggctgactctggttgtgttataaattggaaggggcgagaattaaaatgtggctcaggaatttttgtgactaacgaagtacatacatggaccgaacagtataaatttcaggcagattcaccaaaaagactaagtgctgcaattggtaaagcatgggaagagggtgtgtgtggtattagatcagctacgcggctggaaaatattatgtggaaacaaatatcaaatgaactcaaccatatattattagagaacgatatgaaatttacagttgtagttggtgacgctaacggaatacttacgcaaggtaaaaagatgatacgccctcaacctatggaacataaatatagttggaaatcatggggtaaggccaaaataataggagcagacactcaaaatacaactttcattatcgatggtccagatactcccgaatgtccagacgatcaaagagcatggaacatatgggaagtagaggactatggttttggagtatttaccacaaatatctggctcaaactgagagattcttacacacaactttgtgatcatagactgatgtcagcagcaattaaagactcaaaagctgtacatgcagatatggggtattggattgaaagcgagaaaaatgaaacctggaaattagcaagagccagcttcatcgaagttaaaacttgtatatggccccgatctcatactctgtggagcaatggagttctggaaagcgagatgataatcccgaaaatttacggaggaccaataagtcaacacaattatagaccagggtactttacacaaaccgcaggtccctggcaccttggaaaattagagttagatttcaacctatgtgagggaacaacggtagtggtcgatgagcactgcggtaacagagggccatcacttaggaccactactgtaacaggaaagattatacatgagtggtgctgtagaagctgcacgttgcctccattgagattcagaggtgaggacggctgttggtatgggatggaaattcgaccagttaaggaaaaagaggaaaatttggttcgatccatggtcagcgctggatcaggagaagtcgacagtttctcactaggtcttctctgcgtatctattatgatagaggaggtaatgcgttcgagatggtcaaggaagatgttaatgacaggaactttagctatattctttctgttgataatgggacaactgacttggaacgacctaatacgcttatgtattatggtgggtgcaaacgtaagcgatagaatgggaatgggcacaacatacttagcattaatggctacattcaagatgagacctatgtttgctgtcggactattgtttcgtcgcttgacatcaagagaagtactactactaacaattggcttaagcctagttgcatcagtagaactacctaattctcttgaggaactgggtgatggtttagccatggggatcatgatgctaaagctgctaacggacttccagtcccatcaactttggacgacgttattatccttgacctttataaaaacaacactgagccttgactacgcctggaaaactatggcaatggtgttaagcatagtctcgttgtttccactttgcctttcaactacgtctcaaaagacgacatggttacccgtactattgggcagtttcggatgtaaaccattaactatgtttcttatcacagagaataaaatatggggtagaaagagttggcctctcaatgaaggaattatggcagttgggattgtctcaatccttctaagctcactactcaagaatgacgtacccctagcaggaccgcttatcgctggaggtatgcttatagcttgttatgtcatatcgggatctagtgcagatctaagtttagaaagggcagcagaagtaagttgggaagaagaggctgaacattctggagcctctcacaacatattagtcgaagtacaggacgacgggacaatgaaaataaaagatgaagaaagggatgatacattaactattttgttaaaggcgacattactcgcagtatccggcgtatatcctatgagcataccagctacactatttgtttggtatttttggcagaagaagaaacaaagatcaggagtgctttgggacacgccatcaccaccggaggttgaaagagctgtattagatgatggtatataccgaatactccaacgtggcttattaggtcgatcccaggtaggtgttggcgtttttcaagatggagttttccacacgatgtggcacgtgactaggggtgcggtccttatgtatcaaggcaagcgactagaaccttcgtgggcttctgttaaaaaggacttaatatcttatggaggaggttggaggtttcaaggaagctggaatacaggtgaagaagtacaagttatagctgtagaaccgggcaaaaatcctaaaaatgttcaaacaacaccaggaactttcaaaactccagagggagaggtaggtgcaatagcactagatttcaagcccgggacctctggaagccccatcgtgaatagagaaggaaaaatagtcggactttatggtaatggagtagtaaccacaagtgggacttatgttagcgcaatagctcaggcaaaagcaagccaagaagggccgctgccagaaatcgaagatgaggtatttaagaaacgcaatttaacaataatggacctacatccaggaagtggaaaaacgagaagatatttgcccgcaatagttcgagaagcaataaaacgtaagttaagaacactcatcctggcaccaacaagggtggttgccagcgaaatggcagaggctttaaaaggaatgccaattagatatcaaaccactgcggtaaaaagcgaacacactggaaaggagatagtggatctgatgtgccatgcaactttcactatgaggctattaagcccagtaagggtgcctaattataatatgataataatggacgaagcacattttaccgaccctgctagtattgctgcacgaggctacatctcaacgagagtcggaatgggcgaagcggcggccatctttatgactgcaactcccccgggcagtgtagaggcatttccacaatcaaatgcagtaattcaagatgaagagagagatattccagaacgcagttggaactctggttatgactggatcacggactttcccggcaaaaccgtctggtttgttccaagtatcaaaagtggaaacgatatagccaactgtttaaggaaaaatgggaagagagtaatacaactatcgagaaaaacattcgatacagaatatcaaaagacaaagaataatgattgggactacgttgttacaactgacattagcgagatgggagccaatttccgtgccgatcgggtgattgatcctaggaggtgcctaaaaccagtaatactcaaagatggaccagagcgagtaatcttagctggacctatgcctgtaacagcggcatctgcagcgcaaaggagagggagaataggaagaaatcaaaacaaagaaggtgatcagtacatctatatgggacaaccactaaataacgatgaagatcatgctcactggactgaagcaaagatgttactcgacaatataaatacccctgagggtataattccagcattgtttgaaccggagagggagaaaagcgcggcaattgacggagaatatagactccgaggagaagccaggaaaacatttgtcgagcttatgcggcgaggagacttaccggtttggttatcttataaagttgcttcggaagggttccaatatagcgacaggcgctggtgctttgacggggaacgaaataatcaagtattagaagagaatatggatgtagagatatggactaaagagggagaacgaaagaaactaaggcctcgatggctagatgctagaacatattctgaccctttagcgttacgcgaatttaaagaatttgctgctggccgtagaagtgtcagtggagatttaatattagaaatcggaaaactgccgcaacacctaacattgcgtgcccaaaatgcgttagataatttggtgatgttgcataactcggagcagggagggaaagcatatagacatgcaatggaggagctcccagatactatagaaactctaatgttgttagctcttatagcagtactcactggaggagtaactttattcttcctttcaggcaaaggtttaggaaaaacaagcataggtctattatgtgtcatggccagtagcgtcttgctatggatggccagcgttgaaccacactggattgcagcatcaataattcttgagttctttttgatggtcttgttaattcctgaacctgatcgacaaagaacaccacaagataaccaattagcttacgtagtcatcggactactgtttatgatattgacagtagcagccaatgaaatgggattgctagaaactactaagaaagatctaggaatcggacatgtggtagcagagaatcaccaccacgcaactatgctcgatatagatttacatcccgcttcagcctggacgctttatgcagtagctacgaccatcataactccgatgatgagacatacaatagaaaatacgactgctaatatcagcttaacagcaattgccaaccaagctgcgatattaatggggcttgataaagggtggcctataagtaagatggatatcggagtgcccttattagcgctcggatgctatagtcaagttaatcctcttacgttgacagctgcagtgctaatgttagtagcgcattatgcaattatcggtccaggcctgcaagccaaggcgactcgagaagctcaaaagcgtaccgcggcaggtataatgaagaatcctacggtggacggaattgtggctatagacttagatccagtagtttatgacgcaaaatttgaaaaacagctaggtcaaattatgttacttatattatgtacaagtcaaatattattaatgagaacgacttgggcactctgtgaatcaataacgctcgcaacaggacccttgacaaccctgtgggagggaagccctggaaaattctggaatacaactatagcagtttcaatggctaatatctttagaggatcctacttggctggcgcaggtctagcttttagccttatgaagtccctaggcggagggaggagaggcacaggagcccaaggtgaaacattaggagaaaagtggaagagacagctaaaccagctatccaagtctgaatttaatacatacaagcgaagcgggatcatggaagtcgataggtcggaagcaaaagaaggcctaaaaaggggcgaaacaacgaaacatgcagtaagtagggggacagctaaactcagatggtttgtagaaagaaatttggttaaaccagaaggtaaagttatcgatctggggtgcggtcgaggagggtggagttattattgtgcgggactaaagaaagtaacagaagtcaaaggctacacaaaagggggacccggtcacgaagaaccaataccaatggctacttatggctggaacattgtaaaactacacagcggacgtgatgtatttttcacccctcccgagaaatgtgatacattgttgtgcgacatcggcgagagttcacccaaccccacaattgaagagggacgtactttaagagtattgaaaatggtggaaccgtggttacgtggtaaccaattttgtattaaaatactaaatccatacatgccctccgtagtggaaaccctggagcaaatgcaacgtaaacacggaggaatgttagttagaaaccccctatccagaaattccacacacgagatgtattgggtctcatgtggaaccggaaatatcgttagcgccgtaaatatgacaagtagaatgctcttaaaccgttttacaatggcacataggaaacccacatatgaacgggacgtagatctcggtgcgggaacccgacatgtcgcagttgaaccggagatagcaaacttagacataattggacaaagaatcgaaaacatcaaaaatgagcataagtccacgtggcattacgatgaagataatccctataaaacatgggcttaccacggtagttatgaagttaaaccctcaggcagcgcctcctctatggtgaacggagtagtaaggttactaacaaaaccctgggatgtcatcccaatggtcacgcaaattgcaatgactgacacgacacccttcggacaacaaagagtgtttaaagaaaaagtggacacacggacaccaagaccaaagaggggaacagcgcagattatggaagttacggcaaagtggttatggggatttctaagtcgaaataagaaacccaggatatgcacaagggaagagttcactagaaaagtgagatctaacgctgctattggcgctgttttcgtagacgaaaaccaatggaactccgccaaggaagcagtcgaggatgaaagattttgggatttggtacaccgcgaaagagaattgcacaagcaaggaaaatgtgcaacttgcgtgtataacatgatgggtaaaagagagaagaaattgggtgaatttggtaaagcgaagggctcacgtgccatttggtatatgtggctcggagcaaggtttttagaatttgaagccttgggtttcatgaacgaagaccattggttcagtagggaaaacagcttatccggggtcgaaggtgaaggattgcacaaattaggttacatactaagagatatctctaaaattcctggtgggaatatgtatgcagacgacaccgccgggtgggatacaagaataacagaggacgacttacaaaacgaggccaaaatcacagatatcatggaacctgaacacgcattgcttgcgacgagtatttttaaattaacttaccagaataaagtcgtacgcgtgcaacgaccagcaaaatctggtactgttatggatgtaatatcgcgtagggatcagcggggtagtggtcaggtaggtacctacgggttgaatacctttacgaatatggaggtccaacttattaggcaaatggagtctgaaggtatatttagccctagcgaactggaaaacagcaacctggcggagcgggtactggattggcttgagaaacatggagtcgagagattaaaaagaatggcaataagtggagatgattgtgtagttaagcccaccgacgataggttcgccacggcactgactgcactcaacgacatgggcaaagtgagaaaggatatccctcagtgggaaccatccaaaggatggaatgactggcaacaagtaccgttctgctcgcaccatttccaccaactaataatgaaagatggaagagagatagttgtcccatgcaggaatcaagatgaactcgttggtcgcgcacgagtaagccaaggagcaggatggtcattacgtgaaactgcttgcttgggcaagtcttatgcacaaatgtggcaattaatgtatttccaccgaagagatttaagattggccgctaatgctatttgctcagccgtgcccgtaaactgggttccgacaagccgaacaacttggtccattcacgcgcaccaccaatggatgacaaccgaagacatgctttctgtgtggaatagggtttggatagaagaaaatccttggatggaggataagactcatgtcagttcatgggaagacgtaccgtacctggggaaaagagaagaccaatggtgtggttctttaatcggattgactgcccgtgcaacttgggcaacaaacatacaagttgccattaatcaagtaagacgtttaattgggaatgaaaattatcttgattatatgacatcgatgaagagatttaaaaatgaatcagacccagagggggcgttatggtga

SEQ ID NO: 22104 - RNA, 9879 nt, synthetic construct
  misc_feature 1..9879: note = derived and/or modified CDS sequence (opt6) from DENV-1__KM403597__SS-prME
  source 1..9879: mol_type = other RNA
agcgttactatgctcttgatgctcttacctacagcactggcattccatttaacaactagagggggtgaaccacacatgatagtaagtaaacaagaaagaggaaagagcttattatttaaaacttcagcgggtgttaatatgtgtacccttattgcaatggatttaggcgaattatgcgaagacactatgacctataaatgtcccagaataacagaagcggaacctgatgatgttgattgttggtgtaatgccactgatacttgggtcacctacggaacatgttcacaaacaggcgaacatagaagagaccgaagaagcgttgcgttggcgccacacgtagggctgggcctagagacaagaactgagacttggatgtcgtctgaaggagcctggagacagatacaaagggtagaaacttgggccttaagacatcctggatttacggttatcgccctcttcttggctcatgcaattggaacttcaataacacaaaaaggtatcattttcattttattaatgcttgtaacgccctcgatggcaatgagatgtgtaggtattggcaatagagatttcgttgaaggactttcaggcgcaacctgggttgacgtagtactagagcatgggtcgtgtgtcacaacaatggcgaaaaataaaccaactctagacatagagctactgaaaaccgaggtcactaatcctgccgtcctaagaaaactatgcatagaagctaaaattagtaatacaaccactgactccaggtgccccacccagggagaggctactttggtagaggaacaagatgccaattttgtgtgtagacgaacgttcgttgatcgcggatggggtaacggctgtgggctttttggaaaaggaagtttattaacgtgcgcaaaatttaaatgtgtaaccaaactcgaaggaaaaattgtacaatacgaaaatttaaaatatagcgtgatcgtaacggtacatacgggtgatcaacaccaagttggcaatgagactacagaacatggaactatagcaacgattacacctcaagctccaacatccgaaatacaattaactgattacggagcattaacgcttgattgttcacctaggaccggcttagattttaacgaaatggtgttactaacaatgaaagaaaaatcatggctagtgcataaacaatggtttctagacctaccacttccatggactagcggagcctcaacatcccaagaaacctggaatagacaagatttgttagtgactttcaaaactgctcacgccaagaaacaagaagtggttgtcctgggatcgcaagagggagcaatgcatacagctttaacgggggcaacggaaatacaaacaagcggcacgacaactattttcgccggtcatctgaaatgccgattaaaaatggataaattaacacttaaaggagtaagttatgtaatgtgtacgggaagtttcaaactcgaaaaagaggttgcggaaacacaacacggaacagtattagtccaggtgaaatatgaaggaaccgatgcaccgtgtaaaatacctatttcaactcaagatgaaaaaggtgtaactcagaatgggaggctgataacagccaatcctattgttacggacaaagaaaaacctgtcaatattgaaaccgaaccaccgttcggagagagttatatcgtaataggcgccggcgaaaaagcactaaaactgtcttggttcaagaaaggcagttcaatagggaagatgttcgaagccaccgctaggggtgctagaagaatggcaattttaggtgacacagcctgggatttcggttcaatagggggcgttttcacttctgtaggcaaattagttcatcaagtgtttgggaccgcctatggtgtgctattttcaggagtatcctggacgatgaagatcggtataggaatattgttgacttggctagggctcaatagtagatcgacgagtttaagcatgacctgcatagccgttgggatggtaactttgtatcttggtgtaatggtacaggcagattcgggctgtgtaatcaactggaaaggaagagaactcaaatgcggaagcggtatcttcgttacgaatgaggttcacacctggacagaacaatacaaattccaggctgatagtccaaagaggctaagtgcagcaattggcaaagcatgggaagaaggcgtctgtgggatcaggtcagccacgcgactcgaaaatataatgtggaaacaaattagtaatgaacttaaccacatattactagagaatgacatgaaattcacagtagtagttggtgatgccaacgggatcctaacacaaggcaagaaaatgatccgaccgcaacctatggagcataaatattcgtggaaatcttggggaaaggctaaaataataggtgctgatacacagaatacaacgtttatcatcgatggcccggatacacctgaatgtcccgacgatcagagggcttggaatatttgggaggttgaagattatggcttcggggtcttcaccacaaatatctggcttaaacttagggattcttatactcagatgtgcgaccaccgattgatgtcggcggctataaaggactcaaaggctgttcatgctgacatggggtattggatagaaagtgagaaaaatgaaacctggaaacttgcaagagcgagcttcattgaagtaaaaacttgtatatggccgcgctcgcataccctatggagcaacggcgtcttagaaagcgagatgataattccaaagatatatggaggcccgataagccaacacaattacagaccaggttattttacgcaaacagctggaccctggcatttagggaaattagaactagatttcaatctatgtgaaggcacaactgtggtggtagatgaacactgtggaaacaggggtccgtcgttaaggacaactacagtgacaggcaaaataatacatgaatggtgctgccggtcatgtaccttaccacctctccgattcagaggggaagatggatgttggtatggtatggagatacgacccgtcaaagagaaagaagaaaatttggtaagatccatggtatcagcgggaagtggggaagtggattcatttagccttggattactgtgcgtcagtattatgattgaggaagtcatgagatcaagatggagccgaaagatgttaatgaccggaacacttgctatatttttcctgctaattatgggtcaacttacatggaatgacctaatacgattatgcattatggttggagcaaatgtttcagatagaatgggtatggggacgacatatttagctctgatggccacattcaaaatgaggccaatgttcgctgttggattgttatttcgtcgattaacgtccagagaggtgttattactaacgataggtctcagtcttgtagcgtcagttgagctcccgaactcgttagaagaattaggtgatggactggccatgggtattatgatgctgaaactgctgactgactttcaaagccaccagctgtggactactctactatcattaaccttcattaagacaacattaagtcttgattacgcttggaagacaatggcaatggtcttgtcaattgtaagcctcttcccgctctgcttatctaccacgtcccagaaaacaacatggttaccggtactactaggaagtttcggatgcaagcccctaaccatgtttttaataactgagaacaaaatttgggggagaaaaagctggccactaaacgagggaattatggcggtaggtatagtatcaatacttttgagcagtttacttaaaaacgatgtacccctagcaggccccctaattgctggtggcatgcttatagcgtgttacgttataagtggatcatcagcagatcttagtctcgaaagagcagcagaagtaagttgggaagaagaagcagagcatagtggggcaagtcataacattttagtagaagtacaagatgacggaacaatgaaaataaaagatgaagaacgcgacgacaccctcactatattattgaaggccactttactagcggtaagtggtgtgtaccccatgtcaatccctgcaaccttatttgtatggtacttttggcaaaagaagaaacaaaggtctggagttctttgggacacacctagccctccagaagtcgagagagcggtcttggatgacggcatatacaggattcttcaacgtgggttattgggtcgctcgcaggtaggagtaggtgtattccaagacggtgtgtttcacacgatgtggcacgttactcgaggggcggtactcatgtaccaaggaaaaaggcttgaaccaagctgggcatctgtgaagaaagatctaattagttatggcggaggatggcgatttcaaggctcatggaatacaggagaggaagttcaagtcatagcagttgaacctggcaaaaatcccaaaaatgtgcaaactaccccaggaaccttcaaaacaccagaaggtgaggttggtgctatagcactagactttaaaccaggcacctcgggtagtcctatagtaaatcgcgaaggaaaaattgttgggttatatggtaatggcgtcgtcactacaagtgggacatacgtcagtgcaatagcacaggcaaaagcatctcaagagggaccacttcccgaaatagaagatgaagtgttcaaaaagcggaatctaacaatcatggatttgcaccccgggtcgggaaaaacgagaagatatcttcccgctatcgttcgagaagctattaaaagaaagttacgcacactaattctagcacctactagagtagtagcttccgaaatggcggaagcccttaaaggaatgccaataagatatcagacaactgcggttaaaagtgaacatactgggaaagaaatcgtagacctaatttgccatgcaacttttaccatgagacttttaagccctgttcgagtaccgaattacaatatgatcattatggacgaagcccattttacagatccagccagcattgctgcaagagggtacatatcgacgcgggtcgggatgggagaagcagcagccatattcatgactgcaaccccaccagggtcagttgaggcctttccacagtcaaacgccgtaatacaggatgaagaacgtgatatacctgagagatcttggaactctgggtacgattggataacagattttcccggaaaaaccgtatggtttgtaccatctattaaatccggaaatgatatcgctaattgcctaaggaagaatgggaaaagggttatacagttaagccgtaagacgttcgacacggaataccagaaaaccaagaataatgattgggattacgtagttacaacagatatatcagaaatgggtgcaaatttcagggcagacagagtgatcgatccaagaagatgtctgaaaccagtgattttaaaagatggtcctgaaagagtgatattagcgggtccgatgcccgtcacagcagcttcagcagcacaacgacgaggccggattggacgaaatcaaaacaaagaaggtgatcaatacatttatatgggtcaacctctaaataatgatgaagatcacgctcattggaccgaggcaaaaatgctcctcgataatataaatactcctgaaggaatcatacctgcactatttgagccagaacgcgaaaaatccgctgcgatcgatggagaatatcgactacgaggtgaagctagaaagacatttgtagaattaatgaggaggggtgatttgccagtctggctctcatataaagtagcaagcgagggtttccaatacagtgacagacgatggtgctttgacggtgagagaaacaatcaagtcttagaggaaaacatggatgtggaaatatggacgaaggagggggagcgcaaaaagttaaggccacgatggttagatgcccggacctatagcgatccactggcgctaagagaatttaaagaatttgcagcgggtagaagatcagtgagtggtgatttaatacttgagataggaaagttacctcaacacttaaccttaagggcgcagaatgcccttgacaacttagttatgctacataattcggagcaaggcggcaaagcctatcgccatgctatggaagaactgcctgatacaatagagacattaatgttactagcgctgatagcagtcttgactggtggagtgacactcttctttctaagtggcaagggactcggcaagacaagcattggtttactatgtgttatggcttcgagtgtactactatggatggcttcagtggaacctcattggatagcggcgtcaattattttagagttcttcctgatggttcttctaataccagaaccagatagacaacgaaccccacaggataatcagttagcatatgtagtaataggactgctttttatgatccttactgtagccgctaacgaaatgggcttgttagaaacaaccaagaaagatttaggcataggacatgtcgtagcagaaaaccatcaccacgccacaatgctcgatatagatcttcaccccgcatccgcatggacattgtacgcagttgcaacaacaataataactcccatgatgagacatacgatcgagaatacaacagcaaatatatcattgacggctatagccaatcaagcagcgatcctgatgggtttagataaaggatggccaataagtaaaatggacataggcgtccctctgctagcgctagggtgctattcacaagtgaacccattaacattgacagctgccgtcctaatgctcgtggcccattatgccattatcggcccagggttgcaggcaaaagctacacgagaagcacaaaaacgaactgccgccggaatcatgaaaaatccaacagtagatggaattgttgctattgatcttgatccagtggtttatgacgctaagttcgaaaaacaactaggacagataatgctcttaatactttgcacctctcaaattctactaatgagaaccacatgggcattgtgcgagtcaatcacactagcaacaggacccctaacaactctatgggaaggcagccccggtaaattctggaacacaacgatagctgtatcaatggcgaacatatttcggggaagttatttagctggggctggattagcatttagcttaatgaaatccttaggtggtggaaggcgtggcacgggagcacaaggtgaaactctaggtgagaaatggaagcgtcaacttaatcaactaagcaaatccgaatttaatacatataaacggtcgggtattatggaggtcgatcgcagtgaggctaaagaagggctaaaacggggagagactacgaagcacgctgtaagtagaggaacagcaaaattgagatggttcgtagaaagaaatttggttaagcctgagggtaaggttatcgatctaggttgcggtaggggaggttggagttactattgtgcaggactaaagaaagtaacagaagtaaaaggatatacaaaaggaggaccaggtcatgaagaaccaataccaatggctacatacggatggaacatagttaagctacacagcggacgtgacgtcttctttacgccaccagagaaatgtgacacgttactttgcgacataggtgaaagcagtccaaacccgacgatagaggaaggaagaacattgagagtcttaaaaatggtagagccttggcttagaggaaaccagttttgcattaagatactaaatccctacatgccaagtgtggttgaaacgctcgaacaaatgcaaaggaaacatggtggaatgcttgtaagaaacccactatctcgtaactcaacacatgaaatgtactgggtctcatgtggaaccggcaatattgtatcggcagtcaacatgacaagccgcatgttgctaaatcgatttacgatggcgcacagaaagccaacttatgaacgtgatgttgacctaggtgctggtacacgccacgtagctgttgaaccggaaatagcaaacttagacataatcgggcaacgaattgaaaatattaaaaacgaacataagtctacttggcattacgatgaagacaatccatataaaacttgggcatatcatgggtcttacgaagtcaaaccgtcagggtctgcctctagcatggtcaatggagtggttagattattaacaaagccgtgggatgtaatacccatggtcacacagatagcaatgacagacacgaccccttttggtcagcaaagagtatttaaagaaaaagtagatacacgaacaccgcgtccaaaacgtggaacagcacaaataatggaggttacagccaaatggctttggggatttttaagtcgaaataagaaacctcgtatttgcacgagggaagagttcaccagaaaagtaaggagtaatgctgcaatcggggcggtttttgtggatgaaaatcaatggaactcagcaaaagaggctgttgaagatgaacgtttttgggatttagtacatcgggaaagagaattgcataaacaaggaaagtgcgcaacatgtgtatataatatgatgggcaaacgtgagaagaaactcggagagttcggcaaagctaaaggttcaagagctatttggtatatgtggctgggcgcaaggtttcttgagtttgaagccctaggttttatgaacgaagatcactggttttcaagagagaacagcttaagtggagtagagggcgaagggcttcataaattaggatatattcttagagacataagtaaaatacctggaggtaacatgtatgccgacgacacggcaggatgggatactagaattacggaagacgacttacaaaacgaggccaagattacagatatcatggagccggaacatgctttactcgccacaagtatctttaaactaacgtatcaaaataaggtcgtaagggtacagagacccgcaaaatctggcacggtgatggatgtaatatcgagacgagaccagagaggatcaggtcaagtcggcacctatggtttaaacacatttacgaatatggaagtacaattgatcaggcaaatggagtcagagggaatattctctccatcggagctcgaaaattcaaatttggcggagcgtgttctcgattggctagagaagcacggagtagaaaggttaaaaaggatggcaatcagtggagatgactgtgttgtaaagccaactgatgaccgcttcgcaactgcattaactgcgcttaacgatatggggaaagtcagaaaagatatccctcagtgggaaccgtccaaaggatggaacgactggcaacaggtcccgttctgctcccatcactttcatcaattgatcatgaaagatggaagagaaatagtagtaccatgtaggaatcaagacgagctcgtaggtcgggcgagggtgtctcaaggcgccgggtggagcctaagagaaactgcttgcttaggaaagagttatgcacagatgtggcaactcatgtatttccaccgacgagacctgagattagcggccaatgcaatttgctctgcagttcccgtaaattgggtccctacctctcgaacaacctggtcaatacatgctcaccaccaatggatgaccactgaagatatgctaagcgtgtggaatagagtgtggatagaggaaaacccctggatggaagataaaacacatgtttcgagctgggaagatgttccgtacttgggtaaaagggaagaccaatggtgtggttcactgattggcctcacggcacgagccacatgggctacgaacattcaagtagctataaaccaagtaagacgtctaataggtaacgagaattacctggactacatgacgtcgatgaaacgattcaaaaacgagtcggacccagagggtgcattgtggtga

SEQ ID NO: 22105 - RNA, 9879 nt, synthetic construct
  misc_feature 1..9879: note = derived and/or modified CDS sequence (opt6) from DENV-1__KM403610__SS-prME
  source 1..9879: mol_type = other RNA
agcgtaacaatgttattgatgctcctccctaccgcactggcctttcaccttacaacgagaggaggagaaccgcacatgatagtttcgaaacaggaaagaggcaaatcacttctatttaaaacatcggcaggggtgaacatgtgcaccctaatcgcgatggatttaggtgaattatgcgaagacacaatgacctataagtgccctaggattactgaggcagaacccgatgatgtggattgctggtgcaatgcgaccgatacgtgggttacgtacggcacctgttcacaaacaggcgaacatagacgggataagcggtcagtggcattagcaccgcacgtgggtcttggtctcgagacccggacagaaacatggatgagctcagaaggcgcgtggagacaaatacagaaagtagaaacttgggcattaagacacccagggttcactgtaatagcgttatttttggcacacgcaataggcacaagcataactcaaaaaggaattatctttattctactcatgctagtaactccgagtatggccatgagatgtgtcggaataggaaatagggatttcgtcgaaggattaagcggagccacctgggtggatgttgtcttagagcatggtagctgtgtaacgacaatggcgaaaaacaagcccacattggacatagaactcctaaaaaccgaggtcactaatcctgcagtgctaagaaaattatgcattgaggctaaaatatcaaacacaacgacagatagtagatgtccgacacaaggcgaagccacattagtggaggaacaagatgcaaatttcgtatgtagaagaacatttgtagacaggggatggggcaatggctgtgggttatttggtaaagggagtttgcttacctgtgcaaaattcaaatgtgtcacaaaattagagggaaaaatcgttcaatatgaaaacttgaaatactcagtaatagtgactattcatacaggggaccagcaccaggtaggtaatgaaacaacagaacacggaactattgctactataacacctcaagctcctaccagtgagatccaactaacggattatggagcattgaccttagattgtagtccaagaacaggattagactttaatgaaatggtgcttcttaccatgaaagaaaaatcctggctcgtgcataaacagtggttcttagatcttcctctaccatggacctccggagctagcacaagccaagaaacatggaacagacaggatcttttagttacctttaaaacagctcacgcaaagaaacaagaggtagtagtattaggcagccaagaaggagcaatgcacacagccttaactggagcaactgaaatacaaaccagtggcactacgacgatctttgctggtcatttgaaatgtcgattaaaaatggacaaattaactctaaagggggtgtcatacgtaatgtgcacaggaagttttaagttagaaaaagaagttgcggagacacaacatggtactgtcctagtccaggtaaaatacgaagggacagatgctccctgtaagataccgatatcaacacaggatgaaaaaggagttacacaaaacggtcgtttaatcacagcaaatccgattgtgacagataaagaaaaacctgtgaacattgagacagaacctccattcggcgaatcttatatagtgataggagcaggggaaaaagctttaaagctgtcatggttcaaaaaaggatcaagtattggtaagatgttcgaagcaactgcacgaggcgcacgaaggatggctattttaggcgatactgcgtgggatttcggatcaatcggtggggtcttcacgtccgtaggcaaattagtgcaccaagtatttggtactgcatacggtgtgctatttagtggagtcagttggactatgaaaataggaatcggaatattactgacttggttaggactaaactcaaggagcacaagcttatcgatgacctgtattgccgtaggaatggtaactctttatttaggcgtaatggttcaggcggactcagggtgtgttataaattggaagggaagagaattaaaatgtggttctggaattttcgtaactaacgaggtacacacgtggaccgaacagtataaattccaggcagatagccccaaacgcttatccgccgcgataggtaaagcgtgggaagaaggagtatgtggcattagatcggcaaccagattagagaatataatgtggaagcagatttctagcgagcttaaccatatactattagaaaatgatatgaagttcaccgtcgtagtaggcgatgcaaacgggattctcacacaaggaaaaaaaatgatcagaccgcaacctatggagcacaaatactcatggaaatcatggggaaaagccaaaatcattggtgcggatactcaaaacaccacttttataatagatggtcccgatacacctgaatgtccggacgaccaacgagcatggaatatttgggaagttgaggactatggtttcggcgttttcacgactaatatatggctaaagctaagagatagttatactcaaatgtgcgatcaccgtttgatgagtgctgccatcaaagacagcaaggcagttcacgcagatatggggtattggatcgaaagtgaaaaaaacgagacttggaagctagcaagagcgagctttatagaggtaaaaacctgcatttggcctcgtagtcataccctatggtccaatggtgtattggaatctgaaatgattatacccaagatttacggtgggccaatatcacaacacaactaccgaccgggttattttacccagacagcaggcccatggcatctaggtaaacttgagctcgacttcaacctatgtgaaggaacaacagtagttgttgatgaacattgcggaaatcgtggccctagcttacgaacaaccacggtgactgggaaaataatacatgaatggtgttgcagatcatgtaccttacctccgttgcgttttaggggagaagacggatgttggtatggcatggaaatccgaccagtaaaagaaaaagaagaaaacctagtgcggtctatggttagtgctggtagcggagaagtagactccttttctctaggattgctatgtgtttctataatgattgaagaagtgatgcgttccagatggtcaaaaaaaatgttaatgaccggaactcttgcggtcttttttctgttaatcatgggacaattaacctggaatgatctaattcgactgtgtattatggtaggtgccaacgtttctgatcgcatgggaatgggaactacttacctcgctctcatggccacgtttaagatgcgaccaatgttcgccgtaggtctcctatttagaagattaaccagcagggaggttttactattaacgattggactctccttggttgcaagtgttgaattacccaatagtttagaagaacttggtgacggtttagcgatgggaatcatgatgttgaaactgctaaccgatttccagtcgcatcaactatggacaacattattatcgttgacatttataaaaaccacgctcagcttagattacgcatggaaaaccatggcgatggttttatcaatagtaagcctgttcccactatgtttaagtaccacttctcaaaagactacatggttaccggttttactaggatccttcgggtgcaaaccattaacaatgttcttaatcacagaaaataagatttgggggagaaagtcatggccactaaatgagggaataatggctgttggtatagtttccattcttctttcaagtctgttaaaaaacgatgtaccgttggcaggaccattgattgcgggcggaatgttgatagcttgctacgtaataagcggaagctcggcagatctaagcttagaaagagctgcagaagtgagttgggaagaagaggctgaacatagcggagcctcacataatatcttggtagaagtacaagatgatggcacaatgaaaattaaagatgaagaacgagatgacaccttaacaatactgctcaaggcgacacttttagcagttagcggagtatatccaatgagtataccagcaactttatttgtttggtacttctggcaaaaaaagaaacaaagatcgggtgtattatgggacacaccatcaccgcccgaagttgaaagagcagtccttgatgacggtatctatcggatactccagagaggactattgggtagatctcaagtcggagtaggagtctttcaagacggagtgttccacacgatgtggcatgtcacacgaggcgctgtgctgatgtatcaagggaaacgcttggagccaagttgggcatctgtaaaaaaagacctaatatcatatggaggaggatggcgttttcaaggctcatggaacactggtgaagaggtgcaagtaatagctgttgaaccaggaaaaaatccgaagaatgttcagactacgccgggaacttttaaaactccagaaggagaggtgggtgctattgcgttagacttcaagccgggaacatccggatcaccaatcgtcaatcgcgaaggcaaaatcgttggattatatggtaacggtgttgtaaccacatctggaacctatgttagcgcgatagcccaagctaaagcgagccaagaaggaccattaccggaaattgaggatgaagtatttaaaaaacgtaacttgacgataatggatctgcatccgggctcagggaaaaccaggcgctatctaccagcgatcgtcagagaagcaattaagcgcaagttacgaactttaatattagcaccaacaagggtagtcgcttctgagatggctgaagccttgaaaggtatgccgatcaggtaccaaaccactgcagttaagagcgaacatacgggaaaagaaatagtggatctaatgtgtcacgcaactttcacgatgcgattattatctccagtgagagtaccgaattataatatgatcataatggacgaagctcatttcacagatcccgctagcatagctgcacgcggttatatcagtacacgagtaggcatgggcgaagcagccgcaatattcatgacagcgacgcctccaggcagtgttgaagcatttccacagagcaacgccgtgattcaagacgaagagcgagacatacctgaacgttcctggaacagcggatatgattggataacagatttcccaggcaaaacggtgtggttcgtaccatcaattaaatcgggtaatgatatagccaattgcctacgaaaaaatggcaaacgagtgatccaacttagcaggaaaacgtttgatactgagtaccagaaaacaaagaataatgattgggattatgtagtgacaacagatatttcagaaatgggtgcgaactttcgcgcagacagggtaatcgatccgaggcgatgcttaaaacctgtaatattaaaagatgggccagaaagggttatcttagcgggtccaatgcccgtaacagcggcctcggcggcgcaaaggagaggtaggataggacgtaaccagaataaggagggagaccaatatatatatatgggacaacccttaaataacgacgaggatcacgctcattggacggaggctaaaatgttactagacaatatcaacactccagaaggtattattccagcactttttgaacctgagcgagagaaatcagcagccattgacggtgaatatcgtttgcgaggagaagccaggaagaccttcgtcgaactaatgaggagaggggaccttccagtatggctaagctataaagtagcgtctgagggatttcagtactcggatcgtcggtggtgctttgacggggaaagaaataatcaagtgctggaagaaaacatggatgttgaaatatggacaaaagaaggagaaagaaaaaaattacgaccaagatggctcgacgctaggacatactctgatccgctcgcattgagggagtttaaagaatttgccgcaggaagacgtagtgtctctggcgacctaattttagaaatcgggaagttaccgcaacacctcacgttgcgtgctcagaatgcgcttgataatcttgtaatgttgcataactctgaacaaggagggaaagcctacagacacgcaatggaggaactacctgataccatagaaaccttaatgttactcgcattgattgcagtattaaccggcggagtaactttattttttctaagtggtaagggtctagggaaaacgagcatagggctcctatgcgtaatggccagcagtgtcttattatggatggcctctgttgaaccacactggattgccgctagcataatattagaattctttttgatggttctacttatacccgaacccgaccggcaacgaacgccacaggacaatcaattagcgtacgtagtaattggacttttatttatgatacttacagtcgcggccaatgaaatgggactcttagaaactacgaaaaaagacctcgggataggacatgtcgtagcagaaaatcaccatcacgctacaatgttagatatagaccttcacccagcttcagcatggactttatacgcagtcgcaacaacaattattaccccgatgatgcgacatactattgaaaatacaactgctaatataagtttgactgcaatcgcgaaccaggcagccatattaatgggtttggacaagggttggcctatatcaaagatggacataggagtacctttactcgcattgggatgttatagccaagtcaatcctttgacattaaccgctgctgtcttaatgttagtagcgcattacgcaatcatcggaccgggattacaagcaaaagcaacaagggaagcacaaaagaggacagcagccggaataatgaagaatccaacagtagacgggatcgttgctattgacctagatcccgtagtctatgatgccaaatttgaaaagcaactaggacaaataatgttactaatactctgtacatctcaaatattgttaatgagaacaacgtgggcgttatgtgaaagtataacactggctacaggacctcttacgacgctgtgggaaggatcacctggcaaattttggaacacaactatcgcagtgtccatggctaatatatttcgcggatcatacctagcaggtgcggggctagcctttagtttaatgaaaagtctaggagggggacggagaggcacaggcgcacagggggagacccttggcgaaaaatggaagaggcagttaaaccaattaagtaagagtgagtttaatacctataaacgtagtgggattatggaagtcgatagatcagaagccaaagaagggttaaaacgcggggaaactacaaaacacgcggtatcgagaggaacggctaagcttaggtggttcgttgagagaaacctcgtaaaacctgaggggaaagtaattgatctgggatgtggcagaggtgggtggtcttattattgtgcgggtctgaaaaaagtaaccgaagtgaaaggttataccaaaggaggacctgggcatgaagaacctattccaatggccacatacggctggaatattgtcaagctacactcagggcgggacgtattctttacgcccccagaaaaatgcgatacactcttatgcgacataggtgagtcaagcccgaaccccactatagaggaagggaggacgttaagagttttaaagatggtagagccatggttaaggggaaaccaattttgtatcaaaattttgaacccgtacatgcccagtgtggttgaaacgctagaacaaatgcaacgtaaacatgggggaatgctagtaagaaatccattgtcaaggaattctacacacgaaatgtattgggtatcgtgtggtacaggaaacattgtatcggctgtaaacatgactagccgaatgttactaaatcgtttcacaatggcacaccgaaagccaacgtacgagcgtgacgtagacctcggagcaggaactagacatgttgcggtagaaccagaaatagctaacctagacattataggacaaagaatagaaaacataaaaaatgagcataagagcacatggcactacgacgaagataatccttataaaacatgggcctatcatggatcatatgaagttaaaccgtcgggatcagcaagttctatggtcaatggagttgtcagactattgacaaagccttgggatgtaataccgatggtaactcaaatagcaatgaccgatacaacacccttcggtcaacagagggtatttaaagaaaaagtagatacgagaaccccgagaccaaaaagaggaacagctcaaataatggaagtgacagctaaatggttatggggctttctctcacggaataagaaacccagaatctgtacccgtgaagaattcacaagaaaagtacgaagtaatgctgcaattggtgccgtatttgtcgatgagaatcaatggaattccgctaaggaagctgtagaagacgaaagattctgggacttagtgcatagagaaagagaattacataaacagggtaaatgtgctacatgcgtgtacaatatgatgggaaaaagggaaaaaaaactaggagagtttggtaaggcaaaaggatcccgtgccatatggtacatgtggttaggagccagattccttgagtttgaggcacttggtttcatgaatgaggatcattggttctcaagagaaaatagcctttccggcgtcgaaggagaaggcctacacaaactcggatacatattgagagatatatctaaaataccaggaggaaatatgtatgcagatgatactgccggatgggatactaggataacagaagatgatctgcagaacgaagcgaaaatcactgatatcatggaaccagaacatgctctacttgcaacaagtatctttaaattgacatatcaaaataaggtcgttagagtacaaaggcctgcgaaatctgggacggttatggatgttatctctcgcagagatcaaagaggttcaggtcaggtcggaacatacggattaaatacgttcacaaacatggaagtacagctaattcgccaaatggaatccgagggaatatttttgccaagcgaactagagaacagtaatctcgccgaaagagtattagattggctcgaaaaacacggggtagaaagacttaagagaatggctatttcaggagacgattgcgtagttaaaccgacagacgacaggttcgcaacagctttaactgcactaaatgacatgggaaaggtccgaaaggacattccacagtgggaaccttccaaaggctggaacgattggcaacaggttccattttgtagccatcactttcatcaacttataatgaaagacggacgcgaaattgtagtgccgtgcaggaaccaagatgaactagtaggcagagcacgagtctcacaaggtgccggatggtcattacgcgagactgcatgtttaggtaaatcatacgctcaaatgtggcagctaatgtattttcacagaagagatttaaggcttgctgcaaacgctatttgtagtgctgtaccggtaaattgggtccccacatcgcgaactacttggagtatacacgcccatcaccaatggatgactacagaagatatgttatccgtatggaacagagtctggatcgaagaaaacccatggatggaggacaagacacatgtatcatcgtgggaagatgttccatatcttggaaagagagaagaccaatggtgtggatcactcataggcctaaccgctagggctacttgggcaacaaacattcaagtagcaataaaccaagtacgcagattaattggaaatgagaattatttagactatatgacatcaatgaaacgattcaaaaacgaatcggatcctgagggggcactatggtaa

SEQ ID NO: 22106 - RNA, 9879 nt, synthetic construct
  misc_feature 1..9879: note = derived and/or modified CDS sequence (opt6) from DENV-1__KM403596__SS-prME
  source 1..9879: mol_type = other RNA
tcagtcactatgttacttatgcttttgccaactgcattagcattccatttaacaacaagaggaggggaacctcatatgatagtttcgaaacaagaaagaggaaaaagcctcctgtttaaaacgtcggctggtgtgaatatgtgcacacttatagctatggatcttggtgaactttgtgaagacacaatgacatacaaatgtcctcgcataactgaagcagaaccagatgatgtagattgttggtgcaatgctacagacacgtgggtcacgtatggaacatgtagtcaaacaggggaacacagacgcgatagaaggagtgtcgcactcgcaccacatgtgggattagggttggagaccagaacggaaacttggatgtcaagtgaaggtgcatggcgccagattcaaagagttgaaacgtgggcacttagacaccctggatttacggtgatagcgttgtttttggcgcacgccataggtacttcaattactcaaaaagggataatattcattttacttatgctagttaccccctcgatggcgatgcgatgtgtaggtattggtaatagagattttgttgaaggactatcgggagcaacatgggttgatgtcgtactagaacacggaagctgcgtaactacaatggccaaaaataaaccaacactagacatagagcttttaaaaaccgaagtaaccaaccccgcagtattaagaaaattgtgcatcgaggctaaaatatccaacaccacaactgatagtagatgtccgactcaaggagaggcaacgttagtagaagaacaagacgctaacttcgtatgtaggcgaacgtttgttgatagaggctgggggaacgggtgtggtttgttcgggaaaggatcactgttaacttgcgcaaaattcaagtgcgttacaaaactagaaggtaagatcgtacaatatgaaaacctaaagtattctgtgatagtcactgtgcacacgggggatcaacatcaagtcggaaatgaaactacggaacacggaaccatagcgaccataacgcctcaagctcctacaagcgagattcaactgacggactatggcgctttatcgctggattgtagcccccgaaccggattagactttaacgaaatggtattattaactatgaaagagaaaagctggctcgtccataaacaatggttcctagatttacccttaccttggacttcaggagcttccacgagccaggaaacttggaatagacaggacttattagtaacatttaaaacagcgcacgcgaagaaacaagaagtcgtagtgttgggttcacaggaaggcgcaatgcatacagcgcttaccggagccactgaaatacaaacatcagggactacaactattttcgcagggcacttaaaatgtagactaaagatggacaaattaaccctaaaaggcgtaagttatgttatgtgcacaggtagcttcaaattggaaaaagaggtagcggaaacccagcatgggacggttctagtacaagtcaaatacgagggtacagacgccccctgtaagatacctataagtacccaagacgagaagggtgtaacgcaaaacggtcgattgattacggctaatcctatcgtaacggacaaagaaaaaccagttaacattgaaatagagccacctttcggagagtcctacatagtaattggagctggcgaaaaagctctaaaattatcatggtttaagaaaggctcgtcaatcggcaagatgtttgaagcgacagccagaggagctaggaggatggccattctaggtgatacagcatgggatttcggatccatagggggagtatttacctcagtcggaaaacttgtacatcaagtttttggtacggcgtacggtgtactattttctggcgtttcctggaccatgaaaattggtattggcatcctacttacatggctaggtctaaattcgcgctcaacatcattgtctatgacgtgtatcgctgtggggatggtaactctttatcttggggtaatggttcaagcggattcaggttgtgtaataaattggaaaggcagagaattaaaatgcgggtcagggattttcgttactaatgaggtacatacctggacagagcaatacaaatttcaagcagattctcccaaaagattgtctgctgcaattggaaaagcgtgggaagagggcgtttgtggaatacgaagcgctaccagacttgaaaatataatgtggaaacagatctcaaatgaattgaatcacattttattagaaaatgatatgaaattcacagttgttgtgggtgatgcaaatggtatccttactcaaggcaagaaaatgattcgccctcaaccaatggaacacaaatactcatggaaatcgtggggcaaggctaaaattatcggagcagatacacaaaatacaacatttatcatagacggacctgatactccggaatgtcccgacgaccaacgagcatggaatatctgggaagtagaggattatggattcggcgtgtttacaaccaacatatggctaaaactaagagattcatatacacagatgtgcgatcatagactcatgtctgccgcaattaaggactctaaagcagttcacgcagatatgggttactggatcgaatcggagaaaaacgaaacatggaaactagctagagcgtcttttatcgaagtaaaaacctgtatctggccgcggtcgcatacactatggtcaaacggagtgctcgaatcggaaatgattatcccgaagatatatgggggtccgatctcacagcacaattaccgtccaggttacttcacacaaactgcgggcccatggcatctaggcaaattagaattagactttaacttatgcgaaggcacaacagtagtagttgacgagcattgcggaaatagaggaccatctttaaggaccactacggtcacgggcaaaataatacatgaatggtgttgtagatcgtgcacactgcctcccttgagatttaggggcgaagacgggtgttggtatggtatggaaattagaccagtaaaagaaaaagaagaaaatctcgtaaggtcaatggtatcagcaggatcgggtgaagtagactcattctctttaggattattatgcgtttcaataatgattgaagaagttatgagatcgagatggagtcgcaaaatgttaatgacagggactttggctatcttcttccttttaatcatgggtcaactaacatggaatgatctaattcgcttatgcataatggtaggagctaatgtctctgacagaatgggaatgggaacaacatatttggctcttatggctactttcaaaatgagaccaatgttcgctgtagggctattatttaggaggctaacttctcgagaagtgctattactaactataggcctatcgttagtagccagcgtcgaacttccgaactccctagaggaattgggagacggcctggctatgggtataatgatgctaaaattactaaccgacttccagtcacatcagttgtggacaacgctactgagccttacattcattaaaaccacactgtcgctagattatgcatggaaaaccatggctatggtgttgagtattgtgagcttattccccttatgtttaagtacaacttcgcagaaaactacatggttaccggtactacttgggtcttttggatgcaaacctttaacaatgtttctcataacagaaaacaaaatatggggaagaaaatcgtggccactaaatgaaggtataatggcggtcggaattgtatcaatcttgctatccagtctactgaaaaatgatgttccactagccggccctttaatagcgggtggaatgttaattgcatgctatgtcatttcaggatcttcggctgatttatctctagaacgtgcggcggaggtttcatgggaagaagaggcagagcattcaggagcttctcacaacatcctagtagaagtacaagatgatggtactatgaagatcaaagatgaggaacgtgacgatacactcacaattttattgaaagcaacactactcgccgtcagcggggtttatccgatgtcaattcccgctacacttttcgtatggtatttttggcagaagaagaaacaaaggtcaggagtgctatgggatactcccagtccgcccgaagttgagagggccgtactggatgatggaatctatagaatacttcaacgcggtcttctaggacgaagtcaagtaggagtaggcgtcttccaagatggtgtatttcatacaatgtggcacgtcacaagaggggcagtacttatgtaccaaggtaaaagattagaaccatcttgggccagcgttaagaaagaccttataagttatggtggaggctggagatttcaaggcagctggaatacaggcgaggaggtccaagttatcgcagtagaaccgggcaaaaatcccaaaaacgtgcagacaacaccaggaacatttaagactccggaaggagaagtgggcgccattgcgcttgattttaagccaggtacaagtggcagcccaatcgtcaatagggaaggaaagattgttgggctttatggtaacggggttgtaacaacgtccggaacttacgttagtgccattgcacaagccaaggcttcacaagaaggccctctgccagagattgaagacgaggtattcaagaaaagaaatttaacaattatggacctacaccctggctcaggcaaaactcggcgctatctacctgccatcgttagagaagcgataaaaagaaaactgaggaccttaatacttgctcccactagagttgtcgcttcagaaatggccgaagcactaaagggtatgccgataagataccaaacaactgcagtcaaaagtgaacatactggtaaagaaattgtggacttaatgtgccatgcaacatttaccatgcggctattaagtcccgtgagagtaccgaattataatatgataattatggatgaagctcatttcacagaccctgctagtattgcggcgagaggatatataagcacacgagtaggaatgggagaagccgctgcgatatttatgacagcgacacccccgggctcagtagaagcattcccacaatcaaacgcagtaatacaagacgaagagagggacatacccgaaagatcctggaatagtggatacgactggataaccgatttcccaggtaaaactgtatggtttgttccaagtattaaatctgggaatgacatagcgaattgtctacggaaaaacggtaagcgagtgatacaactctcgagaaaaacatttgatacagaatatcagaaaaccaaaaataatgattgggattacgtagtaacgactgacattagtgaaatgggggctaattttagagcagatagagtgatagacccccgtaggtgtttaaaacctgtcatactgaaagatggaccagaaagagtaatattagccggacccatgccagtaacagcggctagcgcagctcaaaggcgcggaagaatcggccgaaatcaaaataaagaaggagatcaatatatttacatgggacaaccattaaataatgatgaggaccatgcccattggactgaggctaaaatgcttctagataacataaataccccagaaggcataataccggcactctttgaacccgagcgcgaaaaatcggctgcaattgatggggaataccgcctacgtggagaggcgaggaaaacctttgtagaactaatgagaagaggagatctcccggtctggctatcatacaaggttgcaagtgaaggattccaatactccgatcgacgatggtgcttcgacggagagaggaacaatcaagtgctcgaggaaaacatggacgttgaaatatggactaaggaaggagagaggaagaaactacgtccccgttggctagatgcgcgtacatatagtgatccacttgcattgcgcgaatttaaagagttcgccgctggacgaagatccgtgtcgggagatttgattttagaaattggaaaattaccccaacatttaacacttcgtgcgcagaacgcgctagacaatcttgtgatgttgcataatagtgagcaaggaggtaaagcatatagacatgctatggaagaacttccggatacaattgaaacactaatgttactcgcccttattgcggtcttaacaggtggcgttacactattctttcttagtgggaaaggactcgggaaaacgtcaattgggcttctgtgcgtaatggcgagcagtgtactcctatggatggctagtgtagaaccacactggatcgcggcaagtataattctggagtttttcttgatggtcctactgattccagagcctgacagacaaagaacaccccaagataaccaactagcatatgtagtgataggactacttttcatgatactaactgtagccgcaaacgagatgggtctacttgagactacaaagaaagatttgggaataggccatgttgtagcagagaatcatcatcatgctaccatgttggacattgatctacacccggctagcgcttggaccttatacgctgtcgcgacaaccataattacccctatgatgcgacacaccatagaaaatacgacagcgaacatcagtttaacagcaatagctaatcaggcggcaatcctaatgggtctagataaaggatggccgatatccaagatggatatcggggtgccacttttagcactcggatgttatagtcaagttaacccccttaccttaactgccgcagttcttatgctggtggcacattatgcaattattggcccgggattacaagccaaggcaacgcgtgaggcacaaaaacgcactgctgcaggtataatgaaaaaccccaccgttgatggcatagtcgcaatcgatttagacccagttgtatacgatgccaaattcgagaaacagttgggtcagatcatgctgctaattctgtgcacaagccaaatactactcatgcggactacttgggcattatgcgagtctatcactttggccacaggaccattgaccacgctttgggaaggatcgcctggtaaattctggaacacgacgatagctgtatccatggctaatatttttagaggatcatatttagcgggcgcgggactagcattcagccttatgaaaagcctagggggcggacgtcggggtactggcgcacagggagaaaccttaggagagaaatggaaacgtcaattaaatcaactgtctaagtccgaatttaatacatacaaacgatcgggaataatggaggtagaccgaagcgaggcaaaagaaggtctaaaaaggggcgaaacgacaaaacacgctgtttccaggggcacagctaaattacgctggtttgtagaaagaaatttagtcaaaccagaaggaaaagtcatagatctgggttgcggaagaggcggctggtcatactattgtgcgggactaaagaaggttacggaagtaaagggctatacgaaaggcgggccaggtcatgaagaaccaattcctatggctacctatggttggaatattgtaaaactacatagcggtcgtgacgtattctttactccaccagaaaagtgcgatacactattgtgtgacatcggggaatcatcacccaatcccactatcgaggaagggaggacgttgcgcgtattaaaaatggtagaaccatggttaagaggaaaccaattctgtattaaaattcttaacccatatatgccttcagtagtagaaaccttagagcaaatgcaaagaaaacatggaggaatgttagtacgcaatccactatctagaaactccacccatgaaatgtattgggtcagttgcggaactggtaacattgtgagcgcagtaaacatgacttcccgaatgctgttaaaccgatttactatggcacatcgtaaacccacatatgagcgggacgtagatttaggggccggcacaagacatgttgcggtcgaaccagaaaccgcaaacctggatatcataggccaaaggattgaaaatatcaaaaacgagcacaagtctacatggcactatgatgaagataacccatataaaacatgggcatatcacggatcttatgaagtaaaaccaagtggttcggcgagctcaatggtgaatggcgtagtgaggcttttaacaaaaccatgggacgtgattccaatggtaactcaaattgcaatgactgataccacgccattcggacaacaaagagtctttaaggaaaaagtagacacaaggactccacggcccaaaaggggaaccgcacaaataatggaagtaacagcaaaatggttatggggctttctttcacgaaataaaaagcctcgaatatgcactcgagaagaatttactagaaaagtccgaagcaatgcggcaataggcgcagtattcgtagacgaaaatcagtggaactccgctaaagaagcagtggaggacgaaaggttctgggacctagttcatcgcgagcgcgagctccacaagcaaggaaagtgcgctacatgcgtctataacatgatgggtaaaagggagaagaaattgggtgaatttgggaaggctaaaggatcacgggcaatctggtatatgtggctcggagctagattcctcgagttcgaagctctgggtttcatgaatgaagaccattggttttcacgagaaaattctttatcaggtgtggaaggagaaggcctacacaaacttggatatatattaagagatatctccaagatacccggaggaaatatgtacgcagatgacacagcaggatgggacacccgtataacagaggacgatctccagaacgaggctaaaataacagacattatggaaccagaacatgcgttactggcgacatctatatttaaacttacatatcaaaataaagtggttagggtgcaacgtccagcaaaaagtggaaccgtcatggatgtcataagcaggcgagatcagaggggttcaggtcaagtaggtacatatggattaaacacctttacaaacatggaagttcaattaataagacaaatggaatctgaaggcatctttagcccaagtgagttagagaacagtaaccttgctgaacgagtcttagattggctcgagaagcacggcgtagagagactaaaacggatggcaatcagcggagacgactgtgtcgtaaaacccacggatgatagattcgcaaccgccttaactgctttaaacgacatgggaaaggttagaaaagacataccccaatgggaaccgagtaaagggtggaatgattggcaacaggtaccattctgcagccaccactttcatcaactgataatgaaagatggaagagaaatagttgttccatgtagaaatcaagatgaattggtaggtcgagcacgagtaagtcaaggagctggttggagtctaagagagacagcctgtttagggaaaagttacgcccaaatgtggcagttaatgtactttcatagaagagatcttagactcgcggcaaatgctatatgttcggcagttccagtaaattgggtccctacttctcgaacgacgtggtctatacatgcgcatcatcagtggatgacaactgaagatatgttgagcgtgtggaatcgtgtctggattgaagagaacccttggatggaggataagactcacgtatcgtcgtgggaagatgtaccgtacttaggcaaaagggaggatcagtggtgtggatcgctaatcggacttacagccagagctacatgggccacaaacattcaggtagctatcaatcaggtacgccgtctcataggtaatgagaattatctagactatatgacaagcatgaagagattcaaaaacgagtcagatcctgagggcgctctctggtga

SEQ ID NO: 22107 - RNA, 9879 nt, synthetic construct
  misc_feature 1..9879: note = derived and/or modified CDS sequence (opt6) from DENV-1__KM403616__SS-prME
  source 1..9879: mol_type = other RNA
tcggtgactatgctattgatgttactgccaactgcgttggcgttccaccttacgactcgagggggagaacctcacatgatagttagtaaacaggaacgtggaaaatctttgttattcaaaacaagtgctggcgtaaatatgtgtactttaatagcaatggatcttggggaattgtgtgaagatacgatgacatataaatgtcctaggatcacagaagctgaaccggatgatgttgactgttggtgcaacgcgacagacacttgggtaacatatggaacatgttcacagacaggtgaacaccgcagagataaacgtagtgtagcgctcgcacctcacgtgggcttggggctcgaaacaaggacagaaacatggatgagttcagaaggagcatggcgtcaaatacagaaagtcgaaacatgggccttaagacaccctggcttcactgtaatagcactatttttagctcatgcaatagggaccagcatcacacaaaaaggtattatctttatcttgcttatgcttgtcaccccttctatggcaatgcgttgtgttggtattgggaatagagacttcgtcgaaggattaagtggtgcaacatgggttgatgttgtattagaacatggatcttgtgttacaactatggcgaaaaacaagccaaccctggatattgaacttttaaagactgaagtgactaacccagcagtattacgtaaactttgcatagaagcaaaaatatctaacacaactaccgactccagatgtccaacacaaggagaagcgacgctagttgaagaacaagatgcaaacttcgtatgcagacggacttttgttgatagaggatggggaaatggttgtgggttatttggaaagggctcgctgctaacttgtgcaaaattcaagtgtgtaaccaaacttgaaggaaaaattgtccaatacgaaaatttaaagtactcggtagtcgtgaccgtacataccggtgatcaacatcaagttggaaacgaaactacagaacacggaactatagccacaataactccacaggctcctacaagtgaaatacaactaacggactatggagctttaacgcttgattgtagcccacgtacaggtttagacttcaatgaaatggttttactaaccatgaaagagaaaagctggttagtacacaagcagtggtttttagatttaccactcccatggacgtcaggcgcttcaaccagtcaagagacctggaatagacaagaccttttggtaacatttaaaacagcacatgccaagaaacaggaagtggtagtgctaggaagccaagaaggtgccatgcatacagcattgacaggagcgaccgaaatacaaacttcaggaacaacaacaatctttgccgggcatctaaaatgtaggttaaaaatggataaattaacgctaaaaggagtatcttatgttatgtgtactggatcgtttaaacttgaaaaggaagttgcagaaacacaacacggaactgtactggtacaagtaaaatacgaaggtaccgacgcaccatgcaagataccaataagcacccaagacgaaaaaggagtaacccagaatggaagactaataacagctaacccgatagtcacagacaaggaaaagccagtcaatattgaaacagaaccaccattcggggaaagctacatagtaataggagctggtgaaaaagcattgaagctgtcgtggtttaaaaagggaagctcaattgggaaaatgtttgaggcgacagctaggggcgcaagaagaatggccatcttaggtgacacagcttgggatttcgggagtattggaggagtatttacatctgtaggtaaacttgtgcatcaggtctttggaacggcgtatggggtcctgtttagtggagtttcatggacaatgaaaatagggataggcattctcctaacttggttaggattaaattccagaagtacatcattatctatgacatgtatagcagtggggatggtgacactatatctcggtgttatggtacaagctgactcaggatgtgttatcaattggaagggacgggagctcaaatgtggatctggaatattcgtaaccaatgaagtgcacacatggacggagcaatacaaatttcaagcagatagtccaaagagacttagcgcggccatcgggaaggcgtgggaggaaggtgtttgcggtatacgatctgctacaagattggaaaatattatgtggaaacaaatttctaatgaattgaatcatatcctgttggaaaatgatatgaaatttacggtggtggttggagacgcaaatggtatattaactcaaggaaagaaaatgatcagaccacaacccatggaacacaagtatagttggaaatcatggggaaaagccaaaatcataggagcagacacacaaaatactacatttataatagatgggcccgatacaccagaatgtcccgacgatcaacgagcatggaacatatgggaagtggaagattacggatttggcgtcttcaccacaaatatatggttaaagttacgagattcctacacacaaatgtgtgaccaccgattgatgtcagcggctatcaaagactctaaagcagtgcatgcagacatgggatactggattgaatctgagaaaaatgaaacctggaagttagctcgtgcgagctttattgaggtaaaaacttgtatatggccgagatcacacacactatggagcaatggagtattggaatccgagatgatcatacctaagatttacggcggaccgattagtcaacataattatcgccctggctactttacgcaaaccgcagggccatggcacctcggaaaacttgaactagattttaacctttgtgagggaacgacggtagtagtagatgaacactgcgggaatcgcggtcctagtttacgaacaacgacagtaacagggaaaatcatccatgagtggtgttgtagatcttgtaccttaccacctttacgttttcgtggcgaggatgggtgttggtacggtatggagattcgtcccgtaaaagagaaagaagaaaatctcgttaggtctatggtctccgcgggaagtggcgaggtggatagttttagcttaggactactatgcgtatccattatgatagaagaagtcatgaggagccgctggtctagaaagatgctgatgactggtacgttagccgccttctttctcttgataatgggacaattaacatggaatgatttaataagactatgcataatggtaggggcaaacgtaagcgatagaatgggtatgggtaccacgtacttagcgctaatggctacgttcaaaatgcgaccgatgtttgcagtaggcttattatttagaaggttaacgtcgagagaagtgctactactaaccataggtctttccttagttgcttcggttgaactaccgaatagcttagaggagctaggagatggactagcaatgggtattatgatgttgaagttactaacagatttccaaagtcaccaattatggactaccctattaagtctaacatttattaaaacaactttatccctagattatgcctggaagactatggcgatggtattatccatagtatccttgtttcccttgtgtctaagcacgacgtcacagaaaactacatggctcccagttctattagggagctttgggtgtaagcctctaacaatgtttcttattaccgagaataaaatatggggtaggaaatcatggcccttgaatgaaggcataatggctgtaggtatagtgtccatactgctcagttcattacttaaaaatgatgttcccttagccggaccccttatagcgggcgggatgctaatcgcctgctacgtaattagtggcagctcggcagacctatccctagagagagcggccgaagttagttgggaggaagaagctgaacatagtggcgccagtcacaatatattagtcgaagtacaagacgacggtaccatgaagataaaagatgaggaacgagatgacaccctaacgatcctcttaaaagcaactctgttggccgtgtccggagtttaccccatgtcgattccagcaacactattcgtatggtatttctggcaaaagaagaaacaacgctctggagtcctctgggatacacctagtccccctgaagtagaaagagctgttcttgatgatggcatttacaggattctgcaaaggggactattgggacggagtcaagtaggagtaggagtatttcaagacggagtgttccatactatgtggcatgttaccagaggagccgtattgatgtatcaaggcaaacggctagaaccttcatgggcaagtgtcaagaaagacttgatatcgtacggtgggggctggagatttcaaggttcatggaacaccggtgaagaagtacaagtcatagctgttgagccgggtaaaaaccccaaaaacgttcaaaccacaccagggactttcaagacgcccgagggcgaagttggggcgatagcactagacttcaaaccaggaacaagtggatcaccgatagtaaacagagagggtaagatcgtaggattatatggaaatggagttgtaacaacttccggaacatacgtctcagcaatcgcgcaagcaaaagcctcacaggaaggtccattacccgaaatagaagacgaagtttttaagaagcggaacctaaccattatggatcttcatccaggaagcggaaaaacaagacgttatttaccagcgatagtcagggaagctataaaaagaaagctacgaaccctaattctcgcccctacacgggttgttgcatccgaaatggcggaagccttaaaaggtatgccaataaggtatcaaacgactgctgttaagtccgaacatactggaaaagaaatagtagatctgatgtgccatgcaacctttactatgcgactgttaagcccggttagagttccaaactacaatatgataataatggatgaggcacattttacggacccggcatcgattgctgctcgtggttatatatccacgagagtaggtatgggagaagccgctgcaatttttatgaccgctacgcctccaggtagcgtggaggctttccctcagtcgaatgcggttattcaagatgaggaaagagatataccagaacgttcatggaactctgggtatgattggataaccgattttcctggaaaaactgtgtggttcgtacccagcattaaatcaggcaatgatattgcgaattgccttcgaaagaatggaaaacgggtaatacaactatcgcggaaaacgttcgatactgaatatcagaaaactaaaaacaatgattgggactatgtagtaacaacagatatatcggaaatgggggcgaattttcgcgcagatcgcgtgattgacccaagaaggtgtcttaaaccggtcatcctaaaggacgggccagaaagagtaatcctcgcaggacccatgcctgtaacggctgcttcagcggctcaaagacgaggtcggatcggacgaaatcaaaataaggaaggagatcaatatatatacatggggcaaccactcaataatgatgaagaccatgctcattggacagaagctaagatgctacttgataatataaatacacctgaggggattatccccgcactttttgaaccagagagagagaaaagcgcagcgattgacggagaatacaggttgaggggagaagcgcgaaagacatttgtggagctaatgagaagaggagacttgcccgtctggcttagctacaaggtagcctccgaaggatttcagtactctgaccgaaggtggtgtttcgacggagaaagaaacaaccaagtgttagaagaaaacatggatgttgaaatatggactaaagagggagagcgaaagaaactaagacctagatggctcgacgcaagaacgtatagcgatccacttgccctacgcgagttcaaagaatttgctgcgggtcgaagatccgtaagtggagacctaattcttgagattggaaaactacctcaacatttaactttacgagcccagaatgctttagacaacttagtcatgttacacaattcagaacaagggggtaaagcgtaccgccacgccatggaggagctgcccgatacaatcgaaactttaatgttattagcactcatagcagtgctaacgggcggtgtaacgttgtttttcttaagcggtaaagggttaggaaaaacatccataggcttactatgtgtcatggcttctagtgtcctattatggatggcatcggtcgagccgcattggatagcggcgtctattatcctagagttctttctaatggttttactcataccagaaccagatagacaaagaacaccgcaagataaccagttggcgtacgtggtgatcggattacttttcatgatactaacagtagctgcaaatgaaatgggtctacttgagaccacaaagaaagatctcggaataggacacgtagtggccgaaaatcaccaccatgcaactatgctagatattgatttgcacccagcatcggcctggactctatatgctgtagccacaaccataatcacgccgatgatgcggcatactattgaaaacaccactgcgaatattagtttaacggctattgccaaccaagctgcaatcttaatgggtctcgacaagggttggccaatatcaaaaatggatataggagtccccctactagcgctcggttgctattcccaagtcaacccactcacattaacggctgcagtattgatgcttgtggctcattatgccataatagggcccggtctccaggcaaaggcaacgcgtgaagctcaaaaacgcactgcggcaggaataatgaaaaatccaactgttgatggtattgtggcgatagatcttgatcccgttgtgtatgacgcaaaatttgaaaagcaactaggacaaataatgttgttgatactgtgcacatcacaaatattattgatgcgaacaacatgggcattatgtgagagcattacattagccacgggtccgttaactacactatgggagggttccccaggaaaattttggaatacaacaatagccgtatcaatggctaacatttttcgcggaagttacttagcaggggccggcttagcattctcgttaatgaaatccttaggcggaggaagaagaggtacgggtgcgcaaggagaaactttgggggagaaatggaaacgacaacttaaccaactaagcaaaagcgaatttaacacttacaaaaggtctggcataatggaagttgataggagcgaggcaaaggaaggactgaaaagaggtgaaacaactaagcacgccgtctcaagggggactgccaaactccgatggtttgttgaacgtaatctagtaaaacccgaaggaaaagttatagatcttggatgtggccgcggtggatggagttactactgtgcaggcttgaagaaagttacggaagtaaaaggttacactaaaggaggaccaggccacgaagaacctatcccgatggcgacatatggatggaatatagtcaaactgcattctggtcgcgatgtattctttactccacctgaaaagtgcgatacgttactgtgcgacatcggagaaagcagtccaaatcccaccatcgaggagggtaggacacttcgagttctaaaaatggtggaaccttggctacgaggaaaccaattctgcattaaaatacttaatccctatatgccgtctgtagtagagacgcttgaacaaatgcaacgtaaacacggtggtatgttagtcaggaatcctttaagtcgaaactcaactcatgagatgtattgggtatcctgtggtacgggaaacatagtatcagcagttaatatgacttccagaatgctcttaaataggttcactatggcacatcgaaagcccacttacgagcgagatgtggaccttggagctggaacacggcacgtagccgtagagccagagatcgcaaatctagacattataggtcaaagaatagagaacattaagaatgaacacaaaagcacatggcattacgatgaggataacccgtataagacttgggcataccatggctcatacgaagtaaaaccttcgggcagtgcttcaagtatggtaaatggtgtcgtacgactacttactaaaccatgggatgtaattcccatggtcacacaaatagctatgacagacacaacccccttcgggcagcagcgtgtttttaaagagaaggtagacacgagaacaccacggccaaaaaggggaactgctcaaataatggaagtaacagcaaagtggctctggggattcttgtcgcgaaacaaaaagcctcgaatctgtacaagagaagaatttacacgaaaggttagatcaaatgctgctataggtgcagttttcgtagatgaaaatcaatggaactccgctaaagaggcagttgaagacgaaagattttgggacttagtacatagggaaagagaacttcataagcagggaaagtgcgcaacatgtgtatacaatatgatgggtaaacgagagaagaaactaggcgagtttggtaaagctaaagggtcaagagcgatctggtacatgtggctcggagcaagatttctcgagtttgaagcgttaggattcatgaatgaagatcattggtttagtagggaaaacagtcttagcggcgtagaaggagaggggcttcataaattgggttacatcctccgtgatatttccaaaatacctggtggtaacatgtatgccgatgacactgctgggtgggatacccgaataactgaagacgacttacaaaatgaagcaaaaattacagacatcatggaaccagaacatgcgctactcgcgacctccatcttcaagttaacttatcagaataaggtagtaagagtacagagaccagcaaaaagcggaaccgtaatggacgtgatatctagacgtgatcagagagggagtggacaagtaggtacctatgggttaaatacatttacaaatatggaagtccaattaatacgacaaatggagtcagaaggaatcttttcaccgtcagaacttgaaaactccaatttagctgaaagggtactagattggctagaaaaacatggtgttgagagacttaaacggatggcgatatctggagatgattgtgtcgtaaaacctacggatgatagattcgcaacggcattaactgctttaaatgatatgggcaaagttcgaaaggatattccacaatgggaaccaagcaaaggctggaacgattggcagcaagtaccattttgctcgcatcacttccatcaattgataatgaaagatggacgtgaaatagtcgttccatgtagaaatcaagacgagttagtgggtagggcccgggtatcccaaggagcagggtggtctctcagagaaacagcttgtctaggtaagagttatgctcaaatgtggcaacttatgtatttccaccgaagagacttgaggttggctgcaaatgcaatctgtagcgcggtgccggttaactgggtaccaacatctagaaccacctggtccattcatgcccatcaccagtggatgacaactgaggacatgctatctgtatggaacagagtctggattgaagaaaatccttggatggaagacaagacacatgtgtcatcttgggaagatgtaccatacttaggaaaacgagaagaccaatggtgtggtagtttaattggactaacagcacgcgcaacatgggctactaatattcaagtagcgatcaatcaagtgaggagattaatagggaacgaaaattacttagactacatgacaagtatgaaacgttttaaaaatgaaagtgatccagagggggctctctggtag

SEQ ID NO: 22108 - RNA, 9879 nt, synthetic construct
  misc_feature 1..9879: note = derived and/or modified CDS sequence (opt6) from DENV-1__KM403617__SS-prME
  source 1..9879: mol_type = other RNA
tccgttacaatgcttttaatgttgttaccaactgcactagcatttcacttaacaacaaggggaggagaaccacacatgatcgtcagtaaacaagaacgaggaaaatcacttttatttaaaacaagtgccggtgtgaatatgtgtacactaattgctatggacttaggtgaactgtgtgaagatacaatgacttataaatgtcctcggataacagaagcagaaccagatgatgtagattgctggtgtaatgcaacagatacctgggtaacatacgggacttgtagtcaaacgggagaacataggcgagacaaaaggtcagtagcactcgctccacacgtaggattgggacttgaaactagaacagaaacttggatgagcagtgagggtgcttggcgtcaaatacaaaaagtagaaacgtgggccttaaggcatcctggcttcactgtaatagcgctatttctagctcatgcaataggcacgagcatcactcaaaaaggtatcattttcatcttgttaatgctggtaacaccaagtatggcaatgaggtgcgttggaatcggcaacagagatttcgtagaaggtttatcaggagctacgtgggtagacgtagtacttgaacacggctcatgtgttacaacaatggccaaaaacaaacccacactagatatagaacttttaaaaaccgaagttactaaccccgcagtactaaggaaactctgtattgaagccaaaattagcaatacaacaaccgacagccgatgccctactcaaggggaagccacacttgtggaggaacaagatgcgaatttcgtatgcaggaggacatttgtggatcgcggttggggtaatgggtgtggtttatttggcaaagggtctctccttacttgcgccaaattcaaatgtgtaactaaattggagggcaaaatcgtacaatacgaaaaccttaaatattctgtggtagtgaccgtgcataccggtgaccagcatcaagtaggaaatgaaacaacagagcatgggacaatagcaacgatcacaccccaggctcctacaagcgaaattcaactaacagactacggagctttaacactagattgctctcctagaacaggattagattttaacgaaatggttctgttgacgatgaaagagaaaagttggctcgtccacaaacaatggttcctggatttaccactaccatggacgagtggagcatcaacctctcaagaaacatggaatcgacaagaccttcttgtgacgttcaaaaccgcacatgctaagaaacaagaggttgtggtgttagggagtcaagaaggcgctatgcatactgctctcacgggagcaaccgagattcagacaagtggaactacgacaatattcgccgggcatttgaaatgtagactgaaaatggataagctaacgttaaaaggggtatcttacgtcatgtgtaccggttcattcaaactggaaaaagaagtagcagaaacacaacacggaaccgtactcgtacaagtaaaatacgaagggacagacgcaccatgtaagatcccaatttcaactcaggatgaaaagggcgtcacccaaaacggccgcctcataacggcaaatccaattgtgaccgacaaagaaaaaccggtaaatatagaaacggaacctccattcggtgagtcttacatagtgattggagcaggagagaaagcacttaagttaagttggtttaaaaagggatcaagcattggtaaaatgtttgaagctacagcacgaggagctcgaaggatggccattctaggagacaccgcgtgggatttcgggtccataggcggtgttttcacgtctgtgggtaagctagtccatcaagtattcggaaccgcctatggagtgctattttccggagtgtcctggaccatgaaaatagggatcggtatattgctcacctggctaggactaaattctagaagtacgtcgctatctatgacatgtatagcggtaggcatggttacactctatttgggagtcatggtacaagctgattcaggttgtgtaatcaactggaagggtcgagaactaaaatgcggatctggaatattcgtcactaacgaagtccatacatggacagaacaatacaaatttcaagcggattctccaaaaagattaagcgcagcaataggaaaggcgtgggaagaaggagtatgtggcattcggtcggccacaaggttagaaaatatcatgtggaaacaaatatcaaatgaattaaatcacatactattagaaaatgacatgaaattcacggtagtcgtaggcgatgcaaatggaatacttacgcaaggcaagaaaatgataagacctcaaccgatggaacataaatactcctggaagagttggggcaaagccaaaataataggagctgatacacaaaacacgacttttataatagatggccccgatacaccagagtgcccggacgaccaacgcgcatggaatatatgggaggtggaggactatggattcggtgtatttaccacaaacatatggttaaaattaagagactcatatacacaaatgtgtgatcatagactaatgagcgctgcgattaaagattccaaagcagttcatgctgacatgggttattggatagaatctgagaaaaatgaaacttggaaattggcaagagcgagctttatcgaagtaaaaacctgtatttggccgagaagtcacacactatggtcgaacggagtactagaatcagaaatgatcataccaaagatatacggaggtccaatctctcagcacaattatcgtccaggatacttcactcaaaccgcagggccttggcacctggggaaacttgaactagatttcaatctttgcgagggaactaccgtggtcgtcgatgagcattgtggaaatcgaggtccctccctcagaactacaactgtcaccgggaaaataatacatgaatggtgttgcagaagttgcacactacccccgctacgctttagaggagaagatggttgttggtatggcatggaaattaggcctgttaaagaaaaggaagaaaacttggtaagatccatggtgtcggcagggtcaggggaagtagacagtttttcacttggtttgctttgcgtaagtattatgatcgaggaggtgatgaggagccgctggagtcgcaaaatgctcatgacgggtacattggcagtattctttctactaattatgggtcagttgacttggaatgatctgattagattatgtataatggtaggcgccaacgttagtgatagaatggggatgggaacaacataccttgccttaatggcaacatttaaaatgcgacccatgtttgcagtaggtttgttatttagacgactaacaagtagggaggttctcttacttacaattggtttgtccttagtagcatcagtcgaactacctaatagtctcgaagaattgggggacggactcgctatgggtatcatgatgttaaaattactaactgattttcagagtcaccaactatggaccacactgttgtctttaacatttataaaaacaactctgtcactcgattatgcatggaaaacaatggctatggtgctatcaatagtatcactatttccgctttgtctttctactacgtcacagaagactacctggttaccagtattactaggctcatttgggtgtaaacctctaaccatgttcttaataactgaaaataagatatggggcagaaaaagctggcctttgaacgagggtataatggcagtaggtatcgttagtatcctattgtcatctctgttgaaaaatgatgtcccgttggcaggaccacttatagcgggtggaatgctaatagcatgttatgttattagtggttcaagcgcagacttgagcttagagcgggcagcagaagtaagctgggaagaagaggcggaacacagtggtgcgagtcataatatattagtagaagttcaagacgatggtaccatgaaaattaaggacgaagagagagatgataccctaactattttattgaaagctacccttctcgcagtgtcaggagtttaccccatgtcgatacctgcaacgctttttgtgtggtatttctggcagaagaagaaacaacgcagcggagtgctgtgggataccccatctccaccagaggtagaaagagctgtattagacgatggcatatacaggattctacaacgcggattactcggaagatcacaagttggagttggcgtattccaggatggagtgttccatacaatgtggcatgttaccagaggagcggttctaatgtatcagggaaaacgcctagaaccatcttgggcatcagtaaagaaggacctgatatcatatggaggtggttggcgattccaaggctcttggaatacaggagaagaggtacaagtaatagccgttgaaccgggaaagaatcccaaaaatgttcaaactacaccagggacattcaaaactcctgagggagaggttggagcaattgcactcgacttcaagcccggtacaagcggctccccgatagtcaacagagaaggcaaaatcgtgggattatatgggaacggcgttgtaacaacctcaggaacttatgtaagtgctatagctcaagccaaagccagtcaggaaggaccgttaccagaaattgaagacgaagtctttaagaaaaggaatctaactataatggacctccatcccggtagcggcaaaacacgcagatatcttcctgcaatagttcgtgaggcgattaaacgaaaactaagaaccttgatactagccccgacgagggtggtcgcatcggaaatggctgaagccctcaagggaatgccaatcaggtaccaaacaacagcagtgaaatcagaacatacgggtaaagaaatagtcgacttgatgtgccacgcaaccttcactatgagattattatcaccggtaagagtccccaattacaacatgataataatggatgaagcacattttacagatccagctagcattgcggcacgaggatacatttcaactcgagtcggtatgggcgaagccgcagctatatttatgacagcgactccacccggatctgttgaggcattcccccaatccaacgcagtcatacaagacgaagaaagagatatccctgaaagatcgtggaactcaggttacgattggataacggattttccaggtaaaacagtctggttcgtgccatcaattaaaagtggcaacgacattgcaaattgcctcagaaagaatgggaaaagagtgattcagctgtcaaggaagaccttcgacacggaataccagaaaacgaagaataatgactgggactacgtagtaactaccgatatttctgaaatgggcgctaattttcgagccgaccgggttatcgatccacgaagatgtctaaaacctgttatcttaaaagatggcccggagcgagtaatattggcggggcccatgccagttactgcagctagcgccgcacaacgaagaggcagaataggaaggaaccaaaacaaagaaggtgatcaatatatatatatgggacaacctctgaacaatgacgaagatcacgcgcactggacggaagctaaaatgttattggacaacataaatacgcctgaaggcatcataccagcacttttcgaacctgagcgggagaaaagcgctgccatagatggtgaatacaggttgagaggagaagcccgaaaaacttttgttgaactaatgcgacgcggcgacctaccagtgtggctaagctataaagtagccagcgaaggctttcagtacagcgatagaaggtggtgcttcgatggagaaagaaacaatcaggtattagaagagaacatggatgttgaaatatggacgaaggaaggcgagcgaaagaaattaagaccaagatggcttgatgcacgcacgtactccgacccactagctctaagagagtttaaagagtttgcggcaggtaggagaagcgtatcaggtgatttgatactagaaatcggaaaattacctcaacaccttacgctccgtgcacaaaatgcgcttgataatctagtaatgttacataactctgaacaaggaggcaaggcttatcgacacgcgatggaagaattacctgacacaattgaaactttaatgttacttgccttaatcgctgtattaacgggaggagtaacattattctttctctcaggaaaaggtcttggaaaaacaagtattggattactctgtgtaatggcatccagtgtcctgctatggatggcttcagtagaaccccactggatcgcagcctctataatactagaatttttcctaatggtgcttcttattcctgaacctgaccgacaaagaacgccacaagataaccaacttgcatacgttgtaattggacttctgtttatgatactaactgtagcagctaacgaaatgggtttactagaaaccaccaagaaagacttaggtataggacatgtagtggcagaaaatcatcaccacgccacaatgttagacatcgatttacacccagctagtgcgtggactctctatgcagtggcgactacaataataacacctatgatgcgacataccatagaaaatacaactgcaaatatctcgttaacagctatagcaaatcaagctgcaatactgatggggttagacaaaggatggccgatttccaaaatggacatcggagtaccgttgttagcactgggttgttattcccaagtcaacccactaactctgactgcagctgtacttatgctagttgctcattatgctattattggacctggcctacaggcaaaagctacacgagaagctcagaagcggacagcagcagggataatgaaaaatccaactgtagacggaattgtcgccatcgatctagatcccgtagtttatgacgcaaaatttgaaaaacaacttgggcaaattatgctgttaatcttgtgtaccagccaaatactcttgatgagaacaacctgggccctctgcgaatcgatcacattagcaactggtccgttgacaacgttgtgggaaggcagtccaggaaaattctggaacactacaattgcggttagcatggcgaacatatttcgaggcagctatctcgcaggagctggtttagcattttctttaatgaaatccttagggggaggacgacgcgggacgggagcgcagggcgagacccttggggaaaaatggaaaagacagctaaaccaactctccaaatcagagttcaacacatataaaaggagcgggataatggaagtagacagatcagaggcaaaagaaggactaaagcgaggagaaactacgaaacatgctgtaagccgaggaaccgcaaagttaagatggtttgtggagagaaatttagtgaaaccagagggaaaagtcatcgatttaggatgcggcagaggaggatggtcgtattactgtgcgggactgaagaaagtaactgaagtaaagggatatacaaaagggggtccgggtcacgaagaaccaatacccatggctacgtatggctggaatatcgttaaacttcatagtggaagagatgtcttctttacaccaccagaaaaatgtgatactctcttatgcgatataggggagagttcaccaaacccaactatagaggaaggccgcacactaagagtcctcaaaatggtcgaaccatggttgcgaggcaaccaattctgcataaaaattctaaacccctacatgccgtcggtggtagaaacattggaacaaatgcagagaaagcacggagggatgctggtgcgcaacccattatcaagaaattccacgcatgaaatgtattgggtaagttgtggaactggtaatattgtatcggccgtaaacatgacgtctagaatgttgttgaatcgattcacaatggcccacagaaagccaacatatgagcgggatgttgacctcggggcagggactagacatgtagcagtagagccagaaatcgcaaatttagatataattggacaacgaatagaaaacatcaaaaatgaacataaaagtacgtggcactatgatgaggataatccatacaaaacctgggcatatcatggtagttatgaagtcaaaccgtcaggttcggcaagctcaatggtgaacggcgtagtgagattgctaactaagccatgggatgtaatccctatggtgacacaaatcgcaatgacagatacgacaccttttggccagcaacgagtatttaaagaaaaagttgatacccgaacaccaagaccaaagcgaggaacagcacaaattatggaagtcactgcaaaatggttatggggattcttatcgcgtaataagaaaccgcgaatatgcacgagagaggagttcacccgtaaggttcggtctaatgcagcgataggtgcggtgtttgtagacgagaatcaatggaacagcgcgaaagaagccgttgaagatgaacgattttgggatttggtacacagggagcgagaattacataaacaaggcaaatgcgcaacctgcgtatacaatatgatgggtaaaagagagaagaaactcggcgagttcggaaaagccaaaggttcgagagcaatatggtatatgtggttaggagccagatttttagagtttgaagcactaggtttcatgaatgaagatcactggttttctcgagagaactctttgtcaggagtagaaggtgaaggattgcataaacttggatacatacttagagatatatcaaagataccaggtggaaatatgtacgcagatgacacagcgggttgggacacaagaataactgaagacgacctccagaatgaggcaaagattaccgatatcatggagccagaacatgcattacttgctacgtcaatatttaaactaacttaccaaaacaaggtagtgcgtgtacaaagacccgctaaatccggaactgtcatggacgtaataagtagaagggaccaaagaggatccgggcaagtgggaacatatggacttaatacctttacaaatatggaagttcaattgattcgtcaaatggaatcggaaggtatattttctcctagcgaacttgaaaactcaaatcttgccgaaagagttctagattggcttgaaaaacacggagttgaaagactaaaaagaatggcaattagtggggacgattgtgtagtgaaacctacagacgataggtttgcaacggcgctaactgcattaaatgatatgggaaaagtcaggaaagatattcctcagtgggaaccgtccaaaggatggaacgactggcagcaagttcccttttgcagtcaccattttcatcaattaatcatgaaagatggacgggaaatagtagtaccatgcagaaatcaagatgagctagtaggcagagctcgagtttctcaaggggcaggatggtcgctcagagaaactgcatgtttaggtaagtcgtatgctcaaatgtggcaattgatgtattttcaccgacgagatttaagattagcagcgaatgcaatttgtagtgctgtgcctgtaaattgggtacccacttcgcgaacaacctggtctatccatgcccaccaccaatggatgacaacggaggacatgttatcagtttggaacagagtttggatagaagagaacccatggatggaagataaaacacacgttagtagttgggaggatgtaccatacttaggaaaaagagaggaccagtggtgcggaagtcttatcggattgacagcgcgagcaacatgggccaccaacattcaagtagcaattaatcaagtacgtagattaatcgggaatgaaaactacttagactatatgacatcaatgaaaaggtttaaaaatgaaagcgatcctgaaggcgcattgtggtaa

SEQ ID NO: 22109 - RNA, 9879 nt, synthetic construct
  misc_feature 1..9879: note = derived and/or modified CDS sequence (opt6) from DENV-1__KM403635__SS-prME
  source 1..9879: mol_type = other RNA
agcgtcactatgctgttgatgctactgcccactgccctcgcttttcaccttacgactcgaggaggggaaccacatatgatagtgagtaaacaggaacgtggtaaatcactgttatttaaaacgtccgccggggttaatatgtgtacccttatagcaatggatctcggagagctatgtgaagacactatgacatataaatgtccacgaattacggaagcagaacctgacgatgtagattgctggtgcaacgcgacagatacttgggttacgtacggcacgtgctcccaaacgggagaacatcggcgagataaaagatccgttgcactggcaccacacgtaggacttggtttagaaaccagaacggaaacatggatgtccagtgaaggagcatggagacaaattcaaaaagtcgaaacatgggctttaagacacccaggatttacagtaatagcgctctttttggcacatgcaatagggactagcataactcaaaaaggtataatattcatccttttaatgttagtcactccctcgatggcaatgagatgtgtaggtatcggtaacagggactttgttgaaggcttatcaggagcaacttgggtcgacgtggttttagaacatggatcgtgcgtcacaacaatggctaaaaacaaacctacactcgacatagagcttttaaaaacggaagttactaacccggccgttttaagaaaactttgcatcgaagcaaaaattagcaatacgactactgatagtagatgtcctacgcaaggtgaggcaacattggtcgaggaacaagatgcaaattttgtatgcagacgtaccttcgtggatagaggatggggaaacggttgtggattatttggcaaaggaagcctgcttacctgtgctaaatttaaatgtgttactaaactagaaggtaaaatcgtccaatacgagaacttaaaatattctgtaatagttaccgtacacacgggagatcaacatcaagtgggcaacgaaactacagagcatggcacaatagccactattacaccccaagcacctaccagcgagattcagttaacggactatggtgcgctaactctggattgtagcccgagaaccggcctagatttcaatgagatggttcttctgacaatgaaagagaaatcttggttggtacataaacaatggttccttgacttaccgttgccttggacatccggggcatcagccagtcaagaaacctggaacagacaagacttgttagtcacttttaaaacagcacatgccaagaaacaagaagtggtggtcctcggaagccaagaaggggcaatgcacacagccttaacaggcgcaaccgagatacaaacgtccggaactacgaccatattcgctggtcatttaaaatgtagactaaaaatggacaagttgacactaaaaggtgtatcctatgttatgtgcactggttcatttaagctcgagaaagaggttgcggaaacacaacatggcaccgtactcgttcaagttaagtatgaaggcacagacgcgccatgtaaaataccaatctctacacaggacgagaagggcgtaacacaaaacggtcgattgattaccgccaatccaatagttacggataaagagaagccagtcaacattgagactgaaccccctttcggagaaagctatattgtaataggtgccggcgagaaagcacttaagctatcatggttcaagaagggctcgtctatcggaaagatgttcgaagctacagctagaggtgcaagacgaatggcaatcttaggagataccgcttgggatttcgggagtataggaggtgtctttaccagtgtagggaagttagtacatcaagtcttcggcaccgcctatggtgttctattttccggagtatcctggacgatgaaaattggtatagggattctgctaacctggctgggacttaatagcaggtccacaagtttatctatgacatgtatagctgtcggtatggttaccctctatcttggagttatggtacaggctgattcaggatgcgttataaattggaagggcagggaactcaaatgtggcagcggcatatttgttaccaatgaagtacacacatggacagaacaatataaattccaagcagattcccctaaaagactctccgcagcaatcggaaaagcatgggaagaaggagtatgcggcatacgaagtgctacgagactagagaatattatgtggaagcaaatatcaaacgaattgaatcatatactgctcgaaaacgatatgaaattcaccgtagtagtgggcgatgccaatggaatattaacacaaggtaagaaaatgatacgcccacagcccatggaacacaagtatagttggaaatcttggggaaaagcaaagatcatcggtgcagacacgcaaaataccacgtttattatcgacgggcctgacactccagaatgccccgacgaccaaagagcgtggaatatttgggaagtagaagattatgggtttggggtcttcacaaccaacatatggctcaaattgagagattcctatactcaaatgtgcgaccatagattaatgtcagcagcaataaaagactcaaaggcagttcacgcggacatgggatattggatagagtccgagaaaaatgaaacctggaagttggctagggcatctttcatagaggtcaaaacttgtatttggcctcgttcacacaccctatggagcaacggtgtcctagaatcagagatgataattcctaaaatctatggaggtccgatatctcaacataattaccgtccagggtatttcacacaaacagcagggccttggcacttaggcaaacttgaactagatttcaatctctgcgaaggtacaacagtggtagtagatgagcactgcggaaatagagggccaagtctaagaaccaccaccgtaaccggaaaaatcatacatgaatggtgttgtcgatcttgcaccttgccaccattgagatttagaggggaagatggctgctggtatggtatggagatcagaccggtaaaagaaaaagaagagaacctagtccgaagtatggtctctgcggggtctggtgaagtagattctttctccctaggccttttatgtgtgtccatcatgatcgaagaggtaatgcgatcacggtggtctagaaaaatgttaatgacaggtacgctagctgtatttttcttattaataatggggcaacttacctggaatgatctaatccgcctatgtataatggttggtgctaatgtaagtgataggatggggatgggtactacgtatttagcactcatggctacctttaaaatgcgtcccatgtttgcagttggacttctattcaggagacttacctctagagaagttcttctactaactatagggctgagtttagtcgcatccgtcgaactgcctaattctttagaagaattgggagacggtcttgcaatgggaataatgatgttaaaacttctcactgactttcagagtcaccaactgtggactaccctattaagtttaacatttattaaaactacgttatctctggattacgcttggaagaccatggcaatggtactcagtatcgtctcactgttcccactctgccttagtactacatcccagaaaacgacgtggctccccgtactgttgggatcttttggatgtaaaccacttaccatgtttctaatcaccgagaacaaaatctggggtcggaagagttggcctctaaacgaaggaattatggctgtgggtatcgtgtctattttgctgagcagccttctaaagaatgacgttccgctagcaggtcccctaatagcaggaggtatgttgatcgcttgttatgtgattagcggcagtagtgcagacttgagcttagaaagagccgcagaagtttcttgggaagaagaagcagaacattccggagcttcccataatatattagttgaagttcaagacgacggaactatgaaaataaaagatgaggaaagggatgacacattaacgatattattgaaagctactttattagctgtatcaggagtgtacccaatgtcaatacctgcgactttatttgtttggtacttttggcagaagaagaaacaacgtagtggtgttttatgggataccccaagtccgcctgaagtggaacgagctgttttggatgatggaatctacagaatcttacagcgcggtttacttggccggtcacaagtaggagtcggagttttccaggatggggtattccataccatgtggcatgtgacaagaggggccgtcctgatgtaccaaggaaaaagacttgaaccctcatgggcgtcagtgaagaaagatctaatttcttatggtggaggatggaggtttcaaggtagctggaacacgggtgaagaagtccaggttatcgctgtagagcccggcaaaaatccgaaaaacgtacaaacaaccccgggcaccttcaaaacacctgagggtgaggttggtgccatcgcgttagacttcaaaccaggaacgagtggaagtccaatagtgaatcgcgaaggtaaaatagtagggttatatggaaatggagttgtgactacgtccggtacgtacgttagtgctatagcacaagccaaagccagtcaagagggaccacttccagaaatagaagacgaagtgttcaagaaacgaaatctaaccatcatggatctacatcccggaagcggaaaaacacgccgatacctgcctgctatagtgcgcgaagccataaaacgtaagttaagaacgttgatacttgcacccacacgagtagttgcatcagaaatggccgaggctttaaaaggaatgcccattagataccaaacaacagccgtaaagtcggaacacacaggaaaagagatagtagacttaatgtgtcatgcaacttttacaatgaggctattgagtcccgtacgcgtacccaattacaacatgataataatggacgaagcacattttacagacccggcctccattgcagcaagaggttacataagcactcgagtcggaatgggagaagctgcagctatattcatgacagccactcctccaggatccgttgaagcatttcctcaatccaacgcagttattcaagacgaggagcgcgacataccagaaagatcatggaactctggctacgattggataaccgactttccaggcaaaacagtctggttcgtaccaagtattaaatctggcaatgacattgcaaactgtttacggaaaaatgggaaaagagttatacaattatcgcgtaaaacgtttgacacagagtatcagaaaactaaaaacaacgactgggactatgttgtaacaacagatatatcggaaatgggagcgaacttccgggcagacagagtcattgaccccagaaggtgtctcaaacctgttatactaaaagacggacctgaacgagtaatcctagctggaccgatgccagtaaccgcagcttcggctgcccaaagaaggggaagaattggaagaaaccagaacaaagaaggcgaccaatacatatacatgggccagccattaaataatgatgaagatcacgctcattggacggaagcaaagatgcttttggataatataaacacacctgaaggaattatccctgctttattcgaaccagaaagggaaaaatccgctgctattgacggtgaatatagattacgcggagaagcacgcaaaacatttgtcgaactaatgcgaagaggagatttgccagtgtggctatcttacaaagtagcatcggagggattccaatatagtgataggaggtggtgctttgatggagaacgaaataatcaagtcctggaagagaatatggacgtcgaaatttggactaaagaaggagagaggaagaaattaaggccacgttggcttgatgcaagaacatatagcgaccctttggcgctacgagaatttaaagaatttgcagcgggacgtcgatcagtaagcggagacctgatacttgagatcggaaaactgccacaacacttaactttgagagcccaaaatgcactagacaatctagtaatgctacataattcagaacagggtggtaaagcctatcgacacgcgatggaagaacttccggatacaatagaaactctcatgctcttagccttaatcgcagtactcaccggcggtgtaacactattctttttatcgggtaaaggattaggaaagacctctataggtctactctgtgttatggcctcatctgtcttactgtggatggcaagtgtagaaccacactggatcgcagcgtccataattctggaatttttcttaatggtactcctaatacctgagccagacagacaacggacaccccaagataatcagctagcctatgttgttataggtctcttatttatgatcttgacagtagcagcaaatgaaatgggtttacttgaaacaactaagaaagacctcggtatcggtcatgtggtcgccgaaaatcatcaccatgctacgatgttggatattgatctacatccagcgagcgcatggactttatatgccgtggcgacaacaattattacgcctatgatgaggcacactattgaaaacaccacagcaaatatatcattaactgccattgccaatcaggcagcaatcttgatgggacttgacaaaggatggccgataagcaaaatggatataggcgtaccactattagctttagggtgttacagtcaagttaacccactaacactaaccgccgccgtgttaatgctcgtagcacattatgctataataggccctggtctacaagcaaaagcgacaagggaagctcagaaacgtacggcagccggcataatgaagaatcctacagtcgacgggattgtcgcaatcgatttagatcctgtagtctacgatgcgaaatttgaaaaacaattaggacaaataatgttactcatactatgtacatcacagatcctactaatgagaacaacctgggccctgtgtgaatctataactttagcaacaggacccctaaccacactctgggaaggatctccagggaaattctggaatactacgatagccgtttcaatggccaacatattccgcggctcatacttagcaggggctggcttagcattcagtttgatgaaatcattagggggcggccgaagaggtacaggagcacaaggtgaaaccttgggcgagaaatggaaacgacaacttaatcaactatctaagtccgaatttaacacttataaacgaagtgggataatggaagtagataggtccgaagcaaaagaagggttaaagagaggcgaaacaactaagcacgcggtatcccgtggaacggctaagctcaggtggtttgtagaacggaatcttgttaaaccagaaggtaaagtaattgatctaggttgcgggcgaggcggttggagttattactgtgctggcctaaagaaagtaactgaagtgaagggatatacgaaaggtggaccaggtcacgaagaacccattccaatggctacatacggctggaatatagttaaattacacagcggacgggatgtattctttacaccccctgaaaaatgcgatacattattatgtgatattggcgagtcgtcaccaaatccaactatagaagaaggtcgtacactccgagtattaaagatggtagagccgtggctcagaggaaaccagttttgtatcaaaattctaaacccgtacatgccttcagtagttgaaacattagaacaaatgcaaagaaaacacggcggcatgctagtccgaaaccctctttcaaggaatagcacccacgaaatgtattgggttagttgtgggacaggcaatatagtatccgctgttaatatgacttctcgcatgttacttaaccgatttacaatggcccaccgtaaacctacctatgaacgagatgtggacctaggtgcgggtacaagacacgtagccgtggaaccagaaatagcaaacttggacattataggacaaaggattgaaaatatcaaaaatgaacataagtccacctggcattatgacgaggacaatccatataaaacatgggcatatcatggaagttatgaagtaaagcctagtggaagtgccagcagcatggtgaatggcgttgttcgattactaacaaaaccctgggacgtgatacctatggtaacccaaattgctatgacagatacaacaccatttggacaacaaagagtgttcaaggagaaagtggatactcgtacacctcgacccaaacgtggcaccgcacaaatcatggaggtgactgctaaatggctctggggctttttgagtcgtaacaagaaaccaaggatatgtactagagaagagttcacaagaaaagtaagatcaaatgctgcaatcggcgcggtttttgtagacgaaaatcaatggaactccgcaaaagaagcagtagaggatgaacgtttttgggatctagtacatagagaaagagagttgcataaacaggggaagtgtgcaacatgcgtatataatatgatgggtaaacgggagaagaaattgggcgaatttggaaaagcaaaaggctcaagagcgatttggtatatgtggctaggtgcgcgatttcttgagtttgaagcgttaggatttatgaacgaagatcactggttctctcgggagaatagcttaagtggagtggaaggtgaaggcttacacaaattaggatacatcttgcgcgatatctccaaaataccgggaggtaatatgtacgcagacgacactgcaggatgggacacaagaattacagaagacgacctacagaacgaagcaaaaataacagatataatggaaccagaacacgctctattggcaaccagtatattcaaactaacatatcagaataaagtagtacgggtgcaacgacctgcaaagtcaggaacagtgatggacgtgatttccagaagagaccaaagaggaagcgggcaggttggcacttatgggcttaacacattcacaaatatggaagtacaactaatacgtcagatggaatcagaaggtatcttctcgccttcagaattagaaaattccaatcttgcggaacgtgtattagattggttagaaaaacatggcgtagagagattaaagaggatggctataagtggagacgattgcgtagtgaagccaacagatgatcgcttcgctactgctttaactgcattaaatgacatgggaaaagtaagaaaagatataccacagtgggaaccgtcaaaaggatggaatgactggcaacaagtgccattttgtagtcatcactttcatcagttaattatgaaagacggtagagaaatagtcgtaccctgccgcaatcaagatgagttagtgggcagagcaagggtctcgcaaggcgccggatggtcattaagagagaccgcgtgcctaggaaagagttacgcgcaaatgtggcaattaatgtatttccacagacgagacttacgtttagcggcaaatgcgatctgctctgctgtgcctgtcaattgggtaccaacatctagaactacttggtcaatacacgcacatcatcaatggatgactacagaggatatgttatccgtgtggaacagagtatggatagaagaaaacccctggatggaagataagacacatgtttcaagttgggaggatgtaccttatttgggaaagagagaggatcaatggtgtggtagtttaataggactaacagctagggcgacatgggcaactaatatacaagtagccatcaaccaggttagaagattggttggaaatgaaaattatctcgattatatgacctcgatgaagaggtttaaaaatgaatcagacccagaaggtgcattgtggtga

SEQ ID NO: 22110 - RNA, 9879 nt, synthetic construct
  misc_feature 1..9879: note = derived and/or modified CDS sequence (opt6) from DENV-1__KM403621__SS-prME
  source 1..9879: mol_type = other RNA
tcagttactatgttactgatgctacttcctactgctttagcattccatttaaccacgagagggggagaaccgcacatgatagtaagtaaacaagaacgaggtaaatcactgctgtttaaaacatcagcaggagtaaacatgtgtacattaattgcaatggacttgggtgaattatgcgaagatactatgacatacaaatgtccccggataacggaagcagaacccgacgatgtggactgttggtgtaatgccacagatacatgggtaacttatggaacatgtagccaaacgggagaacaccgtagagataaacgctcagttgcactagcccctcatgtaggattgggattagaaacgcgcacggaaacatggatgtcgtcggaaggcgcttggagacaaattcaaaaggtggaaacctgggccttaaggcacccaggatttacagtaatagctttgtttctagctcatgccatagggaccagtatcacacaaaaaggaataatcttcatcctattaatgctagtgacacctagtatggccatgaggtgcgttggaataggaaacagggactttgttgaaggattaagcggtgctacatgggtagacgttgtgttggaacacggctcgtgtgtaacaactatggcgaaaaataaacctacgctggacatagagttacttaagacagaagttacaaaccctgcagtactacgaaaactttgtatagaagcaaagatttccaatactaccacagactctcgatgcccaacacaaggggaagcgacattagtagaagaacaggatgctaactttgtttgtagaagaacatttgttgataggggttggggaaacggttgtggattattcgggaaaggttcattgttaacttgtgctaaatttaaatgcgtaacaaagttagaaggaaaaattgtccaatatgagaatcttaaatattctgttattgtaacagtccacacgggtgaccagcatcaagtaggcaatgaaaccacagaacacggtacaattgcgacgatcaccccacaggcacctacaagcgagatacagcttactgactatggcgccctgaccctagattgtagtccaaggacaggccttgactttaatgaaatggttcttttaacaatgaaagaaaaatcatggctagtccacaaacaatggttcctagatctcccactaccatggacttcaggagccagtacctcccaagaaacatggaatcggcaagacttattggtaaccttcaagacagcacatgccaaaaagcaagaggttgtcgtgctaggcagtcaagagggtgcaatgcacactgcactcacaggtgcaacagaaatacaaacttcggggaccaccacaatttttgctggtcacttgaaatgtcgattaaagatggataagttaacgctcaaaggcgtatcatacgtaatgtgtactgggagttttaaacttgagaaagaggtggcagaaactcagcatggcacagtattagtacaagtaaaatatgaagggacagacgcaccctgtaaaataccaatctcaactcaagatgagaaaggagtcactcagaacggacgtctaattaccgcaaatccaattgttaccgataaagaaaaaccagtcaacatagaaaccgaacctccatttggggaaagttacatagtgattggggccggtgaaaaagcgttaaaattatcttggttcaagaagggttcttccatcggtaaaatgtttgaagcgactgccaggggtgcaaggagaatggccattttaggggacaccgcctgggatttcgggtctattggcggggtatttacctcagtgggaaaattagtccatcaagtctttggcacggcctatggtgttttattctccggtgtttcttggactatgaagatcggaatcggaatcctattaacatggctcgggttaaacagccgctcgaccagcctgtcaatgacatgcatagcagtgggaatggtaacactttatctaggtgtgatggttcaagcagatagtggctgcgtcataaactggaaaggcagagaacttaagtgtggcagcggtatatttgtcactaatgaggtccacacatggactgaacaatataaatttcaggctgattcacccaaaagattgtctgccgctatcggaaaggcttgggaagaaggagtatgtggtattaggtcagcaacaagactagagaatattatgtggaaacaaatatctaacgaattaaatcatatactgctagaaaatgatatgaagtttactgtggttgtaggcgacgcgaacggaatattaacacagggcaagaaaatgataagaccccagccaatggagcacaaatatagttggaaatcctggggaaaagcaaaaatcataggcgcagatactcaaaacacaacttttataattgatggacccgatacaccagagtgtccagatgaccaaagagcatggaacatctgggaagtcgaagattacggattcggagtatttacgacaaacatttggttaaaattaagagacagttacacacaaatgtgcgatcatagactaatgagtgctgctataaaagattctaaagccgtacatgcagacatggggtattggattgagtcagagaaaaatgagacatggaaattggccagagcctcatttatagaggtcaaaacctgtatttggcctaggagtcataccctctggtcaaacggggtccttgaatctgaaatgattattcctaaaatatatggaggaccaatatcgcaacataactatcgcccagggtactttactcagactgcaggtccgtggcatttaggaaaactagaattagattttaatctctgcgaaggtacgacagtagtagtagatgagcattgtgggaatcgtggaccatctcttcgtacaactaccgttaccggcaaaattatacacgaatggtgttgtagatcatgcactttacctcctctacgttttagaggggaagatggttgctggtacgggatggaaatcagaccagtcaaggaaaaagaagaaaacttagtaagaagtatggtatctgcaggatccggagaagtagactcattttccttagggttactttgcgttagtataatgatagaagaggtaatgaggagtagatggtcccgtaagatgctgatgacgggaactttagcagtattcttcttgctaattatgggccaactaacatggaatgacctcattagactatgcattatggtaggtgccaacgtatctgatagaatggggatggggacaacatacttagcgttaatggccacgtttaaaatgaggcctatgtttgctgtaggtctattatttaggagactcacgtcaagagaggtattgcttttaacgataggtttaagcctagtggcgtcagtagaactaccgaactcacttgaggagttaggagacggattggcgatgggaataatgatgttgaaactattaaccgacttccaaagccaccaactgtggactacactattgtctttaacgtttatcaaaacgacattatcgttagactatgcttggaaaaccatggccatggtgttaagcattgtttcactatttccgttatgcctaagtacaacatcacagaaaacaacatggcttccagtcctattgggttcttttgggtgtaagcccctgacaatgtttctaataacagaaaataaaatatggggtagaaaatcctggccactaaacgaaggtatcatggctgtcggtattgttagtattctactaagtagtttactcaaaaatgatgtaccgttagcaggacccttaatagcgggtggaatgttaatcgcttgctacgtaatatcgggcagttcggctgatttatccctggaaagagctgccgaggtaagttgggaagaggaagcggaacattctggcgctagccataacatccttgtagaagtgcaagacgatggaacgatgaaaatcaaagacgaagaacgcgatgatactttaaccattttgttaaaggctacattattagcagttagtggcgtatatccgatgtcaattccagctacattatttgtttggtacttttggcagaagaagaaacagcgcagcggagtattatgggacaccccctctccacccgaggtagaacgagcagtattagatgacggtatttataggattttacaacgaggattacttggaagatcccaggtcggggtaggagtttttcaggatggtgtctttcatacaatgtggcacgtaactcgaggcgcggtacttatgtatcaaggaaaaagacttgaaccatcatgggcatctgtaaagaaagatctgataagctacggtggagggtggaggttccagggatcgtggaatactggagaagaggtacaagtgatcgcagtcgaaccaggcaagaatcctaaaaatgtccagacgactcccgggacgttcaaaacacccgagggtgaggtcggtgctattgcattggattttaaacctgggacgagtggcagccccattgttaatagagaaggtaagatcgtgggactctacggaaatggtgtggtcacgactagcgggacttatgtcagtgccatagcacaagcaaaagcaagtcaagaaggtccactgcctgaaattgaagatgaagtgtttaagaaaagaaatcttacaataatggatttacatccgggaagtggaaagacccggagatatttaccagccatcgtgcgtgaagctatcaaaagaaaactccggaccctaattctagcaccaactagagttgtcgcatctgagatggctgaggctttaaaaggaatgccaattcgatatcaaaccacagcagtgaaatcagaacataccgggaaagagattgtcgatctcatgtgtcacgcaacattcaccatgagactattgtcccctgtacgggttcccaattataatatgataattatggatgaagcgcatttcactgacccagccagtattgccgctagaggttatataagtacacgggtcggtatgggtgaagcagcagcaatatttatgacagcaacaccacctggaagtgtagaaagttttcctcagagtaatgcggttatacaagatgaagaaagggatataccggaacggtcgtggaactctggatacgattggataacagacttccccggcaaaaccgtctggtttgtgccatccataaaaagtggcaatgacatcgccaattgtttgaggaaaaatggtaaaagagttatacaactatcccggaaaacttttgataccgaatatcagaagacgaaaaacaatgactgggactatgtagtcacaactgatatatcggaaatgggtgctaacttcagagcagatagggttattgatcctagaaggtgcttaaaacctgtaatccttaaagatgggccagaacgcgtgatactggctgggccaatgccagtaactgcagcatcagccgcgcagcgcagagggaggatcggtcgcaaccaaaacaaagaaggggatcagtacatctacatgggtcaacctctcaataatgatgaagaccatgctcattggacagaagctaaaatgttattagataacatcaatactccagagggaattattccggctttatttgaacccgaacgagagaaaagtgcagcaattgatggtgaatatcgactacgtggtgaagcacgcaaaaccttcgtagagttaatgagaaggggagacttaccagtatggctatcatataaggttgcatccgaaggatttcaatattcggacagaagatggtgttttgatggtgaaagaaacaaccaagttttagaagaaaatatggacgttgaaatttggacgaaagaaggagaaaggaagaaactacgtccaagatggcttgacgcacgtacatatagcgaccctctcgcattaagagaatttaaagaatttgcggcaggaagacggtccgtatcaggggacttaatactagagattggcaagttacctcagcatctcacactgagagcacaaaatgcactagataatttagtaatgttgcacaattccgagcaaggcgggaaagcctatagacacgctatggaggaactaccggataccattgagacgctaatgttgttggcacttattgcagtgctcaccggcggcgtgacattattctttttatctggcaaaggtctcggcaaaacgagcatagggctactttgcgttatggcttcgtccgtccttctttggatggctagcgtggaaccacactggatcgcagcaagtataatcttagagttcttcctcatggttctactaataccagagccagacagacaaaggacgccacaagacaaccaactagcctacgttgtcatcggtctcctattcatgatactgacagtagcagccaacgaaatgggactattagaaaccactaagaaagacctcggaatagggcatgtcgttgcggaaaatcatcatcatgcgacgatgctagacatcgaccttcatccggcatccgcttggacattgtacgctgtagcaacaaccataataactccaatgatgagacacaccatagaaaatacaacggcaaacataagtttaacagcgatcgcaaatcaggcagcgatactaatgggattggataaaggctggcctatttcaaagatggatataggtgttccattactggcactaggatgctatagtcaagtaaatccactcacgctaacagcggcagtattaatgcttgtagcccactatgcgattatcggaccagggctccaggcaaaggcgacaagggaggcacaaaaacgtacggcagcaggcattatgaagaacccgaccgttgatggcatagttgcgatagatttggacccagtggtttacgacgctaaatttgaaaagcaattaggacaaataatgttgctaatactttgtacttcacaaatcctattgatgagaacgacctgggcactatgcgaatcaataactctcgcaacgggccctttaactaccctgtgggaaggctcacctggaaaattttggaacacaaccattgcagtgtctatggccaatattttcagaggtagctaccttgctggagcagggctagcattttcgttaatgaaaagccttggtggcggaagaaggggaacaggtgctcaaggtgagacattaggggaaaaatggaaaaggcaactaaaccagttaagcaaaagcgaatttaacacatacaaaagatcaggaataatggaagtagataggagcgaggccaaggaaggactaaaaaggggcgaaactaccaaacatgcagtctcccgcgggaccgcgaagttacgctggttcgtggaaaggaacctcgtaaaaccggaaggaaaagtcattgacctcggctgtggacgaggagggtggtcgtattattgtgctggtctaaagaaagtcacagaagtgaagggttataccaaaggcggcccagggcacgaggaacccatccccatggctacatacggctggaatatcgtaaaattacatagtggaagagacgtattctttacaccgccagagaaatgcgacacgttactatgtgacataggtgaaagctcacccaacccgactatcgaagaaggtagaacactaagagtcctcaaaatggtagaaccatggttaagggggaatcagttctgcatcaagatactaaatccttatatgccgagcgttgtcgagacactagaacaaatgcagagaaaacatggagggatgcttgttcgaaatcccctatcacgcaatagcactcacgaaatgtactgggtgtcctgcggtacaggaaatatagtttccgccgtaaatatgacttcaagaatgttactcaataggtttacaatggcccacaggaagcccacgtacgaacgtgacgtcgatttaggggccggcaccaggcatgttgcggttgaaccagaaatagctaatttagatataataggacagaggatagagaacatcaaaaacgaacacaagtcgacatggcactatgatgaagataacccttacaaaacatgggcataccatgggtcatatgaagtaaagcctagtggtagtgctagctcaatggtgaatggggttgtgcgactattaacaaaaccctgggacgtcattcctatggtaacccaaatagcaatgaccgatacaaccccctttggacaacaaagggtatttaaagaaaaggttgacactagaacgccacggcctaaacgtggcactgcccagattatggaggtaaccgctaaatggctgtggggattcctttcaagaaataagaaaccccgtatatgtactagagaagagtttactagaaaagtccggtcaaacgcggcgatcggagcagtttttgtggacgaaaatcaatggaacagcgccaaagaagctgttgaagatgaaagattttgggatttagtacacagggaaagggagttacacaaacagggaaaatgcgcaacctgcgtctacaatatgatgggcaagcgagagaagaaattaggggaatttggaaaagcgaaaggatccagggccatatggtacatgtggctgggtgcgcgattcttagagttcgaggccctgggatttatgaacgaagatcactggttctcgagggaaaatagcctctctggtgtggagggtgaaggattacacaaactcggatatatattacgagatatttcaaaaataccaggaggaaacatgtatgctgacgacactgcaggatgggatactagaatcaccgaagatgatctacagaatgaagcaaagatcacagacattatggaacctgaacacgccctcttagccacaagtatatttaaattaacatatcagaacaaggtagtacgagtacaacgtccagctaagagtgggacggttatggatgtcatatcgaggcgagatcaacgtggatccggtcaagttgggacttacggactcaataccttcacgaatatggaagtgcaattaattagacaaatggaaagtgagggaatctttagccccagtgagttagaaaactcgaatttagcggagagagttctagattggttagaaaaacatggcgtggagaggctgaagcgaatggctatctctggtgacgactgtgtagtgaagcctacagacgatagatttgcgacagcattaacagctttaaacgacatggggaaagtccgcaaagatataccacaatgggaaccttcgaaaggatggaatgattggcagcaagtcccattctgtagccatcattttcaccagctgataatgaaagacggtagagaaattgtcgttccatgtcgtaatcaggatgagttagttgggcgagcgcgagtgagtcagggagcagggtggtcgttaagagagacggcgtgcttgggaaaaagctacgcgcaaatgtggcaactaatgtactttcatagacgagatctccgactggctgcaaacgcaatatgtagcgccgtccctgtaaattgggtcccaacaagccgaaccacatggtcaattcatgcacatcaccaatggatgaccaccgaggacatgttaagcgtgtggaaccgagtctggattgaagaaaatccctggatggaagacaagactcatgtttctagctgggaggacgttccgtacctgggaaaaagagaagatcagtggtgcggtagtctaataggattaacagctcgtgctacatgggcgactaatatacaagtggcaataaaccaagtacgccgtcttatagggaatgaaaattacctagactacatgacttcaatgaaaagatttaagaatgaaagtgaccctgaaggagcactatggtaa

SEQ ID NO: 22111 - RNA, 9879 nt, synthetic construct
  misc_feature 1..9879: note = derived and/or modified CDS sequence (opt6) from DENV-1__KM403623__SS-prME
  source 1..9879: mol_type = other RNA
agcgttactatgcttctcatgctattgccaactgcattagcgttccatttaactactcggggcggtgaaccccatatgattgtatcgaaacaagagaggggtaaatctctcttattcaaaacgagcgcaggggtgaacatgtgtaccttgatagcaatggaccttggagaactctgcgaagatacaatgacctataaatgtcctcgtattacagaagcggaaccggatgacgttgattgctggtgtaatgcaacagatacatgggtaacatatggtacgtgctcccaaacaggtgaacacagacgagacaaacgaagcgtagctctagctccgcacgtaggtttaggactcgaaacacggacagaaacatggatgtcatccgaaggagcgtggcgtcaaatacaaaaagtagagacttgggcgttgcgacatccgggatttactgtaatcgcattctttcttgcacatgcgataggaacgagtataactcaaaaaggcatcatatttatacttctaatgttagtgaccccttcaatggcaatgagatgcgtgggtataggaaatagggattttgtagaaggcttgagtggtgctacgtgggtggacgtcgtactcgaacatggatcatgtgttacaaccatggccaaaaataaaccgactctagacatcgaactgttgaaaacagaggtaacaaatccggcagtattacgaaaactttgtattgaggctaaaatttccaatacaacgactgattcaagatgccccactcaaggagaagcaactttggttgaagaacaagacgcaaattttgtgtgtaggcgaactttcgtagaccgggggtggggaaacggatgtggcctattcggtaaaggatcactcctaacttgcgcgaaatttaaatgtgtaacaaaacttgaaggaaaaattgtacaatacgagaatctaaaatactcagtaatagtaacggtgcataccggagaccagcaccaagtaggaaacgaaacaactgaacatggtacaattgctaccataacacctcaagcaccgacgagtgaaatacaattaacggactatggagcgttaacacttgactgctcgcctaggactggattagattttaatgaaatggtgttattgactatgaaagaaaaatcatggctcgttcataaacaatggttcctggatttgccattgccgtggacaagtggagcaagtacctcgcaagaaacgtggaatcgacaagacctgttagtaacattcaaaactgcacatgccaagaaacaagaagtagtagtacttggtagtcaagaaggggcaatgcacacagctctgaccggtgcaacggagatacagacgtcgggtactacaactatatttgcagggcacttaaaatgtcggttaaaaatggataaattaacattaaaaggagtatcatatgtaatgtgtacaggatcgtttaaattagaaaaagaagtcgctgagactcaacacggcactgttctagtacaggttaaatatgaaggtactgacgctccatgcaaaatacctatatctactcaagatgaaaaaggggtgacgcaaaacggcagattaatcacagcgaatcctatcgtgacagacaaagaaaagcccgttaacattgagacagaacctccatttggcgaatcctatattgtaattggcgcaggagaaaaggctttaaaactctcatggttcaaaaagggtagctcaattggaaagatgttcgaagcgacagcacggggtgcgcgccgtatggcaatattaggagacactgcttgggatttcgggagtatcggaggggtgtttacgtctgtaggcaagttggtacatcaagtgttcggtacagcgtatggcgtactcttcagtggcgtaagctggacaatgaagatcggtatcggtattctactaacatggctaggactgaatagtagatcaacttccctaagtatgacatgcatagccgtaggtatggttactctgtatctaggagtgatggttcaagcagactcgggatgtgtgattaactggaaaggtcgtgaattaaagtgtggcagcggtatattcgtaacgaacgaagtacacacatggacagaacaatataaatttcaggcagacagtccaaaaagactatcagcggctataggaaaagcatgggaagaaggggtctgtggcatcaggtcggctactaggctcgaaaatatcatgtggaaacagataagcaatgaacttaatcatatattactcgaaaatgacatgaaatttacagttgtggtaggggatgccaacggtattctaacccaaggtaagaaaatgataaggccacaacctatggaacacaaatactcgtggaaaagctgggggaaagcaaaaataataggcgcagatacccaaaatacaacatttataatcgacggacccgatacgccagaatgcccggatgatcaaagagcttggaacatctgggaagtagaagattatggatttggagtttttacgacaaatatatggttgaaacttagggatagttatacacaaatgtgtgatcatagactgatgagtgctgctattaaagactcgaaagcagtccatgcggacatgggctattggatcgaaagtgagaaaaacgaaacctggaaattagccagagcatcgtttatcgaggtaaagacatgtatctggccccgatctcatacattgtggagtaacggagtcctagaatctgagatgataattcccaagatatatgggggcccgataagccaacataactacaggcccggttatttcacccagaccgcaggtccctggcacctgggaaaactcgaactagacttcaatttatgtgaaggtacaactgttgtcgttgacgagcattgcggtaaccgcggaccatctttgcgaactactactgtaacaggtaaaatcattcatgaatggtgttgtcgtagctgtacattgccaccactccgtttcagaggggaagatggatgttggtatggaatggaaatacggccagtaaaggagaaagaagaaaacttggtcaggtccatggtgtcagcgggaagtggagaagtcgattcattctcgttaggtttactatgcgttagcatcatgatcgaggaagtcatgaggagtaggtggtctcggaaaatgcttatgaccggtacgttggcagtattctttcttctaataatgggtcaactgacgtggaatgacttaattagattatgcatcatggtaggagccaatgtttcagacagaatgggtatggggaccacatatctagcattaatggcgacttttaaaatgaggccaatgtttgcagtaggactcttatttagaaggctaacttcaagagaagtattgttattaactataggtcttagcttagtcgcctcggtagaattacctaatagtctcgaagagttaggtgacgggctagcaatggggattatgatgctaaaactactgacggattttcaaagtcatcaattatggacaacattattgagccttacgttcataaagacaactctctctttggattatgcttggaagacaatggctatggtattatcaatagttagcctatttccactatgtctatctacaacgagtcagaaaactacatggctaccagttctattaggttctttcggatgtaagccactaacaatgttcctcattacagaaaataagatatggggtaggaaaagctggcctctgaatgaaggcatcatggcagtgggaatagttagtatattactcagttcactattgaagaatgatgtacctcttgccggaccgttaatcgctggcggaatgttgatagcatgctacgttatctcagggtcgagtgcagatttgtcgctagagagagctgccgaggtatcttgggaggaagaagcagaacatagcggagcatcccacaacatattagttgaagtccaagatgatggaacaatgaaaataaaagacgaagaacgagatgacactcttacgattcttctaaaggccaccttacttgcggtatctggagtttacccgatgagcatcccagctacattattcgtgtggtatttctggcaaaagaagaaacaaagatctggtgttctctgggatactccttcgccacctgaggttgaacgagctgttctagacgatggtatctacaggatactccagagggggttattaggacgctcccaagtaggagtaggtgtattccaagatggagtattccatacaatgtggcacgtgacaagaggggccgttcttatgtatcagggtaaacgacttgaacccagctgggcttcagtcaagaaagatttgatcagctatggcggaggctggagatttcaagggtcatggaacacaggtgaggaagtacaagttatagctgtcgaaccagggaagaatccgaagaatgtccagaccacaccaggtacattcaaaacaccggaaggggaagtcggggctatcgcattagatttcaaacctggaacttccggttctccaatagtgaatcgcgaaggaaaaatagtaggattatatggtaatggagttgtaactacatctgggacttatgtatcggccatagctcaagcaaaagctagtcaggaaggacccttaccagagattgaagacgaagtgttcaagaagcgtaatttgacaattatggatcttcatccaggatcagggaaaacacgaaggtacctgccagctatcgttcgagaagctattaaacggaaattacgaactctaattcttgcccccacccgagtagtcgcgtctgaaatggccgaagccctaaaaggaatgccaataagataccaaactacagcagtgaagtccgaacatacaggcaaagaaatcgtggatcttatgtgtcatgctaccttcacgatgaggctcttgtcaccggttcgagttccgaattacaacatgataataatggacgaagcgcactttactgacccagcatcaatagcagcacgagggtacattagcacccgtgttgggatgggtgaagctgccgcaatctttatgactgccactccaccagggtcggtggaaagtttccctcagtcaaacgctgtaattcaagacgaagagagagatatcccagaacgatcttggaactcaggatacgactggataacagacttccccggaaaaacagtatggtttgttccaagtatcaaaagtggaaatgatatcgcaaactgtttaaggaaaaacggaaagcgagtgatccaactatcaaggaaaacttttgataccgaataccagaaaacgaaaaataatgactgggactatgtggttactacagacatatcggaaatgggtgccaatttccgtgcagacagagtaatcgatccacgaaggtgcttaaagcccgtaatattaaaagatggcccagaaagagtaatcttagcaggaccgatgccggtcaccgctgcgtcagcagcacagagaagagggcgaataggacgaaaccaaaataaagaaggcgatcaatacatctatatgggccaacccctgaacaatgacgaagatcatgctcattggactgaagcaaaaatgcttttagacaacataaatacaccagagggcatcattcctgcactattcgaaccagaaagggaaaaatcagccgcaatcgatggggaatatcgactaagaggggaggcaagaaaaacatttgtagaacttatgcggcgcggtgatctacccgtttggttgagttataaagttgcctctgaaggctttcaatattcagatagaagatggtgcttcgacggtgagcgtaacaatcaagttcttgaagaaaacatggatgttgagatttggactaaagagggggagcgcaagaaactaagaccaagatggctggacgctagaacttatagtgatccattagcattgagggagtttaaagaatttgcagcgggcagacgttctgtatctggagatctgatattagaaatcggaaaattgcctcagcaccttacacttagagcacagaatgccctagacaacttagttatgttacataactcggagcaaggtggaaaagcatatcgacatgccatggaagaactgcccgacacaatagaaactctaatgctcttagccctaattgcagtattaaccggaggcgtgaccctattctttttgtccggtaagggactcggcaaaaccagtatagggttactctgcgttatggccagctcagttttactatggatggcatctgttgaaccacactggatagccgcatctatcatattagagttctttcttatggtactccttatacctgaacctgataggcaaaggactccgcaagataaccaattagcttacgtcgtcataggcctcctgtttatgattctcacggtcgctgcgaatgaaatgggcctcttagagacaactaagaaagaccttggcataggacatgttgtggcagaaaaccatcaccatgcaactatgcttgatatagacttacatccagcttcggcatggaccctctacgccgtcgcaacgacaatcatcacaccgatgatgagacacaccatagaaaatactacagcaaacatttctttaacagcaatcgcaaatcaggcggcaatactaatggggctggataaaggatggcccatatccaagatggatatcggcgtaccactgctagccttagggtgctattcacaggtaaatccacttactttgacagcggcggtacttatgcttgttgctcactatgctattattgggccaggtttacaagctaaagcaacgcgagaggcacagaaaagaactgcagcaggaataatgaaaaatcctaccgttgatggcatcgttgcaatcgacctcgaccccgtagtgtatgatgcaaaatttgaaaaacaactaggacaaattatgctgctaatattatgcaccagtcaaatacttttaatgcgaacgacgtgggcactatgcgaatccataacccttgccacgggacccctcacaacattatgggaaggaagtccggggaaattttggaatacaacaatagctgtgagtatggcgaatatattcagaggaagttatcttgcaggcgccggccttgcctttagtcttatgaaatcccttggaggaggacgacgcggtacaggagcccaaggtgaaacgctgggggaaaaatggaaaaggcagctcaatcaactaagtaaatctgaatttaatacatacaagcggagtggaataatggaagtagaccgctccgaggcaaaagaggggttaaaacggggagagacaacaaaacacgcagttagtcgagggaccgcaaaattaagatggtttgttgaacgcaacctggtaaagccggaaggcaaagtcatcgaccttggttgtgggagagggggttggtcatattattgtgccggactgaaaaaggttacagaagttaaagggtacacaaaaggaggtcctggacatgaggagccaattcctatggctacatatggttggaatatagttaaattgcactccggtagagatgtcttctttacgccccctgagaaatgtgacacgttactatgcgacataggagagagctctcctaacccgaccattgaagaagggagaacattacgagtcctaaagatggtagaaccatggttaagggggaaccagttttgtattaaaatattgaatccttatatgccttctgtagtagaaacgctagaacaaatgcaaagaaaacacggaggaatgcttgtaagaaatccccttagtagaaatagtactcatgagatgtactgggttagctgcgggaccggaaatattgtcagtgccgttaacatgacttcaagaatgttgttaaaccgatttacaatggcacaccggaaacccacatatgaaagagatgttgacttgggagccggaacacgacacgtagctgtggaaccagaaatagcaaacttagatataattggtcagcgaattgaaaacattaaaaacgaacataagagtacatggcattatgatgaagataacccgtataaaacttgggcttaccatgggagttacgaggtaaaacctagtggtagtgccagttctatggttaatggtgtggtgcgccttctcacaaaaccatgggacgttataccaatggtaacacaaatagctatgaccgacacgacaccttttggacagcaaagagtattcaaagaaaaagttgatacaagaacacctcgtccaaagcgtgggaccgcacaaataatggaggtcaccgcaaaatggttatggggattcctatccagaaacaagaaaccaagaatttgcacccgcgaggagttcaccagaaaggtaagatcaaacgcagcaataggagccgtatttgtggatgaaaatcaatggaatagtgctaaagaagcagttgaagacgaacgattttgggatttagtacaccgtgaaagagaactgcataaacaaggaaaatgcgcaacttgtgtatataatatgatgggcaagagggagaagaaactaggggagttcggaaaagccaaagggagcagagcaatatggtatatgtggcttggagccagattccttgaatttgaggccctcggatttatgaatgaagatcactggtttagccgagaaaattcattgtctggagttgaaggcgaaggtctgcacaaattagggtatattctccgcgatatttctaaaataccaggtggaaatatgtatgccgacgatacagctggctgggacactaggattacggaagatgatcttcagaatgaagcaaaaattaccgacataatggagcctgaacacgcattacttgcgacatctatatttaagctcacatatcaaaataaggtcgtaagagtccagagacccgctaaaagcggtactgtcatggacgtaattagcagaagagaccaacgaggttcgggacaagtgggcacatatggactaaatacgtttactaacatggaagttcaattgatacgacagatggaatctgaaggtatattttccccaagtgaattggagaactcaaatcttgctgaacgcgtcttagactggctggaaaagcacggagttgaacgattaaaaagaatggccatatccggggatgattgtgtagttaaaccgacagacgatagatttgcaacagcgctgacggcgcttaatgatatgggaaaagtccgtaaagatattccacaatgggaaccaagtaaaggttggaacgattggcaacaagtacctttctgttcccaccatttccatcaattaataatgaaagatggtcgtgaaatagtagtgccatgtaggaaccaagatgaactcgtggggagagcaagagtctcgcaaggagctggttggagtttaagagagacagcgtgccttggaaaatcatatgctcaaatgtggcaactgatgtatttccacaggagagatttacgcttagccgctaatgcgatatgctctgcagtaccagtaaattgggtaccgacgtcaaggactacttggagtattcatgcgcatcatcagtggatgactacagaagacatgctatcagtgtggaatcgcgtatggatagaagaaaatccctggatggaagacaagactcacgtatccagctgggaagacgtaccgtatctaggaaaaagagaagatcaatggtgtggatcattaatcggcctcacagctagagctacatgggcaacaaatatacaagtcgcaataaatcaggtaagaaggctaattggcaatgaaaattacttagactatatgacaagtatgaaaagatttaaaaacgagtcagatccggagggggcgctctggtga

SEQ ID NO: 22112 - RNA, 9879 nt, synthetic construct
  misc_feature 1..9879: note = derived and/or modified CDS sequence (opt6) from DENV-1__KM403575__SS-prME
  source 1..9879: mol_type = other RNA
agcgttacgatgcttctaatgttactccctactgcgttggcattccacctaactacaagaggtggagaacctcatatgatagtaagtaaacaagaacgcggtaaatctttgttatttaaaaccagtgctggagttaatatgtgcacactaattgcaatggatttgggagaattatgcgaagacacgatgacgtacaaatgtccgcgaataacggaagcggaacccgacgacgtggactgctggtgcaacgcaacagatacatgggtaacctatggtacatgttcacaaactggtgaacatagaagagacaaaagaagcgttgctttagcaccgcatgtaggattgggattagaaaccagaactgaaacctggatgtcatccgaaggagcatggagacaaatccaaaaagtagaaacatgggcacttagacatccggggtttactgttattgcactcttccttgcacacgctataggtacgtcaattacacagaagggaataatttttatactgcttatgctagtaactccaagtatggcaatgagatgtgttggtatagggaaccgcgattttgtcgagggactcagcggagcaacctgggtagacgttgtcctagaacacgggagctgtgtgactactatggcgaagaacaaaccaacactcgatatcgaattgctaaagacagaggtaacaaatcctgcagtgttacgaaaactttgtatagaagctaagatctcgaatacgacaactgacagccgatgtccaacccaaggtgaagctacattagtagaagaacaggacgctaacttcgtttgcaggcgaacttttgtagacagggggtggggaaatggatgtggactctttggcaaaggcagcctactaacttgtgctaagtttaaatgcgttaccaaactagaaggtaaaatagttcaatacgaaaatctaaaatactccgtaatcgtaacagtacatacaggtgatcaacatcaagtaggtaacgagacaactgaacatggcacaatagcaacaataactccccaggcccctacttcggaaatccagttaacggactacggggcattaaccctcgactgttcgcccagaacaggtttagatttcaacgaaatggtactactaacgatgaaagaaaaatcatggctagtccacaaacaatggttcttggatctgcctttgccatggacatctggagcttcaacttcgcaggaaacctggaacagacaagatctacttgtgacatttaaaaccgcacacgccaagaaacaagaagttgtcgttcttggctcgcaagagggcgccatgcacactgctttaacaggagcaacagaaatccaaacgtcaggtacgaccacaatattcgcaggacaccttaaatgtcgtctaaaaatggataaacttactctaaaaggtgtctcttacgtcatgtgcactggtagttttaaactcgaaaaagaagtagctgagacacaacatggaaccgtattagttcaagtaaagtatgagggcacagacgcgccatgcaaaataccgataagtacacaggatgaaaaaggggtaacccaaaatggaaggctaatcactgcgaacccaatcgtaacagataaggaaaaacctgtaaacatagaaactgaacctccatttggagaatcttatatagtaataggcgcaggagaaaaagcacttaagttaagttggtttaagaaaggtagtagtataggtaaaatgttcgaagctactgcgagaggtgcaaggagaatggccattttaggggatacagcttgggattttggtagcataggaggagtctttacaagtgtaggtaaacttgtacatcaagtttttggcacagcgtatggtgtactgttctcaggagtaagttggaccatgaagattggcattggtatacttttaacttggttgggcttaaactcaagatcaacttcactttcaatgacctgcatcgctgttggaatggtaacactttacttaggagtcatggtacaagctgattctggatgtgtcattaactggaagggtcgcgagcttaagtgtggctcaggaatattcgttacaaatgaagttcatacatggaccgaacaatacaaatttcaagctgactctccaaaacgtttatctgccgctatcggaaaagcatgggaagaaggggtctgcggaatcagatcagcaactcggttagagaacataatgtggaaacagatatcaaatgaattaaaccatattttacttgaaaatgatatgaagttcactgtagtcgtaggagatgctaatggaatcttgactcaaggcaagaaaatgatacgcccccaaccaatggaacataaatattcatggaaaagctggggtaaagcaaaaattattggggcagatacacaaaatacaactttcataatcgatggtcccgatactccagagtgtcctgacgaccaacgagcatggaacatatgggaggtggaggactatggtttcggtgtcttcactacgaacatatggctcaaactccgtgattcctacactcaaatgtgcgatcataggttaatgtcagctgccatcaaggattccaaagcagtacacgctgacatgggctattggatagaaagtgagaaaaacgagacctggaagttagcaagggcatcatttatcgaagtaaaaacctgtatatggccacgttcacataccctgtggtcaaatggagtacttgagtccgagatgatcataccaaaaatctacggagggccaataagccaacacaattatcggccaggttattttacacaaacagctggtccctggcatctagggaaacttgagctagactttaatttgtgtgaaggcactacagttgtagtagacgaacattgtggaaatagagggccaagtctcagaacgaccacagttacaggcaaaatcattcatgaatggtgctgccgatcgtgtacattaccacccctacggtttcgaggtgaggacggatgttggtacggcatggaaatccgtccagtaaaagagaaagaagaaaacttagtcagatcaatggtgtcggcgggttccggtgaagtagacagcttctctttaggattactatgcgtttcaattatgatagaagaagtcatgagaagcagatggagtagaaaaatgctaatgacaggtacactcgccgtgttctttttactcataatggggcagttaacatggaacgatttaatccgtttatgcattatggtaggtgctaatgtgagcgatcgaatgggaatgggtacaacatatttagcgttaatggcgaccttcaagatgagaccaatgtttgctgtgggattgttatttcgtcgtctgacttcccgcgaagttttattattgacgataggactatcgttagtcgcgagtgtagaactgcccaatagcttagaagaattaggagacggactggcaatgggaatcatgatgttgaaattgctaacagacttccagtcccaccaactgtggactacgctcttgtccctaacttttatcaaaacaacactcagcctagactatgcatggaaaacaatggcaatggttttatctattgtctcattatttcccctatgtctatcaacaacgagccagaagacgacgtggctccctgtattactaggatcgtttggatgtaaaccacttacaatgttcctaattacagagaacaagatctggggaagaaagagctggcccctaaatgaaggtataatggccgtcggtatcgtctcaatattattgagttctctacttaagaatgatgtaccattagcaggaccattgatagccggaggaatgttaattgcctgctacgtaataagtggaagtagcgcagatttatcactggaacgtgctgcggaagtttcttgggaagaagaagcagaacactccggagccagccataatatactcgtagaagtacaggatgatgggactatgaaaattaaagacgaagaacgtgatgacacactcactatactattaaaggcaacactgttagcagtttccggagtatatcccatgagtattcccgccactttatttgtctggtatttctggcaaaagaagaaacaacgatcaggggtgctttgggatactccgtcaccacctgaagtagaacgagccgtgctcgacgatggcatttaccggattctacaacgcggattattgggtagatcgcaagtcggggtcggagtctttcaggacggagtattccatacaatgtggcatgtaactcgcggagccgtcttaatgtatcaaggaaaaagactagaaccttcatgggcctcagtcaaaaaggatttgatttcttatggcggaggatggcgatttcagggatcttggaacaccggagaagaggttcaggtaatagcagttgagccaggaaagaatcctaaaaatgtacaaactactcccggtacatttaaaaccccagaaggtgaagtcggtgcgatcgccttagatttcaaaccaggtaccagcgggagcccgatagttaatagagagggcaaaatagtcggtttatatggcaacggcgttgtaaccaccagcggaacatatgtatcggctattgcacaggcgaaagccagtcaagaaggacctttacctgaaatagaagatgaagtttttaagaaaagaaacttgactatcatggatttacatcccggctcagggaaaaccagaaggtatctgccagccattgttagggaagcaatcaaacgcaagttgagaactttaatattggcgcccacacgagtagttgcatccgaaatggcagaagccctgaaaggtatgcccataagataccagacaaccgccgtcaaatctgaacataccgggaaagaaattgtagatctaatgtgtcatgccacatttacgatgagattgctaagccccgttagagttccaaactacaacatgataataatggatgaagctcactttacagatccggctagcatagcggcgagaggctatatttcaactcgtgttggaatgggagaagcagctgcgattttcatgactgcaacgcctcccggtagcgttgaagcctttcctcaatcaaatgccgtgatccaggatgaggaaagggacatacccgagcggtcttggaactctggttacgactggatcactgacttcccgggaaaaacagtttggttcgtgccgtcaatcaaatcagggaatgatattgcaaactgcttacgtaaaaacggtaaaagagtaatacaactttcacggaaaacctttgatacagaatatcagaagaccaaaaataacgattgggattatgtcgtaactacagacatctcagagatgggcgcaaattttagagccgacagggtcatcgatcctaggagatgcctaaagccagtcattcttaaagacggaccagaacgtgtaatccttgcaggtccaatgcctgtcacagccgcaagtgcagcccaaaggcgcggacgaatcgggcgtaatcagaataaggaaggggaccaatatatttatatgggccagcctctaaataatgacgaagaccatgctcactggacagaagctaaaatgctgctggataacattaatacacctgaggggattatacccgctcttttcgagccagagcgagaaaagtcggctgcaatagatggagagtacagattacgaggagaagcccggaaaacatttgttgaattaatgagacggggagatctacccgtttggctttcatacaaagtagcatcagaagggtttcaatattccgatagaagatggtgtttcgacggtgaaagaaacaatcaagtattagaagaaaatatggacgtagaaatttggaccaaagaaggtgaaagaaagaaattaaggccccgatggttagatgctaggacgtactctgacccgcttgcgctcagagagtttaaagagttcgccgcggggagacgaagtgtatccggagacctaattcttgaaatagggaaattgcctcaacatttgacacttcgggctcagaatgcattagacaacctcgtaatgcttcataatagcgaacaaggcggaaaagcatacagacacgcaatggaagaactcccagatacgatcgagaccttaatgctactagccctcattgccgtactgaccggcggagttacactattcttcctaagtggaaaagggttaggaaaaacaagtataggattactatgcgttatggcttcaagtgttttattatggatggctagcgttgaaccacattggatagcagcgagtataattctagagttcttcctgatggtcttgctcattccagagccggacagacaacgaactccgcaggacaaccagttagcatatgtagtaattggccttctatttatgattttaacagtagccgcaaatgaaatgggattactggaaacaacgaagaaagatttgggtataggacatgtagttgcagaaaatcatcatcacgcgacaatgttagatatcgatcttcatcccgccagcgcttggacactatacgcagtcgccacaactatcataacccctatgatgagacacacaattgaaaataccacagccaatattagcttgacggctatcgctaatcaagctgctatcctaatgggcttagacaaaggatggccgatcagtaaaatggatataggcgtaccccttttagcattgggctgttacagccaagttaaccccctaacactaacagcagccgttttaatgctggtagctcactatgcgataatcggtcccggactacaggctaaggcaactcgtgaggcacagaagcgcacagcggccggaatcatgaaaaatcctacggttgacggaatagtcgccatagatctcgatcccgtagtgtacgacgcaaaatttgagaaacaattgggtcagataatgttattaattctttgtaccagccaaatcttacttatgcgtacgacgtgggcactttgcgaaagtatcactctagctaccggtcctctaacaaccttatgggaagggagtcctggaaaattctggaacaccacaatagccgttagcatggcgaatatttttagaggatcgtatctagctggcgcagggttagcatttagcctcatgaaatcattaggtggtgggaggcgtggtactggcgctcaaggggaaacgttaggcgaaaaatggaaaaggcaattaaatcagttatcaaaatcggaatttaatacctacaaaagatcaggtattatggaagtagataggtcagaagcaaaagaaggactcaagcgaggagaaactacaaaacacgctgtatcaaggggaacggcaaaactcagatggtttgtagaaagaaatcttgttaaaccagaaggcaaagttatagacctaggttgcggtaggggaggttggtcgtattattgtgcaggattgaagaaagtgacagaagtaaaaggctatacaaagggaggcccaggacacgaagaacccatacccatggctacatatggatggaacatagttaaacttcattctggacgagatgtcttcttcaccccgccagagaagtgcgatacactactatgcgatataggagaaagttctcctaacccaacgatagaagaagggcggacactacgggtactcaaaatggtagagccttggttgagagggaatcagttttgcattaaaatcttaaatccatatatgccatctgtagttgaaaccttagagcaaatgcaaaggaaacatggtggaatgttagttcgtaaccctttatcgagaaacagcacacacgagatgtactgggtcagctgcggaacaggaaatatagtgtctgcagtcaatatgacaagtagaatgcttttaaatcgtttcactatggcccataggaaacctacatatgaaagagatgtagacttgggtgcagggacgaggcacgtggcagtcgaaccagagatcgccaacctggacataataggtcaaaggatagaaaatatcaaaaatgaacacaaatcaacttggcactatgatgaagacaatccgtataaaacatgggcttatcacggctcatacgaagtaaagccatcaggaagtgcatcatctatggtaaatggcgtagtacgactattgacaaagccttgggatgtaataccaatggtaacgcaaatagccatgacggacacaacaccattcggacaacagagggtgttcaaagagaaggtagacacaagaaccccgcgaccgaaaaggggcactgcgcagattatggaagtcacagctaaatggttatgggggtttttaagtagaaataaaaagccacggatttgcacacgtgaagaatttacaaggaaagtaagatctaacgcggctatcggcgctgtcttcgtggatgaaaatcaatggaatagtgcaaaagaagcagtcgaagacgaacgattctgggacctggtacatcgtgaacgagaactccataaacaaggaaaatgcgctacttgcgtatataatatgatgggcaaacgtgagaaaaagttaggtgaatttggaaaagccaaaggatcacgtgcaatctggtatatgtggctcggcgcgagatttttagaatttgaggctttaggattcatgaatgaagatcattggttcagccgagaaaacagcttgtcaggtgtagaaggagagggtcttcacaaattaggttacatattaagagacatttcaaaaataccaggtggtaacatgtacgcagacgacaccgcaggatgggatacaagaattactgaagatgacttacaaaatgaggctaagataacagacattatggaaccagaacacgcactacttgcaacaagcatcttcaaattaacatatcaaaacaaagttgtacgtgtacaacggcctgcaaagagtggaacagtaatggacgtaatatcacggagagatcagcgtgggtcaggtcaggtcgggacttacggactgaacacattcacaaacatggaagtacaactgatcagacaaatggagagtgaaggcatatttagtccgtcggaattggaaaactctaatttagcagaaagagtactagattggttagagaagcacggtgtggagaggctaaaaaggatggcaataagtggcgacgattgtgtagttaaaccaactgacgataggttcgcaactgcactcacggctctgaacgacatgggaaaagtgcgaaaggacataccgcaatgggaaccttcgaaaggatggaatgactggcaacaagtaccattttgtagtcaccactttcatcaattgataatgaaggatgggcgagaaatcgtcgtcccgtgtagaaatcaagatgaattagtggggagagctcgcgtttctcagggggcaggttggtccttaagagagacagcttgtttagggaaaagttatgcacaaatgtggcaacttatgtattttcatagacgtgatctaagacttgcagctaatgcaatttgtagtgcggtgccagttaattgggtacctacctccagaacaacctggagtatccacgcccaccatcaatggatgaccacagaagatatgttatcggtatggaatcgagtatggatagaagaaaatccctggatggaggataaaactcatgttagcagctgggaggacgtaccctatttaggtaaaagagaggatcaatggtgtgggagcttaatcggacttacggcacgagcaacatgggcgacaaatatacaggtagctatcaatcaggtgagacggttgataggaaatgaaaattatttggactacatgacttcaatgaaacggttcaaaaacgaatctgatccggaaggtgccctttggtga

SEQ ID NO: 22113 - RNA, 9879 nt, synthetic construct
  misc_feature 1..9879: note = derived and/or modified CDS sequence (opt6) from DENV-1__KM403586__SS-prME
  source 1..9879: mol_type = other RNA
tcggttacgatgttattaatgttgctaccaactgccctcgcgtttcacttaacaacaagaggtggcgaaccgcacatgatcgtatctaaacaagaaagaggaaaatcactattatttaaaacttccgctggagtaaacatgtgtactctgatagcgatggatcttggagaattatgcgaagatacaatgacctataaatgccctagaattaccgaagcagaaccagacgatgtagactgttggtgcaatgccacggacacttgggttacgtacggcacatgctctcaaaccggagaacatcgcagagataaaaggtcggttgccctcgctccacatgtaggattgggtctcgagactcgcacggagacatggatgagcagtgagggcgcatggagacaaattcaaaaagttgaaacatgggcactacgacatcctggtttcactgtaattgcctttttcttagctcatgcgatcggaacatctataacgcaaaaaggaataattttcatactactgatgttagtaactccttctatggccatgagatgcgtaggaataggaaacagagacttcgttgaaggtttatctggagctacctgggtcgacgtagtactagaacacggaagctgcgtaactactatggctaaaaacaaacccacccttgatatcgaactcttgaaaacagaagttacaaatcctgcagtgcttagaaaactgtgcattgaagcaaaaattagtaacactaccactgactcacgttgtcctactcaaggagaagcaactttagtcgaagaacaagatgcaaacttcgtgtgtagacgtacgtttgtagaccggggctggggcaacggttgcggattattcggtaaaggttctttacttacttgcgctaaattcaaatgcgtaactaaacttgaaggcaaaatcgtacaatacgaaaacttgaaatatagcgtaattgtaacagtgcatacaggcgatcaacatcaagtaggtaacgaaacaactgagcatggaacaatcgcaacgatcactccgcaagcccctaccagtgaagttcagctaaccgattacggggctttaacattagactgttctcctaggaccggactagatttcaacgagatggtcttacttactatgaaagagaaaagctggcttgttcataaacagtggtttttagacttaccgctaccatggacgagtggggcgagtacctcccaagaaacatggaacaggcaggatttattagtcacgttcaaaacagcccatgctaagaaacaagaagtggttgtattaggtagccaagaaggtgctatgcatacggctctaactggtgccactgaaattcaaacatccggaacaactacgatatttgcaggacacctcaaatgtcgcttgaaaatggataaactaaccttaaaaggagtctcttacgtaatgtgcacgggttcttttaaattagaaaaagaggttgcagagacacaacatggaactgttctggttcaagttaagtatgaaggaactgacgctccctgtaaaattccgataagtacgcaagatgaaaagggggtgacgcagaacggcaggttaatcacagcgaatccaatagtgactgacaaagaaaaacccgtcaatattgaaactgaacctccatttggggaaagttatattgttataggagccggggagaaggctctgaaactatcatggtttaagaaaggaagttctattggcaaaatgtttgaagctacagctagaggagctagacgaatggcgattttaggtgatacagcgtgggatttcggctctatcgggggagtcttcacaagtgtcggtaagctagtacatcaagtattcgggactgcttacggagtactgtttagcggcgtcagttggacaatgaaaataggaatcggtatattactaacctggttaggattaaacagcaggtctacctcattatccatgacgtgtattgctgttggcatggtgaccctatatttaggagtaatggtccaagccgactcggggtgcgttataaactggaaaggacgagagcttaagtgtggtagcggaatattcgttaccaacgaagtacatacatggactgaacaatataagtttcaagcggatagccctaaacgcctttcggccgcaataggtaaagcctgggaagaaggggtatgtggaatcagaagtgcaacaagacttgaaaatataatgtggaaacaaattagtaacgaactaaaccatatattattagaaaatgatatgaaattcacggttgtagtaggagacgcatatggtatacttacacaggggaagaaaatgataagaccccaaccaatggagcataaatatagttggaaaagctggggaaaagctaaaattataggggccgatacacaaaatacaacttttataatcgatggacctgatacacccgagtgcccggatgatcaacgcgcctggaacatttgggaggtagaagattacggttttggtgtttttacgacaaatatttggctgaaactacgcgactcatacacgcaaatgtgtgaccacagactaatgagcgcggctattaaagattcaaaagccgtacacgcggatatgggttattggatcgaatcagagaaaaacgaaacatggaaattggctcgagctagttttatagaagtaaaaacgtgtatatggccacgcagtcataccctttggagtaatggtgtacttgaaagtgaaatgattataccaaaaatatatggtggcccaatttcacaacataactatagacctggttatttcacacaaacagcaggtccctggcatcttggaaaattagaactagattttaacttgtgtgaaggaacaacggtcgtcgtggatgaacattgtggtaacagaggtccaagccttaggacaactactgtcactgggaaaatcatacacgaatggtgttgcagatcttgtaccctcccgcctctaagatttagaggcgaagatgggtgctggtatggtatggaaattagaccagtaaaagaaaaggaagaaaatctggttaggagcatggtaagtgccggaagcggagaagtagattctttctctttgggtctattatgcgtgtcaattatgatagaagaagtgatgcgttcgcgctggtctcgcaagatgctaatgacgggcacattagccgtcttctttctattgataatggggcaattaacatggaatgatttaatcagattgtgtattatggttggagccaatgtatcagacaggatgggtatggggacaacctatctagcgcttatggccacttttaaaatgagaccaatgttcgcagttggcttactctttagacgcctcactagccgagaggttttactgttaaccatcggtttgtcgctcgtcgcgtcggtagaactacccaactcgttagaggagcttggcgatggacttgctatgggaatcatgatgttgaagttactcacggacttccaatctcaccaattgtggacaactttattgtctctaacattcataaaaactacattatcattagactacgcctggaagactatggcaatggttttgagcatagtatctctgtttcccttgtgtctttccaccacatctcagaaaacgacttggttaccggtactactaggttcatttggatgtaaaccattgactatgtttctaattactgagaataaaatttggggaagaaaatcttggccactaaacgagggtataatggccgtcggaattgtgagtatcctccttagtagcttactcaaaaatgatgtacccctggcgggaccgttaatcgcgggtggaatgctcatagcatgctatgtaatatcaggaagtagcgctgatctttcgcttgagcgtgcagcggaagttagctgggaagaagaggcggaacatagtggtgcctcacataatatactggtagaagtccaagacgatggtactatgaagatcaaagacgaggagagagatgacactctaacgatactacttaaagcaactttattagcggtctccggagtttatccaatgtcaattccagcgacattatttgtttggtacttctggcagaagaagaaacaaagatcaggtgtattatgggatacaccgtccccgccagaagttgaacgagcggtactggacgatggtatctacaggatactccaacgcggactgttgggtcgatcgcaggtaggagtaggtgtatttcaggacggagtttttcacacgatgtggcacgtaacgagaggagcagtattgatgtatcaaggtaagagacttgagccatcttgggcatctgtcaagaaagacctaatttcgtatgggggaggttggagatttcaagggtcctggaacacaggcgaagaagtgcaggttattgcagtagaaccaggaaagaatcccaagaatgtacagaccacacccggaactttcaaaacaccggaaggggaggtaggcgcgatagcattagattttaaaccaggcacaagtggtagccctattgttaatcgtgaaggtaaaattgtaggcctttatggaaatggtgtagtgacgacatcaggaacctatgtatccgcaatagcacaagcaaaagctagccaagaagggccgctaccagaaattgaggacgaagtattcaagaaacgaaacctgactataatggatcttcatcctggaagcggcaaaacaagaagatacctcccggctatagtaagagaggctataaaacgtaagttaagaactttaattttggcaccaactagagtagtcgcatcagaaatggcggaagcattgaaaggaatgccaatacgttatcaaacgactgccgtaaaatccgaacacaccggaaaagaaatagttgacttaatgtgccacgccacctttacgatgagattactatccccagtacgggttccaaattataatatgataataatggacgaggcacactttacagaccccgcatcaattgctgcaagaggatatataagtactcgggtaggcatgggtgaagcagcggcaatatttatgactgccacaccaccgggttcagtggaagcgtttccacaatccaacgcagtcatacaggatgaggagagagacatccccgaaaggtcgtggaacagtggctatgattggataaccgacttccccgggaaaacggtatggtttgtaccaagtataaagagtggtaatgacattgccaactgcctaaggaaaaacggaaaacgagttatccaacttagcagaaaaacttttgacacagagtatcagaaaaccaaaaataacgattgggactatgtcgtgaccacggatataagtgaaatgggcgccaactttcgggccgatagagttatagatcctagaaggtgtttaaagcctgtaatactaaaggatggccctgaacgggtgattttagcgggcccaatgcccgttacagcggctagcgcagcccaaagaaggggacggatcggaagaaaccaaaataaggagggagatcaatatatctacatgggacagcctctaaacaatgacgaagatcatgcacactggaccgaagccaagatgctattagataatatcaatactccggagggtattataccagctctatttgagcccgaacgagaaaaatcggccgcaatcgacggcgagtacagactgcgcggagaagccagaaaaacgtttgttgagctaatgaggcgcggcgatttaccggtctggctgtcatacaaggtagcttcggagggattccaatattctgatagaagatggtgtttcgacggagaaagaaataatcaagtcctagaggagaacatggacgtagaaatatggaccaaggagggagagaggaagaaacttcggcctagatggctagatgccaggacttactcggatccattagcgctacgcgaatttaaggagtttgcagcaggacgtaggagtgtttctggggacctcatattggaaataggaaaattgccacagcacttgacgctaagagcacaaaacgctctcgataatttggtaatgttacacaactcagaacaagggggtaaagcatacagacacgcaatggaagaactcccagacactatagaaacattaatgctactcgcattaattgcggtccttacgggcggagtcacattatttttcttatcaggaaaaggattaggcaagacaagcattggactactatgtgtcatggcatcaagcgtgcttttgtggatggcttccgttgaaccacactggatcgcagctagtataatattggagttctttctcatggttctcttgatacccgaacccgatcgacaaagaacccctcaggataaccagctagcgtatgttgtcataggactcttatttatgatattaacagttgctgctaatgaaatgggcttactagaaaccaccaaaaaggacctaggaattggacacgtcgtagcggaaaaccatcatcacgctacgatgttagatattgatttacaccctgcaagtgcctggacattatacgcagtggcaactacgattataaccccaatgatgagacatactatcgaaaatacaaccgccaatattagcttaactgctattgcaaatcaagctgcgatattgatgggactagacaaaggttggccaatctctaaaatggatataggtgtaccactcttagccttgggttgttattcacaagttaacccactaactttaacagctgcagttttaatgctcgttgcacactatgcaataataggtccaggattgcaagccaaagctacaagagaagcacaaaaacgcactgcagctggtattatgaaaaacccgacagtcgatggaattgtagcaatagacttagatcccgtcgtatacgatgcaaaatttgaaaagcagttaggtcaaataatgttattaatcttatgcacatcacaaatcttattgatgaggacaacatgggcactctgtgaaagcattacattagcaactgggccacttactactttatgggaaggttcacccgggcgtttttggaatactaccatcgcggtcagcatggccaatatcttcagaggaagctatctagcaggagccggattagccttttcattgatgaagagtctaggaggtggtaggaggggaacaggcgcacagggagaaactcttggagaaaaatggaaacgtcaattaaaccaactttcaaagagtgaatttaacacgtataaaagatcaggcataatggaggttgatcgatcagaagcaaaagaaggtatgaaacgaggtgagaccacgaaacatgcagtgagtcgaggaacggcaaagttgcgctggtttgtcgaacgtaacctagttaaaccagaaggtaaagtcattgatctaggctgcgggcgcggcggttggtcttactattgcgcgggtcttaagaaagtcacagaggtaaaaggatacacaaaagggggaccaggtcatgaagaaccaatacctatggcaacatacgggtggaacatagttaaacttcactctggccgagatgtattctttactccacccgaaaagtgcgatacactattatgtgatatcggagagtcaagtccaaacccgaccatagaagaagggaggactcttagagtgcttaaaatggtagaaccatggctaagaggtaatcaattctgtattaaaatcttaaacccctatatgccttcagtagtagaaacgctcgaacaaatgcaaagaaagcatggaggtatgttggtcaggaaccccctaagtagaaatagtacacatgagatgtattgggtaagttgtggtacaggtaacatagtttccgcagtcaatatgacatcgagaatgctactaaataggtttacaatggctcatagaaaacctacgtacgaaagagacgtcgaccttggggccggcactcgacacgtagccgttgaaccagaaattgcgaacttagacataattggtcaaagaattgaaaacatcaaaaatgaacataaaagtacatggcattatgatgaagacaatccctataaaacatgggcgtatcacggctcatatgaggtgaagccaagcggtagtgcttcttctatggtcaatggggtcgtcaggctgctaactaaaccctgggatgtcatcccgatggtaacacaaatagcaatgacagacacaactccatttgggcaacaacgtgtttttaaagagaaagtcgatacgaggacaccaaggcctaaacgaggaacggcgcaaatcatggaagtaacagcaaaatggctctgggggtttctgagtcgcaataagaaaccacggatttgtacacgcgaggaatttacaagaaaagtgaggtccaacgcggctatcggagcagtgttcgtagacgagaaccaatggaacagcgccaaggaagcagtggaagacgaacgtttctgggacttagtccacagggaaagggaattgcataagcaaggcaagtgtgcaacatgtgtttataacatgatgggcaaaagagagaagaaactgggcgagttcggaaaggcaaaaggatcccgggcaatatggtatatgtggcttggcgcacggtttctggagttcgaagcactgggatttatgaacgaagatcactggttctctcgagaaaattcgttgtcaggggtggaaggagaaggccttcataaattgggctatattctacgagacatatcaaaaatcccaggcggaaacatgtatgcagatgatactgccggatgggacactagaatcaccgaagacgatttacaaaacgaagctaaaattaccgacattatggaaccagagcacgcattattagcaacatccatctttaaattgacttaccaaaacaaagtcgtcagagtccaacgtcctgcaaaaagtgggactgttatggatgtgattagtcgtcgcgaccaaaggggttcaggacaagtagggacatatggattaaacacttttactaacatggaagttcaacttataaggcaaatggagtccgagggaatattttcaccgtccgagctcgaaaattccaaccttgctgaaagagtgctagattggctagaaaaacacggagtagaaaggttaaagaggatggcgatctcaggggatgattgtgttgtcaagcctactgacgatagatttgcgacagccttaacagcacttaatgatatgggcaaagtaaggaaagatattccgcaatgggaaccaagcaaaggatggaatgactggcagcaagtaccgttttgcagccatcacttccatcaactcataatgaaagatggaagagaaattgttgtaccatgcagaaaccaagatgagttggtaggtagagcgagagtatcgcagggcgccggatggtccttacgagaaaccgcttgcctcggtaaatcctacgctcaaatgtggcagttgatgtattttcatagacgtgacttaagactcgcagcaaacgcaatatgcagtgccgtgcctgttaactgggttcccacatcgcggaccacatggtctatacatgcacaccaccaatggatgacgacagaggatatgttatccgtgtggaaccgagtatggatagaagaaaacccatggatggaagataaaacacatgttagttcctgggaagatgtaccatacctgggaaagagggaggatcaatggtgtggatcactaataggtctcacggctagagcgacgtgggcaacaaatatacaggtagctattaaccaagtcaggagacttataggtaatgaaaattatcttgattatatgacttctatgaaaagatttaaaaacgaaagcgacccagaaggagcactttggtaa

SEQ ID NO: 22114 - RNA, 9879 nt, synthetic construct
  misc_feature 1..9879: note = derived and/or modified CDS sequence (opt6) from DENV-1__KM403602__SS-prME
  source 1..9879: mol_type = other RNA
agtgtaacgatgttacttatgttgcttccaactgctttagcgtttcaccttacgaccagagggggagaaccccatatgatagtgagtaaacaagaaagaggcaaaagtttactatttaaaacttctgctggagttaatatgtgtaccttaatagcaatggatctgggtgaattatgcgaagatacaatgacgtataaatgcccgagaataaccgaagcagaaccagatgatgtggactgctggtgcaatgctactgatacatgggttacgtacggcacctgttcacaaactggcgaacacagaagggataaaagaagtgtagctctagcgccgcacgtcggtttagggctagaaacaaggacagaaacgtggatgtcgagcgaaggagcttggagacaaattcagaaagtggaaacctgggcacttcgacatccgggctttacagttatagcacttttcttggcacatgcaatcggaacctctataacccaaaaaggaatcatatttatattgcttatgttagtcaccccgtccatggctatgcgatgtgtaggtattggaaatcgagactttgttgaaggcttaagtggagctacatgggtcgatgtagtgttagaacatggatcatgtgtcacaaccatggcgaaaaataaaccaacactagacatcgaattgttaaaaacggaagttactaatccagcagtgttacgtaaactttgtatcgaagcgaaaatatcaaatacgacgactgacagccgatgtccaacacaaggcgaagccacactcgtagaagaacaggacgcgaactttgtgtgtagaagaactttcgtagatagaggctggggtaacggatgcggcttattcggtaaaggtagtcttttaacatgcgcaaaattcaaatgtgtaactaaactggaaggcaaaatagtacaatacgaaaatttaaaatatagtgtgatcgtaacggtacacacaggtgatcagcatcaagtaggtaacgagacaaccgaacacggcacgatagctacgataactccacaagcgcctacgagcgagatacaattaacagattatggtgccattacattagactgttcacctcgaactgggttagattttaatgagatggtactattgaccatgaaagaaaaatcatggctagtacataaacagtggtttctagacttaccacttccatggaccagtggagctagtacttcacaagaaacatggaatagacaagatctattagttacttttaaaacggctcatgctaagaaacaagaagtagtggtcctaggaagtcaagaaggagcaatgcacaccgcactcacaggtgcaacagaaattcagacgtcagggactaccacaatcttcgcgggccaccttaaatgtagattaaaaatggataaactgacattaaaaggcgtatcatacgtaatgtgcaccggaagttttaaacttgagaaagaggtagccgaaacgcaacacggtactgtattggtacaagtgaaatacgaaggaacagatgcgccctgcaaaataccaatctcaacccaagatgaaaagggggtgacacagaatggaagactgatcaccgcaaatcccatagttacggataaagagaaaccagtcaatattgaaacggagccgccgtttggtgagtcgtatattgttatcggagcaggcgaaaaggctttgaagttgagctggtttaagaaagggagttcgataggaaaaatgtttgaggcaacggcacggggagccagaagaatggcaatactcggcgacactgcctgggattttgggagtattggcggtgtttttacctcagtcgggaaacttgtacatcaagtgttcggcactgcttacggcgtcctattttccggcgtctcctggaccatgaaaattggtattggaatcctgctcacgtggctcggcctcaactctagatcaacatctttatctatgacctgtatcgcagttggcatggttacactttacttaggagttatggttcaagcagatagtggatgcgtaattaattggaagggtcgcgaactgaaatgtggatccggcatatttgtgacaaatgaggtacatacttggacagaacaatataaatttcaagctgacagtccaaagagactttcagcagcaatcggtaaggcatgggaagagggagtctgtggcatccgcagcgctactcgactagaaaacataatgtggaaacagataagctcggagttgaatcacattcttctggaaaatgatatgaaattcacggtagtagtgggagatgctaatggaatactgacacagggcaagaaaatgataaggccgcaaccaatggaacacaaatattcgtggaaaagctggggtaaagctaagataataggggctgatacccaaaatacaacatttattatcgatggtccagataccccagaatgcccagatgatcaaagggcttggaacatttgggaggttgaagattatggatttggcgtatttacgactaatatatggcttaaacttagagattcttatacgcagatgtgcgatcatcgactaatgagtgcagctataaaagacagtaaggcagtgcatgcagatatgggctactggatagaaagcgagaaaaacgaaacctggaaactagctagagctagctttatagaagtcaaaacatgtatatggccgagatctcatacattatggagtaacggagtactagaatcagaaatgataataccaaagatatacggaggaccaataagtcagcacaactataggcccggctacttcacacaaacagcagggccctggcatctcggaaaactagagttggactttaatctctgcgaaggtacaactgttgtagtagatgaacattgtggcaacaggggcccttcactgagaacaaccacagtaacaggaaaaataatacacgagtggtgttgcaggtcgtgcactctgcctccccttaggtttagaggggaagacgggtgctggtacggcatggaaatcagaccagtaaaagagaaagaggaaaaccttgttagatctatggtatcagcggggagcggagaagtagattcattttctctgggactattatgcgttagcattatgattgaagaagtgatgcgatccagatggagtaagaaaatgcttatgactgggactctggcagtattcttcttactgataatggggcaactcacgtggaatgacctaatccgtctttgtatcatggtcggagcgaatgtcagtgaccgaatgggaatgggtacgacatacctagcgcttatggctacgttcaaaatgagacctatgtttgcagtagggctactcttccgacgattaacaagtcgagaagtacttttattgactattggtttatcactcgtagcaagtgtagaactgcctaattctctagaagaacttggtgatggtctagctatggggattatgatgctaaaattactaacggacttccaatcacatcagctatggactacgttattatctttgacttttattaaaactacattatctttagactacgcttggaaaaccatggcaatggtactaagcatagtatcattatttcctttatgcctatcaaccacctcgcagaaaactacatggctaccagtacttttaggcagctttggatgcaaaccactaacaatgtttctgattacagaaaataagatatggggaaggaaatcttggcctctaaacgagggcatcatggcggttggaatcgtgtcaatccttctgtccagcttactgaaaaatgacgtaccactggccggacctttaatcgccggtggcatgttgatagcttgttatgttatatctgggtcgagcgcagatttgtcattggaacgcgcggcagaggtaagctgggaagaagaagcagaacatagcggtgcctcgcacaacattttagtagaggtacaagatgacggtactatgaaaataaaggatgaagaacgagacgatacattaactatcttactaaaagcaacgctccttgccgtctcaggtgtatacccaatgtctattccagcgactttgttcgtctggtatttctggcagaagaagaaacaacgaagtggagtcttatgggacacacctagtcctccagaagtcgagcgagcagtgctagatgacggcatatatcgcattctgcagcgaggattattgggccgcagtcaggtcggcgtcggagtttttcaagatggagtatttcacaccatgtggcacgttacccgaggcgcggtactcatgtaccaagggaaacgattagaacccagttgggcctcagtgaaaaaggatctcataagttatgggggaggttggcgctttcaaggttcatggaacactggagaagaagtacaagtgatagcagtagagcccggcaaaaatcctaaaaacgtgcaaacaacacccggcacattcaagacacctgaaggcgaggtaggagcgattgccttggactttaagcctggtacaagtggcagccctattgtgaaccgggagggaaagatagttgggttgtatggcaacggagtagtaactacctctggcacatatgtatcggccattgcgcaagcaaaagcatcacaggaaggtcctttaccagaaattgaagatgaagtttttaagaaacgcaatttaacaataatggatttacatccgggatcgggtaagacacgacgctatttaccagcaattgtgagagaagcaataaaacgcaaactgagaaccctaatattagcgccaactagggtagtagcaagcgagatggcagaagctctaaaaggcatgcccatacgctatcaaacaaccgcagtaaaatctgagcacacaggaaaagaaatagttgatctcatgtgccacgcaacatttactatgcgcctgttatcacctgtacgagtaccaaattacaacatgataataatggatgaggcgcatttcactgatccagcgagcatagcggcaagaggatacatctctacacgagtaggtatgggagaagcagcggctatattcatgacagctacaccaccaggatcagtagaagcatttcctcaaagtaacgctgtaatccaagatgaggaaagagatataccagaacgaagctggaacagtggctacgattggataacagattttcctggtaagacagtctggttcgtgccaagtattaaatctggaaatgacatagcaaactgtttgaggaaaaatggtaagcgggttatacaattgtcaagaaaaacgtttgacaccgaataccaaaagacaaagaataatgactgggattacgtcgtaacaacagatataagtgagatgggcgccaatttccgcgctgatagagtgattgatccaagacgttgtttaaagccggtaatattaaaagatggacccgaaagagtaatcttagcgggaccaatgccagttacggctgcaagtgcagcacaacggcgtggaaggattggcaggaatcagaacaaagaaggcgatcagtatatttatatgggtcagccactcaacaatgacgaggaccacgcccactggacagaggcgaaaatgttattagataacattaatactcctgaaggtataatacccgctctctttgaacctgagcgtgaaaagtcagcggcgatcgacggcgaatataggcttaggggtgaagcaaggaaaaccttcgttgaactcatgaggcgaggtgacctacctgtatggttatcatataaagtggccagtgaaggctttcaatactcagatagacggtggtgcttcgatggagaaaggaataatcaagtactagaggaaaacatggatgtggaaatatggacgaaagagggtgaaagaaagaaattacgacccaggtggctagatgctcgaacctactctgaccctttggcattacgagaatttaaagagtttgctgccggacgcaggtcagtctccggagacctcatactagaaataggaaaacttccccaacatctaacacttcgagcacaaaacgctcttgataatttagttatgctgcataattcagaacagggaggaaaagcgtacaggcacgccatggaagagttgcctgatactatagaaacattaatgttattggcactcatagccgtactgacgggaggagtgaccctattctttttgtccggaaaaggtctaggaaaaacgagtattgggctattatgtgtaatggcatcctcagtactgttatggatggcgtctgtagaacctcattggattgccgcgtctatcatccttgagttctttctcatggttttactaattcctgaacctgatagacaaagaaccccacaagacaatcaactcgcgtatgtagtgattggcttacttttcatgatactaaccgttgcagcaaacgagatggggttattggaaaccactaagaaagaccttgggattgggcacgttgtcgctgaaaaccatcatcatgccaccatgctagacatagatcttcaccccgcaagcgcttggaccctatatgcggtcgctacaacaattattacccctatgatgaggcacacaatagaaaacaccacagctaacatttcactaacggctatcgcaaatcaagcagcgatccttatgggtctagataaaggatggcccataagtaaaatggacatcggagtgccacttctagctttaggctgctatagtcaagtaaaccccttaactcttaccgcagcagtactcatgctagtagcccattatgctattataggacctggattacaagcaaaagcaacacgagaagcacaaaagagaacagcagcagggattatgaaaaatcctacagtagacgggatagtagctatcgaccttgacccagtcgtatacgatgcgaaattcgaaaaacaattaggacaaatcatgctattaattctgtgcactagccaaatactgcttatgagaacgacttgggcactatgtgaaagtataactctagcaactggccccttaacaactctatgggaaggcagtcccggaaaattttggaatacgactattgcagtttcgatggctaatatatttagaggaagttacttagccggagcaggactagcatttagtcttatgaagtcccttgggggcggtaggcgtgggactggtgcacaaggtgagactttaggcgagaaatggaaaaggcaactgaatcagttaagcaagtccgagtttaacacgtataaaagatctggtattatggaggtagatcgctcagaagcaaaagaggggttaaaacgaggggagaccacgaagcatgcagtgtctagaggaacagcaaagctccgatggtttgtagagcgcaatttggttaagccagaaggcaaagtgatcgacttgggctgcggtcgagggggatggtcttattattgtgctggactcaagaaagtaacggaagtgaaaggctacacgaaaggcggtcctggccatgaagaaccgattccgatggctacatacgggtggaacattgttaagctacattccgggagagatgttttctttacaccccctgaaaaatgtgataccctattatgcgacattggcgaatcatctcctaacccaactatcgaagaaggacgtactttgagggtactaaaaatggtcgaaccatggcttcgtggcaatcaattctgtataaagatactcaatccatatatgccgagcgtagttgaaacgttggaacaaatgcaaagaaaacatggcggcatgttagttagaaatcctctatcaagaaattcgacccatgaaatgtactgggtaagttgtggcacagggaacattgttagcgcagtcaacatgacctcgagaatgctattaaataggtttacgatggcgcataggaaacctacgtatgaacgagatgtagacctaggggccggaactcgacatgtagctgttgagccggaaatagcaaacttagatataatcggacagagaattgaaaacatcaaaaatgaacacaagtccacatggcactatgatgaagacaatccgtataaaacttgggcatatcacggttcttatgaagttaaaccttcaggaagtgcttcctcaatggttaacggagtagtccgtctattaacgaaaccgtgggatgtgatcccaatggtgactcaaattgctatgaccgataccacaccgttcggccagcaaagagtttttaaagaaaaagtggatactagaacaccccggcccaaaaggggaacagcccagataatggaggttacagcaaaatggctttggggattcttgtccaggaataagaaaccacgtatatgcacaagagaggaatttaccaggaaggtacgatcaaacgcagcaataggtgctgtctttgtagacgaaaatcaatggaactcagccaaagaagccgtagaggacgaaagattctgggacctcgtacacagggaacgagaattacataagcagggtaaatgtgcaacttgcgtatataatatgatgggtaaaagagagaagaaattaggtgaatttggaaaagctaaagggagccgagccatatggtacatgtggttaggagcaagatttctcgaatttgaggctttaggttttatgaacgaagatcactggttctcacgagaaaacagtctaagtggagttgaaggagaagggctacataaattagggtacatcctacgcgatatatctaaaataccaggtgggaatatgtatgctgatgacaccgcaggctgggatacaaggataacagaagatgacttgcagaatgaggcaaaaataaccgacattatggaaccggaacatgctctattagctacatctatatttaaactcacctaccaaaataaagtggtacgagtgcaacgacctgcgaaatcaggtacggttatggacgtaattagtcgtcgggatcaaaggggtagcgggcaagtaggtacgtacggtttaaataccttcacgaatatggaagtacagttaataagacaaatggaatctgaaggcatcttttctccatcagagctagagaacagtaatttagccgaaagggtactggattggttagaaaaacacggagtggaaagactgaagagaatggccatctcaggagatgactgtgttgtaaagccaacggacgaccgttttgctacggcacttactgctttaaacgatatgggtaaggtgcgcaaggatatccctcaatgggagccgtctaagggctggaatgattggcagcaagttccgttttgctcacaccacttccatcaattaataatgaaggatggccgagaaattgtagttccctgtaggaatcaagacgaattagtgggacgagcaagggtaagccaaggagcgggatggtctctacgtgaaacagcctgcctaggaaagtcgtatgctcaaatgtggcaattaatgtattttcatagaagggaccttagacttgcagcaaatgctatatgtagcgctgtgccggtaaattgggtacctacgtcgagaacgacgtggtcgatacatgcacatcaccagtggatgacaacagaggatatgctctctgtctggaacagagtatggattgaggagaatccttggatggaggataaaacacacgtatcttcgtgggaagatgtaccatacctggggaagcgagaggatcaatggtgtggatcattaattggcttaacagctcgcgccacgtgggctacgaacattcaggttgcaatcaatcaagtccgccgacttataggaaatgaaaattatctggattatatgacgtcaatgaaaagatttaaaaatgaaagtgatccagaaggagcattatggtaa

SEQ ID NO: 22115 - RNA, 9879 nt, synthetic construct
  misc_feature 1..9879: note = derived and/or modified CDS sequence (opt6) from DENV-1__KM403582__SS-prME
  source 1..9879: mol_type = other RNA
agcgtaacaatgctactcatgctactaccaacagcacttgcgtttcatcttactaccagaggaggtgaaccccatatgatagtttctaaacaagaacgaggaaaatcgctattatttaaaacgtcagcgggtgtcaatatgtgtactcttatagccatggatctcggagaattatgtgaagacacaatgacgtacaaatgtccccgaataacagaagcagaacctgacgatgtagactgttggtgtaatgcaacggacacgtgggtaacatacggaacctgtagtcaaacaggcgaacatagaagagacaggcgaagcgtggcacttgcaccacacgtcggattagggctcgaaacgagaacagaaacctggatgagttcagaaggcgcgtggaggcaaatacaaagagtagaaacatgggcactacgacaccctggattcacagtgatagcactctttttagcacacgcaattgggacgtctattacacaaaaagggataatatttattctgctaatgcttgtcacaccttcaatggcgatgcgttgtgttggaattgggaacagggattttgtagaaggcttatctggggctacttgggttgacgttgtactcgaacatggtagctgtgtgactactatggctaaaaataaaccaacgctagacatagaactattaaaaactgaagtgactaaccccgctgttttgagaaaactctgtatcgaagctaaaatcagcaatacaactacggacagccgatgtcccacgcaaggggaagcaacgctagttgaagaacaagatgcaaatttcgtatgtagacgtacgtttgtggaccgggggtggggtaatggttgcggtctttttggcaaaggttcgctactgacctgtgccaaatttaaatgcgtaacgaagttagagggaaaaatcgtgcaatatgaaaacctgaaatactcggtgattgttacagttcacacaggtgatcaacatcaagtaggcaatgaaactacggagcatgggacaatcgccacaattactccacaagcaccaacaagcgaaattcaattaacagactatggtgcactaactcttgattgcagccctagaaccggattagactttaatgaaatggtactgttaactatgaaagaaaaatcatggttagtacataaacagtggtttttagatcttcccttaccgtggactagcggcgcatcaacatcacaagagacatggaacagacaggacctcttagtaactttcaaaaccgcacatgctaagaaacaagaggtggttgtgttgggatcacaagagggagctatgcacactgctttaacaggagctaccgagatccaaacatctgggacaactacaatcttcgcaggtcacttaaaatgtagacttaaaatggacaaactaactttaaagggcgtgtcctatgtaatgtgtacaggttcgttcaaactcgaaaaggaggtggctgaaactcaacatgggactgttttggttcaggttaagtatgaaggaacagatgcaccctgcaaaataccgatatctactcaagacgaaaaaggagtcacacaaaatggtaggctaattacggctaatccaatagtaacagacaaggaaaaacctgttaacattgaaactgaaccgccatttggagaatcgtatatagtgatcggcgcaggagagaaagctctaaaattgtcttggtttaagaaaggatcttcaataggtaagatgtttgaagctactgctcggggagcaagacgtatggcaatactaggagatactgcttgggacttcggatccattggcggagtttttacaagcgtgggaaaactcgttcatcaagtatttggtaccgcatatggtgttttattctctggagtaagttggacaatgaagatcggtatagggatattgttaacatggcttggccttaattctcgaagcacatctctttcgatgacctgtattgcggtcggtatggtaaccttatacttgggagtaatggttcaagcggatagcggttgcgttatcaactggaagggacgggaattaaagtgtggaagtggcatattcgttacaaacgaagtacacacatggacagaacaatacaaatttcaagcagattcaccaaaacgactctcggccgcaattggaaaagcatgggaggaaggggtctgcgggataagatcgacaacaaggttagaaaatatcatgtggaaacagatatcaaatgaattgaatcacatattactggagaatgatatgaaattcacagtagttgtaggagatgccaatggaatacttactcagggtaagaaaatgattcgtccccaacctatggaacataaatattcttggaagagttggggaaaagcgaaaataattggtgcggatacacagaatactacatttattattgatggtcctgatactccggaatgcccagatgaccaacgagcatggaacatttgggaagtagaagactatggtttcggcgtattcaccacaaatatatggctaaaacttcgcgactcgtatacacagatgtgcgaccatagattgatgagtgccgcaataaaggactctaaagccgtccacgctgatatggggtattggatcgaatctgagaaaaatgagacatggaagctcgcgcgagcatcattcattgaagtaaaaacctgcatctggcctcgctctcacacgttatggagtaacggggtcttagagtcagaaatggtgattccgaaaatatatggcggacccataagccagcacaactaccgccctgggtactttacccagaccgccgggccgtggcacctggggaaattggaacttgattttaatctatgcgaaggcacgactgttgtagtagatgaacactgtgggaatagaggtccttctctgagaacgaccaccgtgacaggaaaaataattcatgagtggtgctgtaggtcatgtacactaccaccattacgatttagaggtgaggacggatgctggtatggaatggaaatcagaccagtaaaggaaaaagaagaaaatttagttcgatcaatggtaagtgccggcagtggagaagtggactcgttctctctcggattattatgcgtctctataatgatagaagaagtaatgagaagtcggtggagtaggaagatgctaatgacaggcaccctagcaatattctttctcctcattatggggcaactaacatggaacgacctcattagactttgtatcatggtaggagcaaacgtttctgaccgaatggggatgggtacaacctatctcgctctcatggcgacttttaaaatgagacccatgttcgcagtgggactgttatttcgaagactaacttctcgagaggttctattattaactataggactctccctagtcgcatctgtagagctaccaaacagcttagaagaactgggagatggattagccatggggataatgatgttaaaacttttgaccgactttcaatcgcaccaactttggactaccttattatcattaacttttatcaaaacaactttatctttggattatgcatggaaaactatggccatggtactctctatcgtaagtcttttccccctatgtctatcgaccacttcgcaaaagacgacctggttacccgttttactaggcagtttcggttgtaaaccattgacaatgtttcttataaccgagaacaaaatctggggaaggaaatcatggccgctcaatgaaggtataatggcagttggaatagtaagcatcctattaagttccttactaaagaatgatgtgccattagctggtcctttgatagcgggtggaatgttaatcgcatgttatgtaataagcggatctagtgcggatctatcactagagcgtgctgcagaagtgtcttgggaggaagaagcagaacattcgggagcctcccataatatattggtcgaagtccaagatgatggcacgatgaaaatcaaagatgaggagcgtgatgatacattaaccatattattaaaagcaacactcctagcagttagtggcgtgtatcctatgagcatcccagcaaccctattcgtatggtatttctggcagaaaaagaaacagaggtcaggagtattgtgggatactccgagtccaccggaagtagaaagagcagtacttgacgatgggatttatagaatactgcagaggggattactaggccgatcacaagtaggcgtgggtgtgttccaagatggtgtattccatactatgtggcacgtaactcgaggtgctgtattgatgtaccagggcaaaaggcttgaaccaagttgggccagtgttaagaaagatctcatatcatacggcggtggatggaggtttcagggatcctggaatacaggagaagaagttcaagtaatagcagtagaacccggcaaaaaccccaaaaacgtccaaactacgccggggacatttaagactcctgaaggggaagtaggagcaatcgctttagacttcaaaccagggacttcaggatcaccaatcgtcaatcgggagggaaagatcgtaggactatatggaaatggcgtagtgacgacgtccgggacttatgtttccgccatcgcgcaagctaaagcatcacaagaaggaccactaccggaaatagaagacgaagtcttcaaaaagagaaacttaacaataatggatcttcaccctggatcaggtaagaccagaaggtatttgccggcaattgttcgtgaagcaatcaaacgtaaattgagaaccttaatattagcaccaactagagtagtagcgtcggaaatggcggaagcattaaaggggatgcctatccgataccaaacaacggcggtaaaatccgaacacactggaaaggaaatagtggacctaatgtgtcacgcaacttttaccatgcgactcctatcgccagtaagggtaccaaattacaacatgataataatggatgaagcgcattttactgatcccgctagcatcgcagcaaggggatacatatctacacgtgtaggtatgggagaagctgcagcaatttttatgacagcaacaccaccaggatcagtcgaagccttcccacaatctaatgcagttatccaagatgaagaaagggacattccagaaaggagttggaactctggatacgactggataacagattttccaggcaaaactgtctggttcgttccgagtataaaatcaggtaatgatattgcaaactgcctacggaaaaacggaaaaagagttattcagctatccagaaagactttcgacacagaataccagaaaaccaaaaacaatgactgggattatgtagtaactaccgatatatctgaaatgggcgccaactttcgcgcagatagagttatagatccacgcagatgtctgaagccagttattcttaaagacggaccggagagggttatactagccgggcctatgcccgtcaccgcagcctcagcagcccaacgtcgtggaaggataggaaggaatcagaataaagaaggtgatcaatacatttatatgggacaaccacttaacaatgacgaagaccatgctcattggactgaagccaagatgctgctagataacattaatactcctgaaggaattatcccggcactattcgagccagagcgggaaaaatctgcagcaatcgatggggaataccgtttaaggggagaggcacgaaaaacgtttgtggaactgatgagacgcggcgatttaccggtatggctaagttataaagtggcatcagaaggtttccagtacagtgataggagatggtgttttgatggagaaaggaacaatcaagtattagaagaaaacatggatgttgaaatctggacaaaagaaggggagaggaagaaacttcggccacggtggctagatgcacgtacatacagcgaccctttggctctgcgtgagttcaaagagttcgcagcgggcagaagaagcgtatcaggggacctgattctagaaataggtaaacttcctcaacacctaacattgcgggcccaaaacgcgctcgataatttggttatgctacataattcagaacagggcggaaaagcatacaggcacgcaatggaagaactacccgacacaattgaaacactaatgctactcgcattaatagcagttcttacaggcggagtaacattattcttcttaagcggtaaaggtctcggaaagacttccataggactactatgtgtgatggccagttccgtattattatggatggcgtcggtagaaccccattggatagccgcgtcaatcatactagaatttttcttaatggtactacttattcccgaaccggaccgtcaaaggacgccgcaagataatcaattagcctacgtcgtcattggactactctttatgatcttgactgtagcagcaaacgaaatgggcttactagaaactactaagaaagatctaggtatagggcatgtggtagcagagaatcatcatcatgctacaatgcttgacattgatttgcatcccgcaagtgcctggacgctttacgctgtagctactacaataatcacgccaatgatgagacatacaatagagaatacgactgcaaacatctcgttaaccgcaatagcaaatcaagcggcaattctcatggggctagataaaggatggccaataagtaaaatggacataggagtaccactgttagccttaggatgttactcacaagtcaatccattgactctaacggcagccgtcctaatgcttgtagcccactatgcaattattggtcctgggttacaagcaaaagctactcgcgaggctcagaaaagaacagcagcaggcataatgaagaatccaacagtcgatgggattgtggcgattgatctcgatcctgtcgtatacgatgcgaaatttgagaaacagttaggtcaaataatgttattaatattatgcacttcgcaaatcttattgatgcgtacgacctgggctttgtgtgaaagcataacgctggcaacaggaccacttaccacattatgggaagggagtcctggaaaattttggaatactaccatagcagtaagcatggcaaatatcttcaggggaagctacttagcgggagctgggctagcgttttcattaatgaaaagcctaggcgggggcagacgtgggactggtgcgcaaggagagacactgggtgaaaaatggaaacggcaattaaaccagctgtcaaagagcgagttcaatacgtacaagagatctggaatcatggaagtcgaccgatccgaagcaaaagaaggtctcaaacgtggcgaaactaccaagcacgcagtgagtcgtggaacagcaaaattacgctggtttgtcgaaaggaatttagttaaacccgaaggaaaggtaatagatttaggctgtggacgtggaggttggtcatattattgtgccggactgaagaaggtgacggaagttaagggctatacgaaaggtggaccgggacatgaagaaccgattcccatggcgacgtacggttggaatatagtaaaattacactcaggtcgagacgtattctttacaccaccagaaaaatgtgacacgcttctttgtgatattggagaatcatcaccaaacccaaccattgaagaggggagaacattacgtgtcttaaaaatggtcgaaccctggctgcgaggtaatcagttttgtataaaaatcctgaatccttatatgccatcagtagtcgaaacacttgagcagatgcagcggaaacacggtggaatgttagttaggaaccctctcagcagaaattccactcatgaaatgtattgggtatcctgtggtacaggaaacatagtctcagccgtcaacatgacatcccggatgttactaaacaggtttacaatggcacacaggaagccaacatatgagcgagatgtagatttaggagcaggaaccagacatgtagcagtagaacctgaaactgctaacttagacatcataggacagcgcatcgaaaatatcaaaaacgaacataaatctacttggcattacgatgaagataatccgtacaaaacatgggcatatcatggttcctacgaagtaaagccgtcaggatctgcgtcatctatggtaaatggggtagtccgattattaacaaaaccgtgggatgtaatacctatggtgacccaaatcgcaatgacagatacaacaccgtttggacaacaaagggtttttaaagaaaaggtagatacacgaactccaaggcctaaaagaggaacagctcaaatcatggaagttaccgcaaaatggctctggggttttctttcaagaaacaagaaacccagaatatgtacaagagaagaatttacaagaaaagtgaggtcaaacgctgctatcggtgctgtatttgtcgatgaaaatcagtggaactctgcaaaagaagcagtggaagatgagagattttgggaccttgtgcatagagaacgagaactacataaacaaggtaagtgtgcaacgtgtgtatacaacatgatgggaaagagggagaagaaattaggtgaatttggaaaagcaaaaggaagcagagcaatatggtacatgtggctcggagctagatttttagaatttgaagccctgggatttatgaatgaggatcattggttttcccgagaaaacagcctttcaggcgtagagggggaaggtctacacaaattaggatacattttaagggatattagtaagataccaggaggtaatatgtacgccgatgatactgcagggtgggacactcggattacggaagatgacctgcaaaacgaagctaaaataacagacataatggaaccagagcacgcactgctagctacaagcatattcaaacttacataccaaaacaaagttgtgcgcgtgcaacggccagccaaaagcggcacagtaatggacgtcatcagtagaagagaccaaagaggatcaggacaggtcggcacatatggactaaacactttcactaacatggaagttcagttaatcagacagatggaatccgaaggcatattttctcctagtgaattggaaaatagcaatctggccgaaagagttttagattggctagagaaacacggagtagagcgactaaagaggatggcaattagtggagatgattgtgtcgtaaagccaactgatgatcgattcgcgaccgctttaaccgccctcaatgacatggggaaggtaagaaaagacattcctcaatgggaaccatcgaaaggctggaatgactggcaacaagtccctttctgcagccaccattttcatcagttaatcatgaaagacggcagagaaattgttgtaccatgtagaaatcaagatgagctagtgggacgcgcaagggtctctcaaggggcaggttggtccctacgtgaaacagcttgcctcggtaaatcttacgcccaaatgtggcaactaatgtattttcaccgacgagacctgcggctagccgccaacgctatatgttctgcggtgccggtaaattgggtccccacatcacgtacaacttggtcaatacatgctcatcaccaatggatgacaactgaggacatgttatcagtatggaatcgagtatggatcgaagaaaacccttggatggaggataagacccatgtgtcaagctgggaagacgtaccatatcttgggaaaagagaagaccaatggtgcggtagtctaataggattaactgctcgagcaacctgggcaactaatatacaagtagccattaatcaagttcgaagattaattggaaacgaaaattatttagactatatgacctctatgaaaagatttaagaatgagagtgatccagagggagctttatggtag

SEQ ID NO: 22116 - RNA, 9879 nt, synthetic construct
  misc_feature 1..9879: note = derived and/or modified CDS sequence (opt6) from DENV-1__KM403577__SS-prME
  source 1..9879: mol_type = other RNA
tctgtaacaatgcttttaatgttattgccgactgcactagcgtttcacctgacaactagaggtggagaaccacacatgatagtttcaaaacaagaacgaggtaagagcttactttttaaaacttcagccggtgttaatatgtgcactcttatagcaatggatttgggtgaattatgtgaagatacgatgacttataaatgtcctaggataactgaagcagaacctgatgacgtcgattgctggtgtaatgcaacagacacctgggtaacttatggaacctgttctcaaacaggtgaacataggagagataaaagatccgtcgcattagcgcctcacgtaggacttggacttgaaacaagaacggaaacatggatgtctagtgaaggagcatggagacaaatacagaaagtagaaacgtgggcattgagacatccaggttttacggtaatcgcattctttttagcacatgcaataggaacttcaattacacaaaaaggtataatattcatactgttaatgctggtaacgcccagtatggcaatgcggtgtgtcggcatcggtaacagggatttcgtggaaggcctgtccggggccacgtgggttgacgttgtgttagaacatgggagttgcgtcaccacaatggccaaaaataaacctaccttagatatagaacttctaaaaacagaagttacaaaccctgcagttttgcgcaaattatgtatcgaagccaaaataagcaacactacaacagatagccgatgtcccacacaaggagaggcaaccctagtagaagaacaagatgcaaattttgtatgtagacggacttttgtagatagaggatgggggaatggatgtggcttgtttggtaaaggcagtttattaacatgtgctaaatttaaatgtgtaacaaaactagaagggaaaatagtacaatatgagaacctaaaatatagcgtgatagtaactgtccatacgggagatcaacatcaggtaggaaacgaaaccaccgaacacggaaccatagctaccatcactccccaagccccaacatcagaaatccaactgactgattacggcgcattgacccttgactgttcacctagaactggattagactttaatgaaatggttcttctaacaatgaaagaaaaatcttggctcgtacacaaacaatggtttctagatttaccacttccttggacaagtggtgcatccacttctcaggagacgtggaatcgacaagatttattagtaacatttaaaacggcccacgccaagaaacaagaagttgttgttctagggtcccaagaaggagcaatgcatactgcacttacaggggccactgagatccaaactagcggcacaaccacaatatttgcaggacacctcaaatgtagattaaaaatggataaactaaccttaaagggcgtatcctatgtaatgtgtacagggtcattcaaactagagaaggaagtggcggaaacacagcatggtactgtattagtgcaagttaaatatgaaggaacagacgcgccctgtaaaatacccatatcaactcaggatgaaaaaggagtaacccaaaatggtagacttataacagctaatccaatcgtgacagataaagaaaagcccgtaaacatcgaaacggaaccgccttttggggaaagttacatagtaataggtgcgggtgagaaagctctcaaattatcatggtttaagaaggggagttcaattggcaaaatgttcgaagctacagctagaggagccaggcggatggcgatcctcggggacactgcatgggattttggaagtataggaggtgttttcacatcagtcggtaaattagtccaccaggtatttggcactgcttacggcgttttgttttctggtgtaagctggaccatgaaaataggaatcggaatactgttaacttggttaggattaaactcaagatctacgagccttagtatgacatgcatagctgttggtatggttacgttgtacttaggggtaatggttcaagcagattcaggttgcgtaatcaactggaaaggcagagagcttaagtgtggaagtggaatctttgtaacaaacgaggtccacacctggaccgaacaatataaatttcaggcggatagtccaaagcgacttagtgcagcaattggtaaagcatgggaggagggtgtatgcggtattcggagtgcaacaagattagagaatattatgtggaaacagatcagtaacgaactaaaccatatactgctagagaatgacatgaaatttactgtcgttgtaggggatgcaaatggcatattaactcaggggaagaaaatgatccgaccacaaccgatggaacataaatacagttggaaatcgtggggaaaagccaagatcataggcgcagatacacaaaacacaacttttatcatcgacggcccagatactcccgagtgccctgatgaccaaagagcttggaatatatgggaagtagaagattatggatttggagtttttacgactaacatttggttaaaactacgtgacagttatacacaaatgtgtgaccacaggttaatgagtgcagcgataaaagactccaaagccgtgcatgcagatatggggtattggatagagagtgagaaaaatgaaacttggaaattagcacgagcatcatttattgaggttaagacatgtatctggcccagaagccatacactttggtcaaacggagtattagaatcagaaatgataataccgaagatatatggcggaccgatcagtcaacataattatagacctggatatttcactcagacggccggcccctggcatctcggtaaattagaattagattttaatctatgcgaaggtacaacagtagttgtggatgagcattgcgggaatagagggccttcactacgaactacaaccgtaaccgggaaaattatacacgaatggtgttgtagaagttgtacactacccccgcttagatttagaggcgaggatggatgctggtatggaatggaaatacggcccgtgaaagaaaaagaagagaacttagttagatccatggtctccgcaggttcaggtgaagttgactcttttagtttgggtttattatgcgtaagtataatgatagaggaagtgatgaggtcacgttggtctaggaaaatgttgatgactgggactcttgcggtattctttttattaataatgggtcaacttacatggaacgacctaattaggttatgcattatggtaggagcaaatgtgtcagaccgtatgggtatgggtacaacctatttggctttaatggcgacatttaaaatgcgtccaatgtttgcggtgggattactattccggagactcacctcaagagaagtattattattgaccataggtcttagtcttgtggcaagtgtagaattaccgaatagcctagaggaacttggagatgggttagctatgggcataatgatgctcaaattactgacagacttccaatcacaccaattatggactactctattaagcctgacatttataaaaacgacgttatctttagactatgcctggaaaacgatggcaatggttctgtcaattgtatctttgtttccgttatgtctctcaacgacaagccagaaaaccacgtggttgccagtgctcctaggatcatttggatgtaaacctttaaccatgtttctcataactgaaaataagatatggggcagaaaatcttggccactaaacgagggcataatggcagttggcatcgtctctatattactcagttcgctacttaagaatgatgtcccgttagctggaccattaatcgctggaggtatgcttatcgcgtgttacgttatatccggctcaagcgctgatttaagtctagagagggcggctgaagtaagctgggaggaagaggcggaacacagtggcgcgtcccataatatcttagtcgaagttcaagatgatgggactatgaaaatcaaagatgaagaaagagacgatacattaacaatcttattaaaagccacattattagccgtatctggagtatatcccatgtcaattcctgctaccctatttgtctggtacttctggcaaaagaagaaacaacgctctggcgtcttatgggatacaccaagtcccccggaagtagagagggcagtgcttgatgacggtatttaccgcatactacaacgtggattactaggtcgatcacaggttggagtaggtgtgttccaagacggagtattccacaccatgtggcatgttacccgaggagcagttttaatgtaccaaggaaaacgcctagagccctcatgggcaagtgtcaaaaaggatcttataagttacggtggagggtggcgttttcaaggatcgtggaatactggagaagaagttcaagtaatagcagtagaaccaggtaagaatcctaaaaacgttcaaaccacccctggaaccttcaaaactccggaaggtgaagtgggtgcaattgcattagactttaaaccaggtacgtcaggatccccaatcgtgaatagagaagggaagatcgtaggcctatacgggaacggagttgtaactacatcaggcacatatgtctccgctatagcacaagcaaaggcttctcaggaaggaccactacctgaaatagaggacgaagttttcaaaaagagaaatctcaccattatggatcttcatcccggatctggaaaaactagaagatatttgccggccatagttagagaagcaataaaaagaaaactaagaacactaatacttgccccgactcgtgtcgtggccagcgaaatggcggaagccctcaaaggcatgccaatacgatatcagacaacagcggttaaatccgaacatactggaaaagaaattgtcgatttaatgtgtcatgcaacctttactatgcgattgcttagccctgtaagggtcccaaactataatatgataatcatggatgaagcacacttcacagatcctgcttctattgctgctagaggctacatttcaaccagagtcggtatgggagaagcagcagctatttttatgactgctacacctccaggaagcgtagaggcttttccgcaaagcaatgctgtaatacaggacgaagaacgagacatccctgaaaggtcctggaatagcgggtacgattggatcaccgattttccaggtaaaacagtatggtttgtcccttcaattaaatcggggaacgatattgcgaactgtctccgcaaaaacgggaaaagagtaatacaattgtccaggaagacgtttgacacagaatatcagaaaaccaaaaacaatgactgggattatgtagtgacaacagacatatcagagatgggtgcaaactttagggctgatagagtgatagatccacggcgatgtttaaaaccagttatcttaaaggacggacctgagagagtgatattagcgggcccaatgcccgttacagcagcgtcagctgcacagagaaggggacggataggacgaaatcaaaataaagaaggggatcagtatatatacatggggcaacctttaaacaatgacgaggatcacgcacattggaccgaggccaaaatgctactagacaatataaacacacctgaaggtataatcccagccctattcgaacccgaaagagagaaatcggctgcgatcgacggagagtacagacttagaggagaagcacgtaaaacttttgtagagctcatgcgtagaggcgaccttccagtgtggctaagttataaagtagcgtcagaagggttccagtactccgacaggagatggtgctttgatggagaacgtaacaatcaagtcttagaagaaaatatggatgtagaaatatggacgaaggagggagaacgtaagaaattaagacctagatggttagatgcacgcacttattccgacccgttagcgttacgagaatttaaggaatttgccgcaggacgaagatcagtaagtggcgatttgatcctcgaaataggaaagctaccacaacatttaacattacgggcacagaacgcactagacaacttagtgatgctgcataattctgagcaaggaggtaaagcctataggcatgcgatggaggagttgccagacacgatagaaactcttatgttactagcactcatagccgttttaacgggaggggtcactttattctttttaagcgggaagggactgggcaagacatccataggcttactatgtgtaatggcgagctcagttttgctctggatggcttcagttgaacctcattggatcgcagcaagcatcatactggaatttttccttatggtcttgctgatacctgaaccagataggcagcgtacccctcaagacaaccagcttgcctatgttgtaatagggctactgtttatgatcttaactgtagcggccaacgaaatgggtttacttgaaacgactaagaaagatctcggtattggtcacgtagtcgccgaaaatcaccatcatgcaactatgcttgatatagatcttcatccagcttctgcatggacgctctacgctgtcgcaaccactatcattacccctatgatgaggcatacaattgaaaataccacggcaaatattagtttaacggcaattgcgaatcaagcagcgattctaatgggcttagataaaggttggcctatatcaaaaatggatattggggtgccactactagccctgggctgttacagtcaggtaaatccattaacattaacagcagcggtgctgatgttagtggctcattatgctataataggtcccggattacaagctaaagccacacgtgaagcgcagaaacggactgctgccggtatcatgaaaaatccgactgtcgatggtattgtagctatagacttagatccggtagtatatgatgctaaattcgaaaaacaattaggtcaaattatgcttctaatcttatgcacctcacaaattttgctaatgaggactacttgggcattgtgtgaatcaattacattggctacaggtccactaacaaccctttgggaaggttcaccagggaaattctggaatacaaccatagcagtaagcatggcaaacatattcagaggctcttatttagccggcgcaggactcgcatttagtctaatgaagagtttaggcggcggcagaagaggaacaggggcccaaggggagacgttgggagaaaaatggaagaggcaactcaaccaactaagcaagtccgaatttaacacttataaaaggtctggcatcatggaagtcgaccgctcggaagcaaaggaaggcctaaaaagaggggaaaccacgaaacatgccgtatcgcggggaacggcaaagttaagatggttcgtagagcgtaacctcgtaaaacctgaagggaaagtaatcgatttaggatgtggcaggggaggctggtcgtattactgcgctggcctaaagaaagtaacggaggttaaggggtatactaagggaggcccgggccatgaagaacctatacctatggcaacttatggatggaatatagttaaattacacagcgggagagatgtattctttacaccgcctgaaaagtgtgataccctgttatgcgacatcggagaatcgagcccaaaccccacaatagaggaaggtcgaacactgcgagtgttaaaaatggttgaaccatggctacgaggaaaccaattctgcatcaaaatattgaatccctacatgccgtccgttgtcgaaactttagaacaaatgcaacgtaaacacggaggtatgttagttagaaatcctttaagtaggaacagcacacacgaaatgtactgggtgtcatgtggcaccggcaatatcgtatcagcagtgaacatgaccagtcgaatgttactaaatcggtttacaatggcgcatagaaaacctacgtacgagcgagacgtcgacttaggagcggggacgcgacacgttgctgtcgaacccgaaattgctaatttagatattattggccaaagaatagaaaacatcaaaaatgaacataaatctacttggcattatgatgaagataatccttataaaacatgggcatatcatggatcatacgaagtaaaaccaagtggatccgcgtccagtatggtaaacggcgttgtgcgattactgaccaaaccctgggatgttattcccatggtaactcaaattgccatgaccgatactacacctttcggacaacaaagggttttcaaggaaaaagtggacactcgaactcctcgaccaaaaagaggaacagctcaaattatggaagtaactgccaagtggttatggggatttttgagtcgaaataagaaacccagaatttgcactagagaagaatttactcggaaagtcaggagtaatgctgctataggagctgtattcgtggatgaaaatcaatggaactcagctaaagaagcggtcgaagatgagcgattctgggacctcgtacaccgcgagcgcgaattacataaacaaggaaaatgcgcaacatgtgtttacaatatgatgggcaaacgagagaagaaacttggcgagtttggaaaggcgaaaggaagcagagctatttggtacatgtggcttggtgcaagatttttagaatttgaagccctaggtttcatgaacgaagaccattggttctcacgagagaactctctctcaggagtcgagggagagggtctacacaaactaggatatattctaagggacatcagcaaaataccaggaggtaacatgtacgcggatgatacagcggggtgggatactcggattacagaagacgacttacagaatgaggcaaaaatcaccgacataatggaacctgaacacgcactgttagcgacgagcatattcaaattaacatatcaaaataaagtagtaagagtacagcgaccggcgaagtcaggaacagtgatggatgttatttcgcgtagagaccagagaggctccggacaagttggtacatatgggttaaacacattcactaatatggaagtacaactaataagacaaatggaaagtgaaggcatattcagtccttcagaactagagaatagcaacctagcagaaagggtattagactggttagagaaacatggagtagaaagacttaagagaatggccatcagtggggacgattgtgttgtaaaaccgacagacgaccgcttcgccacagcactaacagctttaaacgatatgggaaaagtcaggaaagatattccacaatgggagccgagcaaaggttggaacgattggcagcaagtacctttttgctcacaccattttcaccaacttatcatgaaggatggacgggagatagttgttccctgcagaaatcaggatgaattagtagggcgagctagagtttcgcaaggcgctggatggagcctaagggaaacagcctgtttaggcaagtcatatgcccaaatgtggcaactaatgtattttcacaggagagatcttcgtctggcagcaaatgcaatctgctcggctgttccagtaaattgggtccctacctcacgaacgacatggtccatacacgcgcaccaccaatggatgaccacagaagatatgctatcggtatggaatagagtctggatcgaggaaaatccgtggatggaagataagacccatgtttccagttgggaagacgttccatacctcggcaaacgagaggatcagtggtgcggctcactaataggtttaaccgcaagagcaacatgggcaactaatatacaagtagcaattaaccaagtccgtcgtttaattgggaacgaaaattacttagattatatgacatccatgaaaagattcaaaaatgaatccgaccctgaaggagccttgtggtaa

SEQ ID NO: 22117 - RNA, 9879 nt, synthetic construct
  misc_feature 1..9879: note = derived and/or modified CDS sequence (opt6) from DENV-1__KM403631__SS-prME
  source 1..9879: mol_type = other RNA
tcagtaactatgttactaatgctactaccgacggctctagcgtttcatcttaccacgaggggaggagaaccacatatgatagtgtcaaaacaagaacgaggtaaatccctattattcaaaacctcggctggagttaatatgtgcactttaattgccatggatctcggagaactctgtgaagatacgatgacatacaaatgccctcgcatcactgaagccgaacctgatgatgtagattgttggtgtaatgctacagatacttgggtaacatacggcacctgtagtcaaactggagaacataggcgagataaaagaagtgttgcattggctccacatgtcggcctaggactggaaacacgaaccgaaacatggatgtcatcagaaggtgcatggagacaaatacaaaaagttgaaacatgggcacttaggcacccagggtttacagttatagctttgtttttggcacatgcaatcggtacaagcatcacacaaaaagggattatatttattttattaatgttagtgactccttcgatggctatgagatgcgttggaataggcaacagagattttgtagaaggtctcagtggcgcaacttgggtagacgtagtgttagaacatggatcatgtgtaacaacaatggctaaaaataaacctacattggatatagaactattgaaaaccgaagtaaccaatcccgcagttctcaggaaactctgcattgaagcaaaaatttcgaatactactacagattcacgttgtcccacacaaggcgaagctacactcgtagaggagcaagatgctaatttcgtatgtagacgaacttttgtagacagaggttggggaaatggatgcggtttatttggaaaaggatcactcctgacttgtgccaaattcaaatgcgtgactaaactagaaggaaaaattgtacaatacgaaaacctcaaatattctgttatagtcacagtacacacaggtgatcagcaccaggtaggaaatgaaacaacagaacacggcactatagccacgataacaccacaagctcccaccagtgaaatacaactgacagactatggcgcactcacactcgattgtagtcccagaactggattagattttaatgaaatggttctgcttacaatgaaagagaaaagctggttggtacacaaacaatggttcttagatttaccacttccttggacaagtggtgcctctacgagtcaagaaacttggaatagacaggatctgcttgtaacgttcaaaacggcccacgccaagaaacaggaagtggtagtgttaggttcacaggagggagcgatgcacactgcactgacaggcgcaactgaaatccaaacaagtgggacaacgacgatattcgctgggcatctaaaatgcagactgaagatggataaattaacgctgaagggagttagctatgtcatgtgtaccggatcatttaaattggaaaaagaagttgctgaaactcaacatggtactgtacttgtgcaggttaaatacgaaggaacagacgcgccttgtaaaataccaatatcgacacaagatgagaaaggagttacccagaatggtcgccttataacagcaaatcctattgtaaccgataaagagaaacctattaatatagaaaccgaaccaccatttggggagtcatacatagttataggagcaggagaaaaggctttaaaactgtcatggttcaaaaagggttcgtctattggcaagatgtttgaggcaacagcccgaggtgcccgacgtatggcgatactaggagacacggcctgggactttggctcaataggaggcgtcttcacctcggtagggaagttagtccatcaagtgtttgggactgcatatggtgtgctctttagtggtgtaagttggactatgaagataggcataggaatactactaacttggctgggtttaaatagtaggtccacgtcgttgtcaatgacctgtatagcagtaggtatggtaacactatatctcggggttatggtacaggctgactcaggatgcgttatcaattggaaaggaagggaactaaaatgcggtagcggcatttttgtaacaaatgaagttcacacgtggaccgagcagtacaaattccaagctgattctccaaaaagattaagtgcagcgatagggaaggcttgggaagaaggagtctgcggtatcaggtcagccacgagattagagaatattatgtggaaacaaatttcaaacgaacttaaccatatattgttggaaaacgatatgaagttcacggtggtagtaggagacgccaatggtatcttaacacaaggcaagaaaatgattagaccccaacctatggaacataaatacagttggaaatcatgggggaaagctaaaattattggagctgatacacagaacaccacgtttattatagatggacccgatactccagaatgccctgacgaccaaagagcctggaacatatgggaggtcgaggattatggattcggcgtatttacaacgaatatatggctaaaattaagagacagttatacacaaatgtgcgatcatagattaatgagcgcagccataaaagattctaaagcggtgcacgcagatatgggatactggatagagtctgagaaaaatgaaacttggaaacttgccagagccagctttatagaagtgaaaacctgcatatggccaaggtctcacaccctatggtcaaatggggtgctagaatccgaaatgataataccgaaaatatatggaggaccgatatcacaacataactatcgtccaggttattttacgcaaactgcaggtccgtggcacctaggaaaacttgagttagatttcaacctttgtgaaggaactacagttgttgtagacgaacattgtggtaaccgtggacccagtttacgaacgactaccgttacaggaaaaataatacatgagtggtgttgtcgatcatgtacgctcccacctttacgattcaggggtgaagacggatgttggtacggaatggaaataagacctgtcaaagaaaaagaagaaaatttagtgcgcagcatggtatcagcaggttccggagaggtagatagtttttcactcggacttctatgtgtcagcatcatgattgaggaagtaatgagatctagatggtcaagaaagatgttaatgacaggtacgttagcagtattctttttattgataatgggacagctaacatggaacgacttgatccgtctgtgtattatggttggagcaaacgtgtcagacaggatgggtatgggcaccacgtacttagccctgatggccactttcaaaatgcgaccaatgttcgcggttggactactattcagaaggttaacatctagagaggtattactactcacgattggactctcactggtggcgtcagttgaactcccaaattctttggaagagttgggagatggtctagccatgggtataatgatgttgaaactattaacggattttcagtcgcatcaactatggactacattactcagcttaacctttataaaaacgacattaagtctggattatgcatggaaaacaatggctatggtattgagtatagtatctctgttccctctatgtctatccactacgtcacaaaagaccacatggctcccggtcctgcttggtagcttcgggtgtaaacctcttacaatgtttctgataacggaaaacaaaatatgggggaggaaatcttggccacttaacgaaggaatcatggctgtaggaatcgtaagtatcttgctgagctcattattgaaaaacgatgtgccgctagccggacctctaatagcagggggaatgcttatagcgtgctacgtcatctcaggaagttccgcagatttatcattggagcgggctgcggaagtatcttgggaagaagaggcggaacatagcggggcaagccataacatcttagtagaagtgcaagacgatggaactatgaaaattaaagacgaagaaagggatgacacgctcacaatactattaaaagcaacattattagctgtatcgggggtatatccgatgtctattccggcaacattatttgtgtggtatttttggcagaagaagaaacaaaggtcaggcgtcctttgggacacaccaagtccaccagaagtggaaagagctgtacttgatgatggtatatatcggatattacaacgagggttattaggacgatcacaagtgggcgtcggagtttttcaggatggtgtttttcataccatgtggcatgtaactaggggtgcggtacttatgtatcaaggaaagcgactagaacccagctgggcgtcagtcaagaaagatttaatatcctatggaggtggttggcgctttcaaggcagttggaatactggggaagaggtacaagtcatagctgtggaacctggcaagaaccctaagaatgtccaaacaactccaggaacatttaaaacacccgagggcgaagttggggcgatagcattagattttaaaccgggtacctccggtagccctattgtaaaccgggaagggaaaatcgttggattgtatggtaatggagttgtcaccactagcggaacatatgtgtctgccattgcacaggcgaaagcgtcccaagaaggtccactaccagaaattgaagatgaggttttcaaaaagagaaatcttactataatggaccttcaccccggatctggtaaaactcgcagatatctgccggcaattgttagagaggcaataaaaaggaaactaagaacactaatactagctcctacacgggttgttgcaagtgaaatggctgaagcgttgaagggcatgccaataaggtaccagactacagcagtaaaaagtgaacatacaggcaaggaaattgttgacctgatgtgtcatgccacgttcacaatgcgattattaagtccggtgcgagtgccaaactataatatgataataatggatgaagcgcacttcacggatccagcatcaatcgctgctagaggctacatatctacgagagtaggcatgggggaagccgcggcaatatttatgaccgctacaccaccaggttccgtggaagcatttccacagagtaatgctgtaatccaagatgaggaacgtgatatacctgaaagaagttggaacagcggctatgattggattacagattttccaggtaaaacggtgtggtttgtcccaagtatcaaatccggaaatgacattgcgaattgtctccggaagaatgggaaacgtgtaatccaactaagccgaaagacttttgatacggaatatcagaaaactaaaaataacgattgggactacgtcgtaactacagatataagtgaaatgggagccaacttccgagcggacagggtaatagatccacgaaggtgtttgaaaccagtgattcttaaagatgggccagaaagagtaattctcgcaggaccaatgcctgtgaccgcggcaagtgcagcacaacgacgtggtcgtataggcagaaaccaaaacaaggaaggcgatcaatatatatatatgggtcaacccttaaataacgatgaagatcatgcacattggaccgaggcaaaaatgttgttagataacattaacacgcctgaaggcatcattccggctcttttcgaacccgaacgggaaaaatcagcagcaatagacggggaatacaggttacgcggagaggccagaaagacgtttgtggagctaatgcgacggggagacctcccagtgtggcttagttacaaggtcgcatcggaagggtttcaatattcagatcgacgatggtgtttcgacggagaaagaaataatcaagttctcgaagaaaacatggatgtcgagatatggacaaaggagggggaaaggaaaaagctaagacctaggtggttagacgctagaacgtatagtgatccgctagctctacgagaatttaaagaatttgccgctggtagaaggagtgtgtctggagacctaattttagaaataggcaaattaccgcagcatttaactctccgagctcagaacgctcttgataacctagtgatgcttcacaattcagaacagggtggtaaggcttacaggcacgctatggaagagttacctgatacaattgaaactcttatgttactagcattaatcgcagtactcactggaggagtcactctattcttcctttctggcaaaggactaggtaaaacttcaataggtttactgtgcgtaatggcatcatccgtcctcttgtggatggcatccgtagaaccgcattggattgcagcatcaataattttagagttctttcttatggtattactaatccccgaaccagatcggcagaggactccccaagataaccaactagcatatgttgtgataggattattatttatgatactaacagttgcggctaacgaaatgggattattagaaacaacgaagaaagacctaggcatagggcatgttgttgcggaaaatcatcaccatgcgacaatgttggatatagatttacatcccgcctcggcgtggacgttatatgcagtagccaccacaattataaccccaatgatgagacatacaatagaaaatactacggccaacataagcctcactgcaatagccaatcaggccgcaatactaatgggcctggataagggctggccaatctcaaaaatggatataggggtgccattgttggcactcgggtgctatagtcaggtaaatcccttgacgctcacggctgcagttctgatgttagtagcacattacgctatcatcggacccggcttgcaagctaaagctacaagagaggcacagaaaaggacagctgcggggatcatgaaaaacccaactgttgatggaatagtggcaattgatttagatccggtggtctacgacgccaagtttgaaaagcagctagggcaaataatgttgttgatactatgtacttcccaaatactattaatgagaaccacgtgggcactatgcgaatcgattacgctggcgactgggcccttaacaactttgtgggaaggatcacccggcaaattttggaacacaacgatcgctgtatctatggccaacatttttaggggatcatacttagcaggcgcggggttagctttttccctcatgaaatcgctagggggtggacgacgtggtacaggcgctcagggagagaccttgggagaaaagtggaaaagacagctaaaccaattgagtaaaagcgaatttaacacttacaaaagatcaggaattatggaggtggacagatcagaagctaaagaaggtcttaaaagaggggaaaccaccaagcatgcggtctcacggggaacagcgaagttgcgatggtttgtcgaaagaaacttagtaaaacctgaagggaaggttatagatctgggatgcggcaggggagggtggtcgtactattgtgcaggtctaaagaaagtcacagaggtaaaaggatatacaaaaggagggcccggtcatgaagaaccaatacccatggcgacgtatgggtggaacatagttaaattacatagcggaagggacgtgttctttaccccgccagaaaaatgtgacacactactctgcgatataggcgaatcaagcccaaaccctactatagaggaaggccgaacactccgggtactaaaaatggtagaaccttggttacgaggaaaccaattctgtattaaaattcttaatccatatatgcccagcgtagtagaaacacttgaacaaatgcaaagaaagcatggtggaatgttagtcagaaaccccctaagtagaaattctacacatgagatgtattgggtcagttgcggaacaggcaatatagtaagtgcagtcaacatgacgtcacgaatgcttttaaacagattcacgatggcccatcgaaagccaacatacgaacgggacgtggatttaggagctggaacgcggcatgtggcggtggaaccagaaattgcaaacttagacattataggtcagcgaattgagaacatcaaaaacgaacataaaagtacttggcattacgatgaagataacccctataaaacctgggcgtaccatggttcttatgaagtcaaaccctcaggatcggcttctagtatggtaaatggggttgtacgactcctaacaaagccatgggatgtcatccccatggtaactcagatagcaatgacagacactactccgtttggacaacagagagtcttcaaagaaaaagtagacacgcgcacaccacggccgaaacgtggaactgcccaaataatggaagttaccgctaagtggctctggggatttttgagcagaaacaagaaaccacggatatgtacccgcgaagagttcacaagaaaagtaagaagcaatgccgctataggtgccgtgtttgttgatgaaaatcaatggaactcagccaaggaagcagtagaagacgagcgtttctgggacttagttcacagagagagagaattacataaacagggaaaatgtgcaacatgcgtttacaacatgatgggaaagagagagaagaaactaggtgagttcggtaaagcaaaaggttcaagagcaatatggtatatgtggctaggagcaaggtttctagaatttgaggcactgggctttatgaacgaagatcattggttctctagggaaaattctttaagcggggttgaaggcgaggggttacacaaactaggatacatacttcgtgatatatctaaaataccaggaggtaatatgtatgcagacgataccgccggatgggatacaagaatcaccgaggatgacctccaaaacgaggcaaaaataaccgacataatggaaccagagcacgcacttttggcaacgtccatatttaaattgacttaccaaaacaaagttgttcgagtgcaaagaccagctaagtccggaaccgtcatggatgtaatatctcgaagagaccaacgaggatccggccaggtgggaacctacggtctgaacacttttactaacatggaggtacaactaatccgtcaaatggaatcagaagggatattttcgccaagcgaattagaaaatagcaatctcgccgaaagagtccttgattggttagaaaaacatggggtagaacgactgaaaagaatggcaatatctggcgatgactgtgtagtcaaaccaacggacgatagattcgcgactgccctaacagcacttaatgacatgggcaaggtgagaaaagatattccgcaatgggagccttcaaaagggtggaatgattggcaacaagtaccgttttgttcgcatcattttcatcaactaataatgaaagacggaagggagattgttgttccctgtagaaaccaagacgaactggtagggcgtgccagagtgtcccaaggagcaggttggtccctaagagaaacagcatgcttgggtaaatcatatgctcaaatgtggcaattgatgtattttcatcgccgagacttaagactagcagcaaatgctatctgtagtgcagtacctgtgaattgggtcccgacatctcgaacaacctggagcatccacgcacatcatcaatggatgaccacagaagatatgttaagtgtttggaatcgggtgtggatagaagaaaatccttggatggaggacaaaacacacgtaagttcatgggaggatgttccatacttaggaaagcgtgaagatcaatggtgcgggtcgctcatagggctgactgccagagccacatgggctacaaatatacaagtagcaatcaatcaggtccgcaggttgatcgggaatgaaaattacctagactacatgacatccatgaaacgcttcaaaaacgaatctgaccccgaaggtgcattgtggtaa

SEQ ID NO: 22118 - RNA, 9879 nt, synthetic construct
  misc_feature 1..9879: note = derived and/or modified CDS sequence (opt6) from DENV-1__KM403632__SS-prME
  source 1..9879: mol_type = other RNA
tctgttaccatgttattaatgttattgccaacggcgcttgcttttcatttaaccacccgaggaggtgaaccacatatgatagtttctaaacaagaacgcggtaaatcactcttgtttaaaacgtcggcaggagttaacatgtgtacattgatagcaatggatctgggagaactctgtgaagatacaatgacatacaaatgcccacgaatcacagaagcggaaccagatgatgttgattgctggtgtaacgctacagacacctgggtaacatatggcacatgctcacaaacaggtgaacataggagagacaaacgaagtgttgccctagcgccccatgttggccttggactggaaacacgaaccgagacatggatgtcctcagagggagcatggcgccaaattcaaaaagttgagacgtgggcacttcgacacccaggattcactgtaatagccttatttttagcccatgccatcggaacatcaattacacaaaaaggtattatattcattctcttgatgttggttacaccgtcaatggccatgaggtgcgttggaataggaaacagagattttgtagaggggttaagtggagcaacatgggtagatgtggtattagaacatggtagctgcgttacaactatggccaaaaacaaacctactttagatatcgaattgttgaaaacagaagtaacaaatccggccgttttgcgaaaactatgtattgaggccaaaataagcaatacgacaaccgatagcagatgccccacgcaaggagaagcaaccctagtagaggagcaagatgcaaatttcgtttgtcgtagaacgtttgtcgaccgtggatggggaaatggatgtggcctattcggtaaagggtcattactaacttgtgctaaatttcgatgtgttaccaaacttgaaggaaaaatcgtccaatacgaaaacctaaaatacagtgtcattgtcactgtgcatacaggagaccaacatcaagtaggaaatgagactacagaacacggaactatcgcaactattacaccacaagcccccacaagcgaaatacaactcacagactatggtgctctaactttggactgtagtccgaggactggtttagattttaacgaaatggtcttgctaactatgaaagagaaaagctggctggtacataaacaatggttccttgatctcccgctaccgtggaccagcggtgcttctaccagtcaagaaacgtggaatagacaagatctgctcgtcacgttcaaaacagcccatgctaagaaacaggaagttgtcgttctaggaagtcaagagggagctatgcacacggctctaacaggcgctacagagatacagacaagcggtacgactacgatattcgctggacatctcaaatgtaggttaaaaatggacaaacttacactgaaaggagtttcatatgtaatgtgcactggctcattcaaactggagaaagaagtagctgagacacaacacggaactgtattagttcaagtaaaatacgaaggaaccgacgccccatgtaaaatccctatttccacgcaagacgagaaaggggtcacacaaaatggaagattgatcaccgctaatcccatagtcacagataaagagaagccagttaacatagagaccgaaccgccgtttggcgaatcctatattgttatcggagcgggggagaaggcacttaaactttcctggtttaagaaaggtagtagcattggaaaaatgtttgaagcaaccgcgagaggggcaagaagaatggccatattaggtgacacagcatgggattttggtagtatcggcggggtttttacttcagttgggaaacttgtacatcaagtttttggaaccgcgtatggtgtcttatttagtggtgtttcttggacaatgaaaataggaataggaatcctattgacgtggttaggactaaattcaaggtctacatcacttagcatgacatgtatagcggttggaatggttactctctacttaggagtaatggtacaggctgattctggttgtgtgattaattggaagggaagagaactaaaatgtggatctggcatttttgtaacaaacgaagttcacacatggacagagcaatataagtttcaagcagatagtccgaagcggttaagtgcagcgataggaaaagcgtgggaggagggcgtttgtgggattcggagcgctacacgactagaaaatattatgtggaaacagatttcaaatgaacttaaccatatactattagaaaatgacatgaaattcacagtggtagtaggggatgcaaacgggatcctcacccagggaaagaagatgataagaccacaaccaatggagcacaaatactcatggaaaagctggggcaaagcaaaaataattggggcagacactcagaacacaacattcattatagatggtccagacactccggaatgtccagatgatcaaagagcctggaatatctgggaagtagaagattacggttttggtgtttttaccactaacatctggttgaagctccgcgattcatatacccagatgtgcgaccataggctgatgagtgctgcaatcaaagattctaaggccgtacatgccgatatgggttattggatagaatctgagaaaaatgaaacatggaaactagctagggcatcgtttatagaggtaaaaacatgcatctggccgagaagccatacactttggtcgaatggtgtgttagaatcagaaatgattatcccgaagatatatggcgggccaatatcacagcataattatagaccaggctattttacccagaccgcaggaccgtggcacttaggaaaactagagttggattttaatttatgtgagggaacaacagtagttgtggatgaacactgtggaaataggggaccatccttgagaactacaacagtaacaggtaaaattattcatgaatggtgctgtagaagctgcacattaccacctctccgatttaggggagaagatggatgttggtatggcatggagataaggccagtaaaagagaaagaggaaaatctagttagatcaatggtcagtgcaggtagcggagaagtagatagttttagtctcggtttattatgcgtaagcataatgatagaggaggtcatgcgaagccggtggtcaaggaaaatgctgatgaccggcacacttgctgtattcttcttactgattatgggtcagcttacatggaatgatttaataagattatgtattatggtaggagcaaacgtttctgatagaatgggaatgggaacgacttatcttgcgttaatggcaacatttaaaatgcgaccaatgtttgcagttggcctccttttccgcagattaactagcagagaagtactcttacttactatcggcttatccctagtggcgtctgtcgaacttcctaactccttagaagaattaggagacgggctagctatgggaatcatgatgttaaaacttctgacagattttcaatcacaccaactttggactacattattaagtcttacctttataaaaactacattgtcacttgattatgcctggaagacaatggccatggtcttatcgatcgtttctttattccctttatgtctatctaccacgtcacagaaaactacatggttacccgtgctacttggatcatttggatgcaagcctttgacgatgttcttaatcactgagaataagatatggggacgcaaatcatggcccttaaacgaaggtatcatggcggttggaatagtgtcgatcctactgagtagcctattaaagaacgatgttccgctcgccggaccattaatagcaggcggcatgctgatcgcctgctatgtaatatctggcagctcggctgatttgagcctggaaagagcggcggaagttagttgggaagaagaagcagaacactccggagcctcgcacaatatattagtagaagtacaagatgacggcacaatgaaaattaaagatgaagaaagagatgatacattgactatactcttaaaagcaactttattggctgtctcaggcgtatacccgatgtctataccagccacattatttgtctggtacttctggcagaagaagaaacaaaggagtggtgttctatgggacacaccctctcctccagaggttgagagagccgtcttagatgatgggatttaccgcatactacaaagaggattactaggtcgcagccaagttggcgttggtgtatttcaagacggtgtatttcatacgatgtggcatgtaacaagaggagcggtgcttatgtatcaaggaaagagattggagcctagctgggcctcagtcaagaaagacttaatcagctatgggggaggatggcgattccaaggtagctggaatactggtgaggaagtccaagtaatagcagtagagcctggcaaaaacccaaagaatgttcaaactaccccgggaacttttaaaaccccagagggtgaagtcggcgcgatagctctagatttcaaaccagggacttcaggatcgccaatagttaatagggaaggtaaaatagtgggcttgtacggtaacggagtggtgacaacctccggcacatatgtatcggcgatagctcaagctaaagcgtctcaagaagggcccctacctgagatagaagatgaagtattcaagaaacgaaacttgaccatcatggacttgcatcctggctcgggcaagacaagaagatacctcccagcaatagtgagagaagctataaagcgaaagctacgaactcttatcctggcccctacacgagtagtagcaagtgaaatggcagaggctctaaaagggatgccgattagataccagactacagcagtaaaaagcgaacataccggaaaagagatagttgacctcatgtgccatgcaacttttactatgagactactatccccagtaagggttccaaactataacatgataattatggacgaggcgcatttcactgatcctgcatcgattgcagcacgaggttatataagcactcgtgtaggaatgggagaagccgccgcaatctttatgacagcaacgcccccaggtagtgtagaagcgtttccgcaatctaacgcagtcatacaggacgaagaaagggatatcccagaacgatcatggaactctggctacgactggataactgatttcccaggaaaaacggtttggtttgttccttcgatcaagtcaggcaatgacatcgctaattgcctaagaaagaacggaaaaagagtaatacagctatctcgtaaaacatttgataccgaatatcagaaaaccaaaaacaacgattgggattacgtggtaacgacagacataagtgagatgggagcaaatttcagagccgacagagttatagatccaaggaggtgtttgaagccagtcattttaaaagatggaccggaacgtgtaatattggcaggtcctatgcctgtaactgccgcttcggctgcacaacgcaggggacgaataggaagaaatcaaaacaaagaaggagaccagtacatatatatgggacagcctcttaacaacgatgaggaccatgcacactggacagaggccaaaatgctcttagacaacataaacacccctgaaggtattatccctgctctattcgaacctgaaagagaaaaatctgcagccattgacggagaatatcggttaaggggtgaagcacgaaagacattcgttgagttaatgagacgtggtgatcttccagtttggttatcttataaagtcgcctcagagggattccaatatagtgatagaagatggtgtttcgatggtgaaagaaataaccaagtcctagaagaaaatatggatgttgaaatttggacaaaagaaggtgaacggaagaaattacgaccacgatggttggatgctagaacatattccgatccacttgccctgagagaatttaaagaatttgcggcaggaagaaggagtgtatccggggatttaattcttgaaattggaaaactaccacaacaccttacattaagagcacaaaatgcgttggataatttagtaatgctccataactctgagcaaggaggcaaagcgtatcgacatgcaatggaggaattgcctgatacaattgaaaccttaatgttattagctctaatagctgtcttgactggcggtgtaaccttattctttctatcaggcaaaggcctcggcaaaacgtccatcggactcctttgcgtcatggcatcatccgtattattatggatggcaagcgtcgagccacattggattgcagcatctatcatattagagttctttttgatggtcttactaataccagaacctgatcgccaaagaactccgcaagataatcaacttgcttatgtagtaattggacttttattcatgattctaacagttgcagccaatgaaatggggttattagagactactaaaaaggacttaggaataggtcacgttgttgctgagaaccatcatcacgcgacaatgcttgatattgatcttcatcccgcgtcagcatggacattgtatgccgtagcaacaaccataataaccccaatgatgcgtcacacaattgagaacaccacagcaaacataagtctaaccgcgatagctaatcaggccgccattcttatgggtttagacaagggttggcctatcagtaaaatggatatcggagttcctctgttagcactaggctgttatagtcaagtaaatcctctcacgcttacagcagccgtgctgatgcttgtcgcgcactatgctattattggcccgggcctacaagctaaagcaacgagagaagcacagaagaggactgcggctggtataatgaagaaccccacagtagatggcattgtagcaatagatttagatccagtagtttatgatgcgaaatttgaaaaacaattgggccagataatgttactgatattatgcacctcacagattttattaatgcgaactacatgggcattatgtgaatcaatcactcttgctacaggccctttaacaactttatgggaaggatcacccgggaaattctggaatacaacaatagctgtatctatggcaaacattttccgaggatcatatcttgcaggagcaggactggctttctccctaatgaaatcgctaggcggtggaagaagaggaacgggagcccaaggcgaaacgttaggtgaaaaatggaaaagacaattgaatcaattaagcaagtcagaatttaatacctataaacggagtggaataatggaggtggatcggtcagaggcaaaagaaggtttaaaaagaggggaaacaactaaacatgcggtatcaagaggcaccgctaaacttcgatggttcgttgaaagaaatttagttaaaccagaaggcaaagtgattgatttaggttgcgggagaggcggatggtcttactactgcgcaggactaaagaaagttaccgaagtaaaaggttacaccaaaggcggaccaggtcacgaagaacctattcccatggcaacttatggctggaacatcgtgaaattacactccggcagggacgtatttttcacaccaccagaaaaatgcgatacactcctatgcgatataggagaaagctcgcccaatccaacaatagaagaaggccgaacacttcgtgttctaaagatggtagaaccatggctaagagggaaccagttctgtataaaaatactgaatccctacatgcccagcgtggtagaaacattggaacaaatgcagcgcaaacacggcggcatgctagtcaggaatcctttaagcagaaattcaacgcatgagatgtactgggtaagctgtgggacaggaaacattgtcagcgctgtcaacatgaccagtagaatgctattaaatagatttacgatggcccatcgaaaacctacttacgaaagagacgttgatctcggagctggtaccagacacgtagctgtcgaaccagaaatagcaaatttggacattattggacagaggatagaaaacattaagaatgaacataaaagcacgtggcattatgacgaagacaatccctataaaacttgggcgtaccatggaagttatgaagtaaaaccttcgggtagtgcatcgtcaatggtgaatggagtcgtaaggctacttacaaagccatgggatgtaatcccgatggtcacacaaatagctatgaccgacacgacaccctttggacagcaaagagtgtttaaagagaaagtagatacaagaactccccgtccaaaacgtggaacggcccagataatggaagttaccgcaaaatggctttggggctttctaagtcgtaacaagaaaccaagaatatgcactagggaagaatttactagaaaagtacgaagtaatgccgccataggtgcagtcttcgtagacgaaaaccaatggaactcagcaaaagaagccgtcgaggacgaaagattctgggacctagtacatcgagaaagagagttgcacaagcaaggtaaatgtgcaacatgcgtctataacatgatggggaaaagagagaaaaagttaggtgagtttggaaaagctaaaggttcgagagctatctggtatatgtggctaggagcaaggttcctagaatttgaggcactaggatttatgaacgaagaccactggtttagtagagaaaatagtctaagcggagtagaaggggaagggttgcacaaattagggtacatactaagagacatatctaaaataccaggtgggaacatgtatgctgatgatacggctggttgggacacaaggataacagaggacgaccttcaaaacgaagcaaaaattacagatataatggaaccggaacacgcattactagctacatcgatttttaagctcacatatcaaaacaaagtagtgagggtacaaaggcccgccaagagcggcacagtcatggatgtaatatcgagacgagatcaacgaggaagtggacaagtaggtacatacggtttaaacacctttacaaacatggaggtacaattaatacgtcaaatggagagcgagggtatcttttcgccaagtgaactcgagaactcaaatctagcagaacgcgtattagattggttggaaaaacatggagtagagcgcttaaaacgaatggcaatttcaggtgacgattgtgtagtcaaacctacggatgatcgatttgcaactgctttaacagcattaaatgacatgggtaaagtacgaaaggatatcccacaatgggaaccttcaaaaggatggaacgattggcagcaagttccattttgcagccatcactttcaccaattaattatgaaagacggccgcgaaatagtagttccctgtcggaatcaagatgaattagtgggtagggccagagtatcccaaggtgcaggatggagtctgcgcgaaacagcttgtctaggtaagtcttatgcacagatgtggcaattaatgtattttcatcgccgcgacttgcgactagctgccaatgctatttgttcggcggtacctgtgaattgggtaccaacttcgcgcactacgtggagtatacatgcgcatcaccaatggatgaccacagaagacatgcttagtgtatggaaccgggtatggatagaagagaatccttggatggaggacaaaactcatgtatccagctgggaagatgtaccatatcttgggaaacgggaagatcaatggtgtggttcattgattggtttgacagcccgcgcgacatgggcaacgaacatacaagttgcgattaaccaagtaagaagactaatagggaacgaaaattatttggactatatgacatcaatgaagagatttaagaatgaatccgatccagaaggagcactatggtaa

SEQ ID NO: 22119 - RNA, 9879 nt, synthetic construct
  misc_feature 1..9879: note = derived and/or modified CDS sequence (opt6) from DENV-1__KM403583__SS-prME
  source 1..9879: mol_type = other RNA
tccgtaacgatgctactaatgctactgccgaccgccctcgcctttcacttaactactcgtggtggagaaccgcacatgatcgttagcaaacaagaaagagggaaaagcctattattcaaaacaagcgctggtgtgaatatgtgtactttaatcgctatggatcttggtgaactatgcgaagataccatgacatataaatgccccagaataactgaagctgaacctgatgatgtagattgttggtgtaatgccactgatacatgggtcacttacggaacttgctcacaaactggtgaacatcgccgcgaccggcgcagtgtagctttagctccccacgttggattgggattagagactagaaccgaaacctggatgagtagcgagggagcttggagacaaattcaaagagttgaaacatgggcactaaggcaccccggtttcactgttattgctctatttcttgcacatgcgatagggacgtcgatcacccaaaaaggaataatatttatactactaatgctcgtaacgccgtcaatggcaatgcgatgcgtcggtattggtaacagggattttgtagagggtctgtcaggtgcaacttgggtagatgtcgtcctggagcatggaagctgcgttacgacgatggctaaaaataaaccaaccctagatatcgaattactaaaaacagaggtaaccaacccggcggtgctaaggaaactatgcattgaagccaaaataagcaacacaacgacagattctcggtgccctacacagggtgaggcaacattagtggaagaacaagatgcaaattttgtctgtagacggactttcgtagaccggggatggggcaacggctgcggactcttcggcaaaggaagtctgcttacctgcgccaaattcaaatgtgtaacgaaactagaagggaaaatagtccaatacgaaaatttgaaatactcagtaattgttaccgtacatacaggtgatcagcatcaagtcggtaatgaaacgactgaacatggcactattgctacgattactccgcaagcaccaacaagcgaaatacaactgacagattatggagctctcactttagattgtagcccgaggacaggactagattttaacgaaatggtgcttttgacgatgaaagagaaatcatggttagtacataaacaatggtttctcgatctacctcttccatggacaagtggagcatcaactagccaagaaacatggaacaggcaagatcttctggtaacattcaaaacagcacatgctaagaaacaagaagtggttgtattaggatcacaagagggtgctatgcacactgcactaactggtgctacggaaatacaaacaagtggcacaacgacgatatttgcggggcacctcaaatgtagattaaaaatggataaattgacacttaaaggtgtatcttatgtcatgtgcacgggaagtttcaaactagaaaaagaagtagctgaaacacaacacggaacagttctcgtgcaagtcaaatacgagggcacagatgctccatgcaaaataccaattagtacacaagacgaaaaaggggtcacccagaatggtagactaatcactgcaaatcctatagtaacggataaagaaaaacccgtaaatatagaaacagagcctccgttcggagaaagttacatcgtcataggagcgggtgagaaagcactgaaactaagttggttcaagaaaggaagtagtataggtaaaatgtttgaagctacagcgcgaggtgcgcgacgtatggcgattttaggagatactgcgtgggattttgggtcaatcggcggagtttttacaagtgtaggtaaattagttcatcaagtttttggtactgcttatggggtactattctcaggcgtaagttggacaatgaaaatcggcattggtatactgcttacatggttagggctaaattctagatctacttcactaagcatgacatgtatagcggtcgggatggttactctatatttaggagtgatggtccaagcagattcgggatgtgtgattaattggaaaggaagagaacttaaatgcggatcaggaatatttgtcaccaatgaagtacacacatggactgaacagtataaatttcaagccgattctccgaaaaggctaagtgctgccatagggaaggcttgggaggaaggtgtatgtggtattcgaagtgcaactaggttggagaacataatgtggaaacaaatatcaaacgagctgaaccatatcttactagaaaatgacatgaaatttaccgttgttgtgggcgatgctaatgggatacttacccaaggcaagaaaatgatcagaccacaacccatggagcataagtactcatggaagtcatggggaaaggccaaaataattggagcggacacacaaaataccacattcataatcgatggaccagacacaccggaatgcccagacgaccaacgagcatggaacatatgggaggttgaagattatggatttggcgtgttcaccactaatatttggctaaaattaagggatagctacacacagatgtgcgaccacagactaatgtcggctgcaattaaagacagtaaagctgtacacgcggacatgggctactggatagaatcagaaaagaatgaaacatggaaattagcaagagcaagttttattgaggttaagacatgcatctggccaagatcacatacattatggagcaatggtgtattagaatccgagatgatcatcccaaaaatatacggtggaccaataagccaacataattaccgacctggctattttacacaaacagctggcccatggcatttaggaaaattggagctagactttaacctgtgcgagggaactactgttgtcgtggacgaacactgtggaaatagagggccttcattacgaactacaaccgtcacagggaaaatcattcacgaatggtgttgtagatcttgtacgctaccaccacttcgatttcgtggtgaagacgggtgctggtatggtatggaaataagaccagtaaaggaaaaagaagagaatttagtacgttcgatggtgtcagccggatcaggggaagtcgactccttcagtctagggctattatgtgtgtcaatcatgatcgaagaggtcatgagatcacggtggtcaaggaaaatgctaatgacggggaccttagccatcttcttcctactcataatgggacaattaacttggaatgatctaataagattatgtataatggtgggcgctaacgtatcagacagaatgggaatgggaactacgtatctggcactaatggcaactttcaaaatgcgtccgatgtttgccgtaggactccttttcaggcgtctgacttcaagggaagtgttgttactaaccataggtctgagtctagtggcttccgttgagctccccaactcacttgaggaattaggcgacggccttgcaatgggtataatgatgctaaagctactaactgattttcaatcgcaccaactctggaccaccttattatcactgacattcatcaaaacaactttgtcactggactatgcatggaaaaccatggctatggtgctgtcgattgtcagcttattcccattatgcctgtcaacaacatcacagaaaacaacctggttaccggttcttcttggaagttttgggtgcaaaccattgactatgtttctgattactgagaacaagatttggggtaggaaaagctggcctttaaacgagggcataatggctgtaggaatagtttcaattctactatcttcattgctcaaaaacgatgttcccctggcaggaccactgattgcaggaggaatgttgatagcatgctatgtaatatcaggaagcagtgccgatctttcattagaaagggcagctgaagtatcttgggaggaggaagctgaacattcgggagcatcacacaatattctagtagaagtacaggatgatggaacaatgaagatcaaagatgaggaacgagatgataccctcactatattactcaaagcgactctactagcagtgagcggagtatatccaatgtcgattccagccacattgttcgtttggtatttttggcagaagaagaaacagcgcagcggtgtattatgggatacaccgagcccacccgaagtcgaaagagcagtattagatgatgggatttatagaatcttgcaaagaggcctcttaggacgatcacaggtcggagtcggagtcttccaagatggagtattccacacgatgtggcacgtaacaaggggagcagtacttatgtatcaaggtaaaagactggaaccttcatgggcaagtgtcaagaaagacttaatctcatatggcggaggatggagatttcaagggtcatggaatactggggaagaagttcaagtaatcgcggtagagcccggtaaaaatcctaaaaatgtccagacaacacccgggacatttaaaactccagaaggggaagttggcgcgattgctctagactttaaaccgggtacatctggcagtcctattgtcaatagagagggaaaaattgtcgggctatacgggaacggcgttgtaacgacttcaggaacttatgtatccgcaatagcacaggcgaaagcatcccaagaaggaccgctgccagagatcgaagatgaagtattcaagaaaagaaatctgacgataatggacctccatcccggctcagggaaaaccagaagatatctacccgcgatagtcagagaagcaattaaacgtaaattaagaactctcatattggctccgacaagagtcgttgctagcgagatggcggaagcattaaaaggtatgccaatacgctaccaaactacagctgtgaaaagcgaacacacgggtaaagaaatagtagatctaatgtgtcacgcgacatttacgatgcgtcttctgtcaccagtccgggtgcccaactataatatgataattatggacgaagcccacttcacagaccccgcgagcattgctgcacgaggttatataagcactagagtaggcatgggagaagctgcagctattttcatgaccgcaacacccccaggatctgtagaggcttttcctcaaagcaacgcagtgatacaagatgaagaaagggatataccagaaaggagctggaacagtggttacgattggatcaccgacttcccaggcaaaacagtttggtttgtaccttcaatcaaaagcggtaatgatatagcaaattgtctaaggaaaaatggaaaaagggtaatacaattaagtaggaaaacctttgacacagaataccagaaaactaaaaacaacgattgggattacgtagtgacaactgacattagtgaaatgggtgccaactttagagctgatagagtaatcgatccacgaagatgtttgaaaccagtgatcttgaaggacggacctgagcgtgtcatattagccggaccaatgccagtaactgcagcatctgccgcacaacggagggggcgaataggtagaaatcaaaataaagaaggggaccaatatatatatatgggccaaccactaaataatgatgaggatcatgcgcattggacggaggcaaaaatgttacttgacaatattaacacaccagaaggtattattccagcattgtttgaaccagagcgggagaaaagcgctgcaatagatggggaatatcggctccggggtgaagctagaaaaacatttgtagagctaatgagacgaggtgatttaccagtttggctatcctataaagtggcgagcgaggggttccaatacagtgatagacggtggtgcttcgacggcgaacgtaataatcaagttttagaagagaatatggacgttgagatctggacaaaagaaggtgaaaggaagaaactaaggccgcgatggctggacgccagaacatacagtgatcccctcgctctaagagaatttaaggaatttgctgcagggcgtaggtcagtgtcaggtgatttaatattagaaattggaaaattaccgcaacacctaacactcagagcacaaaatgcattagataatttagtaatgttacacaatagtgaacaagggggaaaagcatatagacatgctatggaagaactacctgacacaatcgaaaccctcatgctgctcgcattaatagcggtccttacgggaggtgtaacgctgttctttttaagcggaaagggcctagggaaaacttcaattggactgctttgtgtcatggcttccagcgttctattatggatggcatctgtagaaccacattggattgccgcatctattatattggaatttttcctaatggtattactaattccggaacctgatagacaaagaactccgcaggacaatcaactagcgtatgtcgttataggattgctatttatgatcttaaccgtcgcggcaaacgagatgggactgttggagaccacgaagaaagatctaggcattggtcatgtagttgccgagaatcaccatcatgccacgatgttagacatagatttacatccagcgtctgcgtggacactatacgccgtcgcgactactattataactccaatgatgagacacactatagagaatactacagcgaatataagtctaacagcgattgcaaaccaagcagcaatcctaatgggattggacaaaggttggccaatcagcaaaatggatattggcgtacccttattagcgctcggatgctactcacaggttaatccgctgacgttgacagcagccgtgcttatgctagtagctcactatgctattataggcccgggattacaagcaaaagctacaagggaagcacagaaaagaacagcggcaggaattatgaaaaatccaacagtagacggaattgtagcgatcgacctggatccagtagtgtatgacgcaaaattcgaaaaacagcttggccagattatgctgcttatactatgtacaagtcaaatcttactaatgagaaccacatgggccttatgcgaaagcattaccctggcaacgggcccactcacaacattatgggaagggtcaccaggaaaattttggaacaccactattgctgtttccatggcgaacatattcagagggtcataccttgcaggagcagggttagcatttagcttaatgaaaagtctaggaggaggtaggagaggaaccggggcgcaaggagaaactttaggagaaaaatggaagcgacagttaaaccaattaagcaaatcggagtttaatacatataaaagatcgggaatcatggaggtagaccgaagtgaagcgaaagaaggattgaaaagaggggaaacaacaaaacacgcggtttccagaggaacagcaaagttgcgttggttcgttgaacgaaacctagtaaaaccagaaggtaaagtaatagatctaggttgcggacgaggtggatggtcatattattgtgctgggttgaagaaagtgacagaagtaaaaggttatactaaaggcggcccgggacatgaggaaccaatacctatggcaacgtatggttggaacattgttaaactccactcaggtagagatgtattcttcacacccccggaaaaatgtgatactctcctatgcgatataggagaatcttcacctaacccgacgatcgaagaagggagaacgctgagagttctaaagatggttgagccatggctcagaggtaatcaattctgtatcaaaatattgaatccatatatgcctagcgttgttgagaccctagaacagatgcaaagaaaacatgggggaatgcttgtcagaaatccattatctagaaactcaactcacgaaatgtattgggtatcctgtggaactgggaatatagtatcagccgtaaacatgacatcaagaatgctattgaataggtttaccatggcccatagaaaaccgacatacgaaagagacgtggatttaggtgcgggcacacgacatgtagcagtcgaaccggaaatagctaacttagatataatcggtcaaagaatagaaaacattaagaacgaacataaaagtacctggcattacgacgaagataatccttataagacctgggcatatcatggatcgtatgaagtcaaaccttcaggaagtgcatcttcaatggtgaatggagtagttagactccttactaagccgtgggatgtaatcccgatggtaacgcaaattgcaatgactgatacaactcccttcgggcagcaacgggtattcaaagagaaggtcgatacaagaaccccacgtccaaagcggggaaccgcacaaatcatggaggtgacagcaaagtggttatggggtttcctatcaaggaataagaaacctagaatatgcaccagggaagagtttacaagaaaggtccgatcaaatgcggccataggagcagtttttgtcgatgaaaatcaatggaactccgctaaagaagccgttgaagatgaacgtttctgggatttagtacatagggagcgagagttgcataaacaaggcaaatgtgccacctgtgtatataacatgatgggcaaacgcgagaagaaattgggggaatttggtaaagcaaaaggaagtagggccatctggtacatgtggttaggagcacgcttcctagagttcgaagccttggggtttatgaatgaggaccactggttttcacgcgaaaattccttatctggggtagagggcgaaggactacataaactcggttatatactccgagatataagtaaaattcctggtgggaacatgtacgcagacgataccgcaggatgggatacacggataacagaagacgatctacaaaatgaagccaaaattactgatattatggaacctgaacatgctctattggcgacaagtatcttcaaattaacatatcagaataaagttgttcgagttcaaaggcctgctaaaagcggaacagtgatggatgtcattagtagaagagatcaacgaggctcgggacaagtgggaacatacggcttgaacaccttcacaaatatggaagtacaattgatacgtcaaatggaaagtgaaggaatatttagtccatctgaattggaaaattcaaacctggctgagcgggtactagactggctcgaaaagcacggcgtagaaagattaaagagaatggcgatcagtggcgatgattgcgtcgtcaaaccgactgatgatcgattcgctactgcgctaacagccctaaacgatatgggtaaagtccgcaaggatataccacaatgggagccctcaaaaggatggaatgactggcagcaagttccattttgctcccaccatttccatcagttgataatgaaagacgggcgagagatagtggttccatgtaggaaccaagacgaacttgtggggagagcaagagtgtctcagggggcgggttggtctctacgtgaaactgcttgcctaggcaaatcgtacgcgcagatgtggcaattgatgtatttccatagaagggacctaagattagcagctaatgctatttgctcagctgtacccgtaaattgggttccaactagcagaaccacctggagtattcatgctcaccaccaatggatgacaactgaagacatgttatcagtttggaaccgagtatggatagaagaaaatccgtggatggaagacaaaacgcatgtgtcctcatgggaagacgttccatacttaggaaaacgtgaagatcagtggtgcggttcccttattggccttactgcaagagcaacatgggccacaaatatacaggtagctataaaccaagtgcgacgcttgattggaaatgaaaattacctcgattatatgacttcaatgaaacgattcaaaaatgaatcagaccccgaaggtgcactttggtaa

SEQ ID NO: 22120 - RNA, 9879 nt, synthetic construct
  misc_feature 1..9879: note = derived and/or modified CDS sequence (opt6) from DENV-1__KM403579__SS-prME
  source 1..9879: mol_type = other RNA
agcgtaacaatgctattgatgttactgccgacagcattagcatttcatcttaccaccaggggtggtgaaccgcacatgattgtatccaaacaagaacgaggcaaatcgctactttttaaaacaagtgctggtgtaaatatgtgcacattaatagcaatggatctaggcgaattatgcgaagacacaatgacatacaaatgccctcggatcaccgaagcagaaccagatgatgtagattgttggtgtaacgcaacagatacatgggtaacgtacggaacctgttcccagacaggtgaacacagacgagataaacggagtgtcgcattagcaccacatgtcggacttggactcgaaactcggacggaaacatggatgagttctgaaggggcatggaggcagatacaaaaagtcgaaacatgggcactaagacacccaggttttaccgttatcgcactatttctagcgcatgccattggcacaagcattacacaaaaaggaataatattcatattactgatgctagttactccttcaatggctatgagatgcgtagggataggcaatcgggacttcgtagaaggacttagtggagccacttgggtagatgttgtactagaacatggatcatgtgtgacaacaatggctaaaaataaaccgacactcgatatagaattgcttaaaaccgaagtcacaaacccggcagttctaagaaaattgtgtatagaagctaaaattagtaataccacgacagattcgagatgccctacacaaggggaagcaacgctagttgaagaacaagacgctaattttgtttgccgtagaacatttgtagatcgtggatggggaaatgggtgtggcttattcgggaaaggcagcttgcttacctgcgccaaattcaaatgtgtaacaaaattagaaggcaaaatcgtacaatatgaaaatttaaagtattcggttatagtaactgtacacacaggagaccaacaccaagttggtaatgagacaaccgagcatggcaccattgccacaatcaccccacaagctccaacatccgaaatacaattaacagactacggggcgctaactctagattgttcacctcgtaccggactagatttcaatgaaatggttcttttaacaatgaaagaaaagagctggttagtacataaacaatggtttttggacctacctttaccgtggacgtcaggtgccagcacgagccaggaaacatggaatagacaggatttgctggtcacattcaaaactgcccatgccaagaaacaagaagtagtcgtcctaggaagccaagagggagcaatgcacacagcattgacgggtgcaacggaaatacaaacttcaggaaccaccacaatttttgcaggtcacctcaaatgtcgactgaaaatggacaaactgacacttaaaggtgtgtcttacgttatgtgcactggatctttcaaactggaaaaagaagtggcagaaacacaacatggcacagtgttagttcaggtaaaatatgaaggtacagatgcaccatgtaagatacccatttctacgcaagacgaaaaaggagtaacccaaaacggacgtctaattactgcaaacccaatagtgacagacaaagaaaagccagtaaacattgaaacagaacctccatttggagagtcttatattgttataggagcgggcgaaaaagcattaaaacttagttggttcaagaaagggtcatcgataggtaaaatgtttgaagcgactgcacggggagcgagacggatggcgatcttaggagacaccgcatgggatttcggaagcataggtggcgtgttcacaagcgtaggaaaacttgtacatcaagtattcgggacggcctacggagtattattctcaggagtgagttggaccatgaagataggaattggaattttgcttacttggttaggattaaatagtcgttcaacttcgttatcaatgacatgcatcgcagttggtatggttacattatacttaggtgtgatggtacaagcagatagcggttgcgttataaattggaaaggacgggaattgaaatgcggtagtggaatatttgtaacgaatgaggttcacacatggacagaacaatacaaattccaggcagatagtccaaaacgcttatctgcagcgattggaaaggcttgggaagaaggtgtatgtgggattcgtagcgctacaagactagaaaatataatgtggaaacaaatttctaatgagctaaatcacatccttttagaaaacgacatgaaatttaccgtagtcgttggtgacgcaaatgggatattaacgcaaggtaagaaaatgattcgccctcaaccaatggaacacaaatattcctggaagtcttggggaaaagctaaaattattggtgctgatatacagaacacaacttttattattgatggacctgacacacccgaatgtccagatgaccagagagcatggaatatctgggaagttgaagactacggatttggtgtatttacaacaaacatatggttaaaattgcgagattcttatactcaaatgtgcgaccatcgattaatgtccgcagcaataaaagattcaaaagcggtgcatgcggatatgggctactggattgagagtgaaaagaatgaaacatggaaattagcacgagcaagttttatagaggttaaaacatgcatttggccaagatctcatactctttggagcaacggtgtattagaatctgagatgattattcctaaaatatacggaggaccaataagccaacacaactatagacctggatatttcacgcaaactgctgggccctggcatctaggcaaactagaattggacttcaatctttgtgaaggtactacagttgtggtagatgaacattgcggaaacaggggaccatcacttaggacaacaactgtaacaggaaaaatcattcacgaatggtgttgtagatcctgtacattaccaccactaagatttcgcggagaagatgggtgttggtatggaatggagatcagaccggttaaagagaaagaagaaaatcttgtacgcagcatggtgagcgccggttcaggcgaagtagactctttcagtttaggcttattatgtgtatcgataatgatagaagaagtcatgcgtagccggtggagcagaaaaatgctaatgacaggaaccctcgccgtattctttcttttgatcatgggacagttaacgtggaacgatctgatcaggctatgtattatggtgggcgccaatgtgtcagatcgtatgggaatgggcacaacttatttagcattgatggcaacttttaagatgagaccaatgtttgcggtcggactactgtttcgacgtctaacaagccgggaagtcctcctgcttacaataggattaagtctagtcgcatcagtagagttaccaaactcactcgaagaactgggagatggtctcgcaatgggaatcatgatgctcaaattattaacagactttcagagtcatcaactatggacgaccctactgagcttgacatttataaagacgactctaagccttgattacgcgtggaaaactatggcaatggtgctatctattgtgtctctattcccattgtgtctctcgaccacctcacaaaagacaacttggctaccagttctactaggttcatttggttgtaagccattaacgatgttcttaataactgaaaataaaatttggggccggaagagttggccattaaacgaagggattatggccgttggaattgtaagcattttattaagttcactgttgaaaaacgatgttccgctagccgggcctttgattgctggaggtatgctgattgcttgttacgttataagtggtagcagtgctgatttatccctagagagagcagctgaagtcagttgggaagaagaagcagaacactcaggtgcgtcacacaatatcttagttgaagtacaggatgatgggacgatgaaaataaaagatgaagaaagagatgatacattaacaatcctcttaaaagcgacattgctagcagtaagcggagtatatcctatgagtatacctgcgactttgttcgtctggtatttctggcaaaagaagaaacaaagaagcggagtactgtgggacaccccaagcccaccagaagtggagagggccgtactggatgatggtatatacaggattctacaaagagggctcttagggagatcccaggtaggggtaggtgtcttccaagacggggtattccacaccatgtggcatgtcactcggggagcggtgttgatgtatcaagggaaacggctagaaccttcatgggcgtctgtcaagaaagacttgatatcctatggtgggggatggcgctttcaaggttcttggaataccggagaagaagttcaagtaattgccgtcgaaccaggtaagaatcctaagaacgttcaaaccactcctggtacattcaaaactccggagggggaagtgggtgctatagccttagattttaaacctggaacctcaggaagtccgatagttaatagagagggtaaaatcgtaggattgtatggaaatggagtcgtaaccaccagtgggacgtatgtatcagcgatagcgcaagcgaaagcgagccaggaaggcccactgccagaaatagaagatgaagtatttaagaaacgcaatcttactataatggatctacaccctgggtccggaaaaacacgaaggtatcttcctgcaatagtgagggaagcaatcaaaagaaaattaagaacacttatattagcacctacacgcgtagtcgcatcagaaatggcagaagcactaaaaggtatgccgattaggtatcagactaccgccgtaaaaagcgaacacacgggtaaagaaatagttgatctaatgtgtcacgcgacattcaccatgaggctgcttagccctgtccgtgtacctaattataacatgataataatggatgaagcgcattttacagatccagcatctatagccgccagaggttatatatctacccgagttggtatgggagaagccgccgcgattttcatgaccgctactcccccaggaagcgtggaagcatttccccaaagcaatgcagtcatacaggatgaggaaagagatatcccagaaaggtcatggaacagtggatacgattggattaccgattttcctggtaaaacagtgtggtttgttcccagtatcaaatccggaaacgacatagcaaactgcctacgtaagaatggaaaaagggtgatacagctctcacgaaagacatttgatacagagtatcagaaaactaagaataatgattgggattatgtggtaaccactgatatatcagagatgggagcgaacttccgcgcggatagggtgatcgacccacgacgatgcttaaaaccagtgatactaaaagatggccctgaaagggtcatactggcaggccccatgcctgtaactgccgcaagtgcagctcaaagaagaggccgtataggtagaaatcaaaataaggaaggagatcaatacatatatatgggtcaaccactaaataatgatgaagatcacgcacattggacagaggccaagatgttattagacaatataaacacccccgaaggaataatacctgcactttttgaaccagaaagggagaaaagtgcggcgatagacggagagtacagactcagaggtgaagctcgtaaaactttcgtggaacttatgcggcggggcgacttaccggtctggttatcatataaagtagcaagcgaaggtttccaatattctgacagaagatggtgcttcgatggtgagagaaataaccaagtattggaggagaatatggacgtagaaatttggacaaaagaaggagagagaaagaagttaagacctcgatggcttgacgctaggacctacagcgatcccctagcacttcgagaatttaaagagttcgcagcaggtcgacggtcagtctcaggggacttgatactagaaatcggaaaactcccacaacatttaaccctcagagcgcaaaacgcattagataatttggttatgctacacaattcagaacaaggcgggaaagcatatcgccacgccatggaggaactgcccgacacaatagagactcttatgctccttgccttgattgccgtactaactggtggtgtaacgttatttttcttatcaggtaaagggcttggtaaaacttcaatcggacttctgtgtgtcatggcatcaagcgtattattgtggatggcatcagtcgaacctcattggattgcggcgagtataatccttgagttctttctaatggtactattaatcccagaacccgatcgacaacgcacaccacaagataaccaactagcatatgtggtcattggtcttttatttatgattctaactgtagcagccaatgaaatgggtttgctcgaaaccaccaagaaagatttaggaattggtcatgttgtcgcggaaaatcatcatcacgcaactatgctagacattgatctccatccagcatcagcatggacattatatgctgtagctacgaccattataacgcctatgatgcgccacacaatcgaaaacacgacggctaatatctcactgacagctatagctaatcaggctgcaatactaatgggactggacaaaggatggccaatatcaaaaatggacataggtgtcccattattagcactggggtgttactcgcaagttaacccactaactcttaccgcggcagtgctaatgttagtcgcccattacgcgattataggccccggactacaagcgaaagccaccagggaggcccaaaaacgtacggcagccggaattatgaaaaatcctacagtagacggcatagtagcaattgatctcgatccggtggtatacgatgcaaaatttgaaaaacaactgggacaaataatgctattaatactctgcacatcccaaattcttttaatgagaactacatgggccttatgtgaaagcataaccctcgctacagggccactaacgactttgtgggagggaagccctggaaagttctggaatacaactatagcagttagtatggcgaatatctttagaggttcttacttagcaggcgctggcctggcgttttcacttatgaaatctctgggaggaggtcgacgaggaactggtgcccagggtgagacattaggggagaaatggaaacggcaactaaatcaattatcaaaatcagagttcaacacatacaaaaggagcggtattatggaagtagaccggtcagaggcaaaggaaggactaaaacggggagagaccacgaaacatgcagttagtagaggaacagcaaaactaaggtggttcgtagaaagaaatttggtcaaaccagaagggaaagtaattgatctaggatgtggccgtggaggatggtcctactattgtgccgggctaaagaaagttacagaggtaaaagggtatactaaagggggtccagggcatgaagaacccatcccaatggcaacatatggatggaatatagtaaaattacattcaggtagggacgtcttctttacaccaccagaaaaatgcgatacgcttttgtgtgatatcggcgaatcgagcccaaatcccactatcgaagaaggtcgaactttacgtgtattaaagatggtcgaaccctggctaagaggaaaccagttttgtatcaaaattctaaatccttacatgccctccgttgttgaaaccttggaacaaatgcaaagaaaacatggagggatgttggttagaaacccacttagcagaaattctacccatgaaatgtactgggtatcttgtggtacgggtaacatagtaagtgctgtaaatatgacgagtagaatgttgctcaaccgatttacaatggctcatagaaaacccacttacgaacgcgacgtcgacttaggtgcaggcacgagacatgtagctgtagaaccagagatcgcgaacttagatataattggacaacggatagaaaacataaagaatgaacacaaatctacatggcattacgatgaagacaacccgtacaaaacgtgggcttatcacggtagttatgaagtaaagccaagcggcagcgcttcatcaatggtcaacggagtcgtacgacttctaaccaaaccctgggatgttataccaatggtgacacagatagccatgacagatacaacgccattcggtcagcaaagagtgtttaaagaaaaagtggatacccgaacaccgcgtcccaaacggggtactgcacaaataatggaagttactgctaaatggctatggggctttctttcacgaaacaagaagcctagaatctgcacccgggaagagttcacacgaaaggtcagatctaatgcggcaatcggtgcagtattcgtagatgagaaccaatggaatagtgcaaaagaggccgtcgaggatgaacgattctgggatcttgttcatagggaaagggaattacataaacagggcaagtgtgcaacatgtgtttataacatgatgggaaaacgcgagaagaaattgggagagttcggcaaagcaaagggaagtagagcaatttggtacatgtggttaggggctaggtttctagaatttgaggctttaggattcatgaacgaagatcattggttcagccgagagaatagcctcagcggagtagaaggcgaagggctgcacaagttaggctacatcctaagggatatatctaaaataccagggggaaatatgtacgccgatgatacagccggatgggacaccaggattacagaagatgatttgcaaaatgaagcaaaaattactgacataatggaacccgagcatgcattactagccaccagcatatttaaactgacgtatcaaaacaaggtagttagggtgcaaagaccagccaaatcgggaacggttatggatgtcatatcgagacgagatcagcgagggtcagggcaagtaggtacttatgggctcaacacctttacaaatatggaggtacaacttattaggcagatggaatccgaaggtatattttcaccatctgaactcggaaatagtaacttggccgaacgagtcctagattggctagaaaaacacggcgtcgagagattgaagagaatggccataagcggagatgattgcgtagtgaaaccaactgacgaccgatttgcaacagcattgacagctttaaatgatatgggaaaagtgaggaaggatattccccaatgggagccgtcaaagggttggaatgattggcaacaagttcctttttgcagccatcatttccaccaattaataatgaaagatggaagagaaatagtagtaccttgcaggaaccaggatgaattagtaggtcgagctcgagtatcgcaaggtgcgggttggtcactaagagaaacggcttgcttagggaaaagctatgcacaaatgtggcaactcatgtacttccacagaagagatctgagattagcggcaaacgcgatatgctcagccgttccagtaaattgggtccctacgtccagaacaacatggagcatccacgcacaccatcaatggatgactacagaagatatgttgtcagtatggaacagagtctggatcgaagaaaatccgtggatggaagataaaacccacgtttcctcgtgggaagatgtgccctacttaggcaaaagagaagatcaatggtgcggcagtctaataggactcacagcaagagctacctgggctactaatatacaagtagcaataaatcaagtaagaaaactgataggtaatgaaaactacttggattacatgacatcaatgaagcggtttaaaaatgaatctgatccagagggtgctttatggtga

SEQ ID NO: 22121 - RNA, 9879 nt, synthetic construct
  misc_feature 1..9879: note = derived and/or modified CDS sequence (opt6) from DENV-1__HM469968__SS-prME
  source 1..9879: mol_type = other RNA
tcagttacaatgctccttatgttaatgccaacggctttagcatttcatctaacaacacgtggaggtgaaccacatatgatagtaagtaaacaggaaagaggaaaaagtctattatttaaaacgtcagcgggtgtcaacatgtgtacactcattgcaatggatttgggtgaattatgcgaagatacaatgacgtataaatgtccaagaataaccgaagcagaaccagatgatgttgattgctggtgtaatgcaaccgacacgtgggtcacatacggtacctgttctcagacgggcgaacatcggcgagataaacgaagcgttgctctagcaccacatgtgggtttaggtctggaaacgcgaacagaaacatggatgtcatcggaaggcgcatggaaacaaatacaacgtgttgaaacttgggctctaagacacccaggtttcactgtgattgcactgtttcttgcgcacgcaataggaacttcgataactcaaaaaggaattatcttcattttattaatgcttgtaactccgagtatggctatgagatgcgttggcatcggaagtcgtgacttcgtagaaggacttagtggtgctacatgggtagacgttgttctagaacacggcagttgcgtaacaaccatggcaaaagataaacccacattagatatcgaattactaaaaacagaagtaacgaacccagcagtcttgagaaaactgtgtatagaggcaaaaatatctaatacaacaacggactctagatgccccacacaaggcgaggcaaccctcgttgaggaacaggatgcaaactttgtgtgccgacgaacgtttgtcgacagaggttggggaaacggatgcggattattcggaaaaggatctttgatcacttgcgccaagttcaagtgtgtcacaaaactcgaaggaaagattgtacagtatgaaaatttaaaatatagtgttatagtaactgtgcacactggcgatcagcaccaagttggtaacgaatccacagaacatggaacgactgccacaataaccccgcaagccccaacaacagaaattcagttaactgattatggagcattaacgttagattgttccccaagaacgggattagattttaatgaaatggttttgttaaccatgaaggagaaaagctggttggtgcataagcaatggttcctagacctaccactgccctggacctcgggtgcttctacaagtcaagagacgtggaacagacaagacttgcttgttacatttaaaacagcccacgctaagaaacaggaagtcgtagtgcttggttcccaagagggagctatgcacactgctctaacaggcgccacagaaatacaaacaagcggtaccacaactattttcgcgggacacctaaaatgtaggctcaagatggacaaactaaccttaaaaggtatgtcttatgtaatgtgcacaggaagttttaagctagaaaaagaagtagcagagactcaacacggaacggtgctagtgcaaataaagtatgaaggaacagacgcaccatgtaaaataccattttctacacaggatgagaaaggtgtcacccagaatggaaggcttatcactgccaatcccatagttacagacaaagaaaaaccagtaaacattgaagctgaaccacctttcggagaatcatacatcgtcatcggcgcgggggaaaaggcattaaaacttagttggttcaagaaagggtcttcaattggaaaaatgtttgaagctacggcaagaggagcaagaagaatggcaattctaggtgatacagcctgggatttcggctctataggaggagtattcacgtcagtgggaaaattagtacatcaaatatttggcacagcctatggagtactgttttcaggggtcagctggactatgaaaataggtattggagcgttactgacttggttgggcttaaatagtagatcaacgagtctgtcgatgacgtgtattgccgttggactcgttaccttatatttaggagtaatggtccaggcggattcaggctgcgtaataaattggaagggtagagaattaaaatgcggaagtggaattttcgttacaaacgaagttcatacctggacggaacaatataaatttcaagcggacagtccaaagcgactgagtgcagctattggaaaggcatgggaagagggcgtgtgtggaataagatccgcaacaagactcgaaaatatcatgtggaaacaaatatcgaatgaattgaaccacattttactagaaaacgatatgaagtttacagttgtagtaggagatgtagctggcatattagcgcaaggcaaaaagatgatacgccctcaacctatggaatacaagtatagttggaaaagttggggcaaagctaagattataggggcagacgtacaaaatactacctttattatagacggtccaaatactcctgaatgtcctgatgatcaacgagcctggaatatatgggaagttgaagattatggattcggaatatttacaacaaacatttggctaaaattgagggattcatatacacaggtgtgcgatcatagactaatgagtgcagccattaaagatagcaaagccgtgcatgcggatatggggtattggatagagtctgagaaaaatgaaacttggaaattggctcgcgcaagttttatcgaagtaaaaacatgtatatggcccaaatcgcatacactctggtcgaatggtgttttggaaagcgaaatgattatccctaagatttatggaggacccatatcacaacataattatcgaccaggatatttcacacagaccgcaggtccatggcatttaggcaaattggagttagatttcgatctatgcgaaggcacgactgtggtggttgatgaacattgtggtaatcgaggaccatcgctgagaacaacgaccgtcacaggtaagattatacacgaatggtgttgccgttcatgcacccttccccctttacggtttcgcggggaagacggttgttggtacggaatggagataagaccggtgaaagaaaaggaagaaaatctagttaaatctatggtatcagcagggtccggtgaggtggacagtttctctttaggtcttttatgtatttcaattatgatagaggaagtaatgcgttcgcgttggagccgaaaaatgctaatgacagggactctagccgtattctttttattaataatggggcaacttacctggaatgacctgatacgcttatgtataatggtcggagcaaatgccagcgacaggatgggcatggggactacgtaccttgctctgatggcaacctttaagatgagaccaatgttcgcggtggggttattattcaggaggttaacttcaagggaagttttactattaactataggactatcgttggtagcatctgtggagctgccgaactcattggaagaactaggggacggattagcaatgggcattatgattcttaaattactcacagattttcaatcgcatcagctgtgggcaaccctattatcacttacgtttataaagacaacattttctctacattacgcttggaaaacgatggccatggtcttaagcattgttagtctatttcccctctgtctatcaacaacctctcagaaaacaacttggcttcctgtgttgctgggttctctaggctgcaagccgctaacaatgtttttaattgccgagaacaaaatctggggtaggaaaagttggccattaaacgaaggaataatggcagtcggaattgtaagcatattattatcttcgctactcaaaaacgatgtacctctagcgggtcctttaatagctggtggaatgctaatagcatgctatgttataagcggctcgagtgcagacttaagtttagaaaaagcagccgaagtctcctgggaagaagaagctgaacattcaggagcttcccataacattcttgttgaagtacaggatgatggtacaatgaaaattaaagatgaggaaagagacgacactctaacgattctactcaaagctacactattagctgtttccggagtgtaccctctttcaattcctgccacactcttcgtatggtacttttggcaaaagaagaagcaaagatcaggtgttttatgggatacaccgagcccacctgaggtagaaagagccgtccttgatgatggaatttaccgaattatgcaaagaggactgctagggagatcacaagtgggggtaggtgtatttcaagaaaacgtctttcataccatgtggcatgtaacaagaggcgcagtgttaatgtatcaaggtaaaagattagaaccctcgtgggcatcagttaaaaaggatttaataagctacggtggcggatggagattgcaaggtagctggaacaccggggaagaagtccaagtcatagcggtcgaacccggtaaaaatccaaagaacgtacaaacagctcctgggacctttaaaaccccagaaggagaagtaggagccatagcactcgacttcaaacctggaacatctggaagtcctatagttaatagagagggaaagattgtaggattatacggcaacggagtcgtcactacaagtggtacctatgtaagcgctatcgcgcaagcgaaggcaagtcaagaaggtccattaccagaaatagaggacgaagtttttaggaaacgaaatttaacaataatggatctgcaccccggtagcggaaaaacacgcagatatctgccagctatagttagagaggcaattaaacgaaaacttcgcacattgattctggctccgacacgtgtggtagcttctgaaatggcggaagcgttaaaaggcatgccaatacgatatcaaactaccgcggtaaagtcagaacatactggaaaagagatcgttgatctaatgtgtcacgctacgttcacaatgaggctactgtctcccgtgagagtccctaactataatatgataatcatggatgaggcacatttcactgatccttcaagtatagcagctcgagggtatataagtacacgtgtaggaatgggtgaggcagcagcaatattcatgaccgccaccccaccggggtcagttgaagcatttcctcagagcaatgctgtaatacaagacgaagaacgggatattccagagagatcgtggaactcgggatatgaatggattactgacttcccaggaaagactgtatggttcgtaccctcaataaaatcaggcaatgatatagccaattgtttacgtaaaaatggtaaaagagtgatacaactctctagaaaaaccttcgatacagaataccagaaaactaaaaacaatgattgggattatgtagtaactacggatatctctgagatgggggctaactttcgcgccgatcgtgtcattgatccgcgtagatgtctcaaacctgttatacttaaggatgggcctgagagagtaatcttagccggacccatgccagtaacagtagcatctgcagcgcaaaggcgcggacgtattggacgaaatcataacaaagaaggtgatcaatatatatatatgggacaaccactcaacaacgatgaagatcatgcccactggaccgaagcgaaaatgctgttagataacataaacacaccagaaggtattataccggccttattcgaaccagagcgcgaaaagtcggccgcaattgacggtgagtacagacttcgtggagaggcaagaaagacatttgtggaattgatgcgtagaggggatctaccagtatggttaagttacaaagttgcttcggaaggttttcaatattcggatagacgatggtgctttgacggtgagaggaataatcaagtcttagaagaaaatatggatgttgaaatttggactaaagaaggtgaaaggaagaaactgaggccgcggtggctagacgccaggacatatagcgatccattagcgttaagggaatttaaggaatttgctgcaggacgacgatccgtgtcaggagacttaatattggaaattgggaaactgccacaacacctaacgcaaagagcacaaaatgcgctcgacaatctagtcatgctccataacagcgaacaaggcggcagagcataccgtcatgccatggaagaattacccgatacgatagaaacactcatgctactagccctaatcgctgttctaacagggggtgtaactctattctttctaagtggtagaggcttaggcaaaacatctatcggactcctttgcgtaatggcatcaagtgttctcctatggatggctagtgtggagcctcattggatagcggcctctatcattctagaatttttcctaatggttttgctcataccagaaccggaccgtcaaagaacaccacaagacaaccaactcgcctacgtagtaattgggttattattcatgatcttgacagttgcagctaatgaaatgggacttttggagacaacgaaaaaggacctgggaataggacacgtagcagtggagaaccatcatcacgctgctatgctagacgttgaccttcaccccgcgagtgcttggacattgtatgcagtagctacaacaataataactccaatgatgcgacacacaatagaaaacaccaccgcaaacatctcgttaacagcaatagcaaatcaagcagctattctaatgggtctggataaaggatggcctatctcaaaaatggacataggggttccattgctagcattaggttgttattcacaagtgaatcctcttacactcacggcagcggttttaatgctggtcgcacattatgcaataataggtccaggtttacaggctaaagcaacccgcgaggctcaaaagagaacagcagccggcatcatgaagaacccaacggtggatggtatagtagcaatagatcttgatcctgtcgtttatgacgcaaaatttgagaaacaattaggacaaatcatgttgttaattttatgtacgtcccaaatcttacttatgcgcacaacttgggccctatgtgaatctatcacactagctactgggcctctgactacactctgggaagggtccccaggtaaattttggaacactacgatcgcagtaagtatggcaaacattttcagaggaagctatttagccggtgctggtttagctttttctttgatgaagagtctaggcggcggtcgaagaggtacaggtgctcaaggagaaaccctaggagagaaatggaagcgacaattaaaccaactttcaaaatctgagttcaacacctacaagagaagtggtattatggaagtcgacaggtcggaagccaaggaaggtttaaagaggggagaaaccacgaaacacgcggtgagccgtggcaccgccaaacttcgttggttcgtagaacggaatttagtcaaacccgaaggcaaagtaattgatttgggctgtggtagaggaggttggagctattattgtgccggtctaaagaaagttacagaagttaaaggctacactaaaggcggccctgggcatgaagaacctataccaatggcaacttatgggtggaacctggtgaaattgcattcaggaaaagatgtattctttattccacctgagaaatgtgatactttgctatgcgatattggtgaatcttctccaaacccaactattgaagaagggcgtacattgagggtattaaaaatggtcgagccatggctacgtggcaatcaattctgtattaaaattttaaatccctacatgccaagtgtagtcgaaactcttgaacaaatgcaacgcaaatacggtggaatgttagtccgaaatcctttaagccgaaatagtacacatgaaatgtactgggtcagttgcggaactggaaatatagtgagcgcagtgaatatgacatcgagaatgttattaaatcgattcacgatggcacatcgtaaacctacatatgaacgagatgtagatctgggagcgggcacacggcacgtagcagtcgaacctgaagttgcaaatcttgatataatagggcagagaatcgaaaacattaaacacgaacataagtcgacttggcattacgatgaagataacccctataaaacgtgggcgtaccacggatcttatgaagtaaaaccctcggggtcagcaagcagtatggttaatggagtagtgaagttgctcacgaaaccgtgggatgtaatccccatggtaacgcaaattgcgatgacggacacgacaccattcggtcaacaacgagtgtttaaagaaaaggtcgacacaaggacccctaaagcgaaaaggggtaccgcacaaataatggaggttacagcacgatggctatggggatttctgtcaagaaataagaaacctagaatctgtacccgagaggaatttaccaggaaagtaagaagtaacgcggccataggtgcggtctttgtcgacgaaaatcaatggaacagcgcgaaagaagccgttgaggatgaaagattttgggacctagtacatcgagaaagggaacttcacaaacagggcaaatgcgcaacatgcgtatataatatgatgggaaaaagagagaagaaactcggagaatttggcaaagctaaaggcagtcgcgcgatatggtatatgtggttgggtgcccgatttctagagtttgaggctttaggcttcatgaatgaagaccattggttttcaagggaaaatagcttatctggagtagaaggtgagggattacataaattagggtacatactgcgggatatatcgaagatccctgggggtaatatgtatgcagatgatacagccggatgggatacgcgcattaccgaggatgatcttcaaaacgaagcaaagatcaccgatattatggagccagagcacgcgttattagcaaaagctatcttcaaactaacatatcaaaataaagtagttagagtacaaaggccagcaaagaatgggacggttatggacgtgatatcgagaagagatcaaagaggtagcggccaagtaggaacctatgggttaaacactttcaccaacatggaagctcagcttatacgacaaatggaaagtgaaggaatatttttaccgagcgagttggaaactccgaacctagctgagcgagttctagattggctagagaaatatggagtagagcggttgaagagaatggcaattagcggagatgattgtgttgtaaaaccaattgacgataggttcgcgacggcattgaccgcccttaatgatatgggcaaagtccggaaggatatacctcaatgggaaccatcaaagggatggaatgattggcaacaagtgcctttctgtagccaccatttccatcagttaataatgaaagacggtagagagatagtagttccgtgcagaaaccaagatgagttggtgggacgtgccagggtatctcagggagccggatggagcctgagagaaactgcttgtttaggaaaatcgtatgcacaaatgtggcaactcatgtatttccataggagggatcttcgcttggcagcgaacgccatttgctcagcagtaccggtggactgggtacctacgtcaaggaccacatggagtatacacgcccatcaccaatggatgacgacagaagatatgctgagtgtatggaatagggtctggatcgaggagaacccctggatggaagataaaacacatatatctagttgggaagacgttccatatttaggtaagagagaagatcagtggtgcggatctctcattggtttaacagctagagcaacttgggccaccaatatacaagttgctataaaccaagtgcgacgactcataggtaacgaaaattatctagactacatgacatcaatgaaaaggttcaaaaatgaaagtgatcccgagggggctttgtggtag

SEQ ID NO: 22122 - RNA, 9879 nt, synthetic construct
  misc_feature 1..9879: note = derived and/or modified CDS sequence (opt6) from DENV-1__KC172834__SS-prME
  source 1..9879: mol_type = other RNA
tcagtcacgatgttactgatgttaatgcctacagcacttgcatttcacctaacaacaagagggggagagcctcatatgatagtgagtaaacaagaaaggggcaaaagcctattattcaaaacatcggcaggggtaaacatgtgcacactaatcgctatggatctgggagaactttgtgaagacacgatgacatataaatgtccacgaattacagaagctgagcctgatgatgtagactgctggtgcaacgcgacggatacatgggtaacatatggcacttgttcccaggcaggggaacatcggcgtgacaaacgatcggtcgcattagcaccacatgtaggactaggactagaaacccgaaccgaaacctggatgtcatcagagggagcttggaaacagatacagagggtagaaacatgggcactacgacacccagggtttactgttatagccctctttctagcgcacgctattggaaccagcataacgcaaaaaggaataatattcattcttttaatgttggtcacaccttcgatggctatgcgatgtgtcggaatcgggtcgcgcgatttcgtcgaaggtttatcaggagctacctgggtagacgtagtgttggagcatggttcgtgtgtaacaacgatggccaaagataaaccaaccctagatatagaattattaaaaacagaagtaactaatccagccgtactaaggaaattatgtatagaagctaaaatcagcaatactactactgatagtcgttgtcctactcaaggtgaagcgactctggtggaggagcaggatgctaactttgtatgtcgacgaacgttcgtcgatcgtgggtggggtaatggttgcggcttgtttggaaagggatcgttattgacgtgcgcgaaatttaagtgcgtaacaaaattggaaggtaagatagtacaatacgaaaatttaaaatattccgtaatagttactgtgcacactggtgaccagcatcaagtaggaaatgaaagtacagaacacggtaccactgctacaattactcctcaagccccaaccacggaaatacagttaacggactacggtgccttaacattagattgctccccaaggaccgggctggactttaacgagatggtcctacttacaatgaaagaaaaatcgtggcttgtacacaagcagtggttccttgatttaccactaccttggacaagtggggcttcaacatcccaagaaacttggaataggcaggacttactcgtaacatttaaaactgcacatgccaagaaacaggaagttgtagttttaggttcacaagaaggtgccatgcacacagctttaacaggagcaacggaaatccaaacaagtggaacaacaacaatatttgccgggcatctcaagtgtcggttaaaaatggacaaattaacattgaagggaatgagttatgtcatgtgcaccggttcgttcaaattagagaaggaagttgctgagacacagcacggtacggtattagtacaaataaagtacgaaggaacagatgcaccgtgcaaaataccattctcaacacaggacgaaaagggcgtaactcaaaatggtcggttgataacggcgaaccccatagttacggacaaggaaaaaccagtaaatatcgaagccgaacctccattcggagagagttacatagtcataggagctggtgaaaaagctctaaaactgtcttggtttaagaaaggatcctccataggtaaaatgttcgaagctaccgccagaggcgcaagacgtatggcaatcttgggagatactgcctgggatttcggatcaattggaggggtatttaccagtgtgggaaaattagttcaccaaatcttcggtaccgcatatggtgtactattcagcggagtatcatggacgatgaaaatcggtataggagtgcttttgacttggttaggtttgaatagtcgatccacgtctttatccatgacatgtatagctgttggactcgtaacattatacttaggtgtaatggttcaagcggattccggctgcgtaatcaattggaaaggaagagaattgaaatgtggcagtggaatatttgtcaccaacgaggttcacacgtggacagaacagtataagtttcaagcagattctccaaaacgcttatcggcagctataggaaaagcatgggaggaaggtgtctgtgggatacgaagtgcgactaggttagaaaatattatgtggaaacaaatatccaatgagttgaaccatatattgctagaaaatgatatgaaatttacagtggtagtcggcgacgtcgcaggaatactggcgcaaggtaaaaagatgatcagaccgcaaccaatggaatataaatattcttggaaaagctggggcaaggcaaagataataggggctgatgtacaaaacagtacgtttattattgatggtccaaatactccagaatgtcctgacgatcagagagcgtggaacatttgggaagtagaagactacggttttgggatctttacaactaacatatggctaaaacttagagactcatacacacaagtctgcgaccatcgacttatgtcagcagcaattaaagatagcaaagcggtacatgcagacatgggttattggattgagagcgagaaaaatgaaacatggaaactggcaagagcctcattcattgaagttaagacatgtatctggcctaagtcacacacattatggtcaaacggcgtactggaaagcgaaatgattatacccaagatatatggtggcccgattagccaacacaactatcgaccaggttatttcacacaaacggcaggaccttggcaccttggaaagctcgagttagatttcgatctctgcgaaggtacaactgttgtagtagatgaacactgcggaaaccgggggccttcattacgaacgacaactgttacaggaaaaatcatccatgaatggtgttgcaggagttgtacactcccgcccttaagatttagaggggaagacggctgctggtatggcatggaaatacgaccggtgaaggaaaaggaagaaaacctagtaaaatccatggtttctgcaggttcaggggaggtagattcattttctttaggtttattatgtatatcaattatgatcgaagaagtgatgcgaagcagatggagccgaaaaatgctaatgacaggtacattggcagtatttttcctacttataatggggcaattaacatggaatgacttaattagactctgtataatggtgggtgcgaacgccagcgatagaatgggtatggggacgacatacctagccttaatggccacatttaaaatgcggccgatgtttgcagtcggcctactattccgacggttaacatcgcgagaagttctccttttgacaattgggctcagcttagtcgctagtgtagaactaccaaattcacttgaggaattaggcgacggcctagctatgggtattatgatcctgaaactcctgacggattttcaatcacatcagttatgggctacgttactttccttaacctttattaaaactacattttcgctacactatgcgtggaaaacaatggcaatggtgttaagtattgtttcgctatttccactctgcttatctacaacgtcgcagaaaactacgtggcttccggtattgttgggatcattgggatgtaaaccgttaactatgttcttgatagccgaaaacaaaatctggggaagaaaaagttggcctctgaacgaaggaataatggcagtaggaattgtttcgattctcttgtcctcattactaaagaacgatgtaccacttgccggtcccctcatagcaggaggtatgttaatcgcatgttatgtgatcagtggtagctctgcagatctcagcctagagaaagcggcagaggtgtcatgggaagaggaagcagaacatagcggggcctcgcacaatatcctagttgaagtacaagatgacggtaccatgaaaataaaagacgaggaaagagatgatactctgacaatattattaaaagcgacgctcctagcagtaagtggtgtataccctttgagcatccctgcaacattatttgtatggtatttttggcaaaagaagaaacagagaagcggtgtactatgggacacacctagtccaccagaagtagaaagagcggttctcgatgacggaatatacagaataatgcagcgaggactattaggccgctcgcaagtgggagtaggcgtctttcaggagaatgttttccatactatgtggcatgtcacacgtggagcggtacttatgtaccagggaaaaagacttgaaccaagctgggcttcggtcaagaaagatctgatatcatatggcggaggttggcgatttcagggatcatggaatacaggtgaggaggtacaagtaatagccgtggaaccgggtaaaaacccgaagaacgtacaaacagcacccggaacatttaagacacccgaaggagaagtaggagcaattgcccttgattttaaacctgggacttcgggcagtcctattgtaaatcgagaaggaaaaatagtaggtttgtacggaaatggtgtggtaacaacatccgggacttacgtatccgccatcgcgcaagccaaggcatcgcaagaaggaccattacctgaaattgaagatgaggtctttaggaaaaggaatctcacgattatggacctgcacccaggcagcggtaagacacgacgttatttaccagccattgtaagagaagcaataaagaggaagctccgaacattgatcctggctcctactcgggtcgttgcaagcgagatggcggaggccttgaagggcatgccaataagatatcaaaccacagcagtaaaatcagaacatactggaaaggagatagtagatttgatgtgtcatgctacttttacaatgagactactaagtcctgttcgcgtacccaattacaacatgataataatggacgaagcccactttacagatccaagtagtatagcagccagagggtacataagtaccagggtaggaatgggagaagccgcagcaatttttatgaccgcaacccctcccggatcaatggaggcttttccacaatcaaacgctgtaatccaagacgaagaacgagacattccggagagaagctggaacctaggtcatgaatggatcacagatttcccgggcaaaaccgtatggttcgtacctagtataaaagccggcaatgacatagcaaactgcttgaggaaaaatggcaaaagagtgatacaattaagtcgtaagacatttgataccgaatatcagaaaaccaaaaataacgattgggactatgtagttacaacagacatatccgaaatgggtgctaactttcgtgcagatcgagtaattgatcctcgaaggtgcctcaagcccgttatactaaaagacgggccagaaagagtaatactagcaggaccaatgcctgtaaccgtcgcttcagctgcacagcgaaggggtcgtattggtcggaatcataacaaggagggggaccaatatatttacatgggtcagcctctaaacaatgatgaagaccatgcccactggaccgaagcaaagatgctattagacaacatcaatacaccagaaggtataataccagctttatttgagccagaaagagaaaagtcagctgccattgatggagaatatagactaagaggagaggcaagaaaaacattcgttgagctaatgcggcgtggagatcttcctgtatggttaagttataaggtagctagtgaaggctttcaatattcagataggagatggtgctttgacggtgaaagaaacaatcaagtattagaggaaaacatggatgtggagatctggacaaaagaaggtgagcgcaagaaacttaggccgcgctggcttgacgcccgaacttatagtgatcccctagcacttcgcgaatttaaagaatttgcagcaggtcggagatctgtaagtggagatttgatattagagatagggaaattaccccaacatttgacacaaagagcacaaaacgctttagataacttagtcatacttcacaattcggagcagggaggaagggcgtaccggcacgctatggaggagcttcctgatactattgagacattaatgctacttgcgctaattgctgtattaactggaggggtaacattattctttctatcaggtaaaggtctagggaaaacgagcatcggtctcctatgcgtaatggcttcatcagttctactatggatggcaagcgtagaacctcattggatcgcagcctcaataattctcgagttctttttgatggttttgcttatcccggaaccagacagacaaagaactccacaagataatcaacttgcatacgtggtcatagggttactgttcatgatcttaaccgttgcagcaaacgaaatgggactactagaaacgaccaagaaagatttagggataggtcacgtcgcggtcgaaaaccatcatcatgcagctatgctagatgtcgacttgcatcccgcatcagcatggacgctttacgctgtcgctaccaccataattacccccatgatgaggcatactatcgaaaatactacagctaatatatctctaacggccatcgcgaatcaagcagctatactaatgggtttggacaaagggtggccgatttcgaaaatggatataggagttccattgcttgcactgggctgttactcacaggtgaatcccttaacactcactgcagcagtactaatgttggttgctcactacgcaataataggcccggggttacaagccaaagccactagggaagctcaaaaacgtaccgcggctgggataatgaaaaatcccacaatagatggaatcgttgctattgatctagacccggtagtatacgacgctaaattcgaaaaacagctgggacagatcatgttgttaatattatgcacatcacaaattcttttaatgagaactacttgggcactatgcgaatctatcaccttagcaacagggccactgactacactgtgggaaggatctccggggaaattctggaatactacaatagcggtatccatggccaacatctttaggggttcttacctggccggggctggtcttgcattctctcttatgaaatcactaggtggtggacgcagaggaactggagctcaaggcgaaaccttaggagagaaatggaaaagacagttgaatcagctgtcaaaatcagagtttaacacttacaaaagatctggaataatggaggtcgatagaagtgaagcaaaagaaggtttgaagagaggtgaaaccacaaaacacgctgtgtccagggggacagcaaaattacgatggtttgttgaacgcaatctagtaaagccagaggggaaagtaattgacttaggatgtggcagaggtgggtggagttactactgcgcgggactcaagaaagttacagaagttaaaggttatactaagggtggaccaggacatgaggaaccgatacctatggccacttacggctggaatttggtcaagttgcacagtggcaaggatgtcttctttgtgccacctgaaaagtgtgatacactactttgtgacataggtgagtcaagtcctaacccaacaatcgaagaaggaaggaccctaagggtattaaaaatggtagaaccatggttaagaggaaatcaattctgtattaagatattaaacccatatatgcccagtgttgttgaaacactcgagcagatgcaacgaaagcacgggggtatgttagtaagaaacccgctgagtcgcaatagcacccatgaaatgtattgggtttcatgcggaacaggtaacatagtcagtgcagtaaatatgacatccaggatgctacttaacaggttcactatggcacatagaaaacctacatatgaacgtgatgttgatctaggagcaggtactcgccatgtagcggttgaaccagaagtcgcaaacctcgatatcattggacaacggattgaaaatattaaacatgaacataagagcacatggcactatgacgaggacaatccatataagacttgggcttaccatgggtcatatgaagttaagcccagtgggtctgcgtctagtatggttaatggagttgtaaaacttttaacaaagccatgggatgtgatccccatggttacacaaatagcaatgacagacacgacgcctttcggacagcaaagggtatttaaggagaaagtcgacactcggacgccaaaggcgaaacggggtacggcacaaataatggaagtaacagctcgctggctttggggattcctaagtcgcaacaaaaagccaagaatctgcacgagagaagaatttacaagaaaagtacgctcaaatgccgccataggtgcagtattcgtcgatgaaaaccagtggaactcagccaaagaggctgtagaagacgaccggttttgggatcttgtgcatagggaaagggaactacataaacaaggtaaatgcgcaacatgtgtatacaacatgatgggaaaaagggaaaagaaattaggagaatttggtaaagcaaaaggatcaagggccatctggtatatgtggttaggagcgaggttcttggaatttgaggctttaggcttcatgaacgaagaccactggttcagtcgagaaaatagcttgtctggagtcgaaggagaaggacttcataaactagggtatatattaagagacataagcaaaataccaggtgggaatatgtatgcagatgacacagccggatgggatacacgaataacagaagatgacctgcagaacgaagcaaagattacagacattatggaacctgaacacgcattacttgctaaatcaatctttaaactaacgtaccaaaataaggtcgtgcgagtacaacgtcctgcaaagaacgggactgtaatggacgtgatttcacgtcgagaccagaggggcagcggacaagtcggtacatatgggctgaatacgtttactaacatggaagcgcaacttataagacaaatggagtccgaaggaatatttagtccaaacgaattagaaacaccaaacctagcagaaagggtgctcgactggctggaaaaatatggagtagaaagattaaagaggatggcgatatcaggtgacgattgtgtagtcaaacctatcgatgatcgttttgcgacagccttgacggctctaaacgatatgggaaaagtacgaaaggacattcctcaatgggaaccgagcaagggttggaatgactggcagcaggttcctttttgctctcatcactttcaccaactaattatgaaggacggacgagaaattgtagtgccctgtcgaaaccaggacgaattagtaggcagagcaagagtgagccaaggagcaggctggggactacgagaaaccgcgtgccttggcaaatcatatgctcaaatgtggcaactaatgtattttcacaggcgggacttaagattggctgctaatgcaatctgtagtgcagttccagtcgactgggttcctacttcacgaacaacctggagtattcacgctcaccatcaatggatgacaacggaagatatgcttagtgtctggaacagagtatggattgaggaaaatccctggatggaggataagacgcgaatttcttcttgggaagatgtaccatatctagggaagcgtgaggatcagtggtgtggcagtcttattggattaacagctcgagcaacatgggcaacaaatatacaagtagccataaaccaagtacgccgcttgatcggaaatgaaaattacagtgactatatgacttcgatgaaaagatttaaaaatgaatcagagccagagggagcactatggtga

SEQ ID NO: 22123 - RNA, 9879 nt, synthetic construct
  misc_feature 1..9879: note = derived and/or modified CDS sequence (opt6) from DENV-1__KJ933413__SS-prME
  source 1..9879: mol_type = other RNA
tcagtgacaatgcttctaatgctattgccaactgctttagcgttccatctaaccactcgaggaggtgaaccccacatgattgtatctaaacaagaaagaggtaaaagccttttatttaaaacatccaccggggtcaatatgtgcactctaatagccatggatttgggtgagctatgcgaggacacgatgacttataaatgccctcgaatcacggaaaccgaacctgatgatgtagactgctggtgtaatgcaaccgaaacatgggtcacttatgggacgtgtagccaaacaggggaacataggagagataaacggtcggtagcgttggctcctcatgtagggttaggactggaaaccagaactgaaacatggatgtcatctgagggtgcctggagacaaattcaaaaagtcgaaacatgggcactaaggcaccccggttttactgtaatagcactatttttagcccacgctatcggaacttccataacacaaaaaggcattatttttatactactaatgttagtaacaccgtcaatggcaatgagatgcgtagggataggcaatcgagactttgttgagggcctaagcggagcgacatgggttgatgtcgttcttgaacacggaagctgtgtaacaacaatggctaaagacaaacctactctagacatagagcttcttaaaacagaagttacaaatccagcagtccttcggaaattatgtatagaagccaaaatatcgaataccacaacagacagtcggtgtccgacgcaaggggaggctacattggtggaagaacaagatacaaattttgtatgcagaagaactcttgtagatcggggttggggaaacgggtgtggactatttggtaaaggtagcttaataacatgcgcaaaatttaaatgtgtcactaaattagaaggtaaaatcgtccaatacgagaacttaaaatactcagtaatagtaacggtgcacaccggcgatcaacatcaggttggcaacgagactactgaacatggtactacagcaacaataacccctcaagctccaaccagcgagatacaacttacagactatggggctcttacattagactgttcgccacgtacggggcttgattttaatgaaatggtcctactaacaatgaaagagaaaagctggcttgtacacaaacaatggtttcttgacttgccattaccatggacatccggagccagtacgtcacaagaaacatggaatcgccaagatttattagttactttcaagactgctcacgcaaagaaacaagaagtcgtcgtattaggctctcaagagggggcaatgcacaccgcgttaaccggagctacggaaatacaaacttcaggaacaacgacaatattcgctggacaccttaaatgccgattaaagatggacaagttaacattaaagggagtgagttatgtcatgtgtactgggagcttcaaattagagaaagaagtcgcagagacgcaacatggaacggttttagttcaggtaaaatatgaaggaacagacgccccatgtaaaataccatttacatcacaggatgaaaaaggagtgacgcaaaacggcagattaataacagcgaatcccatagtgacagacaaagaaaaaccagtaaatatagaagcagaaccacccttcggtgagtcctatttagtagtcggcgccggcgaaaaagcattaaaattaagttggttcaagaaaggatcttcaatagggaaaatgtttgaagctacggctagaggtgcacgtcgaatggcgatactcggtgataccgcatgggactttggcagcattggcggagtgtttacatccgttgggaaactgatccaccaaatatttggcaccgcatacggtgtattgttcagtggtgtaagctggaccatgaaaataggtatcgggatactgcttacctggttaggtctaaattcacgaagcacgtcattatcgatgacgtgcatagcagtcggcatggtaacattgtatttaggtgtaatggtccaggctgacagtggctgcgtaataaattggaaaggaagggagcttaagtgtggatcgggtatatttgtcacaaatgaggttcacacatggaccgagcaatataaatttcaagccgacagcccgaaaagattatccgcagccataggaaaagcatgggaggaaggcgtatgtggaatacggtccgtaactcgattagaaaacatcatgtggaaacaaattagtaatgaattaaatcacatcctgcttgaaaacgatatgaagttcacagtcgtcgtaggagatgtgaacggaatactagcgcaaggcaagaaaatgataagaccacaacctatggaacataagtattcttggaagtcatggggtaaagccaaagtaataggagccgacgtgcaaaacagtacgttcataatagacgggccaaacacccccgagtgtcctgatgatcaaagagcgtggaatatttgggaagtcgaagactacgggtttggaatatttactacaaatatctggttaaaactaagagactcatatactcaggtatgtgaccatagactaatgtctgcagctattaaagattcaaaagctgttcatgcagatatgggctactggatagaatcagagaaaaacgaaacatggaaactaacgagagcatcatttattgaagtaaaaacttgtgtctggcccaaaagtcataccctatggtccaatggtgtgctagaatcggaaatgataattcccaagatatacggagggcccatatctcaacacaactatagaccagggtatttcactcaaacggcaggaccctggcatttgggaaaactcgaacttgacttcggcttatgtgaaggtactacagtagtagttgacgaacactgtggtaatcgaggaccctctttgcggacaacgacagttactggaaaaattatacacgaatggtgttgcagatcatgcacactcccaccattacgttttaagggtgaagatggttgttggtacggtatggaaattcgaccggtcaaagaaaaagaagaaaatcttgtcaaatctatggttagtgcagggtccggggaagtcgatagtttcagcttaggattgttatgcatatcgattatgatagaagaggtaatgagatctaggtggagcagaaaaatgctaatgaccggaactttggcagtattcttattattaattatggggcaattaacctggaatgatttaataagattatgtataatggtaggggccaatgcaagtgataaaatgggcatgggtactacatacttagcattaatggctacctttaggatgagaccaatgtttgctgtaggacttttgttccgtagactaacatcaagggaagtacttctattaactgtaggtctctcattagtagcaagcgtagaattgccgaatagtctggaggaattaggtgacggactggccatggggatcatgatgctcaagttactaacagattttcagtcacatcaactgtgggcagctttgttatcattgacattcgtaaagactacattttcattgcactacgcgtggaaaacaatggctatgattttgtccattgtatctctctttcccctttgtctatcaactacgagtcagaaaactacctggttaccagtattgcttggctcgctgggatgtaaacctcttacaatgtttctaattaccgaaaatcggatctggggtcgcaaatcttggccattaaacgagggaataatggctgttggtatcgtctccatcttattaagcagtcttctcaaaaacgatgtcccccttgcgggacctttaatagcagggggtatgttaatcgcctgctacgttatttcgggaagcagtgcagatctatctcttgaaaaagctgcagaagtgtcctgggaagaagaagccgaacatagcggcgcgtcacataatatcctggttgaagtccaagacgacggtaccatgaaaatcaaggacgaagaaagggatgatacattaacaatcttactaaaggcaacattgctagcgatttcaggtgtctacccgatgtcaatacccgcaacgctttttgtttggtacttttggcagaagaagaaacaaagatcgggagtactatgggatactccatctccacctgaagtagaaagggcagttcttgatgacggtatatacagaatattgcagcgagggctcctaggaaagagtcaagtaggggtaggagttttccaagaaggcgtgtttcataccatgtggcatgttacacgtggtgcggtcctaatgtatcaagggaaaaggttagaaccgagctgggcctcagtcaagaaagacctcatatcctatggtggaggttggcggtttcagggctcttggaacacaggtgaggaagtacaggtaatagctgtagaaccaggaaagaatcccaaaaacgttcagactgctcccggtacattcaagacacccgaaggagaagttggtgcgatagctctcgactttaaacccggtacctctggctcccctatcgtaaacagagaaggaaagatagtaggtctctatggtaacggcgttgtcacgacgtctggcacgtatgtaagtgcaatagcgcaagcaaaagcatcacaagaagggccacttcccgagattgaagatgaagtatttcgtaagcgcaatcttacgattatggatctgcatccaggaagtggcaaaacgaggcgatatctacctgctatagtacgggaagccattaaacgtaagttaagaaccctggtgctagctcctacaagggtagtagcaagtgaaatggcagaggctttgaaaggtatgccaatacgctatcaaactacagcagtaaagtcagaacacacaggtaaagaaattgtagacctaatgtgccacgcgacattcacaatgaggttgctgtcaccagtaagggtccccaattataacatgataataatggatgaagcacactttactgatccagcatctattgcggctcgtggatatatatctacgcgggtaggaatgggagaagccgctgctatctttatgaccgccaccccacccggttccatggaggcttttcctcaaagtaatgcagctatacaagatgaagaaagagatatacccgaacgatcttggaactctgggtatgactggataacagatttccctggaaaaactgtttggtttgtaccgtcaataaaaagcggaaatgatatcgctaattgtcttcggaaaaatggcaagagagtcgttcaattgagtagaaagacattcgacacagagtaccagaaaactaaaaataacgattgggattacgttgttactacagacataagcgagatgggtgcaaatttcagagcggacagagtgattgatccaagaagatgtctaaaacccgttatcttgaaggacggcccagaaagagtgatactggctggacccatgcctgtaacagtggcaagcgctgcccaaagaagaggacgaattggaagaaaccaaaataaagagggcgatcagtatatttatatgggtcaaccattgaacaacgatgaagaccatgctcattggacggaagccaaaatgttactcgataatataaacactccagagggtattataccggcacttttcgaaccagaacgtgagaagagtgctgcaatagacggggaatatagattacggggtgaagcacggaaaacctttgttgaactgatgaggcgaggagatttaccggtgtggctctcttacaaagttgcatcagaaggcttccaatactcagatcgtcgatggtgtttcgatggcgaacggaataatcaggtcctagaggaaaatatggacgtggaaatctggaccaaagaaggcgagagaaagaaactgcgtccccggtggctagatgctcgcacctactcagatccgttagcgctacgtgagttcaaggaatttgcagcaggacgaagatcagtttcgggtgatcttatattagaaatcggaaagctaccacaacatctgacccaaagagcacaaaatgcattagataatttagttatgctacataatagtgagcaagggggaaaagcctaccgccacgcaatggaagaattacccgacaccatagaaactttaatgctactagcactcattgctgttttgacaggcggagtaacacttttctttttatccggtagaggattaggtaaaaccagcataggcttactttgcgtcatggcttcaagtgcactcttatggatggcgagtgtagaaccccactggatagcggcatcaataattttagaatttttcttgatggtattgcttatccctgaacctgaccgtcaaagaactccccaagacaatcagttggcctatgtggtaattggtctcttatttatgattttaacagtagcagctaatgaaatgggtttattggaaacaactaagaaagatcttgggatagggcatgtagcagccgagtctcaccaccatgcagcaatgctggacgtcgatctgcatccggcgtcagcatggacactatatgccgtcgccacaactgtaataacccccatgatgagacatacaatagaaaacacaaccgctaatatttccctcacagctatagcaaaccaagcagcaatcctgatgggactagacaaaggctggccaatatcaaagatggacataggagtcccgttattagcacttgggtgttactcacaagtaaaccctttgactctaacagctgcagttttaatgttagttgctcactacgctataattgggccaggactacaagcgaaggcgacacgtgaagcccaaaaacgaacagcagcaggaattatgaaaaatccgactgtcgatgggatagtcgctatagacttagacccagtggtttacgacgccaaattcgaaaaacaacttgggcaaattatgctacttattctatgtacatcacaaatattgctaatgagaactacgtgggcattatgtgagtcaatcaccttagccactgggccgttgactacactctgggaaggtagtccaggtaaattttggaatacaacaatagcagtaagtatggcaaatatctttagaggcagctaccttgccggcgctggcctcgccttctctcttatgaaaagtctcggaggtggtcgccgaggcaccggcgcacagggtgagaccctaggtgagaaatggaaaagacaactaaatcagctttcaaaatcagagttcaacacgtataaaagaagtggtatcatagaggttgacagatcagaagcgaaggaaggacttaaacgaggagagacgacaaaacatgcggtatcaagaggaactgccaagctcagatggtttgttgaaaggaacttagtcaaaccagagggcaaggtaatcgaccttggatgcggacgcggaggttggagttattactgtgctggcctcaagaaagtaacggaagtaaaaggctatacaaagggtggaccgggccatgaagaacctattccaatggcaacgtatgggtggaatctagtaaagctacatagcggcaaagatgtattctttactccaccagaaaagtgtgatactctactttgtgatatcggagaaagcagccccaacccaacaattgaagaaggccgaacactaagagtattgaaaatggttgagccctggcttcgagggaatcaattttgtattaaggtgctcaacccatatatgccctcagtcgttgaaactctcgaacaaatgcaaaggaaacacggtggtatgctggtcagaaatcccctatcgagaaactccacacatgaaatgtattgggtgagttgcggtacaggtaatatagtatcagcagtcaatatgacaagtcgtatgttgctaaaccgattcaccatggcgcatagaaagccaacgtacgaacgtgatgtcgatctaggggccggaacaagacatgtagccgtagagccagaagtagcaaatttggatattattgggcaacgaattgagaacattaaaaatgagcataaatcgacttggcattatgacgaagataacccatacaaaacctgggcatatcacggttcttatgaagtcaaaccatcaggttcagcatcgtccatggtaaacggagtagttcgtctcctaacaaaaccctgggacgtaattcccatggtgacacaaattgccatgacggatacaacaccctttggtcaacaacgcgtattcaaagaaaaagtcgataccagaaccccaaaagcaaaaagaggaacagcacaaataatggaagttacggctcgctggttgtggggattcctaagtcgtaacaagaaaccccggatatgtacacgagaagaatttacgaagaaagttcgatcgaacgctgcgataggagccgtgtttgttgacgaaaatcaatggaactccgccaaagaagccgttgaagatgaacgattttgggatctagtacacagagaaagggagttgcacaaacagggaaaatgcgctacatgtgtgtataatatgatgggaaaaagagagaagaaattaggcgagtttggaaaagcaaaaggctcgagagcaatttggtacatgtggttaggcgcaaggttcttggaatttgaggctttaggtttcatgaacgaagatcactggttcagtcgagaaaattctttaagtggagtagaaggtgaaggtttacacaaacttggatacattcttagagatatatcgaaaatccccggtggtaatatgtatgcggacgataccgcgggatgggacactaggataacggaagacgacctacagaatgaagctaaaataactgatattatggaacccgaacacgcattacttgcaacgtcgatatttaaattgacataccaaaacaaagtagtgcgagttcaaaggcctgctaagaacggaacagtaatggatgtaatctcacgtagggatcaaagaggttccggacaagttggaacctacggattgaatacattcacgaacatggaggcacaactgattagacaaatggagtctgagggtatatttttaccgtccgaactggaaacccccaatcttgccgaaagagttttagattggttagaaaaatacggtattgaacgactgaagcgaatggcgatttcaggggatgactgcgtagtaaaaccaatagatgacaggtttgctacagcattgactgcccttaatgatatgggaaaagttcggaaagatatcccacaatgggagccaagcaaaggttggaacgattggcaacaagtgccgttctgttcacatcattttcaccagttaatcatgaaagacgggagggaaatagttgttccctgtaggaatcaggatgaattggttggaagggctagagtctctcaaggtgcaggttggtctttacgggagacagcatgtttagggaaaagttacgcacagatgtggcaactaatgtactttcaccgtagagacttgagactagccgctaatgccatttgtagcgcagtacctgttgattgggttccgacaagtcgcactacttggtcgattcatgcacatcatcagtggatgacgaccgaagacatgctatctgtgtggaatagagtttggatagaagaaaacccttggatggaagataagacgcatgtatcatcctgggaggatgtgccctatctgggcaagcgcgaggatcagtggtgtggttcgttaatcggcttaacagcaagggcgacatgggctactaacattcaagttgcaattaatcaagttcgacggttaataggaaacgaaaactatcttgactatatgacatccatgaagaggtttaagaacgagagtgacccggaaggagcactatggtag

SEQ ID NO: 22124 - RNA, 9879 nt, synthetic construct
  misc_feature 1..9879: note = derived and/or modified CDS sequence (opt6) from DENV-1__KU666942__SS-prME
  source 1..9879: mol_type = other RNA
tctgtaacgatgcttcttatgttaatgccaactgcattggcgttccatctaacaacaagaggtggagaaccacatatgatagttagcaaacaagaacgaggaaaatctctgctgtttaaaacctctgcgggtgtaaatatgtgtacattaatagcaatggatttaggagaactatgtgaagatacaatgacttacaaatgtcctcgaattaccgaggcagaaccagacgacgtagactgttggtgtaatgcaaccgatacttgggtcacgtatggaacgtgttcccaaactggagaacatcggcgtgataaacgaagtgtagctctagcgccgcacgtaggcttaggactcgaaacgaggacagaaacttggatgagtagcgagggggcatggaaacagattcaaagagtagaaacatgggcacttagacacccaggtttcactgtaatagctctattcttagcacatgcaatcggtacgtctatcacacaaaaaggaatcatatttatactcctaatgctagttaccccaagcatggcaatgagatgcgttggaataggaagtagagactttgtagaaggtttaagtggcgcaacctgggtggacgtagtactagaacatggaagctgtgtcacaacaatggctaaagataaaccaaccctggacatagaactgctaaaaacagaggtaactaaccctgctatactaaggaaattatgtatcgaggcaaaaatttcaaatacaacgactgattcacgctgccctacgcaaggcgaagccacgctagtcgaagaacaggacgctaattttgtttgtagaaggacttttgtagacagaggctggggaaacggatgcggactgttcggaaaaggcagtctaatcacttgtgcaaagttcaagtgtgtcacaaagttagaaggaaaaattgttcaatatgagaatctgaaatatagcgtaatcgtaacagtacatacaggcgatcagcaccaagtcgggaatgaatcaaccgaacacggtactactgcaacgatcacgccacaagccccaaccacggaaattcaacttaccgattacggtgccttaacactagactgttcaccaagaaccggtctggattttaatgaaatggttttattaactatgaaagagaaaagttggctagtacataaacagtggtttttggatctcccactaccttggacttctggagcctcaacttctcaagaaacgtggaaccgacaagacctattagttacattcaaaaccgcacacgccaagaaacaagaggtggttgtgctgggttcccaagaaggggcaatgcacacagcactaaccggcgctactgaaatccaaacgtcagggacaacaactattttcgcagggcacctaaaatgtcgtttaaagatggacaaactgactttaaaaggaatgtcatacgtaatgtgcactggctcttttaaacttgaaaaagaagtcgcagaaacacaacacggaacggtattagtacaaataaaatatgagggaaccgatgcaccctgtaaaattcctttcagcacccaagatgaaaagggagtaacgcagaacggtagactgataactgctaaccctatagtaacggataaagaaaagcccgtcaatatagaagcagaacctccgtttggtgagtcatacattgtcataggtgcaggagagaaggcactgaaattgtcctggtttaaaaagggttcaagtataggtaaaatgttcgaagcgacggccagaggggcaagaaggatggcaattcttggtgatacagcttgggacttcggttcgatcggcggcgtatttacatcagtagggaaattggtccatcaaatatttggaaccgcatacggggtactattttcaggcgtttcctggaccatgaagataggaataggagtactgctgacctggttaggactcaatagccgatcaacgagtttatcgatgacatgcatagccgttggcttagttacattatacttaggggttatggttcaagctgattcaggatgcgttataaattggaaaggtagagaactaaagtgtggcagcggtatttttgtaacaaatgaagttcatacatggactgaacaatacaagttccaagcagactcaccaaagcgattgtctacggcgatagggaaggcttgggaggaaggagtgtgtggcattcgaagtgctacacgtcttgagaacataatgtggaagcaaatatcgaatgagcttaatcatatacttctcgaaaacggaatgaagttcactgtagtcgtaggcgacgttgcagggatacttgctcaggggaaaaagatgatcaggccccaaccaatggaacataaatacagttggaagagttggggtaaggctaaaattataggcgcagatgttcaaaacactacattcattatcgatggcccgaatacacctgaatgcccagatgatcagagagcctggaatatatgggaagtagaagactatggatttggcatctttacaacaaatatttggcttaaactgcgagactcttacacccaagtttgcgatcatagattaatgtcggctgcaataaaagatagcaaagcagtacatgcagacatgggatactggatagaaagtgagaaaaatgaaacatggaaacttgctagggcctctttcatcgaagtgaaaacgtgtatctggcctaaaagtcataccctatggagtaatggcgtactcgaatcagaaatgataataccaaaaatctacggcgggccgatatcacaacataactaccgtccaggttactttactcaaacagccggaccttggcacttaggtaagttggagttagacttcgatctatgcgaaggaactacagtggtggtagacgaacactgcggaaatcggggcccgtcgttacgtacaactacagtcacaggaaaaataatccatgaatggtgctgtagaagttgtactcttcctccactcagatacagaggagaagatgggtgttggtatgggatggagattcgtccagttaaagaaaaagaagaaaacttagtaaagagcatggttagtgcgggttcaggcgaggttgactcattttctctaggacttttatgtatatccataatgattgaagaagtaatgagaagcagatggagtcgaaaaatgttaatgactggaactttagcggtattctttctgttaataatgggacaattaacttggaacgacctaatcaggttatgtatcatggtaggggcaaacgcatctgatagaatgggcatgggcactacatacctggctctcatggctacctttaaaatgagacccatgtttgctgtcggattactttttcgaagattgacaagtcgcgaggtattactactcactatcggtctctcattagtagcttcaatggaacttcccaacagtctagaagaactaggggatggtctagctatggggattatgatattgaagctattgaccgatttccaatctcaccaactctgggcgactctgctatctcttactttcatcaaaacaacattttcgttacactacgcttggaaaactatcgcaatggtactgtcaatcgtatccttgtttccgctatgtttgtcaactacatcacagaaaaccacgtggctaccggtattattgggttctctcgggtgcaagccgttgacaatgtttctaatcgcggagaataaaatatggggaagaaagtcttggcctttaaatgaagggattatggcagtgggaatcgtttctatcctattgagttctttacttaaaaacgacgtcccgttagctgggccattaatagctggagggatgctgattgcgtgttatgttatcagcggaagtagcgcagatttatcgctagaaaaagcagcagaagtatcgtgggaagaggaagctgagcactccggtgcatcccacaatatattagtggaagtccaggatgatggaacaatgaaaattaaagatgaggaaagagacgacaccctcacaatattacttaaggcaacattattagcagtaagtggcgtatatccattatccataccggctacactgttcgtctggtatttttggcagaagaagaaacaaagaagtggagtactatgggatacaccgtctcctccggaagtagaaagggctgtgttagatgacggaatttatcgtataatgcaacgaggtttactagggcgttcacaagtaggcgtaggagtttttcaagagaatgtattccatacaatgtggcacgtaactagaggcgccgtactaatgtatcagggtaaacgcctagagccctcatgggcctcagttaaaaaggatttaatcagttacggaggaggatggcgccttcaggggtcatggaatacaggagaagaagtgcaagtaatagctgtagagccaggcaaaaaccccaaaaatgtgcaaacagcacctggaacatttaagaccccagaaggagaagttggagcaattgcattagacttcaagccaggaacgagtggtagtcctatagtaaatagggaaggtaaaatagtaggattatatggtaacggcgttgtaacgacaagtggaacatatgtgtctgcaatagcacaggcaaaggcttcgcaggaaggaccacttcctgaaattgaagatgaagtattccgtaaaagaaatctaacaattatggatcttcatcccggttcaggaaaaacacggagatatttaccagctatagtacgcgaagcgatcaaaaggaaacttagaacactaattcttgcgccgacacgcgtagttgcaagtgaaatggccgaagctctaaaaggtatgcccattaggtatcagacaaccgcggttaagtcagaacacacaggcaaagaaattgtggatctcatgtgtcatgcaacatttactatgcgtctattatcacctgtacgtgtcccgaactacaatatgatcataatggacgaagcacattttacggatccaagttcaatagcagcgcgaggatacataagtactagagtaggcatgggggaagccgcagcaatctttatgacagcgactcccccgggcagcgttgaagcattcccacaatcgaatgctgtcattcaagacgaagaaagggacatcccagaacgtagctggaactcaggctacgaatggattaccgattttccaggcaagacagtgtggtttgtcccgagcataaaatccggcaatgatattgcaaattgtcttaggaaaaacgggaaaagagtgatacagttatctagaaaaacctttgataccgaatatcagaagactaagaacaatgattgggactatgtagtaactacagacatatcagaaatgggagcaaactttcgagctgaccgagtcatcgatccaagacgttgtcttaaaccagttatattaaaagacggcccagaaagggtgattcttgcaggacccatgcctgttactgtagctagtgcagcgcaacgaagaggacggataggtcgtaatcacaataaagaaggagatcaatatatttatatgggacaacccttgaataatgacgaagaccatgcacattggacggaagctaaaatgttactagataacattaatactcctgaaggaatcataccggcattgtttgaacctgaaagagaaaagtcagctgcaatcgatggtgagtatcgtctaagaggggaagcgaggaaaaccttcgttgaattaatgcgacgaggcgacttaccagtctggttgagttataaagtagcctccgaggggtttcagtattctgatagaaggtggtgcttcgacggcgagagaaacaatcaggtattagaagaaaatatggatgtggagatctggaccaaagagggagagaggaagaaattaaggccacgttggctggatgcaagaacgtactcggaccctctagctttacgtgagtttaaagaatttgcagctgggaggcgctcagtatcaggcgacttaatccttgaaattggtaaattaccacaacacttaacccagcgcgctcaaaatgcactcgacaatctcgtgatgcttcataactctgaacaaggtggtagagcgtacagacacgccatggaagaactaccagacactatagaaacgcttatgttgttagccttaatcgctgtgttgacaggaggagtaacattattctttctatctggtaagggccttgggaagacttctataggattgctctgcgtaatggcatcaagtgcattgctatggatggctagtgtagaaccccattggattgccgcgagcataatattagagttctttcttatggtcctcctcattcccgaacctgaccgtcaaagaactccccaagataatcagctagcttatgtggtcattggattattattcatgattttgaccgtagctgcaaacgaaatgggtctgcttgaaactactaagaaagatttaggaataggccatgtagcagtcgaaaatcatcatcacgcagcaatgttagatgtggacttacaccccgcaagcgcttggactttatatgcagtagcaaccactataattaccccaatgatgaggcataccatagaaaatactacagccaatatatcattaacagcaattgcaaatcaagcagccattctaatgggcttagataaaggttggcccataagtaaaatggatataggtgttcctctgttagcccttggatgttattctcaagttaatccgcttacgctcacggcagctgtattaatgttggtagcccattatgctataatagggcccggattgcaagctaaagccacaagagaggctcagaaaagaaccgcggcgggaataatgaaaaaccccacagtagatgggatagtagctatagatctcgatccagttgtatatgatgccaaattcgagaaacaattaggacaaatcatgttattaatactgtgtacaagccaaattctcttgatgagaacaacctgggccctttgcgaaagcatcaccctggcgacaggccctcttacaactctctgggagggtagtccaggcaagttttggaataccacaatagccgtctcgatggccaatatattccgtggaagctacttagctggtgccggactggcgttctcgttgatgaaatcactaggaggcggacgtagggggacaggggcacagggcgagacactgggcgaaaagtggaaacgacagcttaatcagctatctaaaagtgaatttaacacttacaagaggtccggcattatggaagtagacagaagcgaagcgaaagaaggcttaaagcgaggagagacaacgaaacatgcagtgagtcgaggtacggccaagttacgatggtttgttgagagaaatttggtaaagccagaaggcaaagtaatcgacctaggttgtggccgtggcggatggagttactattgcgcgggtctaaagaaagttacagaagtaaagggttatacgaaaggaggacctgggcacgaagaaccagtcccaatggccacatatggatggaatctagtaaaattacactccggtaaagatgtctttttcataccacccgaaaaatgcgatacccttttgtgcgatattggggagagctcaccgaatccaaccatcgaagagggtagaacattacgcgtccttaagatggtagaaccttggttgagaggcaatcagttctgtattaagatcttaaatccctatatgccctcagttgtggaaactttagagcagatgcagcgtaaacacggtggtatgctcgtccgaaatcccttaagtagaaattctacgcatgagatgtactgggtaagttgcggtacaggaaatattgtgagtgcgattaacatgacatcacgaatgttattaaatcgcttcactatggcacataggaaaccgacatatgagcgagacgtcgacttaggggcaggtaccaggcatgtagcagtagagcctgaagtagcaaatctagacattattggtcagcgcatagagaacattaagtgcgaacataaatctacatggcattacgatgaggacaatccgtacaaaacatgggcataccacggctcatatgaagtcaaaccgtccggaagtgcgtcaagcatggtaaacggagttgttaaactgctaactaaaccatgggacgtgattccgatggttacacagattgcgatgactgacacaactccattcggacaacaacgagtgtttaaagagaaagttgatactagaactccaaaagcgaagcgaggtactgcacaaattatggaagtaaccgctaggtggttatggggattcctgagcagaaataaaaagccacgtatatgcacgcgagaagaatttacgcgaaaggttcggagcaacgcggctataggggccgttttcgtcgacgaaaatcaatggaacagtgcaaaggaagcagttgaagacgaaagattttgggatctggttcatagggagagagaactacacaaacaaggaaagtgcgcaacttgtgtatacaatatgatgggtaagagagaaaagaaactaggtgaatttggaaaggctaaaggaagccgtgccatatggtacatgtggctcggggctagattccttgaatttgaagccttaggatttatgaacgaagatcactggtttagcagagaaaacagtctatctggtgtggaaggtgagggtctacataaactgggttacatactcagggacatttctaaaatatctgggggtaatatgtacgccgacgatacggcaggttgggatacgcgaataacggaagatgacttacaaaacgaagcgaaaattaccgagataatggaaccagaacatgctcagttagcaaaggcgatatttaaactaacttatcaaaataaagttgtgagagtccaaaggcccgcgaaaaacggtactgtaatggatgtaatatcgaggagagaccagcgaggctcagggcaagtaggtacatatggtttgaatacatttacaaacatggaggcccagttaattagacaaatggaatccgaggggatctttagcccctcagagcttgaaacaccaaacttggcagagcgcgtactagattggttagagaagtacggagtagaaagattaaaacgcatggcaatatcgggcgacgattgcgtcgtaaaaccaattgatgacagatttgccacggccttaacggcattaaatgatatggggaaagtgaggaaggacatacctcaatgggaaccttccaaaggatggaatgattggcaacaagttcccttctgttcacaccatttccatcaactcattatgaaagatggacgagaaatagtagtcccttgcagaaatcaagatgagttagttggccgggcaagggtatcacaaggagcaggttggtccttaagggaaaccgcttgccttggaaaatcatatgctcagatgtggcaactaatgtacttccatcgcagagaccttaggctagcagcgaacgctatttgcagcgcagtacccgttgactgggtcccgacaagcagaaccacatggagtattcatgcacatcaccagtggatgactacagaagatatgctcagtgtctggaaccgcgtatggattgaagagaatccatggatgaaagacaaaacacatatatcttcttgggaagacgttccatacctcggcaaacgagaggatcaatggtgcggttcgcttataggtcttacagcgagagccacatgggcgacaaacattcaagttgcaataaaccaagtaagacggctaataggaaatgagaattatctagattacatgaccagcatgaaacgatttaagaacgaatccgaccccgaaggagctttatggtag

SEQ ID NO: 22125 - RNA, 9879 nt, synthetic construct
  misc_feature 1..9879: note = derived and/or modified CDS sequence (opt6) from DENV-1__KU666939__SS-prME
  source 1..9879: mol_type = other RNA
tcagtaactatgctgcttatgttgatgccaacggctcttgcattccatttaactacgagaggtggagaacctcatatgattgtttcaaaacaagaaagagggaaatctctactttttaaaacctcagcgggggttaacatgtgtactcttatcgcgatggatttgggcgaactttgtgaagacactatgacctataaatgtccaagaatcactgaggcagaaccagatgacgtggattgctggtgcaatgctacggatacgtgggtgacttacggaacatgctctcaaacgggtgaacatagaagagataaaagatcagttgctttggcaccgcacgtaggattagggctagaaactcgtactgaaacttggatgtcatcagagggtgcatggaaacaaatccaaagagtagaaacgtgggtattgcgtcatccgggcttcacagttatcgcactatttctggcacatgccataggaacaagtataactcagaaaggaataatattcatattactaatgctagtaactcccagcatggcaatgaggtgcgttggaatcggaagtagagacttcgtggaaggtctgtcaggcgctacgtgggtcgacgtagtattggaacatggaagctgtgtaaccactatggcaaaagacaaaccgacattagatattgaacttctcaaaacagaagtgaccaaccctgcagtacttagaaaattatgtattgaggcaaaaatatcaaatacgactactgattcaagatgcccgacacaaggagaagcaacgctagtcgaagaacaggatgccaatttcgtatgtaggcgaacctttgtagatcgaggttggggaaatggatgcgggttatttgggaaaggcagtttaattacatgtgctaaattcaaatgcgttactaaattggagggcaaaatagtacagtacgaaaatttaaaatatagtgtgattgtaacagtccataccggagatcaacaccaggtaggtaacgaaagcactgagcacggaacaaccgctacaataaccccgcaagccccaaccactgaaatacaacttacagattatggggccttaactttggattgtctgccgaggacaggcttagatttcaacgaaatggtcctattgaccatgaaagaaaaatcatggttagttcataaacagtggtttcttgatctaccactcccttggacaagtggagctagcacctcccaggaaacatggaatcgacaggacctgttagtcactttcaaaacagcacatgctaagaaacaagaagtggttgtcctaggatcccaagaaggagctatgcacacggcgttaacaggcgccacagaaatccaaacctcaggcaccactacaatatttgctggccacctaaaatgtcgtcttaaaatggacaaattgacattaaaaggcatgtcatatgttatgtgcacgggatcgtttaaactagaaaaagaagtcgcagaaactcaacacggaactgtcctggtacaaattaagtacgaaggtacggatgcgccgtgcaagatacccttttctacccaagatgaaaaaggagtaactcaaaatggtcgactaataactgcgaatcctattgttacagataaagaaaaaccagttaatatagaagcggaaccaccatttggggaaagctatatagtaataggggcaggagaaaaggcactaaaactctcatggtttaagaagggatcatccataggaaaaatgtttgaggctacggcgcgaggagcccgaaggatggcaatactaggcgacaccgcatgggattttggaagcataggcggagtatttacaagtgttggaaagttagtccatcagatatttggtactgcgtacggagttcttttctccggagtatcctggacaatgaaaataggcataggcgtattgcttacgtggctcgggttaaacagcagatccacgtcattgtccatgacatgcatcgcagtgggtttagtcactttatacttgggagtcatggtgcaagcagactctggttgtgttataaactggaaaggtcgtgaattaaaatgcggaagcgggatatttgttacaaatgaggtgcacacatggactgaacaatacaaattccaagcggatagtcccaaaagactgtccgcagcgattggaaaggcatgggaggaaggagtgtgtgggataagaagcgcaaccaggttagaaaatattatgtggaagcaaataagtaatgaactgaatcatatattactagagaatgatatgaaatttacagtagtagtaggtgacgtagccggaatacttgcacaagggaagaaaatgataagaccgcaacctatggagcataaatattcctggaaatcttgggggaaggcaaaaattattggggccgacgtgcaaaatacaacgtttataatagatggaccaaacacaccggaatgtccagatgatcaaagagcatggaacatttgggaagtagaagactacggatttggaatttttacaaccaatatatggttaaaactacgtgactcatatacgcaagtatgtgatcatcgattgatgagtgctgcgattaaagatagcaaagcagtacatgctgatatgggatattggattgaaagcgagaaaaatgaaacttggaaactggccagagcttcttttattgaagttaaaacttgtatctggccaaaaagtcacacgctatggtcaaatggagtactcgaaagcgagatgattatacctaaaatatatggaggacctatatctcagcacaactatcgtcctggttacttcacacaaacagcaggcccctggcacctaggaaagttagaattagactttgacctctgtgaaggaacaacagtagttgtggacgaacactgtggcaatcgtggtccaagtttacggacgactaccgtaacggggaaaataatacatgaatggtgctgtagaagttgtacactaccaccactaagattccggggagaggatggatgctggtatggaatggaaataagacctgtaaaagaaaaagaggagaatctcgtcaaaagtatggtaagcgcgggctctggggaggtcgatagtttttctctaggtctactgtgtatatcgataatgatagaagaggttatgcgaagccgatggagcaggaaaatgcttatgactgggactcttgcagtattcttccttctaattatgggtcaactaacttggaacgacctgataagactttgtataatggtaggtgcgaacgcctctgaccgcatggggatggggacgacatatttagcactgatggctacattcaaaatgaggccaatgttcgcggtgggcttattgttccgacggttaacttcacgagaagtattgttgcttacgattgggctatccttggttgcctccgtagagctcccaaactctctagaagaattgggagacggcttagctatggggattatgattttaaaattactaacagacttccaaagccaccaactatgggcaacacttctatctttaacttttattaaaacgacttttagtttgcactatgcatggaaaacaatggcaatggttttatctatcgtgtcattaataccgctatgtttatctaccacttctcagaagacaacttggcttcctgttctcctgggtagtctaggatgcaaaccattaaccatgtttttaatcgcggaaaataaaatttggggtcgaaagtcttggcccctaaatgagggaattatggcggtaggtatagttagtatcctactgagctcgttacttaaaaatgacgttccgctagctggacccttaattgcgggtggaatgctgatagcatgttatgtcatctctggtagtagcgcagacttattactagaaaaggctgcagaagttagctgggaagaagaagccgagcactcaggggcgtcacataatatattagtcgaagtacaagacgatggaacgatgaagatcaaagatgaagaacgcgatgatactttaacgatattgttaaaagctacccttctcgccatttccggtgtttatcccctctcaatcccggcaacattgttcgtttggtatttttggcagaagaagaaacagaggtcaggcgtactctgggatactccttccccacctgaagtagaaagagcggtactggatgacgggatatacagaataatgcagcgtggccttcttggtcgctcacaggtaggcgttggagtattccaagaaaatgtatttcatacaatgtggcacgtcacacgtggagccgtccttatgtaccaaggtaaacgtctggaaccaagttgggcgtctgtgaagaaagatttgatcagctatggtggcggctggaggctgcaaggtagctggaatactggagaagaggtacaagtaatagcagtggaaccgggcaaaaacccaaagaacgtacagacagcacccggtacattcaagacaccagagggcgaagtaggggcaatagctctggactttaaaccaggcacaagtggcagccctattgtcaatagagaggggaagatagtagggttatatggaaacggtgtagtgaccacctcaggcacttacgtctcagctattgcgcaggcaaaggcctcacaggaagggccattacccgaaattgaagatgaggtttttcgcaagagaaatttaacgataatggatttacatccaggttcaggaaaaacaaggaggtatcttcctgcaatagtcagagaagcaattaagaggaaactacgcacattgatattagcaccaacaagagtggtggctagtgaaatggcagaggctttaaaaggtatgccgataagatatcagaccactgccgtcaagtcagaacatactggaaaagagatagtggatctaatgtgtcacgcaacttttacgatgcgacttttatctcccgtacgggtacctaattataacatgatcataatggatgaagctcactttaccgatccaagttctatagctgcacgagggtatatctctaccagagtgggtatgggagaggcagccgcaatattcatgactgccactcctcctggtagtgtagaagcatttcctcaatcaaatgcggtaattcaagacgaagaacgagatatcccagaaagatcatggaacagtggatatgagtggataacagactttcccggaaagacagtctggttcgttccctcaataaaatcaggaaatgatatagctaattgtcttcgaaagaacgggaaaagagttattcagctctccagaaagacattcgatacagaatatcagaaaacgaaaaacaacgattgggactacgtagtaacaacagacatatcagaaatgggcgctaatttccgagcagatagggtgatagacccaagaaggtgtctaaaaccagtcatccttaaagatggtcctgaaagggttatactagcgggccctatgccagttacggtagcaagcgcagctcaaagaagaggtagaataggcaggaatcataacaaagaaggtgatcagtacatctacatgggacaacctctcaacaatgatgaggatcacgcacattggacagaggcaaagatgttattggataacataaacacccccgaaggtataataccggctttattcgaacctgaacgagaaaagtcggcagctatagatggggagtatcgattaagaggagaagcgagaaagactttcgtagagttgatgagaagaggagacctacctgtatggctcagttataaagtagcatctgaaggattccaatatagtgacaggagatggtgttttgatggagaacggaataatcaagtactagaagagaacatggacgtagaaatttggacgaaagagggagaaaggaagaaactaagaccacgttggttagacgccagaacatactctgacccattggcactacgtgaatttaaagaatttgcagcaggtcgaagatctgtatcaggcgatctaatattagaaataggcaagctaccacaacatttgacacagagggctcaaaacgctttagataatctagtgatgttacataactcagaacaaggaggtagagcatatagacacgcaatggaagaattaccggatactattgaaacactaatgctcttagcgctaatcgccgttctaacagggggtgtcaccttattctttttgtcaggaagagggcttggcaaaacgagtattggtttgctatgcgttatggcatccagcgtgctattgtggatggcatccgtggaaccacactggattgcagcttcgatcattctggaatttttcctaatggtattactgatcccagaacccgaccgccaaaggaccccgcaagacaatcagctagcttacgttgtaataggattattgtttatgatccttactgtagcagcgaacgaaatgggattattagaaacaactaagaaagaccttggaatcggacatgtcgccgtagagaatcaccatcatgctactatgcttgatgtagacctacatcccgcctcggcatggacactgtatgccgttgccaccacaatcatcactccaatgatgagacacacaatcgaaaataccacagccaatatttcacttacagcaatcgcaaatcaagcagccatactaatgggactcgataaaggttggcccatttcaaaaatggacattggggtacccttgttagcacttggttgttatagccaagtcaatccactaacattaacagcagcagtattaatgttagtcgcccactacgcaatcataggcccaggtttacaggcgaaggcaacgagagaagcccaaaaacgaactgcagcaggaataatgaaaaaccctacagttgacggaatcgtagctattgacttggatccagtggtttacgacgcaaagtttgaaaaacaactcggacaaatcatgctcctaatcctctgtacatctcaaatactactgatgcgaactacatgggcattatgtgagtccatcacactagcaaccggaccacttactacactttgggaaggttcacctggaaaattctggaacacaactatcgctgtgagtatggcgaacatatttcgaggttcttatcttgccggtgcaggcttagcatttagcttaatgaaaagtttgggtggaggtcgaagaggaacaggtgcccagggtgaaacattgggtgaaaaatggaaaagacagcttaatcaactatcaaaatcagaatttaacacatataaacgatcggggattatggaagtcgatcgttcagaagctaaggaaggactcaagagaggagagactacaaaacatgcagtgagcaggggaacagcgaaattaagatggtttgtagaaagaaatttagtaaaacctgaaggtaaagtgatagatttagggtgtggacgtggagggtggagctattattgtgccggactcaagaaagtcacagaggttaagggttatactaaaggtggaccaggacatgaagaaccaataccgatggcgacctacggatggaatttagtcaagttatacagtggtaaagacgtattctttattcccccagaaaaatgcgacacattactttgtgacataggcgaatcatcccccaacccgacaattgaagaaggtagaacccttagggtcctcaagatggtggaaccgtggctcagaggcaatcaattttgcattaaaatcctcaatccttacatgccttccgttgtagagacgttggaacaaatgcaacgaaaacacggagggatgcttgttcggaacccattatcgaggaactcgacacacgagatgtactgggtgtcatgcggaactgggaacatagtatcggctgtcaacatgacaagtcgtatgcttttaaataggtttacgatggcgcacagaaaaccaacatacgaaagagacgtagacctgggcgcaggaacaaggcacgttgccgtcgagccagaagtcgctaatctcgatatcataggccaacgcattgaaaacataaaacacgagcataaatcgacctggcattatgacgaagataacccatacaaaacttgggcttaccacgggagctacgaagtaaaaccatcaggctccgccagtagtatggttaacggagtagtaaaattgttaactaaaccatgggacgtaattccaatggttacacagattgcgatgaccgacacaacgccattcggacaacaacgggtgttcaaggaaaaagtagatactcggacaccaaaggcaaaacgcggaactgctcaaataatggaagttactgccagatggctatggggatttttgtcacgcaacaagaaacctaggatctgtacgcgcgaagaatttactagaaaggtaagatcaaatgctgccatcggagcggtgtttatcgacgaaaatcagtggaacagcgcgaaagaagcggtggaggatgaacgtttctgggatctagtacacagagaaagagaactccacaaacagggaaaatgtgcgacatgtgtatataacatgatgggcaaacgggagaagaaattaggagaatttggtaaagcaaagggaagtagagctatttggtatatgtggttaggggcgcgctttctggaatttgaggctttgggattcatgaatgaagatcattggtttagtagagaaaacagtctctcgggtgttgaaggagaagggttacataaattaggatacatcttgagggatataagtaaaataccaggaggaaacatgtacgcagacgataccgccggatgggatacaagaataactgaagatgacctacaaaacgaagcaaagataactgacataatggaaccggaacacgcgttacttgcaaaagcaatttttaaattgacttatcaaaataaagtagtgagagtccagagaccagcaaagaacgggacggtaatggatgtaatatcacgaagagaccagagaggatcaggtcaagtaggtacatacgggttaaacacatttaccaacatggaagctcaactaattagacagatggagtcggagggaatttttagtccgtccgagcttgaaacgcctaatctggctgaacgcgtgttagattggcttgggaaatatggtgtagagagattgaaacgaatggctataagcggcgatgactgcgtagtcaaaccaattgatgacagattcgcaacggctttaactgcgctaaatgatatgggtaaggtgaggaaggatataccacaatgggaaccttcgaaaggttggaatgactggcagcaagtaccgttttgtagccaccattttcatcaactaattatgaaagacggcagggaaatagtcgttccgtgtcgtaatcaagatgagttggtcggtcgcgcccgcgtgagtcaaggtgcagggtggtcactccgcgaaaccgcttgccttgggaagtcttacgctcaaatgtggcagctaatgtactttcatagacgtgatttacgactcgcagcaaacgctatttgttcagcggtcccagtagattgggtgcccacctcgcgaactacatggagtattcacgcacatcaccagtggatgacaacagaagatatgttatcagtatggaatagagtgtggatagaagaaaatccctggatggaggacaaaacacacatatcgagttgggaagacgtaccttatttgggaaaacgggaggatcaatggtgcggcagtttaatcggtctaaccgccagagccacttgggccacgaacattcaagttgctataaaccaagtcagaaggctaataggtaacgaaaattacttagactacatgacgtcaatgaaaagatttaagaatgagagtgacccggaaggagcattgtggtag

SEQ ID NO: 22126 - RNA, 9879 nt, synthetic construct
  misc_feature 1..9879: note = derived and/or modified CDS sequence (opt6) from DENV-1__KU666940__SS-prME
  source 1..9879: mol_type = other RNA
agcgttacaatgctgctaatgttgactcctacagcgctagcgtttcatctaactacgagaggaggtgaaccacacatgatagtcagtaaacaagaaagaggtaaaagtctactctttaaaactagcgctggtgtaaatatgtgtacattgattgcaatggatctgggagaattatgtgaagatacgatgacttataaatgcccaagaattaccgaagcggaaccagatgacgtcgattgctggtgcaatgcaaccgacacatgggtgacatacggaacatgttcacaaacaggtgaacatagacgagataaacgttcggttgctttggccccacatgtgggtttaggtctagagacaaggactgaaacctggatgagttctgaaggagcgtggaaacaaatccaacgagtagagacgtgggctctaagacatccgggattcacagtaattgccttatttctagcgcacgcaatcggaacctcaatcacccaaaaaggcataatttttatattacttatgttagtaactccatccatggccatgcgctgtgtgggcataggttccagagatttcgtagaagggttgtctggcgcaacttgggttgatgtcgtacttgaacacgggtcatgcgttactactatggccaaagataaacccacattagatatagagcttctgaaaacagaagtaacgaatcccgcggtactgcgtaaattatgcatcgaagcaaaaataagtaacacgacgacagatagtcgatgcccaactcaaggtgaggcaactttggtggaagaacaagatgcgaactttgtgtgtagaagaacattcgttgacagaggctggggcaacggatgtggactatttggtaaaggttctttaattacatgtgcgaaatttaaatgtgtcactaaactcgaagggaaaattgttcagtatgaaaacctgaaatactccgttatcgtaacagttcatacaggggatcaacatcaagtgggtaacgaaagtacagagcacggaacaacagctactataacgccccaagccccaaccaccgaaattcaactaacagactatggagcgttaactctcgactgcagcccaaggacagggcttgattttaacgagatggtcttattgacaatgaaagagaagagttggctagtacataaacaatggtttttagatctgcctctaccttggacatccggagctagtacgagccaggaaacttggaatagacaagatcttctagtcactttcaaaacagcacatgctaagaaacaagaagtcgtggtccttggtagtcaggaaggggctatgcataccgctctaacaggagctactgaaatacaaacatcaggaacaactacaatattcgcgggacatttaaaatgtcgactaaaaatggacaaactaacgcttaaaggaatgtcgtatgtaatgtgtactggttctttcaaactagaaaaggaagtcgcagagacacaacacggaacagttttagttcaaattaaatacgaaggaacggacgctccctgcaaaataccattctctactcaagatgaaaaaggtgtcacacaaaacggacgcctcattacagcaaatcctatagtaacggacaaagaaaaaccggtgaacatagaagcagaacctccttttggagaaagctacatagttattggagcaggagaaaaagctctaaaattatcatggtttaaaaagggttcgtccattggtaagatgttcgaggcaacagcacgaggtgcaagaaggatggcaatacttggggacactgcctgggattttggttcaattggaggagtatttaccagtgttggcaagctagtacaccagatctttggtactgcctatggtgttttatttagtggcgttagctggaccatgaagataggcattggtgtcttactaacttggcttgggctaaattctcgttcgacgtcactcagtatgacatgtatcgcagtcggcctagtaaccttatatctaggagtaatggtccaagcagattctggctgtgtaataaattggaaggggcgcgagttaaaatgtgggtctggtatttttgttactaatgaggttcatacatggactgagcagtataaatttcaagcagacagtcctaaacgattaagcgctgcaataggtaaagcatgggaggaaggtgtatgtgggataaggtcggcgacacggttagagaatattatgtggaaacaaattagcaacgagttaaaccacatactgctagaaaatgatatgaagtttactgtagtagttggagacgttgcagggatactagcacaaggcaagaaaatgattcgtccccaaccaatggaacacaaatacagctggaaatcatggggtaaagcgaagattataggcgctgatgtgcaaaatacgacatttataatcgacgggcctaatacaccggaatgccccgacgaccaacgggcctggaatatttgggaagttgaggactatgggttcggaatttttactaccaacatctggttaaaacttagagatagttacacacaggtatgtgatcatcgattaatgagtgctgcaattaaagactctaaggctgttcatgcagatatgggatattggatcgaaagtgaaaagaacgaaacttggaagctggcaagagcaagtttcatagaggtaaagacatgtatatggccaaagagtcacacattatggtcaaatggagtattggaatcagaaatgataatccctaagatatacgggggcccaatttctcaacataactacagacccgggtattttactcaaacagcagggccttggcatttaggaaaactcgaattagattttgatctatgcgaagggacaaccgttgtggttgacgaacactgcggaaacaggggtccaagtttgaggacaactacagttactggtaaaattatacacgaatggtgctgtaggagctgtacgttaccaccattaaggtataggggtgaagacggttgttggtacggcatggaaattagaccagttaaagaaaaagaagaaaatctagtaaaaagcatggttagcgctggttcaggcgaagtggatagttttagtctgggactcctatgtatctcaatcatgatcgaagaagtaatgagatctaggtggtccaggaaaatgctaatgacaggcaccttagctgtcttctttttattgattatgggacaactaacttggaatgacctaatcaggctttgcataatggtgggagcaaatgcatccgaccggatgggtatgggcactacgtatttagcgcttatggcgacttttaaaatgaggcccatgttcgcagtaggcctcttatttagaagactcaccagcagagaagttctattactaaccattggactaagtttggtagcctccgtagaacttccaaactcacttgaggaactcggagatggattagcaatgggaattatgatacttaagttacttacagatttccagtcgcaccagttatgggcaacactgttatcacttacatttattaaaactacatttagtctacattatgcctggaaaactatagcgatggtactgtcgattgttagcctgttccccctatgtttatctaccacatcacagaaaacaacttggcttccggtactgttaggatcactaggatgcaaaccacttacaatgtttctaatagccgagaataaaatatgggggagaaaatcttggccactcaatgagggaattatggcagtaggtattgtaagtatattacttagctcgttgttgaaaaacgatgtgccactagcaggtccgttaattgctggaggaatgttgatagcatgttatgtaatatcgggatcgtccgcggatttaagtctagaaaaagcggctgaggtgtcctgggaagaggaagcagaacactcgggagcatctcacaacattcttgtagaagttcaggacgatggcacgatgaagatcaaggatgaagaaagggatgatacactaacgatactattaaaagcgacgctattagcagtaagtggcgtttacccactatcaatacctgcaacattatttgtgtggtacttttggcagaagaaaaagcaacgatcaggagtattgtgggacacaccctcacctcccgaagtagaaagggccgtattagacgatggtatatatagaattatgcaacgaggtctattagggcgaagccaagtaggtgtaggagtttttcaagagaatgtgttccacacaatgtggcatgttacaagaggcgcagtcttaatgtatcaggggaaacggttggaaccgtcatgggcctcagttaaaaaggacctaatcagttacggagggggatggcgactccaaggatcttggaacacaggagaagaagtccaagtaatagcagtagaaccagggaaaaatccgaagaatgtacaaactgcacctggaactttcaagacaccagaaggggaagttggcgctatagcgttagattttaaaccaggaactagcggaagtccaatcgttaatagggaaggcaagattgtagggctatacggtaatggcgtcgtaacaacgtcaggtacatacgtctcagctattgcccaggcaaaagcaagccaggagggtccacttccagaaatcgaagacgaagttttcaggaaaaggaatttaacgataatggatttgcaccccggttcaggcaaaacacgacgctatcttccagcaatagtaagggaagcgatcaagcgtaaactacgcactctcatactcgctcctacacgagtagtagcttctgagatggccgaagccttaaaaggaatgccgataagatatcagacgacagctgtcaaatctgaacatactggaaaagaaatagtagacctgatgtgccacgccacattcaccatgagactgctcagtccggtaagagtgccaaattacaatatgattataatggacgaagcccattttaccgacccttcatccattgcagctagaggttatatcagtacacgcgttggaatgggagaagcagcagctattttcatgaccgctacaccacccggatccgtggaagcctttccacaaagcaatgccgtcattcaggacgaagaaagagatataccagagagatcatggaactcagggtatgaatggatcactgacttccctggtaaaaccgtttggtttgtaccctcaataaaatcaggtaatgatattgcaaattgtctaaggaaaaatggtaaaagagtaattcagttgagtcggaagacatttgatacagaatatcagaaaacaaagaacaatgattgggactatgtggtcactacagacatatcagaaatgggagcaaatttcagagcagacagagttatagatcctagaaggtgtttaaaacccgttattcttaaagacggaccggaaagagtgattcttgcgggacctatgcctgtgacagtcgcatcggctgctcaaagaagaggtagaattggtaggaatcacaacaaagaaggggaccaatacatatatatgggacaaccacttaataacgacgaagatcatgcccattggaccgaagcgaaaatgcttctagataatatcaacacgcccgagggaataataccagctttgttcgaaccagaacgggaaaagagcgcagctatagatggtgaataccgtctaagaggagaagcaagaaaaacatttgttgaacttatgagaaggggcgaccttccagtttggctatcatataaagtcgcctccgaagggttccaatattctgatcgacgatggtgttttgacggagaaaggaacaaccaagtacttgaagagaatatggatgttgaaatctggacgaaagagggtgaaaggaagaaactaagacccagatggctagacgcaaggacctacagtgatccactagcgttgcgagagttcaaagaatttgcagctggaagacgaagcgtctcaggggaccttatcttagagattggtaaactgcctcagcacttaacccaaagggcgcaaaatgccctcgataatttggtaatgttacacaactcagaacagggcggtagagcatataggcatgcaatggaagaactcccagacacaatagaaacactgatgttactggcgctaatcgccgtattaactggaggcgtgactctattctttttatcaggaaaaggattaggtaaaacatcgatcggactattatgtgtaatggcaagttctgtcttgttgtggatggcgagtgtagagccgcattggattgcggcgtccataatccttgaatttttcttaatggtacttctcatacctgagccagatcgtcaacgaacacctcaagacaatcaactggcctacgtagttataggattattatttatgattctaaccgtggccgccaacgaaatgggactactcgaaacaaccaaaaaggacttaggaataggacacgtcgcagtagaaaatcaccaccatgcagcaatgttggacgtagatttacatcctgcaagtgcatggacactttacgctgttgccacaacgattataacaccaatgatgagacataccatagaaaatacaacagcgaacatttcattgacggctatagcaaatcaagctgcaattttaatgggactagacaagggatggccgatcagtaagatggacataggcgttcctcttttggcattaggttgctacagtcaggtaaacccgcttacgttgaccgctgcagtcttaatgttagtagcgcattacgcaataataggcccaggactacaggcaaaagcaacacgcgaagcccagaaaagaaccgcagcaggaatcatgaaaaaccctacagttgatggcatcgtagccatagatctggacccggttgtgtatgacgccaaatttgagaagcaattagggcaaataatgctcctaatactatgcacaagccaaattttacttatgaggacaacctgggccctctgcgaatctattactttggctactgggcctcttactaccctctgggaaggttctccagggaagttttggaataccacaatagcagttagtatggcaaatatatttcgagggtcatatcttgcaggagctggacttgccttttcattaatgaaatcactcggcggaggtcgaaggggaactggtgcacaaggggaaacccttggtgagaaatggaaacgccaactaaatcagctcagtaaatctgaatttaatacttataagagatccgggataatggaagtagacagatcagaagctaaggaaggactgaagcgaggcgaaaccaccaaacatgccgtcagtcgagggacagcgaagctacgatggttcgttgagcgaaacctagttaaacctgaaggtaaagtaatagatttgggctgtggaagagggggttggtcttactattgcgcgggtctcaagaaagttacagaagtcaaaggttatacaaaaggaggtcctggccacgaagaaccagtcccaatggctacctacggttggaacttggtaaaattacattcaggaaaagatgtgttctttatcccaccagaaaaatgtgataccttgctttgcgatattggagaaagtagtccaaatccaactattgaagaaggcagaacgctacgagttctgaaaatggtagaaccctggttacgtggtaatcagttttgtataaaaatcctgaacccatatatgccttccgtagtggaaacgctagaacaaatgcaacgaaaacacgggggaatgctagtaaggaaccctctttctagaaactcgacacatgaaatgtactgggtatcatgtggtacggggaacatagtgtcagcgataaacatgacatccaggatgctattaaatcgattcacaatggcacatagaaaaccgacttatgaaagagatgtagatctcggtgctggaacaagacatgttgccgtcgagccggaggtagctaatctagacatcattggccaaagaattgaaaacataaaatgcgagcataagtctacatggcattatgacgaagacaacccatacaaaacgtgggcttatcacggttcttacgaagtcaagccaagcggcagtgcaagctcaatggttaacggggtcgttaagttactaacaaaaccatgggatgtgataccgatggttacacagatagccatgactgacacaactccatttggacaacagagagtgtttaaagaaaaggtcgatacacgaactcctaaggcaaaaagaggcacagctcaaataatggaagttacggcccgttggttatggggttttctgtctcgcaataagaaacctagaatatgtacaagagaggaatttaccagaaaagtgaggtcaaatgcagcaatcggtgctgtgtttgtagatgaaaatcagtggaactcagctaaagaagcggtcgaggatgagagattttgggacctcgtgcatcgggaacgcgagctacataaacagggaaagtgtgcgacttgcgtatacaatatgatgggaaagcgtgagaagaaactcggagaatttggtaaggctaagggttcgcgagctatttggtacatgtggctcggggctagattcttagagttcgaagcattaggtttcatgaatgaggatcattggttcagccgcgaaaattccttatcgggggtggagggcgaaggactgcataaactaggctatatcttacgggacatatctaaaatttcaggaggtaacatgtacgcagacgatactgcgggatgggataccagaatcaccgaagatgacttacaaaatgaagcaaaaatcactgaaattatggaacctgaacacgcacaattagctaaggccatatttaagctaacataccaaaataaagtggtgcgtgtacagcgacctgccaaaaatgggacggtgatggacgttatatcaagacgagatcaaaggggctccggacaagtaggaacttatgggttaaatactttcacgaatatggaagctcaactaattcgtcagatggagtcagaagggatattctcaccgagtgagttagagacaccgaacttagccgaaagggtcttagattggctagaaaaatatggcgttgagcgtttaaaaaggatggctattagtggggacgattgtgtagttaaacccattgacgataggtttgcaacagcactgacagcgctaaacgatatgggcaaggtgagaaaagatatcccacaatgggagccatcgaagggatggaacgactggcagcaagtaccattttgttcgcaccattttcaccaattaattatgaaggacggtagagaaatagtagtaccatgccgcaatcaggatgagctagttggaagggctcgtgtttcacaaggagcaggatggtctttgagggaaacagcatgcttgggaaaatcatatgcacaaatgtggcaactcatgtattttcaccgaagagatttgcgcttagcagctaacgctatatgttccgccgtgccagtagattgggttccgacatccaggacaacctggtcaatacatgcgcatcatcaatggatgactacagaagatatgttaagtgtctggaaccgcgtatggatagaagaaaatccgtggatgaaagacaagacccacattagcagctgggaagatgtaccttatttgggaaaaagagaagaccaatggtgcggtagcctaatcggtcttacagccagagcgacctgggcaacaaacatacaggttgcgataaaccaagtcagaaggctaatagggaatgagaattatttggactacatgacgtctatgaaaaggtttaaaaatgagtcagatcctgaaggagccttatggtag

SEQ ID NO: 22127 - RNA, 9879 nt, synthetic construct
  misc_feature 1..9879: note = derived and/or modified CDS sequence (opt6) from DENV-1__KU666941__SS-prME
  source 1..9879: mol_type = other RNA
tccgtcacaatgcttttaatgttaatgccgaccgccctcgctttccatctgacaacccgtggtggggagccccacatgattgtatcgaaacaagaaagaggaaaatctttattatttaaaacaagcgctggtgtgaatatgtgtaccctaatcgcgatggacctgggagaactatgtgaagacaccatgacatataaatgtcctcgtatcactgaagctgaaccggatgacgtagactgttggtgcaacgcgaccgatacttgggtaacctatggcacgtgttctcaaacaggcgaacaccgtagagataaaagatccgtcgcccttgcgccacacgtgggcttgggtctcgaaacgcgaacagaaacgtggatgtcttccgaaggagcatggaaacagattcaaagggtagagacttgggcactgagacacccaggatttaccgtaattgctctgttcctagctcatgctataggcacttctattacacagaaaggtataatatttattttgctaatgttggttacgccatcaatggcgatgagatgcgttggtatcggatctagagactttgtcgaaggactttctggagcaacgtgggttgatgtagtattggaacatgggagctgcgttacaacaatggccaaagataaacccaccctggatattgaattattaaaaacagaggtaactaatcctgccgtattacgcaaactttgcataggggcgaaaataagcaataccaccaccgatagtaggtgtccaactcaaggggaggctacgcttgtagaagaacaagatgcaaactttgtgtgtcgacgaacctttgtagaccgtggttggggcaacggctgtggactgtttggcaaaggctctttgataacttgtgcaaaattcaaatgtgtaactaaactggaggggaaaatagtacaatatgaaaacctaaaatattccgtaattgtaactgttcatacaggagatcaacaccaagtgggtaatgaaagcacagaacatggaacaacagccaccataacaccacaggcacccactacagaaatacagctaacagactacggcgctttgactttagactgctctccacgaaccggcttagattttaatgaaatggttttattaaccatgaaggaaaaatcatggttagtacacaagcaatggtttctagatctcccattaccttggaccagcggagcatcaacgagtcaagagacttggaataggcaagatctattggtcacattcaaaacggcacacgctaaaaagcaggaagtagttgtcctaggatctcaagagggcgcaatgcatactgcgctgacaggtgctacagaaattcaaacgtcaggaacaacgacaatatttgctggtcacttaaaatgtaggttaaagatggacaaattgactttaaaaggaatgagttacgtcatgtgtactggatcgttcaaacttgagaaagaagtagcagaaacacaacatggtacagtattggttcaaattaaatacgaagggacagacgcaccatgcaaaatacctttttccactcaagatgagaaaggagtgacgcaaaacggtaggttaataacagcaaatcctatcgtcactgataaggaaaaaccagtgaatatagaggcagaacctccattcggtgaatcatatatagtgataggggcgggagagaaggctctaaaattaagttggtttaagaaagggtcgtcgattgggaaaatgtttgaggccacggctcggggagcacgacgaatggccatattaggcgatacagcttgggactttggctctatcggaggggtttttacaagcgttggaaaactggtacatcaaatcttcggaactgcatatggtgtattgtttagtggcgtatcttggacgatgaaaatcggtattggggttctattaacatggttaggacttaacagtagaagtacgagcttaagcatgacatgcatcgccgttgggctggtaaccctttacctaggggttatggtgcaagcagatagtggatgtgtgattaattggaaaggaagggaactgaaatgcggatccgggattttcgtgacaaatgaggtgcatacttggaccgagcaatataaattccaagcagattctcccaaacgactgagcgccgccatagggaaagcatgggaggagggagtctgtggtattcgatctgccacacggttggagaatatcatgtggaaacaaatttccaatgagcttaaccacattttattagagaacgacatgaaattcacagtggtagtcggagatgtcgccggaatactagctcagggcaagaaaatgatccggccacaacctatggaacataaatactcctggaaatcctggggaaaagcgaaaattatcggtgctgacgtccaaaatactacttttattatagacggtcccaacactccggaatgcccagacgatcaacgagcatggaatatctgggaagtcgaagactatggatttggaatctttactacaaacatatggttaaaactacgagattcatatacccaagtatgcgatcacagattaatgtctgcggcaataaaagattcaaaagcagtccatgcagatatgggttactggattgagtctgaaaagaacgaaacttggaaattagcaagagcttccttcattgaagttaaaacctgtatatggccaaaatcacatacgttatggtcaaacggtgtacttgaaagtgaaatgataattccgaaaatatatggtggaccgatatcgcaacataattaccgcccaggatatttcactcaaacagcaggaccatggcaccttggaaaactggaactggatttcgacttgtgtgaaggtacaaccgtcgtggtagacgaacactgcggaaacaggggacctagtttgcgaacgacaaccgtaacgggtaaaatcattcatgaatggtgctgcagatcgtgcacgttaccacccttacgctataggggagaagacggttgctggtacggtatggagattagacccgtaaaagaaaaagaggaaaatcttgtgaagtccatggttagtgcgggaagtggtgaagttgattctttcagcttaggtctgttgtgtataagtataatgattgaggaagttatgcgtagtaggtggtcaagaaaaatgctaatgacaggaacgctcgctgtcttctttctattaatcatgggacaattgacctggaatgacttgatccggctctgcataatggtaggggcaaatgcttcagacagaatgggaatgggcacgacatacctagctctgatggcaacatttaaaatgagaccgatgtttgccgtcgggctgctgtttagacgactcacatcgcgagaagttctacttctaacaatcggattatctctagttgcctccgtagaattacctaactcactagaagaactaggagacggattagcaatgggtataatgatattaaaactattgacggatttccaatcacatcaattatgggctaccttattatccctaacttttattaaaacgactttttcactgcactatgcatggaaaactatagctatggtattgagtatagttagcctattcccactatgtttaagtaccacatctcagaaaacaacttggttaccagtattacttggtagtttgggatgcaaaccgctaacaatgttcttaatagcagaaaacaaaatatggggaagaaaaagctggccattaaacgaaggtattatggcggtaggaattgtttcaatactcttgtcgtcactgctgaaaaatgatgttccactagccggcccactgatcgcaggaggtatgcttatagcatgctatgtaataagtggcagctcagctgatctctctttagaaaaagccgcggaagtatcatgggaagaagaagcagaacactcaggcgcatcacacaatatattagtagaagtacaagacgacggaacaatgaaaattaaagatgaagaacgtgatgacacattaactatcctgctcaaggcgactctactagcagtatcgggtgtttacccactatcaataccagctacactttttgtgtggtatttttggcagaagaaaaagcagcggtctggagtcctatgggacactccgagccctcctgaagtagaaagggcggttctggatgacggaatttacagaattatgcaaagaggactgttaggtcgaagtcaagtcggtgtaggtgtctttcaagaaaacgtttttcacacgatgtggcatgtaactaggggtgcagtgttaatgtaccaaggaaagcgattagagccaagctgggcttcggtcaagaaagatttaataagctatggagggggttggagacttcaaggtagttggaacacaggagaggaggtccaagttatagcagtcgagcctggtaagaacccgaaaaacgtacaaacagcgcctggaacgttcaaaacaccggaaggtgaagtaggtgctatagctcttgatttcaaaccgggcacgagcggttctcccatagttaatagggagggaaaaatagtcggattatacggaaacggtgtagtcacaacaagtggtacctatgttagtgcaatagctcaagccaaggctagccaagagggcccgctacccgaaatagaagacgaagtttttcggaaaagaaacctcacaataatggatctccacccaggatcaggtaaaaccagaagatatctgcctgctatagtacgagaagccatcaaacgtaaattgcgcaccctgatactggcaccaactagagtcgttgccagcgaaatggccgaggctttaaaagggatgcctataaggtaccagactactgcagtgaagagtgagcacactggtaaagaaatagtggatctaatgtgtcatgctacctttacaatgagactactaagtccggtaagagtacctaactacaacatgatcatcatggatgaagcacattttactgatccaagtagtatagccgcaagaggttacatatcaacacgagtcggtatgggtgaggcggcagccattttcatgactgccactccacccggatccgtggaggcttttccccagtcgaacgcagtaatacaagatgaggaacgggatattcctgagagatcatggaacagtggttatgaatggattacggattttccaggaaaaacggtctggtttgtacctagtataaaatctggaaatgacatagcaaattgccttaggaagaatggaaaaagggtcattcagttaagccgaaaaacattcgatactgagtatcaaaagaccaaaaataacgattgggactatgtagtaacaacggacatatcagaaatgggcgcaaattttagggccgacagagtgatagatccgcgtcgttgcttaaaaccagtgatactaaaggatggaccagaacgtgtaattctagctggaccgatgccggtaacagtcgcctcagcagcacaacgtcgtggtcgcatcggaagaaaccataataaggaaggtgatcaatatatatacatgggtcagccattgaacaacgatgaggatcatgcacattggacagaagccaagatgttgctagacaacataaacacccctgagggaataattcccgctctatttgaaccagaaagagagaaatctgcagcgattgatggagaatatagactacgaggtgaagctagaaaaacttttgtagaactgatgcgaaggggtgacctcccagtatggttatcttacaaagtagcatcagaaggttttcagtattcagacagaagatggtgcttcgatggagaaagaaacaaccaagtactggaagaaaacatggatgtcgagatatggacaaaggaaggagaacggaagaaactaaggcctcgatggctcgacgcccgaacctattctgatcctttggctttacgagaatttaaagaatttgcggcggggaggagatcagtctcgggtgatcttattttagaaataggaaaattgccccaacaccttacacagagagctcaaaatgctttggataatctcgttatgttacataattcggaacaaggcggtcgtgcatatcgacatgctatggaggaattaccagatacgatcgagacactgatgttgttagcactaatagcagtactgacaggtggagtcactctcttctttctgtcaggaaaaggtctggggaaaaccagcattggcctgctttgtgtcatggcatcgtcggtccttctgtggatggcgagtgtagagccgcactggatcgcagcgtctataatattagaatttttcctaatggttttattgataccagaaccggataggcaaagaactccgcaagacaaccaattggcctatgtagtgattggtttactatttatgatcctaacagtagctgctaacgaaatgggcctactcgaaactacaaagaaagatctgggaattggacatgtagcagttgaaaatcatcatcacgcagcaatgctagatgtagatcttcacccggcatccgcttggacattgtacgcagtagctacaactataatcactcctatgatgagacacactatagaaaacacaacagcaaacattagtctcacagcaatagctaatcaagcagcaatactgatgggtttagacaaagggtggccaataagcaaaatggacataggagtccccttattagcgctcggttgctatagtcaagttaatccattaaccctgacagcggcagtattaatgctggtagctcattatgcaataataggacccggccttcaggcaaaagccacaagagaagcacagaaacgaacagcagcaggaatcatgaaaaatcccaccgttgatggtatcgtcgctatagacttagaccccgtggtgtatgacgcaaaattcgaaaaacaacttggccaaatcatgcttctcatcctatgtacatcacaaatattattaatgcgaactacttgggcactctgcgagtcaataacgctggcgacaggcccgctaactacgctctgggaaggttctccaggaaaattttggaataccacaattgcggtaagcatggcaaacatctttagaggatcatacttagccggtgcggggctagctttcagcctaatgaaatcattaggaggagggcggagaggcacaggtgctcagggagagacacttggcgagaaatggaaacgtcaattaaaccaactctctaaaagtgagttcaacacctataaaagatcaggaataatggaagtagaccgttcggaagcaaaagaaggactgaaaaggggagaaacgacaaaacatgctgtcagtcgcggtacagctaaactgcgttggttcgtggaaagaaatctagtaaaacctgaagggaaagttattgacctcggatgcggtagagggggttggtcatactactgtgcaggcctaaagaaagtcaccgaggtcaagggatatactaaaggtggtccaggacatgaagaaccagtccctatggcaacttatggctggaacctggttaagttgcattcagggaaagacgtcttcttcataccacctgaaaagtgtgacacactattatgcgatattggtgaatcatcaccaaatccaactatagaagagggacgcacattgagagttcttaaaatggttgagccatggctgcgcggaaatcagttctgtatcaaaattttaaatccttacatgccgagtgtagtcgaaactctcgaacaaatgcaacgaaaacatggagggatgttagtacgcaaccccctaagtcgaaattcgacacatgagatgtattgggtctcatgcggcactggtaatattgtaagtgccataaatatgacgagcaggatgttattaaaccgatttacaatggcacaccgaaaacccacgtacgaaagggacgtcgatctaggcgctggtacaagacatgtcgccgttgagccagaagttgcaaatttagacattataggccaaagaattgaaaacatcaagtgtgagcataaaagcacatggcattacgacgaagacaacccatataaaacgtgggcctaccacggaagctatgaagtaaagccttcagggagtgccagtagcatggtaaacggagtagtaaagttactcaccaaaccttgggatgttataccaatggttacacaaattgctatgaccgacacaactcctttcggccaacaaagagtttttaaagaaaaagtagatacacgtaccccaaaagcaaaacgcggaacggcgcagataatggaagtaactgcaagatggttatggggttttctctccaggaacaaaaagcctagaatatgtactcgagaggagtttacacgtaaagtacgatcgaacgcagctatcggtgctgtttttgttgacgaaaatcaatggaactcggcgaaagaagctgtcgaggatgagagattctgggacctagttcaccgggaacgggaactccacaaacaaggcaagtgtgcaacctgcgtatataatatgatgggtaagagagagaagaaactcggggaatttgggaaagcgaaaggctcaagagctatatggtatatgtggttgggagccaggtttctagaatttgaagcactagggtttatgaacgaagatcattggttctcacgcgaaaattctttatcaggagtggaaggagaaggtcttcacaaactaggctatattttgcgcgacataagcaagatatctggaggaaacatgtatgcagatgacactgccggatgggacacacgaattactgaagatgatttgcagaatgaagcaaaaataaccgaaattatggaacctgaacatgcacaattagcgaaagccatttttaaacttacctaccagaacaaagttgtacgcgtccaaagaccggcgaaaaacggaacggtcatggacgtaatttctaggagagaccaaagaggatcaggacaagtaggtacttatggactaaatactttcacgaacatggaagcacaattgatcagacaaatggagtcggaaggtatattttcaccaagtgaactagaaactcccaacttagccgaacgagtactcgactggttggaaaagtatggtgtagagcgactcaagagaatggccataagtggagatgattgcgtagtcaaaccaatagatgatcgctttgccactgctcttaccgccctaaatgacatgggcaaggtaagaaaagatattccacaatgggaaccgagtaagggctggaacgactggcaacaagtgcctttctgttcgcaccacttccaccagttgattatgaaagacggccgggaaatagttgtcccctgcagaaaccaagatgaattggttggccgagcaagagtgagccaaggagccgggtggtcgcttagagaaactgcttgtcttggaaaatcatatgcacaaatgtggcagctcatgtactttcatagaagagatctaaggttagctgcaaatgctatctgtagtgctgtccctgtggattgggttcccactagccggacgacgtggagtatacatgctcatcaccaatggatgacgacagaagacatgttatcagtatggaaccgagtatggattgaagaaaatccttggatgaaggataaaactcacattagcagctgggaagatgttccttatttgggaaaacgagaagaccagtggtgtggcagcctcataggtttaacagcacgagccacttgggcaacgaacatacaagtggctatcaatcaagtgcggagactcatcggaaatgaaaattacttagattatatgacatcaatgaagagattcaagaacgagagtgatccagaaggagcattatggtaa

SEQ ID NO: 22128 - RNA, 9879 nt, synthetic construct
  misc_feature 1..9879: note = derived and/or modified CDS sequence (opt6) from DENV-1__KC172835__SS-prME
  source 1..9879: mol_type = other RNA
tcggttactatgcttctaatgttaatgccaactgcactggcttttcacctcaccactcgagggggagaaccgcacatgatagtatcaaaacaagaaagaggtaaaagccttctatttaaaacatctgctggagtaaatatgtgcacacttatagcaatggatctaggggaactctgtgaagatacgatgacatacaaatgccccagaatcactgaagcggaacccgatgatgttgattgttggtgtaatgccacggatacatgggtaacatacggaacatgttctcaaacaggagaacatcgacgcgacaaacgttcagttgccttagcaccgcatgtagggcttggactggaaaccagaacagaaacttggatgagcagtgaaggggcttggaaacaaatccaacgggttgaaacctgggctttgagacacccaggatttactgtaattgcgctttttcttgcacatgctatagggacatctatcacgcaaaaaggtattatttttatacttctgatgttggtaacaccatccatggcaatgcgatgtgtaggaatcggctcacgtgactttgtagaaggtttatccggtgcaacatgggtagacgtagttttggaacacggatcttgtgtgacaacaatggcgaaagataaaccgacgttagacatcgaattgttgaaaacagaggtaacgaatccggcagtgctccggaaactctgtattgaagctaaaattagtaataccacgacggatagtagatgccccacccaaggggaggccacattagttgaggagcaagacgcaaattttgtatgtcggcgaacgtttgtagatcgtggttgggggaatggttgtggtttattcggcaaaggctctcttattacatgcgcgaagttcaaatgtgttacaaaacttgaaggtaagatagtgcagtatgaaaacctgaagtattctgttatcgtgacagtacacactggtgaccaacatcaagtaggaaacgagtcaacagaacacgggactacagcaacgattacaccgcaagcaccaactacagagatccaactaactgactacggtgcactaaccttagactgcagcccacgtactggattggacttcaatgaaatggttttattaacaatgaaagaaaaatcctggttagttcataaacaatggtttcttgatctacccttaccatggacttcaggcgcaagtacgtcgcaggaaacttggaatagacaagatttattagttacttttaaaaccgctcatgcaaagaaacaggaagttgtggtgttgggatctcaggaaggggcaatgcatacagctctcaccggcgccacagaaatccaaacaagtgggaccaccactatattcgcaggtcatttaaaatgtagactaaaaatggacaaactgactctaaaaggaatgagttacgttatgtgtacgggtagctttaaactagaaaaagaagtagcagaaacgcagcatggcaccgtcctggttcaaatcaaatacgaaggaactgacgcaccatgtaaaatcccttttagcactcaagatgagaaaggggtgacacaaaatggtcgtctaataacagccaatcctatagtaactgataaagagaaacctgtaaatatagaagccgagccaccattcggcgaaagttacattgtcataggcgccggcgaaaaagcactaaaattgagctggttcaaaaagggatcaagcataggaaaaatgtttgaagcaacggcaagaggagcacgtcgcatggctatactaggtgatactgcatgggactttggatcgataggcggggtatttacgtcggtaggaaagctagtgcaccaaatattcggcacggcatacggtgtattattttcaggagtgtcatggacaatgaagatcggcataggtgtcctactaacgtggttgggacttaattcaagatccactagcctaagtatgacctgtattgcagtcggactcgtcacgttatatttaggtgtaatggtccaagctgactccggatgtgtagtcaattggaagggtagagaactcaagtgcggaagtggtatttttgtaacgaacgaagtacacacttggacagaacaatataagtttcaggctgatagccctaagaggctaagcgctgccatagggaaggcttgggaagaaggggtatgtggtataagatcagctactagattagagaacgttatgtggaaacaaatctcaaacgaacttaaccacatcctattggagaatgatatgaaattcactgttgttgtcggagacgttgcaggtatacttgcacaaggcaagaaaatgataaggccgcagccaatggaatataaatatagttggaaatcatggggaaaggctaaaattattggtgctgacgtgcaaaataccactttcattattgatggaccaaatactccggagtgccccgacgatcaaagagcttggaatatatgggaagttgaagattatggctttggcatatttactacaaacatctggcttagactaagagactcatacactcaggtctgtgatcaccgtcttatgagtgctgcaataaaagactcaaaagcagtccacgcagacatgggatactggatagagtccgaaaagaatgaaacttggaaactcgcgcgagcctcatttatagaagtaaaaacttgtatttggccaaaatcacacacgttatggtcgaacggcgttctagaaagtgaaatgataatacccaaaatctatggaggtccaattagtcaacacaactaccgccccggctattttacacagacagctgggccatggcatcttggaaagttagaacttgacttcgacttatgtgaaggcacgacagtagtggtagatgaacattgtggaaatcgaggtccaagtctaaggacaactacagtaaccgggaaaacgatacatgaatggtgttgtaggtcatgtactcttccccctttaaggtttcgaggagaagatgggtgttggtacggaatggaaatcaggcctgtaaaagaaaaggaggaaaatttagtaaaaagcatggtatcggcaggcagcggggaagtggacagtttcagcctaggtttactgtgcatttctataatgatagaagaagttatgcgctccagatggtcgcgaaagatgctcatgacagggacattagctgtattctttcttttaatcataggtcaactgacatggaacgacctaattagattaagtattatggttggtgctaacgcatccgataagatgggaatgggcaccacatacttagcgttgatggctacgttcaagatgagacctatgttcgctgttgggctcctattcaggcgacttacatccagagaagttctattgttaaccattggtctaagtttggtagcatcagtcgaactacccaattcgctggaagaattaggggacggcctggctatgggaatcatgatattaaaattattaacagattttcaaccacatcaattatgggctacactactatctttaactttcatcaaaaccacattttccctacattatgcctggaaaacaatggcaatggtactaagtattgtctcactattcccactatgtttatcaacgacctctcagaaaactacttggttacctgtgcttttaggaagtttaggttgcaagccattaactatgtttctcattactgaaaacaaaatatggggaagaaaaagctggccattaaacgaaggaattatggcggttgggatagtttcaatactattaagttctctgctcaagaatgacgtaccgcttgcgggacccttaatagcaggcgggatgttaatagcatgttatgtcatcagtggaagttccgccgatctttctctggagaaagctgcagaggtctcgtgggaagaagaagccgaacattccggcgcttcgcataacatactcgtcgaagtacaagacgatggtactatgaagataaaagacgaagagagagacgacacacttacaatcttattgaaagctacactactagcggtgtctggtgtctaccctcttagtatcccagcaactctttttgtgtggtacttctggcagaaaaagaaacaacgatccggagtattgtgggacacaccctcaccacctgaagtagagcgtgctgccttagatgacggtatctataggattatgcaacgtggattactaggcaggtcacaggtgggtgttggtgtttttcaagaaaatgtattccacacgatgtggcatgtaactagaggagcggttttgatgtaccaggggaaacgtctagaaccatcttgggcatcagtcaagaaagacttaatttcatacggaggcggctggagacttcagggctcatggaacaccggggaagaagttcaagtaattgctgtcgaaccaggtaaaaatcctaaaaatgtacaaaccgcgcctggtacctttaaaacaccagaaggtgaagtaggcgcgatagcattagactttaaacctggcacatctggatcccctattgtaaatcgcgaggggaaaatagtaggattatatggtaatggagtagtaactacaagcggtacctacgtgtcggccatagcacaagcaaaggcctcgcaagaaggtcccttgccagaaatagaagatgaagtctttagaaagcgaaatctaactatcatggatctgcaccctggaagtggcaaaacccgcagatatcttccagccatagtgcgagaagccataaaacgcaaactacgcaccctgatactcgcaccaacgagagtcgttgcaagtgaaatggcggaagcattgaaaggcatgcccataaggtaccaaacaacagcagtaaaatcagagcataccggaaaggaaattgtggacttaatgtgccatgcaacctttacaatgagattactttcgcctgtcagggtccccaactacaacatgataattatggatgaagcacattttacggatccatcttcaatagcggcacgaggatatataagtactcgggttgggatgggtgaagcagcagcgatatttatgacagcaactcctcctgggagtgtggaagcatttccacaatcaaatgcggtaattcaagacgaagaacgagatatacctgagcggtcatggaactctggctatgagtggataacagattttccaggaaaaaccgtatggtttgtcccaagcatcaaatcaggaaacgacatagcaaattgcctgaggaaaaatgggaagagggtcattcaattatcacgaaagacttttgataccgaatatcagaaaacaaagaataatgactgggattatgtagtaacaaccgacatatcagaaatgggcgcgaattttcgtgctgaccgtgtaatagatccgcgaaggtgtctaaaacccgtcatcctgaaggacggacccgaaagagtaatattggcaggtcctatgccagtaacagttgcaagcgctgctcagagaagaggtcgtatcgggagaaatcataataaagaaggagatcaatacatttatatgggtcagccactaaataacgacgaggaccacgcacactggactgaagcaaaaatgctgctagacaacataaataccccggagggaataatccccgcattatttgaaccagaaagagagaaaagcgcggcaatcgatggagaatatcgattacgtggggaagcaagaaaaacattcgtagagttgatgagacgtggagatctacccgtgtggctatcttataaggtagcaagtgaaggatttcaatacagtgatcgtagatggtgttttgacggagaaaggaacaaccaagttctcgaggagaatatggacgtcgaaatatggactaaagaaggcgagaggaagaaattgcgaccaagatggttggatgctaggacgtatagtgacccattagccctaagagaatttaaggaatttgcggccggaagacgatccgtcagtggtgaccttatattagaaattggtaaacttccacaacacctcacacaaagagcacaaaatgctcttgacaatctagtgatgctacataacagtgaacaaggcggacgagcttatagacacgcgatggaagaacttcccgacacgatcgaaactttgatgctattagcgctgatcgctgtccttacaggaggagtgacactattctttttgtccggacgtggtctaggtaaaaccagtattggactactctgtgtaatggctagttctgtccttctttggatggcttctgtagaaccccattggattgctgccagtataattcttgagttctttttaatggtactcttaataccagaaccggatagacaacggactccgcaagacaaccaattggcatatgttgtaataggacttttattcatgatcttaactgtcgcagcaaatgaaatgggactactcgagaccacgaagaaagacttaggaataggccatgtagcagatgagaatcatcaccatgctgccatgttagacgtcgatctccatcctgcaagcgcttggacgctatatgcagtagccacgactattataacacccatgatgcgacatactatagaaaacacgaccgctaacatatcactaacagctatagcaaaccaagccgccattctgatgggattggacaaaggatggcctataagtaaaatggacatcggggtaccattattggcactagggtgttatagccaggtaaatccacttactttaacagctgcagtcctgatgctagtagcgcattacgctataataggacctggattacaagcgaaagctacgagagaggcacagaaaaggacggccgctgggattatgaaaaaccctaccgtagatggcatagtcgccattgacttggaccctgtcgtatacgatgctaaatttgaaaaacaacttgggcagatcatgctcctaatactttgtacgagtcaaatattgcttatgagaactacttgggcactatgtgaatcaataacgttggcaacaggacccctgacaactttatgggaaggcagccctggaaagttctggaatacaacgatagctgtaagcatggcgaatatcttccgcggatcttatttggcaggagcaggcctcgctttctccttgatgaaaagtctgggtggaggacgacgcggaacaggcgcacagggagaaaccctgggtgaaaagtggaaaagacaactaaatcaattgagcaaaagtgaatttaacacatacaagagatctggcataatggaagtagataggagtgaggccaaagaaggtttaaaacgaggggagaccaccaaacatgcggtatcaaggggaactgcaaaattaagatggtttgtagagcgaaatctagtcaagccagaaggcaaggttatagacctcggctgtggcagaggaggctggtcatactactgcgcaggtcttaagaaagttactgaagtaaagggatatacaaaaggtggacctggacacgaagaaccgataccaatggccacatacggttggaatctagttaaacttcacagtggaaaagatgttttcttcataccgccggagaaatgcgacaccctactatgtgatataggagaatcaagtccaaaccccacaatagaagaaggaagaactctaagagtactaaaaatggtagagccctggttgaggggaaaccagttctgtataaaaattctgaatccgtatatgccctccgtagtagaaaccctagaacagatgcaacgaaaacatggtggaatgcttgtaagaaacccattgtcccgaaacagtacacatgaaatgtactgggtgtcttgtggaactggaaatatagtctccgctgttaatatgacaagtagaatgttactaaatcgtttcacaatggtacacagaaaacctacatatgaaagagatgttgacctaggagccggcactcggcatgtggctgtagaaccagaagtagcaaatcttgacatcattggacagcgaatagaaaacatcaaacatgagcacaagtccacctggcactatgatgaagataatccctataagacatgggcttaccacggaagttacgaagtaaaaccatccgggtccgcatcatccatggtgaacggagtcgtgaaactcttgacgaaaccctgggatgttatcccaatggttactcaaatcgcaatgacggataccacaccattcggccaacagagagtttttaaggaaaaagtagatactaggactccgaaggcaaagagaggaacagcacaaataatggaagtcacagcccgttggctttggggttttctctcaagaaataagaaaccaaggatatgtacaagggaagaatttacaagaaaagtaaggagtaacgctgcgataggtgcagtatttatagacgagaatcaatggaactcagcaaaagaggcggtggaagatgagagattctgggatctagttcatcgagaacgggaactacataagcaaggaaaatgtgctacatgcgtgtacaatatgatgggaaaaagggagaagaaattaggtgaatttggcaaagctaaaggatcacgagcgatctggtacatgtggctcggagcgagatttctagaatttgaggctttaggctttatgaatgaagatcattggttttcgcgtgaaaatagtttatcgggtgtagaaggtgagggactacataaattgggatatatattgcgagacatttctaaaataccaggaggcaacatgtatgcagatgatacagccggttgggacactcgaataacggaagatgatttacagaacgaagcgaaaataaccgacataatggagagcgagcatgccttactagcaaaatctatatttaaactaacttaccaaaataaagtggttcgggtacaacggcctgcaaagaatggaaccgtaatggatgtgattagtagacgagatcagagaggatctggtcaagtgggaacatatggactaaatacgtttaccaacatggaagcacaactaatccgacagatggagtcggaaggtatattttctccttcggaactagagacaccgaatcttgcagaaagggctctcgattggcttgagaaacatggcgtcgagagattaaaaaggatggctatttccggtgatgactgtgtagtcaaaccaatagacgatagattcgctaccgctctaacagccttaaatgatatggggaaagtacgtaaagatattccccaatgggagccctctaaaggctggaacgactggcaacaagtaccattttgcagtcaccacttccatcaattaatcatgaaggatggaagagaaatagttgttccatgccgtaatcaagatgaattggtaggcagagcaagggtatctcagggagcaggttggtccttacgggagacagcctgtttgggaaagtcgtacgcccaaatgtggcaattaatgtactttcatcggagagatctgagactagcagcgaacgctatatgttcagcagtacctgtggattgggtgccgacatctagaacaacatggagtatccacgctcatcatcaatggatgactaccgaggacatgctgtccgtttggaatagagtctggattgaagaaaacccatggatggaggacaaaactcatatatcaagttgggaagacgtaccatatctcggcaaaagagaagatcaatggtgtggatccctcataggtttaactgcccgagctacatgggccaccaacatccaggtagcaatcagccaagtccgtcgactgataggaaatgaaaattatttagactatatgacgtcaatgaaaagatttaagaacgagtcagacccggaaggagcactctggtga

SEQ ID NO: 22129 - RNA, 9879 nt, synthetic construct
  misc_feature 1..9879: note = derived and/or modified CDS sequence (opt6) from DENV-1__EU848545__SS-prME
  source 1..9879: mol_type = other RNA
tctgtaacgatgttgttaatgttactacccactgcgctagcctttcatctgacaacaaggggtggtgaacctcacatgattgtgagtaaacaagaacgtggtaaatcacttctatttaagacctcagccggagtgaacatgtgcactataattgccatggacctaggagaattatgtgaagacaccatgacatataaatgtcctcgaattacaaaagcagaaccagacgatgtagactgttggtgcaatgcaacggatacttgggtcacatatggtacttgttcaagaaccggggaacatcgtagggataaaagaagcgttgcgctggcaccacacgtcggcctcggtcttgaaacccgcgcggagacctggatgtcatccgaaggagcatggaagcaaattcaaaaagtagaaacctgggcgttaagacatccgggttttactgtcatagccctatttttagctcacgccattggaacgagcataacccaaaaagggataatttttattttgctgatgctggtaacaccaagtatggcaatgcgctgtgtcggtataggaaaccgagactttgtagaaggactaagtggcgcgacatgggtagatgttgtacttgagcatgggagctgtgtgacaactatggcaaaggataaaccaacactagacattgagttacttaaaaccgaggtgacaaagccagctgtacttcgtaaactgtgtattgaagcaaagatttcgaatacaacaacagattctagatgtccaacacaaggagaggcaacactagtggaagagcaggatgcgaatttcgtttgcaggagaacattcgtagatagaggctggggtaatggctgtggattatttggaaaaggaagtttaatcacgtgtgcgaaatttaaatgcgtaacaaaattagaaggaaaaattgttcagtatgaaaacctaaaatatagcgtaatagttacagtacacactggtgatcaacatcaggtcggaaacgaaacgacggaacacggaacaattgcgacgattacgccccaggcaccaacatcggaaatacaactaaccgattatggagcactaacattagattgctcgcctaggaccggcttggattttaatgagatggtactacttactatgaaagaaaaatcatggctagttcacaaacaatggttcttagatttaccactaccatggacaagtggagctagtacccctcaggagacatggaatagggaagatctattagtaacatttaagacagctcatgcgaaaaaacaagaggtggtagtattggggtcacaggaaggtgcaatgcacaccgcgcttacaggggcaacagagatccagacttcagggacgactaagatcttcgcagggcaccttaagtgccggttgaaaatgaacaaacttacactaaaagggatgagttacgtaatgtgcacgggatcttttaaactagagaaagaagtcgcggaaacacagcacggtacagtcctggtccaagtaaaatacgagggaacggatgcaccttgtaaaatacctttttcaacgcaagatgaaaagggtgtaacacaaaatggtcgattaattacggcgaatcctattgtgactgataaagaaaagccagtgaatattgaggctgaacctccttttggagaaagctacatagtagtaggggctggagaaaaagcattaaagctttcttggttcaaaaagggatctagtataggaaaaatgttagaagcgacagcaaggggagcgcgtcgaatggcaatcttaggagacacagcttgggactttggtagcattggaggcgtcttcacatcggtaggcaaattagttcaccaaatttttggaactgcttacggtgtgctgttttccggtgtctcttggactatgaagataggtataggaatactactgacatggctaggcttgaactctcggtcagccagtctgtcaatgacttgtattgccgtaggaatggtaacattatatttgggtgtgatggtacaggccgatagcggctgtgtaattaattggaagggcagggaattaaaatgtgggtccggtatatttgttacaaatgaggtacacacatggaccgagcagtataaatttcaagcagattcacctaagagattaagtgctgcaataggtaaggcgtgggaggaaggtgtatgtggcatcaggtctgcgacaagacttgagaacataatgtggaagcaaatatctaatgaattaaaccatatactcctagagaatgatatgaaatttacagttgtagttggggatgtatcgggcattttgacccaaggcaggaaaatgatcggaccccaaccgatggaacacaaatacagctggaaaagttggggaaaggcaaaaataattggcgctgatgtacaaaataccacatttatcatcgacggcccaaatacgcctgaatgtcccgatgatcaaagggcctggaatatttgggaagtagaggattatggcttcgggatatttacaaccaatatatggctaaaactacgtgacagttatacccaggtttgcgacccaaggttaatgagcgcagccatcaaagattctaaagctgtacatgccgatatgggctactggatagagtctgaaaagaacgaaacgtggaagctagctagagccagtttcatagaagtgaagacatgcgtctggccgaagagtcatacgctatggtccaacggtgttctagaatctgaaatgatcattccgaaaatatatggaggcccaattagtcaacataactacaggccagggtacagtactcaaacagccggcccttggcatttaggaaaactagaattagattttgacctgtgcgaaggaactaccgtcgtggtagatgaacattgtggcaatagaggaccgagtttaagaactactactgtgactggtaaaattatacatgagtggtgctgcagatcttgcactctgcctcccttgcgtttcaaaggagaagatggctgctggtatggcatggagatcaggcctgttaaagataaagaagaaaatttagtcaaatcacttgtatcagctggctccggtgaagtagatagttttagcctcggactactgtgtatctcaattatgattgaagaagtaatgcggtcaaggtggtcccgaaaaatgcttatgactggtactttagcagtctttttactgctaataatgggtcaattaacctggaatgatttgatacgcttatgcataatggtaggggcaaatgcaagtgaccgcatgggcatgggcactacatatctagcactaatggcaaccttcaaaatgcgacctatgtttgccgtcggtttgttgttccgaagattaacatcaagagaagttctgttattaacaataggcctctcactcgtagcgtcggtagaactaccgaatagtctagaagaacttggggacggacttgctatgggaataatgattttaaaactgctaacagattttcaatcacatcagttatgggcggcgctactaagtctgaccttcataaaaactactttttcattgcattatgcctggaaaacggtagcaatggtactatcaatagtatcactatttcccctttgccttagtactacaagtcagaaaacgacatggttgcctgttttgttaggcagcctcggatgtaagcctctgacgatgttcttaatcgccgaaaataaaatatggggccgaaaatcctggccgttaaatgaaggtattatggctgtcggaatagtttcaatattattaagtagtttactcaaaaacgatgtcccgctagcaggccctcttattgcgggcggaatgttaatagcatgctatgtaatcagcggctcatccgctgatctaagcctagaaaaggctgctgaaataagttgggaagaagaagctgaacacagtggggcgagtcacaacatactggtagaagttcaagacgatggaacaatgaaaattaaagacgaagaaagagatgatactcttactatacttcttaaagccaccttactagctgtaagtggtgtttatccaatatccatccctgctacactttttgtgtggtatttctggcaaaagaaaaaacagcgaagtggtgtattatgggatacaccatctccaccagaggtagagcgagcagttttggatgacggtatttaccgaattttgcaacgcggtttattaggtagatctcaagttggagtaggggtctttcaagagggagtgtttcacacgatgtggcacgtgacaagaggagcggttttaatgtatcaagggaaaagattggaaccatcatgggcatctgtaaaaaaagatctgattagttacggggggggatggcgatttcaaggatcctggaatacaggagaagaagtacaggttatagccgttgaacctggaaagaatccaaagaacgtgcagactgcaccggggacttttaaaacccccgaaggcgaagttggagccatagcactcgatttcaaaccaggaacttcaggcagcccaatagtcaatagggaaggcaagattgtaggtctctatggcaacggcgtagtgactacaagtggaacttatgtgagtgcaatcgcgcaagccaaagcaagtcaagaaggtccattgcctgaaatagaagacgaagtctttagaaaaagaaatctaaccataatggatctacacccaggttcaggaaagacaagaaggtacctccccgcgatagtccgcgaagctataaaaaggaaattacgaacactaatattggctcctacgcgcgttgttgcaagtgaaatggctgaagcgctaaaaggaatgcccatccgatatcaaactacagcagttaagtctgagcataccggaagagagatagttgatcttatgtgccacgctacgtttaccatgagacttttatccccagtcagggttcctaactataacatgataattatggacgaggctcatttcacagacccagcatccatagcagcacgagggtatatctcgacgagggtgggcatgggtgaggctgcagctatctttatgaccgcaacgcctcctggctctgtagaagcgtttccgcaaagcaacgcagtaatacaagacgaggaaagagacatacctgaacgttcttggaactcaggctacgattggataacagatttccctggtaaaaccgtgtggttcgtacctagtataaagtcaggaaacgatattgccaattgccttaggaaaaatggtaaacgcgtaatccaactatcaagaaaaacctttgatacagagtaccaaaaaacgaaaaataatgactgggattatgtggttacgactgacataagtgaaatgggagctaattttcgtgcagaccgcgtaattgatccaagacgttgtctaaaacctgttattctcaaagacggtccagagagggtcatattggctgggccaatgccggttacagtcgctagcgctgcccaaaggagaggtcgaataggtcggaatcaaaataaagagggcgatcaatacatctacatgggacagccattaaataatgatgaagaccatgcccattggacagaagccaaaatgctacttgataacattaatacacctgaaggaataatacctgcgctattcgaacctgaacgtggaaaatctgcggccatagatggagaatacaggcttcgaggagaagcaagaaagactttcgtagaactaatgagaagaggagacttgcctgtatggctttcgtacaaagtcgcctcggaaggctttcaatattcagaccgaaagtggtgttttgacggcgagcgtaacaaccaagtgttagaagaaaatatggacgttgaaatttggaccaaagaaggagaaagaaaaaaattacgaccaagatggctggatgcaagaacgtactctgatccccaagctctcagagaatttaaagaatttgctgcgggccgacgaagcgtcagtggtgacttaatattggaaattggaaagttaccccaacatcttactcaaagagcgcagaatgcattggataatctcgtaatgctacataattcagagcaaggtggtaaagcgtaccgacatgctatggaggaactacccgatactattgagacattaatgctccttgcattaattgcagtgttaacaggaggagtaaccctattttttctatcaggcaggggcttagggaagacatctatcggactactatgtgtaatggcatcgagcgtactactttgggtagcttcagtagaaccacactggatcgctgcctcaataatattagaattcttcctaatggtactgctaatacccgaacctgatagacaaagaacccctcaagataatcaactagcttacgtggttataggattgttattcatgatactaacagtcgcggcaaatgaaatgggtctattggaaactaccaagaaagacctgggtattgggcatgtagccgtagaaaatcaccatcatgctactatgctagatgtcgacttacgtccagcctcagcttggactctttacgcagtagccactacgataatcaccccaatgatgaggcatacaatagaaaacacaacagcaaacatatccctgacagcaatcgcaaaccaggccgcaatcctcatgggcctagataagggatggcctatttcaaaaatggatattggagtaccattattggccttaggctgctattctcaagtaaatccactaactttaatcgcagctgtgttaatgttggtagcccattacgcgataatcggtccgggtttacaggctaaggccactagagaagctcaaaagcgaacggcagcagggatcatgaagaatcccacggttgatggaatagtagcaatagatctagatcccgtagtatacgatgctaaatttgaaaaacagctcggacaaataatgttgttaattctctgtacttcacagatcttactgatgcgaacaacatgggcgttgtgtgaatctataacacttgctacaggcccccttactacattgtgggagggaagcccaggaaagttctggaatacaactatcgctgtatcgatggcaaacatattcaggggcagctatttagccggagcgggactagctttctcattaatgaagtcgctaggtggagggcggagaggaacgggagcacagggagaaacactgggagaaaaatggaaacgacagttaaatcagttaagcaagagcgaattcaatacttacaaaagaagcggtattatggaagttgataggtcggaagcgaaagaaggtttgaaacggggcgaaacgactaagcatgcagtatcaagaggtacagccaaactgagatggttcgttgaacgtaatttagtaaagccagaaggcaaagtaatcgatcttgggtgtgggagagggggctggtcatattattgcgccggacttaaaaaagttactgaagttaagggctatacgaaagggggacccgggcatgaggaaccaattccgatggctacatatgggtggaatttagtcaaattacatagcggaaaggatgtgttttttactcctccagaaaaatgcgatactctactctgtgatattggagaaagttcacctaatcccacaattgaagaagggaggaccttaagagtgttaaaaatggtggaaccttggctacggggaaatcaattttgtattaaaatattaaatccatacatgccctcagtcgtagaaacgcttgaacagatgcaacgaaaacatgggggcatgttagtgagaaatcctttatctcgtaactcaacgcacgaaatgtattgggtctcttgcggaacaggcaacatagtctccgcagtgaatatgacaagtcggatgttgctaaacaggtttacaatggcacatagaaaacccacatatgaacgagacgtagacttaggggctgggacacgtcatgtagcagtagaaccggaagtagcaaatttagacatcatcggtcaaagaatagaaaatataaaaaacgaacacaaaagcacatggcattacgatgaagataatccatacaaaacgtgggcatatcatggaagctatgaagtaaaaccgtcaggatctgcgtcgtcaatggttaatggagtggtcaggttattaactaagccgtgggatgttataccaatggtcacccaaatagctatgacagatacaacaccattcgggcagcaaagggtgtttaaagaaaaggttgacaccagaactccgaaagcgaagagaggaactgcacaaataatggaagtcaccgcgagatggctgtgggggtttttatctcgaaacaaaaagccccgaatatgcacacgggaagagttcacaaggaaagttcgaagtaatgccgcgattggagcggtatttgtagacgaaaaccaatggaacagtgccaaagaagcagtggaagacgaacgattttgggatttggtacaccgagagcgagaattacacaagcagggcaaatgtgcaacgtgcgtgtacaatatgatgggtaaaagagagaaaaaactaggggagttcgggaaagccaagggatcaagagcgatatggtacatgtggttaggtgctcgcttcctcgagtttgaagcactcggatttatgaacgaagatcattggttctcacgggagaattccttgagtggagtagaaggggaggggctacataaattaggttatatattaagggatatctcaaaaatacctggaggaaacatgtatgcagacgatacggcgggatgggacactcgaattacggaagacgacttacaaaatgaagcaaaaataacagacataatggagccagagcatgcattgttagcaacctcaatattcaaactgacttatcaaaacaaagtcgtaagggtccagcggccagctaaaaatgggacggtaatggacgttattagcaggagagatcaaagaggctctggccaggtaggtacctatgggctaaacacttttacaaacatggaagttcagcttatacgtcaaatggaaagtgaaggcatattttcgcccagcgagctagaaacaccaaacttggcagaacgagtattggattggttagaaaaacatggagtagagcgactgaaaagaatggctatatccggtgatgattgtgtcgtaaaacctacggatgatagattcgccacggcattgacggcactaaatgatatgggtaaagtcagaaaagatatacctcagtgggaacccagcaaagggtggaatgattggcaacaagttcccttttgttcacatcactttcaccaactaattatgaaagacggacgggagattgtggtaccttgtaggaaccaagatgagttagtaggacgagcgcgagtatctcagggggctggatggtcattaagggaaacagcatgcctaggaaagtcttacgcacaaatgtggcagctaatgtacttccataggagagatctaaggttagcagctaatgctatctgtagcgcagtaccaattgactgggtcccaaccagtcgaactacttggtctatacacgcacatcaccaatggatgactactgaagatatgcttagtgtatggaacagagtgtggatagaggaaaatccctggatggaggacaaaactcacgtaagttcatgggaggacgttccatacctaggtaaaagagaagatcaatggtgcggttctctcattggtttaactgcaagggcaacttgggctacaaacatccaagtagctataaaccaagtcagacgattgataggtaatgaaaattacctagactatatgacgagcatgaaacgcttcaaaaacgaaagtgatttagagggagcattatggtag

SEQ ID NO: 22130 - RNA, 9879 nt, synthetic construct
  misc_feature 1..9879: note = derived and/or modified CDS sequence (opt6) from DENV-1__KR024708__SS-prME
  source 1..9879: mol_type = other RNA
agtgtgacaatgcttttaatgttgctacctactgcgctagcatttcacctgacaacacgaggaggagaaccacacatgattgtgtcaaaacaagaacgtggaaaatcattactcttcaaaacatctgctggcgttaatatgtgtacacttatagcaatggatcttggagaactctgcgaggacacaatgacgtacaaatgcccaaggataacagaggcggaaccggacgatgtggattgttggtgcaacgcaaccgacacgtgggttacctacgggacttgttcacaaacgggcgagcataggagagacaaacgatccgtcgcactagcgccccacgtaggactgggactggaaactaggacagaaacttggatgtcttctgagggcgcttggaaacaaatacagaaagtagaaacttgggcactgcgtcatcctggattcacagtaattgcgctattcctagcacacgcaattggtacgagtataacccaaaaaggaatcatatttattttactaatgttagtaacacccagcatggcaatgcgatgcgttggtataggaaatcgagactttgtagagggtctatcaggagcgacatgggtagatgttgtactcgaacatggtagctgtgtaactactatggcgaaaaacaaacctaccttggacatcgaactcctgaagacagaggtcaccaatcctgctgttttaaggaaactctgcatcgaagcaaaaattagtaataccacgacggattcaagatgtcccacacaaggtgaagcaacattagtggaagaacaggatgctaatttcgtatgtaggagaacatttgtggacaggggatggggaaacggatgcggcttattcggcaaaggatcattacttacttgtgctaagttcaaatgcgtgacaaagttagaaggcaaaattgtacaatacgaaaatctaaagtatagtgtaatagtaacagtccatactggtgatcaacaccaggtaggaaatgaaacaaccgaacatggtactatagctaccatcactccacaggccccaacttcagaaatacagttaaccgattacggtgcacttactttagattgctcccccagaacgggattagacttcaatgagatggtattactgaccatgaaggaaaagagttggttggttcacaaacaatggttcctagatctaccacttccgtggacctctggtgcgagtacttctcaagaaacttggaaccgacaggaccttttggtaactttcaaaaccgctcatgccaagaaacaagaagtagtagtattaggcagccaagaaggtgcgatgcacaccgcactcactggagcaaccgaaatccaaacttcaggtaccacgaccatattcgctggacatctcaagtgtcgtctaaaaatggataaactaacactgaagggagtttcatatgtaatgtgcaccggcagctttaaattggaaaaagaagttgcagaaacccaacatggaacagtcttagtccaagtaaaatatgaaggcactgatgctccatgtaaaattcccatttcaacacaagatgaaaagggggtgacacaaaacggaagactaataacagctaatcctatcgtcacagataaggagaagccagtgaacatagagacagagcctccttttggggaatcatatattgtcattggagccggtgagaaggctttaaagctatcctggttcaagaaaggctcatccataggcaaaatgtttgaagcaacagctagaggggcacggagaatggcaattttaggagatacggcatgggatttcggatcaataggcggggtatttacttcagtaggcaaactggtacatcaagtattcggtactgcttacggagtactattcagtggagtgtcatggactatgaagataggaatagggatattgctgacgtggctagggcttaattctaggtcgacttccctaagcatgacgtgtatagctgttggcatggtaacgttgtaccttggtgttatggttcaagcggactcagggtgtgtcattaactggaaggggcgtgagctgaaatgtggttccggtatctttgtgacgaacgaggtccatacatggacagagcaatacaaatttcaagctgatagtccaaaaagactctctgcagcgataggaaaggcctgggaggagggagtgtgtggaattagatccgctacacggttagaaaatattatgtggaaacaaattagtaacgaattaaaccacattctattagaaaacgacatgaaattcacagtggttgtgggcgacgcaaatgggatacttacccaaggcaagaaaatgattagaccccagccaatggaacataaatatagttggaagtcttggggcaaagcaaaaatcataggagctgacacacagaacacaacatttataattgacgggccggacacacccgaatgcccagatgaccaaagagcatggaatatttgggaagtggaagattacggctttggtgtattcacgaccaatatatggttaaagttaagggactcttacacgcaaatgtgcgatcatagattaatgtcggccgcgatcaaggactcaaaggccgtccatgcagacatgggatattggatcgaaagtgagaaaaatgaaacatggaagttggccagagcctcattcatagaggttaaaacatgtatatggccgaggagccatactttatggtctaacggagtgttagagagtgaaatgatcatcccaaaaatctatgggggacccatctcacaacacaactataggccagggtacttcacccaaactgcagggccatggcatttaggtaagctcgagttagactttaatctgtgcgaaggaacaaccgtcgtagtcgatgaacattgtgggaaccgaggaccctcattacgaactaccacagtcacgggaaagatcattcacgaatggtgttgtcgatcgtgtactcttccaccattgagattcagaggagaagacggatgctggtatggaatggaaataagaccagtgaaggagaaagaggaaaacctggttaggagtatggtgtcggctggtagcggagaagtcgattcattttcactcgggctactctgtgtgtcaatcatgatagaagaggttatgcgttcccgatggtccagaaagatgttgatgacggggacgcttgcagtattcttcctactcataatgggacagttgacttggaacgatctaattagactatgtatcatggttggagctaacgtgagtgacagaatgggaatggggacaacatatttagcgttaatggcaacatttaaaatgagaccgatgttcgcagtcggtctgttatttcgacggttaacttcacgtgaggtactactactgaccatcggattatcgctagtagcttcagtagaattacctaatagcttagaagaactaggcgatggcctggcgatgggtataatgatgttaaaactgctaacagatttccaatctcatcaattatggactaccttactgtctttaacctttataaaaactacgcttagtttagattatgcatggaaaacaatggcgatggtactcagtatagtcagcctcttccccctatgtcttagcactacgtcgcaaaagacgacttggcttccagtgctacttggttctttcggttgcaagcccttaacaatgttcttaataaccgaaaataaaatatggggcagaaagtcttggcccctcaacgagggaataatggcagtgggaattgtgagtatattactgtcaagtttattgaaaaatgatgtgccactagcagggcccttaatagccggaggaatgttgatagcgtgttatgtaataagcggatcctcggccgacctaagcctagaaagagccgcagaagtttcctgggaggaagaggctgaacatagcggagcttcgcataacattctggtcgaagtacaagacgatggcacgatgaaaattaaagatgaagaaagagacgacacacttacaatcctcttgaaagctacacttctagccgtgagcggggtgtatccaatgtctatcccagcaactctattcgtttggtacttctggcagaaaaagaaacaacgttcaggagtgctttgggacacccctagcccaccggaagttgagagggcagtgttagatgatgggatttacaggatcttacagcgaggacttttaggtcgatcacaggttggagtgggtgtattccaagacggggtattccatacgatgtggcatgtcacacgtggagctgtattaatgtaccaaggaaaaagattagaaccaagttgggcgtctgttaagaaagacttaatatcatatggtggcgggtggagatttcaaggtagttggaacacaggcgaggaggtacaagtaattgcagtggagccgggtaaaaatcctaaaaatgttcaaacgacccccggaacctttaaaacaccagaaggcgaagtgggagcaattgccttagattttaaaccaggtacaagtgggtcaccaatagtaaatcgagaaggaaaaattgtcggactatatggaaacggtgtagtaacaactagcggtacgtatgtatctgcaattgctcaagccaaagccagtcaagagggaccgctacccgagatagaggacgaagtattcaagaaacgaaatctaactattatggacctgcatcctggttccggaaagacgagaaggtatttaccagccatagttcgagaggcaatcaaacgtaaattgaggaccctgatattggcaccgactagagtagttgcatcggaaatggcagaggcgttaaaagggatgccgataagatatcaaactaccgctgtaaaaagtgaacatacgggaaaagaaatagtcgacttaatgtgccacgcaacattcacgatgagactactcagccccgtaagagtacctaattacaatatgattattatggacgaagcacacttcactgatccagcctcaattgcagcaaggggttacatatcaacacgtgttggtatgggtgaggcagcagcgatattcatgactgccacccctccgggatctgtcgaatcattcccgcagtccaacgctgtcatccaagacgaggagcgtgatattcctgaaaggtcttggaactcagggtacgactggataaccgactttccaggtaaaactgtatggtttgtaccatcaatcaaaagtggaaatgacatagcgaattgtttaaggaaaaatggcaaaagagttatacaactatcacgcaaaacatttgacactgagtaccagaaaactaaaaataatgattgggattatgtagttaccacagatatatctgaaatgggtgcaaattttcgtgcggatcgggtaatagatcccagacgttgccttaagccagtaattttgaaagacggacctgaaagagtaattttagccgggccaatgccggtcacagctgcatcagccgctcagcgtagaggacgtattggcagaaaccaaaataaagagggtgatcagtatatttatatgggacaaccacttaataacgacgaggatcatgcacactggacagaagcaaagatgctcttagacaatataaacacacccgagggtatcattccagcacttttcgaaccagaacgagaaaagtcagcagcaatcgatggagaatatagattacgtggtgaagcacgcaaaactttcgtagagttaatgcgtagaggggatctccctgtttggttaagctacaaagtagcaagtgaaggctttcagtactcagatagaagatggtgctttgatggcgaacgaaacaaccaggtactagaagaaaatatggatgtggaaatatggacgaaagaaggagaaagaaagaaattgaggcctagatggttagatgcgaggacctatagtgatcctctagctctaagggaatttaaagaatttgctgcaggtagaagatcagtctcaggagatcttatactcgaaatcgggaaactacctcaacatctcacgttacgagcccagaatgcacttgacaaccttgtcatgttacataattctgaacaaggcggaaaagcctataggcacgcaatggaagaactaccagatacaatagaaacattgatgctactagcactgattgcggtgctaacagggggagtcacgctattctttttatctggcaaaggacttggcaaaactagcataggattgctatgcgtcatggcatctagtgtactactttggatggcatcggtggaaccacattggatagctgcgtctataatcctagagttctttttaatggtattattgattcccgaaccagacagacaaagaacaccccaagacaatcaacttgcctacgtagtgataggcctcctttttatgatactgactgttgcagccaacgagatgggactcctagaaacaacaaagaaagatttgggtattggacatgtggtagccgaaaatcatcatcatgcgactatgctagacattgacctacatcctgcttccgcatggaccctgtatgctgtcgccacaacaataataacaccaatgatgcgacacacaatagaaaacacgacggctaatataagtttgacagcaatagccaaccaagctgcaatactgatgggattggataaaggctggcctatatcgaaaatggacattggtgttccattactcgccttaggatgttacagtcaagtcaaccctctgacattgactgcagctgtgctaatgctagtggcacactatgcaatcatcgggccgggactccaagctaaagcaacaagggaagctcaaaaacgtacagcagcaggcatcatgaaaaatcctactgttgatggaatagtagctattgatttagacccagtggtctatgatgccaagttcgagaaacagctgggccaaataatgctgcttattctctgcacatcacagatactattgatgagaacaacctgggcattatgtgaatctataaccctcgctactgggccattaaccacactctgggaaggttcaccaggaaagttttggaatacaacaatagcagtttcaatggcaaacatattccgcggaagttacctagccggtgcaggtctcgcattttcactaatgaagtcattaggagggggtagaagaggtacaggagcgcaaggtgagacgctaggggaaaaatggaaacgtcagctaaatcaactatcgaaatcagaatttaacacttataaacgctctggtataatggaagttgaccgatctgaagccaaagaaggtcttaaaagaggagaaacaactaaacacgcggtatcacgaggcacagcaaaattgagatggttcgtggaacgaaacttagttaaaccagagggaaaagtgatcgatttgggatgtgggcggggcggatggagttattattgtgcaggtctcaaaaaggtaacagaggtaaaagggtatactaaaggtggaccgggacacgaagaaccaatccctatggcaacatatggctggaacatcgtaaaactccattccggaagagacgtatttttcacaccgccagaaaagtgtgacactcttctatgtgatatcggagaatcgagtcccaatcctactatagaggagggcaggacactacgagttctgaaaatggtcgaaccttggctcaggggaaatcaattttgtattaaaatactaaacccatacatgcccagcgtagtagagactttagagcaaatgcaacgaaaacacggaggaatgcttgtacgaaatccgcttagtaggaactctacacacgaaatgtattgggtaagctgtggcactggtaatatagttagtgcggtgaacatgacgtccagaatgcttttgaacagattcacaatggcgcatagaaagcctacttacgagagagacgtggacctaggcgcaggtacccggcacgttgccgtagaaccggagattgcaaatttagacattattggtcaaaggattgaaaacatcaaaaatgaacataagtccacatggcattatgatgaggataacccatataaaacgtgggcataccatggcagctatgaggttaagccttcaggatctgcatcttcaatggtcaacggcgtggtgcgcttactcacaaaaccatgggatgttataccaatggtaactcaaattgcgatgactgataccaccccattcggccaacagagggttttcaaagagaaggtagatactagaactccaagacctaagcgagggacagcacaaataatggaggtaactgcaaaatggttatggggattcctatcaagaaacaagaaaccgagaatttgcacccgagaagaatttactcgtaaagttcgaagtaacgccgcaataggagctgtatttgtggatgaaaatcaatggaacagtgcgaaagaagctgtagaagatgagagattctgggacctagtacacagagaaagagaattacacaaacaaggaaagtgcgccacttgcgtgtacaatatgatgggtaaaagagagaagaaactgggcgagtttggtaaagctaaaggctcaagagcaatatggtatatgtggttaggagccagatttctagaatttgaggcattgggtttcatgaacgaagaccattggtttagtcgggaaaactctttaagcggagtagaaggcgaaggtcttcataaactaggatatatattacgtgatatatcaaagataccaggaggcaacatgtacgctgatgacactgcggggtgggatacacgtattactgaagatgacttacaaaacgaagctaaaataaccgacataatggaacctgagcatgcattgcttgcaacttccatattcaaactgacatatcagaataaagtagtgcgagtacaacgtcctgcaaagtcaggtacagtaatggatgtaatatcacgcagagatcagagagggagtggtcaagtgggcacatatggtcttaacacatttacaaatatggaggtacaacttatcaggcaaatggagtcagaaggtattttctcacctagcgaactggaaaattcaaacttagcagagagggtactagattggctcgaaaaacacggggtggaaagactaaaacgaatggccatttcgggtgatgattgcgttgttaaacctacagacgatagatttgctaccgccttaacagccctcaacgatatgggtaaagtaagaaaagacataccacaatgggaacccagcaagggatggaatgattggcaacaagtacctttctgctcacatcactttcatcaactgattatgaaggacgggagggaaatagttgtcccttgtcgaaatcaagatgagttagtaggacgagcacgagtaagtcaaggagcaggttggtcattaagggagaccgcatgcctagggaagtcctatgcccaaatgtggcaattaatgtatttccatcgaagagatttgagacttgccgccaacgcgatctgctcagcagttcctgtgaactgggtaccaacttctagaacaacatggtctatccatgcacatcatcaatggatgacaactgaagacatgctttcagtttggaacagagtgtggatagaggaaaatccgtggatggaagataaaacgcacgtttcgagctgggaagacgtaccataccttggcaaaagagaagatcagtggtgtggctcactaattggcttaacggcacgagcaacgtgggcaactaacatacaagttgcaattaatcaggttcgaagattaattgggaacgagaattatctcgattacatgacatcaatgaaaagatttaaaaacgaaagcgaccctgaaggcgctctctggtaa

SEQ ID NO: 22131 - RNA, 9879 nt, synthetic construct
  misc_feature 1..9879: note = derived and/or modified CDS sequence (opt6) from DENV-1__KR024705__SS-prME
  source 1..9879: mol_type = other RNA
tccgtaaccatgctcctaatgctactaccaactgcactggcatttcacctaactactcgaggaggagaaccacatatgattgtttctaaacaagaacgtggtaaatctcttttgttcaaaacaagtgcaggagtcaatatgtgtaccctaattgcaatggacctaggagaattatgcgaagacacaatgacatacaaatgcccacgcataaccgaagccgaaccggacgatgtagactgttggtgtaatgctacggacacgtgggtaacttatggaacatgttctcaaacaggagaacatcgaagggataaacggagtgttgctttagcgccccatgtaggtcttgggttagaaacgaggaccgaaacatggatgagttcagaaggggcttggaaacaaattcaaaaagtcgaaacatgggccttacggcatccaggatttactgtcattgctctttttcttgcccatgctattgggacaagtataacacaaaaagggataatctttatattactaatgctagtaaccccaagtatggcaatgaggtgcgtaggtattggtaatagagacttcgtagaggggctctccggtgcaacctgggttgatgtggtacttgaacatggatcctgcgtaaccacaatggctaaaaataaacctactttagatattgaacttctcaaaactgaagtcactaatccggcggtattacgcaaactctgcattgaggctaagatatctaatgcaacaacggatagtcgatgtccaacacagggtgaagcgactttagtagaggaacaagatgcgaattttgtctgtcgccgcacctttgtagatagagggtggggaaacggatgtggcttatttggtaaaggttcactattaacatgcgcaaagtttaaatgtgtcaccaaactcgagggcaagattgttcaatatgaaaatctaaagtattcagttatagtaactgtacacacgggtgaccagcatcaagtaggcaatgagacaactgaacatggtacgatagcgaccataacacctcaagcccccacatcagaaattcaactaacagactacggcgccttaacactagattgttcacctcgaaccggacttgatttcaacgaaatggtattactcacaatgaaggaaaaatcatggcttgttcataagcagtggttcctagatttgccattgccctggacctctggcgcctccaccagtcaagaaacatggaaccgccaggatctattagtcacttttaagacagcacacgccaagaaacaagaggtggtagtactaggatcgcaagagggagccatgcatactgccctcacgggtgcgacggaaatacaaacttctgggacaacaaccattttcgccggccatttaaaatgtaggcttaaaatggataaattgacactgaaaggagtctcttatgtcatgtgtaccggtagcttcaaacttgaaaaagaggtcgcagaaacacaacatggaacagttctagtacaagttaaatacgaaggaactgatgcaccgtgtaaaattcctatatcgactcaagacgagaagggtgttacacaaaatggacgcctaataacggccaatcctatcgtcacggacaaagaaaaaccggttaacatagaaaccgaaccaccattcggtgaaagctatatagtgataggcgctggagaaaaagcactaaagttatcttggttcaaaaagggttcatcaattgggaaaatgttcgaagctacagcacgaggtgcaaggcgtatggcaatattaggtgatacagcatgggactttggatcgatcggtggcgtatttacatcggtaggcaagttagtacatcaagtatttggaacagcttacggtgtattgttttctggggtatcatggacaatgaagattggtataggtattctattgacatggttggggctaaattcgagatctacaagtctttcgatgacatgtattgcagtaggtatggttactctttatctcggagttatggtccaagctgacagtggctgcgtgatcaattggaagggtagggaattgaagtgtggctcagggatattcgtaacaaacgaagtacatacgtggacagaacaatacaaatttcaagccgactcacctaaacgactatctgcagcaattggaaaagcatgggaggaaggggtatgcggcattagaagtgccacaagactagaaaacataatgtggaagcagattagtaacgaactaaatcatatactacttgaaaatgatatgaagttcacagttgtggtaggggatgcaaacggcatattaacgcagggaaagaaaatgatacggcctcaaccaatggagcacaaatattcctggaaaagttggggtaaagcaaaaataattggagccgatactcaaaatacgactttcatcatagatggacctgacacaccagaatgccccgatgatcagagagcatggaatatatgggaggttgaagattatggttttggcgtatttacgaccaacatctggctaaaattaagagatagttacacgcaaatgtgtgaccaccggctaatgagtgccgcaataaaggattcaaaggccgtacacgcagatatgggttattggattgaatcagaaaagaatgagacctggaaactagcacgcgccagcttcatagaggtaaaaacgtgtatatggccgcgatctcatactctatggtctaacggtgtcctagaatccgagatgattataccaaagatatatggtggtcctatctcgcagcataattacagacccggctacttcacacagacagcaggaccgtggcatttgggaaaactagagctggatttcaatctatgtgaaggaacgactgtggtcgtagacgaacattgcggaaacagaggaccaagtttaaggacaaccaccgtcacaggaaaaattatccatgaatggtgctgccggtcatgcacactacctccgctgagatttagaggcgaggacggatgctggtatgggatggagataaggccagtgaaggaaaaagaagaaaatttagtaaggtcaatggtaagtgctggcagtggtgaagtagattccttctctcttggattgctgtgtgttagcataatgattgaggaagttatgcggtcgcgatggtcacgaaaaatgctcatgacggggacattagcggtattctttctcttaattatggggcaactcacctggaatgatctaataagactatgcataatggtcggagccaacgtatcagacaggatgggtatggggacaacatatctagcattaatggctacatttaaaatgcgtccaatgttcgcagtgggtttattatttagacgactaacatcacgggaagtattactacttacaataggcctatcactggtagcgtcggtggaattaccaaattctcttgaagaactcggagatggattagctatgggaattatgatgttaaaacttctcacggacttccagtctcatcagctatggacaacacttcttagcttaacatttataaaaaccacactcagtcttgactatgcttggaagactatggctatggtactatctatagtcagtctgtttccattatgcctgagtacaacaagtcagaaaaccacgtggcttcctgttctattaggctccttcggatgcaaaccgttgacaatgtttctcatcacagaaaataagatctggggacgtaaatcttggccattaaacgaaggtataatggctgtgggtatagtcagtatattattgagttcattgctaaagaacgatgtcccattagcgggaccgttgatagcagggggcatgctaatagcctgctacgttataagcggatcctcagctgacctctcacttgaaagggccgcagaagtctcctgggaagaggaagccgaacactctggagctagccataacatcctagtagaggtccaagatgacggtaccatgaaaattaaagacgaggaaagagacgatacattgaccatattgctcaaagcaacattactagcggtttctggtgtgtatccaatgagtatcccagcaactctcttcgtgtggtatttctggcaaaagaagaaacaaagatcaggcgtcctctgggataccccgtcccctccagaagtcgaacgcgctgtactagacgatggaatctaccgcatcttgcaaagaggtttactaggtcgcagtcaagttggtgtcggtgtttttcaagacggcgtatttcatacaatgtggcatgtgacaagaggtgcagtactgatgtaccagggaaaacggttagaacccagttgggcttctgtcaagaaagatcttatcagctatggtggtggatggcgtttccaagggtcatggaacacgggagaagaagtgcaggtaatagctgtggaacctggcaaaaatcccaaaaacgtacagacgactcctggaacctttaaaactccagaaggcgaagtaggagctatagccttagattttaagcctgggacctcgggctcaccaatcgtaaatagggaagggaagatcgtaggactatacggaaatggtgtagttacaaccagtggcacatatgtttccgcaatagctcaagcgaaagcaagtcaagagggacccttgccagaaatagaagacgaagtcttcaaaaagaggaatcttaccataatggatctgcatcctggtagcggaaagactcgaaggtatttacccgctatcgtacgggaggctataaaaagaaagttacgtaccttgatccttgcaccaacacgagtagtagcctcagaaatggcagaagcactgaaaggaatgccaattagatatcaaactacggcggttaaatcagaacataccggcaaggagattgtggacctaatgtgccatgcaacattcaccatgcgcctacttagcccagtaagggtaccaaattacaatatgatcattatggatgaagctcattttacagatccagcgtctattgcagcgaggggatatatcagcacaagagtgggcatgggagaagctgctgctatatttatgacggccacaccacctggaagtgtcgaagcctttcctcagagtaatgcagtcatacaagacgaagaaagagacatacctgagcgaagttggaatagtgggtacgattggataactgatttccccggaaagacagtatggttcgtaccatcaataaaaagtggtaatgatatcgcgaattgtttaagaaagaacgggaaacgagtgatccagctatctagaaagactttcgacacagagtatcagaaaactaagaataacgattgggactatgtggttacaacagacatatccgagatgggggcgaacttccgtgctgatcgagtaatagaccctaggcgttgtcttaagcccgtaatacttaaagatggcccagaacgggttatattagccggtcccatgcctgttacggctgcatccgcagcacaaaggagaggacgtataggccgcaaccaaaacaaagagggcgatcagtatatatatatgggacagcccttaaacaacgatgaagatcatgcacattggacagaagctaaaatgcttttagacaacattaacacgcccgaaggaatcattcctgcgttatttgagccggaaagagaaaaatcagctgctattgatggagaataccgactgcgcggcgaagcacgcaaaacatttgtggaacttatgcgacgtggagatttaccagtttggctgtcatacaaagtagcaagcgagggtttccaatactcggacagaagatggtgttttgacggtgagcggaataaccaagtattagaagaaaatatggatgtcgaaatctggaccaaagaaggagagaggaagaaactacgaccacgatggttggacgctaggacgtactcagatccactcgcactaagggagttcaaagagttcgccgccggtaggcgtagcgtatcaggcgatttaatattagaaatagggaaactcccacaacatctaacgctaagagctcaaaatgctctagacaacttggtaatgttgcacaactcggaacagggaggaaaggcctacaggcatgccatggaagagttaccagacacgatagaaacgcttatgctattagcactcatcgcggtactaactggaggagtaacattattcttcctaagcggcaaagggttaggtaaaacaagcatcggacttttgtgcgttatggcctcatcagtcctcctatggatggccagcgtggaacctcattggatcgcagcctcaattatcttagagttctttctgatggtcttattaattccagaaccagacagacagagaacaccacaagacaatcaactagcttatgtggtgatagggttactatttatgatacttaccgtagcagcaaatgagatgggattacttgagacaactaagaaagatctgggaataggacatgttgtggcagagaaccaccaccacgctaccatgttagatattgacctccatccggcctccgcgtggacgctatacgcagttgctaccactattataacccctatgatgagacacacaatagaaaatacaacggcaaatatatctttaacagccattgcaaatcaggcagccattctcatgggtttagataaagggtggccaatatcgaaaatggacataggtgtcccattattagcgttaggctgctatagccaagtcaatcctctcacactgacggccgctgtgctaatgttggtcgcacattatgccatcatagggcccggtcttcaagcaaaggccacaagagaagcacaaaagcgaacggcagcggggataatgaaaaaccctacagtagacggaatagtagcgatcgacttggatcctgtggtatatgatgctaagttcgagaaacaactaggccaaattatgctgttaatactatgtacatcgcaaatactcttaatgaggacgacctgggcgctgtgtgagtcaataacgctagcaactgggcccctaactacgctatgggaaggttcgccaggcaaattttggaacaccaccatagcagtcagcatggctaatatatttagggggagttatctagcaggagctggtttagcattcagcctaatgaagagtctcggaggcggcagacgaggtactggagcacaaggagaaacgttaggagaaaaatggaaacggcaactaaatcaactttcaaaatctgaatttaatacatacaaaagatcaggaatcatggaagttgacagaagtgaagccaaagaaggtctcaaacgaggcgagacaactaaacatgctgtatccagaggaacagcgaaattacgatggttcgtagaacggaatttagttaaacctgagggcaaagtaattgaccttggctgtggccggggaggttggtcctattactgcgccggcctaaagaaagtcactgaggtgaaggggtatacgaaaggagggccaggacatgaagaacccattccaatggcaacctacgggtggaatatcgtaaaactacactctggcagagatgtattcttcacaccgcctgaaaagtgtgacaccttattatgcgatataggagagtcaagtcctaatccgacaattgaagaaggaagaactctcagagtactaaaaatggttgagccttggttacgaggaaaccaattttgtattaaaattctaaatccatatatgccatccgtagtggaaacactagagcaaatgcaaagaaaacatggagggatgctagtaagaaacccgttaagcagaaattcaacccatgagatgtactgggtaagttgtggaacagggaatatagtctctgccgtcaatatgacaagtaggatgttactcaatcgttttacaatggcgcatagaaaaccaacatacgaaagggatgtcgatctaggtgccggaaccagacacgtagcggtcgaacctgaaatagctaacctagatataataggacagcggattgagaatatcaaaaacgagcataaatcaacctggcattatgacgaagataacccttacaaaacttgggcttaccatggctcgtacgaagttaaaccttcagggtctgcatcttcaatggtaaatggtgtagtgcgattattaacaaagccatgggatgtaatccctatggtcactcaaattgcaatgactgatacgacgccctttggtcagcagcgtgtattcaaagaaaaggtagacacccgaacgccaagaccaaaaagaggaacagcgcaaatcatggaggtaacagctaaatggctatggggatttttatcccgaaacaagaaaccacgtatctgtactagggaagagttcacacgcaaagtacgcagtaacgcagcaataggagcagtatttgtagacgaaaaccaatggaatagcgcaaaagaagcggtggaagacgaacggttttgggatcttgtccatagggagagggaattacataaacagggcaaatgcgctacatgtgtatacaacatgatgggaaaaagagaaaagaagctaggagaatttggaaaagctaaagggtcaagagcaatctggtatatgtggttaggcgctaggtttctagaatttgaagctcttggattcatgaacgaagatcattggttttctagagaaaattccttatctggagtcgagggtgagggattacataaacttggttatatcttaagagatatatcaaaaataccgggcggcaacatgtatgcagatgacacagctggctgggatacaaggatcacagaagatgacttgcaaaacgaagcaaaaattaccgatatcatggaaccagaacatgcattattagctacaagtatatttaaacttacatatcaaaacaaagtcgtcagagtacaacgaccagcaaagagtgggacagttatggatgtaatctctcgaagggaccaaagaggttcaggacaagtaggcacatacggactgaacactttcacaaatatggaagtacaactaataagacaaatggagagtgaaggaatattttctccatctgaattggaaaattctaacttggccgagagggtattggattggttggaaaaacacggggtagaacgattaaagagaatggccatctcaggagacgattgtgttgtcaaacccacggacgaccgtttcgcaacagcgttaacagcattgaatgatatgggaaaagtaaggaaagatataccacagtgggaaccgagcaaaggatggaatgactggcaacaggtcccattttgttcgcaccattttcaccaactgataatgaaagacggaagggaaatagtcgtgccatgtcgtaatcaagacgagttggtaggtcgagcccgggtttcgcagggtgcaggttggagtctgagagaaacagcttgcctaggaaaatcctacgcccaaatgtggcaattaatgtattttcatcgaagagatttgaggctcgctgctaacgcgatctgctctgcagttccggtaaactgggtaccaacaagtagaacaacttggagcattcatgctcaccatcaatggatgaccacagaagatatgctaagtgtttggaatagagtatggatagaggagaatccatggatggaagacaagacacacgtaagttcttgggaagacgttccctatttgggaaagagagaagatcaatggtgtggttctttgataggtctgacagcgagagcaacatgggctaccaatatacaggtggcgattaatcaagttaggagactaattggaaacgaaaactatttggactacatgacgagcatgaaaaggttcaaaaacgaaagcgaccccgagggcgcactgtggtaa

SEQ ID NO: 22132 - RNA, 9879 nt, synthetic construct
  misc_feature 1..9879: note = derived and/or modified CDS sequence (opt6) from DENV-1__KR024706__SS-prME
  source 1..9879: mol_type = other RNA
agtgtaacgatgctattaatgttattaccaacggcactggcatttcatttaactactcgaggaggggagcctcacatgatagtttctaaacaagaaagaggaaaatcactactttttaaaacctcagcaggagttaatatgtgcacactaatagctatggatcttggagagctatgcgaagacactatgacatataaatgtccacgaataactggtgcagaaccagatgatgtagattgctggtgtaacgctactgacacatgggtaacatacggaacatgttcacaaacaggcgagcataggcgagataaaaggagcgtagcactagcgccccacgtggggttaggtttagaaacacgaactgaaacctggatgtcgtcagagggggcctggcgacaaattcaaaaagttgaaacatgggctttacgtcatccagggtttacagtaatcgcattctttctcgcccacgcaataggaacaagtataactcaaaaaggaatcatctttatcctactgatgttagtaactccatcgatggcgatgcgatgtgtaggaattggcaaccgagatttcgtagagggattatcaggcgctacttgggttgatgtagtgctagaacatggttcatgtgtaaccacaatggccaaaaacaaaccaactttagacatcgagttattgaaaacagaagtaaccaatccggcagtattaagaaaattatgcatcgaagcgaaaataagcaatactaccacagacagtcggtgtcccacccaaggagaagccacactggtggaagaacaagacgcgaattttgtttgtcgaaggacccttgtagatcgagggtggggtaatggttgtggtctctttggtaaaggctcattgcttacttgcgcgaaatttaaatgcgttacaaaactggaaggaaaaatagttcaatacgaaaatttaaaatatagtgtaattgtaactgtacacaccggtgaccaacatcaagtaggaaatgaaacaacagaacacggtaccatagctacaattacaccacaagcaccaacgtccgaaattcaattaacagattacggcgcccttacacttgactgttctccgaggacgggtctcgactttaatgaaatggtgcttttgacaatgaaagagaaaagttggcttgtccacaaacaatggtttttagatttaccattgccttggacatcgggagcatcaacaagccaagaaacatggaataggcaagatctgctagtaaccttcaaaactgctcatgccaagaaacaagaggtagttgtattaggttctcaagagggtgcgatgcatacagcgcttacaggggcaactgaaatacaaacatctggtacgaccactatattcgctgggcatttaaaatgccgactcaaaatggataagttaacattaaaaggtgtgtcatatgttatgtgtaccggatcgtttaaattagagaaagaagtggccgaaacacagcatgggaccgttttagttcaggtaaaatacgaaggaactgatgcaccctgcaaaatacccataagcactcaggatgaaaaaggcgtaacacaaaatggaagactgataactgccaatcctatagttacagataaagaaaaaccagtaaatatcgaaacagagcctccttttggagaaagctatatcgtaataggtgcaggagaaaaagcactaaaactgtcatggttcaagaaaggatcgtcgataggaaaaatgttcgaagctaccgcgaggggtgctagaagaatggccattcttggagatacagcatgggactttggtagcataggaggggtttttacttccgtaggaaaacttgttcaccaggtatttggtacagcttacggggttctatttagcggagtcagttggacaatgaaaataggaatcggcatacttctaacatggctgggattaaattcaagatccaccagtttgagcatgacatgtatagcagtaggcatggttactctgtatttgggtgtcatggtccaagcggattcaggttgtgttataaactggaaagggagagagctcaagtgtggttccggaattttcgtaaccaatgaagtccacacttggacagaacagtataaatttcaagcagacagtcccaaaagactatcagccgcaattgggaaggcttgggaagaaggggtgtgtggaatcagatcagccacaagattagaaaatataatgtggaaacaaataagtaatgaattgaatcacatacttcttgaaaacgacatgaaatttaccgtcgtagtgggagatgccaatggtatcctcacccaaggcaagaaaatgatacgaccacaaccaatggagcacaagtacagttggaaaagctggggtaaagcaaaaattattggagccgatactcagaacacgacatttatcatagatggacctgatacgcctgaatgtcccgacgaccaacgagcgtggaacatatgggaagtagaagattatggtttcggtgttttcacaactaatatatggctaaaattaagagactcatatacacaaatgtgtgatcatcgtttaatgtctgccgcgattaaagactccaaagcagttcatgccgatatgggttactggatagaatccgagaaaaatgaaacctggaagctggcacgagcttctttcatagaggttaaaacttgcatctggccacggtctcatactctatggtccaatggtgtacttgaatcggaaatgatcataccgaaaatctacggaggaccaataagccaacataactatcgacccgggtatttcactcaaacggctggcccatggcatctaggaaaactagagttagattttaacctatgcgaaggcaccacagtagtggtcgacgaacattgtggcaaccgcggtccgtctttgcggacaacgacggtaacaggtaaaataatacatgaatggtgctgccgatcatgcaccctgcctccgctgcgttttcgtggagaagacggatgttggtatgggatggaaatccgaccggtaaaggaaaaagaagaaaatctagtcagaagtatggtttcggccggttctggtgaggtagactcattttcattggggttattatgtgtatctataatgattgaggaagtaatgagaagcagatggagtcggaaaatgctcatgactggaactttggcagtattctttctgcttatcatgggtcagcttacgtggaacgatttaatacggctgtgtataatggtaggggctaacgtatcggatcgtatgggaatgggtacaacctacctagcactcatggcgacatttaaaatgcggcctatgtttgccgtcggactcctcttcagacgtctgacatccagggaggtattattactcaccataggtctaagtctggtggcgtcagttgaattgccaaatagcttagaagaactaggtgacggtctagcaatgggtataatgatgctaaaactactaaccgatttccaaagtcaccagctatggacaacattattaagtcttactttcataaaaactactctatctttagattatgcatggaaaacaatggctatggttctaagtattgtcagcttattccctctatgtctatcaacaacttcgcagaaaactacctggctaccagtactgcttggtagttttggatgtaaaccattaactatgtttctcattactgaaaataaaatatggggtagaaaatcatggccgcttaatgaaggtattatggctgtaggcattgtatcaatattactatccagcctattaaagaacgatgttcctttagccgggccgttaatagccggtggaatgctaatcgcatgctatgtaatttcaggcagttcggcagatctttctctagagagagccgctgaggtttcatgggaagaagaagcagaacatagcggagcatcgcacaacatcttggtcgaagtgcaagatgacgggacaatgaaaataaaagacgaagaaagagacgacacattaacgatactcctcaaagctaccttattagcagtaagcggagtctatccaatgtctatacccgccacgctctttgtttggtatttttggcagaagaagaaacaacgttctggagtcctttgggacaccccatcacctccagaagttgagcgagctgtattagacgatggcatatatcggatacttcaaagaggactcttgggaaggtcgcaagtaggcgtaggagtattccaggatggtgtgtttcacactatgtggcatgtaacaagaggagcagtcttaatgtaccaaggaaaacgtctagaaccaagctgggcatcagtcaagaaagatctaatatcttatggtggtggatggcggtttcaaggaagttggaataccggggaggaggtacaagtcatagctgtagaaccaggcaaaaatccgaagaatgttcaaaccacccccggaacatttaaaacccccgaaggtgaagtaggtgcaatagctctcgatttcaagccgggaaccagtggaagtccaatcgtaaatagggaaggcaagattgtaggtttgtatggaaacggagtagttacgacgtcaggaacgtacgtgagcgctatagcccaagcaaaagcgagccaggaaggaccattacctgagattgaggatgaagtatttaagaaaaggaacttaacaataatggatctacatcctggttctggcaagactcgaagatacttgccggctatcgtgcgcgaagctattaagagaaaactgagaaccctaatactagcaccgactagagtcgtcgccagtgagatggcagaggcactcaagggaatgccgattagatatcagaccacagcggtaaagtctgagcatacaggaaaagaaatcgtagacctcatgtgccatgctacttttacgatgcgtttactaagcccagttagggttcccaactataatatgattatcatggatgaagcacatttcacagacccagcttccatcgcagcaagaggatacataagcacaagagtcggaatgggcgaagctgctgctatcttcatgacggctacaccacctggttcagtcgaagccttccctcaatctaatgctgttattcaagacgaagaaagagacatacctgaaagatcctggaactcgggatacgattggattaccgactttcccggcaaaactgtctggttcgtaccaagtataaaatcaggtaatgatatagcaaattgtttacgtaaaaatggtaaaagagttatacaactaagtagaaaaacattcgacacggaatatcagaaaaccaaaaataatgactgggactatgtagtgacaaccgatatatcagaaatgggtgcaaactttcgagctgaccgggtcattgacccgaggagatgtctgaagcccgttatattaaaggatgggcctgagagagtaattttggctggaccaatgccagtaaccgctgcttcagcagctcaaagaagaggccggatcgggagaaatcaaaataaggaaggagaccaatacatatacatgggacaacctttaaacaatgatgaagatcatgcgcattggacagaagctaaaatgctgctcgataacataaatactccagaaggaataattccagcccttttcgaaccagaaagagaaaagtctgcagccatagatggggaataccgcttaggaggagaagcccggaaaacttttgtagaattgatgaaacgaggagacctaccagtttggttatcctataaagtggctagtgagggttttcaatattccgaccgtaggtggtgcttcgatggggagagaaataatcaagtattagaggaaaacatggacgtggaaatatggaccaaagagggcgaacgaaagaagctaaggccacgatggttggacgcacgaacatatagtgatcctctcgcccttcgcgagtttaaagagttcgctgccggccgaagaagtgtaagtggagatttaatactcgaaattggtaaactgcctcaacacctcacactaagagcccaaaatgcgctggacaacctcgtaatgttacacaattcagaacaaggcggtaaagcctatcggcatgcaatggaggaattgccagataccatagaaacactaatgttactagcactcattgctgttctaaccggcggcgtcactttattctttttatcagggaaaggactaggaaaaacttcgatagggcttctgtgcgtaatggcatcgtcagtgctactctggatggcttcagttgaaccgcattggattgccgccagcattatcctagagttctttctcatggtcctgttaatccccgaaccagataggcaaaggacgccacaagataatcaactcgcatacgtggtaataggcttgctctttatgattctaactgtggcagctaatgaaatgggattgttagaaaccactaagaaagacttaggaataggtcatgttgtagccgaaaatcaccaccacgccactatgcttgatatagatctccaccccgcatctgcatggacgttgtacgccgttgcaactacgatcataacacccatgatgagacatacgatagaaaacacaacggctaatatatcgttaacagctatagctaatcaagctgccatcctcatgggtcttgacaaaggttggccaatctcaaagatggacatcggtgttcctcttttggcacttggctgctacagccaagtaaatccattaacacttacagcagctgtacttatgttagttgcacattacgcaatcataggcccgggactacaagcgaaagctaccagagaagcacagaaaaggacagcagcaggtattatgaaaaatccaacagttgatggaatagttgcaatagatttggatcccgtggtatacgacgcaaaattcgagaaacaattagggcagataatgttgctaatcttatgcacttctcagatattattaatgagaactacgtgggctctctgtgaatcaataacactcgctacgggacccttaacgacattatgggaaggctcccccggaaaattctggaacacaacgattgcggtatcaatggcgaacatattcaggggatcgtatttagcgggggccggactagcatttagcttaatgaaatctcttggaggaggtcgaagagggaccggcgcacaaggagaaacacttggcgaaaaatggaaaagacaattaaatcaacttagtaaatcagagttcaatacgtacaaaagaagtggcattatggaggtggatagatctgaagccaaagaaggattgaagaggggcgaaacaactaaacatgcagtatcaaggggtactgcaaaactaagatggtttgtagaacgaaatttagtcaaacctgaaggcaaggttattgatctcggttgtggacgcggaggttggagctattattgcgcaggactgaagaaagttacggaggtaaaagggtacacaaaagggggaccaggccacgaggaacctatacctatggcaacttacggatggaacattgtcaagctacacagcgggcgagacgtattctttactccacccgagaaatgcgacactctattatgcgacattggtgaatcctctcctaatccaacgatcgaggaagggcggacactaagagtactcaaaatggtcgaaccatggttgagggggaatcaattctgtatcaaaatcttaaatccatatatgcccagcgtggtagagactttggaacaaatgcaaaggaaacacggaggtatgttagttaggaatccactaagcagaaattcaacccacgagatgtattgggtgtcttgtggtaccggaaatattgttagcgctgttaatatgacgagccggatgctccttaataggttcacgatggcacatagaaaaccaacatatgaaagagatgtagaccttggtgcagggaccagacacgtagcagtcgaaccagagattgcaaatctagatattataggacaacgaatcgaaaacatcaaaaatgaacataagtccacatggcattatgatgaagataatccctacaaaacttgggcctatcatggctcatacgaagttaaaccgagtggatcggcaagtagcatggttaatggtgtcgttcgactattaaccaaaccgtgggatgtcatacccatggtaacccaaattgctatgaccgacaccaccccctttggacaacaaagagtatttaaagaaaaagtcgatacgaggacacctagaccaaaaaggggaacagcccaaataatggaggtaactgctaaatggttatggggatttctaagtcgaaacaagaaacctagaatatgcacaagagaagagtttacgcggaaagtaagatcaaatgctgctattggagcagtatttgtagacgagaatcagtggaatagtgcaaaggaagctgttgaagacgaaagattttgggatctcgttcatagagaaagagaattacacaagcagggtaaatgcgccacctgtgtgtataacatgatggggaaaagagagaagaaactaggcgaatttggcaaagcgaaaggtagccgggccatctggtacatgtggcttggcgcccgcttcctggaatttgaagcgttagggtttatgaacgaagaccattggtttagtagagagaactcgttgtctggtgtggaaggtgaaggattacataagttggggtatatcctacgcgatatttctaaaataccgggaggaaacatgtacgccgatgatacggctggatgggatacaagaatcacagaagacgacttacaaaacgaagcgaagataacagacattatggagccggaacacgctctcctagcaacatctatatttaaactaacctatcaaaataaggtagttcgtgttcaaagacccgccaaaagtggtacagtgatggatgtcatttcgcgacgagaccagagggggtccggtcaagtaggaacgtatgggcttaatacttttactaatatggaagtacaactaatacgacaaatggaatcggaaggcatattctctccaagcgaattggagaactctaatctcgctgagagagtgctagattggctcgagaaacatggggtagaaaggcttaaaagaatggcaatatctggagatgactgtgtggtcaagccaactgacgatagatttgcgactgcattaactgcattaaacgatatgggtaaagtacgaaaagatattcctcaatgggaaccgagtaaaggttggaatgattggcaacttgtcccattctgttcccatcactttcaccaattaataatgaaagacggcagagagattgtagtaccgtgccgaaaccaggatgaacttgtagggagagcacgagtctcacagggtgccggatggagcctcagagagacagcctgtttaggaaaatcgtacgctcagatgtggcagcttatgtattttcatcgaagagacttaaggttagcagcgaatgcgatctgttctgcagtaccagtaaattgggtaccaacaagtcgaactacgtggtcgattcacgcccaccaccaatggatgactactgaagacatgttgagcgtctggaatagagtatggatagaggaaaatccatggatggaagataagacacatgtatcatcctgggaagatgtaccgtacctaggaaaaagggaagatcaatggtgtggaagtctaatcggcttaacagccagggcgacgtgggcaacgaatatacaagtcgctataaaccaagtaagaagattaattggaaatgagaattatctcgattatatgacgtcaatgaaaagattcaaaaacgagagcgacccggagggagcgttatggtag

SEQ ID NO: 22133 - RNA, 9879 nt, synthetic construct
  misc_feature 1..9879: note = derived and/or modified CDS sequence (opt6) from DENV-1__KR024707__SS-prME
  source 1..9879: mol_type = other RNA
agcgtcactatgctactaatgctgctacctactgctttagcctttcatctaacaacacgagggggtgagcctcatatgatagtaagtaaacaagaaagaggtaaatcgcttctattcaaaacgagcgcaggagttaatatgtgtactcttattgcaatggacttgggagaactatgcgaagatacaatgacatacaaatgtcccagaataacggaagcagaaccggatgacgttgattgttggtgtaatgcgactgatacctgggttacatatggaacctgtagtcaaaccggagaacacaggagggataaaagatcggtagcactggcaccccatgttggtctaggcctcgaaacaaggacagagacctggatgtcttcagagggggcatggaggcaaatacaaaaagttgagacatgggcgcttagacatccagggttcacggttatagcactatttttggcacacgctataggtacatcaataacacaaaaagggataatattcatactcttaatgctcgtaacgccctcaatggcaatgagatgtgtgggtataggaaatagagattttgtggaaggattgagcggagcaacctgggtagatgtagtactggagcatggttcatgtgtaacaacaatggctaaaaataaaccaacattagatatagagctactgaaaacagaagtaacaaatccagcagtactccgtaaattgtgtatagaagctaaaatctctaatactacgacagattctcgctgtccgacacaaggcgaagcaactttagtggaagaacaagacgcgaatttcgtgtgtcgcaggaccttcgtagaccgaggctggggaaatggctgtggattgtttggaaaaggatctctactaacatgtgcaaaatttaaatgcgttacgaaactggaaggcaaaattgttcaatatgagaatttgaaatattccgtaatagttactgtccacactggagaccaacatcaagtaggaaatgaaacgaccgaacatggcacgatcgccacaattacgccacaagcgcctaccagtgagatacaattaactgactatggagcattaactctcgactgttcacctcgaactgggttagatttcaatgaaatggtgttgttaacaatgaaagaaaaatcttggcttgtccacaaacaatggtttttggacttgcctctcccctggaccagcggggcttcgacaagccaagaaacctggaatcgacaagacttgctggtcacgtttaaaaccgctcacgctaagaaacaggaggttgttgtactaggtagtcaagagggtgcaatgcacactgccttaacgggagccaccgaaatacaaacatcaggtacaaccaccatatttgctggccatctcaaatgtcgattaaaaatggataaattaactctaaaaggagtatcgtacgtaatgtgcacaggctcatttaaattagaaaaagaagtagccgagacacaacacggaacagttctggtccaagttaaatatgaaggaacagatgctccgtgtaaaattccaatatcgacgcaggacgagaaaggagtgacacaaaatggcaggttaattactgcaaatccaatagttacagataaagaaaaaccagtaaatatcgaaacagagccaccatttggtgaatcgtacatagtcataggcgcaggcgaaaaagctcttaaattgtcctggtttaaaaagggatcttcaattgggaaaatgtttgaagccactgcgcgcggcgccagaagaatggctattttaggagacaccgcttgggactttggaagtattggcggcgtttttacatcagtgggcaagctggtccatcaagtattcggaacagcgtatggagtgcttttctccggcgtctcatggacgatgaaaatcggaatcggaatattgttaacctggctagggttaaacagtagatccacaagtttatcgatgacatgcatagctgtaggcatggtgaccttataccttggtgtgatggttcaagccgacagtggttgcgtgataaactggaagggtcgagaattaaagtgcggcagcggaatttttgtcaccaatgaagttcatacatggacagaacaatataaattccaggcagactcaccaaaaagactttcagccgcaattggtaaagcgtgggaagaaggtgtatgtggaattaggagtgcgacaagacttgaaaatattatgtggaaacagatcagtaatgaattgaaccacattttgttggaaaatgatatgaagtttacagtagtagttggcgatgcgaatggcatcttgacccaagggaagaaaatgattcgcccacagcccatggaacataagtacagttggaaatcctgggggaaggccaagataataggagcagacacccaaaatacgacttttataatagatggcccagatactcccgaatgccccgatgaccaacgagcatggaatatttgggaggtcgaagactatggtttcggggtttttactacgaacatatggttgaaacttagagatagctatactcaaatgtgtgaccatagattaatgtcagccgcgataaaagattctaaagcagttcatgctgacatgggatattggatcgaaagtgagaaaaacgaaacttggaaactcgcccgcgcgagtttcattgaggtcaaaacgtgtatttggcctagaagtcatacactctggagtaatggcgttttggaatcagaaatgataataccgaaaatatatggaggcccaataagtcaacataattatagaccaggttatttcactcaaactgccgggccatggcatctaggtaaattggaactggactttaacctatgtgaaggtacaacagttgtagtagacgaacattgtggaaacaggggcccatccttacgtaccacgacggtaaccggcaaaataattcatgaatggtgttgtagatcatgtacgttaccaccccttagatttcggggagaagatggttgttggtacggcatggagattcgaccggttaaggaaaaggaagaaaacttagtaaggtcaatggtctcagctggatcgggtgaagtcgattccttcagtctaggcttgttatgtgtatcaataatgatagaggaagttatgagatcaagatggtctcgtaagatgttaatgaccggaactttagctgtattctttctcctgatcatgggtcagctcacctggaacgacctaattagactatgcatcatggtaggagcaaatgtctctgaccgtatgggaatggggactacatatcttgctttaatggcgacgttcaaaatgcgtcctatgttcgcagtaggactgttatttagaagattaacaagcagggaagtacttctactcacaattggtttaagcctagtcgcatctgtcgagttaccaaattcattggaggaacttggagatggcttagccatgggaatcatgatgcttaagctgcttacagactttcaaagccatcaattatggaccaccctactatccctgacatttataaaaactacactttcattagattacgcatggaaaacaatggcaatggttcttagcattgtctctttatttccactctgtctgtcgactacaagtcagaaaactacttggttgcctgtacttttaggatcattcggatgtaaacctttgacaatgtttcttataacagaaaacaaaatttggggtaggaaatcttggccactaaacgagggaattatggcagttggtatagttagcatcctattatcctccttactcaaaaatgatgtgccactcgcaggtcccctaatagctggaggtatgttgatagcgtgctacgtaatttcaggcagctcagcggatctatcattggaacgtgctgcagaggtttcttgggaagaggaagcggagcattccggagcatcccataatatcctagtggaggtccaagacgatggtacgatgaagataaaagacgaggaacgtgatgacaccttaactatattactaaaagccacgttgttggcggttagcggagtgtatcctatgtcaattccagcaactctatttgtatggtatttctggcagaaaaagaaacaacgctcaggcgttttatgggatacaccaagccctcctgaagtggaaagagcagtattggacgacggaatatatagaatactacaacgaggtttattggggagatcccaagtcggggtcggcgtattccaggatggtgttttccatactatgtggcacgtgacaagaggtgccgttttaatgtatcagggaaaacgattagaaccttcctgggcatcagttaagaaagatctcatcagctacggaggtggatggaggtttcagggctcatggaacacaggagaagaagttcaagtgatagccgtagaaccaggcaaaaatcctaaaaatgtacaaacaacacctggtacattcaaaacgccagaaggagaagtaggcgctatagcactcgattttaagccgggcacatcaggatctccaatagttaatagggaaggcaaaatagtaggtttatatgggaacggtgtagtgactacaagtggcacctatgtctccgctattgcccaagcgaaggcatctcaggaagggccgctaccagaaatagaggacgaagtattcaagaaaagaaacctaaccataatggatttacatccgggcagcggaaagacacgcagatatctgcccgcaatagtgagagaggctattaaacggaaattgaggacactaatcttagctccgacgagagtcgtagcctccgagatggcggaagccctcaagggtatgcctatacgttatcaaactacagctgttaaaagcgaacacactggaaaagaaatcgtggacttaatgtgccacgcaacctttacaatgcgtttactaagtcctgtcagggtccccaattataatatgattataatggacgaagctcattttacagatccggcaagcatagcggctaggggatatattagtacacgagtaggtatgggtgaagcagcagcaatatttatgactgccactccgccaggaagcgtcgaggcgtttcctcaatcgaatgcagtaatacaggacgaagaaagggatattcctgaaagatcttggaacagcggatacgactggattacagactttccaggcaagacagtatggttcgttccttcaataaagtccggtaacgatatagcgaattgtctcaggaaaaatgggaaacgagtgatacaattatcacgaaagacatttgacacagaatatcagaaaacgaaaaataatgactgggactacgtggttacaacagacatatctgaaatgggcgcaaattttcgagcggatcgggttatagacccgagaagatgtttgaaaccggtgattttaaaagatggaccagaacgagtaattttagcaggtcctatgccggtaacggcagcatcggcggcacaacggcgcggaagaatcggtcgcaaccaaaataaagaaggagaccaatacgtatacatgggacagccgttaaacaatgatgaagaccatgctcattggacggaagcaaaaatgttattagataatataaacaccccggaaggtataataccggctctcttcgaacccgaacgcgagaaatcagctgcgattgatggagaatatagactcagaggtgaagctaggaagacatttgttgagttaatgcgtaggggtgatctgccggtctggctatcgtacaaagtagcctctgaaggatttcaatactcagaccggagatggtgttttgacggggaacgtaataatcaggtgctggaagaaaacatggacgtggaaatatggactaaagaaggcgaaagaaagaagttacgccctagatggcttgatgcaaggacatacagcgatcctttagctttgagagaatttaaagaatttgcagcgggcaggcgtagcgtaagtggagatctaatactagagattggtaagctgccccagcacttaactctacgtgcccaaaatgctcttgacaaccttgtaatgttacataatagtgaacaaggaggaaaagcatatcggcacgccatggaggagcttcctgataccattgaaacattgatgttgttaacactcatagcggtattgacaggcggagtcacactattcttcttgtcaggtaaaggactaggtaagacctcgataggattgttatgtgtaatggcgagtagtgttctattatggatggcgtctgtggaaccacattggatagcggccagtattatcctagaatttttcttgatggtcctgttgattccggagcctgataggcagagaacaccgcaagataaccaattggcttacgtagtcataggactactttttatgatcttgacagtcgcagctaacgagatgggtcttttagaaactactaagaaagatttgggaataggacatgtagttgctgagaaccaccaccatgcaacaatgctggatattgatttgcacccagctagcgcatggacactctacgctgtggccactacgatcataacaccgatgatgagacacacgatagaaaatacaacagcaaacatatcgttgacagcaatagccaatcaagcggccatattgatgggattagacaaaggctggcccataagtaaaatggatataggagtcccgctactagctttgggctgttattcacaggtgaatccattaactttgacggcagctgtgctcatgttagtagctcactacgctattatcgggcccggactgcaggctaaagccacacgagaagcgcagaagagaaccgccgcaggaataatgaagaatcctacagtggatggaatagtagccattgatctagatccagtagtttatgatgcaaaatttgagaaacaactaggtcagatcatgctattgatactttgcacatctcaaatcttactaatgagaacgacgtgggccttatgtgaaagcattacattagccaccgggcccctgaccactctatgggagggcagcccaggaaagttttggaatactacaatagctgtatcaatggctaacatatttcggggcagttatcttgcaggagcaggactagctttttcactcatgaaatcattaggtggagggagaagaggtacgggtgctcagggtgaaaccttaggagaaaaatggaaaagacaattaaatcaactaagtaaaagcgagtttaatacttataagcgatcagggataatggaggttgacagaagtgaagccaaggaaggtttgaaaagaggagaaacgactaaacatgcagtatcaagaggtactgcaaaactaagatggtttgtggagagaaacttggttaaaccagaaggtaaggtaattgatttaggatgcggaagaggtggatggtcgtactactgcgcaggtctgaagaaagtaacagaggtgaaaggttatacaaagggcgggccagggcatgaggaaccaataccgatggcaacctacgggtggaacatagtgaagttacacagtggtagggacgtctttttcaccccaccggaaaaatgtgatacactactatgtgacataggagagtcaagtccgaacccaactatagaagaaggaagaacacttagagtattgaaaatggtagaaccatggctacgtggtaatcaattctgtattaaaatactcaatccgtacatgccttctgtagtagagacgctagagcagatgcaaaggaaacacgggggtatgctagtaagaaatcccctgagtagaaatagcacacacgaaatgtattgggtttcatgtggaaccggtaatatcgtatccgctgtaaacatgacaagtaggatgttgttaaatagatttacaatggcacatagaaaaccaacctatgaacgtgacgtagatctgggcgcaggaacaaggcatgtagccgtagagccggaaatcgcaaacctcgatatcataggtcaacggattgaaaacatcaaaaatgaacacaaaagtacgtggcactacgatgaagataatccttacaaaacttgggcatatcacgggtcatacgaggtaaaaccaagtggcagtgcttcctccatggtaaacggggtggtacgactgttgacaaagccttgggacgtgatacctatggttacacaaattgcaatgactgataccaccccttttgggcaacaaagagtatttaaagaaaaggtagacacacgtacaccaagaccaaaacgtggcacagcacagataatggaagttacagcaaaatggctatggggatttttatctagaaataagaaacccaggatctgcaccagggaagagtttactcgaaaagttaggagcaatgcagcgataggtgctgtattcgtcgatgagaatcaatggaactcggctaaagaagcagtagaagatgagagattctgggatctagtccacagagagagagaactacataaacagggcaaatgtgcaacttgcgtgtataatatgatgggtaagagagaaaagaaattgggagaatttggaaaagcaaaaggcagtcgggcaatttggtatatgtggttgggggctcgtttccttgaatttgaagcactaggatttatgaatgaggatcattggtttagccgtgaaaactcattaagtggagttgaaggagagggtttgcacaaattaggatacatattaagagatatttcaaagataccaggagggaacatgtacgcggacgataccgcaggctgggacacacgcatcactgaagatgatttacagaatgaggccaaaataacagatattatggaaccggaacatgctttgttagctacgtccatctttaaactcacttatcaaaataaagttgtaagggtccaaaggccggccaaaagtgggaccgtcatggatgtgatatcaagacgagaccaaagaggatcaggacaggttgggacatatggcttgaacacgtttactaatatggaagtccagttgattcggcagatggaatcggagggcatctttagtccttcagaacttgagaactccaacctagcagagcgagttctagactggcttgagaaacacggcgtggaaaggttgaaacgaatggcgataagtggagacgattgtgtagttaaaccaacagatgatcgattcgccacagcactgacagctttaaacgacatgggaaaggtaagaaaagatataccccaatgggagccctctaaagggtggaatgactggcaacaagttcctttttgcagtcatcactttcaccaactaataatgaaagatggtagggaaatcgtagtcccttgtaggaaccaagacgaattagtgggtcgggccagagttagccaaggtgccggatggtcattaagagagacagcatgtttaggcaagtcatatgctcaaatgtggcaactcatgtatttccatagacgtgatttaagattagcggccaacgctatctgcagcgcagttccagtcaattgggtgccgacatccaggacaacttggtctatacacgcacatcaccaatggatgaccactgaagatatgctttccgtatggaacagggtgtggatcgaagaaaatccatggatggaagataagacacatgtaagtagctgggaagatgttccatatttaggcaaacgagaggatcagtggtgcgggagtttgattggcctaacggcacgggcaacctgggcaactaacatacaagtagcgataaatcaagtaagaaggctaattggaaacgaaaactacctcgattacatgaccagcatgaaacggtttaagaacgaaagcgaccctgaaggcgctctatggtag

SEQ ID NO: 22134 - RNA, 9879 nt, synthetic construct
  misc_feature 1..9879: note = derived and/or modified CDS sequence (opt6) from DENV-1__KC172829__SS-prME
  source 1..9879: mol_type = other RNA
tcagttactatgcttctaatgttgatgcctacagctctcgcatttcacttaacaacaagaggaggagaaccacatatgatagtctctaaacaagaaagagggaaatcacttctatttaaaacttcggccggtgttaatatgtgtactcttattgcaatggatttaggagaactgtgtgaagatacgatgacatataaatgtccgcgaattaccgaagcggaacctgatgatgtagattgctggtgtaatgcaaccgatacatgggttacatatggaacatgtagtcaaaccggtgaacaccggagagataaaagatctgtggcgttagctccacatgtcggattaggactagaaacgcgtaccgaaacgtggatgtcctcagaaggagcgtggaaacaaatacaaagagtagaaacctgggctctacgacacccagggttcacagtgatagctttattccttgcacatgccataggtacttcaataactcaaaaaggaataatattcatacttctaatgctagttaccccatcgatggcaatgagatgtgtagggattggtagtagagactttgtagaaggtctctccggagccacctgggtcgatgtagtactagaacacggatcatgcgttactaccatggcaaaagataagccaacgcttgacattgaactacttaaaacagaagtaaccaaccctgcagtattaagaaagctatgtattgaggcgaagatctcaaacacaacaacagattcacgatgtccaacccaaggagaggcgacgttagtcgaggaacaagacgcaaatttcgtatgcagaagaacgttcgtagataggggatggggaaatggatgtggattattcgggaagggatcactgatcacatgtgcaaaatttaaatgcgtaactaaactcgaagggaaaatcgttcaatatgaaaatctaaagtacagtgtgatagtaacggtacacactggggatcaacatcaagttggaaatgaaagcacagagcatggcactacagccacaattactccacaagcaccaactactgaaattcagcttacggactatggtgctttaacccttgattgtagtccaaggaccgggcttgatttcaatgaaatggtcctcttaacaatgaaagagaaaagctggctagtacacaagcagtggttcttagatctgcctcttccttggacctcgggagcttcaactagccaagaaacatggaatagacaggacttactcgtcactttcaaaactgctcatgcaaagaaacaggaggttgtagtacttggcagtcaagagggagctatgcacaccgccttaacaggggcaacggaaatacaaacctcggggactacaacaatattcgcaggacacctcaagtgtagactcaaaatggataagttgacgttgaaggggatgtcatacgttatgtgtacaggtacattcaaattggagaaagaggtagcagaaacacagcatggaaccgtgttagtacaaattaaatacgagggtacagacgcaccgtgtaagatacccttttcaacacaagacgaaaaaggagttacacaaaatggtcgattaatcacagcaaatccgattgtaactgacaaagaaaagccagtaaatattgaagcagaaccgccattcggcgaatcctatatagtaattggggcgggagaaaaagcattgaaactatcctggtttaaaaaggggagctccatcggaaaaatgtttgaggcaacagcgcggggagcacggagaatggcaatccttggcgatacagcctgggattttgggtctatagggggagtatttacctctgttggaaagctagttcatcagatatttggaacagcgtatggcgtgctatttagcggtgtttcatggacaatgaagataggaataggtgtattgcttacgtggttaggactaaacagccgcagtacgtcattaagtatgacctgtatagccgtcggtttagtaactctttatttaggcgtaatggtacaagcagattcgggttgtgtagtaaactggaaagggcgcgaattaaaatgtggaagtggtatatttgtaactaatgaagtacacacttggacagaacaatacaaattccaagctgactcacccaaacgactttccgcagccataggtaaagcgtgggaggagggcgtatgtgggataagaagcgcaacacgtctggaaaatatcatgtggaagcaaatttcaaacgagttgaatcacatccttttggaaaatgatatgaaatttacggtcgtggttggcgacgtcgcagggattctagctcaaggtaaaaagatgataaggccacaacctatggaatataaatacagctggaaaagctggggtaaagcaaagattataggtgctgatgttcaaaatacaaccttcatcatcgatggtcctaacacaccggagtgtcccgacgaccaacgtgcgtggaatatatgggaagtagaagattacggatttggaatattcactactaacatttggctgaggctcagggacagctacacacaagtttgtgaccatcgattaatgtctgcagcaataaaagattctaaagcagtgcacgctgatatgggctattggatagagagcgagaaaaatgaaacatggaaactagctagagcatcttttatagaagtaaagacctgcatctggccaaaaagtcatactttatggagtaatggagtattagaatcagaaatgataattccgaaaatctacggtggaccaatatctcaacataattatcgaccaggctactttacccaaacagcaggcccgtggcatctaggaaaactcgagcttgatttcgacctatgtgaaggcactacagtagtcgtcgatgagcactgtgggaatagagggccatcactgagaacaacaacagttaccggaaagataattcacgaatggtgctgccgatcgtgcacactaccacccctaagattcagaggcgaagacggatgttggtatggaatggaaatcaggccagtaaaagaaaaagaagaaaacttagtaaagtctatggtgagtgcagggtcgggcgaagttgatagttttagtttgggacttttgtgtatatctatcatgatagaagaagttatgagaagtagatggagccgtaaaatgctaatgacaggtacacttgcagtattctttcttctaatcattggacaactaacttggaatgatcttattcgcctatctataatggtaggagcaaacgcatccgacaagatgggcatgggcactacgtatcttgcactaatggccacttttaaaatgagacccatgttcgcggtagggttactttttcgacggctaacaagccgagaggtattacttcttacaatcggattaagtctagtagcctcggtagagttacctaactcattagaagaattaggtgatggattagctatgggcataatgatccttaagttgttaacagatttccagtcacatcagttatgggcaacactattaagtctcacgtttataaagaccactttcagtctacattacgcatggaagactatggcaatggtcttatcgatcgtctcactatttccattatgcctaagtactacatcacagaaaacaacttggttgccagtgttactaggatccttaggttgcaaacctcttacaatgtttctaatcacagaaaacaaaatatgggggcgtaaaagttggccacttaacgagggtatcatggcagtaggaatagtaagtattctattatccagtctcctaaagaacgatgttccattagctggccctctaatagcaggcggcatgctaatagcctgttatgtaatctccggttcatcagctgatctttcgttggaaaaagcagccgaagtctcgtgggaggaggaagctgaacattcaggcgcatcccataatatcttagtagaggtacaagacgatggtaccatgaaaattaaagatgaggagagagacgataccttaacaatattattaaaagcaacgcttctcgcagtaagcggtgtgtatccgttgtccataccggcaacactattcgtatggtatttctggcagaagaagaaacaaagaagcggagttctatgggatacaccgagtccaccagaggttgaacgggcggtactagatgacggaatttatcgaataatgcaaagaggactactaggaagatcacaagtaggagttggagtatttcaagaaaatgtatttcacaccatgtggcatgtgacacgcggagcggtgttgatgtaccaaggaaaacgacttgaaccctcttgggcttccgtcaaaaaggacttaatatcatacggaggaggatggcgattgcagggtagctggaatactggagaagaggttcaagtaattgccgttgagccaggtaagaatcctaaaaatgtacaaaccgctccaggcacctttaagactaccgaaggggaagtaggagcgatagcgctcgatttcaaacccgggacaagtggctctccaatcgtaaacagagaaggcaaaatagtgggtttatacggaaacggtgttgttacaaccagcgggacgtacgtatctgctatcgctcaggcaaaagcctcccaagagggtccactccctgagatcgaggatgaagtctttagaaaaagaaacttaacaataatggatctgcatcctggttcgggcaagaccaggagatacttacctgcaatcgtacgagaagcaatcaaacgaaaactcaggaccttgattttagcacccacaagagtcgtagcgagtgaaatggcagaagctctgaaagggatgccaataaggtatcagactacagctgtcaaatcagaacatactggaaaagagatagttgatctcatgtgccatgcaacattcacaatgagactattaagccctgtccgagttcctaactataatatgatcatcatggatgaagcacattttacagatccatctagcatcgcagcaagaggctacatatcgacgcgtgtgggaatgggggaagcagctgccatctttatgactgcaacccctccaggatctgtggaagcgtttccacaatcgaacgccgtaatccaggatgaggaaagggatatccctgaaaggtcctggaactcgggatatgaatggatcacggacttttcaggaaaaacagtttggtttgtcccaagtataaaatcagggaacgatatagctaattgtttaaggaaaaatgggaagcgagttatccaattgagtcgcaaaacattcgatacagaatatcaaaagacgaaaaacaacgactgggattatgtagtcacaactgacataagtgagatgggagccaatttccgagcagatcgtgtaatcgatccgaggcgatgcctgaaacctgtgatacttaaggatggacctgaacgtgtcattttggcaggccccatgcccgtgactgtggctagtgcagcacaacggcggggccgaataggtaggaatcacaataaagaaggagaccagtacatctatatgggacaaccattaaacaatgacgaagatcatgcgcactggaccgaagctaaaatgctattggataatataaacactcccgaggggataatcccagcactgttcgaaccggaaagagaaaagagtgctgcaattgacggcgaatatcgtcttaggggtgaggcccgaaaaactttcgttgagctaatgaggcgcggtgacttgccagtttggttatcatacaaagtggcatcggaaggattccaatacagtgatagaagatggtgctttgatggtgaacggaacaaccaagtactagaagagaacatggacgtagaaatctggactaaggaaggagaacgtaagaaacttcgtccgaggtggctagatgctcggacatactcggatccgttggctctaagagaatttaaggaatttgcggctgggagacgaagtgtctcaggtgacctcatattagagatagggaaattaccccaacatcttacacaaagggctcaaaacgctttggataatctggtcatgcttcataattcggagcaaggaggcagagcgtatagacatgcaatggaggaactgcctgatactatagaaactttgatgttattggcattaatagcagtcttaaccggtggtgtaacattgttctttttatcaggaaggggattaggtaaaacatccattgggttattgtgcgtaatggcgtcatctgtgctactatggatggcgtccgttgaaccacactggattgcagcatccatcattctagagttcttcttaatggtcctacttataccagaaccagacaggcaaaggacacctcaggacaatcagttggcatatgtagtaataggactattattcatgatattgacagttgcagcaaatgaaatggggcttctagaaacaaccaagaaagatctagggatagggcatgtagcagacgagaatcaccaccatgctgcaatgctagatgtagatctgcatccagccagtgcatggacgctttacgcagtcgcaaccactatcataactcccatgatgagacatacgatagagaacactaccgctaatatatcattaaccgctatagccaaccaagcggcaatcctgatgggtctggataagggctggcctatctcgaagatggacataggtgtaccgttattggcactaggatgctacagccaggttaatccccttactctaacagccgcggtcctaatgctagtagcacactacgcaataatagggcccggattacaagcaaaagcaactcgagaggcccagaagcggacggccgccggcataatgaaaaatccgacagttgacggaattgtcgcaatagacctcgatcccgtagtctatgatgctaagtttgaaaagcaattagggcaaattatgttactaatactatgtacgtcgcaaatattattaatgcgaacaacctgggcactgtgcgaatcaattactttagcgactgggccactaactaccctatgggaaggttcccctggaaaattttggaacacaaccatcgccgtcagtatggcgaacatatttagagggtcgtatcttgcaggagcaggattagcattcagtttaatgaagtctttaggtggaggaagacgtggaactggagcacaaggggagacattgggcgaaaaatggaaacgtcaactaaatcagttgtccaagtcggaatttaatacttataaaagatcaggaattatggaagtagatagaagtgaagcgaaagagggtttaaaacgaggagaaacaacaaaacatgctgtttcgcgaggtacggcaaagttaagatggtttgttgaacgaaacttagtcaaacccgaagggaaagtaatagacctcggttgcgggagaggaggctggagttattattgtgcaggattaaagaaagttactgaagttaagggatacacgaaaggaggtccgggacatgaggaacctatcccaatggcaacatatgggtggaatctagtgaaattacattcaggcaaggacgtattctttataccacctgaaaagtgcgacactcttctgtgtgatatcggcgaatcaagtccaaatcccacgatagaagaaggaagaactctccgtgtattaaaaatggtggaaccctggcttagaggaaatcaattttgtataaaaattctaaacccatatatgccaagtgtcgtggaaacattagaacaaatgcagaggaaacatggtggtatgttagtgagaaatccactaagcagaaacagcactcacgaaatgtattgggtctcatgtggcacaggaaacatagtgagtgcagtgaacatgacatccagaatgttattgaataggtttacgatggtccataggaaacccacatatgaaagagatgtagatttaggagctggaacaagacatgtagcagtagagcctgaagttgccaacttagacatcataggtcagaggattgagaatataaagcacgagcacaaatctacatggcattatgatgaggacaatccatataaaacctgggcatatcatgggtcttacgaggtaaaaccatccggcagcgccagttcaatggttaatggagtggtaaagctattaacgaaaccgtgggacgttattccgatggtaacccagatagctatgacagatacaacccccttcgggcaacaaagagtttttaaagaaaaggtagataccagaacgcctaaggcaaagagaggaactgcccagatcatggaagtaactgcaaggtggctatggggatttttatcgcgaaataagaaaccaaggatatgtactagagaagaatttacacggaaggtaagatctaatgcagctattggagcagtatttgtagatgaaaaccaatggaacagcgctaaggaagctgttgaagatgaaaggttctgggatctagttcatcgagaacgcgaattacataaacagggtaaatgcgctacatgcgtttacaacatgatgggaaaacgggagaagaaacttggtgaatttggaaaagcgaaaggatcaagagctatttggtacatgtggttaggagctagatttttagagttcgaagccctaggatttatgaacgaagaccattggtttagccgagaaaatagcttgtctggagtagagggtgaagggttacataaattaggttatatactcagagacataagtaaaattccgggtgggaacatgtacgctgatgatacagccggatgggatacaaggattacggaagacgatttacagaatgaggcaaaaattacagatattatggaatcagaacacgccctattagccaagtcaatatttaaattaacatatcagaacaaggtcgtacgggtacaacgaccagccaaaaatggtaccgtaatggacgtgatatctcgaagagatcaacgtggtagtggacaggtaggtacatatggtttaaatacattcacgaacatggaggcacaattgattcgtcaaatggagagtgagggaatattttctccctccgaactagaaactcctaatctcgcagaaagagcattggattggttagaaaaacatggggtggagcggttaaaacgaatggctatttccggggacgattgtgttgttaagccaattgacgatcgatttgctacggcacttacagcactgaacgatatgggcaaagttagaaaagatatcccgcaatgggagccatcgaaaggttggaacgactggcaacaggttccattctgttcacatcatttccaccaacttataatgaaagatggacgtgaaatagtagtaccctgtcgaaatcaagacgagttagtaggtagggcgagggtgtcacagggcgcaggctggagcctaagggaaactgcttgcctagggaaaagttacgcacaaatgtggcaactgatgtacttccacaggagagacttaaggctagctgcaaatgctatttgtagtgctgtccccgtggactgggtaccaacgtcgagaaccacatggagcattcacgcacatcatcaatggatgacgacagaagacatgctttcagtatggaacagagtatggattgaagagaatccctggatggaagacaaaacacatatatcttcctgggaggacgtaccttacttaggcaaaagagaggaccaatggtgtggttcattaatcgggctcactgcccgagcaacttgggctacgaatatccaagtcgctatctctcaggtaagaaggctaataggaaacgagaactacttagattacatgacatccatgaaacgctttaaaaatgaatcagacccagagggtgcactatggtga

SEQ ID NO: 22135 - RNA, 9879 nt, synthetic construct
  misc_feature 1..9879: note = derived and/or modified CDS sequence (opt6) from DENV-1__EU359008__SS-prME
  source 1..9879: mol_type = other RNA
tcggtcacgatgctgttaatgctcatgcctactgcactggcgtttcatcttacaactagaggtggtgaaccacatatgatcgtatcaaaacaagaaagaggtaaaagtctcttatttaaaacttccgcaggagtaaatatgtgtacccttatagcaatggacttaggagaattatgcgaagacacattaacatataaatgcccaagaatcaccgaagcagaaccagacgacgttgactgttggtgtaacgcaactgatacatgggtcacgtacgggacatgttcacagactggagagcatcggcgtgataaacgatcggttgcattagcgccgcatgttggcttaggcctagagacacgcaccgaaacctggatgtcaagcgaaggggcatggaaacagattcaacgggtggaaacatgggcgttacggcatccaggcttcactgtaatagctctttttctagcacatgctatcggtacaagtattactcaaaaaggaattatcttcatactgttaatgttggtaacaccttctatggcaatgcgctgtgtgggcatagggagtagagatttcgtagaagggctgtccggggccacttgggtcgatgtagttttggaacatggaagctgtgtaacaacaatggctaaggacaaacctacccttgacatagagctccttaaaactgaagtgacgaacccagcagttctaagaaagttatgcattgaagctaaaatatcaaacactacaacagatagtagatgcccaacacagggggaagcaaccctcgtagaagaacaagacgcgaattttgtttgcaggagaaccttcgtagaccgtggatgggggaacggctgcggactttttgggaaaggcagtctgatcacatgtgcgaaattcaaatgtgtaacaaaattggaaggtaagatcgtacaatatgaaaatttaaagtattcagtgatcgtaaccgtgcacacaggagatcaacaccaggtagggaatgaaagtacggaacatggaactactgcgaccataacaccacaagctccgacaacagaaatacaacttactgattatggcgccctaacgttggattgtagtccacggaccggactggacttcaacgaaatggtcctactaacaatgaaagagaaaagttggctagttcacaaacaatggtttctagatttaccactaccctggacctcgggagcaagcacaacacaagaaacgtggaatcgacaagacttattggtaacattcaaaaccgcacacgctaaaaagcaagaagtcgtggtgctggggtcacaagaaggagcaatgcatactgctttaacaggagctacggaaatacaaacaagtggaaccaccacaatcttcgcagggcatttaaaatgcaggcttaaaatggataaactcacacttaaaggcatgtcatatgtgatgtgcaccgggtcattcaaactagagaaagaagtagccgagactcagcacgggacagtattagtacaaatcaagtatgaaggcacggatgccccatgcaaaataccgttcttaacgcaagacgaaaaaggagtaactcaaaatggacgtctcataacagcaaatccaatcgttacggataaagagaaaccagttaatatagaagccgaacccccattcggtgagagctacatagtaataggggctggcgaaaaagcgttgaaactctcatggtttaagaaaggttcttccataggcaaaatgtttgaagctactgcgagaggtgcacggcgaatggctattctaggagataccgcatgggatttcggaagcatcggaggcgtcttcacatcagttggaaaactcgttcatcaaatctttgggacagcatacggagttttattctcgggagtctcttggactatgaagatcggaattggtgccctcctaacctggttgggattaaattctcgatcaacctctctatcgatgacatgcatcgcagtaggtctcgtaacactttacttaggcgttatggtccaagcagactccggctgtgttataaattggaaaggtcgagagctaaagtgcggaagtggtatcttcgtaaccaatgaagttcatacgtggacagaacagtataaatttcaagcagatagtccaaaacgcttaagtgcagcaatcggaaaagcatgggaagaaggagtgtgtggtattagatcagcaacacgactagaaaacataatgtggaaacaaatatcaaatgaattaaaccacatactactagaaaatgacatgaaatttaccgttgtagtgggagatgtagcgggcatattagcccaaggcaagaaaatgattcgtccccaaccgatggagcataagtacagctggaagagttggggaaaagctaaaattataggcgcagacgtccaaaatacgacttttatcatcgatggaccaaacacaccggaatgcccagatgatcaaagagcatggaatatatgggaagttgaagattatggcttcggtatctttactacaaatatatggctcaaactaagggactcttatactcaagtatgcgaccacagactaatgtcagccgccatcaaagattcaaaggccgttcatgcagatatggggtactggatcgaatctgaaaagaacgaaacttggaaattagcgagggctagctttatagaagtaaaaacttgtatctggcccaaaagccatacgttgtggagcaacggtgtattagaaagtgaaatgattattcccaaaatttatggcggtcctatatcgcagcataattaccgcccaggctactttacacaaacagcaggaccatggcatctaggtaaattagaactggatttcgatctctgcgaaggaaccaccgtcgttgtagatgaacactgcggcaacagagggccttcactgaggacaacaactgtaactggaaaaataatacacgaatggtgttgtcgatcgtgcacacttccaccgctaaggtttagaggagaagatggatgttggtacggtatggaaattaggcctgtaaaagaaaaggaagaaaatttagtaaaaagtatggtttcagctggatctggtgaagttgattcattctctctaggactcctttgtatatcgataatgatagaggaggttatgcgatcaaggtggtctagaaaaatgttaatgacaggtactttagcagtattctttttattaattatgggacaagtcacatggaatgatctaataagactatgcatcatggtaggcgccaatgcgagtgatcgaatgggcatggggacaacctatctggctttaatggctactttcaaaatgaggccgatgtttgcagttggactattatttcgacgcttgacctccagagaagtgttattgcttaccattggactaagtttggtagcctcggttgaattaccgaacagtcttgaggaactaggtgacggacttgcgatgggaataatgatactaaaattgctaacagattttcaatcacatcaactctgggccaccctacttagtttaacatttatcaagacaacgtttagtcttcattacgcctggaaaacgatggctatggtactgtcaatagtctcattgttccctttatgtttatctacaacatcacaaaagactacatggcttccagtattgcttggatctctaggatgcaaaccactcacaatgttccttattgccgaaaataaaatctggggacggaaatcttggcccctaaatgagggcataatggccgttggaattgtatcaatcttactaagcagtctacttaaaaacgacgtcccactagctgggccattgatagccggtggtatgctgattgcttgctatgtcatatccggtagtagtgcggacctcagtctggagaaagcagcggaagtatcatgggaagaagaagcagaacactctggggcatcccacaatatcctcgttgaagtacaggatgatgggactatgaagatcaaagatgaagaaagggacgatacactaaccatattacttaaagctacactattagctgtttcgggcgtttatcccctctctattccggcgacgttatttgtttggtatttttggcaaaagaagaaacagcgatcaggagtattatgggacacaccaagtccaccagaggttgaacgcgcagtgctcgatgatggtatatatcgaattatgcagcgaggcctgttaggccgatcgcaagtaggtgtcggagtgttccaagaaaatgtctttcacacaatgtggcacgtaacgcgcggagcagttctgatgtaccaaggaaaaaggctcgaaccaagctgggcttcggtaaagaaagacctcatatcttacggtggaggttggagacttcagggctcatggaataccggagaggaagttcaagtgatagcagtagaacccgggaaaaatcccaaaaacgtacaaactgcaccaggtacattcaaaacaccggaaggggaagtgggggcaatcgcattagattttaagcctggcaccagtggaagtcctatagtaaatcgggaaggtaaaatagtaggactttatggtaatggtgtggttacaacttcgggtacatacgtcagtgccatagcgcaagctaaagcaagccaagaaggccctctacctgaaatagaagacgaagtatttagaaaaaggaacctaacaattatggatctccatccaggatcaggtaaaaccagacgatatttgcccgcaattgttcgtgaagctataaaacgaaaattaaggacactaatattagcccctaccagggtagtagcatcagagatggcggaagcgttgaaaggaatgccgataagatatcaaacaacagctgtaaaatcagagcacacaggaaaagagattgtcgatctaatgtgtcatgcaactttcaccatgcgactactaagtcccgtacgggtcccgaattataatatgatcataatggatgaagcccactttactgacccgtccagcattgcagcaaggggatatatatccactagagtaggaatgggagaagcagctgcgatttttatgacagctactcctccgggaagcgtagaagcctttcctcaaagtaatgctgcaatccaggacgaagaacgcgatattcctgagagaagttggaacagcggttacgaatggatcacggacttccctggcaaaacggtatggtttgtcccaagtataaaaagtggtaatgatatagctaactgcctaagaaagaatgggaaaagagtcattcaattaagtaggaagacatttgacacagagtaccagaaaactaaaaataacgattgggactatgtcgtcacgaccgacatctcagaaatgggcgctaattttagagcagacagggtaattgatcccagaagatgtttaaaacctgtgatcctgaaagacgggcctgaacgcgttatcttagctggtcccatgcctgtcactgtagcatcagcagctcagcgtagagggcgcataggtagaaatcataacaaagaaggtgaccagtacatttacatgggacaaccacttaataatgacgaagaccatgcccactggactgaagcgaagatgttattagataacatcaacacaccggaaggtattatcccagcgttatttgaacccgagagagagaaaagcgcagctatagatggtgaatatagactaagaggcgaagctcgcaaaacattcgtagaactaatgagaagaggcgatctaccagtatggttatcgtacaaagttgcaagcgaaggtttccaatatagtgaccggagatggtgctttgatggtgaaagaaacaatcaggtgctagaagaaaacatggatgtagaaatatggactaaagaaggagaaaggaagaaattaaggccaagatggctagatgcacggacgtatagcgatcctttggctctgcgtgaatttaaagaatttgctgcaggacggcgatctgtatcaggcgaccttattctggaaattggtaaactacctcaacatcttactcaaagagcgcaaaatgcattagataacttagttatgcttcacaattctgaacagggaggaagggcatatagacacgcaatggaggaactacctgatactatagaaacgttaatgttactagcgttaatagccgtattaactggtggagtgacattgttctttttatcgggaagaggattaggaaaaacatctattggtttgctttgcgtaatggcatcgtcagtgttactctggatggcatccgtagaaccacactggatcgcggcatccattatcctagagttctttctaatggttttgttgataccagaacccgataggcaaagaacgccgcaggataatcagctcgcatatgtagtaatcggcctgctgtttatgatccttacagtagcggctaacgaaatgggcctcttagagacaactaagaaagatctgggcatagggcatgttgctgttgagaaccaccatcatgctgcaatgttagatgtcgacttacatccagcgtcggcatggactctctatgcagtcgcaacaacaataataacgcctatgatgcgacacacaattgaaaataccacggcaaacataagtctcacagccatagcaaatcaggctgcaattcttatgggactagacaaaggttggccaataagtaaaatggacataggtgtcccattacttgcattaggctgttatagccaggtgaaccctttgactttgacggctgcagtcctgatgttagtggctcattatgccattatcggtccgggattacaagcaaaagcgactagagaagcccagaaaaggacagcagccggaatcatgaagaaccccacagtggacggaattgtagcgatagacttagatccggttgtctacgatgcaaaattcgaaaaacagcttggtcaaataatgttattaatactatgtactagccaaatcttgttgatgcgaacgacgtgggcattatgtgaatcgattacacttgccactggacctctaaccacgctctgggagggatcacctggaaagttctggaacaccaccatagcagtgtcaatggcgaatatttttaggggatcctatttagccggtgcaggtcttgcattctcacttatgaaaagtttaggaggcggtagaaggggcactggtgcgcaaggagaaaccctgggcgaaaagtggaaacgacagctaaatcagctttctaaaagcgaatttaatacttataagaggtcaggaattatggaagttgatcgatctgaagctaaagaaggattaaaaaggggcgaaacgacgaagcacgccgtaagccgtggtaccgcgaaattaagatggttcgtggaaaggaatctcgtaaaaccggagggtaaagttatagacttaggttgcggacgtggtggttggtcatactattgcgcaggattgaagaaagtaacagaagttaaaggctataccaaagggggtcccggtcacgaggaacctatccctatggccacctatggctggaatctggtgaaacttcatagcggaaaagatgtattcttcatcccgccagaaaaatgtgacacactactgtgtgacataggagaaagcagtcctaaccccacaattgaagaaggacgtacactacgtgttctaaaaatggtggagccatggctaagagggaaccagttttgtattaaaatcctaaatccatatatgccatcagtcgtagaaacattagaacagatgcagagaaaacatggtggaatgctggttagaaatccgttgagtagaaatagcacccatgaaatgtattgggtatcttgtggaactggaaacatcgtttctgccgtcaatatgacgagccgaatgttattaaacagatttactatggcacataggaagcctacgtatgaacgagatgtggatctaggagctggcactagacacgtggctgttgaacctgaggttgctaatctggatattattggacagagaattgaaaacataaaacatgaacacaaatctacgtggcattatgacgaggataatccctacaaaacctgggcatatcatggttcatacgaagttaaacccagtggaagtgcatccagcatggttaatggagtagtgaaattacttacaaaaccatgggacgtcataccaatggtaacacagatcgcaatgacagacaccacaccatttggacagcaaagagtgttcaaagaaaaggtagatactcgaacaccgaaagccaaacggggtacggctcagataatggaggtgactgctaggtggctctggggatttttgagcagaaacaaaaagccgagaatatgtacaagagaagagttcacgcgcaaagttagatcaaacgccgcaataggagcggttttcgttgatgaaaatcaatggaactctgctaaagaagcagtagaagatgaacgtttttgggacctggtgcatcgagaaagagaactacataagcagggaaaatgtgctacctgtgtatataatatgatgggcaagagagaaaagaaactcggtgagtttggtaaagctaaaggatctagggctatctggtatatgtggctaggtgcccgcttcctagaatttgaagcgttaggtttcatgaacgaagatcactggttttccagggaaaactcgttatcaggcgtagaaggagagggtctgcataaattaggatatattttgcgagacatcagtaagataccgggcggaaatatgtacgcagacgacacagctggttgggatacaagaataacagaagacgatcttcagaatgaggcaaagattactgacataatggaacctgaacatgccctattagctaaagctatattcaaactaacgtaccaaaataaagtcgtacgagtccagcgtcctgccaaaaatggaaccgtaatggacgtgatctctaggcgggatcagaggggttcaggacaagtcggcacatacgggcttaacacatttacaaatatggaagctcagctgataagacagatggaatccgaaggcatattttcaccaagtgaactagaaactccgaatctcgcagagcgggtattggactggctcgaaaaatacggagtcgagaggctgaaaaggatggcaatctcgggggatgattgtgtagtaaaacccatagacgacagatttgctacagccctcaccgccttaaatgatatggggaaagtaagaaaagatatccctcagtgggaacctagtaagggctggaatgattggcaacaagttccattttgctcacaccattttcaccaattaatcatgaaagatggaagagaaatagtcgtgccttgtagaaatcaagacgaacttgtaggaagggctagagtttctcaaggtgctggatggtcactacgagaaactgcgtgtttaggtaaaagttatgcacagatgtggcagttgatgtatttccatcgcagggatctacgactagcagcaaatgctatttgttctgcggtaccagttgattgggttcccacctcccgaacgacatggagtatacacgcacatcatcaatggatgactactgaagacatgctatcggtatggaatcgagtatggatagaggaaaatccatggatggaggataaaactcacatatcatcctgggaggacgtaccatatctgggtaaacgggaagaccaatggtgtgggtcactaatcgggttgacagcgagagcaacttgggctactaatatacaagttgccatcaatcaagtaagacgactcataggcaacgaaaactacttagactatatgacaagtatgaagagattcaagaatgagtcggatcctgaaggagcattatggtaa

SEQ ID NO: 22136 - RNA, 9879 nt, synthetic construct
  misc_feature 1..9879: note = derived and/or modified CDS sequence (opt6) from DENV-1__AY835999__SS-prME
  source 1..9879: mol_type = other RNA
tctgtaaccatgcttctaatgttaatgccaacagcgttagcctttcacctgactacgcggggaggagaacctcatatgattgtatcaaaacaagaaagaggtaaatcattacttttcaaaacgagtgcaggagttaatatgtgcaccctaatagcaatggaccttggggaactctgtgaagacacgatgacgtacaaatgccctcgaatcacggaagctgaacccgatgatgttgactgttggtgtaacgcaacggatacgtgggtaacatatggtacatgttctcaaactggtgaacatcgaagagataaaaggagtgtggcgctcgccccacacgttgggctcggtctagaaacaaggactgaaacatggatgagcagtgaaggagcctggaaacagatacaaagagtagaaacgtgggcattaagacatccgggattcacggtaatagcattatttctagcacacgcgataggtacaagtataactcaaaaaggaataatcttcattttactgatgctagtaaccccatccatggctatgagatgcgtcgggataggatcacgagatttcgtagaaggattatcgggtgctacatgggttgatgtggtactagaacatggaagctgcgttacaactatggcaaaagacaaaccgacacttgacatcgaactcctaaagacagaagtcactaaccccgctgtgttaagaaaattatgtattgaagctaaaataagcaacacaacgactgattctagatgcccgactcaaggagaagcaaccctagttgaagaacaggatgctaatttcgtatgcaggagaaccttcgttgacagaggatggggtaatggttgcggactctttggtaaaggatcattactcacttgcgcaaagtttaaatgtgtaacgaaattggaagggaagatagtccaatatgagaaccttaaatatagtgtaatagttaccgtacacacgggagatcagcaccaagtgggaaatgagagtacagaacacggaacaacagcaaccataacgccacaagcacccacaaccgaaatccaactaacagactacggagccttaacgctagactgcagtccacgcactggactcgatttcaatgaaatggtattattaactatgaaagagaaaagttggttagttcacaaacaatggtttttagacttaccacttccatggacaagtggagcatccacatctcaagaaacatggaatagacaagatctgttagtaacatttaaaacagcccacgctaagaaacaggaggttgtagtattgggtagccaggaaggtgcaatgcacacggcactaactggagcaacagaaatccaaacttcaggtaccacaactatatttgcaggtcacctaaaatgtagactaaaaatggataaattaacattaaaaggtatgagttatgtaatgtgtacgggatcttttaaattagaaaaagaagttgcagaaacacagcatgggacagttctggtacaaataaagtatgaaggaacggatgcaccatgcaaaatcccatttttaacacaagatgagaaaggtgtgacacaaaatggacgtcttataacggccaatcccatagtcacagataaggagaaaccagtaaatatcgaggctgagccaccattcggagagtcttatattgtgataggtgctggtgaaaaagctcttaagttaagttggtttaaaaagggcagtagtattgggaaaatgtttgaagccacagcaagaggggcgcgcagaatggcaattttaggagacacagcctgggattttggcagtgtaggtggggtattcacatcggtgggcaagctagtacatcaaatattcgggactgcctatggagttctattcagcggcgtgtcatggactatgaaattaggaataggtgtgttactgacgtggttaggattgaactctaggtccactagcctcagtatgacttgcattgctgtaggtctagtcactttataccttggagtaatggttcaggccgacagcggttgtgtaatcaattggaaagggagagaattaaaatgcgggagcggtatattcgtaaccaatgaagtacatacctggactgaacagtataagtttcaagcagacagccccaagaggctgtcagctgctataggtaaagcctgggaagaaggagtctgcggtatcagatccgcgacgagactagaaaatataatgtggaaacaaatcagtaacgaactcaatcacattttgctagagaatgatatgaagtttaccgtcgtagttggagacgtagcaggaatcttggtacagggcaagaaaatgatcaggcctcagccaatggaatacaaatattcatggaaaagctggggaaaagcaaagataattggcgcagacgtacagaatagtaccttcattatagacgggccaaatacaccggaatgtccagatgatcaaagagcgtggaacatttgggaggttgaagactacggtttcggaatattcactaccaatatatggttaaaacttcgggactcatatacccaagtttgtgaccaccgattaatgtccgcggcgataaaagattcaaaggccgtccacgccgatatgggctattggatagaatctgagaaaaatgaaacctggaagctagccagagcatcatttatcgaagtaaaaacgtgcatttggccgaaatcccacaccctatggtcgaacggggttctagaaagcgaaatgataatcccgaaaatttatggagggccgatatcccagcacaattacaggccaggatattttacccaaactgccggtccctggcacttagggaagctagagctagatttcgacttatgtgaagggacaaccgtggtagttgatgaacattgcggcaatcgtggaccatctctaagaacgactacagtaactggtaagataatacacgaatggtgctgcagaagttgtactcttccacccctcagattcaggggcgaaaatggatgctggtatggtatggagatcaggccggtcaaagaaaaagaagaaaatcttgtaaaaagtatggtatcggcgggaagcggcgaggtggactcattttcgctgggactactgtgtatctccataatgatagaagaagtcatgcgcagcagatggtcacgtaaaatgttaatgactggaatattagccgttttctttctactgataatgggacagttgacctggaacgacctgattcgtttatgcatcatggttggtgctaatgcatcggacagaatgggaatggggactacctatctagctctgatggccacatttaaaatgagaccgatgttcgcggtaggacttctgtttcgtaggctaacatcccgagaagtactattattaaccatagggttgagtttggtagcgtctgtagagttacctaatagtctggaggaactaggtgacggcctagccatgggaatcatgattttgaaactgcttacagattttcaatcgcaccaactttgggcaacattattatccttgactttcattaagaccacattctctctacattacgcatggaagactatggcaatggtgctaagcatagtaagtctttttccgttatgcctaagtactacatcacagaaaaccacatggttacccgtattattaggtagcttaggttgtaagccactaacaatgtttttaattgctgaaaacaaaatatggggaaggaagtcgtggcctttaaatgaaggcataatggcggtcggaatagttagtattttgttaagctctttactgaaaaacgacgtaccgctagcgggacccttgattgcgggaggaatgttgattgcatgttatgttatttcgggttcatcagcagatctaagcctcgagaaagcggccgaagtgagctgggaggaggaagcagaacatagtggcgcctcacataacatcctagtagaagtccaagatgatggaactatgaagattaaagatgaagaaagggatgatactctcaccatactgttaaaagcaactctgttggcggtaagtggtgtatacccactatcgattcccgcaactcttttcgtatggtacttctggcaaaagaagaaacaaagatccggagttttatgggatactccgagtccacctgaagtagaaagagctgtattggatgacggtatataccgcataatgcaaagaggattattaggacgaagccaagtcggggtaggcgtattccaagagaatgtctttcacacaatgtggcatgtaacacgtggtgcagtcctaatgtaccaagggaagcgattagaaccgtcatgggcctcagtcaagaaagatttaatcagttatggcggtggttggagattacaaggatcctggaataccggagaagaagtgcaagtgatagcagttgaacccgggaaaaatcccaaaaatgtccaaacagcacccggaaccttcaaaacgccagagggtgaggtgggagcaatagccttagatttcaagccaggtacaagcggctcacccattgtgaaccgagaaggcaaaatcgtaggtttatatggaaatggagtagtaacaacatcgggtacctacgtgtcggctattgctcagacaaaagcgtcgcaagaaggaccactacccgaaattgaagacgaggtctttagaaaacggaatttaacgattatggatttgcacccaggatcgggtaaaacgagaagatacttaccagctatagtaagggaggcaattaagaggaaactacgtacgcttatacttgccccaacaagggtggtggcctctgaaatggcggaagccctcaagggcatgcctatacgttaccagaccaccgcagtgaagtccgagcacaccgggaaagaaattgtagatctgatgtgtcacgcaacattcactatgagattactttcacctgtacgagtacctaactacaacatgataataatggatgaagcacattttaccgatccatcatctatagcagcacgaggctacataagtacacgtgtggggatgggagaagctgccgcaatattcatgactgcaactccaccaggatctatggaggcgttccctcaatcgaatgctgtaattcaggacgaagaaagggatataccagaacgatcgtggaatagtggctacgaatggataacagattttccaggtaaaacggtatggttcgtaccctctatcaaggcgggaaacgatatagcgaactgtctaaggaaaaacggaaaaagagtaatacaacttagcagaaaaaccttcgatactgaatatcagaaaactaagaataacgattgggactatgtagtcacaacagatatctcagaaatgggtgcaaactttcgtgcagacagggtaattgatccccgtaggtgcttaaaaccagtcattctcaaggacggaccggaaagggtgatactagctggcccaatgccagtcactgtcgcgtcagcagcccaacgtcgaggcagaatcgggaggaatcataataaagagggagatcaatatatctatatgggacaaccactaaacaacgatgaggatcacgcacattggacagaagcaaaaatgctattggataatataaacacacctgaaggcattattcctgctctttttgagcctgagcgtgaaaaatcggcagcaatagatggtgagtaccgtctaagaggggaagcacgaaaaacatttgtagagttaatgcgcagaggtgaccttccagtttggttgtcgtataaagttgcatcagagggttttcaatacagtgatcgtcgatggtgctttgacggtgagcgtaataatcaagtactagaggaaaacatggacgttgaaatatggactaaagaaggagagaggaagaaactcagacctagatggctagatgccagaacatacagcgatccgctagcacttagagagttcaaagagttcgccgccggacgaaggtcagtatccggggatctgatcttggaaataggaaagttgcctcaacatcttacacagagagcacagaatgcactggacaatctagttatgctacataactcagagcaaggaggcagggcctatagacacgccatggaagaattaccagacaccatcgaaactttaatgttactagcactcattgccgtactaacaggaggggtgactctattctttctgagcgggaaagggttaggtaaaacgtcaataggattactgtgtgtcatggcgtcctccgtacttctatggatggcgtcagtcgaaccccattggattgctgcaagtataattttagagttctttttaatggttttgctgataccagaaccagatagacagcgaacaccacaagacaatcaattggcttatgtagtaattggtcttttatttatgatactaactgttgccgctaatgagatgggtctgctagaaacaactaagaaagatcttggtataggtcatgtcgcagtggaaaatcatcaccatgcagctatgcttgatgttgatctacatccagcaagtgcatggaccttatacgccgtggcaactactataattacacctatgatgaggcacacaattgagaacactacagctaacatctcattaacagctatagccaaccaagctgctattttaatggggctggataaaggctggccaatatcaaaaatggatattggtgtacctttgttagctcttggttgttatagtcaagttaatccattaactctaacggctgcacttctaatgttagtggctcactatgccattattggacccggattacaagccaaagcaacgcgtgaagcacaaaagcgaacagcagcaggaatcatgaaaaacccaacaatagatgggattgtagcgatagacctagatccggtcgtttatgacgccaaatttgagaagcagttaggtcagatcatgttactaatcctgtgtacttctcaaattttgttaatgcggacaacatgggcattatgcgaatcaattaccctagccaccggtccgttaactacattatgggaaggatctcctggcaagttctggaacacgacaatagccgtatcaatggctaatatctttcgagggtcctacttagcaggggccggcttggcgttctcgttaatgaaaagcctcggtggcggacggcggggtacaggggctcaaggcgaaacattaggagagaagtggaagaggcagttaaatcaattatctaagtccgagtttaacacctacaaaaggagcggcataatggaggtagataggtctgaggcaaaagaaggacttaaaaggggtgaaacgactaaacacgccgtatcaagaggtacggcaaaacttcgttggttcgtggaacgtaatctggtgaagcccgaaggcaaagttatcgacctgggatgtggtagaggtggctggagctattactgtgcgggacttaaaaaggttacagaagtgaaaggttatacaaaaggagggcccggtcatgaagaaccgataccgatggccacatatgggtggaatcttgtcaaattacacagcggaaaagatgtctttttcatcccaccagaaaaatgtgatacattactatgtgacatcggtgagagttcaccgaatccaaccattgaagagggacgaacattaagagttttaaaaatggtagaaccatggctgcgaggtaatcaattctgcattaaaatccttaatccatatatgccctcagtggttgaaactcttgaacaaatgcaaaggaaacatgggggaatgttagtccgtaatccactctcaagaaacagcacacatgaaatgtattgggtgtcctgtggcacaggaaatatagttagtgccgttaatatgacaagcaggatgcttttgaatcggttcactatggcgcatagaaaaccaacttatgaacgtgatgtagacctaggagctggtaccagacatgtggctgtcgaaccagaagtcgctaacctcgatattattggacaacgcatagagaatataaaacacgaacataaatcaacatggcattatgacgaagataatccttataaaacatgggcataccatgggagctacgaagttaaaccatccggctcagctagttcaatggtaaatggagtggtaaaactattaactaaaccttgggatgttataccaatggttacccaaatagccatgacggacacaaccccgtttggacagcaaagagtttttaaggagaaagtagacacgcgaaccccgaaagctaaaagaggcacagcacaaataatggaagtaacggcgcgatggctatggggatttctttctcggaataagaagcccaggatatgcactagagaggagttcacacgaaaagtaagaagcaatgctgcgattggtgcagtttttgttgatgaaaaccagtggaatagcgcgaaagaagcagttgaagatgatagattttgggacctggttcatcgggagagagaattacataagcaaggaaaatgcgcgacctgcgtatataatatgatgggaaaacgtgagaagaaactgggtgagttcggcaaagcgaaaggttcacgtgcaatatggtatatgtggttgggggcgaggtttctcgagttcgaagccttagggttcatgaacgaagatcattggtttagtagagaaaattcactctcaggagttgaaggagaaggattacataagctcggatacattctacgtgatatatcaaaaatcccgggaggtaatatgtatgctgatgatactgcagggtgggatactcgaattaccgaagatgacttacagaatgaagcaaaaataacggatataatggaaccggaacacgcacaactcgcaaagagtatatttaaattaacttaccaaaacaaagttgtaagggtacaaagacccgctaaaaatgggactgtcatggacgtaatatctaggagagaccaaaggggctcgggccaagtaggtacatacggactgaacacatttacgaacatggaagcacaacttatacgacagatggaatcagaaggaatatttagtccaaatgaattagaaactcctaatttagctgaaagggtactagactggttagaaaaatatggagttgaaaggttaaaaaggatggctatctccggtgacgattgcgtagtaaaacctattgacgacagattcgctacagctttgactgcacttaacgacatgggcaaagtcagaaaggacataccacaatgggagccaagtaaaggctggaacgactggcaacaagtaccattctgttctcatcattttcatcaacttataatgaaagatggtagagaaatagtcgttccttgcaggaaccaagacgaactcgtaggccgtgcaagagtgagccagggagccggctggtccctaagagagaccgcgtgtttaggtaaaagttatgctcaaatgtggcaattaatgtatttccaccgacgagatttacgtttagcggcaaatgctatatgttctgccgtgcctgttgattgggtgcctacaagtaggacaacttggtcgatacacgcccatcatcagtggatgaccaccgaagacatgctctccgtttggaaccgggtttggattgaggaaaatccatggatggaagataaaacgcgtatttcaagttgggaggatgtgccctacctaggaaagagggaagatcagtggtgtggtagtttgataggtcttactgcacgggctacgtgggctacaaatattcaggtagctataaaccaagtgagacgtttaataggaaatgaaaattatagcgactatatgacgtccatgaaacgattcaaaaatgaaagtgaaccggaaggtgctctatggtaa

SEQ ID NO: 22137 - RNA, 9879 nt, synthetic construct
  misc_feature 1..9879: note = derived and/or modified CDS sequence (opt6) from DENV-1__KP686070__SS-prME
  source 1..9879: mol_type = other RNA
tcagtaacgatgctactaatgttattaccaactgcacttgcatttcatctaactacaagaggaggagaaccacacatgattgtatcaaaacaagaaaggggaaaatcgctcctgtttaaaacaagtgctggagtaaatatgtgtacacttatagcaatggatctaggcgaactttgtgaggacaccatgacatacaaatgtccccggataacagaagctgaaccagacgatgtagactgctggtgtaatgcgacagatacatgggtgacatatggaacgtgtagtcaaactggtgaacaccgaagagataaaaggtctgttgcattggcgccgcatgttggactgggtctagaaacaaggacagaaacatggatgtcatcagaaggggcttggaggcaaattcagaaagtggaaacttgggcactccgacacccaggcttcacggtaatagcattgtttttagcacacgcgattggtacgagtattacacaaaaaggcatcatttttatacttttaatgttggtaactccttcaatggccatgcgatgtgttgggatcgggaatagagatttcgttgaaggcctgtcgggggctacatgggtagatgtagtgttagaacacggaagttgcgtgacgactatggccaaaaataaaccaactcttgacatagagcttttaaaaacagaagtcaccaatcccgctgtgttaaggaaattatgtatagaagcaaaaataagtaatacgacaaccgactcaagatgcccgacccaaggtgaggctaccctcgtagaggaacaagatgcaaattttgtctgtcggcgtaccttcgtagatcgaggatggggtaatggctgtggtttatttggaaaagggagtttattaacatgtgccaaatttaaatgcgtgactaaattagaaggcaaaatagttcaatatgaaaatctaaaatattcagtgatagtaactgttcacacgggtgaccaacatcaagtgggtaacgaaacaactgaacatggaacaattgctactattacacctcaagctccaacaagcgaaatacaattaaccgattatggggcactaacattagattgcagtccccgtactggattagactttaatgagatggtcctacttactatgaaagagaaatcgtggctagtccacaaacaatggtttttagatctaccactcccatggacgagcggggccagtacatctcaggagacgtggaatagacaggatctccttgtaacctttaaaacagcccatgccaagaaacaagaagtagtagtccttggatcacaggaaggggctatgcatacagctttaaccggagctaccgaaatacaaacctccggtaccactacaatctttgctggacatctgaaatgtaggcttaaaatggacaaattaactctgaaaggggtaagttatgttatgtgcaccggttccttcaaacttgaaaaagaggtggctgaaacacagcatggaaccgttttggtacaagtaaaatacgaaggcacggacgcgccttgcaaaatacccataagcacacaggacgagaaaggtgtgactcagaatggtcgattgattacagcaaatccaatcgtaactgacaaagaaaagccagttaatatagagacagaaccgccctttggagaatcttacatagtaataggagcaggagaaaaggctttgaaattaagctggtttaagaagggatcatcaataggcaagatgttcgaagcaactgcaagaggggctcgacgtatggccattctaggagacacggcatgggacttcggcagtatcggaggtgtattcacatcagtcggaaagttagtccatcaggttttcggtactgcctatggcgttctattctccggcgtctcatggaccatgaaaataggtatcggtatactgttaacgtggttgggattaaattcacgttcaacaagtttgtcaatgacttgcatagcagtcgggatggtaactttatacctaggagtaatggtacaagctgattcaggctgcgtaattaattggaaaggtcgggaactgaaatgtggcagtggcatctttgtaacaaatgaagtacacacgtggacagaacagtacaagttccaggctgattcgccgaaaagactaagcgcagctataggtaaggcatgggaagaaggcgtatgtgggataagatcagccacaagattggaaaacataatgtggaaacaaatatcaaatgaattaaatcacatattattagagaacgatatgaaatttacagtagtagttggagatgctaatggaatactaactcaggggaagaaaatgatcagaccccaacccatggaacacaaatacagctggaaatcatggggaaaagctaagataataggggctgacacacaaaacaccacctttataatagacgggcctgacacgccagagtgcccggatgatcaaagagcctggaacatatgggaggtcgaagactatggctttggcgtattcacgactaatatctggttgaagctccgagatagttacacacaaatgtgcgatcacagactcatgtctgcggcaatcaaagattccaaagccgtgcatgcagatatgggatattggatagaatctgagaaaaatgaaacctggaaactggcgagggccagctttatagaagttaaaacatgcatatggccaaggtcacacacactttggtctaacggagtacttgaatccgagatgataatccccaaaatatacggagggccgatctcccaacacaactacagacctggttattttacgcaaaccgctggaccctggcatttaggaaagctggaattagattttaatttatgcgagggaaccaccgtagtagttgacgaacattgtggcaatcgcggtcccagtctacgaacgactacagtaacagggaagattattcatgaatggtgctgtagaagttgtactcttcctcctttaagattcagaggagaagatgggtgttggtacggaatggaaataagaccagtcaaggaaaaggaggaaaacctagttcgaagcatggtctcagctgggtcgggggaagtggattcatttagtttaggattgctttgcgtaagcattatgatagaagaagttatgcggagccgatggtctcgaaagatgttaatgacaggaactttagctgtcttctttttattaatcatgggccaattaacgtggaatgatctgatccgcctatgcatcatggtcggagcgaacgtttccgatagaatgggtatggggacgacatacctagctctaatggctacgttcaaaatgagacctatgtttgcagtaggattgctttttagacggctaacgtcgcgtgaggttcttttgttgacaatcggattaagtctagtagcttccgtagagctgcccaactcattagaagaactaggagatggattagcgatgggtataatgatgcttaagttacttacagatttccaatcccatcaattgtggacaacattgctgtcccttacatttattaaaacaacgttatcacttgattacgcgtggaaaactatggcaatggttctatctatcgtcagcttatttcctttatgcctctctacgactagccaaaagactacatggttaccagtgctacttggatcttttggatgtaaaccactaacgatgtttttaattactgaaaacaaaatatggggtcgaaaatcatggcccttgaacgaaggaattatggctgtaggaatagtaagcatacttctatcatctttactaaagaatgacgttcccttagctggaccattgattgcaggcggaatgctaatcgcttgttatgtaatatcggggtcgagtgctgatctcagcttggagagagcagcagaagtaagctgggaagaagaggctgaacattctggagctagtcacaacattctagtcgaagttcaagatgatggaacaatgaaaatcaaagacgaggagagagacgacacacttaccatcctgttaaaagcaacactattagcagttagcggagtgtacccaatgtcaataccagcaactttgtttgtctggtacttttggcagaaaaagaaacaacgatccggagtattgtgggacacacccagccctccagaagttgaacgcgcagtactcgatgacggaatttaccgcattttacaacgcggcttattaggacgtagtcaggttggagttggagtcttccaagacggtgtgtttcatactatgtggcatgtaacgagaggagctgtgttaatgtaccaaggaaaaagactagaaccaagctgggcgtctgtcaagaaagatctcatatcatacggaggcggatggaggtttcaaggctcgtggaatacaggtgaagaggtacaagtaatcgctgtggaaccaggcaaaaatcctaaaaatgttcagactacaccgggaacgtttaaaacacccgaaggagaggtaggagcaattgctctagattttaaacctggaacatcaggttctccgattgttaatcgagaaggtaaaattgttggtttgtatggcaacggtgtagtaaccacttctgggacgtatgtatccgctattgcgcaagcaaaagcatcacaagaaggacctcttccagaaattgaggatgaagtattcaagaaaagaaacctaacaataatggatttacatcccgggtcaggtaaaactcgaaggtacctacctgcaatagtaagagaagcgataaaaagaaaactgagaaccctaattctagcaccaacacgggtggttgcgtcagaaatggcagaagcgctaaaagggatgccaattagatatcaaaccaccgcggtcaaaagtgaacacacgggcaaagaaatagtcgatctcatgtgtcacgcaactttcactatgcgtttactttcaccagtacgggttccgaattataatatgataattatggatgaagcacatttcaccgatcccgcatcaattgcggctcgaggttatatatcaacaagagtgggtatgggagaggcggcagcaattttcatgaccgcaacaccaccaggaagtgtagaggctttcccccagagcaatgcagttatacaggatgaagaaagagatataccggaacgctcatggaactccggctatgattggattactgacttccccggaaagacagtatggtttgtaccatcgattaaatcaggaaacgacattgcaaattgtcttaggaaaaatggcaagcgcgtaatccaactttccagaaaaacttttgacaccgagtaccagaaaaccaaaaataacgattgggattatgtggtaacaacagacatcagcgaaatgggagctaactttagagctgatcgagtaatcgaccccagacgttgtttaaaaccagtaatactcaaggatgggccagaacgggttatattagctgggcctatgccagttacggctgcatcagctgcacaacgccggggaaggataggacgtaaccaaaataaagaaggagatcagtatatttatatgggccagcccttgaataatgacgaagaccatgcacattggaccgaagccaaaatgttgttggataatattaatactccagaaggtattattccggcactgttcgaaccggagcgagaaaagagtgcagcgatcgatggagaatatagattacgcggagaagcaagaaaaacatttgtcgaactcatgcgaagaggtgacctccccgtatggttaagttataaggtagcctcggagggcttccagtattcagatcgaagatggtgttttgatggagagcgtaacaaccaagtcctcgaagaaaacatggatgtagaaatatggaccaaagaaggcgaacgtaagaaattacgaccaagatggcttgatgcccgaacgtactcagacccacttgccctaagagaatttaaagagttcgcagctgggcgaagatcagtttcaggtgatctaattttagaaatcggcaagctcccacaacacctaacattgagagcgcaaaatgccttagataacctagttatgttacacaacagtgagcagggaggaaaggcctataggcacgctatggaagaactacctgatacaattgagacccttatgctattagcattaattgctgtattaacaggaggtgtaactctcttcttcctttctggaaaaggccttggtaaaacttccatcggacttctttgcgtaatggctagttccgtattgttatggatggcaagtgttgaacctcactggattgccgcaagcataatattagagttctttttgatggtattacttatacctgaaccagacagacaaaggacacctcaagataaccaattagcctatgtcgtaatcggattgttatttatgatactcacggttgcagcaaacgagatgggtttgctggagacaactaagaaagatctcgggattggtcatgtcgttgctgaaaatcaccatcatgcaacaatgttggatatcgatttacatccagcttccgcgtggactctctatgctgtggcaactacgataataacacccatgatgagacacacgatagagaatacaacagcaaacatatctctgacggcgatagccaatcaagcggcaatactaatgggcttggataagggctggccaataagcaaaatggatattggagtcccgttattagctcttgggtgctattctcaagtaaaccctttgacacttacagcagcagtttcaatgcttgttgcgcattatgcaataattggtcccggattacaagccaaggccactagagaagcacagaagagaacggctgcaggcatcatgaaaaatccgacagtcgacggaattgttgcaatagatctagatccagtcgtatacgatgccaaattcgaaaagcaattgggtcaaataatgttgctaattttatgcacatcacaaatattgcttatgagaactacttgggcattgtgtgagtctattaccctggcaacaggccctttaactacattatgggaagggtccccaggaaaattttggaatacaactatcgcagtatcaatggccaatatatttagaggttcttatctcgccggggctggattagcattttctctcatgaagtcattaggaggtggcaggagggggacgggagctcaaggcgaaacactgggagagaaatggaaacgacaattgaaccagttatcaaaatctgaatttaatacatataaaagaagtggcatcatggaagtggacaggtcagaggctaaagaaggcttgaaaagaggagaaacaacaaaacacgcagtaagtagggggacagcgaagttgagatggttcgtggaacgaaatcttgtgaaaccagaaggtaaagtaatagatttaggttgcggccggggtggttggtcgtattattgtgcgggactaaagaaagtcaccgaagtaaaaggctacacaaagggaggaccgggacatgaagaaccgataccaatggcaacttacggatggaacattgtaaagttacattcaggacgtgatgtattctttacacctccagagaaatgcgacaccctactttgtgatataggggaatcgtcaccaaatccaacaattgaggaggggcgcaccctcagggttttaaaaatggtagagccatggctacgaggcaaccaattctgcataaagatcctgaatccctatatgccttctgtcgtagagaccttagaacagatgcaacgaaaacacggaggaatgcttgtgagaaatccattatcccgaaatagtactcatgagatgtactgggtatcatgcggaacagggaatatagtttcagccgttaatatgacaagtaggatgctactcaatcgattcaccatggcccataggaaaccaacttatgaacgagacgtagatctcggtgccggaacaagacacgttgcagttgagccagaaattgctaatttagacataataggtcaaagaatagaaaatattaagaacgaacacaagagtacatggcattacgatgaagataatccttataaaacctgggcgtatcatggaagttatgaagtcaaaccctctggaagcgcgagctctatggtgaatggggtagtgcggttattaaccaaaccatgggacgtaattccgatggtaactcaaattgctatgacggacactactccgttcggtcaacagcgtgtcttcaaagaaaaagttgacacaagaacaccaaggcctaagagaggtactgcacaaatcatggaggtaacagcaaaatggctctggggattcttatcgcgaaacaaaaagcccaggatatgtacacgcgaagagttcacaagaaaagtaagatctaatgcagccataggtgcagtattcgtagacgagaatcagtggaactctgcaaaagaagctgtagaagatgaacgattttgggatctagttcatagggaaagagaactacataaacagggaaaatgtgctacatgtgtatataacatgatgggtaaacgtgagaagaaactaggggaatttggtaaagccaaaggatcacgagctatctggtatatgtggctaggggcacgattcctagaatttgaagcactaggatttatgaatgaagaccattggttttctcgagaaaattctctaagcggagtagaaggagagggattgcataaattgggttacattttacgtgatatcagcaaaatacccggcgggaatatgtatgctgacgatacagctggatgggatactagaattactgaagatgaccttcagaatgaggctaaaatcaccgacataatggagcccgagcatgcactactggctacaagcatatttaaacttacatatcaaaataaagtggtgagagtccaaaggcccgccaagtccggcactgtgatggacgtgataagcagacgagaccaacggggatcagggcaagtgggtacgtatggactcaatacatttacaaatatggaggtgcaactaataagacaaatggagagcgaaggtatcttttcacctagcgaactagagaacagtaacttggcagaaagagttttagattggctggaaaaacatggtgtagagcgattaaaacgcatggccatctcaggggacgattgcgttgtaaaacccactgacgatagatttgccactgcactaactgcgttaaatgacatgggcaaagtccgaaaagacataccccaatgggagccaagtaaaggctggaatgactggcaacaggtgcctttctgtagccatcactttcatcaactgataatgaaggacggaagagaaatcgttgtcccatgcagaaatcaagacgaattagtaggccgcgctcgcgtgtcacagggtgctggatggagtcttcgggaaacagcttgtctcggcaaatcatatgcccaaatgtggcaattaatgtattttcaccgtcgtgatttgaggttagcagctaacgcaatttgttctgctgtgccagtaaattgggttcctaccagcaggacaacatggtctattcacgcacaccaccaatggatgacaacggaagacatgcttagtgtgtggaacagagtttggatcgaggagaatccgtggatggaagataaaacccacgtttcatcgtgggaagacgtgccatacctaggtaaacgagaggaccaatggtgtggaagtcttattggactaacagcaagggcaacatgggcaaccaacattcaagtagcaattaaccaggtaagacgactaataggaaacgaaaactatttagactacatgacaagtatgaagaggtttaagaatgaatcagatccagaaggagcattatggtga

SEQ ID NO: 22138 - RNA, 9876 nt, synthetic construct
  misc_feature 1..9876: note = derived and/or modified CDS sequence (opt6) from DENV-1__KF672760__SS-prME
  source 1..9876: mol_type = other RNA
agcgtaactatgctgcttatgctacttcctaccgcacttgcattccatctcacaactcgagggggagaacctcacatgattgtcagcaaacaagaacgcggaaaatcccttttatttaaaacctcggcaggggtgaatatgtgtacacttatagctatggacttaggagaactttgtgaagacacaatgacatataaatgcccgaggataacagaagcagagcctgatgacgttgattgttggtgcaatgcaactgatacatgggtaacatatggaacatgtagtcaaacgggcgaacacagaagggaaaaacgtagtgtggcgctcgcgccgcacgtaggcttaggtctagaaactaggacagagacgtggatgtcgagtgagggagcttggaaacaaattcaacgtgttgagacgtgggccctgcgtcatccaggttttacagtaattgccttctttttagcacatgcaatcggcacctcaatcactcaaaaagggattatttttatacttttgatgttagttacaccttccatggctatgagatgtgtgggaataggaaaccgtgatttcgttgaaggcttgagtggcgctacttgggttgacgttgtcttagaacatggatcatgtgtaactactatggccaaaaataaacccacattagatattgaattgttaaaaacagaagtaactaatcctgcggtactcaggaaactatgcatagaagccaaaataagcaatacaacgacagattcacgctgcccaacgcaaggggaggctacgctcgttgaggagcaagatgctaactttgtatgtcgaaggacattcgtcgatagaggttgggggaacggttgtggcctttttgggaaagggtcgttactaacgtgtgcgaaatttaaatgcgtaaccaaattggaaggcaaaatagtacagtatgaaaacctcaaatattcagttatagttaccgttcacaccggcgatcaacatcaagttggaaacgagaccacggagcacggtaccattgctacaatcacgcctcaggcgccgactagcgaaatccagctaacagactatggggctctcactctagactgttcaccaagaacaggacttgattttaacgagatggtactattaacaatgaaagaaaaatcatggctagtacataaacaatggttcttagacctaccgttgccctggacatccggggcatcgacttcacaggaaacttggaatcggcaagatcttctcgtaacttttaaaacagctcatgcaaagaaacaagaagtagtcgttctaggaagtcaggaaggcgctatgcacactgctttaactggtgcaacagaaatacaaacttcaggtacaacgacaatatttgccggccatttgaaatgcaggcttaagatggacaaacttactttaaagggtatgtcttacgtaatgtgtactggatcgtttaaacttgaaaaagaggtagcagaaacacagcatgggacagtcctcgtgcaggtcaaatacgaagggacagatgctccgtgcaagatacctttcagcacccaagatgaaaaaggagtcacacaaaacggtagattaataacggcgaacccaattgtcaccgataaagaaaaaccagtcaatattgaaactgaaccaccattcggtgagtcttacattgtagttggggctggtgaaaaagctctaaaactttcctggtttaaaagaggtagctctatcggtaagatgtttgaagcaacagcacgcggagcccggcgaatggcaatattgggggacacagcgtgggactttggaagtatcgggggcgtgttcacatctgtaggtaaacttgtgcatcaggtatttggaacagcatacggcgttttgttctcaggtgtatcatggacaatgaagatcggaataggaatacttttaacgtggctgggactaaacagtagaagtacctccctctccatgacctgcattgccgttgggatggttactctgtatttaggggtgatggtgcaagctgacagtggttgcgtaattaactggaagggccgtgaattaaaatgtggatccggaattttcgtaacaaacgaagttcatacgtggacagaacagtataaattccaagcagatagcccaaagcgactatcagcagcgataggtaaggcttgggaagaaggagtttgtggaattagatctgcaacaagacttgaaaatataatgtggaagcaaatatcgaacgagctaaaccacattctgctggaaaatgacatgaaatttaccgttgtagtcggtgatgctaatggtattttagcacaaggcaagaaaatgataagaccccaaccaatggaacataaatattcttggaaaagctggggcaaagcaaagatcataggggcagacatacagaacacaacttttatcattgatggacccgatactccagaatgccccgatggacaaagagcatggaacatttgggaagtggaagattacgggttcggagtgttcactaccaatatatggttaaaactccgcgatagctacacgcaaatgtgtgatcatcgactaatgagtgcagccatcaaggatagcaaggccgttcacgctgacatgggatattggatcgaatcagagaagaatgaaacatggaagttagcacgtgcctcgtttattgaagtcaaaacgtgcacctggcctaaatcacacacgttatggtcgaatggtgtattagaaagtgaaatgataatccctaaaatcttcggcggcccaatttcacaacataattacagaccgggttactttactcaaacagcaggaccgtggcaccttgggaaactagaacttgacttcgatttatgtgagggcactacggttgtagtcgatgaacactgtggcaacagaggccccagcttaagaactacgacagttaccgggaaaatcattcatgagtggtgttgtcggagttgtacattacctccgctacgatttaggggagaagatgggtgctggtacggcatggaaatccgcccagttaaagaaaaagaagaaaaccttgttagaagtatggtatcagctgggtcgggggaggttgacagctttagtctcgggattctatgtgtatctatgatgatagaagaagtcatgcgttcccgctggtcaagaaaaatgttaatgacaggtacattagcagtcttcctcctattaattatgggccaactgacatggaacgacttaatccgactctgcataatggtaggagcaaatgcaagtgataggatgggaatgggaacaacttatttagctctaatggcaacgttcaagatgcgtccaatgtttgctgttggactcctatttcgtagattgacaagcagagaggtcttattattgacaataggattaagcctagtagcatgtgttgaactccccaacagtttagaagaactgggagacggcttagcgatgggaataatgatgcttaaattattaacagaatttcaaccacatcagctatggacaacattattgtccctaacgttcgtaaaaacaacattatctctggattatgcctggaagacgactgccatggtgctttcaatcgtttctttatttccattatgtttaagtacgacatcacaaaagacaacgtggctaccagtccttctcgggagttttggctgtaaaccattaacaatgttcttaataacagaaaacaaaatttggggtaggaagagttggcctctaaacgaaggtattatggctattggaatcgtatctattttattgtcatctctattgaaaaatgatgttccattagcaggaccattaatagcaggagggatgttaatagcatgctacgtcataagtggtagtagtgctgatctatcgcttgagaaagccgcagaagtatcatgggagcaagaagcagaacatagtggagcaagtcataacatattagtggaagttcaagacgacggaacaatgaagataaaggatgaggaacgagacgacactctcactattctcttaaaggccacactactagctgtatctggagtatatcctatgtcgatacccgcaactctatttgtttggtatttttggcaaaagaagaaacaaaggagtggagttctatgggatacaccatcacctccagaagtagaacgtgcagtcttagacgatgggatatatcgtatattacaacggggattgttaggacgctcccaagtaggcgtaggcgtatttcaagatggagttttccatacaatgtggcacgttactagaggagctgttctaatgtaccagggtaaacgattagaacctagctgggcgagcgtgaagaaagatctaataagctatggtggaggttggagatttcaaggatcatggaatactggagaagaggttcaagtaattgctgttgaaccaggaaagaacccgaagaatgtacaaacgacccctggtacatttaagaccccagaaggagaagtgggtgcaattgctttggattttaaacctggtacttcaggttcgcctattgtcaacagagaaggaaaaatagtggggttatatggaaatggagtcgtaacaacaagtggcacgtacgtatctgctatagcacaagcaaaagcctcacaagagggaccattaccagaaatagaagatgaagtttttaagaaacgaaatctcacaataatggatcttcacccaggatctgggaaaaccagacgatatctcccggctatcgtccgggaagcaattaaacgaaaattacggactcttatactagcacctactagagtagtagccagcgaaatggcagaagcattaaagggaatgccgattagataccaaacaacagccgtaaaaagtgaacataccggacgagaaatcgtcgatttaatgtgccatgcgactttcactatgcggctattgtcgcctgtaagggtaccaaactataacatgataataatggacgaagcacactttaccgatccagcgagcatagcagcaagaggttacatttccacaagagtgggaatgggagaagcagccgctatttttatgacagcaacacctcccggcagtgtagaagcatttcctcagtcaaatgctgttatccaggacgaagaaagagatataccggaacgatcttggaacagtggttacgactggataacggattttcccgggaagaccgtatggtttgtgcccagtataaagtctggaaacgatattgcaaattgtcttagaaagaacggaaaaagagtcattcaattaagtcgaaaaacctttgataccgaatatcagaaaactaaaaataacgactgggattatgtagtgacaacagatattagcgagatgggggcgaattttcgagcagacagagtaatcgatccacggcggtgtctgaaaccggtaatcttaaaagacggtcccgaacgcgttatattagctggaccaatgccagtaacagtagcatcagcggcacaaaggagaggcaggatagggagaaaccaaaataaagaaggcgatcaatacgtatatatgggacaaccgttgaacaacgatgaggaccatgcgcattggacagaagcaaaaatgttgttagataatattaatacaccggaggggataatcccagcattgttcgagccagaaagggaaaaatctgctgcgatagacggtgagtacagacttagaggagaagcgcgcaaaacttttgtagaacttatgagacggggagaccttccggtgtggctatcatacaaagtggcatccgagggctttcaatactcagataggcgatggtgttttgacggagagcgtaacaatcaagtcctcgaggaaaatatggatgttgaaatctggacgaaagaaggggaaagaaagaaacttagaccaaggtggttggatgctagaacttacagcgacccgttagcgttaagggaatttaaagaatttgcagcaggcaggcgatctgtatctggagatctcattctcgagattggcaaactcccccagcacttaaccctacgagcgcagaatgcattggacaacctagtaatgttgcacaacagcgaacaagggggaaaggcttacagacacgctatggaagaacttccagacacaattgaaactttaatgttattagctcttatagcggttttgactggcggagtcacgctattctttttgtcaggtaaaggcttggggaaaaccagtatcggattgttatgcgttactgcttcctctgccttactgtggatggctagtgttgagccgcattggatagcggcatccataattcttgagttcttcttaatggtcttactcatacctgaaccagatcgacaacggaccccacaagataaccaactagcctatgtggtaataggcttattattcatgatcttgactgtggccgccaatgaaatgggcctcttagaaacaacgaaaaaggacttagggatagggtatgtagccgctgagaatcatcaacatgccacgatgctagatgtagatctccatccagcatcggcctggacactctacgcagtcgctacaacggtcatcacacctatgatgcggcacacaattgagaacacgacagcgaatatatctttaacggcgatagcgaatcaagcggcgatattaatgggactggataaaggatggcctataagtaaaatggatataggagtaccattactagctctaggctgttatagccaggttaatcctctaacactcactgcagccgtattgatgctcgtggcgcattacgcaataattggacctggtcttcaggccaaagctaccagggaagcgcaaaaacgaaccgctgccggaataatgaaaaaccctacagtcgatggcatagttgcgatagacctagaccctgtagtttatgatgccaaatttgaaaaacaattagggcaaattatgttgttaatactgtgcacttctcaaatattactaatgagaaccacttgggcactgtgtgagagtatcacactcgcaacaggtccactcacaacactgtgggaaggatcacccggaaaattctggaatacgacgatagcggtcagtatggccaacatatttcgaggctcatatctggcaggagctggactagctttttctctaatgaaatcgcttggcggcggacgcagaggaacaggtgcacaaggagaaacacttggcgaaaagtggaaacgtcaactaaaccaattaagcaaatccgaatttaacacatataaaagatctggtattatggaggtggatcggtcagaggctaaggaaggcctcaagcgaggtgagactacgaaacatgcggtttcgaggggaacagctaagttacgatggtttgttgagcgtaacttagtaaagccagaaggtaaagttatagacttaggatgtggaagaggaggatggagttattattgtgctggtctcaagaaagtgacagaagtaaagggctacaccaagggagggcccggacacgaggaaccaataccaatggcaacttacggctggaacctcgttaaattgcactctggtaaagatgtcttctttatgcctccagagaaatgcgacactttgttatgtgatataggagaatcttcaccaaacccaaccatagaagagggaaggacactccgggtattaaaaatggtggaaccttggttaagaggaaatcagttttgcataaaaatcctaaatccctatatgccatctgttgtagaaactctagaacgcatgcaaagaaaacacggcggaatgctagtcaggaatccgctctcccgtaatagtacacatgaaatgtactgggtttcctgtggcactggcaatatagtatccgcagtcaatatgacaagtagaatgctactgaatagattcaccatggcccataggaaaccaacgtacgaacgcgatgtcgatcttggagcaggtactagacatgttgcagtggaaccagaagtcgcgaacctagatataataggacagagaattgaaaatatcaaaaatgagcacaagagtacatggcattatgacgaagacaatccgtataagacctgggcttatcatggctcctatgaggtgaagcctagcggatctgcgagttcaatggtaaatggagtagtgcgtcttctcacgaaaccttgggacgtaattccaatggttacgcaaatagcaatgacggatacaaccccttttggccaacaaagggtgtttaaagagaaggtggatactagaacgccgcgggcaaaaagaggtactacacaaatcatggaagtaactgcgaaatggctttggggattcttgtcacgaaacaagaagccaagaatatgtactagagaagagttcacaagaaaagttcgcagtaatgctgctattggagcagtttttgttgatgaaaaccaatggaatagtgcaaaagaggcagtagaagatgaacggttttgggacttagtacacagggaacgagaactacataaacaaggaaaatgtgcgacctgtgtttataacatgatgggcaagcgagaaaagaaactaggagagtttgggaaagccaaagggtcgcgcgctatatggtacatgtggctaggagcaagattcttagagtttgaagcacttggatttatgaacgaggaccactggtttagcagggaaaattcattaagtggagttgaaggagaaggcctacataaacttggctatatactaagagatatatcaaaaattcccggaggaaacatgtatgcagacgacacagcagggtgggacacacgaataacggaagatgatctacaaaacgaagcaaaaataaccgatatcatggagcctgagcatgctttattagctacctctatatttaaactgacctatcaaaataaagtagtaagagtgcaaagacctgccaaaaacggaactgtaatggacgtaataagtcggcgggaccaacgtggttctgggcaagtaggcacatatggtctaaatacatttaccaatatggaagtgcaattaattcgtcagatggaaagtgaaggcatctttttgccttcagaactagaaaccccaaacttagctgaaagagcccttgactggcttgagaaacacggggctgaaaggcttaaacgcatggctatctcaggcgacgattgcgttgtaaaaccaatagatgacagatttgcaacggccctaacggcattaaatgatatgggaaaagtaagaaaagatatcccgcaatgggagccaagcaaaggatggaacgattggcagcaagttcctttctgttcacatcattttcaccaactcattatgaaagatggaagagaaatagtggtaccatgcagaaatcaagacgagctagtaggaagggctcgagtgtcacaaggcgccggatggtctcttcgggaaacggcctgtttaggtaaatcatacgcgcaaatgtggcaactcatgtattttcacagaagagatcttagattagcagctaatgcaatttgttcagcagttccggtcgactgggtaccagcaagccgaactacttggtctatacatgcacatcaccagtggatgacaacggaagacatgttatcagtttggaaccgggtgtggatagaagagaacccatggatggaagacaaaacacatgtttcaagctgggaagaagtaccttaccttggaaaacgagaagatcaatggtgcggatcactaataggcttaactgcgagggcgacctgggcgactaatattcaagttgctataaatcaagtacgtagactcatcggtaatgagaactatttagattatatgacatcaatgaaaagatttaaaaacgaatcagacccagagggggcattatgg

SEQ ID NO: 22139 - RNA, 9876 nt, synthetic construct
  misc_feature 1..9876: note = derived and/or modified CDS sequence (opt6) from DENV-1__KF672759__SS-prME
  source 1..9876: mol_type = other RNA
tcagtcaccatgctacttatgttactcccgaccgctttagcgtttcacttaacgactagaggcggagaaccacatatgatcgtatcaaaacaagaaagaggaaaatctcttctgtttaaaacttcagttggagtaaatatgtgcacgttaattgcaatggacctaggagaattgtgcgaagatacaatgacatacaaatgccctagaataacagaagctgaacctgacgacgtagattgttggtgtaacgcaacagacacttgggtgacgtacggaacttgtagtcaaacgggagaacaccgaagagataaaagatcagtggcactagccccacacgtaggcttgggattggaaacgagaacagaaacatggatgtcatcagaaggtgcttggaaacaaattcagaaagtggaaacgtgggctttgagacaccccgggtttacagtaatagcgttattcttagcgcatgctataggaacgtcgattacccaaaaagggatcatcttcatactacttatgctcgtgaccccatctatggccatgagatgtgttggtatagggaaccgcgactttgtagaaggcttatcaggcgcgacttgggtagatgtagttttagaacatggatcttgcgtcaccactatggcgaaaaacaaaccgacccttgatattgaacttctgaaaaccgaagtgactaacccagcagttttacgcaaactatgtatagaggcaaaaatatctaacacaacaacagacagtagatgccccactcaaggagaagcgaccctagtagaggaacaagatgcaaatttcgtatgccggagaacttttgtagacagaggatgggggaatggatgcggattatttggcaaaggatctctgcttacgtgcgccaaatttaagtgtgtaaccaaactagaggggaagatcgtacaatacgaaaatctaaagtacagcgtaatagtgacagtccatacaggtgatcaacatcaagtgggaaatgaaacaactgagcatggtacaatagctactattacaccgcaagctcctacctcagagatccaattgacggactatggagctttgacactggattgttcacctcgaacaggattagattttaatgaaatggtactcttaacaatgaaggaaaagagctggctagtacacaaacaatggttcttagacttaccgttgccatggacctctggtgctagtacaagtcaagaaacctggaacagacaggatctattggtgacatttaagaccgcgcatgccaagaaacaagaggtagttgtactaggcagtcaagaaggcgcaatgcacacagcattaacaggagcaactgaaattcagacgtcggggacgactacgattttcgccggacatttgaaatgtcgtttgaaaatggacaaactgactctcaaaggtatgagctatgttatgtgtacgggaagttttaagctcgaaaaagaagttgccgagacgcaacacggaactgtcctggtacaagtaaagtatgaaggaacagacgctccttgtaaaattccattcttaacacaagacgaaaaaggggtcacacaaaatggaaggttaataaccgcaaaccctatcgtcactgacaaagaaaaaccagtcaacatagaaacagagccaccttttggtgaatcatatatcgttgttggggcaggagaaaaagcattaaaattgtcttggtttaagaaaggatcatcaataggcaagatgttcgaagcgacagctcgtggggccaggcgaatggccattctgggggatacagcatgggattttgggtccatcggtggattatttaccagtgtcggaaaactgatccatcaagtatttggcacggcatacggggtattattttccggagtatcttggacaatgaagattggaattggcattctattaacatggttagggctaaattcgaggagcacaagcctgagtatgacatgcatagcagttggcatggtaaccctctacttaggtgtaatggtacaggctgatagtggttgcgtgattaactggaaagggagggaactgaaatgtggtagtggtattttcgtcactaatgaggtacacacatggacagaacaatacaagtttcaagcagattcgcctaaaagattatcggcagcaataggaaaagcatgggaagaaggagtgtgtggtataaggtcggctacaaggctagaaaacatcatgtggaaacaaatctcgaatgagttaaattacatcctgttggaaaatgatatgaaattcaccgtagtggttggagacgtgaacggaatactcgcgcaggggaagaaaatgattagaccacaaccaatggaacataaatactcatggaaaagctggggaaaggctaaaataataggggcagatatacaaaatacgactttcatcatcgatggacctgatacacccgaatgcccagacgatcagagagcgtggaacatatgggaggtagaagattatggtttcggaatattcactaccaacatatggcttaaactaagagacagccacacacaaatgtgcgaccatcgattaatgagcgccgcgataaaagatagtaaagcggtacatgcggatatgggttattggatagagagcgaaaagaacgaaacctggaaactagcgcgtgcatcgtttatagaagtaaaaacatgtatttggccaaaaagtcacacattatggagtaatggcgtattagaaagtgagatggtaattccaaagatttatggagggccgatttctcaacacaattaccgacccggctacttcactcaaactgcaggcccatggcacctcggaaagctagaactagattttgatctatgtgaaggtacgaccgttgtggtagatgagcattgcggatatcgcggtccttcactgagaactaccacggtgacagggaaaatcatccatgaatggtgttgtcgaagttgcaccttaccaccgttaagatttagaggcgaagatggatgttggtacggaatggagatcaggccggtcaaagaaaaggaagagaatttggtacgttcaatggttagtgcaggttcgggagaagtcgatagttttagcttaggtatattatgtgtttcaatattaatagaagaggtcatgagatcacgatggagtcgcaaaatgttgatgaccggtacactggccgtatttttattattaattatgggacagttgacctggaacgacttgatcaggttgtgtattatggttggagctaatgcatcggaccgcatgggaatgggaaccacatatctagcacttatggctacatttaagatgagacctatgtttgctgtagggttgttatttagaagattgacatgtcgagaagtacttctccttaccgtaggattatctctagttgcatcagtcgaattacccaacagtttagaagaacttggagatggcctagcgatgggcattatgatgctgaagttattaacagacttccaacctcatcagctatggaccacgttactgagcctaacattcattagaacgtctttgagtttggactacgcttggaagactatggctatggcgttatctattgtttcattatttcctctttgtcttagtacaacatctcagaaaactacttggctacctgtacttctaggatcctttggatgtaaacccctaacgatgttcctgataacggaaaacaaaatatgggggagaaaatcttggcccataaacgagggtataatggctgtgggcatcgtctccattctattatcgtctttgctaaagaatgatgtaccattagcgggtcccctcatagcgggagggatgctcatcgcctgttatgtaatatctgggtcctcagcggatttaagtttggaaaaggctgccgaagtgagttgggaagaagaagctgaacactcgggaacatcacataatattctagttgaggtacaagacgatggcactatgaaaataaaagatgaggagagagacgatacactaacaattttgttgaaagccactttgttagctgtatcaggggtttatcccatgagcatccccgcaacactattcgtatggtatttctggcagaagaagaaacagagaagcggggttttatgggatactccatcaccaccgaaagtagaaagagcagttctggatgacggcatctacagaatactccaacgaggactattgggtagatctcaagttggtgttggagtatttcaagacggtgtatttcatacaatgtggcatgtgacacgaggtgcagtgttaatgtatcaaggtaagagattagaaccttcttgggcaagtgtaaagaaagacctaatatcttatggtgggggctggcgttttcaggggagctggaacacaggcgaagaagtacaagtgattgccgtagaaccaggcaagaaccccaaaaatgttcagactacgccaggcacatttaaaacccctgagggagaagtgggtgccattgcactagactttaaacctggcacaagtggctcaccgattgtcaacagagaaggcaaaattgttggactttatggtaacggagttgtcacgactagcggaacatatgtgtccgccatagcccaagcgaaagcgactcaagaaggacccctgccagagatcgaagatgaggtatttaagaaaagaaacctgactatcatggatcttcatccgggtagtggtaaaacgaggagatatttaccagcgattgtgagagaagctataaagaggaaattaagaactctaattttagcgccaactcgagttgtggcgtcagagatggcagaggctttaaagggaatgccaataaggtaccagacgaccgcagtgaaatccgaacatacaggtagagaaatcgttgatttaatgtgccatgccacattcacaatgcgtttgttatctcctgtaagagtaccaaattataatatgataataatggacgaggctcattttaccgacccagctagcatagcagcacgtggatatattagcactcgagttggcatgggtgaagctgctgctatatttatgacggctacaccgccaggctccgtcgaggcctttccacaaagcaacgctgtaattcaagatgaagaaagggacataccagagcggtcttggaactcaggttatgattggatcacagactttcccggaaagacagtgtggttcgtaccgtcaataaaaagtggaaatgatattgctaattgtttaaggaagaacggaaaaagagtaattcaactatcacgaaagacgtttgacacagaatatcaaaagacgaaaaataatgattgggattatgtagtgactacagatatatcagagatgggagctaattttcgtgccgatagagtcatagacccacgaaggtgtctaaagcctgttatactcaaagaaggaccagaaagggtaatcttggcaggacctatgccggttacagtagctagcgcagcacaaagaagaggacgtattggaagaaaccaaaataaggaaggggaccagtacatctatatgggccaacctttgaataatgacgaagatcacgcacactggacggaagcaaaaatgcttcttgataacataaatactccagaagggataatacccgcactgttcgaaccggaaagagaaaagtctgcagcaatagatggggaataccggttgagaggagaggcgaggaagacatttgtggaattaatgcgtaggggcgacttaccagtctggttatcatataaagtggcctcagaaggattccagtatagtgatcggagatggtgttttgatggggaaagaaacaaccaagtgttggaagaaaacatggatgtagaaatatggactaaagaaggtgaacgaaagaaactaagaccacgctggctagatgcgaggacatacagtgacccgctagcattacgcgaatttaaagagtttgcagccggcagacgctctgtttcgggcgatcttatacttgaaataggcaaattaccacaacacctaacgttacgtgctcaaaacgctttagacaacctagtcatgcttcataacagcgaacaaggaggaaaagcatatagacacgcaatggaggaattgcccgataccatcgaaacgctcatgttattagctttaatagcagtcttaacaggtggagtcacattatttttcttgtctggaaaaggattagggaaaaccagtatcggactattatgcgtaatggcgagtagcgcacttctatggatggctagtgtagagccgcactggatagctgcaagtattatattagagttcttcctaatggttttgttaataccagaacctgatcgtcaaagaaccccacaagacaatcagctcgcttatgtagtcattggtttgctttttatgatcttaacggttgcagccaatgaaatggggctcctagaaactaccaagaaagatctgggtataggacacgtagcagtggaaaatcatcatcatgctacaatgctggatgtagacctgcgccctgcttctgcatggacactttacgctgtagcgactacggtaatcactccgatgatgcggcatacgatcgaaaacacaactgccaatataagccttacagcaatagcaaaccaagccgcgatacttatgggactagataaaggatggccgatctcaaaaatggatataggagtgccgttattagcactgggttgctattctcaggtaaatccattaactctaaccgcagctgtattgatgcttgttgcacactatgcgataatcggtccaggtttacaagccaaagcaacaagggaggcccagaaacggactgcagccggaataatgaagaatcctacagtagatggtattgtgacgattgacttagatccagtagtatatgacgcaaaatttgagaagcaacttggccaaattatgctgttaattttatgtacttcgcaaatactactgatgcgaactacctgggcgctatgtgaatccataacattggctacgggtccgctgacaacgttgtgggagggatcccccggaaagttctggaataccactatagctgtttcaatggcgaacatatttcgtggatcatatttagcgggtgcgggtctcgcattctctctaatgaagtcgttaggaggtggacgacgtgggacaggggctcaaggagaaacattgggtgaaaagtggaaaagacaactcaatcagctatctaaatcggagttcaatacctataagaaatcgggtatcatggaagtggatcgttcggaagcgaaggagggcctcaaacgcggtgaaacaaccaaacacgccgtttcgagaggtacagcgaaactcagatggttcgttgagagaaacttggttaaacctgaaggaaaggtcattgatttaggatgcggacggggaggttggagttattattgtgcaggactcaagaaagtgaccgaagtaaaagggtacacaaaaggtggaccaggacatgaagaaccgataccaatggcaacatatggttggaatttagtaaaattacatagcggaaaagacgtattctttacgcctcctgaaaaatgcgatacccttctttgtgatatcggggaaagctcaccgaatcctacaattgaagaagggagaacattaagagtattaaaaatggtagaaccttggctcagaggaaaccagttttgcataaaaatattaaatccttatatgccttcagtggttgaaaccctagaacaaatgcaaagaaaacatgggggaatgttggtccggaacccgttaagcagaaacagcacacacgaaatgtattgggtatcctgtggcacaggcaacatagtaagcgcagtaaatatgacaagtcgaatgctcttgaataggtttacaatggcacacagaaaaccaacttacgaaagagatgttgatttaggggctggaacgcgtcacgtcgccgtagagccggaggttgctaacctagatattataggccaaagaatcgaaaatataaagaatgaacataaatcaacctggcattacgatgaggacaacccatacaaaacatgggcgtatcatgggagttacgaagttaaaccgtctgggtctgcctcttcaatggtaaatggagtggtaagactgttaacaaaaccatgggatgtaataccaatggtcactcaaatcgctatgactgatactacaccgttcggacagcagagagtattcaaagaaaaagtcgatacgagaacaccaagggctaagagaggcaccgcacaaattatggaggtaacggctaaatggctatggggattcttaagtagaaataagaaaccaaggatatgcactagggaagaatttaccagaaaagtacggtcgaatgcagcaataggagcagtattcgtagacgaaaaccaatggaactccgccaaggaagcagtcgaagatgagagattttgggatctagtacaccgtgaaagggaactacataaacaaggaaaatgtgctacgtgcgtctacaacatgatgggcaaaagagaaaagaaacttggtgaatttggcaaagcaaaaggaagtagagccatctggtatatgtggcttggtgcgcgatttttggagttcgaggcgttgggatttatgaatgaggaccattggtttagccgggagaacagcttaagtggagttgaaggagaaggtttacacaaactaggatacattttaagggatatttccaagataccaggcggtaacatgtacgcagacgatacagcaggctgggacaccagaataacggaggatgacttgcaaaatgaggctaaaattacggatataatggaaccagaacatgcattgctagctaccagtatatttaagctgacttatcagaacaaagttgttagggtacaaagaccggctaaatcaggaacagttatggatgtaatttcaaggagagatcaaagaggaagtggacaagtaggaacctatggattgaacaccttcacaaacatggaagtacaattgataaggcaaatggaaagtgagggaatattttctccgtctgagttggagacaccaaatttggcaaagaaagtcttggattggctagagaaacacggggctgaacgattgaaaaggatggctataagcggtgatgactgtgttgtcaaacctatagatgatagattcgcaaccgccttaactgcacttaatgacatggggaaagtgagaaaagatattccgcaatgggaaccctctaaaggatggaatgattggcaacaagtcccattctgttcccatcactttcatcaactaatcatgaaagacggacgtgagattgtagtcccatgcaggaatcaagatgagttggttgggagagctagagtctcccaaggagccgggtggtcattgcgcgaaactgcctgtttaggcaagagctatgcacagatgtggcaactgatgtattttcatagaagagatcttcgtctggctgcgaacgccatatgttcagctgtgccagtggattgggtaccaacttcacgcactacctggtcgatacatgcgcatcaccaatggatgacaactgaagatatgttatcagtttggaacagggtttggatagaagaaaacccttggatggaagataaaacccatgtatcttcgtgggaggaggttccgtatctgggaaaaagggaggatcagtggtgcggatccttgatcggattaacggcaagagctacatgggcaacgaatattcaagttgcaattaatcaagttagaagattgataggaaacgaaaactatcttgactatatgacaagcatgaaacggtttaagaatgaatcagaccccgaaggggccctctgg

SEQ ID NO: 22140 - RNA, 9876 nt, synthetic construct
  misc_feature 1..9876: note = derived and/or modified CDS sequence (opt6) from DENV-1__KF672761__SS-prME
  source 1..9876: mol_type = other RNA
tccgtcactatgctatttatgttactcccgacagcattagcatttcacttaacgacacgcgggggcgaaccccacatgatcgtaagcaaacaagaacgtggtaaatctctcttgttcaaaacaagtgcgggggttaatatgtgcacactaatagctatggacctcggggaattatgcgaagacacaatgacatataaatgcccgaggattacagaagctgaaccagacgacgtcgattgttggtgtaacgcaaccgatacatgggtcacatatggaacctgctcccagacgggcggtcatcgacgagataaaaggtctgtagctttagcgccccatgtaggactaggacttgaaacaaggacggaaacatggatgtcatccgaaggagcatggaaacaaatacagaaagttgagacatgggcattaaggcatcccggatttacggtaattgcactatttttagctcacgcgattggaacaagtatcacacaaaaaggaataatttttatattattaatgttggtaaccccttcgatggcaatgaggtgcgtggggataggaaatagagactttgttgaaggcttatcaggagctacgtgggttgatgttgtactagaacatggctcatgtgttacgaccatggccaaaaataaaccgactttagacattgaattgctgaaaacagaagtaaccaatccagctgttttacgcaagttgtgcatagaggcaaaaatatcgaacactaccacagatagccggtgtccaacacaaggtgaggctaccttagtcgaagaacaggatgctaatttcgtgtgtcgtcgaacctttgtggatcgcggctgggggaacggttgtggcctctttggaaaagggtcgcttcttacatgtgctaaatttaaatgtgtaactaaactagagggaaaaattgtacaatatgaaaatttgaaatacagcgtcatagtaacagtgcataccggggatcaacatcaggtaggtaacgagacaactgaacatggaaccatagcaactatcacaccacaagcccctacatccgaaatacaattaacggattatggtgcgcttacactagactgttctcctagaactggattagactttaatgaaatggtgcttctcacgatgaaagaaaaatcatggttagtacataaacaatggtttctagacctaccattgccatggacaagcggcgctagtacctcacaagaaacttggaatagacaagacctattagtaacatttaaaacagcacacgctaagaagcaagaagtagtagtgcttggctcacaagaaggagcaatgcacacagcactcactggggccacagaaattcagacaagcggtacaacaaccatatttgctggacatttaaaatgtagattaaaaatggataaattaacgctcaaaggaacttcatatgtaatgtgtactggatccttcaaattagaaaaagaagttgctgaaacccagcatggaacagtacttgtccaagtcaagtacgaagggacagatgctccttgtaaaatcccattctccacacaagacgaaaaaggcgtaacacaaaatggaagactaatcacagcaaatcccatcgttaccgataaggaaaaaccagttaacatcgaaactgaacccccgttcggtgaatcatacatagttgttggagcgggcgaaaaggctttaaagctctcttggtttaagaaagggagttcaataggtaagatgtttgaggctacagctagaggagctaggaggatggctattctaggtgatactgcatgggatttcggttctataggaggtgtatttacaagcgttggcaagttagtacatcaggtattcggaacggcatacggagtactattttcaggtgtcagctggactatgaaaattggtattggaatactgttgacatggctaggactaaactcaagatcaacctccctctcaatgacttgcatcgcggtggggatggtcaccctctatttaggggtaatggtacaagcggactcaggctgtgtcattaattggaaggggcgagaattaaaatgcggtagtggaatttttgtgactaacgaagttcacacgtggaccgaacagtataaatttcaagctgatagtcccaaacgcttatcggctgctataggaaaagcatgggaagaaggagtatgtggaattagaagtgctacaaggttagaaaatataatgtggaagcaaatttcaaatgaattaaaccacatattacttgaaaacgacatgaaattcacggtggttgtgggcgatgcaaatggaatattagctcaaggtaagaaaatgataaggccccagcctatggaacacaaatattcatggaaaagctggggcaaggcaaaaatcataggagccgacatacaaaataccacattcataatcgatggcccagataccccagaatgtccagacgaacaaagagcctggaatatatgggaagtagaggactacggtttcggaatattcacaactaatatatggttaaaattacgtgactcgtatacacaaatgtgcgatcaccgattaatgagcgccgcaataaaagattcaaaagcagtacatgccgatatgggctattggatagagtcggagaaaaacgagacatggaagctggcgcgagcttcattcatcgaggtcaagacttgcatatggccgaaatcccatacgctctggagtaatggggttcttgagagtgaaatgatcataccgaaaatatacggtggtcccatctcacaacataactatagaccaggatatttcacacaaactgcaggaccatggcatttaggtaaactcgaactcgactttgatttgtgcgagggaactacagttgtagtcgacgaacattgcggaaatagagggccaagtctaagaacaactactgtcacaggaaaaatcatacatgaatggtgttgtcgttcctgcactttaccacccctgagatttcgaggggaagacggatgctggtatggaatggaaattagaccagttaaggaaaaggaggaaaatttagtcaggagtatggtaagtgcaggtagtggagaagtggatagtttctctctaggtatcctttgtgttagcataatgatagaagaagtaatgagaagtaggtggagtaggaaaatgctgatgaccggtaccctagctgtgtttcttttactcatcatgggacagttaacgtggaatgacttgatacgactatgcataatggtcggtgcaaatgctagcgacaaaatgggcatgggcacaacgtacttggcgttaatggcaacctttaaaatgaggcctatgttcgccgtaggtttactattcaggcgtctaacatcgagagaggtattgctcttgacgattggcctaagcctagtagcatctgtcgaattgccaaatagtttggaggaattgggagacgggctagcgatgggcataatgatgttaaaactcctcacggaatttcaacctcatcaattatggacaacgcttttaagcctcacttttataaaaaccacactcagccttgactatgcttggaaaacaactgcaatggttctctcaatcgttagtctatttcctttgtgtttaagtacaacaagtcagaaaacaacatggttaccagttttattagggtcgtttgggtgtaaaccgctaactatgttcttaataacagagaataaaatatggggaagaaaaagttggccactaaatgaaggtattatggcaataggcatcgttagtattttattatcgtcgcttctgaagaacgatgtaccgctagctgggcctttgatagcaggaggaatgttaatcgcctgttacgtcatctcaggaagttcagccgacttgtccttggaaaaggctgctgaagtctcttgggaagaagaggcagaacatagcggcacatcgcataatattcttgtagaagtccaggatgacggaacaatgaagattaaagatgaagaaagagatgatactcttacaatattactgaaagctacactgctcgccgtttctggcgtttacccaatgtcgatacccgcaacattattcgtgtggtatttctggcagaagaagaaacaaagatcaggcgttttatgggacacaccgagtccccctgaagtggaacgagcagttctggacgatggaatatatagaatacttcagaggggccttctaggccgctcacaagtaggcgttggagtatttcaagatggtgtgttccatacaatgtggcatgttacaagaggtgccgtgttaatgtaccaagggaagagacttgagccgtcttgggcatcagtaaagaaagatctaatatcatacgggggcggatggagatttcaagggtcatggaacactggagaggaagttcaagtaatagcggtagaaccaggtaaaaatccgaaaaacgtccaaacaacaccagggacttttaagaccccagaaggtgaggttggggctattgccctggattttaagccaggaacaagcggttctccaattgttaatcgagaaggtaaaattgttggactctatggaaatggtgttgttaccacgtcgggaacatacgtttcagcaatagcacaagctaaagcatcacaagaaggtccactcccggaaatcgaagacgaggtcttcaagaaacgtaacttgaccattatggaccttcacccgggtagcggcaagaccagaagatatttgccagcgattgtccgagaagcgataaaaagaaaactaagaactctgatattagctccaacgcgtgtggtggcaagtgaaatggcggaagcactaaaaggaatgccaatacgttatcaaacaacagccgttaaatcagaacacacgggccgggagatagtagacttgatgtgtcatgccacattcaccatgagactcttatcaccggttcgcgtgcctaactacaacatgatcatcatggatgaagctcacttcacggatccagcatctatagctgcaaggggctatatatccacgcgagtaggaatgggcgaagctgccgcaatatttatgactgccacaccgccggggagtgtcgaggcgttccctcaatccaatgcagtcatccaagatgaagaacgcgacattccagagcggtcttggaatagtggttatgattggataactgactttcctgggaaaacggtatggtttgtaccttcaataaaatctggtaatgacattgctaactgcttacgcaagaatggaaaacgtgttatacaactgtcaagaaaaacatttgatacggagtatcaaaagaccaaaaacaacgattgggattatgtagtaactactgatatatcggaaatgggcgcaaactttagggcagaccgtgtaatcgatcctagaagatgtttgaaacctgtgatattaaaggatggacccgaacgagtcatcttggcaggccccatgccagttacggttgcatcagctgctcaaagacggggtagaatcggccgtaatcagaataaagaaggagatcaatacgtctatatggggcaaccgcttaacaacgatgaagaccatgcccattggacagaagcgaaaatgctactggataatattaatacccccgaaggaattatcccagcacttttcgaacctgaaagagagaaatcagcagcaattgatggagaatatcggttaagaggtgaagcaagaaaaacgttcgttgagcttatgagaagaggagatttaccagtctggctatcatataaagtcgcaagtgaaggatttcaatattcggacagaagatggtgttttgacggggaaagaaataatcaagtccttgaagaaaatatggatgtggaaatttggacaaaagagggagaacgtaagaaattaagacctaggtggcttgatgcacgaacttatagtgatccgctcgcattgcgagaatttaaagaatttgcagctggtaggcgctcagtgtcgggagatttgattttagagataggaaaactaccacaacatctaacattacgggcccaaaacgctttggataacttagttatgttacataactcagagcaaggaggtaaggcataccggcatgctatggaagagttaccagatacaatagaaacccttatgcttctagcactcatagccgtactaactggaggagtaacacttttcttcctttcgggaaaaggtttggggaagacctctataggtctattatgcgttacggcatcatcagcattactttggatggcgtctgtcgagcctcattggattgctgcaagcattatactagagttctttttaatggtcctcctcataccggaacctgacaggcagagaacacctcaagataatcaactagcctacgttgtgataggacttctttttatgattcttacagtagcagcaaacgaaatgggactattagaaacaacaaagaaagatttgggaattggtcatgttgctgccgaaaaccatcaacacgcaacgatgttggatgtagacctgagaccggcatcagcatggaccctgtatgcggttgcaacaaccgtaatcacaccaatgatgagacacaccattgaaaacacaaccgctaatatatctttaaccgccatagctaaccaggcggccatcttgatgggactagataaaggctggcctataagtaaaatggacataggggtaccgcttttggctcttgggtgttatagccaagttaatcctttaacattaacggcagctgtacttatgttagtagctcactatgccattatcgggccaggtcttcaggcgaaagcaacgagagaagcacaaaagcgcacagccgcaggcattatgaagaatcccacagtagacggaatagttgctatcgatctagacccagtcgtatatgacgccaaatttgagaaacaacttggacaaatcatgctacttattctctgtacctctcaaattttgttaatgagaacaacatgggccttatgtgaatctatcacactagctactggccctctaacaactttatgggaaggatcgcctggaaagttttggaatacaacaatcgccgtatctatggctaatatttttaggggaagctatctcgctggtgcggggctagcattctcgcttatgaaatctctcggagggggtcgaagaggaacgggagcacagggagaaactttgggtgaaaaatggaaaagacaattaaaccaactgtcaaagagtgagttcaacacatacaagcgtagcgggattatggaagtagatagaagtgaagcaaaagaaggattgaaacgcggtgaaactacaaaacatgcagtctcaaggggtacagctaaacttaggtggttcgtggaacgtaaccttgtaaaaccggaaggcaaagtaattgaccttgggtgcggtcgtggtggatggtcctattattgtgctgggttaaagaaagttactgaggtaaaaggatacacaaaaggaggaccgggccatgaggaaccgattcctatggcaacatatggatggaatttagtgaaactacattctggaaaagatgtgtttttcatgccgcctgaaaaatgcgacacattattatgtgatataggtgaaagttcgcctaatcccacaatagaagagggtagaacgcttagagtgctcaaaatggtagaaccgtggttaaggggcaaccaattttgtattaagatactaaatccttacatgccaagtgtggtcgaaacattagaacaaatgcagagaaagcatggaggtatgcttgtcaggaatccgctttcgcgcaacagtacacatgaaatgtactgggttagttgcggaactggaaacatagtttcagcagtaaatatgacctcgcggatgctcttaaacaggttcaccatggctcatagaaaacccacatatgaaagagatgtagatcttggtgcaggaacaaggcacgtcgccgtagagccagaggtggctaatctagacataataggacaaaggatagaaaatattaaaaacgaacataaatcaacatggcattatgacgaagacaacccgtacaaaacatgggcttaccatggttcctatgaggtcaagcccagcggtagcgcgtcaagtatggttaatggagtagttagactactcacgaaaccttgggatgtaattcctatggtaacacaaatagccatgacagatacgacgcctttcggccagcaaagagtctttaaagaaaaggtggacacacgaacacctagagcaaaaagaggtacggcccaaatcatggaagtaactgcaaagtggctttggggattcctgtccaggaataagaaaccaaggatctgcacccgcgaagaatttactcggaaagttcgatcgaacgctgccattggagcagttttcgttgatgaaaaccaatggaactccgcaaaggaagcggtcgaagatgaacgattctgggatctcgtacatagagaacgtgaactccataagcaaggcaaatgcgcgacgtgtgtttataatatgatgggaaaacgagaaaagaagttgggagagttcggcaaagcgaaaggatcacgagccatctggtacatgtggctcggagcgaggttcctagagttcgaagcccttggctttatgaatgaggaccattggttcagccgtgaaaatagtttgtctggtgtagagggggaaggtttacataaactaggttatatcttgagagatattagcaagatacctggaggtaatatgtatgcggatgacacagcaggttgggacacacgcataaccgaagatgatttgcaaaacgaagcaaaaattactgatattatggagccagaacatgctctcttggctacctcaatattcaaactcacataccaaaacaaagtagtacgagttcagaggccggccaaaaatggaacagtcatggatgtgattagccgacgagaccaaagggggtcaggccaagtcggcacttatgggctaaatacatttactaacatggaggtccaactcattaggcaaatggaaagcgaaggaatatttttgcccagcgaattagaaactcctaatctcgccgagagggttctagactggctggaaaaacatggtgcagaaaggctcaaaagaatggctatctcaggagatgattgtgttgttaaaccaattgatgatcgtttcgcaacggcgttgatagctcttaacgacatgggaaaagtaagaaaagatataccgcaatgggaaccatcaaagggttggaacgactggcagcaagttccgttttgttcacaccacttccaccaactaattatgaaagatggaagagaaattgtcgtcccatgccgtaaccaagatgaactggtgggccgtgctagggtgagccaaggtgccggatggtcattgagggaaacggcctgcctggggaaaagctatgcacaaatgtggcagctaatgtattttcatcgccgcgatctaagacttgcagcaaacgcaatatgttcagcggttccggtcgactgggtacccacctcaagaaccacctggtcgatacacgcacatcaccagtggatgactacagaagacatgttaagtgtgtggaatcgagtctggatagaggaaaatccttggatggaagataaaacacatgtgagcagttgggaagaagttccttatctcggaaaaagagaagatcagtggtgcggatcattaattggactaacagccagagctacatgggcaactaatatacaggtagcaataaaccaggtcagacggttaataggcaatgaaaactatttagattatatgacatctatgaaacggttcaagaatgaaagtgaccctgaaggcgctctatgg

SEQ ID NO: 22141 - RNA, 9876 nt, synthetic construct
  misc_feature 1..9876: note = derived and/or modified CDS sequence (opt6) from DENV-1__KF672762__SS-prME
  source 1..9876: mol_type = other RNA
tcagtaaccatgcttcttatgctattgccgaccgcactagctttccatttgaccacccgcgggggtgaaccgcatatgatagtatctaaacaagaacggggaaaatcattactattcaaaacatcagctggagttaatatgtgtactctaattgctatggacttaggagagttatgtgaagacactatgacatataaatgcccaagaataacggaagcagaacctgatgacgttgattgttggtgcaacgcaactgatacttgggtaacatacggtacatgttcacaaacaggagaacatcgtagagataaacgaagtgtagccttagcaccacacgtgggccttggtcttgaaacaagaactgaaacctggatgagttcagaaggagcatggaaacaaatccaaaaagtagaaacttgggctttaaggcaccccggctttactgtaattgcgttgttcttagcccacgctataggcacatcaataacccaaaaaggaataatattcatacttttaatgctcgtaacaccttccatggcaatgcgatgtgtcggcataggtaatcgtgattttgtggaaggcctcagcggtgcaacctgggtagatgtagttctcgaacacggctcatgcgttactacaatggccaaaaataaaccaactttggatatagaattgttaaaaacggaagttacaaatccagcggtgctgagaaaattatgtatagaagccaaaatcagtaatactacaacagatagccgctgtcctacccagggtgaagctactctagtcgaggaacaagatgctaactttgtatgccgccggacttttgtggatagagggtggggcaatggatgcggtttgtttggaaaaggatctttattaacttgcgctaaatttaaatgtgtaaccaaattagaaggaaaaatagtacaatatgagaaccttaagtactcagttatagtaacagtacacacaggcgatcagcatcaagtaggtaatgaaacaaccgaacatggaacgatcgctactattacaccacaagcccccacctcagaaatacaattgactgattacggcgcattaacgctagattgtagtcccagaacggggttagatttcaatgagatggtattactaaccatgaaagaaaaatcatggttagtacacaaacagtggtttttagacttgccgttgccttggacatcgggcgcttcgacgtcacaagagacctggaacagacaggatctcctagtgacttttaaaacagcacacgctaagaagcaagaagtagtagtgctgggctcacaagagggagcaatgcatacagctctaactggtgcaacagaaatacagacaagcggaactacgacaatcttcgcgggtcatctaaaatgtaggctaaaaatggataaattaacgcttaaaggcacatcatatgttatgtgtacggggtcttttaaactggaaaaagaggtcgctgaaacgcagcacggtacggtgctagtccaagttaaatacgagggcatcgatgctccttgtaaaatacctttttcaacacaggacgagaaaggagtcacacagaacggtaggttaattacagcgaaccctattgtaactgataaagagaaaccagtgaatatcgagacagaacccccttttggcgaatcctatattgtagttggagccggtgaaaaagcactgaagctcagctggttcaagaaaggctcaagtattggtaaaatgtttgaagctaccgcacgtggggcacgccggatggcgattctcggggacacagcttgggactttggatcaataggtggagttttcacatctgtcggaaaacttgtacaccaagtacttggcacagcgtatggagtgttattctctggtgtatcttggacaatgaaaattggtataggtatcctgctcacatggctcgggctaaactctagaagcacgagcttgtcgatgacatgtattgcagtaggaatggtgacattgtacctaggagtaatggtacaggctgacagcggatgtgtgattaattggaaaggtagagaattaaaatgcgggagcggcatattcgtaacgaacgaagtgcatacatggactgaacaatataaattccaggctgactccccgaagcgattaagtgccgccatagggaaagcgtgggaagaaggagtctgtggaatacgaagtgcaacaagattggaaaatattatgtggaaacaaatctcgaacgaactaaatcatattcttctggaaaatgacatgaagtttacggtggtggtaggagatgcaaatggtatactagcccaaggtaagaaaatgatcagaccgcaaccaatggaacacaaatactcttggaagagttgggggaaagcaaagatcatcggagcagacattcaaaatacaacgtttataatagacgggccagacaccccggaatgtccagacgaacaaagggcttggaatatctgggaagtagaagactatggatttgggatctttacaacaaatatctggttaaaactacgagattcctatactcaaatgtgcgaccacagacttatgtcagctgcaattaaggatagtaaagctgtacatgccgatatgggatattggattgaatcagagaaaaatgagacatggaaattggctagagcttcatttatagaggtcaaaacctgtatatggccaaaatctcacacactatggagtaatggagtcttggaatcagaaatgatcataccaaaaatttatggtggaccaattagtcaacataattatagaccgggctattttacccaaacagctggcccatggcatttaggcaaactagaacttgatttcgatttatgtgagggaacaaccgttgtagtggacgaacattgtggaaatcgaggcccatcgttgaggacaaccacagttactggaaaaataattcatgagtggtgctgtcgttcatgcacgctaccaccgctacgattcaggggagaagatggttgctggtatggaatggaaatcaggcctgtcaaagaaaaagaagaaaacttagtgcgaagcatggtcagcgcaggctctggtgaggtagacagttttagcttaggtatattatgtgtaagtatcatgatagaggaagtaatgagatctaggtggtcgcgaaaaatgctaatgactggaacgttagcagtattcttattactaataatgggtcaattaacatggaacgatttaataaggttatgtataatggtcggcgcaaatgcctcggacaagatgggcatgggcacaacatatttagctctgatggcaacatttaaaatgagaccaatgttcgctgttgggctgttattcaggcgcctaacctccagagaagtattgctactaacaatcggtttaagcctagtagcttcagttgaacttccaaatagtctagaggaactcggtgacggtctggctatgggaataatgatgcttaaactgttgacggaatttcagcctcaccagctatggacgacgcttttgagcttaacgtttattaaaacgacattatcactagattacgcctggaaaacaacagctatggtactttccatagtcagcttattccccttgtgtctatcgacgacatctcaaaagactacttggttaccagtgttactcggtagtttcggttgcaagccacttactatgtttcttataacagaaaacaaaatttggggtagaaaaagttggccattgaatgaagggattatggctatagggatagtatcaatactcctatcttcattattaaagaatgatgtaccgttggccggtcctcttattgctggcgggatgctgatagcttgttatgtaataagtgggtcatcagcggacctatcactagagaaagctgccgaagtatcatgggaagaagaagctgagcattcgggtacgagtcataatatactggtcgaagtccaagatgacgggacaatgaaaataaaagacgaagagagagatgacaccctaacaattttattaaaagcgactcttttggcagtgtctggggtttacccgatgtctataccagcgacgttatttgtatggtatttttggcagaagaagaaacaacgatcaggtgttttgtgggataccccatcgccaccagaagtagagcgagcagtattagacgatggtatctatagaattttacaacgcggactattgggacgtagtcaagtaggagtaggggtcttccaagacggggtattccatacaatgtggcatgttactcgcggtgcggtacttatgtatcaaggtaaacgtctagaaccttcttgggcgtcagtcaagaaagatttgatttcatacggagggggatggcggttccaaggttcttggaatacgggggaggaggtacaggtaattgctgtcgaacctggcaaaaaccccaaaaatgttcagactaccccaggaacattcaaaacaccagaaggagaggttggagcgatcgccctagacttcaaaccagggacatcaggcagtcctatagttaatagggaaggcaaaatagtagggctatacggtaacggagttgtaacgacctccggaacttacgttagtgcaatagcccaggccaaagcatcccaagaaggccctctaccagagatcgaggatgaggtttttaaaaagagaaatttaacaatcatggaccttcatccaggttctggaaagacccgacgctatctcccagctatcgtacgtgaagcaatcaaaagaaaacttcgaacattgattctagcaccgacaagagtggtggccagtgaaatggcagaagcgctgaaaggaatgcctattagatatcaaacgacagctgtaaagtcagagcatactggtagggagatcgtagatcttatgtgccacgcaacattcacgatgaggttgctcagtcccgttagggtgcccaattataatatgataataatggatgaggcacactttactgaccctgcaagcatcgctgcaaggggctatatctcaacgagagttggtatgggcgaggccgcagccattttcatgactgcaactccgcccgggagcgtagaggcatttccacaaagcaatgcggtcattcaggacgaggagagagatataccggaaagatcttggaactctggatacgattggataacagactttcctggaagaactgtatggtttgtgcctagtatcaaatcagggaatgacatagctaattgtctcaggaaaaatgggaaacgagtcatacaattatcacggaaaacgtttgatacagaatatcaaaagactaaaaataatgactgggattatgtggtaactacagacatttccgaaatgggggcaaacttccgagctgatagggtgatcgaccctaggcgttgcttaaagccagttatcttaaaagatggacctgaacgtgttattttggccggtccgatgccggtgacagtcgcatcagcggcacaaagaagaggcagaattggacgaaatcaaaataaagaaggagaccaatatgtctacatgggccaacctttaaataatgacgaagatcatgctcattggacagaagcaaaaatgctcttagataacataaacactccagaaggcataatacccgctttattcgaacctgagagagaaaagtcagcagcgattgacggagaatacagactgaggggagaagcaagaaagacgtttgtagagctgatgagaagaggagatctgcctgtatggttatcttataaggttgcttctgaaggattccagtacagtgaccgccgctggtgcttcgatggtgaacggaataatcaagttctagaggaaaatatggatgtagaaatttggaccaaagagggcgaaaggaagaaactacgtcctcgatggttagacgctcggacctatagtgatccattggccttacgtgaatttaaagaatttgctgcgggtcgacggagtgtgtctggtgacctcattttggaaatcggaaaacttcctcagcatcttacccttcgagcgcaaaacgccttagataatttagtaatgttacataatagtgaacaaggaggtaaagcgtatcgacacgctatggaagaactacctgatactatagaaacgttaatgttgctagctctgatagctgtactcacaggtggtgtaacgttattctttctaagtggtaaaggtcttgggaaaacgtcaatagggttgctttgcgtaactgcatcttcagccttattatggatggctagtgttgaaccccattggatagctgcatctataatactggagttctttcttatggtattattaatccccgaaccagatcgccagaggacaccacaagataaccaactggcatatgttgtaataggccttttatttatgatcttaaccgtcgctgcaaacgaaatgggactactagaaacaactaagaaagatttggggattggtcatgttgccgctgaaaaccatcaacatgctaccatgctggatgtagatcttaggccagcgtccgcttggactttatacgcagtcgcaactactgtcataacccctatgatgagacatacaattgaaaatactaccgcaaacataagcctgacagccatagccaatcaagctgcaatactaatgggtttggacaagggatggcccatatctaagatggacataggtgttccactactcgcattaggatgttatagccaagttaaccctttaacacttacagcagccgtgttgatgttggttgctcattatgcaattatcggaccaggactacaagcgaaagctactagggaagctcagaaaagaacagcagcaggaattatgaaaaatccgactgtcgatggtatcgtagccattgatcttgatcccgtagtttacgatgcaaaatttgaaaaacagcttggtcaaatcatgctactaatcttatgcacctcgcagattttgctaatgcgaacgacttgggctctctgtgaatctataacacttgcgacaggacctcttacaacgttatgggaaggatcacctggcaaattttggaatactacgatagcagtatcaatggcaaatatattccgaggatcatatttagcaggggcgggtctggcattcagtttaatgaaaagtttaggaggaggtagacgggggactggagcgcagggagagacgttaggtgaaaaatggaagaggcagcttaaccaactcagtaagtcagagtttaatacatacaaaagatccggcattatggaagtagatcggtccgaagcaaaagaaggacttaaacgaggtgaaacaacaaaacacgccgtttcgagaggtacagccaaattacgatggtttgtagaaagaaacctagtgaagcctgaaggtaaagtaatcgatcttggatgcggaaggggcgggtggtcgtattattgcgctggtctcaagaaggtgacggaggttaaaggatacactaaagggggtcctggtcatgaggaaccaataccaatggcaacctacggttggaatctcgtaaaattacactcggggaaagacgtgtttttcatgccaccagaaaaatgcgacactttattatgcgacataggggaatcgtcaccaaatccaacaattgaggaaggcaggactcttagggtattgaaaatggtagaaccatggctaagaggaaaccagttttgcataaaaattctgaacccgtacatgccttctgttgtcgaaacgttggagcaaatgcaaagaaaacatggtgggatgcttgtgagaaacccgctgagcagaaattccacacacgaaatgtattgggtatcctgtggaacggggaacatagtgtcggcagtcaatatgacatcgaggatgttgttaaacaggtttacgatggcacaccgaaaacctacatatgaaagagacgtagatttaggagctggtactagacatgttgcggttgaaccggaagttgcaaatctagacataataggacaaagaatagaaaacatcaaaaacgaacacaaaagtacttggcattacgatgaggacaacccctataagacttgggcctatcatggaagctatgaagtcaaacccagcggaagcgcgagttcaatggtaaacggtgttgtgagactcttgacaaaaccttgggatgttattccaatggtaacccaaatcgctatgacagatactacaccttttgggcaacagagagtctttaaagagaaagttgacactagaacaccgcgagctaaacgaggaactgcacaaataatggaagtgacagctaaatggctttggggatttctttctcggaataagaaaccacgaatatgcacaagggaggaatttactagaaaagtaagatcaaatgcagctatcggagcggtttttgtagacgaaaatcaatggaactccgctaaggaagccgtggaggatgagagattttgggatctagttcatcgggaacgagagttacacaagcaaggtaaatgtgcaacatgtgtctataatatgatgggcaaacgtgagaagaaactaggcgagttcggaaaagcaaaaggatctagggcaatttggtatatgtggctaggagctaggttccttgagtttgaggccttaggcttcatgaatgaagatcattggtttagtcgagaaaattctctttcaggagtcgaaggagaaggtctgcacaaactaggatatattctgcgagatataagtaaaatacctggtggaaatatgtatgctgatgatacagccggatgggacaccagaataacagaagatgatcttcaaaatgaggcaaaaattacggacataatggaaccagaacatgccttactagctacaagtatttttaagctaacctaccaaaacaaggtagtcagagttcaaagaccagccaaaaacggtacggtaatggatgtaatttcgagacgagaccagcgggggagtgggcaagttggaacttacgggttgaatactttcacaaatatggaagttcagctaattagacaaatggaatcagaaggaatatttctaccatctgaattagaaactccgaaccttgcagagagagtccttgactggttagaaaagcatggagccgaaagattaaagagaatggctataagtggcgacgattgtgtagtaaaaccaatcgatgatagattcgctactgcgctcattgccctgaatgatatgggtaaagtaagaaaagacatacctcaatgggagccctctaagggatggaatgactggcaacaagttccattttgttcccaccatttccatcaacttataatgaaggatggtcgagaaatagtcgtcccctgcagaaaccaagatgagctagtaggaagggcgagagtcagccaaggcgcaggttggagtctcagggagacagcttgtttaggcaagtcatatgctcaaatgtggcagctaatgtactttcatagaagagatttgcgtctcgcagctaatgcaatctgctcagcagtacctatagactgggtacctacaagccgaacaacatggtccatccacgcacatcatcaatggatgacgacagaggatatgcttagcgtttggaaccgagtatggattgaggaaaacccttggatggaagacaaagcacatgtaagctcctgggaagaagtcccttacttggggaaacgggaagatcaatggtgcggaagtctaataggattgacggcaagagcaacgtgggcaacaaatatacaggtagcgataaatcaggtacggaggctaatcgggaacgagaattacctagattacatgacttctatgaaaaggtttaaaaacgaaagtgatcctgaaggggctctctgg

SEQ ID NO: 22142 - RNA, 9879 nt, synthetic construct
  misc_feature 1..9879: note = derived and/or modified CDS sequence (opt6) from DENV-1__JF459993__SS-prME
  source 1..9879: mol_type = other RNA
tccgtgacgatgctatttatgttattacctacgagcttagcatttcacttaacaactaggggcggagaaccgcatatgattgttagcaaacaagaacgaggcaaatcattattattcaagacaagtgccggcgtaaacatgtgtacgttaattgcgatggatcttggagaattgtgcgaagacaccatgacctataaatgtcctcgaattactgaaactgaaccagatgacgttgattgctggtgcaacgcaactgaaacttgggtaacttacggcacatgttcacaaaccggcgagcatagaagagacaaacgatccgttgcattagccccgcatgtagggttaggtctagagactagaaccgaaacctggatgtcatcagaaggtgcatggaaacagattcagaaagtcgaaacatgggcattagggcacccgggtttcaccgtcattgctctattcctagcgcatgcgataggcacaagtataactcaaaaagggatcatattcatcctactgatgttggttactccatcaatggcgatgcgctgtgttggcataggcaatagagatttcgtagaagggttatctggtgccacatgggtggatgttgtattggagcacggatcatgcgtcaccacgatggcaaaagataagccaacattggatattgaattattaaagacagaggtaactaacccagccatattacgcaaactctgtatagaagctaaaatatcaaataccacaactgatagtagatgtccaacgcaaggtgaagccacgctggtagaagaacaggatacgaactttgtttgtaggcggacctttgttgatcgaggatggggtaacgggtgtggactttttggcaaaggaagtttaataacttgtgctaaatttaaatgtgtaacaaaactggaggggaaaatagttcaatatgagaatctaaagtactcggtcattgttactgtgcacactggcgatcaacaccaagtgggtaacgagacaacagagcatgggactacagctacaattaccccccaagccccaacctcggagatacaactaactgattatggagcgcttacattagactgctccccaagaaccggactcgattttaatgagatggttttattgaccatgaaagaaaaaagctggctggtacataaacaatggttcctggatctaccgttaccatggacatcaggagcaagtacttcacaagaaacgtggaacagacaggatctcctagttacattcaaaacagctcatgctaaaaaacaagaagtagttgtcttggggagtcaagaaggagcaatgcatacagccctgacaggggccaccgaaatacaaacaagtggaactacgacaatatttgcgggccacctcaaatgcagattaaaaatggataaacttactctcaagggggtaagctatgtgatgtgtacaggaagtttcaagttagaaaaggaagtagcagaaacacaacatggaactgtccttgtacaggtaaaatatgaaggtactgatgctccatgcaaaataccattctcatcccaagacgagaaaggtgtaatacagaacggaagattgataacggcaaatcccatagttacagacaaggagaaaccagtaaacatcgaagcggaaccacctttcggagaatcgtatatcgtcgtaggagccggtgaaaaagcacttaaattatcttggttcaagaaaggaagttcgataggaaaaatgttcgaagcaacagctcgcggagctagacggatggccatattaggtgacacagcttgggacttcggctcgataggcggtgtatttacgagtgtagggaaattagtgcatcaaatctttggaacggcgtacggagtcctctttagtggggttagctggactatgaaaattggtataggcattttattaacatggttaggattaaacagcaggtcaacaagtttaagcatgacatgcatagccgtaggaatggttacgctttatttaggggtaatggtacaggcagattctgggtgtgtgatcaactggaaaggtcgggaactaaagtgcggttcaggaatattcgttaccaatgaggtgcacacgtggacggaacaatataagttccaagcagattccccaaaacgcctgagtgctgcaataggcaaggcatgggaggagggagtttgcgggatacgatcagcaacacgcttagaaaacattatgtggaagcaaatctcaaacgaattgaatcatattctcttagaaaatgacatgaaatttactgtagtcgtaggagatgtcgctggaatacttgcacaagggaagaaaatgatccgaccacaaccaatggaatataaatactcatggaaaagctggggaaaagcgaaaataatcggagcggacgtgcaaaatgccacattcataatagacggcccaaacacgccagagtgtcctgatgatcagcgcgcatggaatatatgggaagtcgaagactacggctttggcatatttaccacaaatatatggctaaagcttcgagattcttatactcaagtatgtgaccatcgccttatgagcgcagcgatcaaagactcgaaagctgtccatgcagacatggggtattggattgaaagcgaaaaaaatgaaacctggaaactagcccgtgcatcgtttattgaagtcaaaacatgtgtttggccgaaaagccataccctttggtctaacggagtattagaatctgaaatgataattccgaaaatatacggtggcccaatatctcaacacaatcatcggccaggatacttcacccaaactgctgggccttggcacctgggaaaattggaactggattttgatctatgcgaaggaacaaccgtcgtagtcgacgaacattgtggtaatagagggccatcacttaggactacaacagtaactggtaaaataattcatgaatggtgctgccgaagctgtacgctaccacctctccgatttagaggcgaagacggttgttggtacggtatggaaataaggccagtaaaggaaaaagaagagaatttggtaaaaagtatggtaagcgcaggttccggagaagtagacagtttttcattgggcctattatgcatatctataatgatagaggaagtaatgagaagtagatggagtcgtaaaatgttgatgacgggaactttggctgtattctttctattaataatggggcaattaacctggaatgatttaataagactatgtataatggtaggtgccaatgcctcggacaggatgggaatggggacgacttatctggcattaatggctacttttaaaatgagacctatgtttgccgtgggactattatttcgacggttaacaagccgagaagtcttgttattaactataggactatcgcttgttgcatcggtcgagctgccaaacagcttggaagaacttggcgacgggttggctatgggtattatgatacttaagttattgactgatttccaatcccatcaactgtgggcaactctcctctcgctaacgttcataaaaacaacgttcagtctccattatgcatggaaaactatggcaatggtattatcgattgttagtttattccctctatgtctttctacgacatctcaaaaaacgacctggctaccagtcctattagggtccctcggatgcaagcccctaacaatgttcctgattgcagaaaataagatttggggcaggaagagctggccacttaatgaggggataatggcagtaggaattgtgtctattttattatcgtcactattgaagaatgacgtacctctagcaggcccactcattgcaggaggaatgctcatcgcgtgttacgttataagcggctcgagcgcggacctctctttagaaaaagcagcagaggtttcatgggaagaggaggcagagcattctggtgccagtcataatatcttagtggaggtgcaggatgacggaacgatgaagattaaagacgaagaaagggatgatactttaacaattctattaaaagcgaccctgttagcagtcagtggagtatatcctctatcaatacccgcaacattattcgtatggtacttctggcagaaaaaaaaacaaagaagcggggtactatgggacactcccagtccacccgaagtcgaaagagcagtattagacgacggcatttacaggataatgcagcgaggcttgctaggtagatcccaagttggagtaggagtattccaggaaaacgtgttccatacaatgtggcatgtaactcgaggtgccgtcctaatgtaccaaggaaaaagactagaaccatcgtgggcaagcgtgaaaaaagacctgataagctacggaggaggatggagactacaaggaagttggaatactggagaagaagtacaggttatagctgtcgaacctggtaaaaatcccaagaacgtacaaacagcaccaggaacattcaagacgcctgagggagaagttggagccattgcactagattttaagccaggcactagcggtagcccaatagttaacagggaaggaaaaatagttgggttgtacggcaacggagtcgtcactacaagtggcacatacgtgagtgctatcgctcaagcaaaagcatcacaggaaggacctctcccagaaatagaagacgaggtattcagaaaaaggaaccttacgataatggacttacacccgggctctgggaaaacccgaagatatctaccggcgatcgttcgagaagccatcaaaagaaaactgagaacgctgatccttgcacccacacgagtagtcgccagcgagatggcagaagcattaaaaggtatgcccattagataccaaacaactgcggttaaaagcgagcatactgggaaggaaattgtggatcttatgtgccatgcaacatttactatgcgtttactgtcgccggtgagagtacccaattacaacatgataattatggacgaagcccactttaccgaccctagtagtattgcagccagaggttacatttctacccgtgttggaatgggcgaagcagctgctatttttatgacagcgacgcccccgggtagtgtggaagcctttccgcaatcaaatgcagtaatccaagatgaagaacgtgacattcccgaaaggagctggaattccgggtatgagtggattaccgattttcctggtaaaacagtctggttcgtccctagcataaaaagtggaaacgatatcgccaactgcctgcgcaaaaacggcaaacgggtaattcaattaagtagaaagacattcgacaccgaataccaaaagacgaaaaacaatgattgggattacgtagtaactactgatattagcgagatgggtgccaatttcagagccgatcgagtcatcgatccaagacgatgtttaaaaccagtgattctcaaagatggaccagagcgcgtcatacttgccggtccaatgccggtgaccgttgcatcggcggcacaacgacgaggcaggataggtaggaaccataataaagagggcgatcaatatatatatatgggtcaacctttaaacaacgacgaggatcatgcacactggactgaagcaaaaatgctgctagacaacattaacaccccagagggcattataccagctttatttgaaccagaacgcgagaaaagtgcagcaattgacggcgaatacagattacgaggagaggcgaggaaaacttttgtcgaattgatgcgaagaggagaccttccagtatggctatcttacaaagttgcttcagaagggtttcagtattcagatcgacgttggtgttttgatggtgaaaggaataaccaagttttggaagaaaacatggacgttgaaatctggactaaagaaggggaacgtaaaaagctccgaccaaggtggttagatgcacgaacatactcggacccactagcgttaagagaattcaaagaatttgctgcagggaggagaagtgttagcggggatctgatacttgagataggaaaactgccccagcacttaacacaacgagcccaaaatgcccttgacaatttggttatgctacacaattcagaacaaggaggtagggcatacaggcatgccctagaagagttacccgatacaatagaaacattaatgctattagcgttgatagccgtgcttacgggaggagtaactttatttttcttatcaggaagagggttaggcaaaacaagcatagggctgctatgtgtgatggctagctcggcactgctttggatggcatctgtagaacctcattggatagcagcttccatcattctggagttcttcctaatggtactattaataccagaacccgatcggcaacgcacaccgcaagataatcaattagcatacgtagtaataggtttgctgttcatgattctgacggtagctgcaaatgaaatgggcttgttagaaacgacgaaaaaagatttgggaattgggcacgtagcggtggaaaatcatcatcacgcgtccatgctagatgttgatttacaccctgcgtcagcatggacactctacgcggttgcaactaccatcattacacctatgatgaggcataccatagagaatacaactgctaatataagtcttacagcgatagccaatcaggcagcaatactcatgggtcttgataaaggatggccaatatcaaagatggatattggagtcccactactggccttagggtgctacagccaggtcaatccattaacattgacagctgcggtattaatgttagttgcgcattatgcaattattgggcccgggcttcaagcaaaggctacgcgagaggcacaaaaaagaacagctgcaggaataatgaaaaatccaacagttgatgggatcgttgcgatagacctagatcctgtagtctatgatgccaaattcgaaaaacaactgggacaaattatgttgttgattttatgtactagccaaatactacttatgcgaacaacatgggcgttatgcgagagtataacccttgctacaggacccctcactacactctgggaaggctcaccgggaaaattctggaacacaacaatcgccgtgagtatggcaaacatattccgaggaagctatttagccggagcaggactcgcctttagtctcatgaaatcattgggaggaggcagacgtggaaccggtgcacaaggtgaaaccttaggtgaaaaatggaaaagacaattgaatcaactttcgaaatctgaattcaatacatacaaacgtagtggtataatggaagtcgatcgatcagaagcaaaggaaggtctaaagcgtggggaaacaaccaaacatgcagtcagtcgaggtactgcaaaattaagatggttcgtcgagaggaatctagttaaaccagaaggtaaggtcatagacctgggttgtggtagaggtgggtggtcatattactgcgcaggcctaaaaaaagttacagaggttaaaggctatacaaaaggagggcccggacacgaagaaccaataccaatggctacctatggttggaacttagttaagcttcacagtggcaaggatgtctttttcatcccgccggagaagtgcgatactttactatgcgacataggtgaaagtagcccaaatccgaccattgaggaagggaggacacttcgggttctaaaaatggttgaaccatggctacgaggcaatcaattctgtatcaaaatactaaacccatatatgccgagtgttgtcgaaactctagaacagatgcagagaaaacatggtggtatgttggtacgaaaccccctaagtcgaaactcaacccatgagatgtactgggtatcgtgcggaaccggaaatatcgttagtgctgttaatatgacaagtcgtatgttgttaaatagatttactatggcccaccgtaaacctacatacgaaagagatgttgacttaggagcagggactcgacacgtcgcagtagaaccggaagtagctaatttagatattattggacaaaggatcgagaatattaaacatgagcacaaaagtacctggcactacgatgaagataatccgtacaaaacgtgggcctatcacggatcatatgaagtaaaaccgagtggaagtgcatcaagcatggttaatggtgtagttaagctattaacaaaaccttgggacgtcatacccatggtcacacaaatagcaatgacagatacaacccctttcggacaacagcgggtcttcaaagaaaaagtggatacccggactcccaaagccaaaagaggaactgcccagataatggaagtcacagcacgttggctttggggcttcctttcgagaaataaaaaacctagaatttgtacacgcgaggagttcacccgtaaagttaggagtaatgcagctattggagcggtgttcgttgatgagaaccaatggaattcagccaaagaggctgtagaagatgaaagattttgggatttagtacatcgggaacgggaactgcataaacaaggtaagtgcgctacctgtgtatataatatgatgggcaaacgagagaaaaaactgggcgagtttggtaaagcaaaaggatctagagctatatggtatatgtggcttggtgcaagattcctagaattcgaagcattagggtttatgaatgaggaccactggtttagtagagagaactcactgtcgggtgttgagggggaaggtttacataaattaggatacattttaagggatataagtaaaattccaggaggaaatatgtatgcagacgatactgcaggatgggacacgcggataacggaagatgatcttcaaaacgaagcgaaaataaccgacatcatggagccagagcatgcccttctcgcaaaatctatattcaaattaacttatcaaaataaggtagttcgtgtgcaaaggcccgccaaaaatggtacagtaatggacgttataagtcgacgagatcaaagagggtccggtcaagtcgggacgtatggcctgaatactttcaccaatatggaagcacagctcataagacaaatggaatctgaagaaattttttcaccctcagaattagaaactccaaacttggcagaaagggtactagactggttagaaaaatatggagtggaaagattgaagaggatggctataagtggagacgattgtgtggtgaaacccatagatgatagatttgcgaccgctctaacggctcttaacgatatgggtaaggtaagaaaagacatacctcagtgggaaccaagtaagggttggaacgactggcaacaagttccattttgcagtcatcactttcatcaattgataatgaaggatggacgggaggttgtagttccatgtagaaaccaagacgaattggtcggtcgagcaagagtgagtcagggcgcaggatggtcattacgcgaaactgcctgtttaggaaagagttatgcacaaatgtggcagctaatgtattttcatcgccgggatctgagacttgcagcaaacgcgatttgctctgcagtacctgttgattgggtgcctacatccagaactacatggtccatccatgcacaccaccaatggatgaccacggaagatatgctatctgtttggaatcgggtgtggatagaggaaaacccatggatggaagataaaactcatgttagtagctgggaagatgtaccgtatcttggaaaaagagaggatcaatggtgtggctctttaattggattgactgcacgagctacatgggcaacaaacatacaagtagcaattaaccaagtaagaagattaataggaaacgagaattatttagattacatgacttcaatgaaacgattcaagaacgagtctgacccagaaggtgcattatggtaa

SEQ ID NO: 22143 - RNA, 9876 nt, synthetic construct
  misc_feature 1..9876: note = derived and/or modified CDS sequence (opt6) from DENV-1__KF672763__SS-prME
  source 1..9876: mol_type = other RNA
tcagttactatgctactaatgttactacccactgctctagcttttcatctaaccactcggggtggcgaaccgcacatgatagtctctaaacaagaaagaggtaaatctctcctttttaaaacttccgctggtgtaaatatgtgtacgttgatcgcaatggatctaggagaattgtgtgaagatactatgacgtacaaatgcccaagaataactgaagcagaaccagatgacgtcgattgttggtgcaatgccactgatacttgggttacatacggaacatgcagccaaactggcgaacacagacgggacaaacgatctgttgcattggcaccacacgtaggtcttggactcgaaacgagaactgaaacctggatgagtagtgaaggggcatggaagcaaattcaaaaagtagaaacctgggcattaagacatccaggcttcaccgttattgctctatttttagcacatgctataggtacaagtataacacaaaaagggataatctttattcttctcatgttagtaacaccatcgatggcaatgagatgtgtaggaatcggtaatcgagactttgtcgaaggccttagtggggctacctgggtggatgttgtgttagaacatggctcctgtgtaacaacaatggccaaaaataaacctactttagatatagaacttttaaaaactgaagtgactaaccctgccgttctaagaaaactttgtatagaagcaaaaatatccaacactacaacggattcgagatgtccgacccaaggagaagccacattagtggaagaacaagacgccaatttcgtctgcagaagaacttttgtagacaggggatggggcaatggatgtggactatttggcaaaggctccttactaacttgcgcaaagtttaaatgtgtgacaaaattagaaggcaaaatagtgcaatacgaaaacctgaagtactcagtgatagtaactgtacatacaggagatcaacatcaagtcggtaatgaaaccactgaacatggaacaatcgctacgataacacctcaagcaccaacatcagaaatacaattaacagattacggagcacttactttagattgttcaccgagaacggggctagatttcaatgaaatggtactgttaacgatgaaagagaaatcatggctcgtacataaacaatggtttttagacctgccattgccgtggacaagtggagctagtacatctcaagagacttggaatagacaagatttgttggtcacatttaaaactgctcatgccaagaaacaagaagtcgtcgtattagggtcccaggagggggctatgcatacagcattaacaggtgccaccgaaatacagacatctggtactactaccatttttgcaggacacttaaagtgcagactgaaaatggacaaacttacgttgaaaggtacgtcttacgttatgtgcactggctcttttaaactcgaaaaagaagttgcagagacacagcatggaaccgtgctagttcaggtaaaatatgaaggcacagacgcgccttgcaagatccccttctcgacacaagacgaaaaaggagtaacgcaaaacggtcgcctaattaccgccaacccaatagtaacagacaaagaaaagcctgttaacatagagacagagccgccatttggggaaagttacatagtagttggcgttggagaaaaagctcttaaactttcatggtttaagaaaggtagttctattggcaagatgttcgaggcaaccgctcggggagctagacgaatggcaatattaggagatactgcatgggatttcggatctattgggggagtatttacatctgtaggcaaattagtacaccaagtatttggtactgcgtacggagtgctttttagtggagttagctggaccatgaaaataggcatcggaatcttacttacatggttagggctcaattcaagaagtactagcctttctatgacgtgtatagcggttggtatggttaccctatatctgggagtaatggttcaagcggattcaggttgcgtcattaactggaaaggtcgagaattaaaatgtggatccgggatttttgtaacaaatgaagttcacacgtggacagaacagtataaatttcaagcagactcgccaaaaagattgtccgcagcaatcgggagagcatgggaagaaggcgtgtgcggcatccgaagcgctactcgcttagagaacatcatgtggaaacaaatatcaaacgagttaaaccacatattgttagaaaacgatataaagtttacagttgttgtaggaaatgctgacggtattctagcacaagggaagaaaatgataagacctcagccaatggaacataaatacagctggaaatcgtggggcaaggccaagataatcggggccgatatacagaatactacctttataatagacgggcctgatacccctgaatgcccagatgagcaaagagcatggaacatttgggaagtcgaagactatggctttggaatctttactactaatatctggcttaaacttcgagactcttacacgcaaatgtgcgatcaccgtctgatgtcagccgccataaaagacagcaaagccgttcatgcagacatgggatattggattgaatcggagaaaaatgagacatggaagctagcaagagcgtcatttatagaagtcaagacctgcatttggccaaagtcccatacgttgtggtccaatggagttctagaatcagaaatgataattccaaaaatgtatggaggtccaatatcgcaacacaactaccgacctggatattttacacagaccgcagggccctggcacttagggaaactagaattagactttgacctatgtgaaggtaccacagtggtcgttgacgaacattgtggttcacgaggacccagcttacgaacaacaactgttactggaaagataatacatgaatggtgttgtcgctcatgcacacttccacctttgagatttcggggtgaggacggatgctggtatggaatggaaatcaggccagtcaaagaaaaagaagaaaacctggtaagatcaatggtcagtgcaggttcaggggaagtcgacagcttctcactcggaatattatgcgtaagcataatgatcgaggaagttatgagatctcgctggtctagaaagatgcttatgacaggaactctagcggtgtttctactcttgatcatgggacaattaacatggaatgatttaattagactctgtattatggtaggagcaaatgcctcagataaaatgggcatggggactacatatctcgcgctcatggccaccttcaagatgaggcccatgtttgcagtaggtttattatttagaagattgacatccagagaagttttattgttaactattgggctaagtttaatggcatcagtcgagttacccaattcccttgaagaactgggcgatggactggccatgggaattatgatgttaaagctattaactgaatttcagcctcatcaattgtggacaacgctcttgtccctgacgttcatcaaaacaacattatcgctagattacgcatggaaaacgactgcaatggtactgagcatagtaagtctcttccctctatgcctaagtacgacgtctcagaaaaccacgtggttacctgttttgttaggtagttttggatgtaaaccattaaccatgttcttaataactgaaaatgaaatatgggggcggaaatcatggccactcaacgagggcataatggctattgggattgtatcgatacttttatcatccttgctgaaaaatgacgttcctttagccggtccactaatagcaggaggaatgttgatagcttgttacgtaatttctggaagctcggcggatctctcgctagaaaaagctgcagaagtctcatgggaagaagaagccgaacacagtggaacatcgcacaatatattagtcgaagttcaggatgacggaacaatgaaaatcaaagatgaagaacgcgacgacacactaactatcctactaaaagcaacattactcgctgtctccggagtctacccgatgagtatcccagccaccctatttgtgtggtacttctggcagaagaagaaacagcgatctggtgttctatgggacacaccgagtccacccgaggtagaacgtgcagttttagatgacggaatataccggattttacagcgaggcttattggggcgcagtcaggtgggcgtaggcgtatttcaggacggagtattccatactatgtggcatgtgacacgtggagctgtgttaatgtatcaaggtaaacgactcgaaccctcatgggcaagtgtaaagaaagatttaattagctatggaggtggttggagattccagggcagttggaacacgggcgaagaggtacaagtgattgctgtagagcctggtaagaatccgaaaaacgtacaaaccacgccagggaccttcaaaacccccgaaggagaagtgggcgccattgcactagattttaaacctggtacatcaggtagtccaatagtgaatagagaaggtaaaattgtaggtctatacggtaacggagttgtaacaacctcagggacgtatgtttctgcaatagcacaagcaaaggcaagtcaggaaggtcccctgccagagattgaagacgaagtctttaagaagcgcaacttaacaataatggatttacacccgggatcaggtaaaacgcgtaggtacttaccagctattgtgagggaggccataaagcgtaaattgagaacattaatcctggctcccacaagagtagtagcctctgaaatggcagaagcattaaaaggtatgcctattagataccaaacaacggcagttaaaagcgaacatacgggaagggaaatagttgacctgatgtgtcatgccactttcacgatgaggctcctaagtcctgtacgagtgccgaattacaatatgataataatggatgaagcacattttacagacccggcttcaattgcagcaagaggatatatcagtacgagagtgggcatgggggaagcagctgcaatctttatgacagccacgccaccaggtagcgtagaagcattcccgcaaagcaacgcggtcattcaagacgaagaaagagatataccagaacgatcatggaactccgggtatgattggatcacagactttccgggaaaaacagtatggttcgtccctagtataaagtcaggcaatgacattgctaattgcctacgtaaaaacggaaaacgggtaatacaactgtcacgaaaaacatttgataccgaatatcagaaaaccaagaataacgactgggactacgtagtgactactgacatatcagaaatgggtgcaaattttagggccgatcgtgtaattgatccaagaaggtgtctaaagccagtaatactaaaagacggacctgagagagtaatactagcaggaccgatgcctgtgacggttgcttcagcagcacagagacgaggacgtatcggtcgaaatcaaaacaaggaaggcgaccagtatgtctatatgggccaacccctcaacaacgacgaggatcatgcgcactggacagaagctaaaatgctactcgataacatcaacacaccagaagggataatcccagctttatttgagccagaacgtgagaaaagtgctgcgatagatggggaatacaggctcagaggggaagctcgcaagacttttgtagaattaatgcgaagaggtgacctcccggtctggctaagctataaggtggccagtgaaggctttcagtacagtgatcggaggtggtgcttcgacggagaacgcaataaccaagtacttgaagagaatatggatgtggaaatctggacgaaagaaggagagaggaagaaactacgaccaagatggttggatgctcgcacctattctgaccctctagcattaagagaatttaaagaatttgcagctggacgaaggtcggtctccggtgacttaatattagaaatcggaaaacttcctcaacatttaacactaagagcacaaaatgccctcgataatcttgtaatgttacataattcggaacaaggagggaaggcatacaggcacgcgatggaagaactccctgatacaatcgaaacattaatgctattagccttgatcgcggtactaacgggaggcgtgacattatttttcttgagtggaaagggcttaggtaaaacatctattgggctactctgtgtgaccgcttcatcagcgctactgtggatggcctcagtagaacctcattggatagctgccagcataattctagagttctttctaatggtccttctaatcccagagccagatagacagagaacaccacaggacaatcaattagcttatgtagtgatcgggctgctttttatgattttaacagtagcggcaaacgagatggggcttttagaaactacgaagaaagatttagggatcggacatgtagctgctgagaaccaccaacacgcaactatgctggacgttgatttacatccagcatcagcttggactctctatgcagtagcgacgaccgtaataaccccaatgatgcggcatacaatcgagaatacaaccgcaaatatatcacttacagctatagcgaatcaagctgcaatactcatgggtttggacaaaggctggcctatctctaagatggatttaggagtccccctgctggctctaggttgttattcacaggtaaatccattaacgctaactgcagctgtattaatgcttgttgctcactatgcaattatagggcccggacttcaagccaaagcgacccgcgaagcccaaaaacggaccgcagccggcataatgaaaaatccaacaatcgacgggatagtagccatagacctcgatcctgtcgtgtatgacgcaaagtttgaaaagcaactaggacaaatcatgttactaatactatgcacatcacaaatactattaatgagaacaacttgggcattgtgtgaatcgattacactagctacgggacccttgactacactatgggaaggtagtccgggtaaattttggaatacaacaatcgcagtgagtatggcaaatatatttcggggctcctatcttgccggagcgggtctagcttttagtctaatgaaatccttaggaggaggcagacgggggactggagcgcagggtgagactttgggggagaaatggaaaagacaattaaatcagcttagtaagtctgaatttaacacttacaaaagatccgggattatggaagtagacaggtcagaagctaaagagggtttgaaaagaggagaaactactaaacacgcggtgtcgcgaggaacagcaaaactgcgatggtttgtggaaagaaacctagtgaagccagaaggaaaggtaattgatttagggtgtggccgaggaggatggagttattattgtgctggattgaagaaagtcacagaagtaaaaggctataccaagggaggaccagggcacgaagaaccgatacccatggcaacatatggatggaatctagtcaagttacattccgggaaggacgtattctttatgccccctgaaaaatgtgacactcttctatgcgacataggcgagtcatcgccaaatccaacaattgaagaagggagaactttacgggttctaaaaatggtagagccatggctgcgtggtaaccagttttgtatcaaaattttgaatccttatatgccctctgtcgttgaaacgctagagcaaatgcaacgcaaacatggtgggatgttggtacggaatccactaagccgaaacagcacacacgaaatgtattgggtatcatgcggaacgggaaatatagttagcgcagtgaacatgacttctcgtatgcttctgaaccgttttacgatggctcatagaaaaccgacatatgaaagagatgtagacttaggggctggaacaaggcatgtcgctgttgaacctgaggtcgcaaatctcgatataataggacagcgaatagagaacatcaaaaatgaacataagtcaacgtggcattacgatgaagacaatccttacaaaacatgggcataccatggatcttacgaagtaaaaccgagcggatcagcctcatcaatggtgaacggcgttgtaagattactgactaaaccatgggatgtcatacctatggtcacacaaatagcaatgacggataccacgccattcggtcaacaacgtgtctttaaggagaaagtagacacgcgaacacccagagcaaaaaggggaactgcacagataatggaagtcactgcaaaatggctatggggctttttatcaaggaacaagaaaccacgtatatgcactcgcgaagagttcacaagaaaagtgcgtagtaacgcagcaatcggcgcagtatttgtggatgaaaatcagtggaactcagccaaagaagccgtcgaagacgaaagattttgggatttagtgcatagagaacgagaattacataaacaagggaaatgtgcgacatgcgtttataacatgatgggaaaaagggaaaagaaactcggagagttcggaaaagcaaaaggatcaagagccatctggtatatgtggctaggagcacgcttcctcgaatttgaggcgttaggttttatgaatgaagaccactggttcagtagggaaaactcactatcaggtgttgaaggcgaaggtctccacaaactagggtacatcttaagagatatttcgaaaattccagggggcaacatgtacgcagatgatacggccggctgggacaccagaatcactgaggatgatcttcgcaatgaagcaaaaattacagatataatggaaccggaacatgcgctactagcaacaagcatatttaaacttacataccaaaataaggtagtcagggtgcaaagaccagctaaaaatggaactgttatggatgtaatctcaagacgggatcaaaggggctccggccaagtaggtacatacggattaaataccttcactaatatggaagtacaattaattcgacaaatggaatcagaagggatcttctttccttcagaactagaatcaccgaatttagctgagagagtgctggactggttagaaaaacacggggcagagagactaaaacgtatggcaatatctggcgacgactgtgtagttaaacctatagacgacagattcgcaacggcactgatagcacttaatgacatgggaaaagtacgtaaggatattccacaatgggaaccctcaaagggatggaatgactggcaacaagtgcctttttgttctcatcacttccaccaattaatcatgaaagacggccgtgaaatagttgttccatgccgtaaccaggatgaactcgttggacgtgctcgagtgtcacagggcgcgggatggagcttacgagaaacagcttgtttaggaaagtcgtatgcacaaatgtggcaactcatgtatttccacagaagagacctacgtttagcagctaatgcaatatgttctgcagtaccagttgattgggtcccaacgagtagaaccacttggagtatacatgctcatcaccaatggatgactacggaagacatgttatccgtttggaatcgagtttggattgaagaaaacccatggatggaagataaaacacacgttagctcttgggaggaagtgccgtatctcggaaaaagagaggatcaatggtgtgggagtctcataggactaacagcacgagcaacatgggcaaccaatatccaggtggcaataaaccaagtacgaagacttatagggaatgaaaattacttagactacatgacatccatgaaaagatttaaaaacgagtctgaccctgagggggcactatgg

SEQ ID NO: 22144 - RNA, 9876 nt, synthetic construct
  misc_feature 1..9876: note = derived and/or modified CDS sequence (opt6) from DENV-1__KF672764__SS-prME
  source 1..9876: mol_type = other RNA
tcagttacaatgctgctaatgctgctacccacagcacttgcattccatctgacaacgaggggtggagaacctcacatgatagtgtcaaaacaagaacgaggtaaatcactcctatttaaaacatctgcaggagtaaatatgtgcacccttatagcaatggatttgggtgaactgtgtgaagatacgatgacctacaaatgtccacggataacagaagctgaaccagatgatgttgattgttggtgtaacgcaacagacacctgggtaacatacggaacatgttctcagacaggtgaacaccgaagggataaaagaagcgtggcattagcaccacatgtagggctcggtttagagacaagaactgagacatggatgtcatcagagggcgcatggaaacagatacaaaaagtagagacgtgggcattacgtcaccctggtttcaccgtaattgcactatttttggcgcacgcaataggcaccagtattacacagaaaggaattatatttatcctcctcatgttagtaacacctagtatggcaatgagatgtgtcggtataggaaatagagattttgtagaaggcttgtctggtgctacatgggtagatgtagttttagaacatggctcatgcgtgacgacaatggccaaaaataaaccaacattagatatagaattactaaaaacagaagttacaaatccagccgtgttaaggaaactgtgtatcgaggcgaaaatttcaaacactactactgatagccggtgcccaacccaaggtgaggcaaccctagtagaagaacaggacgccaatttcgtatgccggaggacattcgttgatcgcggatggggaaatgggtgcggcctatttgggaaaggatcgctattgacttgcgcgaaatttaaatgcgttacaaaattagaagggaaaatagtccaatatgaaaatctaaaatattctgtcatagtaactgtccataccggagaccagcatcaagttgggaatgaaactactgaacatggaacaattgcgaccatcactccacaggctcctacaagcgagatacagctgacggattacggagcacttacattagattgtagcccaagaacaggattggatttcaacgaaatggttctactcactatgaaagaaaaatcatggctagtacataaacagtggttcttagatctacctctgccatggaccagtggggcttcaacaagtcaagaaacttggaatcgtcaagatttattggtcacatttaaaacggcacatgccaagaaacaggaagtggtagtattgggttcacaggaaggcgcgatgcacacagcgcttaccggagcaactgaaatacagacgtctggaacaacaacaatattcgcgggccatctaaaatgcagattgaaaatggataaattaaccttaaaaggcacctcatacgtgatgtgcactgggtcattcaaattagaaaaagaagtcgcggagactcaacatggtaccgttttagtacaggtcaaatatgaaggaactgatgctccgtgcaagattcctttcagtacgcaagacgaaaaaggagtgacgcagaatggacgtctgataactgctaatcctattgtcactgataaagagaaacccgtaaacattgaaacagaaccgcccttcggagaatcgtatattgttgttggtgctggggaaaaagcattaaaattgtcatggttcaagaaaggatcatccataggaaaaatgttcgaagcaaccgcaagaggggcacgacgaatggctatattgggtgatacggcatgggattttggatcgatagggggagtctttacgagtgtaggtaaactggtacatcaagtgtttggaacagcatatggagttctattctctggggtttcatggaccatgaagatcggaataggcatcttactaacttggttaggcctcaatagccgaagcacatccctatctatgacctgtattgcggtgggaatggtaacattgtatctaggagtaatggtacaggcagactcaggttgtgtaataaactggaaaggtagggaattaaaatgtgggagtggtatttttgttactaacgaagtccatacttggacagagcagtacaaatttcaggcagattcaccaaaaaggcttagtgctgccattgggagagcttgggaagaaggagtatgtgggatccgtagtgcaacacgattagaaaatattatgtggaagcaaataagtaatgaactaaatcacattttattagaaaatgacatcaagtttaccgttgttgtaggtaatgccaatggaatactcacacaaggaaagaaaatgatacggccacaacctatggaacacaaatatagctggaaatcatggggcaaagctaaaataataggagcagacattcagaataccacgtttataatagatggacccgatactccagagtgcccggatgagcaaagagcgtggaatatttgggaggtagaagactatggattcggaatattcaccactaatatatggctcaaacttcgggacagttacacacaaatgtgtgatcatcgattaatgtccgctgcaataaaagatagcaaagccgttcatgcagacatgggatactggatcgagagtgagaaaaatgaaacatggaagttagcgagggcgtcattcattgaagtgaaaacctgtatttggcccaaatcacacacactatggagtaatggggtattagaaagcgaaatgataatcccaaaaatgtacggaggacctatatcccagcacaattatcggcctggctattttacccagaccgctggaccctggcacctagggaaattagaactggattttgatctatgcgagggaacaaccgtagttgttgatgaacactgtggatcgcgtggtccatccttacgaactacaacagtaaccggaaaaataatccatgagtggtgctgtcgttcgtgtacattacctcctcttaggtttaggggagaggacggatgctggtatggtatggaaattcgacccgtcaaagaaaaagaggaaaacctagtgaaatcaatggtgtctgctggatcaggagaagtggactcgttctccctagggatactctgcgtgtcgataatgattgaagaagttatgagaagtagatggagtcgaaaaatgctgatgacggggacactagcggtttttctacttttaatcatgggtcaactaacgtggaatgacctgattcgactgtgcataatggtcggcgcaaatgccagcgataagatgggaatgggaactacatacttagcattaatggctacatttaagatgcgacccatgttcgctgtaggcctgttgtttagaaggttaacctcgagggaagtactgctactcacaattggtttatcattagtggcatcggtcgaattacctaatagccttgaagaacttggggatggactggccatgggcattatgatgttgaaactccttactgaatttcaacctcatcaattgtggacaacattattgtcactaacatttataaaaacaacacttagcttagattacgcttggaagacgacagcaatggtacttagcatcgtcagcttatttcctctttgtttaagtaccacgtcacaaaagaccacttggttaccagtcttattaggttcatttggatgtaaaccattaacgatgtttctgataacagaaaataagatatggggaagaaaatcatggcctcttaatgaaggtattatggcaatcggaatagtgagcatattattaagctctttactaaagaatgatgtacctctagctggccccttgatagcaggcggaatgctgatagcgtgctacgtcatttctggatcctcggctgatctcagcttagagaaagccgcagaagtatcttgggaagaagaagccgaacactcgggcacgtcacataacatcttagtagaagtccaagatgacggtactatgaagattaaagatgaagagagagatgacacactaactatacttcttaaagcaactctactggcagtgagtggggtatacccaatgagcataccagcgactttattcgtatggtatttttggcagaagaagaaacagaggtcaggcgtcctatgggatacaccttcgcctccagaagttgaacgagctgtactcgatgacggaatataccgaatcctacaaagaggcttattaggacggagccaagttggcgttggtgtttttcaagatggagtattccacacgatgtggcacgtaactaggggtgcggtcctaatgtatcaaggtaaacgcttagagccaagttgggccagcgttaagaaagatttaatttcatatggaggtggctggaggtttcagggatcatggaacactggagaagaggttcaagttatagctgtagagcctggcaaaaatccgaaaaacgttcagactacgcccggaacgttcaaaacaccagaaggcgaagtcggagcaattgcacttgattttaaaccggggacaagtggatcccctatcgtaaatcgagaaggcaaaatagtaggtttatacgggaacggagtggtaacaaccagtggcacctacgtcagtgccattgctcaggcaaaggcttctcaagaggggccattaccagagatagaagatgaagttttcaagaaaagaaatctgactataatggaccttcatccaggatctgggaaaacaagacgttatcttccagccatagttagagaagcaataaaaagaaaacttcgaaccttaattctcgcacccacaagagtcgtggcatctgaaatggcagaagccttgaaagggatgcctatcagatatcaaacaacggctgtgaaatcagaacatactggacgcgagatagtcgacttaatgtgccacgcaacattcacaatgagactattatcaccggttagggtgccaaactataatatgattataatggacgaggcgcattttacagaccccgctagcattgctgcaagaggctatatatcaactcgagttggaatgggtgaagctgctgcgatatttatgacggcaacaccaccaggaagtgtagaggccttcccgcagtccaacgcagttattcaagatgaagagagagatatacccgaacgctcctggaactctggatatgactggataactgattttcctgggaagaccgtatggtttgtacctagcataaaaagcggaaatgacattgcaaactgcttaaggaaaaatgggaagagagttatacaattatcacgaaaaaccttcgacacagaataccagaaaactaagaacaacgactgggattatgtagtcacaacggatatttctgaaatgggggcaaattttcgtgcagacagagttatagatccaagaagatgcctcaaaccggtaatattgaaagatggtcctgaaagagtaatactcgctggtccaatgccggttaccgtagcatcagcggcccagcggcgagggcggatcggcagaaatcaaaataaagaaggcgatcaatacgtgtacatgggacaacccttgaacaatgatgaagatcacgcgcattggacagaggcaaaaatgttattagacaacataaacacccccgaagggataattcccgcattattcgaacctgagcgagagaaaagtgctgctatagacggggaatatcgtctaagaggagaggccagaaagactttcgttgaattaatgcggcgtggtgatctacccgtatggttatcgtataaagttgccagtgaaggttttcaatattcagatagaaggtggtgctttgacggagaaagaaacaaccaagttttggaagaaaacatggatgttgagatatggacgaaggagggtgaaagaaagaaactacgcccaagatggcttgatgcccgtacatattctgacccactcgctctaagagaatttaaggagtttgccgccggacgtagatccgttagcggagatcttattctcgaaattggaaaactgccacagcacctcacattaagagcacaaaacgccttagacaatctagtaatgttgcacaattctgaacagggcggaaaggcctatcgacatgcaatggaagaactgccagatacaatagaaaccttaatgttactagccctaatagcagttttaactggaggagtgacattattctttttatccggaaaaggtttaggaaagacctctattggactcttgtgtgtaacagctagttcagcacttttatggatggcttcagtagaaccccattggattgctgcttccataatattagaatttttcctcatggtcttactcattcctgaaccagatagacagcgcacaccccaagacaaccaacttgcatacgtcgtgataggactattatttatgatattaactgttgccgccaacgagatgggactgcttgagacaactaagaaagacctcggaattggtcatgtggcagccgagaatcatcagcatgcgacaatgttagacgtggatttacatccggcttcagcatggactctctatgctgttgctacgacagttataacacccatgatgagacatacaatcgagaatacaacggcaaatatttcacttaccgctattgcaaaccaagccgcaattctgatgggcctagataaaggatggccgatatcaaaaatggacctaggggtgcccctactagctctagggtgttacagtcaagtgaatccattaaccttaactgctgctgtattaatgttggtcgcccattacgcaattataggtcctggattgcaagcaaaagcaacacgagaagctcaaaaacgaactgccgcaggaattatgaaaaacccaacagtggatggtatagtggcaattgatcttgatccagtagtatatgacgcgaagtttgaaaaacaattaggacaaataatgctcctaatactttgtacctcacaaatacttctaatgcggacaacatgggcattatgtgaatctattacattggctacaggaccacttacgacattgtgggaaggaagccccggaaaattctggaacacaacaattgcagtttcaatggcaaatatattccgaggtagctatctagcaggagccggtttggcgttttcactaatgaaaagccttggaggcgggcgaagaggaacaggggcacaaggagagacattgggagaaaagtggaaacgacaactaaatcaactgtctaaaagtgagttcaacacatacaaaagaagtggcatcatggaggtcgatcgtactgaagccaaagaaggactaaaaagaggggagacaaccaaacatgcagttagtaggggaactgctaaacttaggtggtttgtcgaacgtaatttagtgaagccagaaggcaaagttattgatcttggatgtgggaggggaggttggagttactattgcgcgggtcttaaaaaggtaacagaagtaaaaggttacactaagggaggtcccggacatgaagaacccatacctatggctacatatggttggaacctcgtaaaattacactcagggaaagatgtattctttatgcctcctgaaaagtgtgatacactattgtgtgatattggggaatcatctccaaatcccactattgaggaaggacgcacattaagggtactaaagatggtcgaaccatggttacgaggaaatcaattttgtataaaaatactgaatccatatatgcccagtgtagtcgaaaccctcgaacagatgcaacgcaaacacggcggaatgcttgtcaggaaccctctatcacgcaattccactcacgaaatgtactgggtctcatgtggcaccgggaacatagtatcagcagtaaacatgacgtcccgtatgttgctaaatcgctttactatggcacaccgaaaaccaacgtacgagagagacgtggacttaggggcggggacacgccatgtagcagtagagccggaagtggccaatttggacataataggacagagaattgaaaatatcaaaaacgaacacaagtcaacctggcactatgacgaagacaacccttataagacatgggcatatcacggatcctacgaagttaagccatcggggagtgcatcttcgatggttaatggggtagttcggttattaacgaaaccgtgggatgttattccgatggtcacgcaaatagcaatgacagatacaacaccatttggacaacaacgagtcttcaaagagaaagtagatactagaacccccagagctaaaagagggactgcacaaatcatggaagtaacggcgaaatggttatggggtttcttatctcggaataaaaagccacgtatatgcacaagagaagaatttacaaggaaagtcaggtcaaacgccgcaatcggcgccgtttttgtagatgagaatcaatggaacagcgctaaagaggctgtagaggacgagcgcttctgggatctggtacatagggaaagggaacttcataaacaggggaaatgtgcaacttgtgtttataacatgatgggaaaaagagagaagaaactcggcgagttcggtaaagcaaaaggttctagagccatatggtatatgtggttgggggcacggtttcttgagttcgaagcactgggtttcatgaatgaggatcactggttttccagggaaaactcgctcagtggagtggaaggtgagggattacacaaattaggatacatcctacgagacatatccaagattcccggagggaatatgtatgcggacgacacagcgggatgggatactcggataaccgaggacgatcttcaaaacgaagcgaaaataacagatatcatggagcctgaacatgccctactcgccacaagtatatttaaacttacctatcaaaataaagttgttagagttcagaggccagccaagaacggaaccgtaatggatgttatttcgaggagagaccaaaggggtagtggacaggtaggaacctacggacttaatacgttcaccaatatggaagtacaattgataaggcaaatggaatcagagggaatcttctttccgtccgagcttgaaagtcctaacctagcagaaagagttttggattggctagaaaaacacggtgctgagcgactaaaaagaatggcaatttcaggcgacgactgtgtagtaaaaccaatcgatgatcggtttgcaactgcactgattgccttaaatgatatgggaaaggtaagaaaagatataccgcaatgggaaccatctaaaggctggaacgattggcaacaagtgccgttctgctcacatcatttccaccaactcattatgaaagatggtagggaaatagtcgttccttgccggaaccaagacgaattagtcgggagagcgcgggtatctcagggtgcaggttggtctttaagggaaacggcttgcctggggaaaagctacgcacagatgtggcaacttatgtactttcataggagagatcttagattggccgcaaatgcgatatgttcagcggtgccagtagattgggtcccaacttcacgcacaacgtggtctatacacgctcatcatcaatggatgactacagaggacatgctaagcgtatggaatagagtctggattgaggagaacccgtggatggaagacaaaacacacgtctcgagctgggaggaagttccgtatttaggcaaaagggaagaccagtggtgtggaagtctgattggcctaacggctagagcgacatgggcgacgaacatacaagtggcaataaatcaagtaagacgcctcatcggcaacgaaaattacttagactatatgacatcaatgaaaagatttaaaaatgagagcgaccccgaaggcgctctttgg

SEQ ID NO: 22145 - RNA, 9879 nt, synthetic construct
  misc_feature 1..9879: note = derived and/or modified CDS sequence (opt6) from DENV-1__EU863650__SS-prME
  source 1..9879: mol_type = other RNA
tcagtaaccatgttattaatgttattgccaactgtcttaacctttcatttaaccactcgagggggagaaccgcatatgatcgtatccaaacaagaacggggtaaaagtctgctgttcaaaacatctgcaggagtaaacatgtgcaccttgatagcaatggatttaggagaattatgtgatgacacaatgacttacaaatgcccgagaataacagaaacagaacctgatgacgtggattgttggtgtaacgctactgaaacgtgggtgacctacggaacttgttcacaaacgggggaacatcgacgtgacaaacgatccgttgcactggctccacatgtaggtttagggttagaaactcgaacggagacatggatgtctagtgaaggtgcttggcgtcaaattcagaaagtagaaacttgggcgctcagacacccaggatttacggtaattgccttatttctggcgcatgctatcggcaccagcataactcaaaaaggaataattttcattttattaatgcttgtaacaccttcaatggccatgcgatgtgttggcatcggaaacagagattttgtggaagggttgagcggggcaacatgggtagacgtagttctcgaacatgggtcttgtgtaactaccatggccaaagacaaacctacacttgatatagaattattaaaaacagaagttacaaatccagcagtactgagaaaactgtgtatagaagctaaaataagtaatacaacgacagactcgcgttgcccgacgcaaggcgaagcaacattagtcgaagaacaagacacaaatttcgtgtgcagacgaacttttgttgataggggttggggaaatgggtgcggattattcggcaaaggttccctcatcacttgtgccaaattcaaatgtgtaaccaaactagaaggtaaaatagtacaatatgaaaacctcaaatacagcgtaatagtcacagtacataccggggaccaacatcaggtcggcaatgaaacaactgaacatggaacaatagcaactattacaccacaagcgcctacgagtgaaatacagttaacagactatggggcattaactcttgattgctctccaaggacagggctagactttaatgaaatggtgctattaacgatgaaagagaaatcatggttagtccacaaacaatggtttctggacttgcctttaccgtggacaagtggagcaagtacaagtcaagaaacatggaacaggcaagatcttttggtaacattcaaaaccgcgcacgcgaagaaacaggaagtggtagtcctcgggagtcaagaaggggcaatgcataccgcactgaccggagctacggaaatccaaacctcaggaacaacaacgatatttgcaggtcatctgaaatgccgccttaaaatggataaattaacgcttaaaggcataagctacgtaatgtgcaccggactgtttaaactagagaaagaggttgctgaaactcagcatggcacagtattagtccaagtaaaatacgaaggtacagatgcgccatgtaaaattccttttagctctcaagacgaaaaaggtgcaacacaaaacgggagacttgtaacggcaaatccaatagtaaccgacaaggaaaaacctgtgaatatcgaagcagaaccgccatttggagagtcatacatcgtagtcggtgcaggggaaaaagcgcttaaattatcgtggttcaagaaagggagctctattggaaagatgttcgaggcaaccgcaagaggagctagacgcatggcaatactcggtgatacagcatgggactttggatccattggaggggtttttacttcagttggaaaactggtacatcaaatctttggtactgcgtatggcgttctattctcaggtgtatcttggacaatgaaaatcggcatagggatccttttgacttggctaggacttaatagtagatccacatcgttaagtatgacatgcatagcagtaggaatggtgacactatatttaggcgttatggtacaagcagacagtggatgtgtcataaactggaagggccgagaattgaagtgcggatctggtatatttgtaacaaacgaagtacacacgtggacagaacaatataaatttcaagccgattcacctaaacgattatcagcggcaattggaaaggcttgggaggaaggcgtatgcggtataagaagcgcaacaagattggaaaatataatgtggaaacaaatatctaatgagttaaaccatattttgttggaaaatgatatgaaatttaccgtcgtagttggcgacgtttcagggatacttgcgcaaggcaagaaaacaatacgcccacaaccgatggaacacaaatattcatggaaaagttggggtaaagccaagatcataggagcagatgtacagaataccacatttataatagacggacccaacactcctgaatgcccagatgaccagagagcctggaatatttgggaagtagaggactacggttttgggatttttacaacaaatatttggctgaagttacgcgatagttatactcaagtttgtgatcacaggctgatgtcagcagccataaaggactcaaaagctgtacatgcagatatgggatactggatcgaatcggagaaaaacgaaacgtggaaattagccagggcgtcattcatcgaggtgaaaacctgtgtttggcctaaaagtcatacactatggtcccatggagtgttagaatcggaaatgattataccaaaaatatatggcggcccgatctcacaacataattaccggcctggttattttactcaaacagctggaccttggcacctcggaaaactcgaattagattttgacttgtgcgaaggaactactgttgttgttgacgaacattgtggaaatcgaggcccatcgttacgaactactacggtcacgggtaaaattattcacgaatggtgttgtcggagctgtacattaccaccactccgatttaagggagaagacggatgctggtatggtatggaaatacgaccagttaaagagaaggaggaaaacctcgtcaagagtatggtgtcagccggatccggcgaagtcgatagtttctcactaggactattgtgcataagtattatgattgaagaagtcatgcggtctcgatggtccaggaaaatgttaatgacgggaactcttgtagtatttcttctccttacattaggtcagcttacatggaacgatttaattcgactatgcataatggtgggtgccaatgcgtcggataacatgggtatgggaaccacatatttagctcttatggcaacattccgaatgagaccaatgtttgcagtaggactactcttcaggagactaacaagcagagaagttctcctgctgacagtaggactaagtctagttgctagtgtcgaattgccaaattcattggacgagctaggagacggactagccatgggaatcatgattttaaaattgttaacggatttccagtcccaccaactatgggcaaccctcctatctctgacatttgtgaaaaccacgctgtctttacactacgcctggaaaacaatggctatgatactaagtatcgtcagcttattaccactatgcttatcaacaacctctcagaaaacaacgtggcttccagtgctcttaggatctttgggttgcaaaccactgacaatgtttttgataacagagaataagatatggggaagaaaatcctggccacttaatgaaggaattatggcggtcggaatagtgtctatactattgagcagtttactgaaaaacgatgtaccactagctggtccgttgattgcagggggtatgttaattgcttgctatgttatttcagggagctccgcagacctctcattggaaaaggcagccaaagtctcgtgggaggaagaggcggaacattcaggcgcttcacataacatcttagtagagatacaggatgacggtaccatgaaaataaaggatgaagaacgagacgatactataaccatattattaaaagcaacattactagcaattagtggagtatatcctatgtcaatacctgcaactttatttgtgtggcacttctggcagaagaagaaacaaagatccggtgtgctctgggacacgccaagccctccagaggtagaaaaagccgttttagatgatggtatctataggatcttgcaaagaggacttttaggaagatctcaggtaggggttggagtcttccaagaaggagtgtttcatacaatgtggcacgttacaagaggagctgttttgatgtatcagggaaaaaggcttgaaccttcctgggcctctgttaagaaagatctaatatcatacggaggagggtggcgatttcaaggttcatggaatactggtgaagaagtacaagtaatagcggttgaaccgggcaaaaacccaaagaatgttcagaccgcccccggtacatttaaaacgagcgaaggtgaagtcggcgctattgcactggatttcaaaccaggaacctcaggaagtccaattgtaaatagggaaggtaaaatagttggactatatgggaacggtgttgtaactacatcaggcacctacgtgagcgcaattgctcaagcgaaagcatcacaagaaggtcctttaccagaaatagaagacgaagtattccgaaaacgtaatcttacaattatggatttgcatcctggttctggtaaaactcgacgttatttaccagcaatcgttagagaggctataaaacgaaagttaagaactttagtattggcaccaacgagagtcgttgccagtgaaatggcagaagccttaaagggtatgccaataagatatcagacaacggctgtaaaatcagaacacacgggcaaagaaattgtagacctgatgtgtcatgctacctttacaatgcggttattgagccctgtaagggtacctaattataatatgattattatggacgaagctcattttacggacccagcgtcaatcgcagcaagaggctatatctctactagagttggaatgggtgaagcagcggcaatattcatgacagcaaccccaccaggatctgttgaggccttcccccaaagtaatgctgtcattcaagatgaagaaaaagatataccagaacgaagctggaactcaggctatgactggattacagactttccaggaaaaactgtctggtttgttccatctatcaaaagtggaaacgacatagcgaactgtttaagaaagaacgggaaacgtgtgatacagttatctcggaaaaccttcgacaccgaataccaaaagacaaagaataatgactgggactatgtggtgaccactgatattagtgaaatgggtgcgaacttccgtgcagaccgtgtgatagatccacggagatgccttaaacctgtgatactaaaagacggcccagaacgggtgattctggccggtcccatgcctgtaacagtggcgtcggcagctcaaagaagaggacgtattggtcgtaatcaaaacaaagaaggagaccaatatatatacatggggcaaccgctaaacaatgatgaagatcacgctcattggaccgaagcaaaaatgcttctagataacatcaacactcctgagggaattataccggcactattcgaaccggaacgcgagaaaagtgcagctatagacggagaatatagattaagaggagaagcacgaaagaccttcgtagaattaatgagacggggtgatctccctgtatggttatcatacaaagtagcaagtgagggatttcaatactcagatcgccgatggtgtttcgatggggagaggaacaaccaggtactagaagagaatatggacgtggaaatatggactaaagaaggagaaagaaagaaattgagacctaggtggttagacgccaggacctattccgatccactagcactaagggaatttaaggaatttgcagccggacgaagatcagtatcaggagatcttatacttgaaatcgggaaactacctcagcatttaacacaacgagctcaaaaagcactagacaatcttgtaatgctacataactcagaacaaggtggaaaggcctatcgtcacgcaatggaggaattacccgatacaatagagacaataatgcttttggcgctaatcgccgttttgaccggaggagtaacactgtttttcctatcgggaagaggactgggaaagacatccataggtctgctgtgcgttacgtcaagctcagctttattgtggatggccagcgttgaaccacactggatcgcagcatctataatcctagaatttttcctaatggtcttgcttatcccggaaccggaccgccaacgaacacctcaagataatcaattagcttatgtcgtaataggattgctctttatgatattaactgttgctgcgactgagatgggattacttgagacaactaagaaagatcttgggattggtcatgcagctgcagaaaatcatcatcatgcagctatgctagatgtcgacctacatccagccagtgcctggacattatatgccgtagcaacaactataattacaccaatgatgagacatacgattgaaaatactacggcgaatatttcattaacagcaatagcaaaccaagctgctattctgatgggccttgacaaaggttggccaatttccaaaatggatattggggtgcctttactagctctgggatgctattcgcaagtaaatcctctcactttgactgcagctgtcttaatgcttgtagctcactatgcaataataggtccgggtctacaagctaaagcaactagggaggctcaaaaacgaaccgcggcagggataatgaaaaatcctactgtagatggaattgtcgccattgatcttgatcctgtggtttacgatgccaaatttgaaaaacagttgggacagataatgttgttaatcttgtgtacatcgcagattttactgatgagaacaacatgggcactctgtgaaagcattactttagctacgggacccttgaccacactttgggaaggctcccccggtaagttttggaacaccaccatcgcagtcagtatggctaatattttcagaggatcgtacttagctggcgcaggtctagcatttagtttaatgaaaagtctcggaggcggaaggcgcgggactggagcccaaggtgaaacactgggagaaaaatggaagaggcaactaaatcaactcagtaagtcggaatttaaaacttataaaaggtcggggataatagaagtagatagatccgaagcaaaggagggtctaaagaggggtgagacgacaaaacacgccgtatcacgaggtaccgcaaaactaagatggtttgtagagcgaaatttggttaagccagagggcaaagttattgatctagggtgtggacgtggcgggtggtcttattactgcgcaggactcaagaaagtaacggaagtaaaagggagtacaaaaggaggccctggtcatgaagaacctattcctatggcaacatacggatggaatctagttaaattacacagcggaaaagacgtattctttataccacccgagaaatgcgatactttgttatgcgatataggcgaaagctcaccaaacccgacgatcgaagaaggaaggacactaagagtgctcaaaatggtggaaccttggctcagagggaaccagttctgcataaaaattttgaacccatatatgcctagcgtagttgaaacactagaacaaatgcaaagaaaacatggtggaatgctcgtaagaaatcctcttagtcgaaattccactcacgaaatgtactgggtaagctgcggtacagggaacatagttagcgcagtaaatatgacatctcgaatgctccttaacagatttacaatggcgcaccggaaaccaacgtacgaaagagatgtcgacctcggggcaggaacaaggcacgttgcagtcgaaccagaggtagcaaatttggatataattggacaaagaatagaaaatataaagaacgagcataaaagtacgtggcattatgatgaagacaatccatacaaaacttgggcctatcatggctcatacgaagtaaagccttcaggctcagcgagcagcatggtaaatggagtagtcagacttctgacaaaaccatgggacgtgatcccaatggtaacacaaatagcgatgacagatactacaccatttggccaacagagagtcttcaaagaaaaagtagatactagaacgccaaaagccaaaagagggactgcacagataatggaggttacagctaaatggttatggggatttctaagtcgtaacaagaagccccgaatctgcactcgagaagagtttacgcgtaaagtgcgaagtaatgctgcgatcggcgcagtattcgtagacgagaaccagtggaactcaccaaaagaagccgtagaagacgagaggttctgggatttagtacatagggaaagggagctacataaacaaggcaaatgcgcaacatgtgtatataacatgatgggaaagagagagaagaaattgggagaatttggtaaagcgaagggtagccgtgcaatttggtacatgtggttaggcgcgcggttcctggagtttgaagccctgggattcatgaacgaagatcattggttcagtcgtgaaaatagcttgtcgggggtagaaggagagggtctacacaaattaggttatatattaagagacatttcgaaaatacctggtggaaatatgtacgccgacgatacagcaggttgggataccagaataactgaggacgatctccaaaatgaagcaaaaataaccgacataatggagccagagcatgctctattagctaccagtatatttaagttgacttatcagaataaagttgtgcgtgtacaaagaccagccaaaaacgggaccgttatggacgtcattagtagaagggatcaacggggcagtggtcaagtcggaacttacggactgaatacattcacaaatatggaagctcaactaatccggcaaatggaatccgaaggaatctttttaccttcagaactagaaccacccaatttggcaggacgagttccagattggttggaaaagcatggtacagaacggctcaggcgcatggctatttcaggagatgattgtgtcgtaaaaccgatcgatgatcgatttgccaccgcacttaccgccttaaatgatatgggaaaagtacgcaaggacattcctcaatgggaacccagtaaaggttggaatgattggcaacaagtgccattctgcagtcaccacttccatcaacttataatgaaagatggcagagaaatcgttgtgccctgtcgaaatcaggatgaactggttggtagagctagggtcagccagggagcaggttggtccttacgcgaaactgcttgtctagggaagtcatatgcacaaatgtggcaattaatgtactttcacagaagggacttgaggcttgcagcaaatgccatttgttccgcggtgccggttgattgggttccgacgtcgagaacaacatggagcatacatgcgcaccatcagtggatgactacagaggacatgctctcagtatggaatcgggtatggatagaggaaaatccgtggatggaagacaaaacacatgtctcaagttgggaagacgttccatatttaggcaaaagggaagaccagtggtgcggtagcttgattggcttgacagctagagcaacatgggctaccaacatacaagttgctattaatcaagtcagaagattgataggcaatgagaactatctagattatatgaccagtatgaagaggtttaaaaatgagtctgaccccgaaggtgcattatggtaa

SEQ ID NO: 22146 - RNA, 9879 nt, synthetic construct
  misc_feature 1..9879: note = derived and/or modified CDS sequence (opt6) from DENV-1__KU365900__SS-prME
  source 1..9879: mol_type = other RNA
agcgtgacaatgctcttaatgctaatgcctacagcacttgcttttcatctaactaccaggggaggagaaccacatatgatagtatcaaaacaagaaaggggaaaatcactcttgttcaaaacctcagcaggggttaatatgtgtacgctaatagcaatggacttaggggaattatgtgaagatactatgacttataaatgcccaagaataacggaagcagaacctgatgatgtggactgctggtgtaacgccaccgatacttgggttacttacggtacgtgctcccaaaccggagaacatagaagagacaaaaggagcgtagcattagcgccgcacgtaggtttaggactcgaaacaagaacggaaacatggatgtcatcagaaggagcctggaaacaaattcaaagagttgaaacatgggcattaagacatcctgggtttacggtgatagcactatttttagctcacgcaataggtacctctattacccaaaaaggaataatatttatattgctaatgctcgtgacgcccagtatggctatgcgttgtgtaggtattggaagtagagatttcgttgagggactatccggagcaacctgggtagatgttgttctcgagcacggaagctgcgtaacaacgatggctaaagacaaacctacgctcgacatagaattattgaaaacagaagtaaccaatcctgcggtactacggaaattatgtattgaagcaaaaatcagtaacactacgacggatagccggtgcccgacacaaggtgaagctactctagtcgaagaacaagatgcaaattttgtgtgccgaagaacttttgttgacaggggttggggaaatggatgtggactctttggtaaaggatcattaattacatgcgcaaaatttaaatgcgtaacaaaacttgaaggaaaaatagtccagtatgagaacctaaaatatagtgttatcgtcacggtacatacaggagaccaacaccaagtaggtaatgaatctacagagcacggaactacggcaacaattacgccacaagcaccaacaacagaaatacaactgacagattacggagctcttactctggattgtagtcctagaacgggacttgattttaatgaaatggttctactaacaatgaaagagaaaagctggttagttcacaaacaatggtttttagatttaccactaccttggacgtcaggagcaagtacctcgcaagaaacatggaacagacaagacctattagtgacgtttaaaacagctcacgcaaagaaacaagaagtagtagtactgggaagtcaagagggcgcaatgcacaccgctctaactggtgctactgaaatccaaacatcaggaaccacaacgatttttgcaggacatttaaaatgtagattaaaaatggacaaactgactctaaaagggatgtcatacgtcatgtgtacaggttcatttaaactagaaaaggaggtcgcggaaacccaacatggaacggtcttagttcaaataaaatacgaaggaacggacgcaccctgtaaaatcccattttcaacacaggatgagaagggtgttacccagaatggaagactgattactgcaaatcccatagtgacagataaagaaaagcctgtaaatattgaggcagagcctccgtttggagaatcgtacatcgtcataggcgcgggcgaaaaagcactgaaacttagttggtttaagaaaggaagctcaattggcaaaatgttcgaagctacagcgagaggggcacgaagaatggcaattctaggcgatactgcctgggactttggcagcataggaggcgtcttcacaagcgttggtaaacttgtgcatcaaatttttggaaccgcatatggggtattattcagtggtgtctcgtggacgatgaagataggaataggtgtcttgttaacctggctaggattgaatagccgatcaacgagcttgtccatgacttgtatcgcggtgggattggttaccctatacttaggtgtaatggtccaagcagatagtggctgcgtaataaactggaagggaagggaactaaaatgcgggagtggaatattcgtcaccaatgaggtgcatacctggacggagcaatataaatttcaagctgactcccctaaacgccttagtgcagctattgggaaagcctgggaagaaggcgtatgcggtatccgatctgcaacccgattggagaacatcatgtggaagcaaatttcgaatgagctgaaccatatattacttgagaacgatatgaaatttactgtcgtcgtcggagatgtcgcaggtatcctagctcagggtaagaaaatgataagaccccaaccaatggaacataaatattcatggaaatcctggggaaaagcgaaaatcataggtgcagatgtacaaaatacaacattcattatagatggcccaaacactccagaatgcccggacgaccagcgagcatggaacatttgggaagttgaggactacggcttcgggatttttactactaacatatggctgaaactaagagacagctatacacaagtatgcgatcacaggttaatgagcgcagctataaaagactcaaaagctgtacatgccgacatgggttattggatagagtctgagaaaaacgaaacctggaaactagctcgagcgtctttcatagaagttaagacatgcatttggcctaaatcacatacattgtggagtaacggagtccttgaatcagaaatgattattcctaagatttatggtggaccgatatcacaacacaactatagacctgggtatttcacacagacagcaggcccttggcatttagggaagttagaattggactttgatctctgcgagggaacaaccgtggtagttgacgaacactgtggtaatagaggcccatcgttaagaactaccactgtgacaggaaagattatccatgaatggtgctgtagaagctgtactctaccccctttaagatttcgaggagaggacggatgctggtacgggatggagatcagaccagtgaaggaaaaagaggaaaatctcgtaaaaagtatggtgagcgccgggccgggagaagtagattctttctcgttaggactactatgcatatccattatgatcgaagaagtaatgcgctctagatggtctaggaaaatgctaatgacaggaacgctcgctgtattctttttattaatcatgggacagctgacatggaatgatttaataagactatgcatcatggttggcgcaaatgcctccgataggatggggatggggaccacgtacctagctttaatggcaacattcaaaatgaggcctatgttcgcagtgggtttactcctgagaagacttacttcaagggaagttctcttattaacaataggccttagtcttgttgcgtccgttgaactgccaaatagcttggaagaactaggcgatgggcttgcaatgggaattatgatactgaaattgttaacggatttccaatcacaccaactttgggcaacgcttttatcattaacattcattaaaactacattctcgttacactacgcttggaaaactatggctatggtgttatcgattgtgtctttattccctctatgtttaagtacaacatctcaaaagactacatggcttccggtgcttttgggaagtctgggatgcaaaccgttaaccatgtttcttatagccgaaaacaaaatatggggaaggaaaagttggccgttaaacgaaggtataatggccgtaggaatcgtttcaatacttctaagctcattattgaaaaatgacgtaccactagcaggcccactaatagccggaggcatgctgatcgcctgttatgtcatcagtgggagtagtgcagatttatctctggagaaagccgcggaagtctcctgggaggaggaagcagaacactcaggcgcttcccacaatatattggttgaagtacaagacgatgggacgatgaaaataaaggatgaagaacgtgacgacaccctgaccatactcttgaaagcaacattattggcagtcagcggggtttacccattatcaataccagcgactttattcgtttggtacttctggcagaagaagaaacaacgaagcggagtattgtgggatacacctagtcccccggaagttgaaagagcagtattagatgatgggatataccgcataatgcagcgcggtctactcggaagaagccaggttggagtaggcgtttttcaagaaaatgtatttcacaccatgtggcatgttacccgcggagcagtccttatgtatcagggtaaaagactcgaaccatcatgggctagtgtcaagaaagatcttatatcatacggagggggctggagactacaaggatcttggaataccggagaagaagtccaagtaatagcagtagaacctggcaaaaatccgaaaaacgtgcaaaccgcgcctggtacatttaaaactccagagggcgaagtcggtgcaattgctttagactttaagccggggacaagtgggtctcctattgtcaatcgagaaggcaaaattgtaggattatatgggaacggagtcgttacgacttccgggacctacgtatctgctatagcacaggcaaaagctagccaagaaggaccattgcctgaaatagaagatgaggttttcaggaagcggaatttgacaattatggacttacacccgggatcaggcaaaaccagacgatatctgccagccatagtacgagaagcaattaagcgaaaattacgtacactaatcctggcgccgacacgcgtagtagcgtcagaaatggcagaggctttaaagggaatgcctatcagatatcaaacaactgcggtaaagagcgaacataccggaaaagagatagtggacctgatgtgccatgcaactttcacgatgaggctgctgtctcccgtacgtgtacctaactacaatatgataattatggatgaagcacattttacggatccaagcagtatcgcggctcggggatatatttcaacaagggtaggcatgggggaggctgcggcaatattcatgaccgctactccgcctggttcagttgaagcattcccacaatcaaatgcagtaatacaggatgaggaaagagatattcctgaaaggtcatggaatagcggctacgaatggattactgattttcctggtaaaacagtctggttcgtgccctcgattaagagtggaaacgatattgctaactgcctgcgtaaaaatggaaagagagtaatacagttatcaagaaaaacatttgacacggagtaccagaagactaaaaataatgactgggactacgtagtgactaccgatatttcagagatgggagcgaatttcagagccgatagagtaattgaccccagaagatgcttaaagccagttatattaaaggacggacccgaacgtgtaatactagcggggcctatgccggtcactgtggctagcgctgcacaaaggaggggaagaataggacgaaatcataataaagaaggtgaccagtatatatatatgggtcaaccactcaataatgatgaagaccatgcccactggactgaggctaaaatgttgttggataacatcaatacacctgagggtattatacctgcgttgtttgagccagagagagagaaatcagctgcaatagacggggaatacagattaagaggcgaggcacgcaaaacgttcgtggaactgatgcgacgtggcgatttacctgtatggcttagctacaaagtagcatcagagggatttcaatacagtgacaggaaatggtgctttgacggagagaggaataaccaggtattagaggaaaatatggacgttgagatctggactaaagagggagaaagaaagaaattaagacccagatggctagatgcaagaacctactcagatccattagcgttaagggaatttaaggaatttgcggcaggtcggcgctctgttagtggtgacttgattttagagataggtaaactaccacaacacttgactcagcgagcacaaaatgcactagacaatctagtaatgttacacaatagtgaacaagggggacgagcatatagacacgccatggaggaactccctgacactatagaaacactaatgctgttggcactcattgcagtacttaccggaggtgtgacattgtttttcctatcaggcaggggactaggaaaaacatcaatcggtttactttgtgtaatggcaagtagtgtactgctatggatggcctcggttgagccacactggatcgccgcatcaattatattagagttctttctaatggtgcttttaattccggaaccagatcgacagagaaccccgcaagataatcagttggcatacgtagttatagggttgttattcatgatactaacagttgcagcaaatgaaatggggctactggaaacaactaaaaaggacttgggaatcggtcatgtagctgtcgaaaaccatcaccatgctacaatgttagatgtcgatttgcaccctgcatcagcatggactttatacgccgtagctaccacaataattacgccgatgatgagacacaccatagagaacacaaccgctaatatatcgctaacagcaattgccaatcaagcagcaattcttatgggcttagataaaggctggcccattagcaaaatggatattggtgtcccactcttagctctcgggtgctatagtcaggtgaacccactaacacttacagcagcggtgctgatgctagtagcacactatgcgattataggtccaggtctccaagcaaaagccacaagagaagcacagaaaagaactgcagctggaatcatgaagaatcctacagttgatggtattgtagctatagatcttgaccctgttgtgtatgacgcgaaatttgagaagcaattaggacaaataatgttactcatattatgtacgtcccaaatattattaatgagaaccacctgggcattatgtgagagtattacactagcaacaggaccgcttacaacactatgggaaggttcaccaggtaaattttggaatacgacaatagcagtatcaatggccaatatatttagaggtagttacctagccggtgctggattagcattttcattaatgaaatctctcggcggaggaagaagggggactggagctcagggtgaaacacttggagaaaagtggaagcgtcaactaaatcaactttccaaatcagagttcaacacatataagagatcgggtattatggaagtagatagatctgaagcaaaagaagggctaaaaaggggcgaaaccacaaaacatgcagtgagcagaggaacggcaaagctacgatggttcgtggaacgtaatttagtaaagcctgagggcaaggtaatagacttgggatgcggaagaggaggatggtcctattattgtgcagggcttaagaaagtgacggaggttaaagggtacaccaaaggaggacccggtcatgaagaacctatacctatggcaacttatggctggaatttagtaaaactatattcaggaaaagacgtattcttcataccgccggagaaatgcgatactttgctatgcgatataggcgaatcatctcccaacccgacaatagaagaaggaaggactttgcgagtattaaaaatggtagaaccatggttgcgcggaaaccaattttgcattaaaatattgaatccttatatgccaagtgtagtagagactctggagcaaatgcagaggaagcatggagggatgctagtgcgtaatccacttagtcgtaatagcacgcacgaaatgtattgggtctcatgcggaactggaaacattgtttccgcagtaaatatgaccagccgtatgttattgaaccgatttactatggcacaccgtaagcctacctacgagaaggacgtagacttaggagccgggactcgacatgttgcggtagagcctgaagtggcgaatctggatataatagggcagagaatagagaatataaaacatgaacataaaagcacctggcattatgatgaagataatccttataaaacatgggcatatcatggaagttatgaagtaaagcctagcggaagtgctagttcgatggtaaacggagtggtaaaattgctaactaaaccttgggatgtcatcccaatggtgacccaaatcgcaatgacggatacaacaccatttggacaacaaagggtatttaaagagaaagtggataccaggacacctaaagcaaagagaggtactgctcaaattatggaagtaacagctaggtggttatgggggttcctaagcagaaacaagaaaccaaggatttgtacccgcgaagaatttactagaaaggtgcgatccaatgcggctataggcgcagtatttatcgatgaaaaccaatggaatagcgcgaaagaagcagttgaggacgaaagattttgggaccttgtccatcgagaaagggaattacacaaacaaggaaaatgtgccacgtgcgtgtataatatgatgggaaagagggagaagaaactcggggagtttggtaaagcaaaaggatcgcgagccatttggtatatgtggttaggggctaggttcttagagtttgaggctctaggctttatgaacgaggatcattggtttagcagagaaaattctttgtcaggcgtagagggagaaggcctacataaattgggatatatcttaagagatattagtaagataagtggagggaatatgtatgcggatgacaccgcagggtgggacacaagaataacagaagatgacctgcaaaatgaagctaaaattactgatatcatggaaccagaacatgcacttttggctaaagcaatctttaaactgacctaccaaaataaagtggtcagagtacaacgtccggcgaagaatgggacagtcatggatgtcattagcagaagggatcaacgtggtagtggacaagttgggacttatggcctaaatacatttacaaatatggaggcgcaactgattagacagatggagtccgaaggaattttcagcccttcagaactcgaaactcccaacttagctgaaagggtactcgattggttaggaaaatatggcgtagaaaggttgaaacgtatggcgatcagtggtgatgattgtgtagtaaaaccaattgacgaccgattcgctacggcattgaccgctttgaacgatatgggaaaagttagaaaagatattccgcaatgggagccaagcaaaggatggaacgattggcagcaagttcctttttgttcacatcatttccaccaattaattatgaaggatggacgagagattgttgtaccatgtagaaatcaggatgaacttgttggtagagcaagagtctcacagggagcaggatggagcctaagagagacagcatgtctaggaaaaagttatgcccaaatgtggcaattaatgtattttcaccgaagagatctgcgcctagccgcaaatgcgatttgttcagcggttccagttgattgggtcccgacaagtagaacaacatggtcaattcatgctcatcaccaatggatgacaacagaagacatgcttagcgtttggaatcgagtatggattgaagagaacccatggatggaagacaagactcatatctcatcatgggaggatgtcccatatttaggaaaaagggaagatcaatggtgtggatcacttatcggacttacagcacgagcaacatgggcaaccaacatacaagtagctataaatcaggtccgcaggttaataggaaatgagaattatttggattatatgacttcaatgaaaagatttaaaaatgaaagcgaccctgaaggagctttatggtaa

SEQ ID NO: 22147 - RNA, 9879 nt, synthetic construct
  misc_feature 1..9879: note = derived and/or modified CDS sequence (opt6) from DENV-1__FJ176779__SS-prME
  source 1..9879: mol_type = other RNA
tctgtgactatgttacttatgctgatgcccactgcacttgcttttcacttgacaactaggggaggagaaccacacatgattgtaagcaaacaagaacggggcaaatccttactgtttaaaacgagcgccggagtcaatatgtgcaccttagttgcaatggacctgggtgaattatgcgaagacactatgacttacaaatgtcccagaataactgaagcggaacccgacgatgtagattgttggtgtaacgcaactgacacatgggtaacgtacggtacgtgcagccaaacaggggaacatagacgtgataaaagaagtgttgcactagcaccccacgtgggtttaggattagaaacccgaacggaaacatggatgtcatcagaaggggcctggaaacaaatccagagagtggaaacctgggcacttagacatccaggattcacggtaatagctttattccttgcacatgcaataggaacatcaataacacagaaaggaataatatttatactgcttatgcttgtcactccttcaatggccatgagatgtgtaggaataggaagccgtgacttcgtagaggggttatcaggcgccacctgggtggatgttgttctggaacatggtagctgcgtcacaacgatggcgaaagataaacccacactagatatagagttattgaaaacagaagtgactaatcctgcggtattaagaaaactatgtatagaagcaaaaatatccaacacaactactgacagtagatgccctacgcaaggtgaggctactttggtcgaagaacaggacgctaatttcgtatgcagacgtacattcgtagatagaggctggggaaatgggtgtggacttttcggaaaaggttcattactgacctgtgctaaatttaaatgtgtaaccaaactagaaggtaaaatcgtacaatacgagaacttaaaatactcagtcatagtgactgttcataccggagaccagcatcaggtgggcaacgaaagcaccgagcatggaacaactgcgactattactccccaggctccaaccacagaaattcagctaaccgactatggagcgttaacattagattgcagccctcgtaccggtttagactttaacgagatggtattattaacaatgaaagaaaaatcctggttggtacataaacaatggttcttagacttaccactaccatggacatctggggccagcacaagccaagaaacatggaatcgtcaagatcttctcgttactttcaaaactgcacatgcgaagaaacaagaggtagtagtattgggttcacaagaaggtgcaatgcacacagcgttgacaggcgcaaccgagatccaaacttcagggacaactacaatattcgcaggtcatcttaaatgccgcctaaaaatggataaactaaccctaaaagggatgtcgtatgttatgtgcacaggtagtttcaaattggaaaaagaagtcgctgaaacccagcatgggacagtgttggtgcagataaaatatgagggcactgatgctccctgtaaaattccatttagtacccaagatgagaagggagtaacgcaaaatgggagactaataacagcaaaccccatagtgacggataaagaaaaacccgtgaatatagaggctgagcctccatttggggaaagctatatagttataggtgttggagaaaaggctttgaaactaagttggtttaagaaaggatcttcaattggtaaaatgtttgaggcgacggcaagaggggccaggagaatggcaatactaggagatactgcatgggactttgggtctatcggtggtgtattcaccagtgtaggaaagctagtacatcagatttttgggacagcttatggtgtactgttctccggggtaagttggacaatgaaaataggtattggggtcctactcacatggctaggtttaaattcgagatccacaagtctgtcaatgacatgtatcgcagttggattagtaacactgtatcttggagtaatggttcaagcagattcaggatgcgttataaattggaaaggcagagaattaaaatgcggatctggtatattcgttacaaacgaagtccacacttggacagaacagtataaattccaagcagactcaccgaagaggctatcggctgccattgggaaggcttgggaagaaggggtctgtggaataagatcagctactcgattagagaatatcatgtggaagcaaatatcaaatgaactaaatcacatattattggaaaacgatatgaaattcaccgtagtagtaggagatgtcgcagggatactagcacagggcaagaaaatgattagaccccaaccaatggagcacaaatactcatggaaaaattgggggaaagcaaaaatcattggcgcggatgtacagaacagcacgttcattattgacggacccaacacaccagaatgtagtgatgatcagagagcctggaatatatgggaggtagaagactatggttttggaatatttaccacaaatatttggctcaaacttcgggattcatatactcaagtttgcgaccatcggctcatgtctgcagctataaaagattctaaggcagttcatgctgacatggggtattggattgaatctgagaaaaatgaaacctggaagttagcgagagcatcttttatcgaggtaaaaacctgtatatggccaaagtctcatacactctggagcaatggcgtcctcgagtcagagatgataatacccaagatatatgggggacctataagccagcacaactatcgaccaggatattttacacagacagcgggaccatggcatttaggaaaacttgaactcgacttcgatttgtgtgaagggaccacagtggtagtagacgaacattgtggcaatagggggccatcattacgcactacaacagttaccgggaaaataatacatgaatggtgctgccggtcctgcactttaccgcctctaagatttagaggagaagacggatgttggtatggtatggaaatcaggcccgttaaagaaaaagaggaaaaccttgtgaaaagtatggttagcgctggtagtggagaagttgattcgttttccctcggtttgctttgtataagcattatgatagaagaagttatgcgaagtagatggtccaggaaaatgctaatgaccggtacgttagcggtattctttctactaattatgggtcaacttacatggaacgatctgatcagattgtgtattatggtcggggcaaatgcatcagacaggatgggtatgggaactacttacttggcgttaatggcaaccttcaaaatgcgacccatgtttgcggtgggactgctgtttcgtcgattaacttcaagagaagtgctactattaacaattggactgtcacttgtagcatctgtcgaactgcccaacagtcttgaagaacttggagacggtttagctatgggaataatgatacttaaactactcaccgattttcaaagccatcaattatgggccacacttcttagtatgacgtttatcaaaactacattctcactacattatgcatggaaaacgatggcaatggtattatccatcgtaagtttattccccttatgtttaagtactaccagtcagaagaccacatggttgccggtacttctaggatcattgggatgcaaaccactaacgatgttcttaatcgcagagaataaaatctggggcaggaaatcatggcctttgaacgaaggcattatggcagtgggaattgtctctatacttctctcgagtcttctcaaaaatgatgtgcccttagccggcccattaatagcgggcggtatgctaattgcgtgttacgttataagtggatcaagcgcggatctatccttggaaaaagctgcagaggtttcatgggaggaggaggcagagcacagcggtgcgagccacaatattctggtagaagtacaagatgatggaaccatgaagatcaaagatgaggaacgggacgacacacttactattctactgaaagcaactctgctcgcagtgtcgggtgtatatccattgtctataccggcaacactgttcgtctggtatttctggcagaagaagaaacaaaggagcggcgtactatgggatacaccatcgcccccaaaggtagaaagagcggtccttgatgacgggatatatcgtataatgcaacgaggacttttaggtcgctcacaggtcggggttggtgtatttcaagaaaatgtttttcacaccatgtggcatgttactcgaggtgcagtgctgatgtaccaagggaaacggcttgaaccgtcgtgggcttcggtcaaaaaggatttaataagttacggcggagggtggcgactacaagggagttggaacacgggagaggaagttcaagtgattgcggtagaacctggaaagaatccgaaaaacgtccagaccgcacctggtacatttaaaactcctgagggtgaagtgggagctatagctttagacttcaaaccagggacaagtggctcgccaatagttaaccgagagggaaaaattgtcgggttatacggaaacggtgtagtaactactagcggaacatacgttagtgccattgcgcaagcaaaagcctctcaagagggaccactacccgaaattgaagatgaagtcttcaggaaacgaaacttgacgataatggatctacatcctggatctggaaagacaaggcgttacttaccagcgatagtacgagaagcaatcaaaaggaaaatgaggacacttatacttgccccaaccagggtagttgcatcagagatggccgaggcgcttaaaggaatgccaatcagatatcaaactacagctgtgaaatctgagcatactggaaaagaaatcgtcgacctaatgtgccacgcaacttttacgatgagactcttaagtccggtgagagttccaaactataatatgataattatggacgaagctcattttactgacccaagttccatagcagcgagaggctacataagtacccgggttgggatgggggaggcagcagcaatttttatgacggcaacgcctcctggttctgtagaggcattcccccagagtaatgcggtcatacaagacgaagaaagagacatcccagaaagatcatggaatagcggctacgaatggatcaccgaatttccaggaaaaaccgtatggtttgtaccatcaataaaagccggaaacgatatagccaactgccttaggaaaaacggaaaacgagtcattcaactctctagaaaaacatttgatactgaatatcagaaaactaagaataacgattgggattacgtcgtaacgacagatattagcgaaatgggagcaaattttcgtgcagaccgtgtaattgatcctaggcgttgtttaaagccagtaattctaaaggacggacctgaacgtgtaatattagctggaccaatgcccgttacggtcgccagtgcagcacaaagaagaggtagaataggtcggaaccataataaggaaggcgatcaatatatatatatgggccaaccgttaaacaacgatgaagatcatgcacattggacggaagcaaaaatgctccttgacaatatcaatactcccgagggtataataccggcgttgtttgaaccggagagggagaaatctgcagcaatagatggtgaatataggttacgtggagaagcgcgcaaaacatttgtcgagctcatgagacgaggagacctaccagtatggttatcttacaaagtggcgagtgagggatttcaatatagtgatagacgatggtgtttcgatggagaaaggaacaatcaagtcttggaagaaaatatggatgtagaaatttggacaaaagaaggcgagcggaagaaactgagacccaggtggctagatgcgagaacttattcagatccgttagccctaagagagttcaaagaatttgctgcaggccgacgttcggtatccggggaccttatattagaaataggaaaattaccacaacatctaacacaacgggctcagaatgccttggacaatctagttatgctacacaattcagagcaaggcggtagagcttatcgccacgcaatggaggaattaccagacaccatagaaacattaatgttattggccctaatagcagtactaactggcggagtaacactattctttctttcagggaaaggcctaggaaaaacaagtataggactactctgtgtcatggcatccagcgtattgctatggatggctagtgtagagcctcattggatcgcagcgagtattatattagagttctttctcatggtccttttaatacctgagcctgacagacagcgtacacctcaggacaaccaattagcatacgtcgtaattggtctactttttatgatactaacggtagcagctaatgagatgggcttattggaaactaccaagaaagatcttggaatcggacacgtcgcagttgagaatcatcatcatgccgcaatgctcgacgtcgatttacaccccgcttcagcatggacgttatacgcggtagcaaccaccataattacccccatgatgcggcataccattgaaaatactacagcaaacatatctctgacagccatcgccaatcaggctgcaatacttatgggactggataaagggtggccgatatcaaagatggatattggcgtcccactattggccttgggctgttatagtcaggtaaatcccctaacacttacagcagccgtgctaatgttagtagcgcattatgcaattataggacccggcttacaagctaaggctacacgagaagcgcaaaaacggacagctgccggtattatgaagaatccaacaatagatggtattgtagcgattgatctggatcctgtagtctatgatgcaaagtttgagaagcagttagggcaaataatgttacttatactatgcacatcccaaatactcttgatgaggactacgtgggcgttgtgtgaatcaataacactagctacaggacccttaacaacattgtgggaaggaagtcccgggaaattttggaatacaaccattgcagtcagtatggctaatatattcagaggatcatatctcgccggagcgggtttggcattcagcttaatgaaatcactaggaggcggaagaagaggaacaggggcccaaggtgaaactctaggggagaaatggaagagacaattaaaccaactctctaagagcgagtttaatacatacaaacgtagtggaattatggaagtcgatagaagtgaagcaaaagagggtctgaaaagaggcgaaacgacaaagcacgctgtgtcgagaggtacagcaaagttgcgatggttcgtcgaaaggaatttagtgaaaccagaaggaaaagtcatcgatctaggttgtggacgaggcggttggagctactactgtgcaggactaaagaaagtaactgaagtcaaaggatatacaaaaggaggaccaggtcatgaggaaccgataccaatggcaacgtatggttggaatcttgtcaagttacacagtgggaaggatgttttctttataccaccagagaaatgtgacactttactatgtgatataggtgaaagcagcccaaaccctacgatcgaagaagggaggacactaagggtcctcaaaatggtagagccatggctgagggggaatcaattttgcattaaaatattaaacccttacatgccttcggtagtagaaactcttgaacaaatgcaaagaaaacatggaggaatgcttgtccgaaatcccctctcacgtaattcaactcatgagatgtattgggtaagttgcggtacaggaaacatagttagtgctgtaaacatgacttctagaatgcttcttaaccgatttacaatggctcatcgaaaaccaacgtacgagcgtgatgtagatttaggtgccggtactcggcatgtggcagttgaacctgaggtcacaaacttagatataatcggccaaagaattgaaaacatcaaatatgaacataagagcacatggcactacgacgaagataacccttacaagacctgggcctaccacgggtcctatgaagtgaaaccatcaggtagtgcctcatcaatggtgaacggcgtagttaaactcctaactaaaccatgggacgtcatcccaatggtaacacaaattgcaatgacagatacaactccctttggtcaacaaagagttttcaaggaaaaagttgatacgcgcacacctaaagcgaaaagaggtacggctcaaattatggaagtcactgctagatggctttggtcattccttagcaggaacaagaaaccaagaatctgtacgagagaagagttcacacgaaaggtaaggagcaacgctgcgattggagccgtgtttgtagatgagaaccaatggaacagtgctaaagaagcggtggaggacgatagattctgggatctagtacacagagagcgagaattacataagcaaggtaaatgtgctacatgcgtctataacatgatgggaaaaagggagaagaaactaggtgaatttggaaaagcaaaagggtcacgcgccatctggtatatgtggctaggagctagattcttagagtttgaagcactaggtttcatgaatgaagatcattggtttagcagagagaactcactttcaggagtagaaggtgaaggacttcataaattaggatatatactccgtgacataagtaaaataccaggaggcaacatgtacgccgacgacacagccggttgggatacacgaataacagaagatgatctacagaatgaagctaaaataaccgacataatggagccggaacatgccttactagcaaaaagcatattcaagctaacataccaaaataaagtagttcgggtacaaaggcctgccaaaaatggaactgtgatggacgtaataagcagacgagatcaacgtggttcaggtcaagtgggaacatacggattgaacaccttcactaatatggaagcccagttaatacgacaaatggaatcagaaggaattttctcgccaaacgaactggaaaccccgaacctcgctgagcgtgttttagactggctcgagaaatacggggtagagagacttaaacgaatggcgattagcggtgatgattgcgttgttaaacctatagatgatcgttttgccacggcgctaaccgcactaaatgatatgggaaaagtacgaaaagacatccctcaatgggagcccagcaaaggttggaatgactggcaacaggtgccattttgctcacaccactttcaccaacttataatgaaggatggcagagaaatagtcgtaccttgcagaaatcaagatgagttagtaggccgggctcgagtaagccaaggagccggatggtctttacgcgaaactgcgtgcctaggaaaaagctacgcacaaatgtggcaattgatgtattttcaccgaagagatttaaggttggcggctaatgcaatttgcagtgcagtaccggttgactgggttccaacctctcgaacaacgtggtctatacatgcacatcatcagtggatgaccaccgaggacatgttaagcgtatggaaccgcgtctggatagaagagaatccctggatggaagacaaaacgaggatatctagttgggaagatgtaccatacctgggaaaaagagaagatcaatggtgtggaagtttaataggcttaacagcgagggcaacttgggcaacaaatattcaagttgcaattaaccaagttcgtaggctcattggtaacgaaaactattcagactatatgacatcaatgaaacgatttaagaacgagtcagaacccgagggcgctttatggtag

SEQ ID NO: 22148 - RNA, 9879 nt, synthetic construct
  misc_feature 1..9879: note = derived and/or modified CDS sequence (opt6) from DENV-1__FJ176780__SS-prME
  source 1..9879: mol_type = other RNA
agtgtaacgatgctacttatgcttatgcccacagcgctagcttttcatctcacaacaaggggaggagaaccacatatgatcgtctccaaacaagaacgtggaaaatctctcctttttaaaacgagcgcaggagtgaatatgtgtaccctaatcgctatggatctcggtgaattatgtgaagataccatgacctacaaatgccctaggattactgaggcggaaccggacgacgtggattgttggtgtaacgcaactgatacatgggtgacatatggaacttgctcgcaaactggtgagcatcgaagagacaaaagaagcgttgctctagcaccccacgtaggcctgggtttggaaaccaggactgaaacatggatgagttccgaaggagcatggaaacagatacaaagagtagaaacttgggctctacggcacccaggctttacagttatagcactctttctagctcatgcaataggcacttcgataacacaaaaaggaataatattcatcctattaatgctagtaacaccatccatggcaatgcgatgtgttggtataggttcccgagattttgtggaaggattatccggggcaacctgggtagatgtagtattagaacacggctcttgtgtaactacaatggcaaaagataaaccgaccttagacatagaacttctgaaaactgaagtaaccaatccagcagtattaagaaaactgtgcatcgaagcgaaaataagcaatacaacgaccgattccaggtgccctacgcaaggtgaagcgactctagtcgaagaacaagacgcaaactttgtgtgccggcgcacttttgtagatcgcggatgggggaatggatgcggcctgtttggcaaaggaagtttaattacatgtgccaaatttaaatgtgtaacaaaattagaaggtaaaattgtccaatacgagaacctaaaatattcagtcattgttacagtacacacgggcgatcaacatcaagtgggtaacgagtcaactgaacacggaaccacagcgaccataacacctcaagcaccaacaacggagattcaactaactgactatggtgcactaactctggactgttcaccgcgaacaggactagactttaatgagatggtgctcctaacgatgaaagaaaaatcttggttagttcataaacaatggttcttagacctccctttaccatggacaagtggagctagtacttcgcaggaaacctggaaccgacaagacttgttagtcaccttcaaaaccgcccatgccaagaaacaagaggttgtggtcttaggctctcaggaaggcgccatgcacacagcgctaactggagcaacagaaatacaaactagcggtacaacaacaatatttgccgggcacctaaaatgcagattaaaaatggataaactaacgcttaaaggcatgagttacgttatgtgcactggttcgttcaaattagaaaaagaagtagcggaaactcaacatggaacggtgttagtacaaattaaatatgagggaacggatgcaccatgtaaaataccttttagtacgcaggacgaaaaaggtgttactcaaaatggtagacttattaccgcgaacccgatcgtaacagataaagaaaaaccagtaaacatcgaggccgaaccaccatttggcgaatcttatattgttataggagcgggagaaaaagccttaaaactgagttggtttaagaaaggaagcagtataggaaaaatgttcgaagctacagcgcgaggtgctagacgcatggctatcttgggagatacagcatgggattttggatctataggtggagttttcactagcgtagggaaattggtacatcagattttcgggacagcatacggagtattattttctggagtgtcatggacgatgaaaatagggataggagttttattgacttggttaggtctaaattctcgaagtacgtcactaagcatgacgtgcatagctgtgggcttggttacgctatatcttggtgtaatggtacaagcagacagcggttgcgtcataaattggaaaggaagagagctgaaatgcggttcaggaatatttgtaacaaatgaagtacacacgtggactgaacaatataaattccaagcagactccccaaagagactgagtgcagcaattggtaaggcttgggaggagggtgtctgcggcatcagatcagcgacgcgattagagaacataatgtggaaacagatttcaaatgagttaaatcacattctgcttgagaatgacatgaaatttacagtggtggtaggagatgtggcagggatcctggcacaagggaaaaagatgataagaccgcaacccatggaatataaatacagttggaaaagctgggggaaggctaaaataatcggagctgatgtacaaaatacaacgttcattattgatggtcctaatacgccagaatgtcccgacgatcaaagggcatggaacatttgggaagtagaggattatggatttggcatattcacaactaatatctggttgaaactacgtgacagctacacccaggtatgtgatcacagattgatgtcagcagcaataaaagattcaaaagctgtccatgccgatatgggatattggattgaaagtgagaaaaatgaaacgtggaaactcgctagggcgagtttcatagaagtaaaaacctgtatttggcccaaatcgcatacactatggagtaacggagttttggaatctgaaatgattattcccaaaatatacggaggtcccataagtcagcataactatagacctggttactttacacaaacggcgggtccttggcatctagggaaactcgaattggacttcgacttgtgtgaaggaactactgttgttgtagatgaacattgtggtaacagagggccatccttaaggacaactacagtaacgggtaaaataatccacgaatggtgttgcagaagctgtacactacccccgctgcgtttcagaggagaagacgggtgttggtatggaatggaaattcgcccggttaaagaaaaagaagagaatttagtcaaatccatggtcagcgccggatcgggtgaagttgacagtttttcactaggactcctatgcataagtattatgatagaggaggtaatgcgttcacgatggtctcgtaaaatgctaatgaccgggactttggcagtatttttcttattaataatgggtcaattaacttggaacgatctgattcgtttatgtattatggttggagccaatgcgagtgatagaatgggtatgggaactacttatttagcacttatggcgacttttaaaatgcgtcccatgtttgccgtcggtctgctttttagaagactaacatcgagggaggtattgctcctaacgataggtctatccttagttgcttcagttgagctgcccacctcattggaagaattaggcgatggactggcgatgggaataatgatattgaaactattaactgactttcaatcgcatcaactatgggcaacactgctttccctcacctttgtgaaaacaacattttcattacactacgcctggaaaacaatggcaatggtgctatcaattgtctcactatttccactatgcctcagtacaacatcacaaaagactacatggttacccgtattattaggcagcttaggatgtaaaccgctaactatgttcctgattgcagaaaacaaaatctggggtaggcgttcgtggcctctaaatgaaggaataatggctgtcggaatagtttctatactattaagtagccttctaaagaacgatgttccattggccggtccactcattgctggtggaatgttgatagcctgctatgtgatatcaggatcatcagcagatttgagtttagagaaagctgcagaagtatcttgggaagaggaagcggaacatagtggagctagccacaatatcctcgtcgaagtacaggacgacgggacaatgaaaatcaaagatgaagagagagacgacacgcttactatattattgaaagcaacattactggccgtctcaggagtctaccctctaagtattccagcgactctattcgtctggtacttttggcagaagaagaaacaacgttcaggtgtattatgggatacaccttcgccaccagaggtagaaagggccgtattggatgatggaatatatagaataatgcagcgcggattactaggtagatcccaagtaggggtaggggtattccaagaaaatgtttttcatactatgtggcacgtgacaaggggtgccgtcttaatgtatcagggaaagagactcgaaccctcatgggctagtgtgaaaaaggatttaatatcatatggtggtggatggcggttacaagggagctggaatactggcgaagaagtacaagttatagcagttgaacctggcaaaaatccaaagaatgttcaaacagccccaggtacatttaagacacctgagggtgaagttggagcaatcgccctagattttaaaccaggtacttctggttccccaatagtaaatcgtgagggaaaaattgtaggtctttacggcaacggtgttgtaacgacaagtggaacttacgtttcagcaattgcgcaagcgaaagcaagccaagaaggaccattaccagaaatagaagacgaagttttcagaaaacgaaatctaaccataatggaccttcaccctgggtcaggaaagaccagaagatacctacccgcgatagttagagaagcaattaaaaggaaactaagaactcttatcctcgcaccaacaagggtcgtggcgtcagaaatggcagaggcattgaaaggcatgccaatacggtatcaaacaaccgcggtcaagtcggagcataccggaaaagagatagtagatttgatgtgccatgcgacatttacaatgcgcttactatcaccagtgagggtcccaaactataatatgataatcatggatgaagcacatttcactgacccttcgagtattgcagcaaggggctacatttcaacaagagtaggaatgggggaagccgcagcgatctttatgacagcgactcctcctggaagtgtagaggcttttccccaatctaatgctgttatacaagacgaagaacgtgatataccagaaagatcatggaatagtggatatgagtggataactgacttcccgggcaagacagtttggttcgtacccagcataaaaagtggcaacgatatcgcgaattgtctccgcaaaaacggcaaaagggtcattcaactgagtagaaaaacattcgacacagaataccagaaaactaaaaacaatgattgggattatgttgtaaccacagacataagcgaaatgggggcaaatttcagagcagatcgagtaatagacccacggcgttgtcttaagccagtaatactaaaggacggaccagagagagttattcttgcaggcccgatgccagttactgtggccagtgctgctcaacgaagaggacgtattggcaggaaccataacaaagaaggggatcaatacatatatatgggccagcccttaaataatgatgaggaccatgctcattggacggaagccaaaatgcttttagataatatcaacacaccagaaggcattatcccggcattattcgaacccgaacgagagaagtctgcagccattgatggtgaatatcgtcttaggggagaagcccgcaaaacattcgtagaactcatgaggcggggtgacttacccgtatggctatcttataaagtagcctctgaagggtaccaatactctgatagacgatggtgcttcgatggggaacgtaataaccaagtattagaagaaaatatggacgtcgagatatggacaaaagaaggtgaaagaaagaaattacgaccaaggtggttagatgcacgaacctattcagatcccctcgcactgcgagagttcaaagaatttgcagcgggaaggaggtctgtgtcaggcgatttaatattggagattggaaagttaccacaacatttaacgcaacgggcacagaacgcactagacaatctagtaatgctacacaacagcgaacaagggggcagagcttataggcatgccatggaagaactacccgacacgatagaaactctcatgctactcgcgcttattgcagttttaacaggaggtgttaccttattctttttatctgggcgaggtttagggaagacatcaataggattgctctgcgtcatggcctctagtgtcctcttatggatggcttcagtagaaccacactggattgcggcaagcataatactcgagttctttctcatggtactcttaatacccgaaccggacagacagagaacaccacaggataatcagttagcgtacgttgtgatcggactattattcatgattttgacagtcgcagctaacgaaatgggcttattagaaacaactaagaaagacttaggtatcggacatgttgcagtagaaaaccatcaccatgctgcgatgctggatgtcgacctacatccagcaagcgcctggactttatatgctgtcgctacgacaatcataacgccaatgatgagacatacgattgaaaatacaacagccaatatatcgcttacagcgatagctaatcaagcagccattttaatgggcttggacaagggttggcctatatcaaaaatggacatcggcgtgccactgctagctctcggatgctactcgcaggtaaatcctctcactttaacagcggccgttctcatgctagtagcacattatgctattatagggcctggactgcaagctaaagcaactagagaagcacagaaacgaactgctgcgggaatcatgaaaaatccaactgtcgacgggattgttgccatagatttagacccggtagtttatgatgcaaaatttgagaaacaattaggccaaataatgctgcttatactttgtacctcacaaattctactcatgaggactacatgggcactatgcgaatcgattaccctagctacaggtcctttaacgacactttgggaaggaagccctggtaaattttggaacactacaatagccgtgtctatggcaaacatcttcagggggtcatatcttgcaggcgctggcctcgccttctcactaatgaaatctttagggggaggtcgaagagggacaggagctcaaggggaaacattgggagaaaaatggaagcgacagctgaatcaactgagtaagagtgaatttaacacgtacaaaaggagtggcataatggaagtcgatagatccgaggcaaaagagggacttaaaagaggtgaaactacaaaacatgcagtctcccgaggcacggctaaattaagatggtttgtggaaaggaatctagtaaaaccagaaggcaaggtaatcgacttggggtgcggcaggggcggttggtcatattactgtgcaggactaaagaaagttacggaagtaaaaggttatacaaaagggggaccaggacacgaagaacctatccccatggcgacctatggatggaatttagtgaaactacactcgggtaaagacgtattctttataccacccgaaaagtgtgacacccttctgtgcgatataggtgaatctagcccaaatcccacaattgaggaaggtcgcactcttagagtacttaaaatggtagagccatggttgagaggaaatcagttttgcataaaaatattaaatccgtatatgccatcagtcgtagaaacattagagcagatgcaaagaaaacacggaggtatgcttgtcagaaatccactatcgagaaacagcactcacgagatgtattgggtatcttgtgggacgggtaatattgtatcagcagtgaacatgactagcagaatgctactgaatcgatttactatggcacacagaaaaccaacgtacgaacgtgatgtcgatctaggggcaggaacaagacatgttgcagtagagccagaagtaactaacctagacataataggccaaagaatcgaaaatataaaacatgaacataaaagcacatggcattatgatgaggataacccatacaagacttgggcttatcacggatcttacgaggtcaaaccaagcggttcagcgagcagcatggtaaacggggttgtgaaattacttacaaagccctgggatgttattcctatggtaacacaaattgcgatgacagatacaacacccttcggccaacagagagtattcaaagaaaaagttgatacaagaactcccaaagcaaaacgcggaacagcgcaaatcatggaagtgactgccaagtggctttggggttttctctcaagaaataagaaaccacgaatatgcactagagaagaatttacaagaaaagtacgttcaaatgctgcgataggggcggtattcgtggatgaaaatcaatggaactcggcaaaggaagcagttgaagacgagcgattttgggatctagttcatagagagagagaactacacaaacaagggaaatgcgcaacttgcgtatataacatgatggggaaaagagaaaagaaactgggggaatttggtaaagccaaggggagtagggcgatttggtatatgtggctcggggctagattcctagaatttgaagcactaggttttatgaatgaggaccattggtttagtagagaaaatagtttatctggagttgaaggtgaagggcttcacaaactaggatatatactaagggatataagcaaaattcctggtggtaatatgtatgccgatgatactgcaggttgggatacgcgaataacggaagatgatctgcaaaatgaagcaagaataaccgatataatggaaccagagcacgctttattggcaaaatccatttttaagctaacatatcaaaataaggtggtacgagtacaacgtccagccaaaaatgggactgtcatggacgttataagtcgacgggatcaaagggggtcgggacaagtaggtacctatggactcaacacatttaccaatatggaagcacaactcattcgtcaaatggaatctgagggaatcttcagcccaagtgagttggaaacaccgaacttagcagagcgagtgctagactggcttgagaaatacggggttgaaaggttgaagagaatggctatttcaggagatgactgtgtagtaaaaccaatcgacgatcgtttcgcgaccgctttgactgcgttaaacgatatggggaaagtcagaaaagatattccacaatgggagcccagcaaaggctggaatgactggcaacaagtgcccttttgttcacaccatttccatcaattaataatgaaagacgggcgtgaaattgtagtaccatgtcgaaatcaagatgaactcgtaggccgtgcccgagtatcacagggagctggttggagtctaagagaaacagcatgcttggggaaaagctacgctcaaatgtggcaactcatgtactttcatagacgggacctacgattggccgccaacgctatttgtagtgctgtaccagtagattggataccaacgtctcgcactacgtggagcatccacgcacatcaccagtggatgactacagaagacatgctcagtgtctggaaccgagtctggatagaggaaaatccatggatggaggacaaaacacatataagtagctggggagacgtcccttacctcggcaaacgcgaagaccaatggtgtggtagtctaataggtctcacagctagagcgacttgggctacaaatatacaagtcgcgatttatcaggtccggcgtttaataggcaatgaaaactatttggattatatgacatcaatgaaaaggtttaaaaacgagagtgacccagagggagctttatggtag

SEQ ID NO: 22149 - RNA, 9879 nt, synthetic construct
  misc_feature 1..9879: note = derived and/or modified CDS sequence (opt6) from DENV-1__JN205310__SS-prME
  source 1..9879: mol_type = other RNA
agcgtaactgtcctatttatgctcctaccgactgcattagcattccaccttactaccttgggaggagagccacatatgattgtaagcaaacaagaacgaggtaaaagtttactctttaaaacctcagcgggggttaacatgtgtacgttgatagctatggacttaggcgaactatgtgaagataccatgacttacaaatgtcctagaataacagaaaccgaaccagatgacgtcgattgttggtgcaacgcaaccgaaacatgggttacttatggtacctgctctcaaacaggagaacacagacgggataaacggagtgttgcactcgcaccacatgttggtctgggacttgaaactaggaccgaaacgtggatgtcgtcagaaggtgcatggaaacaaatacaaaaagtagaaacatgggcactacgtcatcctggctttacagttatagcactctttttggctcacgctataggcacttctataacccaaaaaggaattatattcatacttcttatgttagtaacaccttcgatggcaatgcgctgtgttggtataggcaatcgagattttgtggaaggcccttccggcgcaacatgggtagacgttgttttagaacatgggagctgcgttacaaccatggcgaaaaacaaaccgactttagatattgaactattaaaaacagaagtgacaaatccagcaatactccgaaaactatgtatcgaagctaaaatttcgaacacgacaaccgacagtagatgccctacacaaggcgaagcgacgctagtggaagaacaagatacgaactttgtatgtagacgtacatttgtagacagagggtggggaaacggatgcgggttgtttggtaaaggatccttaattacatgtgcaaaatttaaatgtgttacaaaactagaaggaaaaatcgtccaatatgaaaacttgaaatattcagtaatcgtaacagtccatacgggcgatcagcatcaagtaggtaatgaaacgaccgagcatggaacaaccgcaatcataacaccacaagctcctacatctgaaattcaactgaccgattatggtgctctaactcccgactgttcacctaggacaggcctcgactttaatgaaatggtattgctgacgatgaaagaaaaatcttggttagttcataaacaatggttccttgatctaccattaccctggacatcaggggcctcgacttcccaagaaacatggaaccgacaagatctcctcgttacatttaaaaccgcgcatgccaagaaacaagaagtagtcgtattaggctcacaagaaggggctatgcacactgcgttgacgggagcaacagaaatacaaacttccggtactacgacaatatttgctggtcatttaaaatgcagattgaaaatggacaaactaacgttaaaaggtgtttcgtatgtgatgtgcactgggagctttaagttagaaaaagaagtagctgaaacccaacatggcaccgtcttagttcaagtaaagtacgaaggcacggatgctccctgcaaaataccctcaagcagccaagatgaaaaaggagtgatacagaatgggcgtttaattacagccaatcctatagtaacggacaaagaaaaaccagtgaatatagaagcagagccaccatttggtgaaagctatattgtggttggtgccggtgaaaaagccttaaaactatcctggtttaagaaagggagcagtattggcaagatgttcgaagcgacggccaggggtgcaaggaggatggctattttaggagatacagcttgggattttggaagcatcggaggtgtatttacatctgtaggaaaattagtacatcaaatatttggtacagcatatggagtactattttcgggtgtctcatggacaatgaaaattggaataggaattttacttacgtggttaggcctaaatagcagatctacatctctctccatgacctgtattgctgtaggaatggtaactctatacttaggggtcatggtccaggcggacagcggatgtgttataaattggaaagggagagaattaaaatgtggttcaggtatatttgtcactaacgaggtacatacctggaccgaacaatacaaattccaggcggactcaccaaaaagattaagtgcagccataggaaaggcttgggaagagggtgtctgcggcattagaagtgctacccgattagaaaacataatgtggaagcagatttctaatgaactaaaccatatcttattggaaaacgatatgaaatttacggtggttgttggagatgtatctggaatattggcgcaaggaaagaaaatgattcggcctcagcccatggagcataaatatagctggaaaagctggggcaaagcaaagatcataggcgctgatgtccaaaacacaacattcatcatagatggccctaataccccagaatgtcccgacaaccaacgagcatggaatatttgggaggtggaagattatggattcggtatatttacaactaacatatggctaaaattaagagattctttcacacaggtatgcgatcatagattaatgtcagccgccataaaagatagcaaagcagtgcatgcggacatgggttattggatcgagagcgagaagaaagaaacctggaaattggcacgggcgtcattcatagaagtaaaaacatgtatatggccaaaatcgcatactctgtggagtaacggagtattggagtctgaaatgatcatcccaaaaatctacggaggccccgtcagtcaacataattacagaccgggttattttacgcaaaccgctggcccttggcatctaggcaaactagaattggattttgacttgtgcgaaggaacaactgtcgtagtagatgaaaactgcggcaacagaggaccgagtttaagaactacgactgtcacaggaaaaacaacgcatgagaggtgttgtagaagttgtacattaccgccattacgattcaaacgcgaggatggttgttggtacggaatggaaattagacctgtgaaggaaaaagaagaaaacttagtgaagtctatggtctccgcaggctccggagaagtagatagtttttcattaggacttttgtgtatatcaatcatgattgaagaggtgatgagaagcagatggagtcgaaagatgctgatgacaggtactctggctgtatttttattactgacaatggggcaaagtacatggaatgatttgataagactatgtactatggttggcgctaacgcatccgacatgatggggatgggaactacctatctagcattaatggctacattcagaatgaggcccatgtttgctgtcggtttgctgttccgaagactgacttcaagggagattctactgcttactgtgggcctaagtctggtagcatcagtagaattgcccaatagtctagaagaacttggagacggtctagctatgggtataatgatgttgaaactcttgacggactttcaaccacatcaactttgggcgaccttgttaagtcttacatttgttaaaactacactatccctacactacgcatggaaaacgatggcgatgattctcagtatcgtctcattacttccactttgcttatctaccacatcacagaaaactacttggttacccgtcctattaggtagtctaggatgcaaacctctaacgatgttcctaattactgaaaataaaatttggggcagacgtagctggccactgaacgaaggcataatggcaataggcatagtttctatattattatcctcacccttgaaaaatgacgtaccactagctggtccactcatagcaggagggatgctcatcgcttgttacgtcataagcggatcatcagcggacttatctttagagaaggcagcagaggtctcatgggaggacgaggcagaacacagtggtgcaagtcacaacattttagtcgaggttcaagatgatggaactatgaaaataaaagatgaagaaagagatgatacgttaactatcttgttaaaagcaacgctattagtcataagtggtgtatatcctatgtccatacctgccactttatttgtgtggtacttttggcagaagaagaaacaacgctcaggtgtattatgggatacgcctagtcctcctgaagttgaacgagcggtattagataatggtatatacagaatactacagcgtggcttactcggcagaagccaggtcggtgtaggcgtatttcaagagggagtgttccatacaatgtggcatgtaacgagaggtgccgtattaatgtatcaaggcaaaagactagaaccatcttgggcatcagttaaaaaggatctgataagttatggaggtggttggaggtttcaggggtcttggaatacaggcgaggaagtacaggtaatagcagtggaacctggtaaaaaccccaaaaatgtgcagacaacgcccggtacattcaaaacgccagaaggggaagtaggagctatagcactggattttaaaccaggcacatccgggtcaactattgttaacagggaaggaaagatagtgggactgtatggtaatggtgttgtaacgacaagtggaacgtacgttagtgcgattgcacaggcaaaggcgagccaggagggccctctacctgaaattgaggacgaagtatttcgtaaacgaaacttaaccatcatggacctgcaccctggatcggggaagactaggagatatctaccggctatcgtgagagaagctatcaagagaaaattaaggactttagtactggctccaactagagtcgtagcgtcggaaatggcggaagcccttaagggaatgcctattagataccagactacagcagtaaaatctgaacacacaggaaaagaaattgtagatttaatgtgccacgctacatttacgatgagactcctatcaccggtaagggtcccaaactacaacatgattattatggatgaagctcattttacagatcctgcgtcaatagccgcgaggggttatatcagcacgagagttggtatgggggaggctgctgcgatatttatgaccgcaacgcctccaggaagtgtagaagccttcccccaatcaaatgccgtcattcaggatgaagaaagggacatacctgaaaggtcatggaatagtggttacgaatggattactgattttccgggcaaaaccgtttggtttgtcccctcaattaaatcaggcaatgatatcgcgaactgccttcgtaaaaatggaaaaagagttgttcaattatcaagaaaaacctttgatactgagtatcagaaaaccaaaaacaacgattgggattatgtggtaaccacagatataagcgaaatgggggctaattttcgagcagatagagtaatagatccaaggcgctgcctgaaaccagtcatattaaaagatggcccagaacgtgtcatactggctggtcccatgcctgtaacagtcgccagtgcggctcaacgtagaggaaggatcggaaggaatcccaataaggaaggcgatcagtatgtctacatggggcaacccctaaataacgatgaagaccatgcacactggactgaagcgaaaatgttactagacaatataaacacacctgagggaataattccagcactatttgaaccagagagagagaagtctgccgcaatagatggcgaatacagattaaggggtgaggcgagaaaaacctttgttgagctaatgagaaggggtgatttaccggtatggctatcctacaaagtagcaagtgaaggctttcaatattcggacagacggtggtgttttgatggggagcgaaacaaccaagtcctcgaagaaaacatggacgtcgaaatctggacgaaagaaggagaaaggaagaaactacgtccaagatggcttgatgcgagaacctatagtgaccccctagcactacgagagttcaaagaatttgcagcaggtagacgatcagtatccggcgacctaatattggaaatcggtaaactaccacaacatttaactttaaaagctcaaaacgcattagataacttagtcatgctgcataatagtgagcagggcggcaaggcttacaggcacgcgatggaagaattacccgatacaattgaaaccttaatgttattagcgctaatcgctgtactgacaggcggtgtaacactatttttcctcagcggtaggggattaggaaaaacctcaataggactactgtgtgtaatggctagcagtgtgctcttatggatggcatcagtcgagcctcactggatagctgcatccataatcctagagttctttttaatggtcctacttattccagaacccgatagacaaagaaccccacaagataaccaacttgcatacgttgtaatagggcttctatttatgatactaacagtagcggcaaatgagatgggcctattagaaacgacgaaaaaggatctagggattggtcatgcagccgcagaaaatcaccaccatgccgcgatgttggatgtagatctgcatccggcctcagcttggacactctatgcggtagcaacaacaataataacgccaatgatgcgacatacgatcgaaaatacgacggcgaacatttcattaactgctatagccaatcacgccgctattttaatgggcctggacaaaggttggcctatttcaaaaatggatataggtgtaccattactcgccttaggatgttactcacaggtaaacccattaactctgacagcagcggttttaatgttggtagcacattacgctataattggccccggattacaggcgaaagcaaccagggaagcgcaaaaacgtacggctgccggaataatgaaaaatcctacggttgatggaattgtggcaatagacttggatccagttgtatatgacgctaagattgaaaagcaactagggcaaattatgctattaattctatgtacctcacaaatactgcttatgcggactacctgggcattatgcgaaagcattacattagccacgggtcctttaaccacactttgggaaggtagtcctggaaaattttggaatacgacgattgctgtttccatggctaatatcttccgaggatcgtacttagctggggctggccttgcattttcgttaatgaagagtttgggaggaggtaggagaggaactggggcacagggcgaaactctaggcgaaaaatggaaaagacaactcaatcaattaagcaaatcagaatttaacatatataaaaggagcgggataattgaagtagatagaagcgaagcaaaggaagggttaaaacgcggcgaaactactaaacacgcagtatccagggggacggcgaagctcaggtggttcgtcgagcgaaatcttgtcaaaccagagggaaaggttatagacctcggatgtggacgaggtggatggtcctactattgcgcaggcctgaagaaagtgaccgaagttaaagggtacacaaaaggaggcccgggtcacgaagaaccaatacctatggcaacttacgggtggaatttagttaaacttcattcagggaaggacgtattctttactccacccgagaaatgtgatactcttctatgcgacattggggaatcatcaccgaatccgactatagaagaaggacggacactaagggtactgaaaatggtagaaccatggctaaggggaaaccaattctgcataaaaatcttgaatccctacatgcccagtgtagtcgaaacgctagagcagatgcaaagaaaacatggaggtatgcttgtcagaaacccattatccagaaatagtacccatgagatgtactgggttagttgtggaacaggaaatatagtcagtgccgtcaatatgacaagccggatgttactcaatagatttacgatggcccatcgaaaaccaacgtatgaaagagatgttgacttaggagcaggcacaagacacgtagctgtggagccagaggtagcaaacttagacattataggacaacgaatagaaaacattaaaaacgaacataaatccacatggcattatgacgaagacaacccatataagacttgggcttaccacggatcttatgaagtaaaaccaagcggttccgcaagcagtatggtaaatggtgtagtaagacttctaacgaaaccatgggatgttataccgatggtcacgcaaatcgcaatgaccgataccacacccttcggccaacagcgagtatttaaggagaaagtagatactagaacgcccaaagcaaaacgtggaactgcgcaaataatggaggttacagccagatggctatgggggtttttatccaggaacaagaaaccaagaatctgcacgcgagaagaatttacacgaaaagttaggtcaaacgcagctattggtgcagtattcgtcgacgaaaaccagtggaatagtgctaaagaagctgttgaagatgaacgtttctgggatctagttcatcgagaacgcgaactgcacaagcagggaaaatgcgccacttgtgtctacaacatgatgggacgtagggagaagaaactgggtgaatttggaaaagccaaaggctccagagcaatttggtacatgtggttaggtgccagatttctggaatttgaagccctaggatttatgaatgaggatcactggttcagtagggaaaacagtcttagcggagttgaaggggagggacatcataaactcggttatatcttgcgggatataagtaaaatacctggaggaaatatgtatgcagatgacacggcaggctgggatacaaggataacagaggacgatctacagaacgaagcaaaaattactgacatcatggagccagaacatgcattattagcaacgagtatctttaaattgacataccagaataaggtggtacgtgtacagagacccgctaaaaatggtactgtgatggatgtaataagtagacgagaccaaagaggatcaggacaagtgggtacatacggcttgaatactttcactaacatggaagctcaattaataagacaaatggaatctgaagggatatttagtccaagcgaattagaaactccaaacctagcggaaagagttttcgattggctcgaaaaacatggcatagaacgattaaagaggatggcaatatcaggagatgattgtgtagtaaagcccatagatgatagattcgcaacagcgctaaccgctcttaacgatatgggtaaggtaaggaaagatataccgcaatgggaaccacctaaagggtggaacgactggcaacaagtaccattttgcagtcatcactttcaccagttgataatgaaagatggcagagaaatagttgtaccctgcagaaatcaagacgagttagttgggcgagctcgggtctcacagggtgcaggttggtcactacgtgaaactgcgtgcttgggaaaatcttacgcacagatgtggcagctaatgtacttccacagaagagacttaagactcgctgcaaacgctatttgttcggctgtcccagttgattgggttcccacaagtaggacgacgtggagtattcacgcgcaccatcaatggatgacgaccgaagatatgttatcagtctggaacagggtatggatagaagaaaacccatggatggaagataaaactcacgtaagctcatgggaagatgtcccttatctagggaagcgagaggaccagtggtgcggcagcttgatcggattaacagcaagagcaacgtgggcaaccaatattcaagttgccataaaccaagtaagaaggttaataggtaacgagaactatttagactatatgacaagtatgaaaagattcaagaacgaatccgaccccgagggagctttgtggtga

SEQ ID NO: 22150 - RNA, 9879 nt, synthetic construct
  misc_feature 1..9879: note = derived and/or modified CDS sequence (opt6) from DENV-1__HQ332182__SS-prME
  source 1..9879: mol_type = other RNA
agcgtgacaatgttactaatgcttctgccgacagcgctagcatttcatctaacaacacgaggcggggaaccgcatatgatagttagcaaacaagaacgagggaaatcattactcttcaaaacaagcgcaggggttaatatgtgtactttaatagcaatggacctaggggaactatgcgaagatacaatgacatacaaatgtccacgaataacggaagcagaacctgatgacgttgattgttggtgtaatgctacagatacatgggtaacatatggtacatgcagccaaactggagaacatagaagagataaacgttctgtcgctttagcaccccatgtgggtttgggtcttgaaacgcgaaccgaaacgtggatgagtagcgaaggagcatggaaacagatacagagggtagagacatgggcactccgccatcctggatttacagtaatagctttgtttcttgcacatgcaattggcacctcgattacgcaaaaaggaattatattcatactattaatgctagtaacaccatctatggcgatgcgttgtgtcggaattggaaatagagactttgtagaaggacttagtggggcaacctgggtcgatgtcgtattggaacatggtagttgtgtcacgactatggccaaaaataaaccaacattagatatagaattgttaaaaacggaggttacaaatccagcagttcttaggaaactatgcattgaagctaaaatttctaatacaactacagacagccggtgccccactcaaggagaggcgaccttagttgaagaacaagatgcaaacttcgtatgcagaaggacatttgtagatagaggttggggtaatggttgtggtttatttggaaaaggctcattgcttacttgcgctaaatttaaatgtgtcacaaaactggagggtaaaatagtccaatacgaaaacttaaaatattcggtaatagtaaccgttcacacgggagatcagcaccaggtcggtaacgaaacgacagaacacggtacaattgctactataacacctcaagcccccacgagcgaaatacaactaaccgactacggcgctttaaccttagattgctctccccgaacgggtctcgatttcaatgagatggtactattaacaatgaaagaaaaatcgtggttagtccataagcagtggttccttgatttacccttgccatggacaagcggagcgagtacaagccaagagacctggaatagacaagacttattagttacgttcaaaacagcacatgcaaagaaacaagaggtagtggtattaggatcacaggagggtgcgatgcacaccgcattgacaggtgctacagaaattcaaacctctgggacaacgactatatttgctggccacctaaaatgcagactgaaaatggataaattgacattaaagggcacaagctacgtaatgtgtacaggaagtttcaagctagaaaaagaagtagctgaaactcaacatggtacagtattggtccaggttaagtacgaaggcaccgacgccccttgtaaaataccattctcaacacaagatgagaaaggagtgacgcaaaatggtaggctaataaccgccaacccaattgtaactgacaaagaaaaaccggtcaatattgagactgaaccacctttcggagaatcctacatagtagtaggggcgggtgagaaagcattaaaactgtcctggttcaaaaagggttcttcaataggaaaaatgttcgaagcaaccgcgagaggagctaggagaatggcgattctcggggacacagcctgggattttggaagtattgggggagtattcacaagcgttggaaagctagtacaccaagtgtttggaaccgcatatggggtgctgttttcaggcgtctcgtggacaatgaaaataggtataggtatactacttacctggctaggattaaacagccgcagtacatcattgtccatgacatgtatcgcggtgggaatggtgaccctatacttgggagtcatggtacaggctgattcagggtgtgtaataaactggaaagggcgagaactcaagtgcgggagtggaatttttgtaacaaacgaagtccacacatggacagaacaatataaatttcaagctgattcacctaaaaggttatcagcggcgatcggtaaggcttgggaggaaggtgtgtgcgggattcgaagtgctacccgactggaaaatataatgtggaagcaaataagtaatgagttaaaccatatcctactagaaaatgatatgaagttcacagtagtggttggcgacgccaacggcatattagcccaaggaaagaaaatgatcagacctcaacctatggagcacaaatactcgtggaaaagttgggggaaagccaaaataataggagccgacattcagaatactacttttataatagatggacctgacactccagaatgcccagatgatcagcgcgcgtggaatatctgggaagtggaagattatggattcggaatcttcactactaatatttggctgaaattgagagatagctatactcaaatgtgcgatcacagactgatgagtgcggctattaaagattctaaagctgttcacgccgatatggggtactggatagagtctgagaagaatgaaacctggaaattagccagagcatcattcattgaagtaaaaacatgtacctggccaaaatctcataccttatggtcgaacggcgtgctcgagagtgagatgataataccaaaaatctacggaggtcccatcagtcaacacaactataggcctggctattttacacaaacagctggaccatggcatcttgggaaattagaattagattttgatctttgcgagggtaccacagttgttgtagatgaacattgcgggaacaggggaccaagtctacgaacgacaacagtgacaggaaagattatccatgagtggtgttgcagatcatgtacgcttccaccactacgatttagaggggaggatggttgttggtatggtatggagatacgacctgtgaaagaaaaagaagaaaacctagttcgatcgatggtttccgctggatcaggcgaagttgattcattttctttaggtatactttgtgttagtataatgatagaagaggtcatgagaagtcgttggagtagaaaaatgttgatgaccggtacattagcggttttcttattactaattatgggtcaattaacttggaacgatctaattcgactatgtatcatggtgggcgcgaacgcatcagacaggatggggatgggtactacgtacctagccttaatggctacatttaaaatgcgaccaatgttcgccgttggattattgtttcgaagacttacatcccgagaagttcttcttctaactataggcctaagcctagtagcatccgtagagttacctaatagcctcgaagaactcggcgacggtttagcaatgggcataatgatgttaaagttactaacagaatttcaaccacaccaactatggaccacgcttttaagccttacatttattaagacaacattaagcctagactacgcatggaaaaccacagcaatggcgttatcaatagtatcattattccctctatgtctatctacaacatcccagaaaacaacctggttacctgttttattaggatcgttcggctgtaaaccgttaacaatgttccttatcacggagaataagatttggggacgtaaaagttggccgatcaacgaaggcataatggctataggtatagtaagcattctactttcaagccttctcaaaaacgatgtgcctttagcagggcctctgatagcgggtggtatgttgattgcatgctacgtcatctctggcagtagtgctgacttatccttggaaaaggcggccgaagttagttgggaacaagaagcagaacacagcggtacgtcccacaatatactggttgaggtacaagatgatggcacaatgagaatcaaagatgaagagaaggacgatacattaacaattctattaaaggctacattgctcgcagtgagtggagtctacccaatgtcaatccccgcaacactgttcgtgtggtatttctggcagaaaaagaaacagagatcgggagtattgtgggacaccccaagtcctcccgaagtagaaagggccgtactggatgatgggatttatagaatattacagcggggtttactaggtaggtctcaagtgggtgttggagtttttcaagacggcgtctttcatactatgtggcacgttactagaggggctgtcctcatgtatcaaggcaaaaggcttgaacctagctgggcgagtgttaagaaagacttgatcagttatggcggaggatggagatttcaaggatcatggaatactggagaagaagtccaggtaatagcagtagagccaggaaagaaccctaaaaacgtgcagacaactcctggaacttttaaaacaccagaaggggaagtaggagcgattgcgttagattttaagcctggaacatctggctcacccatcgtaaatcgtgaaggaaaaattgtaggtctctatggaaatggagttgtgacaacatcgggtacatatgtatctgctatagcgcaagcgaaggcttcacaagagggccctcttccggaaatcgaggatgaagtgtttaagaaaagaaatttaactataatggatttacaccctggtagtggaaaaacgaggagatacctgccggcaattgtacgagaagccatcaagaggaaattgagaactttaattctagcacccacaagagtagtagcatccgaaatggctgaagcacttaaaggaatgcctattagatatcaaacgactgctgtcaaatctgagcacaccggcagagagattgtagacttaatgtgccatgcaacttttacgatgagactcttgagccccgttagagttcccaactataacatgattatcatggatgaagcacattttaccgaccctgcatctattgccgcaagaggttatatcagtactcgtgtaggtatgggtgaggccgcagcaatatttatgacagcgacgccaccaggttcagtcgaagcctttccacaatcaaacgcagttatacaggatgaagaacgtgatatacctgaacgctcttggaactcgggatatgactggataactgatttcccggggaaaaccgtgtggtttgtgcctagcattaaatcggggaatgatatcgcaaattgcctccgaaagaatggaaaacgggtaattcaactaagtagaaagacatttgacacagaataccagaaaaccaaaaacaatgattgggattacgtagttactacagatataagtgagatgggtgcaaattttagggcagatagagtgatagacccccggagatgcctaaagcccgtaattctaaaagatggacctgagagagtcattctggccgggccgatgccagtaactgtggcttcggctgctcaaaggagaggccggataggccgaaaccaaaataaagaaggagatcagtacgtgtatatgggacaaccactgaacaacgacgaagatcatgcccattggactgaagctaaaatgctcttagataacattaatactccagaaggtataattccagcgctattcgaaccagaaagagagaaaagtgccgccattgacggagaatatcgacttagaggtgaagcaagaaaaacgtttgtagaactcatgagacgaggggatctacccgtttggctttcatacaaggtagcaagcgaaggctttcaatatagtgaccgacgttggtgttttgatggagagagaaacaatcaggtgttagaagagaacatggatgtggaaatatggactaaggaaggcgagagaaagaaactccgcccccgatggttagatgcgcgaacttatagtgatccgctggccctaagagagtttaaagaatttgcggcaggaagaagaagtgtatctggcgatctaatcttagaaataggaaaactgccgcagcacttaactttacgcgcgcaaaatgcgctcgacaaccttgtcatgctacataacagcgaacaagggggaaaggcttatagacacgctatggaagaactaccagacactatagagaccttgatgctcctggcgctcatcgcagttttaacaggaggagtcactctgttctttcttagcggaaaaggactaggcaagacttcaataggtttgctctgcgtcaccgcatcgtcggtattattatggatggcttcagtagaaccccattggattgccgcttcaataatactagagttctttctaatggtcttgttaataccagaaccggatagacaacgcacaccccaagacaatcaactcgcgtatgtcgtcatcggtttattatttatgatcctcacagtagcagcgaatgaaatgggcctactggaaacaacgaaaagggacttaggaataggacacgtagctgctgaaaaccaccaacacgcgacaatgctcgacgtagatctaagacccgcatcagcgtggacgctctatgcggtcgcgacgacagtgataacccctatgatgagacataccatagaaaatacgaccgcaaacatcagtctaactgctattgccaaccaagcagctatcttaatggggcttgataaaggatggcccattagtaagatggatatcggggttccactactagctttaggatgctatagccaagtgaatccgttaacacttacggcagcagtattgatgctagtcgctcactatgcgataataggaccgggattacaagccaaggcaaccagagaagctcaaaagagaactgcagctggcattatgaaaaatcccaccgtggatggcatcgtcgctatcgacctagatccggtagtatatgatgcaaaattcgaaaaacagcttggtcaaataatgttactaatcctttgcgcttcacaagtactcttaatgcggacaacctgggcactatgcgaatctattaccctcgcaacagggcccttaacaaccctatgggagggttcaccaggtaagttctggaataccacaatcgcagtatcaatggccaatatattcagaggctcgtatctcgccggtgcaggtttggccttttcacttatgaaaagtttaggcggaggacgaaggggtacaggagcccaaggcgaaaccttgggtgaaaaatggaaaagacaactaaatcaactaagcaaaagtgagttcaatacctataagcgttcaggaataatggaagtagacagatccgaagcaaaagaaggattaaagagaggcgaaactactaagcatgccgtctcaagaggtacggcaaaattaagatggtttgtcgaaagaaacctggtaaaacctgaaggaaaagtaatagatttaggatgtggtcgcggtggatggagctattactgcgcaggattaaagaaagtaaccgaagttaaaggttacaccaaaggaggtccgggccatgaagaaccgataccaatggcaacatatggttggaacctagtaaagctacacagcggaaaagatgtattctttatgcctccagaaaaatgtgacacactactctgtgatattggtgaatcttcgcccaacccgacaatagaagagggtagaaccctacgagttcttaaaatggttgaaccatggctacgcggtaaccagttctgcattaagatcctgaacccatatatgccatctgtagtcgagacattagaacaaatgcagaggaaacatggaggtatgttagttcgcaacccgctaagcagaaactctacacatgagatgtactgggttagctgcggaactggcaatatagtaagtgctgttaatatgacttctcggatgttacttaatcgttttacaatggcccatcgaaaaccgacatatgaacgagacgtagacctaggagcaggaacaagacacgtggcagtagaaccggaagttgcaaacttagacattataggtcaaaggattgagaacatcaaaaatgaacacaaatcaacctggcattatgacgaggataatccttacaaaacttgggcataccatggtagctacgaagtaaaaccctcgggcagtgcatcgtcgatggtgaatggagtagtacgactgctgaccaaaccctgggatgtgataccgatggtaactcaaatcgccatgaccgatactacgccattcggacaacaacgagtgttcaaagagaaagtagatacacgaactccaagagctaaacgtggtacgactcaaatcatggaagtaacagctaaatggttatggggttttctaagtcgcaacaagaaaccgcggatatgtacgagggaggaatttacgagaaaagtgaggtctaatgccgctgttggagctgtatttgtcgacgaaaaccagtggaacagtgctaaagaggcggtagaggacgaacgattttgggatttagttcatagagaaagagaacttcataaacagggaaaatgtgccacctgtgtgtataatatgatgggcaagagggaaaagaaattaggcgagtttggtaaggctaaagggtcacgtgcaatttggtatatgtggctcggagcaagatttctagagttcgaggcactcggttttatgaatgaagatcattggtttagtagagaaaacagcctttcaggagtcgaaggagaaggactccacaaattaggctatatcttacgggatataagtaagataccaggagggaatatgtacgccgacgacacagcagggtgggatacacgaatcacggaagacgatttgcaaaacgaggccaagataacagatataatggaaccagagcacgccctactggcaacatcaatatttaaattaacatatcaaaataaagtggtacgcgtacaaagacctgccaaaaatggtacagtaatggacgtcattagtcgacgtgatcaacgaggatctggtcaggtgggaacatatggcttaaatactttcacaaatatggaagttcaacttatcaggcaaatggaatcagaagggatatttttaccgtcggagttagaaacccccaatttggctgaaagagtattagattggctggagaaacatggagcagaaaggctgaaacgaatggcaatatctggagatgactgtgtagtaaagcccatagatgacagattcgcaaccgccctcactgctttaaacgatatggggaaggtcaggaaggacatccctcaatgggagccttctaaagggtggaatgactggcaacaagttccattctgctcacaccattttcatcagctgataatgaaggacggacgtgagatagtcgtaccctgtcgtaaccaagatgaacttgttggacgtgctagagttagtcaaggagctggatggagccttagagaaaccgcatgcctaggtaagtcctatgctcaaatgtggcagctgatgtacttccataggagggaccttcgtctggctgctaacgcaatatgttcagctgtaccagtagattgggtacctacaagtcgcacgacctggtcgattcacgcccaccatcaatggatgactaccgaagatatgttatcagtctggaatcgagtttggatcgaagaaaacccatggatggaagataaaacacatgtaagtagttgggaagaagtgccatatttaggaaagagagaagatcaatggtgcgggagtttaatcggcttaacagctagggcaacctgggcgaccaatatacaagtcgcaataaatcaagtgaggcgattaatcggaaacgagaattatctagactacatgacttcaatgaaacgctttaaaaatgaatcagatccagaaggagccttatggtag

SEQ ID NO: 22151 - RNA, 9879 nt, synthetic construct
  misc_feature 1..9879: note = derived and/or modified CDS sequence (opt6) from DENV-1__HQ332181__SS-prME
  source 1..9879: mol_type = other RNA
agtgtaactatgttactaatgttattgcctacggctctagcttttcatctaactacacgaggaggggaaccacacatgatagtgagtaaacaagaacgcggcaaatctttgttattcaaaacctcagcaggagttaatatgtgcacactcatcgcaatggacctaggagaactttgtgaagatacaatgacttacaaatgtcctagaatcaccgaagcagaaccagatgatgtagattgttggtgcaatgcgacagacacatgggtcacgtacggaacctgtagccaaaccggagaacaccggagagagaaaaggtccgtagcgctcgccccacatgttggactaggtctcgaaacacgcaccgaaacatggatgagttctgaaggggcgtggaagcaaatacaacgggtagaaacatgggcgctaagacatccaggtttcacagtaatcgcattctttctggctcacgcaataggtacaagtattactcaaaaggggattatctttattttgttaatgttggtaactccatcaatggcgatgcgttgtgttggaataggaaatagagattttgtagaaggtttgagcggggctacgtgggtagacgtcgttttagaacatggatcatgtgtaacaacaatggccaaaaataaaccaacattagacatagaattgctgaaaacggaagtaacaaatcctgccgtcttgagaaaactgtgcattgaagctaaaatctcaaacacaacgacagattcacgttgtccaacacaaggggaggcaacgctagtagaagaacaagacgcgaatttcgtatgtagaagaacgttcgtagacaggggatggggaaatggatgtggactatttggaaaaggatccctcttaacttgcgcaaaatttaaatgcgttacaaaactagagggaaaaatcgtacaatatgaaaatttaaagtacagtgtcatagttacagtgcatacgggtgatcaacatcaagtgggcaacgaaacaactgaacatggaacaatcgccacaattaccccacaagcaccaacaagtgaaatacaattaactgactacggagcactaactcttgattgttcaccccgaacaggattagactttaatgagatggttctgctcactatgaaagagaagtcttggcttgtgcacaagcaatggtttttagatttgccattgccatggacaagcggagcttcaacctcacaagaaacatggaatcgtcaagatctgctggtaacattcaagacagctcacgctaaaaagcaagaagtagtcgtattgggctctcaagaaggagcgatgcatacagcactcaccggagcaactgaaatccaaacctcaggtacaacgacaatattcgctggccatttaaaatgtaggctaaagatggataaactaaccttgaaaggtatgtcttacgtcatgtgtacaggcagctttaaactggaaaaagaagtggcagagacacaacacggaacggtgttagtacaggtcaaatacgaaggaactgatgcgccatgcaaaatccctttcagcactcaagacgaaaaaggagtaacgcaaaacggtagattaataacagctaatccaatcgtaacagataaagaaaaaccagtaaacattgaaacagaaccgcctttcggtgagtcatatatagtggttggagccggtgaaaaagcactaaagttaagttggtttaagaggggtagctcaataggtaaaatgttcgaagctacagcacgtggcgcaagaaggatggcgatcctgggagataccgcttgggactttggatcgattgggggagtatttacaagcgtaggcaaattagttcatcaagtctttggtacggcttacggggtgctattttcaggtgtaagctggacaatgaaaattggaattggaatactcttgacttggttagggcttaacagtagaagtacatctttaagtatgacttgtattgcagttggtatggtcactttatatttgggggtaatggtgcaagcggattcaggatgcgttataaattggaaaggaagggaattaaaatgtggatcaggcattttcgtcacaaatgaagtacatacttggacggaacagtacaagttccaggcagactcaccaaagcgattatccgccgcgatcgggaaggcttgggaagaaggagtatgtggaataaggtctgcgacaagactagaaaacataatgtggaagcaaatctcaaatgaattgaatcacattttgctggagaatgatatgaaattcaccgttgtcgttggtgatgcgaatggaatcctagtacaaggcaagaaaatgatcagaccacaaccgatggagcataagtattcttggaaatcctggggaaaggccaaaattataggagcagatatacagaacactacattcataatcgacggaccggatactcctgaatgtccggatggacaacgcgcatggaatatttgggaagtcgaggactacggttttggtgtttttactactaatatatggttaaagttaagagactcatatacacaaatgtgcgaccacagactaatgtccgcagctattaaagattcaaaagccgtacatgcggatatgggatattggatagaaagtgagaaaaatgaaacctggaaactggcgcgcgcgtcgttcatagaagtaaagacatgtacgtggccaaagtcacacactctctggagtaatggcgtacttgagtcggaaatgatcatccctaaaatatatggaggtccaatcagtcaacacaattatcgaccgggatacttcacgcagacagcgggtccatggcatttgggtaaactcgagttagattttgacttatgcgagggtacgacggtggtagtggatgaacactgtggtaacagagggccatctttaaggactaccacagtaacagggaaaattatacatgagtggtgctgccgatcatgtactttaccgccgcttagattccgaggcgaagatggctgttggtatggaatggaaatccgcccagtaaaagaaaaagaggagaatctagtaagatccatggtgagtgccgggactggtgaagttgattcattctcattaggaatactgtgcgtaagtataatgatagaagaagttatgagatcgaggtggagcaggaaaatgttgatgaccgggaccctcgcagtatttttacttctaataatgggacagctaacttggaacgatttaatacggctatgcataatggtaggagcaaatgcgagcgatagaatgggcatggggacaacataccttgcacttatggctacatttaagatgagacccatgttcgcagtaggtctcttatttagacggctaacaagcagagaagtcctcttactaacaatcggactaagtctagtagcgtcagtcgaattaccaaacagcctagaggaactcggagacggtctagcgatgggaataatgatgctcaaattacttacggaatttcagccacatcaactgtggaccactttgcttagtttaacattcgtaaaaacagctttaagtttagattacgcatggaaaacaacagccatggttctatcgatagtatctttatttccattatgcttaagtaccacttcacagaaaacaacatggctacctgtcctattgggctcttttggttgtaaacctttgacaatgtttctaataactgagaataagatttggggccgaaaatcctggccactaaacgagggtataatggcaattggaatagtgagtattttgctcagttcgttattaaagaacgatgttcctctagcaggaccgctaatagctggagggatgctcatcgcttgttacgttatatctggatcttcggcggatctaagtctagagaaggcagcagaggttagctgggaacaagaagcagaacatagcggagcctcacacaatattctagtcgaagtgcaagacgatggcacaatgaaaatcaaggatgaggagagagatgatacactgaccatccttttaaaagccacattgttagcagtttccggggtctatcctatgtctatcccagcgacactgtttgtatggtatttttggcagaagaagaaacaaagaagcggcgtgctatgggacacaccttcaccgccagaagttgaacgagccgtactcgacaacggaatatatagaatattgcagaggggactgttagggcgttcacaagtaggtgtcggagtatttcaggatggggtatttcataccatgtggcatgtcacacgaggagctgtattaatgtaccagggaaaacgactggaaccaagctgggcatcagtcaagaaagatttgatatcctatggtggagggtggcggtttcagggcagttggaacaccggcgaagaagtacaagtaatagctgtagaaccgggcaaaaaccccaaaaatgttcaaacaacacctgggactttcaaaaccccagaaggcgaagtcggtgcgatagcgttagactttaaacctggcacctctggctcccccatcgttaatagagaaggcaaaattgttggtttatacggcaatggagtagttaccacatcagggacttacgtatccgctatagcacaggcaaaagcatcacaagaaggccccctacctgagatagaggacgaggtttttaagaaacgaaacttaacaatcatggatcttcacccgggcagtggaaagactaggcgatatcttcctgcaatagttagagaagcaataaagcggaaattacgaacattgatattagcaccaacaagagtagtggcaagcgagatggcagaggcgttaaaaggaatgccaataagatatcaaacaacagcagttaaatcagaacacacgggtcgagagatcgttgatttaatgtgtcatgcaacttttacaatgcgattgttatctcccgtccgagtaccgaattataatatgataataatggacgaagcacattttacagatccagcgagtatcgccgcaagaggatatatatcaacgagagtaggtatgggtgaagcagcagcgatattcatgaccgcaacaccgccaggaagtgtagaagcatttccccaaagtaacgcagtaatacaagacgaagaacgagatataccagaaaggtcttggaactcaggatatgattggataacagactttcctggtaaaacagtatggtttgtgccttccattaaaagtgggaacgacatcgcgaactgtctaaggaagaatggtaagagggttatccaactttcaagaaaaacatttgacaccgaatatcagaaaactaaaaacaatgactgggactacgttgtcacaacagacattagtgaaatgggcgcaaattttcgggccgaccgagtaattgacccacgcagatgcctcaaaccagtgatattgaaagacggacctgaacgtgttatattagcaggccccatgccggtaacagtagcatcagcggctcaaagaaggggtcgaataggaagaaatcagaataaagagggagaccaatacgtttacatgggccaaccactaaataatgatgaggaccacgcacattggactgaagccaaaatgttattagacaatataaatactccagagggtattatccccgcacttttcgagccggaacgagagaaaagcgcagcaatagacggcgaatacagacttcgtggggaagcaagaaaaacatttgtcgaactaatgagaagaggagatttgccagtgtggctaagttataaagtcgcatccgaaggatttcaatactctgatagaagatggtgctttgatggcgaaagaaataaccaagttctcgaggagaatatggacgtagaaatatggacgaaggagggtgaacgaaagaaattaaggccaaggtggctcgatgcacgaacatactctgatccgctagcgttacgagagtttaaagagtttgccgctggcaggcgttcggtatcaggagatctcatcttagaaatcggaaaacttcctcaacatttaacgcttcgagcacagaatgcattagacaacttagtcatgctgcataatagtgaacaaggcggtaaagcatacaggcatgcaatggaagagttacctgacactatagagacattaatgttattagcccttatagcggtgctaacaggaggagtaactttattctttctgtcaggcaaaggattaggaaaaacctccataggattgttgtgtgtgacagcctcgtcggcattactgtggatggctagtgttgaaccgcattggatagcggcatccataattcttgagttctttctgatggttcttttgattccggaacctgatagacaacgaactccccaggacaaccaactagcctacgtcgtgataggattactattcatgattctaacagtcgctgctaatgaaatgggccttttagaaacaactaagaaagatctgggtattggatatgttgcagcagagaaccatcaacacgcaaccatgttagatgtagatctacatccagcctctgcttggaccttatatgcagtagctacaactgttataacaccaatgatgagacatacaattgagaataccacagcgaacatttctcttacagcaatagccaaccaagcggccatccttatgggactagacaaaggatggcctatatcgaaaatggacattggagtacccctacttgcgctcggctgctactcacaggttaatcctttaacattgaccgctgcagttctaatgctagtcgcccactatgcaataataggaccagggcttcaggccaaagcgacgagagaagcgcaaaagcgaaccgccgcgggtataatgaaaaatccgaccgtcgatggcatagtagcaatagatctagatccagtagtatatgacgcaaaatttgaaaagcaattagggcaaataatgttgttgattttgtgtacatctcagattttgttaatgcgcacgacatgggctctttgtgagagtataacattagctacagggccgttaactacactatgggaggggtctccaggcaagttttggaacacgaccattgccgtatcgatggctaatatattccgcggatcatatctagctggggcagggttggccttttccttaatgaaatccttagggggaggacgtcgtggcacaggagctcaaggcgagacactaggtgaaaagtggaagagacaactaaaccaattgagcaaatctgagttcaatacgtataaacgtagcgggataatggaagtggaccggagcgaggcaaaagaggggcttaaaagaggtgaaactacaaagcacgcggtatctagaggaacagcgaagttgcgatggttcgtggaaagaaacctagtgaaaccagaagggaaagtgatagatttaggatgcggcaggggaggatggtcctactactgtgctgggttaaagaaagtaaccgaagtcaagggttatactaaaggtggtccaggtcatgaagaaccaataccaatggcaacatacggctggaatttagttaagctccatagcgggaaagacgtgttctttatgcctccagagaaatgcgatacactgttgtgtgatattggtgaatcttccccaaaccccacaattgaagagggaagaacgcttcgtgttttgaaaatggtagagccttggcttcgaggaaaccaattctgtataaaaatccttaacccatatatgccaagcgttgttgaaacactcgaacaaatgcaaagaaagcatggcgggatgctagttcgaaatccactcagtagaaatagtacacatgaaatgtactgggtgtcatgtggcacaggaaatatcgtctcggccgtgaatatgaccagccgaatgctattaaatagattcacgatggctcacagaaaaccaacatatgaaagagatgttgatttaggtgctggaacacgacacgttgcagtggaaccagaagttgctaatcttgatattattggacaaagaattgaaaacatcaaaaatgaacataaatcaacatggcattacgatgaagacaatccatataaaacatgggcgtaccacggttcatatgaagtaaaaccatctggatcagccagttccatggtgaatggtgtagttagactattaacaaaaccctgggacgtaataccaatggtaactcaaatagcaatgactgatacaacaccctttggacagcaaagagtattcaaagaaaaagtggacacaagaacgcccagggcgaagagaggtacaacacaaataatggaggtaacagcaaaatggttatggggttttctgtcaagaaataaaaagccacgaatatgcactcgtgaagagttcaccagaaaagtaaggtctaatgcagcaattggcgcagtgtttgttgacgagaatcaatggaacagtgccaaagaagctgtcgaagatgaaagattctgggatttggttcatcgagagagagaacttcataagcaaggtaaatgtgctacttgcgtatacaatatgatggggaaaagggagaaaaagctgggcgaatttggaaaagcaaaaggttctcgggcaatctggtacatgtggcttggtgcgcgcttcctagagttcgaggcattggggtttatgaacgaagatcactggttcagcagagagaacagccttagcggagttgaaggagagggtctacataaattgggatacattctacgggacatatcaaaaatacccggtggtaatatgtatgcagatgacacagcaggatgggacacgcggattactgaagatgatctccaaaacgaagccaaaattacagatattatggaacctgaacatgcattattggctacgagcatttttaaattgacctatcaaaataaggtagttagagtacaacgaccagctaaaaatggaacagtgatggatgtaataagcagaagggatcagcgaggatctggtcaagtagggacatacggtttaaatacttttacaaatatggaggtacaactaataagacaaatggagtctgaaggaatattcctaccgtcggaactggagacgcctaatttagctgaacgggcactggattggttagaaaaacacggagctgagcgactgaaaagaatggcaatttctggcgatgactgcgtagttaagccaatagacgatagattcgcaactgcgctaacagctttgaacgatatggggaaggtccgaaaagatataccgcagtgggaaccatcaaaaggatggaacgattggcaacaagtacctttctgttctcaccattttcatcaactgattatgaaagatgggcgggaaatcgtagttccatgtagaaatcaagacgaattagtgggacgggcaagagtcagccaaggagcgggatggtcactacgcgaaacggcttgcctaggcaaaagttacgcacaaatgtggcagctaatgtactttcatagaagggacttaagattggcggcgaacgcaatatgttcagccgtacctgtagattgggtcccaacaagtaggacaacctggtcaatccatgctcatcatcaatggatgacaaccgaagatatgctgagtgtatggaaccgagtttggatagaagaaaatccttggatggaagataaaacgcacgtcagtagttgggaggaagttccctatcttggcaaaagagaagatcaatggtgtggttccttaattggattgacagccagagctacatgggcaacaaatatccaagtagctataaatcaggtaaggcgtttaatagggaacgagaactacctggactacatgaccagtatgaagagatttaaaaacgagagtgattctgaaggggcgttgtggtaa

SEQ ID NO: 22152 - RNA, 9879 nt, synthetic construct
  misc_feature 1..9879: note = derived and/or modified CDS sequence (opt6) from DENV-1__HQ332180__SS-prME
  source 1..9879: mol_type = other RNA
agtgtaacaatgttacttatgttgctcccaacggcattggcatttcatctaacgacgagaggaggggaacctcacatgattataagcaaacaagaacgagggaaatcattactttttaaaacaagcgcgggtgtgaacatgtgtacattaattgcaatggatcttggagaactatgcgaagacacaatgacgtacaaatgtcctagaataacagaagccgaaccagatgatgtagattgttggtgtaatgctactgatacttgggttacctatggaacctgttcccaaacaggtgaacatcgcagagataaaagatctgtagctctggctccacacgtgggtttaggtttagaaacacgtacagaaacatggatgtcatcggaaggagcgtggaaacaaatacaaagggtagaaacgtgggcactacgacacccaggattcactgttatagcattgtttttagcacatgcaatcggaacatcaataacccaaaaaggaataatctttattctgttgatgttggttacgccgagtatggcgatgcgctgcgtagggataggcaaccgtgatttcgtcgaagggctaagcggagcaacatgggtagacgtcgtgctcgaacacggttcctgcgtaactactatggcgaaaaacaaaccaacactcgacattgaactacttaaaactgaagtcactaaccctgcggtacttcgtaaattgtgcattgaagccaaaataagtaataccaccaccgactcacgatgccccacacaaggtgaagcgaccctcgttgaagaacaagatgctaatttcgtctgccgaagaacctttgttgatcgaggttggggcaatgggtgcggcttgtttgggaaaggaagtctcctaacttgcgcaaaatttaaatgcgtcaccaaactcgaaggaaaaatagtccaatatgaaaatttgaaatactccgtgattgtcacagtacatactggtgatcaacaccaagtcggaaatgaaaccactgaacacgggactatagcaacgattactcctcaggctccaacaagcgaaatacaactaacggattacggtgccttaactctagattgttccccgcgtaccggcctagatttcaatgaaatggttctacttacaatgaaagaaaaatcctggcttgttcacaaacaatggtttttggacctcccattaccatggacttcaggcgctagcactagccaagagacgtggaatagacaagatttgttagtcacattcaaaactgcccatgccaagaaacaagaagtagtcgtattagggagccaagagggtgcaatgcataccgccttgacaggagccacggaaatacaaacatccggaacgacaactatttttgcaggtcacttgaaatgtagacttaaaatggataaactaacattaaaaggaatgagttacgttatgtgcactggatcgtttaaattagaaaaggaagttgcagaaactcaacatggaactgtacttgtacaagttaagtacgaaggcacggacgcaccatgtaaaatcccattttctacacaggatgaaaaaggggtcacacaaaacgggagacttataacagctaacccaatcgtaacggataaggaaaagcctgtaaatatagaaacagagcctccctttggtgaatcgtatatcgtcgtaggagccggagaaaaagcgctaaaactaagctggttcaagaaaggtagttcaataggaaaaatgtttgaagcaactgctcgaggtgcgaggagaatggcaatattaggagatacggcttgggattttggttcgatagggggagtatttacgagcgtcggaaaacttgttcaccaagtattcggaaccgcctacggtgtgctattttctggagttagttggacgatgaaaattggaataggaatcctactaacttggctaggtctaaattcaagatcaacgtcactttcaatgacgtgtatagccgttgggatggtaactctgtacctaggtgctatggtgcaagcggatagcggatgtgttattaactggaaaggacgggaactgaaatgcggctctggaatttttgtaacaaatgaagtacacacttggaccgaacaatataaattccaagcagactctcctaaaagactatcagctgccataggtaaggcatgggaggaaggggtgtgtggaattaggtcagcgactaggcttgaaaacataatgtggaaacagataagcaatgaactaaatcacatattactggaaaatgacatgaaattcacggtagtcgtaggagatgccaatgggattctggctcaaggtaagaaaatgatcaggccgcaacctatggagcataaatattcatggaagtcatggggcaaagccaaaatcatcggagctgatatacagaacacaacattcattatagatggcccggatactccagaatgtccagatggacagagagcctggaacatttgggaagtagaggattatggttttggaatctttactacgaacatatggttaaagttgcgcgactcgtacacccagatgtgcgatcatcgtctaatgagtgccgccataaaagacagcaaagctgtacatgccgacatgggatattggatcgaaagtgagaaaaacgaaacatggaaattagcacgggcatcatttattgaagttaaaacatgcacatggcccaaatcacacacgctctggagcaacggcgtacttgaatcagagatgataattccaaaaatatacggaggacccatctcgcagcataattatagacccggttatttcacacaaacagctggaccttggcatctaggaaaactagaattagattttgatttgtgtgaagggacaacggtagttgtagatgaacactgtggtaatcgtggtccctcactacgaaccactactgtaaccggtaagattatacacgaatggtgctgtagatcatgcacgctgccgcctctaagattccgtggagaagatggttgctggtacggaatggaaatccgtccagttaaggaaaaagaagaaaatctggtaagaagtatggtctcagctggatcaggagaggttgattcgtttagcttaggcattctttgcgtaagtattatgatagaagaagtaatgaggtccagatggtccagaaagatgctaatgacaggaacccttgcggtatttctactactaattatgggacagttaacttggaatgatttaatacggttgtgcataatggtgggagcaaatgcttcggaccggatgggaatgggaaccacacacttagcattaatggccacgtttaagatgcgtcctatgttcgctgtgggattattattcagacgtttaacctcgagggaagtgttactgttaacgattggacttagtctaatggcgtctatggagctacctaactccttggaagaattaggagacggcttagcgatgggcattatgatgttgaaactccttactgagttccaaccacatcaactttggaccacgcttttaagtttaacgttcgttaaaacaacactaagtttggactatgcgtggaaaacgactgcgatgatactatccatcgtctcactattcccattatgtttaagtacaacaagccagaaaactacatggttacccgtcctgctaggttcgtttgggtgcaaaccattaacaatgtttctgataacagaaaacaagatctgggggagaaagtcatggccacttaatgagggtataatggcaattggaatagtctctatactgttatcatccctactaaagaatgatgtacccttagctggaccacttatagcgggcggcatgttaatagcgtgttacgtaatttcaggaagctctgcagatctctcgctggaaaaagctgcggaagtgtcttgggagcaggaggctgaacatagtggagcgagtcataatattcttgtcgaagttcaagatgacggaacgatgaaaattaaagacgaagaaagggacgatacactcactattttactgaaagcaacgttactagctgtaagtggcgtctatccgatgagcatcccagctacactatttgtttggtatttctggcagaaaaagaaacagaggagcggcgtcttgtgggacacacctagtcctcccgaagtggagagagccgttttagacgatggtatatatcggatattacaacggggattactagggagatcacaagttggagtaggcgtctttcaagacggagtatttcacacaatgtggcacgtcactcgcggcgcggttctcatgtatcaaggaaaacgtctagaaccctcatgggcctctgtcaagaaagatttaattagctacggaggcgggtggcgtttccagggatcttggaatacaggagaagaagtacaagtgattgccgtggaaccaggcaaaaatccgaaaaatgtccaaacaacccctggtacttttaaaaccccagaaggtgaagtaggggccatagccttagattttaagcctggaacatccggcagccccattgtcaatagagaagggaaaatagttggtttatacggaaacggggtagttacaacaagtggtacttacgtaagtgctatagctcaggcaaaagcatcacaggaaggaccactaccggaaatagaagatgaagtatttaagaagcgaaatctaacgataatggatctccatcccgggtccggtaaaactagaagatatctgcctgcgatagtacgcgaagcaattaagcgtaaattacggaccctcattctggccccgacgcgagtagtcgcttctgaaatggcagaggctcttaaagggatgcccattcgttatcaaacgacagcagtaaagtcagagcacactggccgtgaaatagtcgatcttatgtgccatgcgaccttcacgatgaggttattatcgcctgtaagagttcccaactataatatgattataatggacgaggcccatttcaccgaccccgcctcaatagcagcaagaggatacatatcaactagagtaggtatgggtgaggctgcagcaatctttatgacagccactcctccggggtccgtcgaagcgtttcctcaatcaaacgcggttatacaagacgaggaaagagatataccggaaagaagctggaactcaggatacgattggataacagattttccagggaagacggtatggtttgtaccttctataaaaagtggaaatgacatagcaaattgtttaaggaaaaacggaaaaagagtaatccagttaagtagaaaaacgtttgatacagagtaccagaaaactaaaaataatgattgggattacgttgtgacaacagatatttcggaaatgggggctaacttcagagcggacagagtaattgacccaagacgatgtttgaagccagtcatattaaaagatggtccagaaagggtcatccttgcagggccaatgccagtcactgtcgcgtcagccgctcaacgtaggggacgaattggacgaaaccagaacaaggagggcgaccaatatgtatatatgggacaaccgcttaataacgatgaagaccatgcgcactggactgaggctaagatgctcttagataatatcaataccccggaaggtattataccggcactattcgaaccggaacgcgaaaaatcagccgcgatagatggcgaatataggttaagaggggaagctcgaaaaacatttgtcgaactgatgcgaagaggtgacctacctgtatggctgtcatacaaagtcgcatcagaaggttttcaatatagtgacagaagatggtgctttgatggtgaaagaaacaatcaagtcttagaagaaaacatggacgttgaaatatggacaaaagagggagaaaggaagaaactccgtccccgatggttagatgctcgaacctatagcgacccgcttgcgctaagagagttcaaggagttcgcggcaggaaggcgatctgtatctggtgacctgatcttggagataggaaaattaccacaacatttaaccctacgcgcacaaaatgccctagataacctagtgatgttacacaacagtgaacagggcggaaaggcttatcgtcacgctatggaggaattacctgacactatagaaacccttatgttgttagcactaattgctgtcttaaccggtggggttactttgtttttcttaagcggaaagggattaggaaaaacaagcatcgggctgttatgcgttaccgctagctcggcattactatggatggcaagcgtcgaaccccattggattgcagcaagcatcattcttgagttcttccttatggtcctactaatcccggaaccagatcggcaaaggacaccccaagataatcagctagcctatgtagttatagggttgttatttatgatactaacagtcgctgcaaacgaaatgggactccttgaaactaccaagaaagatctgggtataggctatgtcgcagcagaaaatcatcaacatgccactatgttggatgttgacctgagacctgcaagtgcatggacactatacgcagttgccacgacagtgataaccccaatgatgagacataccatcgagaacacaacagcaaacataagtctaacagcaatcgcaaatcaagcagcaatattaatgggcctcgacaaaggatggccgattagtaaaatggacattggggtaccattactggcattaggttgctattcacaagtcaacccattaacactcactgcagcggtattgatgttagttgcacattatgccataataggaccgggtcttcaggcaaaagccacgcgtgaagcacagaaaagaactgcggcaggaataatgaaaaatcccaccgtagacggtatagtggcaatagatcttgatccggttgtatacgacgcaaagttcgaaaaacaattaggccaaataatgttattaatcttatgtaccagccaaatattgctcatgcgaacgacatgggccctttgcgaatcaattaccttagcaacggggcctttaaccacactatgggaaggaagtccagggaaattttggaacactacaattgcagtaagtatggcaaatattttccgagggtcatatcttgctggagccgggttagcatttagtttaatgaaaagtttaggcggcggtagaagaggcacaggtgcacaaggagaaacattaggggaaaaatggaaacgacaacttaatcagctctcgaaaagtgaatttaacacttacaaaagatcagggattatggaagttgacagatcggaggctaaagaaggtttaaaaagaggcgagactacaaagcacgcggtgtctcgaggaacagcaaaactgaggtggtttgtcgaaaggaatttagttaaacccgaagggaaagtgatagaccttggatgtggacgaggcggctggagttattactgtgcaggtttgaagaaagtaactgaagttaaaggatataccaagggcgggcccggtcacgaagaacccattcctatggcaacgtatggctggaatctagttaaacttcatagtggtaaggacgtgttctttatgccacctgagaagtgtgacacactcctatgtgacataggtgaatcatctccaaatccaacgatagaagaaggaaggaccttacgcgtgctaaagatggtagaaccctggctaaaaggaaaccaattctgtataaaaatcctaaacccatacatgccgtctgttgtagagaccttagaacaaatgcagcgtaaacatggcggaatgctagttagaaaccccctatcaagaaatagtactcacgaaatgtactgggtaagttgtggtacgggcaacatagtgtcggcagtgaacatgactagcagaatgttactgaatagatttactatggcacacaggaaacctacatatgaacgcgatgttgatttgggagcggggacgcgccacgtggccgttgaacctgaagtggcaaaccttgatatcataggtcagagaatcgagaatatcaaaaatgaacacaagtctacatggcactatgacgaagataacccatataagacttgggcataccacggttcatatgaggtgaagccttcgggttcagcctcaagtatggtaaacggtgtagtccgtttattaacaaaaccctgggatgtaattccaatggtaacacagatagctatgactgatactacacctttcgggcaacaacgggtgttcaaagaaaaggtagatacgagaactccgagagctaagcgaggtacaacccaaatcatggaagtgactgccaaatggctgtggggttttctatcacgtaacaagaaaccgagaatttgcactagagaagagttcacacgaaaggtcagatcaaatgcagctataggagcagtattcgtagatgaaaatcaatggaatagtgcgaaggaagcggtagaggatgagagattttgggatctggtgcacagagaaagagagctacataaacaaggaaaatgtgcaacatgtgtatataacatgatgggcaaacgcgagaagaaattgggggaatttggaaaagcaaaaggatcccgggcaatatggtacatgtggctaggagccagattcctagagttcgaagccctaggatttatgaacgaggaccattggtttagtcgtgaaaattcgctctcaggggtcgaaggcgaaggattgcataaattaggctacatattaagagatataagcaagatacccgggggaaatatgtacgctgatgatactgcgggatgggacacaagaattacagaagatgacctacaaaatgaagctaagatcacggatataatggaaccagagcacgccctattagcgacctctatttttaagttaacatatcaaaacaaagtagtacgagtacaaagaccagccaaaaacggcaccgtaatggatgtaatatctcgtcgagatcaaagaggatctggacaagtgggtacatatggcttaaatacgtttacaaatatggaagttcaattgatacgtcaaatggagtcagaaggaatatttctaccgagtgaacttgaaacaccaaatctagcggaacgagtcttagattggcttgaaaaacacggggcagaaagattgaaaaggatggctatctccggagatgactgcgttgtgaagcctatagacgatagattcgctacagcactgactgctttaaatgacatgggcaaagtacgtaaagatataccacaatgggaaccatcaaaaggctggaatgattggcaacaggtcccattttgtagtcaccacttccatcaattgatcatgaaagatggtagagaaattgtagttccctgccgaaatcaagatgagttagtaggtcgagcaagagtatcacaaggagcaggatggtcgttaagagagacggcttgcctaggaaaatcttacgcccaaatgtggcaactaatgtacttccatcgtcgggacttacgccttgcagctaatgccatctgttcagcagtaccagtagattgggtcccaacttctaggactacttggtcaatacatgcacaccatcagtggatgactacagaagacatgctcagtgtatggaatagggtctggatagaagaaaatccctggatggaagataagacccatgtttcttcttgggaggaagtcccgtatttaggaaagcgagaagatcaatggtgtggttctttaataggattaacagcacgcgcaacttgggccactaatattcaggtagcgataaaccaagtgagaagattaataggtaacgaaaattatttagattacatgacttcaatgaagcgtttcaaaaacgaatcggacccagaaggggccttgtggtaa

SEQ ID NO: 22153 - RNA, 9879 nt, synthetic construct
  misc_feature 1..9879: note = derived and/or modified CDS sequence (opt6) from DENV-1__HQ332179__SS-prME
  source 1..9879: mol_type = other RNA
tctgtaacaatgttattaatgttgcttcccactgcgttagcttttcatttaaccacgcgtggaggcgaaccacatatgattgtatcaaaacaagaacgcggcaaatcacttctgtttaaaacaagtgcaggagtgaatatgtgtactttaattgctatggatttgggcgaactatgcgaagatacgatgacatataaatgtccgcgtattaccgaagcagaaccggatgacgtagattgttggtgcaatgcaacagatacgtgggtaacttatggaacttgctcgcaaactggagagcatcgtagagataaaagaagcgttgctttggcgccgcacgtgggattagggctggagactcgaactgaaacttggatgagttctgaaggggcgtggaaacaaattcaaagagtagagacctgggcattacggcacccaggattcacagtcatcgctcttttcttggcgcacgccataggtaccagtattacacaaaaaggcataatctttatacttttaatgttagtaacgccatcgatggccatgagatgcgtcgggatagggaatagagacttcgttgagggcttaagcggcgcgacatgggtagacgtcgtattggaacatggctcatgtgtcacaacaatggccaaaaataaaccaacattagatatagaactattaaaaaccgaggtaacgaacccggcagtgttgaggaaactatgtatagaagctaaaatctcgaacaccactacagattcacgatgccctactcagggcgaggctacactggtagaagaacaagatgccaactttgtctgcagaagaacattcgtggaccgaggatggggcaatggatgtggactttttggaaaaggaagcctattgacctgcgcaaaattcaaatgcgtcacgaaattagaaggcaaaatagtgcaatatgaaaacttaaaatactccgtgattgtaacggtacacaccggtgaccagcaccaagtaggcaatgaaacaactgaacacggtactatcgccactataacaccgcaagctcccacttcagaaatacaattaacagattacggcgcactaacattagattgttccccgcgcaccgggttggatttcaatgaaatggttttattaactatgaaagaaaagtcatggctggtacataaacagtggttcttggacctcccattaccttggacgtcgggggcttcaacatcacaagaaacatggaataggcaagacttattagttacatttaagacagcacacgccaagaaacaagaggttgtggtgttgggaagccaagaaggggccatgcatacagcattgacaggagcaacagaaatccaaacctcaggtactacaacaatatttgcaggacatttgaagtgtcgtcttaaaatggacaaacttactctaaagggaatgagttatgttatgtgtactggttcgtttaaacttgaaaaagaagttgcagaaacccagcacggcaccgtcctagttcaagtaaagtacgaaggaactgatgcgccatgcaaaataccgttctcaactcaagacgagaagggagtaactcaaaatggcagattaataacagccaatcccatcgttacggacaaggaaaaacccgtaaacatcgaaactgagccgccctttggagaaagctatattgtagtgggtgctggagaaaaagcattaaaattgagttggtttaagaaaggatcctcaatagggaaaatgtttgaagctacagcccgtggagcaaggagaatggctatcttgggcgacacagcctgggactttggaagtataggtggagtatttacatcagttggaaaattggttcaccaagtttttgggacagcgtatggggtattatttagcggtgtatcatggaccatgaaaataggtattggtatattattgacatggcttggactcaatagtagaagtaccagcctgtccatgacctgtatagctgttggaatggtaacattatatctaggtgtaatggtgcaagcagattcagggtgtgtaataaattggaaaggacgagaattaaaatgcggatcagggatatttgttaccaatgaagtacatacctggacagaacaatataagtttcaagccgatagcccaaaacgactttcagcggcaataggaaaggcgtgggaagaaggagtctgtggtattagatccgctactaggttagagaatattatgtggaagcaaatatcaaatgaattgaaccatatattactagaaaatgatatgaaatttactgttgtagtgggggatgccaatgggattttagcgcaaggaaagaagatgatacgaccacaaccaatggaacacaaatattcttggaaaagctggggaaaagccaagattattggagcagatatacaaaatactactttcattattgatggtcccgacactcccgaatgccccgacggacaacgagcttggaatatatgggaagtagaggactacggtttcggtatttttacaacgaatatttggttaaaactgcgagattcttacactcaaatgtgcgaccatagattaatgtcagcagctataaaagattcgaaggcagtacatgccgatatgggttactggatagaatcagagaagaatgaaacttggaaactggctcgagctagtttcatcgaagtcaaaacatgtacatggcccaaaagtcacacactatggagtaacggcgtactggagtccgaaatgattataccaaaaatatatggtggacccatatcgcaacataattatcgacccggctattttacccaaacagcaggaccttggcacttagggaaacttgaattggattttgatctttgtgaaggaactacggtagtcgtcgacgaacattgcggaaatcgcggcccatcactcaggactacgactgtaactggaaagataatacacgaatggtgctgccgttcgtgcacgctcccacctttgagattcagaggagaggacggttgttggtatggaatggagataagaccagtaaaagaaaaagaggagaaccttgtaaggtcaatggtatctgcaggatctggggaagttgactcattctccctgggaattttgtgcgcaagtataatgatagaggaggttatgaggagcagatggagtcgcaagatgttaatgaccggcaccctagccgtctttttgcttttaataatgggacaattaacctggaacgatctgataagactatgcataatggtaggtgctaatgcatcggacagaatgggaatgggaactacgtacttagcgctcatggctacttttaaaatgcgaccaatgtttgctgtaggactattattccgtaggttaacatcaagagaagtactcttactaacgattggtctctcgctagtagcatccgtcgaactacctaacagtttagaagaacttggagatggactagccatgggaataatgatgctaaaacttttaacagaatttcagccacatcaactatggacaacactattaagcctaacgttcgtgaaaaccacgttaagtctagattacgcatggaaaactacagctatggttctttcaattgttagtctttttcctctttgcctaagtactacaagtcagaaaactacatggttgccagtattacttggatcgttcggatgtaaacctctaacaatgttcctaatcaccgaaaacaaaatctggggtcgtaaatcatggcctcttaatgaaggaataatggcgattggaatcgtgtcaattttacttagtagtctcttgaaaaatgatgtaccactagcaggtccactaatcgcaggaggaatgcttatagcctgttacgtgatatctggtagtagcgccgatctactacttgaaaaggcggcagaggtctcttgggaacaagaggcagaacactcaggcgcttcacataatatattagttgaagtacaggatgatggtacgatgaagataaaggacgaggaaagagatgacactcttacaatactcctcaaagctacattattggcggtttctggagtgtaccctatgtccattcccgcaacgctttttgtatggtatttttggcagaagaagaaacaacgcagtggcgtactatgggatacaccatcccctccagaggttgagcgcgcagttttagatgatggaatatatcgaatactccaacgtggtttactcgggagatcccaagtaggggtcggagtgttccaagacggggtcttccacactatgtggcatgttacgcgaggtgcagtcctaatgtatcagggaaaacgcttagaaccatcctgggccagcgtcaagaaagatctaatttcctatggcggtggttggcgctttcagggaagttggaacaccggtgaagaagtgcaagttatagcggtagaaccaggcaaaaaccccaaaaacgttcaaaccacccctggaaccttcaaaacaccagaaggggaagttggtgcgatagcactagactttaaacccggaacctccgggtcgcctatagtaaacagagaggggaaaattgttggcctatacggtaatggagtagttactacaagtggaacctacgtatcagcgatcgctcaggcaaaagcatcgcaagagggacccctcccggagattgaagacgaagtattcaaaaagaggaatctcacaataatggacctgcacccgggatctggaaagacaaggagataccttcctgcaatcgtgagagaagctataaaaagaaaacttcgtactttaatactagctccaacaagggttgtggcaagtgaaatggcagaagcactcaaaggtatgccaataaggtaccagacgactgctgtgaagtcggaacatacaggacgggaaatagtggatcttatgtgtcacgctacgtttacaatgagattactatcaccagtccgagtcccgaattacaacatgattataatggatgaggcccactttactgatcccgcaagcatagctgcaagggggtatatcagtacacgagttggcatgggtgaggcagctgcaatttttatgacggcaacaccaccaggatcagtcgaggcatttcctcaatcgaacgcagtcatccaggatgaagaaagggacatacctgaaagaagttggaacagtggctacgattggataacggattttccaggaaaaacggtgtggttcgtaccaagtataaaatcaggaaatgacattgcaaattgcctgcgtaagaatggtaaacgagtcatacaactaagtcggaaaacctttgatactgaataccagaaaaccaaaaataacgactgggattacgtggttaccacagatataagcgaaatgggcgcaaacttcagagcagaccgtgttatagaccccagaagatgtctgaagcctgtaattctaaaggacggtccagaaagagtaattctagccggcccaatgccggtgactgttgcaagcgcagcacaacgcagaggacgtatcgggaggaatcaaaataaagaaggagatcaatatgtatacatgggacaaccactaaacaacgatgaagaccacgctcactggacagaagcaaaaatgttgttagacaacattaatacgccagaagggattatacctgcgttgtttgagcccgaacgagaaaagtcagcggcgattgacggagaatatagattaagaggggaagcacgaaaaaccttcgtcgagctaatgagacgaggtgatttgcctgtctggttgtcttataaagtagctagcgaagggtttcaatactcagaccgaagatggtgtttcgacggagaacggaataatcaagttctagaagaaaatatggacgttgagatctggacaaaagaaggagaaaggaagaaactcaggccaaggtggctggatgcgcgcacgtacagtgacccgctggcattacgagaatttaaagaatttgcagcagggagaaggagtgttagtggtgacctaatattggagattggtaaattgcctcaacatttaactttaagggcacaaaatgcccttgataacctggtaatgctgcacaactcagaacaagggggcaaagcatataggcatgcgatggaggaactacctgatacaatagagactctgatgctactagctttgattgcggtacttacaggaggtgttacactattctttttaagtggtaaagggctaggcaaaacatcgataggtttattgtgcgtaaccgcatcatctgcgctactctggatggcgtgtgtcgagccccattggatagctgctagtattatcttggaatttttcctgatggttttgctaataccagaaccagacagacagcgaaccccgcaagacaatcaactagcctacgtagtcataggacttcttttcatgattttgactgtagctgcaaacgaaatgggacttttagagacaaccaagaaagacttaggaatcggttatgtagctgcagagaaccaccagcatgcaacgatgttggatgtcgatttacggcccgcatcagcatggactctttatgcggtagctaccacggtaatcacaccaatgatgcgtcacacaatcgaaaacactacagcaaacatttctttaacggcaattgcaaatcaagctgccatcctaatgggattggataaagggtggccaataagcaagatggatattggtgtccccttgttagcattagggtgctatagccaggtaaacccattgacgcttactgctgctgtcctaatgttagtagcgcattatgccataataggaccaggactacaagcgaaagctactcgagaagcacagaaaaggacagcagcaggtattatgaaaaatccaacagttgatggtatagtagcgatagacctcgatccagtagtatacgatgctaagttcgaaaaacaattaggtcaaattatgttattaattctatgcacgagtcaaattttattaatgagaaccacatgggcactctgcgaatctattacactagctactggacctctcactactttgtgggaaggaagtcccggtaaattctggaatactactatagctgtatctatggctaatatatttcgaggatcctacctagccggtgcaggtttggcattttcactaatgaaatcattaggagggggccggaggggtacaggtgcccagggagagactctcggtgaaaaatggaaaagacaacttaaccaactaagcaaaagcgaatttaacacttataaaagaagtggaattatggaagtggatcgatccgaagcaaaggaaggtttaaaaaggggcgaaacaaccaaacacgccgtatcaagaggaaccgctaaactaagatggtttgtagaaagaaatttagtaaaaccagaaggaaaagtaatcgatctcgggtgtggaagaggagggtggtcatattattgcgcgggactcaagaaggtcaccgaagttaagggatacactaaaggcggacccggacatgaagaacccattccaatggcaacctacggctggaacctagtcaaattacattcaggaaaggatgtattctttatgccaccagagaaatgtgataccttgctttgtgacattggagagtctagtcccaacccaacgatagaagagggaagaacccttagagttttgaaaatggtagaaccctggctgaaaggtaatcaattttgcatcaaaatattgaatccttatatgccgagcgtggtagaaactctggaacaaatgcaacgaaaacatggcggaatgttagtacgaaatccccttagtagaaacagtacccatgagatgtactgggtaagttgtggtactggcaacatagtgtcagccgtaaatatgaccagtaggatgttgttaaaccgtttcaccatggctcatagaaagcctacctatgaacgcgatgtagatttaggagcaggaacacgtcacgtcgcggtcgaaccagaggtggcaaatctcgacatcataggccaaagaatagaaaacatcaaaaatgagcacaaatcaacttggcactacgacgaagataacccatataagacatgggcatatcacgggtcatatgaagtaaaaccttcaggatcagcatcatccatggtcaacggagtagttcgtttgttaacaaaaccatgggatgtgattccaatggttacacagattgcaatgacggacacaactccctttggtcagcaaagagtatttaaagaaaaagtagacacacgcactcctagggccaaacgaggaacgacacaaataatggaggtaacggcaaaatggttgtggggtttcttgtccaggaacaagaaaccacgaatctgtacaagagaagaatttacccgaaaggtaagaagtaacgcagcaataggtgcagtatttgtggatgaaaatcagtggaatagtgccaaagaagcagttgaggatgaacgattttgggacttagttcatcgagaacgagagctgcacaagcaaggcaagtgcgctacttgtgtttataacatgatgggcaagagggagaagaaactaggagaatttgggaaagcaaaagggtcaagagcaatatggtatatgtggttaggtgcgagattcctagagttcgaggctttgggatttatgaatgaggaccattggttttctcgagaaaatagcctttcaggagtagaaggagaaggtttacacaaattagggtacatattacgcgatattagtaaaatccccggcgggaatatgtatgccgacgacactgcaggttgggacactagaataacagaggacgatttgcaaaacgaagcaaaaataacagacataatggaaccagagcacgcactattagcaacttcgatctttaaacttacctatcaaaacaaagttgtaagagtgcaacgtcctgcaaagaatggtacggttatggacgtaataagtcgaagggatcagaggggatccgggcaagtcggtacctacggattgaatacattcacgaatatggaagttcaattaatccgacaaatggagtcagagggtatcttcctgccatctgaactagaaacgccaaatctagcagagagagtcctcgactggctagaaaaacatggagcagaaagattaaaaaggatggcaatatccggggatgactgtgtagtgaagccaatagacgaccgatttgcaacagctctgaccgctttaaatgacatgggtaaggtccgaaaagatattccccaatgggaaccaagcaaaggatggaatgattggcagcaggttccattttgttcgcatcacttccaccaactgataatgaaagatggacgagaaattgtggtgccatgtagaaatcaggacgagttagtagggcgtgccagagtcagccaaggcgcaggatggagtttgcgagaaactgcatgtcttggaaaaagttatgctcaaatgtggcaactaatgtattttcacagacgggatctgcgcttagcagctaatgcaatatgcagtgccgtacccgttgactgggttccgacaagcaggacgacctggtccattcatgcgcatcatcaatggatgaccactgaagacatgttatcggtttggaatagagtgtggattgaagaaaacccgtggatggaagataagacgcacgtgagctcatgggaagaagtaccgtacttgggaaagagagaagatcaatggtgcggatcattgataggtctgactgcgagggcgacttgggccaccaacattcaggtagcaattaatcaagtaagacgcctaataggaaatgaaaactacttggactacatgacttcgatgaagcggttcaaaaatgaatcagatcccgaaggagcactttggtaa

SEQ ID NO: 22154 - RNA, 9879 nt, synthetic construct
  misc_feature 1..9879: note = derived and/or modified CDS sequence (opt6) from DENV-1__KR919820__SS-prME
  source 1..9879: mol_type = other RNA
actgtagtggcattgctaatgctattaccaatggtcttctcatttcacttaactacacgaggaggggaaccacatatgatcgttaacaaacaagaacgcggaaaaagcctcttattcaaaacatccggtgggatcaacatgtgtacactcatagcaatggatttgggagatttatgtgaagacactatgacgtataaatgccctcggataacagaagcagaacccgatgacgttgattgttggtgtaacgctaccgatacatgggttacatatggtatctgtagtcctacgggtgaacatcgtagagaaaaacgttcagtcgcgcttgcaccacacgtgggtctagggttagaaactagagctgaaacttggatgtcttccgaaggagcttggaaacaaatccaaagggtagaaacctgggcactgcgccatcctggtttcaccgtaatagctttatttttagctcacataataggaacaagcattacacaaaaaggcgttatctttatattattaatgctcgtaacaccgagtatggctatgcgatgtgtcggagtcggaaatcgcgactttgtagaagggcttagtggcgctacctgggttgacgtggttctagagcacggaagctgcgtaacgactatggccaaaaataaacctactctagatattgaattattaaaaacagaagtaagtaatcccgccgtgttgaggaaactttgcatagaggcgagaatatcaaatacaacgactgattcacgatgccccacacaaggcgaggcttctctgtcagaggagcaagatacaaacttcgtgtgccggagaactctagtggacaggggatggggcaacggctgtggtctctttgggaaaggatcgctgataacgtgtgcgaaattcgaatgtttgactaaaatggaaggtaaaatagttcagtacgaaaatttgaaatactcagtaatagtaaccgtacatactggggatcaacaccaagtaggtaatgaaactacgggacatggcactaccgcaactataacaccacaagcgccaacttcagaaatacaacttactgactatggggccctgacattagactgcagtccacgaaccggattagatttcaatgaaatggttctgttaactatgaaagagaaaagctggctagtccacaaacagtggttcttggacctgcccctcccgtgggccagcggagcaagtagccctcaggaaacgtggaatcgacaggacctgctcgtaacgtttaaaacagctcatgcaaagaaacaagaggtggtagtactggggagccaagaaggagcaatgcacacggccctcactggggcaacagaaattcaaacttcaggtacaacaacgatattcgcaggacatctcaaatgtagactcaaaatggacaaattgactctaaaaggaatgtcctatgtaatgtgcacagggtcctttaaactaaagaaagaagtagcagaaacccaacacggaactgttttagttcaagtagagtacgaaggaactgatgccccatgtaaaataccgtttactacacaagacgaaaaaggggtaattcaaaacggtagattaataacggcgaatcctattgtaacggataaagaaaaacccgtaaatatagaggctgaaccaccatttggagaatcttatatggttataggcgtaggggacaaagcactcaaactatcctggttcaaaaagggctcgtctcttggaaagatgttcgaagcaacagcacgcggggctcgacggatggcaattttaggcgataccgcttgggattttggctcagttggtggtgtttttacatcgatgggaaagctagtacatcaaatcttcggaacagcttacggggtgttattttctggggtatcatggaccatgaaaatcgggataggtcttttattaacttggttaggtctgaactctcggtcaaccagcttgtctatgacatgcattgcagtcggaatcatcacgttatatttaggtgtaatggtacaagccgatacaggttgcgtggttaattggaaagggagagaactcaaatgcggttcaggtatatttgttacaaatgaagtccacacttggacagaacaatacaaattccaagcggattcaccaaaacgcctatcagctgctataggcaaagcgtgggaagatggtgtttgcggaattagatcagcaactaggctagaaaatataatgtggaaacaaatagctaacgagctaaactatattcttttagaaaatgatatgaaattcacggttgtcgttggagatgttaaagggatactcacacaaggtaagaaaggtatacgacctcagccgatggagcataaatactcctggaaatcttggggtaaagcgaagataatcggagcagacgtacagaatacgacatttataatagacggccctgatacacccgaatgtccggactctcaacgagcgtggaacatttgggaagtagaagattatggatttgggatttttacaacaaacatatggcttaaactacgggatagctacacacaagtatgtgatcaccgattaatgtcagcagcaataaaggattcgagagccgtacacgcagatatgggatactggatagagtcggagaaaaatgagacgtggaagttgagcagggcttcatttattgaagtaaaaacttgtacgtggcctaagagtcacacattatggtcaaatggcgtccttgagtcagagatgataattccaaaaatttatggagggcccataagccaacataattatagaccaggatattttacccaaactgctggtccttggcaccttggaaaacttgagctagattttgatctgtgtgaagggacgaccgtcgtagttgacgagcagtgtggaaatagaggtccaagtttgagaacaacaacagtaacaggcaaaattatacacgaatggtgctgtcgaagctgtaccctcccgccattaagatttaaaggagaagatggatgttggtatggaatggaaatacgccctgtaaaagaaaaagaagaaaatctcgtaaagtctatggtatcagcaggatcaggaaaggtagataacttttccctcgggttattatgtattagcataatggtggaagaagtgatgcgatcaagatggagcggcaagatgttaatgaccggtacaatggccgtgttcttgctattagttatgggacaattaacctggaatgatttgatacgagtttgcattatggttggagcacatgctttggactcaatgggcatgggaacaacctatctagcactaatggcgacttttaaaattagaccaatgttagcggttggattactattcagaaaactgactagcagggaaattctgttgctgacaatcggtctatctttgataacccctgtagaactacctaactccattgaagaactcggtgatggattagcaatgggaataatgatgttaaaacttcttacagatttccaaccatatcaactatgggcaactttactaagcctgaccttcgtaaaaactacactaagccttcactacgcatggaagactgcagcgatggtactctcgatcgtcagcttgttgccgctctgtttatcaacaacatcacagaaaacaacatggctacccatattactcgggtccttaggctgcaagccattaacaatgttcctaatcagcgaaaataagatatggggcagaagatcttggccaataaatgaaggcataatggctgtcggaatagttagtatactaatgtcatcactgttgaaaaacgacgtcccactagcgggtcctttaatcgcagggggaatgttagtagcatgttatgtcatttcaggatcaagtgctgatcttacacttgagaaaaccgcggaagtaagttgggaagaagaggcggaacacagtggaacggcgcataatatattagtcgaagtgcaagatgacggtacgatgaaaataaaagacgaagaacgcgaggacacacttacaatattattaaaagcagcactattagcattatcaggagtatatcctatgtctattccggccactctgttcgtatggtacttttggcaaaagaaaaagcaaagatctggcgtgctgtgggatataccaagcccgcctgaagtagaaaaagccgtactagacgacggaatatacagaattttacaaagaggagtttttggcagatctcaggtcggagtgggggtatttcaagagggcgtattccacacaatgtggcatgtgacaagaggggcagtcttaacatatcagggaaaaagactcgaaccttcatgggcttctgtgaagaaagatttaattagctacggaggcggctggcgattgcaaggaagctggaacgtcggtgaagaagtccaagtaatagctgttgagccaggcaaaaatcctaaaaacgttcaaactgtcccaggcacctttaaaacacatgaaggcgaagtaggagcgatagccttggacttcaagcccggaacctcaggaagtccaatagtaaatagagatggcaaggtagtgggattatacggaaatggcgtagtcacaaccagcggtacatatgtatccgcaatagctcagtctaaagtttctcaagagggtccattgccggagatcgaggatgaagttttcaagaagaaaaatttgactataatggacttacacccaggtagcggaaaaacacgccgatacctaccagcaattgtccgagaatcaataaaacgaagattgcgaacattaatactggcgccgacgagagtggtagcctcagaaatggccgaggcactcaaaggtttgcctatccgataccagacgacagccgtgagaaatgaacacacggggcgcgaaatagtagacttaatgtgtcatgcaactttcaccatgagattattatcaccggttcgagtaccgaactacaatatgataatcatggatgaggcacactttaccgacccagcatctatagcagcccgaggatacattagcacgagagtcggaatgggggaagcagcggcaatttttatgacagctacaccccctggaagcgcggaggcattcccacaaagtaactctgtcatttatgatgaagaaaaagatatcccagagaggagctggaactcaggatacgattggattacagacttccaaggaaaaaccgtctggtttgtaccatcaataaagacgggtaatgatatagctaattgtttacgtaaaaacggcaaaagagtaatacagttgagtagaaaaacatttgacactgagtaccagaaaacgaaaaactccgattgggattttgtggtcacgacagatataagcgaaatgggcgcgaactttagagctgatagggttatagacccgaggcgctgcctaaaaccagttatacttagagatggaccagaacgagtcatcctagctggtccaatgccagtgacagtggcaagcgcagctcaaaggcgcggaagaatcggtagaaaccagtccaaagaaggcgaccaatatatctatatggggcaaccgctcaataatgacgaagatcatgcgcactggaccgaagcaaaaatgctattggataatatcaacacaccagaaggaatcataccagctctattcgagccggaacgcgagaaatcagccgcgatagacggcgagtaccgattacgcggggaggctagaaagacatttgtagagctaatgagacgaggcgaccttccagtatggctatcctacaaagttgcctcagaagggatacagtatgctgaccgaaagtggtgctttgatggagaacgaaataatcaaatattagaagaaaatatggatgtggaaatatggaccaaagaaggagaaaggaagaaacttcgaccgcgatggttagacgcaagaacatatagcgatcctctagcgctaagagagttcaaggagttcgctgctggtaggcgttcagtatcaggagacttaattctagaaataggcaaattgccacatcatttaacccaaagagcacaaaacgccctagataatttagtgatgttacacaattccgaacaaggaggacgagcatacagacatgcgatggaagaattgccggatacgatagaaacattaatgttgttagccatgattgcaacgctgactgggggagttgctcttttcttcctatccggtaagggactgggaaaaacttctattgggctattatgtgtaatggcctccagtaccttgttatggatggcgagcgttgagccccactggatagcagcgagtatagtgctagagttcttcttaatggtcctacttattccagaaccagacagacaacggaccccacaagataatcaactggcatatgtagtgattggtctcctagtactgatccttactgtagccgctaatgagatgggcttgttagaaacaacgaagaaagatttaggcataggaagcgctgcagctgaaatacaacaccataccacaatcctagatgttgatctacaccccgcaagtgcgtggacgctttacgcggtcgccactactgttattacaccgatgttaagacacacgatagaaaacactactgcaaacatgtcattaacagccatcgcaaaccaagctgccatattgatgggtttagacaaaggatggccaatatcaaaaatggacataggagtaccgttacttgcactaggctgctatagtcaagtaaatccaatgacgctaacagctgccgttttaatgttagtcgcccactacgcaataattggcccaggattgcaggctaaagcaacccgagacgcgcaaaaacgaactgctgcgggaataatgaagaaccctacggttgacggtatcgttgcgattgatcttgacccagttgtatacgatactaagttcgaaaagcagctggggcaaataatgctacttattctatgcacaagccagatactattaatgcgtacaacgtgggcattttgtgaaagcataacgctggccactggtccattaacaacattatgggaagggtctcctgggaagttttggaacactactattgccgtaagtatggctaatatttttcgagggagctatttagccggtgctgggctcgcgttcagtttaatgaagtctcttggaggaaatagaagagggacaggcgcccaaggtgagacactaggagaaaaatggaagcgtcagctcaaccagctgagtaaactagagttcaacacgtataaacgcagtggcataatggaagtcgatagaacagaggccaaagaaggattaaagagaggagagacgacaagacatgccgtaagtcgagggacagccaagctaaggtggttcgtcgaacgcaatttagtaaaacctgaaggaaaagtgatagacctagggtgcggaagaggtggatggtcttactattgtgcaggcctcaagaaagtcacggaggtaaaaggttatactaaaggcgggcccggacatgaagaaccgatacccatggcaacatacggctggaacctagtaaaattacacagtggaaaagacgtatttttcataccccctgaaaaatgtgacactttattatgtgatatcggagagtcttcgcctaacccaaccattgaagagggacgaacactaagagtattaaagatggtcgaaccttggttacgaggaaatcagttttgcataaaagtattgaatccttacatgccatctgtggtagagactctagaaagaatgcaacgtaaacatggaggcatgctcgtgagaaacccactctctagaaacagtactcacgagatgtattgggtatcctgtggaactgggaatatagtgagcgctgtcaatatgactagcagaatgttattaaataggttcacaatgactcatagaaaaccaacttatgagaaagatgtagacttaggagcaggcacaaggcatgtagctgtcgaaccagaggtcgcgaacctagacattattggtcaaagaatcgagaatattaaaaatgaacataaaagtacttggcattacgacgaagacaacccatataaaacatgggcatatcacgggagttacgaagtcaaaccaagtggttctgccagctcgatggttaatggtgtagttcgactgttaactaaaccatgggatgtgatacccatggtaacacaaatagcaatgacagatacaactccattcgggcagcaaagagtgtttaaagagaaggtggatactagaacaccaaaggctaaacgtggaactgcacaggttatggaaattacagcaggttggttatggaaatttctctctcgaaagaagaaacccaggatctgcaccagagaagagtttacaaggaaagtcaggtcaaatgcagcaataggtgccgtcttcgttgatgagaaccaatggaactcggccaaggaggctgtagatgatgagcgcttctgggacctagtgaatagagaaagagaactacacaaacagggcaaatgcgcaacttgcgtttataacatgatgggaaagagggagaagaaattgggtgagttcggtaaagcgaaggggagtagagcaatttggtatatgtggttaggagcacggttcttggaatttgaagcgctaggatttatgaacgaagatcattggttttccagagataacagtttgagcggagtagaaggtgagggtctacacaaattaggctacattttacgagacatcgcaagaataccaggaggcaatatgtacgcagatgacacggccggctgggatacacgaataaccgaagaagatttacagaatgaagctcgtgtcaccgaactgatggaaccagatcacgctcaattggcaacatcaatttttaggttaacataccaaaataaagtagtaagggtccaaagacctggcaaaaatggcaccgtaatggatgtaatctcacgtagagatcaacgaggaagtggccaagtagggacatacggcttaaatacatttacgaacatggaagcacaattaattcgacaaatggaatccgaaggggtattttcgccgtccgaattagaaacgcccaacctggctaatcgcgtacttgattggctagaaaaatacggtgttgaacgactcaagagaatggctattagcggtgatgattgcgttgttaagccaattgatgatcgttttgctaccgcattgactgcacttaacgatatgggtaaagttcgaaaagatataccgcaatgggaaccatccaggggttggaatgactggcaacaagttccgttctgcagtcatcatttccatcaacttattatgaaggacggtagagaaatagttgtaccatgtagaaaccaagacgagttagttggacgagctagagtcagtcaaggagcgggatggagcctaagggagacagcatgccttgggaagtcatacgcccaaatgtggcaattaatgtacttccatcgtagggacttacgactggcagccaatgcaatatgctctgctgtgcctgtagattgggtgccaacgagtcgaactacttggagcatacatgctcatcatcaatggatgacaacagaagacatgttatcagtatggaatagagtatggattgaagagaatccttggatggaagataaaactcacgtaacctcctgggaagacgtaccctacttaggaaaacgtgaagatcaatggtgcggtagcttaataggactttcagcgcgcgcaacttgggcaataaatatacaagtagcaattaaccaagtacggaaattaattggtaatgaacattaccaagattacatgacatccatgcgacgctttaaaaatgaaagtgagcctgaaggagcactatggtga

SEQ ID NO: 22155 - RNA, 9879 nt, synthetic construct
  misc_feature 1..9879: note = derived and/or modified CDS sequence (opt6) from DENV-1__DQ285561__SS-prME
  source 1..9879: mol_type = other RNA
agcgtaactatgcttctcatgcttctaccaactgcattaacatttcatctaaccactcggggaggtgaacctcatatgatagttggaaaacaagaaagaggtaaatctttgctgtttaaaacgagtgccggtgtaaatatgtgtacattgattgctatggacctcggtgaactgtgtgacgacacgatgacatataaatgtccaagaattacagagaccgagccagacgacgttgattgctggtgtaatgcaactgaaacctgggttacgtacggtacgtgcagccaaaccggagaacacagaagagacaaaagatccgtggcactagcaccccacgttggactaggattggaaacgcgcacagaaacttggatgagttccgaaggcgcttggcgtcaaatacagaaagtggaaacttgggcactgaggcatccaggatttactgtaatagctttattcctggcacatgcgataggtactagcattacacaaaaaggaataatattcatactactaatgctagtaactccatctatggcaatgaggtgcgtagggataggcaatagagattttgtagaaggtttgtcaggagctacctgggttgacgtagttttagaacatggttcatgcgttactactatggcgaaagataaacctacactggatattgaactgttgaaaacggaagtaactaatcccgcagtgctacgtaaattatgtatagaagctaaaatatctaatacaacaacagacagccgatgccctactcaaggagaagcaacccttgtagaggaacaagatacgaatttcgtgtgtagacgtacatttgttgatagaggctggggtaacggatgtggcttatttggaaaagggagtctgataacatgtgcaaaattcaagtgtgtcaccaaacttgagggaaagattgtccaatatgagaatcttaaatacagcgtaatagtaaccgtccacactggtgaccaacatcaagtcggaaatgaaacaaccgaacatggaacaatagcgaccataactcctcaagctccaacatctgaaatacaattgactgattacggcgcattgacactggactgctccccacgaacaggattagattttaatgaaatggtactacttacaatgaaagaaaaatcctggttagtacataaacaatggttcttagaccttccattaccttggacgtcaggtgcgtcaacgtcccaagagatctggaaccgacaagatttacttgtcacatttaaaactgcacatgccaagaaacaggaagtcgttgtactaggatcccaggaaggggcaatgcatactgctctcactggggctactgagatccagacatcgggaacaacaaccatatttgcgggccatctcaaatgtagattaaaaatggacaaattgacattgaaagggataagttacgtaatgtgcacgggatcttttaagttagaaaaggaggtggcagagacacagcacggtactgtattagtacaagttaagtatgagggtacagacgcaccatgcaaaatcccattctcctctcaagacgaaaaaggtgtcactcaaaacggacgtcttgttacagcaaatccaatagtcactgataaagaaaaaccagtaaacattgaagctgagccgcctttcggagaatcttatattgttgtgggagccggtgaaaaagcgctaaaattaagttggtttaagaaaggatccagtattggaaagatgttcgaagccacagctaggggagctagaagaatggctatattaggcgacacagcatgggattttggaagcatagggggagtatttacgtctgtaggtaaacttgttcatcaaatattcggaacagcctatggagtattatttagcggagtaagctggacgatgaaaataggcattggtatactactgacttggcttggcttaaatagcagatccacaagtctctcaatgacatgcattgccgtaggaatgataactctttatctgggagtaatggtccaagcagatagtggttgcgtaatcaactggaaaggccgagaactaaagtgtggaagcggcatatttgtcacaaacgaagtacatacatggactgaacaatataaatttcaagcagattcccctaagagactaagtgccgcaataggaaaggcatgggaggaaggagtgtgcggaataaggagtgctacccggctcgagaatataatgtggaaacaaatctcaaatgaattaaaccacatactattagagaatgacatgaaatttacagtagttgttggagatgtgtctggtatccttgcgcaaggtaagaaatcgataaggccgcagcctatggaacataaatactcatggaaaagctggggaaaagctaagattataggagcggacgtacaaaacacaacatttataattgatggtccaaatacgcccgagtgtccagacgatcaacgagcctggaatatttgggaggtggaagattacggattcggtatctttacaacaaatatttggctcaaactgagggactcatatacacaggtatgtgatcatagattaatgagtgcagccattaaagatagtaaggcagtgcatgcagacatgggctactggatagagtcggagaagaatgaaacgtggaagctagctagagcgagttttattgaagttaaaacttgtatatggcctaaatcacacacactttggtccaatggtgttctagaatcggaaatgattatacctaagatatatggaggacctattagtcagcataactaccgacctggatacttcactcaaacggcgggaccctggcatctaggaaaactagaactcgactttgatctttgtgaaggcacaaccgtagtcgtcgatgaacactgcggcaacaggggacctagcttacgcaccacaacagtaaccggcaaaataatacatgaatggtgttgcagaagctgcacccttcctcctctccgattcaaaggcgaagacggttgttggtacgggatggaaattcgaccagttaaagaaaaagaagaaaacttggtaaaaagcatggtaagtgcaggttctggcgaagtagattcattctcactaggcttactctgtatttcaataatgattgaagaagttatgcgctcccggtggtctcgaaaaatgcttatgactggtacattagcagtattcctcctgttgacgatgggacaattaacttggaacgacctaataagattgtgcataatggttggagccaatgcgagtgataatatggggatggggactacctatcttgcattaatggctacctttagaatgcgtccaatgttcgccgtggggttactatttaggcgtctaacctcacgagaagtactattgctaactgtggggctatcactggtagcttcggtcgaactccctaattccctagaagaactaggagatgggttagcgatgggtattatgatcttaaaactactaacagatttccaatctcatcaactatgggcaacattattatcacttacatttgtcaaaactacgttctcactacactacgcatggaagaccatggccatgatactgagtatagtctcattgttcccattatgcctaagcacaacatcacagaaaaccacgtggttacctgttctcctgggaagtttagggtgcaagccactaacgatgtttctgattactgaaaataaaatatggggaagaaaatcatggcctctcaatgaaggcataatggcagttgggatagttagcatattgttatcaagtctactgaaaaatgacgtccctttggcaggacctctaatagcaggaggtatgctaatagcctgctacgttattagcggatcatccgcagatttatcactagagaaagctgccgaagttagttgggaagaagaagcagaacactcgggtgcgagtcataacatattagttgaaatacaagacgatggaaccatgaaaattaaagatgaagaacgcgatgatacaatcacaatattgcttaaggcaacattattagcaatatcaggagtatatcctatgagtataccggcgacactcttcgtttggtacttttggcagaagaagaaacaaaggtctggagtattgtgggacacaccatctccacccgaggtggagcgagctgtcttagatgacggaatatatagaattttacagcggggattactaggtagatcccaagtcggtgtaggtgtgttccaagaaggcgtgtttcatacgatgtggcacgttactaggggtgcagttctaatgtatcaaggtaaaaggcttgaacctagctgggcgagcgtcaagaaagatttaatatcatacgggggtggttggcgatttcaaggctcgtggaatacaggtgaagaggtccaagtaatagctgtagaaccgggcaaaaatcccaaaaatgtgcaaacagcaccgggtacctttaaaacgagcgaaggtgaagtaggtgcgatcgcattagactttaaaccagggacatcaggcagtccgattgtaaaccgagaagggaaaatcgtcggactttatggaaatggagttgtgactacttcgggcacctatgtaagcgcgatagcacaagccaaagcgagtcaggaaggaccactacccgaaatagaagatgaggtttttagaaaaagaaatctgaccataatggatctgcaccctggttcagggaaaacacgcagatatctgccggccattgtgcgcgaagcaataaaaagaaaattaagaacattagttcttgcgcctactagagtagttgcaagtgaaatggcggaggctttgaaaggtatgccgataagatatcaaaccactgctgtgaagtcagagcatacaggaagagagattgtcgatttaatgtgtcatgcaacatttaccatgaggttgctttctccagtaagagttccaaactataacatgattataatggacgaagcacactttaccgatccagcttctatagcagcaaggggttacatatccacaagggtgggaatgggcgaagcagcagctatttttatgacagcgacacctcccggatccgtagaagcgttcccccagtccaacgccgtcatacaggacgaggagaaagatatacctgagagaagctggaactccggatacgattggattaccggatttcctggtaaaacagtttggttcgtaccttcaatcaaatctggcaacgatattgctaattgccttaggaaaaatggtaagcgcgtgattcaattgagtcgtaaaacatttgatacagagtaccaaaagactaaaaacaatgattgggattacgtcgtgactacagacatttcggagatgggcgctaattttcgggcagaccgtgtgattgatcctcgtcgctgtttgaaaccagtgatattaaaagacggaccagagcgcgtcattcttgctggacctatgccggtaacggtggcaagtgcagctcaaaggagaggacgcattggtcgaaaccagaataaggagggagatcagtacatttatatggggcagccattaaataacgacgaagatcacgcccactggacagaggcaaaaatgttacttgacaacatcaatacgcctgaagggattattcccgcattatttgagcctgaaagggaaaaatcggcggccattgacggagagtatcgtttacgaggagaggctcgaaaaacatttgtagaactaatgcgtagaggtgatttgccggtgtggttaagctataaagtggcgtccgaaggatttcagtacagtgatagaagatggtgtttcgatggggaacggaacaaccaagtcttagaggaaaacatggatgtagaaatttggacgaaagaaggtgaaaggaagaaattacgtccgagatggctagatgcaagaacgtattcagatccactggcactgagagaatttaaagaatttgctgcaggcagacgatccgtaagcggagatttaatcttagagatagggaaattaccccaacacctaactcaacgtgcacagaacgcattagataatctagttatgttacataactcagagcagggaggaaaggcgtatcgacatgctatggaagaactaccagatacaatagagacattaatgctcttagcgctgattgcagtcttaaccgggggtgtaacactctttttcctaagtggtcgtggtttgggcaaaacaagtattggacttctttgtgtgatgagctcgagtgctctactttggatggcctcagtagagcctcattggatagctgcgagtattatattagagttctttttgatggttctacttattcccgaaccagatagacaacgaacacctcaggacaatcaacttgcgtatgtagtaataggattattatttatgatattaaccgtagcagccaacgaaatgggccttctcgaaactaccaagaaagacctcggtataggacacgctgctgcagagaatcaccatcatgcagcaatgctagatgtagacttacaccccgcaagtgcatggactctctacgcagtagcgaccacaatcatcacgcccatgatgagacatactatagaaaacacaacggcaaatatttcattaacagcaatagcaaatcaggccgccatattaatgggtctagataaagggtggccgatttctaagatggacatcggagtgcctctcttggcgttaggctgttattcccaggtaaatcccttaactctaacggcagctgtattgatgcttgtcgcacactatgccattatcggacccggtctccaggcaaaagcaactcgtgaagcgcagaaaagaacagcagcaggcataatgaaaaatccaaccgtagacggaatagtagcgatagatctcgacccggttgtttatgatgcaaaatttgaaaagcaactaggacaaataatgcttctaatcttgtgtaccagtcaaattcttttaatgagaactacatgggcgctgtgcgaatccataactttagcaaccggaccgcttactacactctgggaaggatcgcctggaaaattttggaatacgactattgctgtgagcatggcaaacatatttagaggaagctacctagcaggagcaggattagccttttctctcatgaaaagcctaggcggaggaagacgaggtacgggtgcacaaggagaaacacttggggaaaaatggaagagacaactgaatcagttaagtaaaagtgaatttaatatctacaagcgatcaggcatagtggaagttgaccgttccgaagcaaaggagggactaaaaaggggtgagacaataaaacatgctgtatctcgtggcactgcaaaactaaggtggtttgtagaacgaaatcttgtaaaaccagaaggtaaagtaatagacctaggatgtggtagaggaggttggtcctattactgtgcaggacttaagaaagtaaccgaagtaaaaggatatacaaaagggggtcccggacacgaggagccaattccaatggcaacatacggctggaatttggtcaaactatacagtggaaaagatgtatttttcattccaccagagaaatgtgatacactactttgtgatattggcgaatcaagtcccaatccgacaatcgaagaaggacgtacattaagagtgttaaaaatggttgaaccatggttaaggggaaatcaattttgtatcaaaatattaaatccatacatgccatcagttgtagaaacgctggaacaaatgcaacgaaaacacggaggaatgcttgtacgtaacccattaagcagaaacagcactcacgaaatgtattgggtatcttgtgggactggcaatatagtatccgcggtaaatatgacttccagaatgttactaaaccgatttacaatggcccaccgaaaaccaacctatgaaagagatgtcgatttaggcgccggtactcgacacgtcgccgttgaaccggaggtcgccaatttagacattatcggacaacggattgagaatatcaaaaatgaacacaaaagcacatggcattacgatgaagataatccttataaaacatgggcttaccacggatcttatgaagtcaaaccttccggatcggcaagtagtatggtaaatggagttgtgagattactcacaaagccgtgggatgtaatacccatggtaactcaaattgctatgacagacacaacaccgttcggacaacaacgagtatttaaagagaaagtggatactaggaccccgaaagcaaagagggggaccgctcaaataatggaagtaacagcaaaatggctatggggatttttgtcacgcaataaaaagcctaggatatgtaccagagaggaatttactagaaaagtccgctctaacgcagctataggagcagtgtttgtcgatgaaaatcagtggaatagcgcaaaagaggctgtcgaagatgaaaggttttgggacttagtgcgtcgagagagagaattgcataaacaggggaaatgcgctacttgtgtatataacatgatgggaaagagagagaaaaagctaggtgaatttggcaaagcaaagggcagccgtgcaatttggtatatgtggttgggagcaagattcctagaatttgaggcactaggtttcatgaacgaagatcactggttctctagagaaaacagtttgtcaggcgtcgaaggcgaaggactacataagctaggatacatacttagagacattagcaaaattccaggcggcaacatgtatgcagacgatacggcggggtgggacactaggattacagaggatgatctccaaaatgaagccaaaataacagacatcatggaaccggagcacgcactattggcgacgtctatattcaaacttacgtatcaaaataaggtagttagagtccaaagacctgctaaaaatggtactgtgatggatgtgatttcacgaagagatcaacgaggatcaggacaagtgggaacttatggtttgaacacatttacaaatatgggcgcgcaactaataagacaaatggaatcagagggtatcttcagcccgagtgaacttgagactccaaacctagccggcagagtcttagactggttagaaaaacacggcatcgaaaggttgcgtagaatggcaatttcgggcgatgattgtgtcgtaaaaccaattgacgataggtttgcgacagcgctaactgcactaaacgacatggggaaggtaagaaaagatatacctcaatgggagcccagtaaaggatggaacgactggcaacaagtgccattttgcagccaccatttccatcaattaatcatgaaggacggtcgagagattgtagttccttgtcggaatcaagatgaacttgtcggacgagcaagagtatcacagggagcaggatggtcgttaagagaaacggcctgtctaggaaaaagctatgcgcagatgtggcaattgatgtatttccatagacgagaccttcgtcttgccgccaatgcgatttgctcggcggtaccagtcgattgggtaccaacttcacgaactacatggtctattcacgcacatcaccaatggatgacaactgaagatatgctcagtgtatggaacagagtatggattgaagagaatccatggatggaagacaaaacccatgttagtagttgggaagacgtgccgtatcttggaaagagggaagaccaatggtgcggtagcctaattggtctgactgcaagagctacgtgggccaccaatattcaagtagcaattaatcaggttagacgcctgataggtaatgaaaattacttagattatatgacatcgatgaaaagattcaaaaacgagtcggatcctgagggcgctttatggtga

SEQ ID NO: 22156 - RNA, 9879 nt, synthetic construct
  misc_feature 1..9879: note = derived and/or modified CDS sequence (opt6) from DENV-1__DQ285562__SS-prME
  source 1..9879: mol_type = other RNA
agtgttacgatgctattaatgcttctgccgacggcattagcctttcatctcactacgcgaggaggtgaacctcatatgattgtatcaaaacaagagcgaggaaaatctttgttatttaaaacatctgcgggggtaaatatgtgcaccttaatagcaatggatctaggagagctatgcgaagataccatgacatacaaatgcccaaggataacggaagcagaacccgacgatgtagattgttggtgcaacgcgacagatacatgggttacctatggtacatgctctcaaacaggtgaacatcgcagggacaaaaggtcagtagcattagcaccccacgtgggattaggtttggaaacgagaacagagacttggatgagctcggaaggagcctggagacaaatacaaaaagtagaaacttgggctttacggcatccaggtttcacggtcatagcgctattcctggcacacactatcggaacatcaattacacaaaaaggtataatttttatacttttaatgttagtgaccccatccatggctatgagatgcgtcggaataggaaacagggattttgtagaagggctatcaggtgcgacctgggtcgacgtagtactagagcatggttcatgtgttaccactatggccaaaaataaacctacactggatattgaacttctcaaaacggaagtaacaaacccggcagttttaagaaaattatgtatagaagcaaaaataagtaacacaacaacggattcaaggtgtccaactcaaggtgaagcgactcttgtagaagaacaagacgcaaattttgtttgcagaagaacattcgtggatcgaggttggggaaatggttgtggcctatttggaaaaggatcgctgttaacgtgtgccaaattcaaatgtgtaacaaaactcgaaggaaaaatcgtacaatacgaaaacttaaaatattcggtaatcgtaacagtccacactggagaccaacaccaagttgggaacgaaacaacagaacacggtacaattgccactattacgccacaagcaccaacgtctgagatacaattaacagattatggagccctaactctggactgtagtccgcgtaccggcttggactttaacgaaatggtacttctgacaatgaaagaaaaatcatggttagtacataaacaatggtttcttgatctacctcttccctggacatcgggtgcgtcaactagccaagagacctggaacagacaagacttattagttacattcaaaaccgctcatgccaagaaacaagaggtagtagtattgggttcgcaagagggcgctatgcataccgcactcacgggagcaacagaaatacagacctctggaactactacgatatttgctggacatctcaaatgtagattaaaaatggacaaacttacactaaaaggtgtaagctacgtcatgtgtacaggatcatttaaactagaaaaagaagtcgcagaaacacaacatggaactgttttagtacaagtaaagtatgagggcacagatgctccgtgtaaaatacccttctcaacgcaagacgaaaagggtgtaacacaaaatgggagactcataaccgccaaccctatagttactgacaaggaaaaaccagtcaacattgaaaccgagcctccctttggagaatcttacatagttataggagcgggcgagaaggccctaaaactaagttggttcaaaaagggatcatcaataggaaaaatgtttgaggcaacagcacgtggtgcaaggcgaatggcaatactaggcgatactgcatgggattttggcagcataggcggcgtatttaccagcgtgggaaaattggttcaccaagtattcggcaccgcatacggcgtactattctctggagttagctggacaatgaagattgggataggaatcttgctaacctggctcggactaaattcacgaagtacctcactaagcatgacctgtatcgtggtaggtatggtgaccctgtatcttggggtaatggtacaagccgactctggctgcgtgatcaattggaaaggacgagagcttaaatgtggtagtggaatattcgtcacaaatgaagttcacacatggactgaacaatataaattccaggcagactcgcccaaacgtctatcggcagcgataggcaaggcatgggaggaaggagtgtgcggcattagatccgctactcgtctagaaaacataatgtggaaacaaattagcaatgagttaaaccatatattactagagaatgatatgaaatttactgtagtcgtgggcgacgcaaacggaatactaactcaaggcaagaaaatgataaggccacaacctatggagcataaatatagttggaaaagttggggaaaagcaaaaatcataggggctgatattcaaaacactacttttataattgatggaccggacacaccagaatgccccgatgaccagcgagcatggaacatctgggaggttgaggactacggctttgggatatttactacaaatatatggctaaaattaagagattcttatacgcaaatgtgtgatcacagattgatgtccgctgcaatcaaagattccaaagctgtccatgctgatatggggtactggatagaatctgagaaaaacgaaacatggaaacttgccagagccagcttcatagaggtcaagacgtgtatatggccaagaagccacaccctatggagcaacggagtcctcgagtcagagatgataatccctaagatctatggaggacccatatcgcaacacaattatcgcccggggtacttcacgcaaacggcaggtccctggcatttaggaaaattagagttagactttgatttgtgtgaagggactactgtggtcgttgatgaacattgtggaaaccgaggacctagccttcgaactacgacagtgacaggaaaaatcattcacgagtggtgttgcagaagttgtactttgccgccgctccgcttcaaaggagaggacggttgctggtatggtatggaaatccgaccggtgaaagaaaaagaggagaatctcgtccgaagtatggttagtgcaggttcaggtgaggtagactcgttctctctaggtctcttatgtgttagtatcatggttgaagaagtaatgcgttctagatggtcaagaaaaatgttgatgacaggcaccttagctgttttcttcttgttaattatgggccaattgacttggaatgacctaataaggctatgcataatggtgggggccaatgtatcagacagaatgggtatgggcacaacatatttagctctaatggcaaccttcaaaatgaggccaatgttcgcagttgggcttttatttcgtcgacttacgagtagagaagttctacttctcactatagggttatcattagtcgcatctgtcgaattaccaaactctctggaggaactaggagacgggttagctatgggaatcatgatgttaaaacttctcacagattttcaaagccatcaactatggacaactctattatctctaacctttatcaaaacgacactgtctttggactatgcttggaaaacaattgccatggtgctttcgattgtatctctatttcccctgtgtttatccacaacaagtcagaaaacgacatggttgccagtgttattgggaagtttcggatgtaaaccacttaccatgtttttaataacagaaaacaagatctggggaagaaaatcgtggccccttaatgaaggcataatggcggtcggtatagtatcgatcctattgtcctcgctattgaaaaacgatgtccctctagctggaccactcatagctggtggaatgctcataacttgctacgttataagcgggtcttctgcggaccttagtttagaaaaagcagcggaagtttcttgggaggaggaagctgagcattctggagcatcacataatatcttggtcgaggtgcaggatgatggtactatgaaaattaaggatgaagaaagggatgacactctaacgattctgctaaaagcaacactcctagctgtaagcggagtatatccaatgagcataccagctactttatttgtatggtatttttggcagaagaagaaacagagatcgggggtattgtgggacacgccatcccctccagaagtggaaagagcagttctagacgatggcatatatagaatattgcagcgtggactactaggaagaagccaagttggagtcggggtattccaagatggggtcttccatactatgtggcacgtcaccagaggagcggtactcatgtatcaaggaaaaagattagaaccaagttgggcaagcgtgaaaaaggatctaataagttatggtggaggatggcggttccaaggatcttggaacacaggagaagaagttcaagtaatcgctgtagaaccaggcaaaaatccgaagaatgtccaaacgactcccgggactttcaaaactccggaaggcgaagttggagcaatagcacttgactttaaacccggaacaagcggatcccccatagtaaatagagaaggaaaaattgtaggactgtatggaaacggtgttgttacgacgtccggaacgtatgttagcgcgatagcacaggcgaaggcttcgcaggagggaccattacctgaaatcgaggatgaagtgtttaagaaacgaaatcttacaataatggatctacatccgggatcaggaaaaaccagacggtacttacctgctattgtccgagaagctataaaaaggaaactaagaaccttaatattagcacccacacgggtggttgcatcggaaatggctgaagcccttaaaggtatgccaataaggtatcaaactactgctgttaaatcagaacatacaggtcgtgaaatagtggacttgatgtgccatgcgaccttcactatgagacttttatcacctgtccgtgtcccaaattacaatatgataattatggacgaagcgcactttaccgaccccgcttcaatagcagcccgaggttatatatcgacaagagttggaatgggcgaagcagccgctatatttatgacagcaacacccccaggttcagtcgaagcattcccacaaagtaacgctgtgatacaggatgaagagagagatatcccagaacgttcctggaactctgggtatgattggataacagatttcccaggaaaaacggtctggtttgtaccatcaatcaagtcaggaaacgacatcgcgaactgcctcagaaagaatggtaaaagagtaattcagctatcacgtaagacatttgacacagaatatcaaaagactaaaaataacgattgggattatgttgtaactaccgatatctcagaaatgggagcaaactttagagccgatcgtgtaattgatccaagaagatgcttaaagcccgttatactgaaagatggacccgaaagagtaattctagctgggccgatgccggtaaccgtagcaagtgcggctcaacgtaggggaaggatcgggcgtaaccaaaataaagaaggtgaccagtacatatacatggggcaaccactaaataacgatgaggatcacgctcattggactgaagctaaaatgctcctagacaacataaatacaccagaaggaatcattccagctctatttgaacctgaaagggagaaatccgcagccatcgatggggaatatcgactacgtggcgaagcgagaaaaacatttgtggaattaatgaggagaggagatttgcccgtgtggctctcttataaggtggcgagcgaaggcttccaatactcagatagacgatggtgtttcgatggtgaaaggaacaaccaggtattggaagaaaatatggacgtagagatatggacaaaagaaggagagagaaagaaattgcgaccacgctggttagatgctcgcacctatagtgaccccctagcgctaagagaatttaaagagtttgcagccggtcgtcgtagcgtatctggcgatctaatactcgaaatagggaaattacctcaacatcttacactcagagctcagaatgccttagataaccttgtaatgctacataatagtgagcaagggggaaaagcctacagacatgccatggaggaactcccggatacgatagaaaccctaatgctactggcattaatagcagtcttaaccggaggtgtgacattattctttttatctggaaaaggattagggaaaacgtcaatcggcttattatgcgtcatggcatctagtgttctgttatggatggcttcagttgaaccacattggatagcagccagtataatccttgagttctttctgatggtacttctcattcccgaaccagatcgacaaagaacaccacaggataaccagttagcgtatgtggtcataggcctattattcatgattttaacagtcgcagcaaatgaaatgggtttgttagaaaccacgaagaaagaccttggaataggtcacgcagtcgctgaaaaccaccatcacgcaacaatgctagatatcgaccttcaccccgcctcagcgtggacattatatgctgttgcaactacaatcataactcccatgatgaggcatactatagaaaatacgacagcgaatataagtttaacagcaatcgctaatcaagcggcaatattaatgggcctagataaaggatggcccataagtaaaatggacataggggtacctctacttgctttaggatgttactcccaagttaacccgttaaccctaacggcagccgtccttatgttagtggcccattatgcaataataggtccgggactacaggcgaaggcgacgagagaagcacaaaagcgcaccgcagcaggtataatgaagaatccaaccgttgatggaatagttgctatagatctagaccctgtggtatatgatgctaagtttgaaaaacaactaggtcaaatcatgctattgatattatgcacgagtcaaattttattgatgcgtactacttgggcgttgtgtgaatctatcacattagctactggccctttaacaactctttgggagggaagcccaggtaaattttggaacacaacaatagcagttagtatggctaatatatttcgaggctcatatcttgccggagcaggactcgcgttttcactaatgaaatcattagggggcgggcggcggggaacaggagcgcaaggcgagacacttggcgaaaaatggaaacgccaacttaaccaactgtcaaaatctgagttcaatacctataaaagaagcggcatcatggaagttgaccgctcggaggcaaaggaagggttaaaaagaggagaaacaactaaacacgccgtgagtcgaggaaccgcaaagctgaggtggttcgtagaacgaaatttagtgaaaccagaaggaaaagtgatagatttaggctgtggaagaggaggatggtcatactattgtgccggactcaagaaagttacggaggtaaaaggttacacaaaagggggtccaggtcatgaagaaccaattcctatggctacatacggttggaatctagtgaaattacatagcggtaaagatgtattcttcactccacccgaaaagtgtgatacactattatgcgacattggagaatcatcaccgaatccaacaatcgaagaagggaggacactacgtgtcttaaaaatggtcgagccttggctacgaggcaaccaattttgtattaagatactcaatccctatatgccatctgttgtagaaactcttgagcaaatgcaaagaaaacatggtgggatgttagtaagaaacccattgtcgagaaattctactcatgagatgtactgggtaagttgcgggacagggaacattgtatcagcagttaacatgacatctcgcatgcttttaaacagattcacaatggctcataggaaaccgacctatgaaagggatgttgatttaggggctggaacacggcacgttgcagtagaaccagaaatcgcgaatttagatattataggccaaagaattgaaaatattaaaaatgagcacaaatcaacgtggcattacgatgaagacaatccgtacaagacctgggcatatcacggtagttacgaagtaaaaccaagcgggagcgcatcttcgatggttaacggtgttgtaaggttattgacaaaaccctgggatgtaattcccatggtcacccaaatcgccatgactgatacaacaccttttggacaacaacgagtatttaaagaaaaagttgatactcgtactccgcgtccgaaaagaggaaccgcacaaattatggaagttacagcaaagtggctgtgggggtttctatccaggaacaagaaacctagaatatgtactagagaagaatttacccgaaaagtcaggtcaaatgccgcaatcggggctgtttttgtagacgaaaaccaatggaactcagcaaaagaagccgtagaagacgaacgtttctgggatctcgttcaccgagagcgtgagcttcataaacaggggaaatgcgccacttgtgtttataacatgatgggtaaacgtgagaagaaacttggagagttcggaaaagctaaagggtccagagctatatggtacatgtggttaggagctcgtttcctcgaatttgaagcgctaggctttatgaatgaggaccattggttttcgagagaaaattctttatccggagtagaaggtgaagggcttcacaaattaggatacatattaagagacatatctaaaattcccggaggaaatgtatatgcagacgataccgccggatgggatacccgaataaccgaggatgatttacaaaacgaagccaaaataactgacatcatggagccagagcatgcattactagccacttctatattcaaacttacataccaaaacaaagtggttagggtccaaagaccagcaaagagtggtacagtaatggatattatttcacgtagagaccaaagaggatctggtcaagtaggtacttacggattaaacacgtttaccaacatggaagtccagcttatcagacaaatggagtccgaaggtatatttagtcccagtgaattagaaaattcaaatctcgcggaaagagttcttgattggttagagaaacatggggttgagcgattaaaacgcatggcaataagtggtgatgactgcgtcgttaagcccactgacgaccgatttgccacggcgttgacagcactaaacgacatgggaaaagtaagaaaagatatcccacagtgggagccatcgaaaggatggaatgattggcaacaagtgccattttgttctcatcattttcatcaacttataatgaaagacggacgagagattgtcgttccatgcagaaatcaagacgaactcgtcggtagagcccgtgtctcacaaggagctggttggtcgctgcgtgaaacagcttgtttagggaaaagctatgcacaaatgtggcaactaatgtacttccaccgacgtgatctacgattagctgctaatgcaatctgctcagcagtgccagttgattgggtgccaaccagcagaacaacgtggagcatacacgcacaccatcaatggatgacgacagaggacatgctctcagtatggaacagggtctggatagaggaaaacccgtggatggaagataaaactcacgtttctagctgggaagatgtaccatatcttgggaagagggaggaccaatggtgtggttcactaatagggctaacggcgcgagccacgtgggcaacaaatatccaagtcgcaataaagcaagtaagaagactaataggaaatgaaaattacttggattatatgacgagcatgaaacgttttaaaaatgaatctgacccagaaggggctctatggtaa

SEQ ID NO: 22157 - RNA, 9879 nt, synthetic construct
  misc_feature 1..9879: note = derived and/or modified CDS sequence (opt6) from DENV-1__DQ285558__SS-prME
  source 1..9879: mol_type = other RNA
tccgttactatgctgttaatgttactcccaactgcattaacttttcacctcacgacgcgcggaggggaacctcacatgattgtgggaaaacaagaacgaggtaaatccttattgtttaaaacgtctgcaggagtaaacatgtgtactctcatcgctatggatctgggagaattatgcgatgatactatgacttacaaatgcccaagaatcacggaaacagaacctgatgatgtggattgttggtgtaatgcgacagaaacatgggttacatacggaacatgctcgcaaacgggtgaacatagaagagacaaacgaagcgtagcattagccccacacgtagggctgggcctggaaacgcgtacagaaacttggatgagcagtgagggtgcctggagacaaattcaaaaagtagagacatgggcccttagacatcccggatttacagttatagcactattcttagcacacgccataggtacttcaataactcaaaaagggataattttcatattactaatgctagtaactccgtcaatggcaatgcgatgcgtaggaataggcaatagggacttcgtcgaaggtttgagcggagcaacttgggttgatgtagttctggagcatggatcttgtgtaacgactatggcaaaagataaacctacactggacatagaactgttaaaaacagaagttacgaacccagcggttcttagaaaattatgtatcgaggccaaaatatcaaatacaacaacagatagccgttgtcccacgcaaggtgaagctaccctagtagaagaacaagatacaaattttgtatgtagacgtacatttgtagatcgaggctgggggaatggatgtggtctatttggtaaaggttcgttaataacatgtgcgaagtttaaatgtgtaactaaacttgagggtaaaatagttcagtacgagaatttaaaatactccgtaattgttacggtacataccggagatcaacaccaagtaggaaatgaaacaaccgaacacggaacgatagcaacaatcacaccacaagctccaacttctgaaattcaacttacagattatggtgcattgacactggactgtagtcccagaacaggacttgactttaatgagatggtccttttaacaatgaaggaaaagagttggctagttcacaaacaatggttcttggacctgcccctaccatggacatccggggcgtcaacgagtcaagaaacttggaatcggcaagatcttctagttactttcaagacggcacacgcgaagaagcaagaagtagtagtgttaggaagccaagaaggagctatgcatacagcactcaccggtgcaacagaaatacaaacaagcggtaccacgacaatatttgctggacatttaaaatgcaggcttaaaatggacaaattaacattaaaaggaataagttatgttatgtgtactggatcatttaagctagaaaaagaagtagccgagacacaacatgggacggttttagtacaggtgaagtatgaaggtactgatgctccgtgtaagatacctttttcaagtcaagacgagaaaggtgtgacgcaaaacggccgattagtcacggctaacccaatagttactgataaagaaaagcctgtaaatattgaagccgagccaccttttggcgagtcgtacatagtagtcggagccggcgagaaggcactcaagttgagctggtttaagaaaggttcatcgataggaaaaatgtttgaagcaacagccagaggggcacggcgaatggcgatactaggcgacactgcctgggattttggaagcataggcggtgtatttacatcagtcggcaagttagtacatcagatattcggtacagcatatggcgtgttgttttcaggtgtgtcttggaccatgaaaatagggattggtatactattaacgtggctaggtttaaactcaagatcaacaagtttgagtatgacatgcatcgcagttggcctaataacactatacttaggggtcatggttcaggcagattccggttgtgtaatcaactggaaagggagggagttaaaatgtgggtcaggtatatttgtcactaacgaggtacacacttggaccgaacaatacaaattccaagctgattcaccgaagagactttctgctgcaataggtaaggcatgggaagagggagtatgcggcatacgaagtgcgacacgtctagagaacattatgtggaaacaaatatcgaatgaacttaatcatatactgctcgaaaacgatatgaaatttaccgtagtagtaggtgatgtcagtggtattctagcgcagggtaagaaaagtatacgacctcaacctatggaacataaatattcctggaaaagttgggggaaggcaaaaataataggagctgacgtacagaacaccacttttattattgatggaccgaataccccagaatgcccagacgatcaaagagcttggaacatttgggaagtagaagattatggctttggcatcttcacaacaaatatatggttgaaattaagagactcttatacacaggtgtgcgatcatcggcttatgagcgcagcgatcaaagatagcaaagccgttcacgcggatatgggctactggatagaaagcgagaaaaacgaaacatggaaacttgctagagctagctttattgaagtcaaaacctgtatatggccaaaatctcacacactgtggtcaaacggtgtcctagaaagcgagatgatcattccgaagatatacggtggaccaatatcacaacacaactatcgcccgggatattttacgcaaaccgcaggaccatggcatctaggaaaactggaattagatttcgacttgtgtgaaggtactactgtagtggtagatgaacactgcgggaatcgtggtccatctctgcgaacaactactgttaccggcaaaataattcatgagtggtgctgtcggtcgtgcactttaccgccactcagatttaaaggagaagatggttgttggtacggcatggagattcgacctgtaaaagagaaagaagaaaatttagtaaaaagcatggtaagcgccgggagtggtgaagtggatagcttttctttaggattattatgcattagcattatgatcgaagaagtgatgagatcgagatggtcaagaaaaatgctgatgacaggaacgctagcagtatttttactcctaaccatgggccagcttacctggaacgacctaatccgattatgcataatggtgggagcaaatgcgtcggataatatgggcatgggaacgacgtatttagcattaatggcgacctttagaatgcgaccaatgttcgcagttggcctgttgttcaggcgtttaacgtctagggaggttttactcttaacggtaggtttatcactggtggcaagtgttgaattgccaaactcattagaagaattaggtgatggactagctatggggatcatgatacttaaacttctaacggactttcaatcgcaccaattatgggccactcttctttcactaacttttgtaaagacaacattcagtctccactacgcatggaaaacaatggcaatgattctaagtattgtgagtcttttcccattatgcttatcaacgacgtcacagaagacaacgtggctgcctgtactacttggttcgttaggttgtaaacctttaacgatgttcctaataacagaaaacaaaatctggggaagaaagtcctggccattaaatgaaggaataatggcagttggaatcgtaagcattttactaagttcccttctcaaaaacgacgtgccactagctggaccgctaattgccgggggtatgttaatcgcatgttatgttatttcgggatcatcagccgatctaagtttagaaaaagccgccgaagtaagctgggaagaggaagcagaacattcgggagcatcacataatatattagtggagattcaggatgatggtaccatgaaaattaaagatgaagaaagagatgacacaattacaattctactaaaggcgacattacttgcaatatcgggtgtatatccgatgagcatacctgcaactttattcgtttggtacttttggcaaaagaaaaagcaacggtcaggagtcttatgggatacgccatcaccgcctgaggttgagagagcagtcctcgatgatggaatataccgtatactgcaaagaggcttattaggacgttctcaggtaggggtaggtgtgtttcaggagggggtatttcacactatgtggcatgtgaccagaggagcggttctgatgtaccaaggaaagaggttagagccatcttgggcaagtgttaagaaggatttgatttcttatggaggaggatggagatttcaggggagttggaacacgggcgaggaggtacaagtaatcgcagtcgaaccgggaaagaatcccaaaaatgttcaaactgccccgggaacttttaaaacatctgaaggtgaagtaggagcaattgcactagattttaagcctggtacatctggatcacctatcgttaatcgcgaaggtaaaatagtaggcctatacggaaacggagtcgtcacaacatcaggaacatacgtttccgctatagctcaagctaaagccagtcaggagggtcctctaccagaaatagaagacgaagtctttagaaaacggaacttaacgataatggacctccatcctggttcggggaagacgagaagatatttaccagctatcgttcgagaagctataaaacggaagttaaggaccttagttttagctccaacacgagtcgtagcttccgaaatggctgaggcactcaaaggtatgcctatacgatatcaaaccacggctgtaaaatcagagcataccggaagagagattgtagatttaatgtgtcacgccacatttactatgcggttactttctccagtgcgagtgcctaactataatatgataataatggatgaggcgcatttcactgacccggcatcaattgctgcaagaggttacatatcaactagagtaggaatgggcgaagctgccgcgatatttatgactgccactccaccaggttccgtggaagcattcccgcaatccaacgccgtaatacaagatgaagaaaaggacattccagagcgaagttggaacagtggatacgactggataactgattttcctggaaaaactgtctggttcgtaccgagcatcaagtctggcaacgatatagcaaattgccttaggaaaaacggtaaaagagttatccaactctcaagaaagacttttgatacagagtatcagaaaactaaaaataacgactgggattacgtggtaaccacggatatcagcgaaatgggcgctaacttcagggccgatagggtaatcgatccgcggagatgccttaaacccgtaatcctcaaggatgggccagaaagagttattcttgcggggcccatgccagtcaccgttgcttcggccgctcaaaggagaggacgcataggcagaaatcagaataaggaaggagatcaatacatatacatggggcaacctctcaataatgatgaagatcatgctcattggactgaagcaaagatgttactggataacattaacactcccgaaggaataattccagccctattcgaaccggaacgagaaaaatcagcggctattgacggtgagtacagattaagaggggaagctcgaaaaactttcgtagagctaatgagacggggtgacttgcctgtgtggctatcgtacaaagtggccagcgaagggtttcaatactcagatagaagatggtgttttgacggtgaacggaataatcaggtattagaggaaaatatggacgttgagatttggacaaaggagggagaaagaaagaagttgagaccacgctggctagatgcgagaacctatagtgacccacttgccctacgggagttcaaagaatttgcggctggtcgaagatcagtttcaggagatcttatcttagaaataggaaaattacctcagcaccttacacaaagggcacaaaacgctctggacaatctagtgatgttacataactctgagcaaggtggaaaagcatacaggcatgctatggaagaactaccggatacaattgaaaccctcatgttgctcgcattgatcgctgttttaacgggaggtgtgacattattctttttatctggcagagggttgggcaaaacaagtatcggtttgctatgcgtgatgtcatcttccgccctcttatggatggccagcgtggaaccacactggattgcggcatccataatccttgagttcttcctaatggtacttcttatcccagaaccggatcgacaaagaactccccaagataaccaactagcgtacgtcgtaataggcctattatttatgattctaacggttgcagccaacgaaatgggtttattggagacaacgaagaaagaccttggtataggacacgcggcagctgaaaaccatcatcacgcagcaatgcttgatgttgatttgcaccctgcatcagcatggacactatatgcagttgcgacaacaataattacaccgatgatgcgacacacgatagagaacacgacagcaaatatctcattgacggcaattgccaatcaagcggctatcctgatggggttggataaaggttggccaatttcaaagatggacatcggggttccccttttagctttaggatgttatagtcaagtgaacccgctcactctcacggctgctgttctgatgctagttgcccactatgctatcataggtccaggtctacaagcgaaagcaaccagagaagctcaaaaacgaacagccgccggtataatgaaaaatccgaccgtggatggaattgtcgcgattgatttagacccagtagtgtatgatgcaaaatttgagaagcagttgggtcaaataatgttacttatactttgcacatcccaaatattgcttatgagaacgacgtgggcgctatgtgaaagcattacccttgcaacaggtccactaactacactgtgggaaggaagcccaggtaaattttggaacacgacaattgctgtaagtatggctaatatatttaggggttcatatctagctggcgcaggcttagcattctcattaatgaaaagtttagggggcggcagaaggggaacaggtgctcaaggagagacattaggtgaaaaatggaaacgacaattaaatcagttgtcgaaaagcgaatttaatatttacaagagaagcggtattgtggaagtagaccgcagtgaagcaaaggaaggattgaaacgcggcgaaacaataaagcacgcagtatcgagagggacggcaaaattgagatggtttgtagaacgtaacttagtgaaacctgaaggaaaggtcattgatttgggctgtggtcgaggaggctggtcatattattgtgcaggactcaagaaagtgacagaagtcaaaggttatactaagggcggaccagggcacgaagaaccaattcctatggctacctatggttggaatttagtaaaattatatagcgggaaagatgtattctttataccaccggagaaatgtgataccttgctttgtgatatcggtgaaagctccccaaatcctacaatagaagagggtcgaacgcttagagtccttaagatggtagagccctggttaaggggtaaccaattttgcattaagatattgaacccgtatatgccaagtgtagttgaaaccttagaacaaatgcaaagaaaacatggaggtatgctagtgcgaaaccctctaagtagaaatagtacgcacgaaatgtattgggtaagttgtgggacaggaaatatagtgtctgcggttaatatgacctcaagaatgcttttaaatagattcacgatggcccatcgaaaaccaacatacgaacgggacgtagacttgggggctgggacaaggcatgttgcagtggagccagaagtagcaaacctagacatcataggacaaagaatagagaatattaagaatgaacacaagagcacctggcattacgatgaagacaacccttataaaacatgggcctatcatggctcgtatgaagtgaaaccatccggaagtgcaagtagtatggtcaatggagtagtcagacttttaacgaagccttgggatgtaataccaatggtaacacagatcgcgatgacagatacaactccatttggtcaacaacgagtatttaaagaaaaagtcgatactaggacacccaaagctaaacgcgggacggcccaaataatggaagtaacagcaaaatggctctggggttttctaagccgaaacaaaaagcctagaatatgtactagagaagagttcacaagaaaagtaagaagtaacgcagcgataggtgcagtatttgttgacgaaaatcagtggaacagcgccaaggaagccgtcgaagatgaaaggttctgggatctagttcgacgtgaaagagaacttcacaaacaaggaaaatgcgcgacatgcgtttacaatatgatgggcaaaagggagaagaaactcggtgaatttggaaaggcaaaagggagtagagctatttggtatatgtggttgggcgcacgattcttagagttcgaggctctaggatttatgaacgaagaccactggttcagtcgcgagaactcactttcaggtgtagaaggcgaaggtctacataaattaggttatatacttagagatatctcaaaaatcccgggcggaaatatgtacgcagacgatacggcagggtgggatacaaggataacagaggacgacctccaaaacgaagcaaaaatcactgacattatggaacccgaacacgcacttctagcgacatctatatttaaattaacctatcaaaacaaagttgttcgagttcaacgcccagccaaaaacggcaccgtaatggacgtcattagccgaagagaccagcgcggctctggacaagttggaacttacggactaaataccttcaccaatatgggtgcacaattgattagacaaatggagtctgaaggtatattttctcctagtgaactagaaacgccaaatttagcaggcagagttttagattggctggagaaacatggcatagagagactacgcagaatggccattagcggagatgattgtgtcgtcaaacccatagatgatagatttgcaacggctctgactgcgttaaatgatatgggaaaagtacgaaaggatattcctcagtgggaaccgagcaaaggatggaatgattggcaacaagtaccattttgttcacatcatttccatcaactcataatgaaggatgggagagaaatagttgttccatgccgaaatcaagacgaattagtagggcgggcaagagtaagccaaggcgccggatggtcactccgcgaaaccgcgtgcttgggtaaatcgtatgcacaaatgtggcaactaatgtactttcatcgtagggacctacgccttgctgctaacgctatctgctcagcagtccccgtagactgggtacctacaagtaggactacatggtctatacacgctcaccatcaatggatgaccaccgaggacatgttgagcgtatggaatagagtttggatagaagagaatccttggatggaagacaaaacccatgtgtcaagctgggaagatgttccttatcttggtaaacgagaggatcaatggtgtggatcactaatcggtttgaccgcacgagcaacttgggcgactaacatacaagttgccataaaccaagtgagaagacttatcggaaatgaaaattacttagattatatgacaagcatgaagcggttcaagaacgaaagcgatccagaaggcgcattatggtaa

SEQ ID NO: 22158 - RNA, 9879 nt, synthetic construct
  misc_feature 1..9879: note = derived and/or modified CDS sequence (opt6) from DENV-1__DQ285559__SS-prME
  source 1..9879: mol_type = other RNA
tcagtcactatgcttctgatgcttctccctactgcgttgacatttcacttaaccactagaggtggagaacctcatatgatcgtctcgaaacaagaaagaggtaaatccctgctatttaaaacaagtgttggggtaaatatgtgcacattaatagctatggatctaggtgaactatgcgaagatactatgacctacaaatgtcccagaattaccgaagcagagccggacgatgtagattgctggtgcaatgccacggacacatgggttacatacggtacctgctcacaaaccggtgaacaccgaagagataaaagatctgtagcattggcaccccacgtagggctcggcttagagacaaggacggaaacctggatgagcagtgaaggagcatggaaacagatacaaaaagtcgaaacatgggctttgcgccaccctgggtttaccgtaatcgctttattcctcgcccacgcaataggtacctcaataacgcaaaaaggaatcatattcatactactaatgttggtaacaccgtctatggccatgagatgtgtcggtatcggcaaccgggattttgtagaaggtttatcaggagctacatgggtcgacgttgttttagaacacggaagttgcgtaaccaccatggccaaaaataaacccacactagacatagaattgcttaaaacggaagttacaaatccagcagtgttacgcaaactttgcatagaggctaagatatccaatacaacaacagactctagatgtcctactcaaggagaggcaaccctagtggaagaacaagatgccaactttgtctgtaggcgcacttttgttgatagagggtggggcaatggatgtgggctctttggtaagggatcactgttaacctgtgctaaatttaaatgtgttactaaattagaaggaaagattgtccaatatgagaatctcaaatactcagttatagtaacggtccacactggggaccaacatcaggtcggtaatgaaactacagaacatgggacaatcgccactatcactccgcaagcacctacttccgagatccagctaatagactacggagcattaacactggactgtagtccaaggacagggctggattttaatgaaatggtactactaactatgaaaggcaaaagctggctcgttcacaaacagtggttcttagacctacctcttccttggacatcaggtgcgagcacctcacaagaaacgtggaacagacaagatcttctcgtaacatttaaaacagctcatgcgaagaaacaggaagtagtggtattgggttcacaggaaggagcaatgcatacagcattaacgggagcaacagaaatacagacatccggaaccacaacaatcttcgcaggtcacttgaagtgcagactaaagatggataaactcacattgaaggggatgtcatacgttatgtgcacaggaagtttcaaattagaaaaagaagtagcggaaacgcaacacggtaccgtcctagtacaagtgaagtatgagggaacggatgcaccttgcaaaattccattttccacacaggatgagaaaggtgttactcagaacggtcgattaattaccgcaaaccctatagtcactgacaaggaaaaaccggtgaacattgaaaccgagccaccttttggagagagttatatcgtagtaggagcgggagaaaaagcattaaaactaagttggtttaagaaaggctcgtcaatcggaaaaatgttcgaagcaacagcacgtggtgccaggcgtatggcaatccttggagacacagcctgggattttggtagcatcggcggagttttcacaagtgtgggaaaactaacgcatcaagtattcggaactgcatatggagtcttgttctctggagttagttggacaatgaaaataggtattggtatacttttaacttggttaggcttaaactcccgctctactagcttaagtatgacctgtattgcggttggtatggtaacactgtacttaggagtaatggtacaggcagattcaggctgtgtaataaattggaaagggagagagttaaaatgtggatcaggaatctttgtgacaaatgaggtacatacatggactgaacagtataaattccaagcggacagtcctaagaagttatcagcagccataggaaaagcatgggaagagggcgtgtgtggcatacgaagcgcgaccagactagagaacataatgtggaaacaaatcagtaatgagctaaattatatattgttagaaaatgatatgaaattcactgtcgtggtaggtgatgcaaatggcattctcgcacaaggtaaaaagatgattcgtcctcaacctatggagcacaaatactcgtggaagtcatggggaaaagcaaagatcattggtgcagatattcaaaatacaacttttatcatcgacggtcccgacaccccagaatgcccggacgaccaacgagcatggaatatatgggaggttgaagattatggctttgggatatttactacaaacatttggctaaaattaagagactcatatacacaaatgtgtgaccataggctaatgagtgcagctataaaagatagcaaagcggtacatgcagatatgggatattggatagagtcagagaagaatgaaacttggaagttggctcgtgcatcctttatcgaggtcaaaacatgtatctggccgaaatcgcataccttatggtcaaacggagtattagagtcagaaatgataataccaaagatatacgggggtcccatttcccaacataactatagaccaggatattttactcaaactgctggaccctggcacttaggcaaattagagttagactttgatctatgcgaaggcactacagtcgtggttgacgagcattgtggaaatagaggtccatccttaagaactacaactgtaactggtaaaattatacatgaatggtgctgccgttcttgtacccttccaccattgcgctttcgcggcgaagatggatgttggtatggcatggaaatacgacccgtaaaagaaaaagaagaaaacttagtcagatcaatggtaagtgctggatcgggtgaagtggattctttcagtttaggtatactctgtgtatcaattctaatagaagaagtgatgcgaagtaagtggtcaagaaaaatgttgatgacaggaacgttagcagtgtttctgcttttgattatgggccaactaacttggaatgatctgaccaggctctgcatcatggtaggagcgaacgctagtgacaggatggggatgggtacaacttacttagccttaatggcgacctttaagatgagaccaatgttcgcagtaggactactctttcgccgtctaacatcccgtgaagtactgttattaaccataggattaagcctagtagcgtcagtagaactgcctaattctctcgaagaattaggtgatgggttagcaatgggaataatgatcttaaaattattaacggactttcaaccacaccaactctggacgactttactttccttgacctttattaaaaccacactaagcctagattacgcatggaaaactatggcgatgactttatcaattgtatccctcttcccgctgtgtctctcgaccaccagtcagaaaacaacttggttaccagttctactaggaagttttggctgtaaacctttgaccatgtttttaataacagaaaataagatctggggaagaaaatcttggccaataaacgaaggtataatggctgtaggcatagtaagtatcttactctcatcactgttaaagaatgacgtacctctcgccggtccattgatagccggcggcatgttaatcgcatgttatgttatcagcggatcttcagcagaccttagtctagaaaaagcagcagaagttagttgggaggaggaagcggaacattcgggcacatcgcacaacatattagtggaggtacaggatgatggtactatgaagatcaaggacgaggaaagagatgacaccttgactatactactcaaggctactcttttagctgtgtcaggtgtgtacccgatgagcattccggccacattatttgtttggtatttttggcagaagaagaaacaacgttccggtgttctgtgggacaccccgagccctcccgaagttgaaagggcagtcttggatgacggcatataccgtatactgcaaagggggttgttaggtagaagtcaggttggagtcggcgtgtttcaagatggtgtttttcacacaatgtggcacgtaacacgcggagcagtcctaatgtatcagggtaaaaggttagaaccgtcttgggcctctgtcaaaaaggatctaataagctatggaggtggatggcgattccaaggtagctggaatacaggagaagaagtacaagtaatcgcggttgaaccaggaaagaatcccaagaacgttcaaaccacaccaggtacatttaagacaccagagggtgaagtcggggcaatcgcccttgatttcaaaccaggcacatcgggatcaccaatagtcaatagagaaggaaaaatagtaggtctatacggtaatggagtagtcacaacaagtggaacatatgttagcgcaattgcacaagcaaaggccagccaagagggtccattaccagaaattgaagatgaggtattcaagaaacgtaatttgaccattatggacctacacccagggagcggcaaaacaaggcgatacctgccagccattgtaagagaagcgataaaaagaaaattgcgtaccctaattttagcgcctacgagagtagttgcgtctgaaatggcagaagcattaaaaggaatgccaattagatatcagacaacagcagtaaagagcgaacacacaggtcgagagatcgtagacttaatgtgccacgcgacattcaccatgagactcttatcacctgtccgtgtgccaaattataacatgataataatggacgaagcacatttcactgatcccgctagtatagcagcccgtggatatatttcaacaagagtaggaatgggggaagctgcggcgatttttatgactgctaccccaccaggttcggtagaagcattccctcagtcaaatgcggtcatacaggacgaagaaaaagacattcctgaacgatcatggaacagtggatatgattggattacagattttccaggaaaaactgtatggtttgtaccaagtataaaatctggaaacgatatcgctaactgtcttcgaaagaacggcaaaagagtcatacaactgagtagaaaaacattcgacacagaataccagaaaacaaagaacaacgattgggactatgtggttacaacagacatatccgaaatgggggctaattttcgtgcagaccgagttatagatccacggcgttgtttaaaacccgtaatcctaaaagacggaccagaacgagttatactagccggtccaatgcctgttaccgtcgcgtcggcagctcaaagacgcggccgaattgggagaaatcaaaacaaagaaggcgatcaatatgtgtatatgggacaacctctgaacaacgatgaagatcacgctcactggactgaggctaaaatgttgttagacaatataaacacacccgaagggatcatacctgccttattcgagccagaacgagaaaaatcagcggccatagatggcgagtatagactcaggggagaggctaggaaaacattcgtggaacttatgcgccgtggagatctaccagtctggctatcatacaaagttgcctctgagggttttcagtattctgatcgaaggtggtgctttgatggagagagaaataaccaggtattagaggaaaatatggatgttgaaatctggacaaaagaaggagagaggaagaagttacgccctcgatggctagatgcgagaacatattcagatcccttggcattacgagaatttaaagaatttgctgcgggccgtcgcagtgtttcaggcgaccttatcctggagattggtaaattgccccaacatctaactttacgagcccagaatgcattagataacttagtaatgttacataatagcgaacagggaggaaaagcgtatagacacgccatggaggaacttccggatacaattgaaacgttaatgcttctagcactaattgccgttttaaccggaggcgtcacactattctttttatctggtaagggactcggaaaaacttctataggactactttgtgttatggcttcgtcggcattactctggatggcatcagtcgaaccgcattggattgcagcaagcataattttagagttctttctaatggtactgcttatacctgagccagatcgtcaacgcactccacaagataaccaactcgcttatgtagtgattggtttactctttatgatcttaaccgttgcagccaatgagatggggctgctagaaactacaaagaaagacttggggatagggcatgtcgctgcggaaaatcaccatcatgcgaccatgttagacgttgacttgcgtcccgcgtcagcttggacactatacgcagtggcaacaacggtaataacaccaatgatgcgtcatacgatagaaaataccacagcaaacattagcctaacagctatagcaaaccaagcggcaattctgatgggtctagataaaggatggcctatatccaaaatggatataggggtacctttattagcccttggatgttactcacaggtaaacccattaaccctaacagcagccgtcttaatgctagttgctcattatgctattatagggcctggtcttcaggcaaaagccacaagggaggcacaaaaacgaacagcagccggaataatgaaaaatccaactgttgacggtatagtagcaatagacctagatccagtagtttatgacgcaaaatttgaaaaacagttgggacagataatgctattaatactctgcacctcacagatattattgatgcgaaccacgtgggcgctctgcgaatccattacattagccacaggtcctctaacaactctctgggagggatccccaggaaagttttggaacactactatagcggtatctatggcaaacattttcagaggttcataccttgcaggagcaggtttagcattttcattaatgaaatccttgggaggcggaaggcgcggaacaggagcgcagggcgaaacgctcggtgaaaagtggaaacgacaacttaatcaattaagtaagtcagaatttaacacttataaaagatcaggaataatggaagtagatcgaagcgaagcaaaagaaggcctcaaaagaggcgaaacaacaaagcacgctgtttcaagggggacagcaaagttgagatggtttgtagaaagaaacttggttaagcctgaaggaaaagttatagatcttggctgtgggagaggaggatggtcctactactgcgcaggattaaagaaagtcacggaagtaaaaggttatacaaaaggcgggccgggtcatgaagaacctattcctatggctacgtatgggtggaatctcgttaaactacactctggaaaagacgtattctttatacctccagaaaaatgtgacaccttattatgtgacattggagaatcatcgcccaatcctacaattgaagagggccgaacactaagagtgctgaaaatggtggaaccctggttaaaaggaaatcaattttgtatcaaaatattgaacccatatatgccatcggtagtcgaaactctcgaacagatgcagaggaaacacggcggtatgttagtcaggaatccgctctcacgtaatagtacacacgaaatgtattgggtctcgtgtggcacgggaaatatagtgagcgctgtaaacatgactagcagaatgcttctcaataggtttacaatggcccataggaaaccaacgtacgaaagagatgttgatcttggcgctggaacccgtcacgtagccgtagaaccagaagtggcaaatctggatatcataggtcagagaattgagaatatcaaaaacgaacacaaatccacgtggcattacgacgaggacaacccctacaaaacctgggcatatcatggaagttatgaagttaagccgagtggatcagcatccagcatggtaaacggagtagtgaggctactaaccaagccatgggatgttataccgatggtgactcagatagctatgacggacaccacaccattcggtcagcaaagggtatttaaagaaaaagttgatacacgcaccccaagggcaaaacggggtactgcacaaattatggaggtcaccgctaaatggctgtggggattcctcagtcgaaataaaaagccacggatctgcacaagagaggaatttacacgcaaagtaagaagcaacgcggcgataggtgctgtgtttgtagatgaaaaccaatggaactcagctaaagaagcggttgaggacgaacgattctgggatttagtccaccgagagagagagttgcacaaacaaggtaagtgcgcaacatgtgtatataatatgatgggcaaaagagagaagaaactcggagaatttgggaaagcaaaaggatcaagagccatatggtacatgtggctgggcgcacgatttttagagttcgaagccctaggttttatgaacgaggaccattggttctcccgagaaaatagtctgtctggcgttgaaggagagggcttacacaaattaggttatatactacgagatataagtaagataccaggaggtaatatgtatgcagatgataccgcagggtgggacacccgaattacagaagatgacttacagaatgaggcaaaaatcacggatataatggaaccagaacacgctttgttggctacagctatttttaaattaacttaccaaaacaaggtggtcagagtccagcgaccggctaaatctggtactgtgatggatgttatatctcgtagagaccaacgaggctcgggacaagtgggaacttacggcctaaatacatttacaaacatggaagcccaactaattaggcaaatggaatcggaaggaatattcctaccatccgagttagaaacaccgaatctggcaaaacgcgttcttgattggttagaaaaatatggcgcagaacgattaaaacgaatggccattagcggagacgattgtgtagtaaagcctatagatgatcgatttgccaaagcattaaccgcgctaaacgacatgggaaaagtacgaaaagacattccccagtgggaaccttctaaaggttggaacgactggcaacaggtacctttctgttctcatcattttcatcagttgatcatgaaagatgggcgagaaatcgtagtaccctgccgcaaccaggatgaactcgtcggaagggcacgtgttagtcaaggagcagggtggtctctcagagaaactgcatgtctcgggaaatcatacgcccaaatgtggcaattgatgtattttcatagaagggatctacgacttgccgctaatgcaatttgtagtgcagttcctgtcgattgggttccgacgagcagaacaacatggtctatacatgcacatcatcaatggatgacaactgaagatatgctatcagtctggaacagagtatggatagaagaaaatccatggatggaagataaaacacacgtttcctcctgggaagaagtaccttatcttggtaaacgcgaagatcaatggtgtggatcacttattggactgacagcaagggcaacatgggctaccaatatccaggtcgcaataaatcaagttagaagactaataggaaacgaaaactatctagattatatggcaagtatgaagagatttaaaaacgaaagcgaccctgaaggtgctttgtggtaa

SEQ ID NO: 22159 - RNA, 9879 nt, synthetic construct
  misc_feature 1..9879: note = derived and/or modified CDS sequence (opt6) from DENV-1__AF311956__SS-prME
  source 1..9879: mol_type = other RNA
tcagtgacgatgttacttatgctacttcccacagctctagcttttcatttaactacacgaggaggggagccacacatgatagtttctaaacaagaaagagggaaatcattactatttaaaacaagcgcaggagtgaatatgtgcactttgatagcaatggacttgggtgaactatgtgaagataccatgacttataaatgccccagaataaccgaagctgaaccagacgacgttgattgttggtgcaatgctacggatacatgggtaacttacggtacctgttctcaaaccggagagcatagaagagataaaagatcagtcgcattagctccccatgttggattaggattagagacaagaactgagacatggatgtcatcagaaggagcgtggaaacaaatacaaaaagttgagacttgggcattacgacatccgggttttactgttatagctctttttctagcccatgcgattggaacatcaatcacacaaaaaggcataatttttatacttcttatgttagtgactccatccatggctatgagatgtgttggtataggaaaccgagatttcgtagaaggtttaagtggggccacctgggtagacgttgtattagagcacggaagctgtgtaaccacaatggctaaaaacaaaccaacattagacattgaactcttaaaaacagaagtaaccaatccagcggtactacgcaaactatgtatagaggctaaaatatcgaatacgacaacagactcgagatgtcccacacaaggagaagcgactttggtagaagaacaagacgccaactttgtatgcaggaggaccttcgtggacagagggtggggaaatgggtgtgggctctttggtaaagggagtttacttacctgtgcaaaattcaaatgtgtaaccaaactcgaaggtaaaattgttcaatacgaaaatttgaaatatagtgttatagttacggtacatacgggcgatcaacaccaagtaggaaatgaaacaactgagcatggaacaattgccaccataaccccacaagcgccaacgagtgaaatacaactaaccgactatggagctctaaccctagattgtagtcctaggactggacttgattttaacgaaatggtcttactgacaatgaaagaaaaatcatggctagtgcacaaacaatggtttctagacttacccctaccgtggacttctggagcctcaacgtcacaggaaacgtggaaccgacaggatttactcgttacttttaaaactgcacatgctaagaaacaagaagtggttgtattagggtcacaggaaggagccatgcatacagcactaaccggagccaccgaaatacagacatctggcactacgactatatttgcaggccacttaaaatgtaggctaaaaatggataaattaaccttgaaaggtacgtcttatgtgatgtgtactgggagttttaaacttgagaaagaggtggccgagacacaacatggaacagttttagttcaagtgaaatatgagggaactgatgcgccctgtaaaataccctttagtacacaggacgagaagggagttacacagaatggaagactgataacagcgaaccccattgtcacagataaagaaaaacccgtgaacatagaaacggaaccgccgtttggtgagagttacattgttgttggggcaggcgaaaaggctttaaaactgagctggttcaaaaaggggtcatcaattggcaaaatgttcgaagctacagcaagaggcgccaggcggatggcaatactaggagatacggcatgggattttgggagtataggaggggtatttacaagtgtgggaaaactcgtacatcaagtttttggaacagcttacggggttctattttcaggagtctcatggacaatgaaaataggcattggaatcttgctaacatggttaggattaaactcacggtcaacaagcctaagtatgacctgtatcgcggtgggaatggtcaccctttatcttggagtcatggtccaagctgactcaggttgtgttatcaattggaagggacgcgaattgaaatgtggttctggaatatttgtaacaaatgaggtacacacatggaccgagcaatataagttccaggccgacagtcccaaacgattgagtgcagcaatcggtagagcttgggaagaaggagtctgcggcataagatctgcaacgcgactagaaaacattatgtggaaacagatttcaaatgaacttaatcatatacttctagaaaacgacataaaatttacggtagtagtaggaaatgcaaatggtatacttgcccaaggcaagaaaatgataagaccacaaccgatggaacataaatactcgtggaaatcttggggaaaagcgaaaataataggggccgatatccagaatacaacctttataattgacggaccagacacacccgagtgtcccgatgaacagagagcatggaacatctgggaagtagaagattatggtttcggaatatttacgacgaacatttggctgaaattaagagattcctacacccagatgtgcgaccatcggcttatgagtgccgcaattaaagatagcaaagctgtccacgccgacatgggttattggattgaaagcgagaagaatgaaacctggaaattagcacgtgcatccttcatagaagtaaaaacatgtatttggccaaaaagccacactttatggtcaaatggcgttttggaatctgagatgataattccaaaaatgtatggagggccaataagtcagcacaattatagacctggatactttactcaaactgcaggaccatggcatctggggaagctagaattggattttgacctatgcgaggggacaacagtagtagttgacgaacactgtggcagtaggggtccaagcctgcgaacgaccactgttacaggaaaaataattcacgaatggtgttgccgatcatgcacattgccaccactccgctttcgcggcgaagatggttgctggtacggcatggaaatacggcccgtaaaagaaaaagaggaaaacctggttcgctcgatggtctcagcgggttctggagaagtagatagttttagcctaggaattttatgcgtatccattatgatagaagaggtcatgagaagcagatggagtcgaaaaatgttaatgacgggtacgctcgccgtcttccttcttctaataatgggacaacttacgtggaatgacttaattcggctatgcattatggtaggggcaaatgccagtgataaaatgggcatgggcaccacatacctggcactaatggccacattcaagatgaggcctatgtttgcagtaggtctattattccgaagactcacaagcagagaagtattactcttgactataggtctttccctcgttgctagtgtggaactacctaactcgcttgaagaactaggagatggattagcaatggggattatgatgttaaaactgctaacggaatttcagcctcatcaactatggacaacgcttctcagtttaacattcattaaaacaacattgtcattagattacgcctggaagacaactgccatggttctaagcatcgtaagtctgtttccattatgcttgtcaacaacatcacagaaaacaacttggctcccggtacttttaggcagcttcggctgtaaacccttgactatgtttctgatcacagaaaatgaaatttggggacgaaaaagctggccacttaacgaggggataatggcgatagggatagttagtatattgttatcttcgttacttaaaaatgatgtacccttagccgggcccctgatagccggcggaatgctaatcgcctgctatgttatatcaggctcatctgcagatcttagcttggagaaagcagcggaagtatcatgggaagaggaagcagaacattcaggtacaagtcacaatatattagtcgaagttcaagatgatggaacaatgaaaataaaggatgaagaacgggatgacactttgacaattctacttaaagcaacattactggcggtatctggcgtatatccaatgtctattcccgccacactctttgtatggtatttttggcagaagaagaaacaacgatctggagttctatgggacacgccgtctcctcctgaagtggaacgagctgttttggacgatggaatttatcgtatccttcaaaggggattattaggtagaagccaagtaggagttggcgtctttcaagacggcgtctttcacacaatgtggcacgttactagaggtgcagttttaatgtatcaaggaaaaagacttgaaccgtcatgggcctctgtcaagaaagatttaatatcctatgggggaggttggcgcttccaaggaagctggaatacaggcgaagaagtgcaagtaatagcagtagaaccaggaaagaatcccaaaaatgtacagactacgcctggcactttcaaaacaccagaaggggaagttggagcgattgctctggattttaagccaggcacatccggatcccctatagttaatcgagaaggtaagatagtaggattatacggtaatggagtagtaacaacttcaggcacctatgtctcagcaatagctcaagcaaaggccagtcaagaagggcctcttccagaaatagaagacgaagttttcaaaaagagaaatctcacaataatggacctacacccgggttccgggaaaacaagacgatacctacctgctatcgtaagagaggcaattaagcgaaaattaaggaccctaatccttgcccctaccagagttgtcgccagtgaaatggccgaagcgctcaaaggtatgcccattaggtaccaaacaacagccgtcaaatcagagcatactggccgagagatagttgacttaatgtgtcacgcaacattcacgatgaggctgctatctccagtaagggtgccaaactacaacatgataatcatggatgaagcgcatttcactgatcctgcaagcatcgcagcgagagggtatatatcgacacgcgttggtatgggggaagcggcagccatctttatgactgcaacgccccctggttcagtagaggctttcccgcaatctaacgctgtaatacaagatgaagaacgtgatataccggaacgatcgtggaacagcggatatgattggataaccgatttcccaggaaaaaccgtttggtttgttccgtcaattaaatcaggaaatgatatagcgaactgcctaaggaaaaacgggaagagagttatacaacttagccgaaaaacgttcgacacagaataccaaaagaccaaaaacaatgattgggattatgtcgtaactaccgatattagtgaaatgggagctaactttagagccgacagagtgatagatccacggagatgtcttaaacctgtcatcctaaaagacggcccagaacgagttattcttgccggaccaatgccagtcacggttgcatccgcagcacagagacgtgggagaattggacgcaaccaaaacaaagaaggtgatcaatatgtatatatgggtcagcctcttaacaacgatgaagatcacgctcattggacagaagccaagatgctactagacaacattaatacacctgaaggaataatcccggcactgtttgagccggaaagagaaaaatcagcagctatcgatggcgagtacagactgaggggtgaagcaaggaagacatttgtggaactaatgcgtaggggcgacttaccggtctggctatcttacaaggtcgcctccgagggattccaatactcagacagacgctggtgcttcgatggtgaacgtaacaatcaggtgcttgaggaaaatatggacgtagaaatatggactaaagaaggagaaaggaagaaattaagaccccgatggttggatgcccgtacctattcggatcctttggccttacgggaatttaaagaatttgcggcaggcaggagatcagtatcaggtgacttaatcctggaaattggcaaactccctcagcatttaacgttgcgagcgcaaaatgccttggataatctggtaatgttgcataatagtgaacagggcgggaaagcatacagacacgcgatggaggaactacccgatacaatagagaccctaatgttattagctctaatagctgtactgacaggtggagtgacactattctttctgtcaggaaaaggcctagggaagacatctatcggactactttgcgtgacagcgagcagtgcacttctttggatggccagtgtcgagcctcattggatagcagcatctataattctagaatttttcctcatggtattacttataccagaacctgatagacaaagaacaccgcaggacaatcaattagcctacgtagttataggcctgctgttcatgatacttacggtcgcggcgaacgaaatgggattattagagactaccaagaaagacttaggaatagggcatgtggcagcagaaaatcatcaacatgcaacgatcttggatgtcgaccttcaccccgcaagtgcctggacactttacgcagtagctaccaccgtaatcacacctatgatgagacacacaatcgaaaatactaccgcgaacatcagcttaaccgccatagcgaaccaagcagccattttaatgggactagataaggggtggcctatctcaaaaatggaccttggtgtccctctactagcgcttggctgttatagtcaagtcaaccccttaaccttaactgcggcagttttaatgttggtcgcccactatgcaattataggtcctgggttacaagcaaaagctacccgtgaagctcaaaagcgaaccgcagctggaataatgaaaaatccaactgtagacggcattgtcgcgatagatctggatccagttgtctatgatgcaaaatttgaaaaacaactggggcagataatgctcttaattctatgtacatctcagatattacttatgaggactacatgggcactttgcgagtctattacactggctacaggccccttaacaacactttgggaaggcagccctgggaaattctggaacactacaatagcggtatcaatggccaacatatttagaggctcgtacttagccggtgctggacttgcctttagtctaatgaagagtttaggtggaggcaggagagggacaggagcacaaggagagactctcggcgaaaaatggaaaagacagttaaaccaattaagtaaaagcgaatttaacacttacaaacgttctggtataatggaagtagatcgctccgaagcaaaagaagggttaaaaagaggggaaactaccaaacacgcggtatcccgaggaaccgctaaacttagatggtttgtagagagaaatttagtaaaacctgaaggaaaggttatagacctaggttgtggtcgcggaggatggagctactattgcgcagggcttaagaaagtcacagaagtaaagggctatacaaaaggtggtcctggacatgaggaaccgattcccatggcaacctatggctggaatctggtaaaacttcatagtggtaaagatgtattctttatgccacccgagaaatgcgacacactactttgtgatattggtgaaagttcaccaaacccaactatagaagaagggagaacactcagagtattaaaaatggtggaaccatggcttaggggaaatcaattttgtataaaaatacttaatccctatatgccatcagtagtagaaaccctagaacaaatgcaaagaaaacacgggggtatgctcgttcgaaatccattaagtcgtaatagcactcatgagatgtactgggtctcatgtggaaccggcaacattgtgagcgctgttaacatgacatcgcgtatgttgcttaaccgttttacaatggcgcaccggaaacctacatatgaaagagacgttgatcttggggcagggactagacatgttgcagtcgaacctgaggtagctaacttagatataattggacagcgaatcgagaacatcaaaaacgagcataaatctacatggcattatgatgaagataatccatataaaacgtgggcatatcacggatcttacgaagttaagcccagtggatcagcatcatccatggtcaatggagtagtaaggttactaacgaaaccatgggatgtaatcccaatggtaacacaaatcgcaatgaccgacactacacccttcggtcaacaaagagtctttaaagaaaaagtggacacaagaacaccccgggcgaaacgaggcacagctcaaataatggaagtaactgccaaatggctttggggatttttatcaagaaacaagaagcctcgtatatgtacacgagaagaatttaccagaaaagtaagaagtaatgctgctattggagctgtttttgttgatgagaatcaatggaacagtgcaaaagaggcagttgaggatgaacgtttctgggacctagtacaccgcgaacgagaactccataaacaaggtaaatgtgccacctgtgtgtataatatgatgggaaaacgtgagaagaaattgggtgaatttggaaaagccaagggatccagggctatttggtacatgtggttaggggccagatttctggagttcgaagcgctaggatttatgaatgaagaccactggttttcaagagaaaattcgctgagcggagtcgaaggtgaagggctacataagttaggttatatcttaagggatatatccaaaataccaggagggaatatgtatgctgatgacactgcgggatgggacacacgaattactgaagatgacctacagaacgaagcaaaaattacagatatcatggaaccagaacatgcacttctggctacctctatatttaaattaacgtatcagaataaggtagtcagagttcaaaggcccgcgaaaaacgggactgtcatggatgtaattagtcggagggatcaacgtggatcaggacaagtaggtacatatggattaaatacgtttacgaatatggaagttcaactcatcagacaaatggaaagtgagggtatcttctttccgagtgaactggaaagtccaaacctcgccgaaagagtattggattggctagaaaaacatggagccgaaagacttaaacgaatggcaatttctggggatgattgcgttgtcaagccaattgacgatcgattcgccacagcacttattgctttaaacgatatgggaaaagtaagaaaagatattcctcaatgggagccaagtaagggatggaatgactggcaacaagtaccattctgttcacaccatttccaccaattaattatgaaggatggccgagaaatcgtagtcccctgccgaaatcaagacgaattagtaggccgggcacgagtgtcacaaggagctgggtggagcctaagagaaacagcatgtttaggaaaatcttatgcacaaatgtggcaacttatgtattttcataggagagaccttagactggcggcgaatgccatatgttctgctgtcccagtggactgggtacctacaagcagaacaacctggagcattcatgcgcaccaccaatggatgactacagaagatatgttgtctgtgtggaacagagtctggatagaagaaaatccatggatggaagacaaaactcatgtcagctcctgggaagaagttccgtacctaggaaagagagaagatcaatggtgtggtagtcttataggtttaacagcccgcgccacttgggctacaaacatacaagtcgctatcaatcaagttaggcggttaattgggaatgaaaattatttggactacatgacaagtatgaagaggtttaagaatgaaagtgatcccgaaggagcattgtggtga

SEQ ID NO: 22160 - RNA, 9879 nt, synthetic construct
  misc_feature 1..9879: note = derived and/or modified CDS sequence (opt6) from DENV-1__AF311958__SS-prME
  source 1..9879: mol_type = other RNA
agtgttactatgctcttaatgctactacccacggcgcttgcatttcatctaactacacgaggtggtgaaccccatatgatagtaagtaaacaagaacgaggtaaatcattgttatttaaaaccagcgctggcgtaaatatgtgtacgttaatagctatggatttgggtgaattatgcgaggacacgatgacgtacaaatgcccgcgaattacggaagcagaaccagatgatgttgattgctggtgtaatgctacggatacttgggtaacttacggaacttgttcccaaacgggagaacatagaagagataaaagaagtgtagccttagcaccacatgttggtctaggtcttgaaacaaggactgaaacatggatgtcttcagaaggagcttggaaacaaattcaaaaagtagaaacttgggcattgcgccaccctggctttaccgttatagctctctttctagcacatgccataggaacaagtattactcaaaaagggataatctttatcctactaatgttagtaacgccgagcatggcaatgcggtgtgtaggaattggtaatagagattttgtcgaaggtctgtcaggcgcaacctgggtggatgtagtactagaacacggaagttgcgttactacaatggccaaaaataaaccgacccttgacatagagttgttaaaaaccgaagttactaacccggctgtattaaggaaattatgcatagaagctaaaatatcaaatacgacgaccgactcaagatgtccgacccaaggcgaagcaaccttagtagaagaacaagatgctaatttcgtatgccgtcgcacatttgtagatcgagggtggggtaacggttgcggattatttggaaaaggttcattactcacatgtgccaaatttaagtgtgtaacgaagctagaaggaaaaatagtgcagtacgaaaatttaaaatattcggtgattgtaacagttcatacgggagatcaacatcaagtaggaaacgagacgactgaacatgggacaatagctacgattacacctcaagccccaactagcgaaatccaattaactgactacggcacgctaacattagattgctcacccagaactggcttagactttaacgagatggtactcttaaccatgaaggagaaatcctggttggtccataagcaatggtttttagatttacctttaccatggacttctggagcatcaacgtcgcaagaaacctggaatagacaggatcttctagtaacgttcaaaacagcccacgcaaagaaacaagaagttgtcgtactagggtctcaggaaggagcgatgcatacagcattaacaggcgcaaccgagattcagacaagtggaactacaacgattttcgccggacacctaaaatgcagattaaagatggacaaactcacattgaaaggtacatcgtatgttatgtgcaccggctcattcaaacttgaaaaggaagttgctgaaacacagcacggaaccgttctcgttcaagtgaaatacgaaggcacagatgcgccgtgtaaaataccattttccacccaggacgaaaaaggagttacacaaaatggacgtttaataaccgccaacccaattgtaactgacaaagaaaaaccagttaatattgagaccgaaccgccattcggagaatcatatattgtcgtaggggccggagaaaaggcgctgaaactaagctggtttaagaaaggaagctcaattggaaaaatgttcgaggcgacagcaaggggcgctcgacgaatggctatattaggcgatacagcctgggacttcggctccataggaggggtattcacaagcgtaggcaagctagtacatcaggtgttcggtaccgcgtatggggtactcttcagcggagtttcctggaccatgaaaataggaatcggcattttattaacatggcttggcttgaacagccgttcaacaagcctcagtatgacttgcattgcagtgggcatggtgacactatacttaggtgtaatggtgcaagcagatagtggatgcgttatcaactggaagggacgtgaactaaaatgcggtagcggtatattcgtaacaaacgaagtgcacacatggactgaacaatataaattccaggcagacagtccaaaaagactttcagcggcaatagggagagcgtgggaagagggagtttgcggaatccgttcagcgacaagactagagaacataatgtggaagcaaataagtaatgagctcaatcatatattgctagaaaacgacataaaatttacagttgtagttggcaacgcaaacgggatactggcacagggtaagaaaatgatacgccctcaacccatggagcataaatacagttggaaatcatggggaaaagctaaaataataggagctgatatccaaaatacaaccttcataatcgacggacccgataccccagagtgccccgatgaacaacgcgcttggaatatatgggaagtggaggattatggcttcgggatatttacgaccaacatatggttaaagctgagggactcgtacacgcaaatgtgtgatcatcggctcatgtctgctgccataaaggattccaaagcagtacatgccgatatgggatactggattgaaagtgagaaaaacgagacctggaagctggcccgtgcgtctttcatagaagtaaagacttgcatctggccaaaaagccacacattatggagcaatggcgtgctagaaagcgaaatgatcattccaaagatgtatggtggaccaattagccaacataattatcggcctgggtactttactcaaactgctggcccttggcaccttggaaaacttgaactagattttgatttgtgcgaaggcacaaccgttgtagtcgacgaacattgtggtagtcgaggaccctccttaagaactactaccgtgacgggtaagatcatacacgagtggtgctgtcggtcatgcacactgcccccactaaggttccgcggagaagacggctgttggtatggaatggagataaggcccgtaaaagaaaaagaagaaaacctggtgcgctcaatggtttcggcaggatccggtgaggtggattcgttttcactagggatcctatgtgtcagcataatgattgaggaagttatgaggtctaggtggtcgagaaaaatgttaatgactggaacattggccgtattcctactcttaataatgggacaactgacttggaatgacctcatacgtctatgtattatggtcggagcgaacgctagtgacaaaatgggtatgggtacaacatacctggccttaatggccactttcaagatgcgtcccatgtttgcagtcggcttactgtttagaagactaacttctcgagaggttttattactcacaataggccttagcttagttgcaagtgtggaactgcccaactcgctagaagaacttggagatggattagcaatgggtattatgatgttaaagttattaaccgaatttcaaccacaccaactctggacaaccctcttaagcctaacttttattaaaacaacattgagtcttgattatgcatggaagactaccgcaatggtactcagtatagtgagtctatttccgttgtgtcttagtacaacttcacagaagacaacatggttacccgtactactaggatcattcggatgcaaacctttaacaatgttcctaattacagagtacgaaatatggggtcgtaaaagctggccacttaacgaagggataatggcaatcggaatagtcagtattttactaagctcacttcttaaaaacgacgttccgctagccggtccactaatcgctggcggtatgcttatagcatgctatgtcatcagcggctcgtcggctgatttaagcctagagaaagcagcagaagtaagctgggaagaagaagcagagcactccggtacaagtcacaacatactcgtagaagtccaagatgatggaacaatgaagataaaggatgaagaacgcgacgatactctcaccatactattaaaagccaccttattagctgtatcaggagtatatcctatgtcaatcccagcaactttgttcgtatggtatttttggcaaaagaagaaacaaagaagtggagtattgtgggatacccccagccctcctgaggtggaaagagcagtactagacgatggaatttacaggatacttcagagaggcctcctaggtagatcacaagtgggggtaggtgtatttcaggatggagtcttccacaccatgtggcacgtaacaagaggcgccgtgttgatgtatcaaggtaaacgtcttgaaccatcgtgggcgagtgtcaagaaagatctaatatcttatgggggaggctggagatttcaggggtcctggaatacaggggaggaagtacaagtgattgccgtggaacctgggaaaaatcccaaaaatgtccaaacaacccccggaacgtttaaaacgcctgagggcgaagttggagccatagctttagatttcaagccaggaacatccgggagtccaattgttaatcgtgaaggtaagattgtagggctttatggaaatggcgtggtcactacttcaggtacttacgtgtctgcaattgcccaagcaaaggcaagtcaagaggaaccattacctgaaatcgaggacgaagtttttaagaaaagaaaccttaccataatggatctccacccaggaagcggaaaaactcgtcggtacctccccgctattgttcgtgaggctattaaaaggaaattacggactttaatcttagcaccaactcgagtcgtcgcatcagaaatggctgaagctctcaagggcatgcccattagatatcaaactaccgcagtgaaaagcgagcatactgggcgagagattgttgatttaatgtgtcatgcaacattcacgatgcgtttgttatcaccagtcagggttcccaactataatatgattataatggacgaagcacatttcactgacccagcatctatagctgcaagaggatacatcagtacacgcgttggaatgggggaagccgcggcaatattcatgactgctaccccgcctggttctgttgaagccttcccccagtccaatgctgttatacaagatgaagaacgagatattcctgaaaggtcttggaactcaggatacgactggataactgacttcccgggcaaaacggtttggttcgtaccctcaatcaagtccgggaatgatatagcgaattgcttacggaaaaacggcaaaagagtcatacaattaagtcggaaaacgtttgacacagaataccagaaaactaagaacaacgactgggattatgtcgtgacaaccgacatcagcgaaatgggagcaaattttagagctgatagagtcatagacccccgacgttgcctaaaacccgttatcctgaaagacggacccgaaagagtgatcctagccggccccatgcctgtaactgtagcaagtgcggcgcaacgaagaggacgaattggaaggaaccagaataaagagggagatcaatacgtgtacatgggacagccgttaaataatgacgaagatcatgctcattggacggaagcaaaaatgctgttagataatattaatacacccgaaggaataatacctgcgttattcgagccagaaagggagaagtctgcagctatagatggtgaatatcgattgcgtggagaagcgcgaaaaacatttgtagaattaatgcgtagaggcgatcttccggtatggctaagctacaaagttgcatccgaaggattccaatattcggacaggaggtggtgttttgatggggaaagaaacaatcaagtccttgaggagaacatggatgtagaaatctggacaaaagaaggagaaaggaagaagctacgccctagatggcttgatgcaagaacctacagtgatccattagcactaagggaatttaaagaatttgccgcgggccgcagaagtgtctccggagacttaatacttgaaatcggcaaattgccacagcatctgacattgagggctcagaatgctcttgacaatttagttatgttgcataactcagaacaaggaggtaaggcttaccgacacgccatggaagaactcccggataccatcgagactttaatgttattggcattaatagcggtgctaacaggcggtgtaactttattctttttgtctgggaagggcctggggaagacatcaataggtttactctgtgtcacggcatcatccgcactattatggatggctagtgtcgaacctcactggatcgctgcgtctataatattggagttctttctaatggtcttattaattccagaaccagacagacagagaacccctcaagataaccaactagcttatgtcgtcatcggactactatttatgattctaacggtcgcagcaaatgaaatgggcttactagaaacgacaaagaaagatcttggtatagggcacgttgcagccgaaaatcatcaacacgccacaatgcttgacgttgacctgcacccagcgagcgcctggactttatatgcagtggctaccaccgtaattacacccatgatgaggcacacgattgaaaatactacagcaaacattagtctgactgcaatagccaatcaggcagcaattctcatgggtttagacaagggttggcctatatccaagatggatctaggtgttcccttattagcactaggttgctatagtcaagtaaatccacttacactaacagcagctgtgcttatgctagtagcgcactatgcaataataggccccggattacaagctaaagcaacaagagaagcgcagaaaagaacggccgctggaataatgaaaaacccaacagttgatggcatagttgcaattgatctcgatccagtagtatacgatgctaaatttgaaaaacaattaggacaaattatgttactaatattatgtacaagtcaaatactgctgatgcgtaccacttgggcattatgcgaatctattaccctagctacaggcccactcacaactctatgggaaggatcacccggaaagttctggaatactacaattgccgtatccatggcaaatattttcagaggatcatatctagcaggcgctggattagctttcagtttaatgaagtcactagggggaggaagacgcggtacaggcgctcaaggagaaacattaggtgaaaaatggaagcgacagttaaaccagctgtctaaatccgaatttaatacctataagagatctggtatcatggaagtagaccgttcggaagcgaaagaaggccttaaacgcggagaaactactaaacatgcggtatcacgaggcgcggctaaattgagatggttcgtggaacggaatcttgtgaagccagagggtaaagttatcgacctaggttgtggcaggggaggttggtcatattattgcgccggactcaagaaagtaactgaagtaaaggggtatacaaaagggggaccaggccatgaagaaccaataccaatggcaacttacgggtggaaccttgtgaagttgcactcaggtaaagatgtattctttatgccaccagaaaaatgcgatactttgctttgcgacatcggagaatcaagtcccaaccctactatagaagagggaagaacgttacgagtgttaaagatggttgaaccttggttaagaggaaatcaattttgtattaaaatattaaatccctatatgccaagcgtagtagaaactctggaacagatgcagcgcaaacacggaggtatgttagtccggaatccgctatcgcggaatagtacacatgaaatgtattgggtcagctgtggaactggaaacatagtttcggctgttaatatgacatcaagaatgttgctaaaccggttcactatggcccatagaaagccaacgtatgaacgcgatgtcgatttgggtgcaggtacaagacatgtggccgtcgaaccagaggttgcaaacttagacataataggacaaagaattgaaaatatcaaaaatgaacataaatcaacctggcactatgatgaagataatccttacaaaacttgggcataccatggatcttatgaagtaaaaccttctggttcagcaagttcaatggtaaatggagtcgtaagattattaaccaaaccatgggacgtgattcccatggtcacacaaattgcaatgactgatactacaccctttggacaacaaagagtattcaaggaaaaagtagacaccagaacgccaagggccaaaaggggtacagcacaaatcatggaggttacagcaaaatggttatggggctttttatcacgtaacaagaagccgagaatttgtacaagagaagaatttacgaggaaagttagaagcaacgcagccattggggcagtatttgtagatgaaaatcaatggaactcagccaaagaggcagtagaagacgaaagattttgggatctagtacatagagaaagagagttgcacaaacaaggaaagtgcgccacatgtgtctataatatgatgggaaagagagagaagaaactaggagaatttggcaaagccaagggatctagagcaatttggtacatgtggctaggggcacgttttctagagttcgaggctttaggtttcatgaatgaagatcactggttctcacgggaaaattccctgtctggtgtagaaggggaaggattacataaactaggttatatactaagggacatcagtaaaatacccggcggcaacatgtacgcagatgataccgcgggttgggatactaggatcactgaagatgatctacagaatgaggccaaaataacggacataatggaaccagaacatgctctcctggctacgtccatatttaagctaacttaccaaaacaaggtagttcgagttcaacgcccagcgaagaacggaacagtcatggatgtaatctcaagaagagaccaacgtgggtctggtcaggtaggtacatatggcctcaacacctttacaaacatggaggtgcaattaatacgtcaaatggaatctgaaggaatattctttccttcagaattagaatcgccaaacctcgctgagcgagtactggattggttagagaaacacggagctgaacgattaaaaagaatggctatttcaggtgatgattgtgtcgtgaagcctatcgatgataggtttgcaacagcacttatcgccctaaatgatatgggtaaggtcagaaaagatattccccaatgggaaccatccaaagggtggaatgattggcaacaagttcccttttgctctcaccatttccaccagttgattatgaaagatggtcgggaaatagtggtaccctgtcgtaaccaagacgaattagtgggaagggcgagagtgagtcaaggagccggatggtccctaagagaaaccgcgtgtctcggtaaaagttacgcccaaatgtggcaacttatgtatttccacagacgggatttaagactagcagcaaacgctatctgtagtgccgtgcctgtagattgggttcccacgtcgcgaacaacttggtctatacatgcgcatcatcagtggatgaccactgaagacatgctatcggtatggaatagggtttggattgaagaaaatccctggatggaagataaaactcacgtatcttcctgggaagaagttccatatctaggaaaacgcgaagatcagtggtgcggatcactaatcgggctaacagctagagccacctgggcaaccaacatccaagtcgcgataaaccaggtcagaagactaataggaaacgaaaattacttagattacatgacaagtatgaaaagatttaaaaacgaatccgacccagagggggcactatggtaa

SEQ ID NO: 22161 - RNA, 9879 nt, synthetic construct
  misc_feature 1..9879: note = derived and/or modified CDS sequence (opt6) from DENV-1__AF311957__SS-prME
  source 1..9879: mol_type = other RNA
tccgtcacgatgttactaatgctacttcccactgcattagctttccacctgacgacacgaggaggtgaaccgcatatgatagtgtctaaacaagaacgcggcaaaagtctactattcaaaacctctgccggtgtgaacatgtgcacgttaatagcaatggacttaggcgaattatgtgaagatacaatgacatataaatgtccacgaatcactgaagcagaacccgatgatgtagattgctggtgtaacgcgacagatacctgggtgacctacgggacatgtagccaaacaggagaacatcgacgggacaaacgatcagtggcacttgcgccccacgtagggctagggctagaaacaagaacggaaacatggatgtcatcagagggagcatggaaacaaattcaaaaagttgaaacatgggcactccgacatccagggtttactgtgatagccttattcctagcgcatgcgatcggaacttcaatcacgcaaaaagggataatatttattctcctaatgcttgttactccaagtatggcaatgagatgcgtaggaataggtaacagagacttcgtcgaaggactttctggagccacatgggtagatgtcgtgttagaacatggctcgtgcgtgacaacaatggccaaaaataagccaaccctcgacattgaacttttaaaaacagaagtaaccaatcctgcagttttaaggaaactttgcatcgaagccaaaatcagcaatacaacgacagactcacggtgtccaacacaaggtgaagcaactcttgtcgaagaacaagatgctaattttgtatgtagaagaacgtttgtagataggggatgggggaacggctgcggactattcggtaaggggagtctgctaacgtgtgctaagtttaaatgtgtcacgaaactagaaggcaagatagtacaatatgaaaatctcaaatatagcgtaattgttaccgtccatacaggagaccaacatcaagttggaaatgaaaccacggaacacggtacaatagccactataacaccgcaagcaccgacaagtgaaatacaactaacggattatggagcattgactttggactgctctcctcgaacgggtttagacttcaacgaaatggtactactaacgatgaaagaaaaatcttggttggtgcacaaacaatggtttctagacctacccttaccgtggacaagcggtgcatcaactagccaagaaacttggaatagacaagacctattagtcacatttaaaacagctcatgcaaagaagcaggaagtagtagtattgggctctcaagaaggcgccatgcacaccgctctaacgggggcaactgaaatacaaactagcggtaccacaacaatattcgcagggcatctgaagtgtcggttaaaaatggacaaacttacgcttaagggtacctcatatgtaatgtgtacaggcagctttaaattggaaaaagaagttgcagaaactcaacatggaactgtcctggtacaggtaaaatatgagggtacagacgctccgtgtaaaataccattttccacacaggacgagaaaggagtaacacaaaatggtaggttaataactgccaacccgatagttaccgacaaagaaaaaccagtcaacatcgagacggaaccaccttttggagagagctacatagttgtgggagcgggtgagaaagcgctgaagctatcgtggttcaaaaaggggtcgagcattggtaagatgttcgaagcgacagctcgaggcgccaggaggatggcaatacttggcgacaccgcttgggactttggttcaatcggaggtgtgttcacaagcgttggaaaacttgtccaccaagtttttggaaccgcctatggagtactgttctctggtgtctcttggacaatgaaaatagggattggtattctgctaacatggctaggattaaacagcaggagcacatccctttcaatgacgtgtattgcagttggaatggttacactgtatttgggagtgatggtgcaagcagacagcggttgcgtaataaactggaagggccgagaattaaaatgcggtagtggaatttttgtaacgaatgaagtacacacttggacagagcaatataaatttcaagctgatagtccaaaacgtctgtcagctgcaataggaagggcgtgggaggagggtgtttgtggcatacgatcagcaacaagattggaaaatataatgtggaagcaaataagtaatgaattgaaccacatcctcctggaaaatgatataaaatttacagttgtcgttggtaacgcaaatggcatcttagcacaaggtaaaaagatgataagacctcaaccgatggagcataaatacagttggaaaagttggggcaaagcaaaaattataggagctgacatccagaacacgacattcatcatcgacggacctgacacacccgaatgtcccgacgaacaacgtgcgtggaatatatgggaagttgaagactatggattcgggatatttactacgaatatatggttaaagttacgggattcatatactcaaatgtgcgaccacagactaatgagcgcagcgataaaagactctaaagctgtacacgctgacatgggatattggatcgaaagcgagaaaaacgaaacttggaaactagctagggcctctttcatagaagtaaaaacatgtatatggccaaagtctcacacattgtggtctaatggtgtgctagaaagtgaaatgatcataccaaaaatgtacggaggtccgattagccaacataattatagaccaggatacttcacccaaacagcgggaccatggcacctggggaaattagaactcgattttgatctctgtgaaggtacaactgttgtcgttgacgagcattgtggctccaggggaccgagtttacgaacaaccacggtaacgggaaaaatcattcatgaatggtgttgtaggagttgtactctaccaccgctaaggtttagaggagaggatggttgctggtacgggatggaaattagaccagtgaaagaaaaagaggaaaacctcgttagatctatggtgtcagccgggagtggagaagtagattctttttcgctaggaatactgtgtgttagtatcatgatagaagaagtaatgagatcaagatggtcacggaagatgctcatgactggaacactagcggtgtttttgctactaattatgggacaactcacatggaatgacctaattagattatgtataatggtgggcgcaaacgcaagtgataagatgggtatgggtacaacttacctagcgttgatggcaacattcaaaatgagacccatgttcgctgttggccttttgtttagaaggctaacaagccgcgaagttttgttactgacaattggtctatctttagtagcatcagtagaattaccaaattctttagaagagttaggagacggtttggccatgggaattatgatgctaaaactacttactgaatttcaaccccatcagctttggacgacgttgctatctttgacttttattaaaacgactttaagtctagattacgcatggaaaactactgccacagtattgagcatagttagtctattccccttatgtctcagtaccacatcacagaaaaccacatggctccctgtacttctaggcagttttggatgcaaacctctaaccatgtttctcattacagaaaatgaaatatggggacggaaatcatggcctctgaatgagggtattatggctatcgggattgtatcaatattgttaagtagcctactcaaaaacgatgtcccattagctggtcctttgatagcaggaggaatgttaatagcatgctacgttatatcaggctctagtgctgatttgagcctagaaaaagccgccgaggtgtcatgggaagaggaggctgaacattccggaacgtctcataatattctggtcgaagtacaagatgatggaacaatgaaaataaaggacgaggaacgcgatgacaccttaacaattcttttgaaggcaacgctactcgcagtaagtggagtgtatcctatgagcataccggcaacactattcgtctggtacttttggcagaagaagaaacaaagaagcggggttctatgggacacaccaagcccacctgaggtggaacgagcggtactagatgacggcatttataggattctacagcggggactacttggtagatcccaagtgggtgtcggggtgtttcaagacggggtatttcacacgatgtggcacgttacgagaggagccgtattaatgtaccaaggaaaaagattggaaccaagctgggcaagcgttaagaaagatctaatttcttatggtggagggtggaggttccaaggcagttggaacacaggtgaagaggtacaagtaattgcagttgagccaggtaaaaatcctaaaaacgtacaaaccacaccaggtacatttaaaacaccagaaggagaagttggcgcgattgcgcttgattttaaacctggaacttcagggtcaccaatagtaaatagggaaggaaaaatagtaggtctttatggaaatggagtagttaccacgtcaggaacatacgtttccgctattgcacaagcgaaagcgtcacaagaaggcccgttacctgaaattgaagacgaagtgttcaagaaaagaaacttgacaataatggatctacatccaggtagtggcaaaactcgaagatatttacctgctattgtaagagaagctataaaaagaaagctccgtacattaattttagctccaacacgtgttgtagcatccgaaatggctgaggcactaaaaggaatgccgatacgatatcaaactacagcggtaaaaagtgagcatacaggcagagaaatagtagaccttatgtgtcatgcgaccttcacaatgcgacttttgagcccagtacgggtgccaaactacaacatgataatcatggatgaagcacattttacagacccggcatccatcgctgcaagaggctacatcagcacaagagtgggtatgggagaggctgcagcaatatttatgaccgcaacaccgccgggttcagtagaggctttcccgcaatccaacgctgtaatacaagatgaggaaagagatataccagaaaggagctggaactcgggttatgattggattacagattttccgggaaaaaccgtttggttcgtgccaagtatcaagtctggaaacgatatagctaattgtttacggaaaaacggcaaaagagttatacaactctcacgaaagacattcgatactgagtatcagaaaactaaaaacaatgactgggattatgtggtaacaaccgatataagtgagatgggtgcaaattttagggcggatagagttatagatccacgacggtgtctcaaaccagtaatacttaaagatggcccagaaagagttatactcgcaggcccaatgccagttacagtagcgtcggcagcacaacgacgcggcagaattggtagaaatcaaaataaagaaggagatcaatacgtgtacatgggccaaccgctaaataatgacgaagaccacgcacactggacagaagcaaagatgctattagataacataaataccccagaaggaatcataccagcgctatttgaaccagaaagagaaaaatcagctgcaatagacggtgaatatagactccgcggggaagcgcgtaagacttttgtcgaattaatgcgtcgaggagatttaccagtgtggcttagttataaagtagccagcgaaggttttcaatattctgatcgacggtggtgcttcgatggagagcgaaacaatcaggtcctagaggagaacatggatgttgagatatggaccaaagaaggtgaacgaaagaaattgagaccacgatggttggatgctaggacctattcagaccctctagcactacgggagttcaaagagttcgcagctgggcgaagaagtgtatcttccgatctaatattagaaataggaaaattgccccaacacttgacactgcgcgctcaaaatgcgcttgacaacctagttatgctacataattcagaacaagggggtaaagcctatagacatgcgatggaggagctcccagacacaattgagactttaatgttacttgcacttatagccgtactcacaggaggtgtaacgcttttcttcttatccggtaaaggcttaggaaaaacttccataggtcttctatgtgtaactgcatcatcggccttactatggatggcatccgtagagcctcattggatagctgcgtcaataatactagagtttttcttaatggtacttcttatacctgaaccagatagacaaagaacgccacaggataatcaattagcgtatgtagtgataggattattatttatgatactgacagttgcagcaaatgagatgggcttactggagacaactaagaaagacctgggtataggccatgtagcagcagaaaaccatcagcatgctacaatgttagatgtggatctacaccctgcaagtgcatggacattatacgcagttgcaactacagtaataactccaatgatgaggcatactatagaaaacaccacagctaatatatcactaacagcaatagcaaatcaggcagcaatattaatggggctagataagggatggcctatatcaaagatggacttaggtgtaccgttactcgcattggggtgctactctcaagtaaatccgttgacccttacagcggcagtattaatgctcgttgcgcattacgctattattggacctggtctacaggcgaaggcaacgcgggaagcgcagaaaagaacagcagcgggaataatgaaaaatccgaccgtagatggaatcgtagcgatagacctagacccagtggtctacgatgcgaagtttgaaaaacaactaggtcaaatcatgctcttaatactctgtacaagccaaatattacttatgcggacaacatgggctttatgtgaaagcatcacattagccacaggaccactaacaacactctgggagggatcaccgggaaaattctggaacacgacaatagcggtatcaatggcaaatatattcagaggctcctatctagcaggcgctgggttggcctttagtttgatgaaaagtttaggcggaggtcggcgcggtaccggagcgcaaggggaaacattaggagaaaagtggaagcgacaactaaaccagcttagtaaatcagagtttaatacatacaaaagatctggtataatggaagtagaccggtctgaggcaaaagaaggccttaaacgtggagagactactaagcatgctgtgtcaagaggaacagcaaagttgaggtggttcgttgagagaaatttagtaaaaccagaaggaaaagttatagatttaggttgtggtcgaggtggatggagttattactgtgcaggtttaaagaaagtaacggaggtgaaaggatatacaaaaggcggtcctgggcatgaagaaccgatccccatggccacatacggctggaatctagtaaagttacattcaggaaaagatgtattctttataccccctgaaaaatgtgatacacttctatgtgacatcggcgagtcatcaccaaatccaacaatagaagaaggtagaaccctacgggtactcaaaatggtcgaaccatggctccgtggcaatcagttttgtataaaaatactcaatccgtacatgccatctgtagttgagacattggagcaaatgcagagaaaacatggaggtatgctcgtacgtaatcctctctcccggaatagtacccatgaaatgtattgggtgtcttgtggtacaggaaatatagtctcagctgttaatatgacttcaagaatgttattaaatagatttacaatggctcatagaaagccaacatatgaacgagatgttgatctcggagctggaacgagacatgttgcagtagagccagaagtagctaatctagacataattggtcagcgaatagagaacataaagaatgaacacaaatctacttggcactacgatgaagataatccatataaaacttgggcttatcatggctcatatgaagtaaaaccaagcgggagcgcatcttctatggtaaacggagttgtaaggttgttgactaaaccttgggatgtaatccccatggtaacccaaattgccatgacagacacaactccctttggtcaacaaagagtatttaaggaaaaagtagacacacgcacgcctagggctaagaggggtactgcacaaatcatggaggttacggccaaatggttgtgggggttcttgtcaaggaataaaaagccacgaatatgtactagagaggaatttactagaaaggttagatcgaatgcagcaataggggcagtatttgttgatgaaaatcagtggaacagtgcgaaagaagccgtcgaagacgaaagattttgggacttagtacatcgcgaacgtgagctgcacaaacaaggcaagtgcgcgacatgcgtctataacatgatgggaaaaagggagaagaaattaggcgaatttggaaaggcaaaaggttcaagagcaatttggtatatgtggcttggagcaagattccttgagttcgaagcactgggtttcatgaacgaagaccactggttttcacgtgagaatagtcttagtggagtagagggtgaagggttacataaactaggatatatccttagagatataagcaaaataccaggaggcaatatgtatgcggatgacacagcaggttgggatactaggataacggaagatgatcttcaaaacgaagcaaaaataacggatataatggaacctgaacacgctttactagcaacaagtatctttaaactaacatatcaaaataaggttgtcagagtacaaaggcctgcaaagaatggaacagtgatggacgtaatctcaagaagggaccagcggggaagcggacaagtaggcacttatgggctgaacacgttcaccaatatggaagtacagctcataaggcagatggagagtgaagggatatttttcccctcagagttggaatccccaaatttggcagaacgagtattagactggcttgaaaaacatggcgcggagagattgaagagaatggcgattagtggcgatgattgcgtggttaaacccattgacgataggtttgcaacagctttgatagcactaaacgacatggggaaagtcagaaaagatatcccccaatgggaaccgagtaaaggctggaatgactggcaacaagtaccgttctgcagtcatcatttccatcagctgattatgaaagatggaagagaaattgttgttccatgtaggaaccaagacgaactcgtaggcagagcaagagtgtcacagggagctggttggagccttagagaaactgcttgtctaggaaaatcatacgcccaaatgtggcaacttatgtattttcacagacgagacttaaggttagcagcaaatgcaatatgttccgccgtgcccgtggactgggtgcccacaagcagaacaacttggagtattcatgcacatcaccagtggatgactacagaggatatgctttccgtgtggaaccgcgtttggatagaggaaaacccatggatggaagataaaacacatgtaagttcctgggaggaagttccatacctgggtaagcgagaagatcaatggtgcggaagtcttattggtttaacagcgagagctacttgggctactaacattcaagtcgcaattaatcaggttagaagactaattggaaacgagaattacctagactatatgacaagtatgaaaaggtttaaaaatgaaagtgacccggaaggggcgttatggtag

SEQ ID NO: 22162 - RNA, 9879 nt, synthetic construct
  misc_feature 1..9879: note = derived and/or modified CDS sequence (opt6) from DENV-1__EU280167__SS-prME
  source 1..9879: mol_type = other RNA
tccgtaacaatgctacttacattaatgccgacagcgctagctttccacctaacaacacgaggaggagaaccacatatgattgtatcaaaacaagaacgaggaaaatctttattgtttaaaacaagtgctggcgttaatatgtgcacattgatagcaatggatttaggagaattatgtgaggatacagtcacgtataaatgcccacgaataacagaggctgagccagacgacgtcgactgttggtgcaatgcaacagatacatgggtcacatacggtacatgttcgcaaactggagaacacaggcgtgacatccgatcagttgcactcgcaccgcacgtaggtttgggactagaaacacgtacggaaacttggatgagctccgagggagcatggaaacaaattcaaagggtagatacttgcgtactcagacatccaggatttactgttatagcactgtttttggcacatgcaataggtacttctattagccaaaaaggaataatcttcattctgctcatgttagtaacaccatcgatgactatgcgatgtgtgggcatagggtcgagagattttgtcgagggccttagtggggcaacatgggtcgacgtagtgctagagcacgggtcgtgtgtcacaagtatggcgaaagataaaccaacattagacattgaactattaaaaacggaggtgcctaatccagcagttctgaggaaattatgtatagaagccaaaatatccaatacaacaacagatagccgatgccctacgcaaggtgaagcaacgcttgtagaagaacaagatgcaaacttcgtttgtaggagaactttcgtagatagaggatggggaaacggatgcggcctgtttggaaaagggtccctactaacatgcgataaattcaaatgcgtcaccaaattggaaggaaaaattattcaatacgaaaattttaaatatagtgttattgttacagtgcataccggcgaccaacatcaagtgggtaatgaatctacagaacacggaacaaccgcaacaataacgccacaagctccaactacggaaattcaacttacagattatggcgcactaacgcttgattgttcaccacgaacaggccttgacttcaacgagatggtgcttctgaccatgaaagaaaaatcatggcttgttcataaacaatggtttctagatctacctctaccttggacaagtggtgcgagcaccagtagggaaacctggaacagacaagacctattagtgacttttaaaacagcacatgccaagaaacaagaggtcgtagtgctggggtcacaagaaggagccatgcataccgcactgacaggtgccacggaaattcaaacatcaggtactactacgatattcgctgggcacctaaaatgccgactaaaaatggacaaactgacactaaaaggtatgagctatgtaatgtgcactgggtcatttaaacttgagaaagaagtggctgaaacccaacatggaactgtactcgtgcaaattaaatacgaaggaaccgatgcaccctgtaaaattccattcagtactcaagatgaaaaaggcgttacacagaatggaagattaataacagctaaccccattgtcactgacaaagaaaaacctgtaaatatcgaagcggaacccccttttggcgagagttacatcgtaattggtgtaggcgaaaaagctctcaaacttagctggttcaagaaaggctcatcgataggcaaaatgttcgaagcaacggcacgaggtgctcgtagaatggcaatcttaggagacacagcgtgggacttcgggtcaattggcggcgtgttcaccagtgttggtaaattagtacaccaaatatttggaacagcgtacggagtacttttcagtggtgtttcctggactatgaaaataggaatcggagtgttattaacatggctaggccttaatagtcgttcaacgagtctttccatgacctgcatagctgtaggacttgtaactctatacttaggtgttatggttcaagcagatagcggatgtgttataaactggaaagggagaggactaaaatgtggaagtggtattttcgtcaccaacgaagtacacacttggacaggacaatacaaatttcaagcagattctccgaaaggtctatcagctgcgattggaaaggcttgggaagaaggtgtatgtggtattcggtctgctacacggcttgaaaatatcatgtggaaacaaatatcgaacgaactgaatcatattttgctcgagaatgatatgaaattcactgtggtagtcggtgatgtagctgggatactggcacagggcaagaaaatgatccgaccccaaccaatggaacataaatactcgtggaagaattggggcaaagcaaaaataataggagctgatgtacaaaactcaacttttattatagacggcccaaacacgccagaatgctcagatgaccagcgagcctggaacatctgggaagtcgaagattatggtttcggaatattcactactaacatatggctcaaactccgggattcgtatacacaggtatgtgaccataggttaatgtccgctgcaattaaagactctaaagcagtacatgcggatatgggatactggatagagagcgagaaaaatgaaacatggaaactagccagggcaagtttcatagaggttaaaacgtgtatctggcccaaaagccacacactatggagtaacggcgtgttagagtccgagatgatcatacctaaaatttacggaggtcctatctcccaacataactacaggccagggtacttcacgcaaacagccggtccatggcatctgggtaaattagagttggatttcgacttatgtgaaggaacaactgtggttgttgatgaacattgcggaaacaggggtcctagtcttggcacaacgacagtgactgggaagataatccatgagtggtgctgcaggtcatgcacactgcctccactgcgattcaggggtgaagatggatgttggtatggcatggaaataagacctgttaaagaaaaggaagaaaaccttgtaaaaagtatggttagcgctgggagcggtgaggtagatagtttttccttaggtttactgtgcataagtattatgatagaggaggtaatgcgtagcagatggagtagaaaaatgctcatgacagggacactagctgtatttttcttgttaataatgggacaactaacctggaacgatctaattcgactttgtattatggtaggagcaaatgcatctgatagaatgggaatgggaacaacctatttggctttaatggctacatttaaaatgcgtccgatgtttgctgtaggattactatttcgtagattaacaagtagagaagttctattattaacaataggtctttcacttgtggcctctgttgaactacccaactccctagaggaattaggtgacggcttagctatgggaattatgatactaaaattgttaactgacttcaggtcccaccaattgtgggctaccctactttccatgacttttataaaaacagcattttccttacactacgcatggaaaaccatggcgatggtgctgagtatagtctctctattcccattatgcctgtacacaacgagtcagaaaacaacctggttaccagtattgctaggaagtctaggctgcaaaccactcactatgtttttaattgccgagaataagatttggggcagaaagtcttggccgttgaatgaaggcattatggcagttggtatagtttcaatcttactttcaagtctattaaagaatgacgttcccttagcagggccactaattgcgggtggaatgctaatcgcatgttatgttataagtggctcatcggctgatctaagtttagaaaaagctgcagaagtgagttgggaagaggaagcggaacattcaggtgcttcgcacaatatattagtagaagtacaagacgatggaacaatgaagattaaagatgaagagagggacgacacgctaacaatcctgctcaaggcaacattactagcagtctcaggagtatacccgttgtcgatacctgccaccctgtttgtgtggtgtttttggcagaagaagaaacagagaagtggtgtattatgggacactccatctccaccaaaggtggaaagagctgttttagatgacggaatatacaggataatgcaaagaggcttattaggcagaagtcaagttggtgtgggcgtatttcaagagaatgtatttcatacaatgtggcacgtaacaagaggagctgtgctaatgtatcaaggcaaaaggcttgagccatcatgggcttccgttaagaaagatcttatttcttatggtggagggtggcgacttcaaggcagttggaacacaggtgaagaggtccaggtaatcgcagtagaaccaggtaaaaatcctaagaatgtacaaacagcccctggtactttcaagacgccagaaggagaagtgggggctatagcattggactttaaacctggaacgtccggatcgccaatagtgaatagagaaggaaaaatagttgggttatatggcaacggggtagttacgacgtctggaacttacgttagtgctattgcacaagctaaggccagtcaggaaggaccgttgcccgaaatagaagatgaagtattcagaaagagaaatctgacgattatggatctccatccaggtagtggaaaaaccagaagatatcttccagcgattgtgagagaggcaataaaacgtaaaatgcgaacactaatattggctccgacaagagtcgtggccagtgaaatggccgaggcattaaaaggtatgccaatcagatatcaaacaactgccgtaaaatcagaacataccgggaaagagattgttgatctaatgtgtcatgctacgtttacaatgcgtctactcagtcctgtaagggtgccaaactacaacatgataattatggatgaagcacactttaccgatccttcatctatagccgcgcgtggatatatctctactcgtgtaggaatgggcgaagctgcagcgattttcatgactgcaacaccgcctggatcggtggaggcatttccccaatccaatgcagtaatacaagatgaagaaagagacatccctgaaagatcttggaatagtgggtacgagtggattacggattttccaggaaaaacggtatggttcgttccttcaattaaggctggaaacgatataaccaattgtctacggaaaaacggtaaaagagttattcaattatctaggaaaacatttgacaccgaatatcagaaaaccaaaaataatgactgggattatgtcgtcaccaccgacataagcgaaatgggagctaatttcagagcagacagagtgatggaccccaggagatgtttgaaaccggtgattctaaaagacggacctgaaagagttattcttgctggaccaatgcctgtaaccgtggcatcagcagcgcaaaggagaggtcggataggtagaaaccataataaggaaggtgatcaatacatttatatgggtcagccacttactaatgatgaagaccacgcgcactggaccgaagccaaaatgctgttagataacataaatactccagaaggtataattcctgctctgttcgagcccgagagagagaaatcagcagccatagatggagaataccgattaagaggagaagcacgtaaaacatttgttgaattaatgagacgtggagatctcccagtctggctcagtcataaggttgcctcagaaggatttcaatacagtgacagaaggtggtgcttcgatggagagagaaataatcaagtattagaagagaacatggatgtcgaaatatggactaaagaaggcgaaagaaagaaacttcgacctcgatggttggatgcacggacttatagtgacccattggctctcagggaatttaaggaatttgcggcgggccgacgatcagtaagcggcgatttgatattagaaataggaaagctaccacaacatcttacgcaaagggcacaaaacgctcttgataacttagtcatgctacacaactccgaacaaggcgggcgcgcataccgacatgccatggaagaacttcctgatacaattgaaacactaatgcttttagcactaatcgcagtgttaacaggaggtgtaaccctcttctttctcagtggaaaaggactgggaaagacaagcataggtctattatgtgttatggcgtcttcagtcttattgtggatggcttctgtagaaccccattggatcgccgctagcatcatcctagagttctttctcatggttcttctcatcccagaaccagatcgccagcgtaccccacaggataatcagctagcatacgtggtcatcggattgttatttatgatattgaccgtagccgcaaatgaaatggggttactagaaactaccaagaaagatctcggaataggacatgtagccgttgaaaatcatcatcacgcagcgatgctagacgtcgacttgcatcctgcttcagcgtggacattgtacgccgtagcaacaactatcattactccaatgatgcgtcacacaatagaaaatacaacagcaaacatctccttgactgccatagccaatcaagctgcaatactaatggggttggataaggggtggccaatttcaaaaatggacataggtgttccgctacttgctctaggatgctactctcaggtgaatcctctaactcttaccgcagccgttttaatgctagtagctcactatgcaattatcggaccgggactccaagcaaaagctacacgtgaagcacagaagcggacagccgcaggtatcatgaaaaatcccaccattgatggaatagtcgccatagatttggatccagtagtctacgacgcaaaatttgaaaaacagttaggccagataatgctgctcatattatgcacatctcaaatattactcatgcgaaccacgtgggcattgtgcgaatctattaccttagccacaggacccctaacgactctatgggaagggtcaccagggaagttttggaacacaacaatagccgtctcgatggcaaacatattcaggggatcttacctagctggtgcaggcttagcattctctttaatgaaatcattgggtggagggaggagaggtaccggggctcagggtgaaacactcggagaaaaatggaagagacaactaaaccagctttcaaaatcagagttcaatacttataaaagatctggaataatggaagtagatagatccgaagcaaaagagggccttaaacgaggcgagaccacgaaacatgctgtgagtcgcggaaccgcaaaattacgttggttcgtcgaacgaaacttagtaaaaccagagggaaaagtcatagatctggggtgtgggcgaggcgggtggagttattactgcgctggtttaaagaaagtgaccgaagtgaaaggatatactaaaggaggaccagggcatgaggagccaataccaatggctacctatggttggaatctcgtcaaattgcatagtggaaaagacgtgttcttcatcccaccagaaaaatgtgatactttattatgcgatatcggagaatcatcaccaaatccaaccatagaggaaggcagaacattacgggtattaaagatggtcgaaccatggcttcgtggcaaccaattttgtataaaaatactaaacccatatatgccaagcgttgtcgaaactcttgaacagatgcaaagaaaacacggaggaatgctagttagaaatcctttatcacgcaacagcactcatgaaatgtattgggtaagctgtggtacaggaaatatcgtatcggcggtaaacatgacgtcacgaatgctgttaaatagattcacgatggcccatcgtaaaccaacatacgaaagggatgttgatttaggggcaggtacaagacacgtagcagttgagccagaggtagcaaatctagatattattggtcaaagaattgagaacataaaacatgaacataagtcaacgtggcattatgacgaagataatccatacaaaacttgggcctatcacggaagttacgaggtcaagccgagtggatccgccagttctatggtcaacggtgtcgttaaactacttactaagccttgggacgtaatcccaatggtaacacagatcgctatgacagataccacacccttcggacaacaaagggtattcaaggagaaagttgatacacgtacaccgaaagctaaacgaggaacagcgcaaatcatggtagtgacagccagatggctgtggagttttctatcgcgaaataagaagcccaggatctgtacccgggaagagtttacgagaaaagtaagaagcaatgccgcgataggcgcagtatttgtggatgagaatcagtggaactccgctaaagaagcagttgaagatgatagattctgggacctggtacatagagaacgcgagctccacaaacaaggtaaatgcgcgacgtgcgtatataacactatgggcaagagggagaagaaattaggtgaatttggaaaggcaaaagggtcaagagccatctggtatatgtggttaggggcaagatttctagagttcgaagcactaggtttcatgaatgaggaccattggttctctcgtgaaaatagtctcagcggtgtagaaggcgaaggattacataaattaggatacatactaagagatatttcaaagattccagggggaaatatgtacgccgacgataccgcaggttgggacacgagaataacagaaggagatctacaaaacgaagcgaagataaccgacattatggaaccagaacatgcattgcttgcgaagagtatctttaaactcacataccagaataaagttgtaagagtccaaaggccagccaaaaatggtacggttatggatgtgatatcacgccgagatcagcgaggttcaggacaagttggaacatacggattaaatacttttaccaatatggaagcacaactcatccgacaaatggaaagtgaaggaatattttcaccaaacgaactcgagactccgaacctggcagagcgggtactagattggctagaaaagtacggagtagaaagattaaaacgcatggcaatttccggggacgactgcgtcgttaaaccaattgacgatagattcgctacagcactcaccgcccttaatgacatggggaaggtaagaaaggatattcctcaatgggaaccatcaaaaggttggaacgactggcaacaagtacctttttgctcgcatcattttcaccaactaatcatgaaggacggtagagaaatcgtagtgccatgcagaaatcaagatgaattagtgggtagagcaagagtgagtcaaggggccggatggtccttgcgtgaaactgcatgccttggtaaaagctatgctcagatgtggcagctaatgtacttccatcgacgcgatttgcgcctagcagcaaacgcaatatgttctgctgtgcctgttgactgggttccaacgagccgaacaacttggtcaattcatgcccatcatcagtggatgacaaccgaggacatgctttcggtctggaaccgtgtatggatagaagaaaacccatggatggaggataagacacgtataagttcatgggaggacgtcccttacctaggggaacgagaagaccagtggtgcggttccctaataggccttactgcaagagcaacatgggcaacgaatgttcaagttgcaatcaaccaagtaagaagactcattggaaatgaaaattattccgattacatgaccagtatgaaacgattcaagaacaaatcagagccagagggtgccctttggtaa

SEQ ID NO: 22163 - RNA, 9876 nt, synthetic construct
  misc_feature 1..9876: note = derived and/or modified CDS sequence (opt6) from DENV-2__AJ968413__SS-prME
  source 1..9876: mol_type = other RNA
actgctgggatgataatcatgctcattcccactgtaatggcttttcacctaactacgcgtaatggggaaccacacatgatcgtatctagacaagaaaaaggtaaatcactgttattcaaaacagaagacggggtaaacatgtgcacattgatggcaatggatctaggagaattatgtgaagatacaattacatacaaatgtcctcttctccgccaaaacgaacctgaagacatcgattgttggtgtaattcaacgagtacttgggttacctatgggacatgcacaaccacaggtgaacatcgtcgggagaaaaggtcagtagcactcgttccacatgtagggatgggactggaaacgaggacagaaacttggatgtccagcgaaggggcctggaaacacgctcaaaggatagaaacatggatactaaggcacccaggattcacattaatggctgccattctagcatatacaataggaacgacacacttccaaagagcactaatctttatactcctaactgcagtggcgcccagtatgacaatgcgttgcataggtatatcgaatagagactttgtagaaggagtaagcggagggagttgggtagacatcgtactagagcatggaagttgtgtaacaactatggccaaaaacaaaccaacgctggatttcgagttaataaaaacagaagcaaaacaactagctacgctaagaaaatattgtatcgaggcaaaattaacgaacacaaccacagaatcaaggtgcccaacgcaaggagagccgtcactgaacgaggaacaggataaacgatttgtatgcaaacacagtatggttgataggggttggggaaacggttgtggcctctttggtaaaggcggtatcgtaacgtgtgccatgttcacttgtaagaaaaatatggaaggtaaaattgtacaaccagaaaacttagagtatacaatagtaataacaccacactctggagaggaacatgctgtaggtaatgatacaggtaaacatggaaaagaaattaaaataacgcctcaatctagcataactgaagcggagctaactggatacgggacagtaactatggaatgctctccccgcacaggacttgattttaatgaaatggtacttcttcaaatggaaaataaagcctggttggtacaccgacaatggtttttagatctaccattaccttggctccctggtgcggatacgcaggggagcaattggatacaaaaagaaaccttagtaacattcaaaaatcctcatgcgaagaaacaagacgtcgtagtactcggatcacaagaaggcgcgatgcacacagccctgactggcgcaacggagatacaaatgagtagcggtaacctcttatttacagggcacctgaaatgtaggctaagaatggataaattgcagttgaaaggaatgtcttatagtatgtgtactggaaagtttaaggtagtaaaagaaatagcagagacacaacacggaacaatagtagtgagagttcaatatgaaggcgacgggagtccctgtaagatcccatttgaaattatggatttggagaagagacacgtattagggaggttaattactgtcaatcctattgttacggagaaagatagcccagttaacatagaagccgagcctccgttcggtgattcatacgtaatcataggtgtagaaccaggtcaattaaaacttaattggttcaagaaaggtagtagcataggacaaatgttcgaaacaaccatgcgaggggctaaaagaatggccatacttggcgataccgcatgggatttcggatcattaggtggagtctttacatcgattggaaaggctttacatcaggtgttcggggcaatttatggagctgctttttctggggtcagttggacgatgaaaattttaattggcgtgataataacgtggatcggaatgaactcacgttctacttcgctaagtgtaagtttagtactggtcggtgtcgtaactctctatttgggagttgttgtacaagccgactctggatgtgtagtttcctggaaaaataaagaattaaagtgtggttctggaatttttattacagataatgttcatacatggacggaacagtataaatttcaaccagaatcaccgagcaagctagcttccgccatacaaaaggctcaccaggaaggcatatgtgggattcgctccgtgactagattagagaacctaatgtggaagcaaataacaccagagttaaaccacatcttatcagaaaatgaagtaaaactaaccattatgactggagatataaagggaataatgcacgcggggaaaagatcacttagaccgcaacctactgaactacgatatagttggaaaacatggggaaaagcaaagatcttaagtacagaatcacacaatcaaacttttctaatagatggtccggagacagccgaatgccccaatacgaatcgggcatggaactcgctagaggtggaagactatggatttggagtttttacaacaaacatatggctcaaactgcgggaaaagcaagacgtcttctgtgatagcaagttgatgtcagcagcgataaaagataatagggcagtacacgcagatatgggctactggattgaatcagcattgaacgatacttggaaaattgaaaaagcgagctttattgaagttaagagctgccattggccaaagagtcacacgctgtggagcaatggagtgctcgaaagtgagatgataatacccaaaaatttcgcgggccctgtatcacagcataactaccgaccaggttatcatacacaaactgcaggtccttggcacttgggaaaactagaaatggatttcgatttttgtgaaggaacaaccgttgttgtcacagaggactgcggtaaccgaggcccttccttaagaacgacaacagcgagtggaaaattgataacagagtggtgttgccgttcatgtacactccctccactgagatacaggggcgaagacggctgctggtatggtatggaaatccgacctttaaaagagaaagaagaaaacctagtaaatagcctagtaacggcaggccacggtcaaatcgataatttttcattgggtgttctgggaatggcgttatttttagaagaaatgttgagaactagagtaggaacaaagcatgccaccttactcgtggccgtttcttttgtaacactaataacaggaaacatgagctttcgtgaccttggtagggtaatggtcatggtgggtgccacgatgaccgatgatattggcatgggagttacatacctagctctactcgctgcctttaaagtccgtcctacttttgcggcaggactattgttgagaaaacttacctctaaagaacttatgatgacaaccataggtgtcgtacttttatcgcaaagcacaattccggagaccatactagaacttactgatgctcttgcattgggtatgatggtattaaaaatcgtcagaaagatggagaggtatcagctagcagtaacaattacagcgatactgtgcgttcccaacgcagtgatattacaaaatgcatggaaggtatcatgtacaatattagcagtagtttcagtgtcaccattgttattgacaagctcacagcagaaagccgattggattcctctagcactaactataaagggtttaaatcccaccgcgatatttcttactacattgtcaagaacgtccaagaagcgctcgtggcctcttaacgaagcgatcatggctgtaggaatggtatcgattttagctagtagcttattgaaaaacgacatcccaatgacaggtcctctagtcgcgggtggattattaaccgtctgctatgtactaaccggtagatcagcagatttagaacttgaaaaagcagcagatgtgagatgggaggatcaagcggaaatctcgggcagttcaccaattctgtccataacaatctcggaagatggatcaatgtcaattaaaaatgaagaggaagaacagacgttaactattctaataagaaccggattgctagtaataagcggattatttcccgtctccatcccaattacagctgcagcgtggtatttatgggaagtcaagaaacagcgagctggagtgttatgggatgtaccatcgcccccaccagtaggaaaggccgagcttgaagatggtgcgtacagaataaaacaaaaaggtattctcggatattcacaaataggggccggtgtttataaagagggtacatttcatacaatgtggcatgtaaccagaggcgcagtactcatgcataaaggaaaacgaattgaacctagctgggcagacgtcaagaaagatctaatatcttatggcggcgggtggaagctggaaggagagtggaaagaaggcgaagaagtacaggttttggctttggaaccaggtaaaaatcctagagcagttcaaacaaaaccgggattatttaaaacaaatacgggaactataggggcagtcagtcttgatttttctccgggtacttccggctcgcctataatcgataaaaagggtaaagtggttggtttatatggaaacggagtcgtcactagaaatggggcatatgtaagcgccatagcacagactgaaaagtcaattgaggacaatcccgaaatagaagatgatatcttcagaaagaaacggctgacaataatggacttgcatcctggtgcgggaaaaacgaaaagatatttaccagctatagtaagagaagcgatcaaaagaggactgcgaacgcttattctggccccaacaagagtagtagctgcagagatggaagaagcactccgtggattaccaataagataccaaacccccgcaatacgggctgaacatactggaagagagatcgtcgatctaatgtgtcatgctacatttactatgagactgttgtcgccggtaagagtccctaactacaacttaatcatcatggacgaagcacattttacagatcctgcaagtatagctgccagagggtatattagtacaagagtcgaaatgggggaggcagcaggcatcttcatgacagcgactccaccgggaagccgggacccgtttcctcaatctaatgctcctattatggatgaagaaagggaaattcctgagcgatcctggaacagtgggcatgaatgggtaactgacttcaagggtaaaaccgtctggtttgtaccgtccattaaagctgggaatgacatcgcagcatgcctaagaaagaatggcaagaaagtcatacaattatcacggaagacatttgactcagaatatgttaagacacgtacaaacgattgggacttcgttgtaacaactgatataagcgaaatgggtgcaaatttcaaggcagaacgagtgattgatcctaggcgatgtatgaaacctgtaatcctaacagacggcgaagaacgagttattttggcaggaccaatgccggtaactcactctagcgctgctcaacgaagagggcgaataggacgaaatcccaaaaatgaaaatgaccaatatatatatatgggagaaccactagaaaatgacgaagattgcgcacactggaaggaagcaaaaatgctcctagataatatcaacacaccagaaggtattatcccaagcatgtttgaaccagagcgagaaaaagtagatgctattgacggggaatataggctacgaggtgaagccaggaaaacgtttgttgacctaatgaggagaggagacctaccagtgtggttagcatataaggtagcagcagaaggcataaactatgctgacagaagatggtgttttgacggaatcaggaacaatcagatattagaagaaaatgtagaagtcgaaatttggacgaaagagggagaaagaaagaaattaaaaccaagatggttagatgcacggatatatagtgacccactggcactaaaagaatttaaagagttcgcggcgggtagaaaatctttaacgttaaatttaataacggaaatgggtcggctcccaacttttatgacacagaaggcacgagatgccttggataacctcgcagtacttcataccgctgaagcagggggtcgtgcatataatcatgctctatcagagctaccggagaccctagaaaccttattattactaaccttattagctacagtgacgggaggtatattcttgtttttaatgtctggtcgcggtattggaaagatgactttgggcatgtgttgtataattacagcgagtattctgctctggtacgcccaaatacaaccacattggatagctgcctcaataatactcgagttctttttaatagtactactcatccctgaaccagaaaagcaacgaacaccgcaggacaatcaactaacgtatgtggtcattgcgattctcactgtcgtcgccgccacaatggccaacgagatgggattcttggagaaaacgaagaaagacttaggattaggatccataacgacacaacaacccgagtcaaacattcttgatatagacctacggccagcttcagcatggacactatatgcagttgcgacgacatttgtaacacctatgttaagacattcaattgaaaactcctccgtaaacgtatctctcactgcgatagccaatcaagcgaccgtacttatggggttaggaaaaggttggccactctctaaaatggacataggagtacctcttttagctataggttgttacagtcaagtaaatccaattactctaacagcagccttattattgttagtagcacattatgccattattggaccagggttacaggctaaagctacgagggaagcacagaaaagagcagctgcaggtataatgaaaaatcccacagtagatggaataacggtaatagacctcgatcccataccctacgatccaaagttcgaaaaacagctagggcaagtgatgcttttagttttatgcgttacacaagtcctaatgatgcgaaccacatgggctctctgtgaagcactcactctagctactggtccgatctcgactctgtgggaaggaaatccaggcaggttctggaataccacaattgcggtaagcatggcaaacatattcagaggatcctacttagcaggagcaggcttgctattttcaataatgaaaaacacgactaacacaagaaggggaaccggaaatattggggaaacgctaggtgaaaaatggaaaaatagattaaatgcccttgggaaatcagaatttcaaatctacaagaaatcaggaatccaggaagtagacagaacactagcgaaagaagggattaaaagaggcgaaacagaccatcatgcagtatcaagaggttctgcaaaattgagatggtttgtagaaagaaatatggtaactccggaaggcaaagtagtcgatctaggttgtggccgcggaggttggtcatactactgcggcggactaaagaacgtgcgagaggtcaaaggtttaactaaaggagggcctggacacgaagaaccaataccgatgagcacttacggttggaacctcgtacgcctacaatccggcgtcgatgtattcttcacaccacctgagaaatgtgatacattactgtgtgatattggtgaatcatcaccaaatccgactgtagaagctggacgaactttaagagtactaaatctcgtggagaattggctaaataacaacatacagttctgtataaaagtcttaaacccttatatgccaagtgtgatagagaaaatggaggctttgcaacgaaaatatggaggggctttagtgagaaacccactcagtcgcaattcaacacacgaaatgtattgggttagcaacgcttcgggcaacatcgtatcatcggtaaatatgatttctcgcatgctcataaatcgttttacgatgaaacacaaaaaggctacatacgagccggatgttgatctaggaagcgggactagaaatataggaatagaatcggaagtccccaatttagatattataggaaaaagaattgagaaaattaaacaagaacatgaaacaagctggcattatgatcaagaccatccttacaaaacttgggcataccacggcagttatgaaacaaaacagaccggttcggcatctagcatggtcaacggtgtggtaaggttattaacaaaaccttgggatgtagttccaatggtcacccaaatggctatgacggacacaacaccctttggtcagcaacgggttttcaaagaaaaggtagatacacgaacacaggaaccaaaagaaggaactaaaaagctgatgaaaatcacagccgaatggttatggaaagaactaggcaagaagaaaacaccacgtatgtgtactagagaagaatttacaagaaaagtacgaagtaatgcagcgctaggagcgattttcacagacgaaaacaaatggaagtctgcaagagaagcagttgaagattccagattttggggtctggttgacaaagaaaggaatctacacttagaaggcaaatgtgaaacttgtgtgtataatatgatgggaaaacgggagaagaaattaggcgagttcggaaaagcaaaaggatcacgagcaatttggtacatgtggttaggcgcacgattcttggaatttgaggcgctaggtttcctgaatgaagatcattggttttctagggagaacagcctttccggtgtagaaggagaggggttgcacaagttaggatatattttgcgagacgtaagcaagaaagaaggcggagctatgtacgccgatgatacagcaggttgggatactagaattactcttgaggatctcaaaaatgaggaaatggtaacaaatcacatggagggagaacataagaaactagcggaggcgatatttaaactgacctatcagaacaaggtagtaagagttcaaagaccaactccgagaggcacggtaatggatatcatctcgcgtcgtgatcaaagaggctcgggacaagttggtacatatggcttaaacacatttacaaatatggaagcacagctgatccgacaaatggaaggagaaggagtgttcaagtccatacagcatctaacggttactgaagaaatagcagttcagaattggttggcgcgggttggacgcgagaggctcagtcgtatggctattagcggggatgattgtgttgtgaaaccgcttgatgacaggttcgcatcagctcttacagctctaaatgatatggggaaagtccgaaaagacatacaacaatgggaaccatcaaggggttggaacgactggacccaagttcctttttgcagccatcatttccatgaattgatcatgaaagacggaagagtcctagtagtcccttgcaggaatcaggatgaactgataggacgagccaggattagtcaaggtgcaggatggtccttaagagaaacagcctgtctaggaaagtcttacgcgcagatgtggagtttaatgtatttccatcgtagggacctgaggcttgcagcaaatgccatttgcagcgcagtcccaagccattgggttccgacgtcacgaactacatggtcaattcacgcaaaacatgagtggatgaccacggaggatatgctgaccgtttggaatagggtttggatccaagaaaatccttggatggaagacaaaactccggtagaatcatgggaagaaataccctatttaggaaagagagaagatcagtggtgtggttcactgataggcttaacaagtcgagccacatgggctaaaaatattcaaacagcgatcaaccaagtccgaagtttgattggtaatgaggaatatacggattatatgccatcaatgaagagatttcgaagggaagaggaggaagcaggcgtgttgtggtaa

SEQ ID NO: 22164 - RNA, 9876 nt, synthetic construct
  misc_feature 1..9876: note = derived and/or modified CDS sequence (opt6) from DENV-2__AB543624__SS-prME
  source 1..9876: mol_type = other RNA
agcgcaggaatgataataatgctgataccaactgtaatggctttccacttaacgactagaaacggtgaaccccacatgattgtaggaatccaagaaaaaggaaaatcattattatttaaaacagaagatggagtaaacatgtgtaccctaatggcaatggacctcggcgaactatgtgaagacacgataacttataaatgtccattgctacgacagaacgaacctgaagacatagactgctggtgtaacagtacctccacctgggtgacctacggaacgtgtactacgacaggagaacatagacgagagaaaaggagcgtggccttagtaccacatgtgggaatggggttagaaactagaacggaaacatggatgtcaagtgaaggagcatggaaacatgcacaacgaatagaaacgtggatattacgtcatcccggattcacaatcatggctgccattttagcatacacgatagggacgactcatttccaaagagtgttgatattcatattgttaacagcggtagcgccatcaatgacaatgcggtgcattggcatttctaatcgagattttgttgaaggtgtgagtggtggaagctgggtagatattgtgctagaacatggtagctgcgttacaacaatggcgaaaaataaacccacactcgacttcgaattgattaaaacagaagcaaaacagcccgccacccttagaaaatattgcattgaagcaaaattaactaatacgacgactgagagtagatgtcccactcaaggcgagccgtcgttgaaagaagaacaagataaacgatttgtgtgcaaacatagcatggttgatcgcggatgggggaatggttgcggtttatttggcaaaggcggtatagtaacttgcgctatgttcacatgcaagaaaaacatggaaggcaaaattgtacaacccgaaaatctggaatataccatcgttgtgacaccacacagcggcgaagaacatgcagtgggaaatgatactggaaaacatggtaaagaaataaaggtgactcctcaatcctcgattactgaggcagagctaatcggatacggaactgttacaatggaatgttcccctagaacgggcttagactttaacgaaatggtactacttcagatggaaaataaggcatggctagtacaccgccagtggtttttggacttacccctaccatggttaccaggtgccgataagcaggaatcaaactggatacaaaaagaaacgctcgtgacgtttaaaaatccacatgcaaagaaacaagatgtcgtagttctagggtcacctgagggagcaatgcatacggctttaacaggagcaactgaaatccaaatgtcgagtgggaatcttcttttcacaggacatcttaaatgtagattacgaatggataaacttcaattaaagggtatgtcgtacagcatgtgcacgggtaaatttaaagttgtaaaagaaattgccgagacccaacatggaacaatagtaataagggtacaatacgaaggtgatggtagtccttgtaaaattccctttgaaatcatggatcttgaaaaacgttatgtgcttggtaggctcatcacagtcaacccaatagtgacagaaaaagacaatcctgtcaacattgaagcagaaccaccatttggcgatagttacataataataggagttgaaccaggacaattaaaattaaactggtttaagaaaggttcgtcgataggacagatgtttgaaaccacaatgcgtggagcaaaacgaatggcgatactaggtgacactgcttgggacttcggatcgttaggaggcgtgtttacttcgataggaaaagcgctacatcaggtatttggcgctatatatggagctgcattctctggagtatcctggactatgaaaatcttgatcggggtcatcataacatggatagggatgaatagcagatcaacatccctatccgtatctctggtccttgtaggcatagtcacgctctatttaggagtaatggttcaagcagactcaggttgtgtagtaagttggaaaaataaggaattgaaatgcggatcaggaatattcatcacagataacgtacacacttggacggaacagtataagttccagccagaatccccgtccaaactggcgagtgctatacaaaaagcacaggaagaggggatctgtggaattagatccgtaactcgattagaaaatttaatgtggaaacaaatagcaccagagcttaatcacatacttgccgaaaatgaggtaaaacttacgatcatgacaggcgacataaaaggtatcatgcaagctggaaagagatcgctccgaccgcaaccaaccgaattaaaatactcctggaagacctggggcaaggcaaaaatgttatctaccgagtcgtataaccaaacatttctcatagatggtcctgaaactgcagaatgtccgaataccaatagagcctggaatagcctagaagttgaagactatggatttggtgtattcaccacaaacatatggctaaaactaaaggaacgtcaagacgccttttgtgattccaaacttatgagtgctgccataaaagataacagggcggttcacgcggacatgggttactggatagaatctgcgctcaatgacacttggaaaatcgagaaggcgtctttcattgaagtcaaaaactgtcattggccaaagtcgcataccctttggtctaatggggtattggagagtgagatgattatacccaaaaacttagccggacctgtgagccaacataattaccgtcccggctaccacacacagattgccgggccatggcatttaggaaagctggaaatggatttcgatttctgcgatggaacaacggttatagtcaccgaagactgcggcaatcgtggccccagcttaaggactaccacagcctccggtaaactaatcaccgaatggtgctgccggtcctgcacattaccgccacttaggtatcgaggagaagatggatgctggtatggcatggaaataaggccattaaaagaaaaagaagagaacttagtaaattctttagtaacggccggccacggacaagttgataatttttcactgggagtccttggcatggctctgtttctggaagagatgctccgcacaagagtaggtaccaaacatgcgatattattagttgccgtatcttttgtgacattgatcacaggcaatatgagctttaaagatctagggagagtcgtagtaatggtcggagctactatggctgatgatataggtatgggagtaacctatttagcactacttgcagcattcaaagttcgaccaaccttcgctgcgggcttattactgcgaaaattaacatcaaaggaattaatgatgacaactattggaatcgttctattatcgcaatccactatcccagaaacagttctcgaattgaccgatgcattggcgctgggtatgatggttttaaagatagtaaggaacatggaaaagtaccaactagctgtgacgatcatggctatactatgtgtacctaacgcagtaatactgcaaaacgcatggaaagtaagctgtactatattagctgtagtatcagtatccccattgcttcttacaagtagtcaacaaaagaccgactggatccctttagccctcacaataaaaggtcttaacccaacagcaatctttctgacaacgctgtcccgcaccaataagaagaggagctggcctctaaacgaagcaattatggcagtagggatggtaagcatactagcgtcctcacttcttaagaacgatatcccaatgaccggccccctcgttgctggaggtctccttacggtttgttacgtgctgacaggaaggagtgcagatctagagttagaacgtgcaacagatgtaaaatgggaggaccaagcagaaattagtggaagcagcccaattctatctatcactattagtgaggacggatcgatgagcatcaaaaacgaagaagaagaacaaacactcacaatacttatccgaacaggattactggtcatcagcgggttatttcctatatccataccaataacagccgcggcttggtatttatgggaagtaaagaagcaaagagcgggagtcttatgggacgtgcccagtccaccacctatgggcaaagctgaactcgaagatggcgcctataggataaaacaaaaaggcatcttaggctactctcaaattggagcgggagtttacaaagaaggaacatttcacacaatgtggcacgtcacccgaggagctgtgttaatgcataaaggcaagcgaatcgaaccttcttgggcagatgtcaaaaaggatttaattagttacggtggtggatggaaattagagggcgagtggaaagaaggggaagaagtacaagtattggcgcttgaacctggaaagaaccctagagctgtacaaacaaaaccaggattatttaaaacaaacaatgggacaatcggtgcagttagtttggatttcagcccggggacaagcggatcaccgattatagacaagaagggtaaagtagtcggtttatacggcaacggagttgtgactagatcaggagcatatgtttccgcaattgcacagactgagaaaagcatagaagataatccagaaatagaggatgatatttttaggaaaagaagattaacaattatggatttacatccaggagccggtaagacaaaacgatacctaccagccatcgtgagagaggcaataaaaagaggcttaaggacattaattctagcaccgacacgagtcgtcgcggctgagatggaagaggctttacgtggtttgcctatcaggtatcaaactccagctattcgggcggagcatacaggaagagaaattgtcgaccttatgtgccacgctacattcactatgaggctccttagcccggtgagagtcccaaactataacttaataataatggatgaagcgcattttacagacccggcctctattgctgcaagaggttatatatctacaagagtcgaaatgggcgaggctgcaggaatctttatgactgcaacgccaccaggaagcagagatcctttcccacagtcaaacgcaccgataattgacgaagaacgggaaataccggagcgctcatggaacagcggacacgaatgggtcactgatttcaaaggtaaaacggtatggtttgtacctagtataaaagcaggtaatgatattgcagcttgccttagaaagaatggcaaaaaggtaatacaactttcacgtaaaacttttgacagtgaatacgtaaaaacaagaactaatgactgggattttgtagtaaccactgatataagcgagatgggggcaaattttaaagccgaacgtgtaattgaccctcgacgatgcatgaaaccagtaattctaacagatggagaagagagagttatacttgcagggcccatgcccgtaacgcattcatctgcagcacaaagaagaggtagaataggaagaaacccaaagaatgagaatgatcaatacatatacatgggggagccacttgaaaatgacgaggattgtgctcattggaaagaagcgaaaatgctactggacaatattaacacacctgagggtattatccctagtatgttcgaaccagaaagagaaaaagtagacgcaatagacggagaatacagattacggggtgaagcaagaaaaacatttgtggacctgatgcgtagaggcgatttaccagtgtggttagcttacaaagtcgctgcagaaggaataaattacgccgatcgaagatggtgctttgacggcataaagaataaccagatacttgaagaaaatgttgaagttgaaatctggacaaaagaaggagaacgcaagaaacttaaaccacggtggttggatgctcgcatttatagtgacccgctagcgttaaaagaatttaaagagtttgcagcgggaagaaagtcactaacacttaatctcataacagaaatggggagattaccgacatttatgactcagaaaactagggatgccctggataatttggccgtgctacacacagcagaagcgggaggtcgagcatataaccatgcgttaagtgaactaccagaaactctagaaacattacttctactaactttattggctacagtcactggtggcatctttttatttcttatgagcggccgaggtattggaaaaatgacactcgggatgtgttgtataataacagcatcgatattgctttggtatgcgcagatacagccgcattggatagcagcgtcgatcatcttagaatttttcctaatcgttctgttaattccggaaccagaaaagcaaaggacaccccaagataatcaactgacatatgttgtaatagcaatactaactgtagtagctgctacgatggctaatgaaatggggtttctcgagaaaaccaagaaagacctagggctaggttctatcgcaacccagcatcctgaatcaaatattctagacatagatctacgacccgcttctgcttggacattgtatgccgtggcgacaacattcattacacccatgctccgacattcgatagaaaatagctctgtaaacgtgtcattaaccgctatcgccaaccaagctactgttctaatgggtttgggaaaaggctggccattatcgaaaatggatataggggtccctctgctagctatagggtgctattcgcaggtcaatcccatcacactcaccgctgcattgttgctactcgtggcgcactatgctattattggaccaggtcttcaagcgaaagctacacgagaagcacagaagagagccgctgcaggaattatgaaaaacccgacagtagatgggatcactgtaattgatttagatcccatcccctacgatccaaagtttgagaaacaattaggccaagtaatgctactcatactgtgtgtgacacaggtgcttatgatgagaacaacgtgggcactttgcgaggccctaacattggcgaccggaccaatttctcctctttgggagggtaacccaggaagattctggaatactactattgcagtatcaatggcgaacatattccgcggatcttatctagcgggagctggtttattattctctataatgaaaaatacaacaaatacaagacgaggaacaggaaacatcggagaaacactcggggaaaagtggaaatcccgccttaatgcgcttgggaaatcagaatttcaaatttacaagaaatcgggaatccaggaggtggacagaacattggcaaaagagggtataaaaaggggagaaactgaccatcacgctgttagtagaggatcagcaaaattaagatggttcgttgagagaaacatggttactcctgaaggaaaagtagttgacctcggatgcggacgaggaggttggtcttactattgtggaggcttgaaaaatgtaagagaagtgaagggacttactaaaggtggaccaggacatgaggaaccgatccccatgtctacttacggatggaacttagtaagactccagagcggcgttgacgttttcttcattccgccggaaaagtgtgatactcttctatgcgatataggagagagcagtccaaaccctactgtcgaagcaggcagaacactaagggtcttgaacttagtggagaactggctaaataaccacacacatttttgcataaaggtgttaaacccgtatatgccatcagttttagagaaaatggaagcattacaacgaaaatacggaggggccttggtgcgaaatccattgtcgagaaattctacacatgaaatgtactgggtaagtaacgcatcaggtaatatcgtatcctcggtaaacatgatatcaagaatgttgataaatagatttacgatgaggcacaagaaagcaacttatgaacccgacgtagatttagggtctggaacacgaaacataggtatagaatcagaaatccctaaccttgatattatagggaagaggattgaaaagataaaacaagaacacgaaaccagttggcactacgaccaagaccacccatataaaacgtgggcatatcacggttcgtatgaaacaaaacaaaccggtagcgcctcaagtatggtgaacggcgtcgtaagactcttgacaaaaccttgggatgttcttcccacggtgacacaaatggcaatgacagatactacgcctttcggtcagcaacgggtatttaaagaaaaagtcgatacgagaactcaagaacctaaagagggaactaaaaagttgatgaaaattactgcggagtggctatggaaggagttaggcaagaagaaaacacccagaatgtgtacccgagaagagtttacccgtaaagtgagatctaacgcagcattaggagcaatattcacagacgaaaataagtggaagtcggcgagggaggcagtagaagactcacggttttgggaattagtagataaagagagaaatctgcatttagaaggaaaatgtgaaacatgcgtatacaatatgatggggaaaagggagaagaaactaggagagttcggaaaggcgaaaggaagccgcgcaatatggtatatgtggctaggcgctcgattcttggaatttgaagcgctaggctttctcaacgaagatcattggttctccagggaaaattcgttatccggagtcgaaggagaagggttacataaattaggatatattctaagggatgtctcaaagaaagaaggaggtgcgatgtatgccgacgatacggcaggctgggatacaagaattacactcgaagaccttaaaaatgaagaaatggtgacaaatcacatggaaggagaacataagaaactggccgaggctatattcaaactgacgtatcagaataaagtagttcgggttcagcgaccaacaccgagaggaacggtaatggacataattagccgaagagaccaacgaggcagtggccaagtcggaacatatggcctaaacacctttacgaatatggaagcacagcttatacgacaaatggaaggagagggggtttttaagaacattcaaaggttgactgtaaccgaagaggtagccgtccataattggctggcacgagtcggaagagagagattgtcaaggatggcgatatctggcgatgattgcgtagttaaaccactcgacgacagatttgcaaatgcgttgactgctcttaatgatatgggtaaaattcggaaagatattcagcagtgggaaccaagcaaaggttggaatgattggacccaggtgcccttttgtagtcatcattttcacgaacttataatgaaggatgggagagtacttgtcgttccgtgtagaaatcaggacgaactaatcggtagagcacgtatctcacagggagcaggatggtcactaagagaaacggcttgcctaggcaagtcttacgcacagatgtggagcttaatgtattttcatagaagggacttaagactagctgctaacgcaatatgtagcgcagtaccatctcattgggttcctacctcaaggactacatggagcatacatgcaaagcatgaatggatgacaacggaagacatgcttacggtgtggaaccgtgtgtggatccgtgaaaatccatggatggaagataaaacaccagtggaatcatgggaagaaatcccatatctaggaaaaagggaggaccaatggtgtggttcattaataggattaacgtcgagagccacctgggcaaagaacattcaagcggcaattaatcaggtacgttcattaataggcaacgaagaatatacagattacatgccatccatgaagcgcttcagaagagaagaggaggaagcaggcgtactctggtaa

SEQ ID NO: 22165 - RNA, 9876 nt, synthetic construct
  misc_feature 1..9876: note = derived and/or modified CDS sequence (opt6) from DENV-2__AB189122__SS-prME
  source 1..9876: mol_type = other RNA
accgctggtgtaataataatgatgataccaactgttatggcatttcatcttacaacacgaaatggagaaccgcatatgatcgtgtcacgacaagaaaaaggaaaatcgctactatttaaaaccgaaaatggagtaaatatgtgcactcttatggcaatggacttaggagaactatgcgaagacacaattacgtataattgtccgttgctaagacaaaacgaacctgaagacatagattgttggtgtaattcgacgtcaacgtgggtaacctacggaacctgcacggctactggtgaacacagacgggaaaaacggagtgtggctttggctccacacgtgggaatgggtcttgaaacaagaaccgaaacatggatgtcaagtgaaggagcttggaaacatgcacaaagaattgaaacatgggtattgcggcacccagggtttacaataatggcagcaatcttagcgtacacaataggcacgacttacttccaaagggttcttatttttatcttactaacagcagttgcaccttcaatgaccatgcgttgtataggcatatcaaacagagatttcgtagaaggagtatctggcggttcttgggttgacatcgtactagaacacggaagctgtgtaactaccatggccaaaaataaaccaacacttgattttgaactaatcaaaactgaagcaaaacaccccgcaacacttagaaaatattgtatagaagcgaaactgacaaacactacaacggcaagtcgatgcccgactcaaggggaaccatcattgaatgaagaacaagataaaagattcgtatgtaaacattcgatggtggacagaggatgggggaacgggtgcggcttattcggaaaagggggaattgttacctgcgcaatgttcacatgcaagaaaaatatggaaggaaaagtagtccaaccagaaaacttagaatacactatagtaataacacctcatagcggagaagaaaacgcagtaggtaatgatactggtaaacacggaaaagaaataaaagtaacaccacagagttcaataaccgaagcagaattaacgggttatggtacggttacaatggaatgttctcctagaacgggcttagattttaacgaaatggtcttactacaaatggaaaataaagcatggctagtacatagacaatggtttttagatctaccgttaccatggttaccaggtgcagacacacaaggatccaactggattcaaaaagaaactttggtaacattcaaaaacccacatgccaagaaacaagacgtggttgtacttgggtcacaagaaggcgctatgcatacagcgttaacgggtgctactgaaattcagatgagtagcggtaatctactattcactgggcaccttaaatgtcgcttacggatggacaaattacaactaaaaggaatgtcttacagtatgtgcaccggcaaatttaaagtagttaaagaaatagcggaaactcaacacggaaccatagttatacgggtacaatatgaaggagatggaagcccgtgtaagataccctttgaaattatggatctagagaaacgtcatgtgttaggcagattgatcacagtaaatccaatagttacagagaaagattctcctgttaatattgaggcagaaccaccgtttggagattcatatattattataggagtggaacctggacagctaaaactcaattggttcaagaaaggatcatctatcggccaaatgttcgaaacaactatgcgaggagcgaaaaggatggccatattaggggacactgcttgggattttggtagccttggtggtgtattcacatcaataggaaaggctctacaccaagtatttggagctatatacggtgcagcattttctggcgtaagctggactatgaaaatacttataggagtagttattacatggataggtatgaactcaagatctacttctctcagtgtctcgcttgtacttgtcggagtcgtgacgctctatttaggcgttatggtgcaggctgacagtggatgtgtagtttcctggaaaaataaagaattgaagtgtggaagtgggatatttattactgacaatgtgcatacttggacagaacaatataaatttcaaccagaaagccctagcaaactcgcttcagcaatacaaaaagcgcatgaagaaggtatatgtggtataagaagtgttacccgactagagaatctaatgtggaaacaaataacaccagagctaaaccacattttaagtgaaaatgaagttaaacttactattatgacgggagacatcaaaggaataatgcaagctgggaaaagaagtctacgaccacaacctacagaactgaagtactcatggaaggcttgggggaaggcgaaaatgctatcaacagaactgcataatcatacatttctaattgatgggcccgagactgccgaatgtccaaatactaacagagcatggaactccttagaagtagaagactatggattcggcgtttttactaccaacatttggctaaaattgaaagaacgtcaagatgtattttgcgattctaagctcatgtctgcagccattaaagataatagggctgtacacgccgatatgggctactggatagaatccgcactaaacgacacttggaaaatcgaaaaggcttcatttatcgaggtaaaatcatgccattggcctaaatcacatactctttggtccaacggggtgttagaatcggagatgataatacccaaaaatttcgccggtccggtgtcgcaacacaattatagaccaggatatcatacacagacagctggaccctggcacttgggtaagctagaaatggacttcgatttctgtgaaggcaccaccgtcgtagtaacagaggattgtggtaatcgaggcccgagtttgaggacaacaacagcctcaggaaaactaatcactgaatggtgctgccggtcctgcacgctgccacctcttagatatagaggtgaagatggatgctggtatgggatggagattagacctctaaaagaaaaagaagaaaatcttgtcaattcgttagttacagcgggtcacggtcaaatagataacttttctctgggagtattaggaatggcactatttcttgaagaaatgcttagaacaagggtcggaacgaaacatgcgatcctcctagttgcagtaagtttcgtaactttaataacgggaaacatgagctttagagatttagggagagttatggtaatggtcggggccactatgacagatgacattggcatgggggtgacatatctggcgctcctagcggcttttaaagtgagaccaacctttgcggcaggcttgctacttaggaaattaaccagcaaggaattaatgatgacgacaatcggcatagtactcctatcacagagtaccatacctgaaacgatccttgaactgacagatgcgctggcactaggtatgatggtattaaaaatagtaaggaacatggagaaataccaactagctgtaacaatcatggctatcctctgtgtaccaaacgcagtaattttgcagaatgcctggaaagtgtcgtgcacgaccttagccgtggttagcgtgagcccgctgttgctcacgagctcgcaacagaaagcggattggatacctctggcattaacgataaaaggcctgaatcctactgcgatattcttaacaaccctatctagaacgagcaagaaaagatcttggccattgaacgaagctataatggctgtagggatggttagtatcctagcctcatcccttctcaaaaatgatatacccatgacggggccgctagtggccggaggtctgctcacagtttgctacgtcttgacaggcaggagcgcagatctagaattagaaagagcggctgatgtacgatgggaagaacaagcggagatctcaggtagctctcccatattatcaataacaatcagcgaagatggatcaatgagcatcaaaaacgaggaagaagaacagacactgacaattcttatacggacaggtctactcgtaatctccggactatttccggttagtatacctataacagcagctgcttggtatttatgggaggtcaagaaacagagagcgggagtgttgtgggacgtaccttctccaccacccgttggaaaagctgagttagaggacggtgcttaccgaattaaacaaaaaggaatacttggttacagtcaaataggagtgggagtatataaagaaggcacatttcataccatgtggcacgttacacgtggggcagtactgatgcacaaggggaaaagaatagaaccatcgtgggcagatgtaaagaaagacttgatttcctatggtggaggttggaaactagaaggagaatggaaagaaggggaagaagtgcaagtattagcactagagcccggcaaaaacccacgtgcagtacaaactaaacccggtctctttaaaactaatacaggtacgataggggctgtttcacttgatttttctccaggcacaagtggaagtccaatcgtagataagaaaggaaaagtagtcggactatatggtaatggagtggtcacacgaagcggtacctatgtaagtgctattgctcaaacagagaaaaatattgaggacaatcctgaaatagaggatgacatattcaggaagaaacgattaacgattatggatttacaccctggagcgggtaaaacaaagcgatacttacctgccatcgtacgagaggctattaaaagagggctaagaactttaatactcgcgcccacacgcgtggtcgccgcggaaatggaggaggctttgagaggactcccgattcgctaccagactccggcaattcgcgctgagcataccggcagggaaattgtcgatcttatgtgtcacgcaacatttaccatgagactactatccccgatacgagtgcccaattataatttaataattatggacgaggctcacttcacagatcctgcctcaatagccgctcgaggttatataagtactagggttgaaatgggtgaagccgcaggtatctttatgactgcaacacctcctggctcaagggatcctttccctcagagcaacgcccctataatggacgaagaacgagaaatccctgaacgtagttggaatagcgggcatgaatgggtaacggattttaaagggaaaacggtatggtttgtaccgagcattaaagcaggcaatgacatagcagcgtgtctaaggaaaaacggcaagaaagtaatacaattatctcgcaaaacatttgactctgaatatattaaaacaagaacaaatgattgggacttcgttgtgacaacagacatatctgagatgggggcaaacttcaaagcggagagagtgattgatccgagacgttgtatgaaaccggtaatcttaacagatggggaagaacgagtaatcctagctggcccaatgcccgttacccattcctcagcagcacaaagacgaggaagagtaggtcgtaatcccaaaaatgaaaacgaccaatatatttacatgggtgagcctctcgagaatgatgaagactgtgctcattggaaagaggccaagatgctcttagataatattaacacacctgagggaatcattccatcaatgtttgaacctgaacgagaaaaggtagacgcaatagatggagagtataggttgcgaggagaagccaggaagacattcgtagacttgatgaggcggggagatcttcccgtatggctggcgtacagagtggccgcagaaggcattaactatgcggatagacgctggtgctttgatggagttaaaaataatcaaatactagaagaaaacgtagaagtcgaaatatggactaaagagggcgaaaggaagaaacttaaaccgcggtggcttgatgcacgtatatattctgacccgttagcgctaaaagagttcaaagagtttgccgcaggacgtaaatcgttaactctaaacttaattacagaaatgggccgtctccccacgtttatgacacaaaaggcgaggaatgcacttgataacttggctgtcttgcatacagctgaggcaggaggacgagcatacaatcacgcgttatctgagttgccagaaactcttgaaacactattattgctgacgttattagcaactgtcacgggtggtatatttttatttctcatgagcggaaaaggtatcggcaagatgaccttaggaatgtgctgtattataactgcgagtgtcctcctatggtatgcacaaatacaaccacactggatagcagcgtcaataattctagagttcttcttaattgtgctcttgatacccgagcctgaaaagcaacgtacacctcaggataatcaactaacctatgtcgtaatagcgatattaacagtagtagctgccacaatggcaaatgaaatgggatttttagagaaaactaagaaagacttcgggctcggtagcattgctacacagcaaccagaaagcaacattctggatatagacctcaggccagcttccgcatggacactttatgccgtagctaccacctttataacccctatgctaagacatagcatcgaaaattcttctgtaaacgtaagtcttactgcaatagcaaatcaggctactgtactaatgggtctagggaaaggctggcccctatctaagatggatataggtgtaccattactagccatcggttgctattcacaggtaaatccaataacgttaacagcagcgttactattacttgttgcacattacgctataattggaccaggtttacaagctaaggcgacgagagaagcacagaaaagagcggctgcaggaattatgaaaaacccgactgtagatggtattactgtgattgatttagatccaataccgtatgatcctaaatttgaaaaacaactaggacaagtcatgttattggttttgtgcgtaacacaagtattaatgatgcgtacaacgtgggcgttatgcgaagctctaacactagccaccgggccgatttctacactctgggaaggaaatccaggacggttctggaatacaacgatagcagtgtcaatggccaatatatttcgaggatcctatttagctggcgcgggtttattgtttagcataatgaaaaacacagctaataccagaaggggaacaggaaatactggtgaaacactaggagaaaaatggaagaaccgattaaatgcgctagggaaatcagagttccaagtctataagaaaagcggtatacaagaagtagataggactctggccaaagaagggatagagaggggagaaacagaccatcacgcggttagtcgcggtagtgcgaaactgcgttggttcgtagagcgcaatttagttacacctgaggggaaggtcgtggatcttggatgcggacgtgggggatggtcatactattgcggtggcctcaaaaatgtaaaagaagtcaaaggcttaacaaaaggaggacctggacatgaagaacccatccctatgtctacatacggctggaatttagtacgcctacaaagtggagtagacgtattctttactccacccgaaaagtgcgatactctactgtgtgatataggcgaatccagtcccaatccaacagtcgaagcaggaagaacactacgagtcttaaacttagttgaaaattggttaaacaataatacacaattctgcattaaagtattaaatccatacatgccatcagtgattgaaaagatggaagcactacaaaggaagtacgggggcgccttggtaaggaatcctttatcgagaaattctacacatgagatgtattgggttagcaatgctagcggcaatattgtgagtagcgttaacatgatatcaagaatgctgataaacagatttaccatgcgccacaagaaagcaacatacgaacctgatgttgatttaggaagtggaacaagaaatatcggcatagaatctgagataccaaacttggatattataggaaaacggatcgagaaaataaaacaagaacatgaaacaagttggcactacgaccaagatcatccatacaaaacttgggcctaccacggctcatacgaaacaaaacagacaggaagtgccagctcaatggttaatggagttgttagactactgaccaaaccatgggacgtgattcctatggtaacacaaatggcaatgacggacacgacaccctttggtcaacaacgagtttttaaagaaaaagtagatactcgaactcaagaaccgaaagaaggaacgaagaaactaatgaaaattactgcagaatggttgtggaaagaattgggcaagaagaaaaccccgagaatgtgtacaagagaagagtttaccaggaaagtaaggtcaaatgcggcgctaggcgcaatttttacagacgaaaataagtggaaatcagcaagggaagcggtggaagacagcggattttgggaattagtagacaaagaaagaaatctacaccttgagggcaagtgcgaaacctgtgtatataatatgatgggtaaaagggagaagaaactaggtgaatttgggaaagctaaaggttcacgtgccatttggtatatgtggcttggggccagatttctagaatttgaggctttaggctttttaaatgaagaccattggttttctagagaaaacagccttagtggcgttgaaggagagggtttgcataaactaggttatattttacgcgatgtcagcaaaaaggaaggtggggctatgtatgccgacgacacagcaggttgggataccagaataacgttggaagacctcaaaaatgaggaaatggtcacaaatcatatggaaggagaacacaaaaagctcgctgaagccatctttaaattaacatatcaaaacaaagtagttcgtgtacagagaccaacgcctcgtggaacggttatggacataatatcaagaagagatcagagagggtctgggcaagtagttacctacggccttaatactttcacaaatatggaagctcagctaattagacagatggaaggagaaggagtattcaaatccatacaacacttaacagttactgaagagatagcggtcaaaaactggctggctagagtaggtcgagaaagattatctaggatggctatctcaggtgacgattgtgtagtaaaacccttagacgacaggtttgcatcggcattaactgcactaaacgacatggggaaagtgcgcaaagatatacaacaatgggagccctcacgtggctggaacgattggacgcaagttcctttttgcagccatcactttcacgagttaattatgaaggacggaagggtattggtggttccctgcagaaatcaagatgaattgatcggcagagcaagaatttcacaaggggccggatggtcacttagggaaactgcttgtttaggtaagagctacgctcaaatgtggagtttaatgtattttcaccgtagagatttacgtcttgccgccaacgcgatatgttccgcagttccgagccactgggttcccacctcacgaactacatggtctatccatgctacacatgagtggatgacgactgaagatatgctaactgtttggaaccgtgtatggatacaagaaaatccatggatggaagataaaacacctgtcgaatcgtgggaagaaataccatatttaggaaaacgcgaagatcaatggtgcggttcacttataggtctcacctcaagagctacgtgggcgaaaaatattcaaacagctattaatcaggttagatcacttattggtaacgaagagtatacagattatatgcccagcatgaagaggtttaggcgagaagaagaagaagctggggtactatggtga

SEQ ID NO: 22166 - RNA, 9876 nt, synthetic construct
  misc_feature 1..9876: note = derived and/or modified CDS sequence (opt6) from DENV-2__AB189123__SS-prME
  source 1..9876: mol_type = other RNA
actgcaggggtaataataatgatgattcctacagtaatggcattccatcttacaacgcgaaatggggaacctcacatgatagtgtcacgccaagaaaaaggcaaatcgttgttattcaaaacggaaaacggtgttaacatgtgcaccctgatggcaatggaccttggagaactttgtgaagatactattacgtacaattgcccacttttaaggcaaaatgaacccgaagacattgattgttggtgtaattcaacatcgacctgggttacatatggaacttgcactgctacaggggagcaccgccgagaaaaacgcagcgtagctttagcacctcatgtggggatggggttagaaaccaggactgagacgtggatgagctctgagggtgcatggaaacacgcacaaaggatagaaacctgggtacttcgtcacccaggtttcacaattatggctgcaatcctagcttacaccattggcacgacatacttccaacgagtactcatatttatacttctaacagccgtagccccaagcatgaccatgcgctgtataggcattagcaatcgagatttcgtagagggcgtaagtggaggcagttgggttgatatcgtcttggaacatggaagttgtgtaacaacgatggctaaaaacaaaccaactttggattttgaactcattaaaactgaggccaaacatcccgcaactttgcgaaaatactgtatagaagcaaaactcacgaataccacaactgcttcacgatgcccaacacaaggtgaaccatcattgaatgaagaacaagataaaagattcgtctgcaaacattcaatggtagacaggggatggggaaatggatgtggactatttggtaaaggaggtattgtaacatgtgcgatgtttacctgtaagaaaaatatggaaggtaaagttgtacaaccggagaatctagaatacacgattgtcataaccccgcacagtggagaagagaatgctgtaggtaacgatactggcaaacacggaaaagaaataaaagtaactccacaatcctccataacagaggctgaattaactggatacggcacagttactatggaatgctcaccaagaacggggctagattttaatgaaatggtacttttgcaaatggagaataaggcttggcttgtccatcgacaatggttcctcgacttacctcttccttggctaccgggggcagacactcaaggttcaaattggatccagaaagaaactctggtaacttttaaaaatccacatgcaaagaaacaagatgtagtagttctaggtagccaagaaggtgcaatgcacacggcacttactggagcaaccgaaattcaaatgtctagtggaaatctattatttacgggccatctaaaatgtcggctacggatggataaattacaattaaaaggtatgtcgtattcaatgtgtactggaaaatttaaagtagtgaaagagatagccgaaacccaacatggcactatagtaattcgagtacaatatgaaggtgacggaagcccatgcaaaataccttttgaaataatggaccttgagaaacgacatgtactaggtagattaattactgtaaacccgatagtaacagagaaagatagtccagtaaacattgaagccgagccgccattcggcgattcctacattataattggagtagaaccaggtcaactaaaactaaactggtttaaaaagggtagtagtattggtcaaatgtttgaaaccactatgaggggagctaagaggatggccattctaggggataccgcatgggatttcggatcattgggcggagtctttacttcaatcggtaaggccctacaccaagtgtttggagccatttacggagcagccttcagcggagtatcatggactatgaaaatcttgatcggtgtagttattacatggattggcatgaactctagaagtacatctctaagtgtatctctcgtactcgttggtgttgtgacactctatctaggggtcatggtacaagcagacagcggctgtgtcgtcagttggaaaaataaggagttaaaatgcggttccgggatattcatcacggataacgtacatacctggactgaacagtacaaattccaaccagaaagcccttctaagctagctagtgcaatacaaaaggcacatgaagaaggaatctgcggaataagaagtgtaacccgtttggaaaatctaatgtggaaacagatcaccccagaattaaatcatattttatcagaaaacgaagtaaaacttactatcatgacaggagacattaagggtatcatgcaagctggtaaaagaagtttaagaccacagccaactgagttaaaatactcatggaaggcttggggtaaagccaaaatgctatctaccgaattgcacaatcacacctttttgattgatggacctgaaacagcagaatgcccaaataccaatagggcctggaactccttagaagtagaagactatggttttggagtatttacaacgaatatatggctgaaactaaaagagcggcaggacgttttctgcgattcgaagttaatgagcgcagcgattaaggataacagggcagtacacgcagacatgggatattggattgaatctgcgctgaacgatacttggaaaattgaaaaagcctcatttatcgaagttaaatcatgtcactggcctaagtctcatacgttatggagcaatggagttctcgagagtgaaatgatcatacctaaaaatttcgcagggcccgtgtcacaacacaattatagaccaggataccatacccaaaccgctgggccttggcatctaggtaaattagaaatggattttgatttctgcgaaggaacaactgtagtagttactgaagattgcggtaatcgaggaccatcattaaggacaactacagccagcggaaaattgataactgaatggtgctgtagatcttgcactctgcccccattaagatatagaggtgaagatggctgctggtacggtatggaaatacggcctttgaaggaaaaagaagaaaatctagtaaatagtttagttacagcaggccatggacaaatagacaatttttctctgggcgttcttggaatggcgttatttttagaagagatgctccggacaagggtggggactaaacacgcaatactcctcgtggctgtatcattcgttacactcattacaggaaacatgtcttttcgtgatttaggaagagttatggttatggtaggtgcaacaatgacggatgatataggaatgggggtgacgtatttagcattactagccgccttcaaggttcgtcctacttttgccgctggcctgcttttaaggaaacttacatctaaagaacttatgatgacaacaattggcattgtactcttaagtcaaagcaccatacccgaaacaatactagaattaactgacgcactagcacttggtatgatggttctaaaaattgtaagaaacatggaaaaataccaactagcagttacaataatggcaatcttatgtgtaccaaacgcagtaatactacaaaatgcatggaaggtaagctgtacgactcttgccgtggtgtccgttagtccattgctgctaaccagtagtcaacagaaagcagactggataccactcgcgttgacaataaaaggattaaaccccactgcaatatttctaaccacgctgagtaggacatcaaagaaaagatcatggccactaaacgaagccatcatggctgttggaatggtctcaattttagctagctcattgttaaagaatgatatcccaatgactggcccattagttgcgggcgggttgttgacagtatgttatgtactcactggacgttccgccgaccttgaactagaacgtgccgccgatgttaggtgggaggaacaggctgaaatatcaggttcttctcctattctctcgatcactatttctgaagatggttcaatgagcattaaaaatgaggaagaagaacagacactcacaatcctaattagaactggtttattggtcatctccggtctattccccgtgagcatcccaataacagcagcagcatggtacttgtgggaagtcaagaaacaacgagcaggagtcttgtgggatgtaccgagcccgccacccgttggcaaagccgagcttgaggacggagcgtatcgaattaaacagaaaggtatattaggatactcacaaattggtgctggcgtatataaagaagggacctttcatacgatgtggcacgtaaccagaggagcagtactaatgcacaaaggtaaaagaatagaacccagctgggctgatgtcaagaaagatttaattagctatggtggaggttggaaactagaaggtgaatggaaagaaggggaagaagtacaagtattagcacttgaaccaggcaaaaacccgcgcgctgtacagactaagccaggcttgttcaagactaatacggggactattggagcagtgagtttggatttcagtcctggcactagcgggagtccgattgtagacaagaaaggaaaagtagtaggtttatatgggaatggagtagtgacacggtctggtacatacgttagtgcaattgctcaaacagagaaaaacatagaagacaaccccgaaattgaagatgacattttccgcaagaaaaggcttactatcatggacttgcatcccggagcagggaaaacaaaacgttacttgccagcaatagtaagggaagccattaaacgaggacttcgcacgctaatcttagccccaacacgtgttgtggccgctgaaatggaagaagcgttaagaggcttgcctattcgatatcaaacaccagcaattagagccgaacacacgggcagagaaatcgtagatctaatgtgccacgcaacgttcacaatgagattgttaagcccaatacgggtcccaaactacaacttaataattatggacgaagctcatttcactgaccctgctagtatagctgcgagaggctatatatcaactagagtggaaatgggtgaagctgcaggcatattcatgaccgcaactcctccggggtctagagatcccttccctcagagcaatgctcctataatggacgaggaaagagagatacctgaaagatcgtggaacagtggacatgaatgggtgacagacttcaaaggtaaaacagtatggtttgttccatcaatcaaggctggtaacgatatagcagcatgcttaaggaaaaatggaaagaaagtcatacaactaagtagaaaaaccttcgactcagaatacattaagacgagaacgaacgattgggacttcgtcgtaacaaccgacataagtgagatgggtgcaaattttaaagcagaacgagtaatagacccacgaagatgtatgaagccggtaattctaacagatggggaagaaagggtgattttagcaggtcctatgccggtaacacactcaatagcagcacaaaggcgaggtagagttggacgaaaccctaaaaacgagaacgaccaatacatatatatgggcgaacccttagaaaatgatgaggattgtgctcactggaaagaggctaagatgttactagataatatcaatacgcctgaaggtatcataccatctatgttcgaaccggaacgggaaaaagttgatgcaatagatggcgagtatcgtttaagaggtgaggcccgtaagacatttgtggacttaatgcgccgaggagatctgccagtatggttagcatatagagtagccgctgaaggtatcaattatgctgaccgtagatggtgttttgacggcgtcaaaaacaatcagatactagaagagaatgtagaagttgaaatctggactaaagaaggagaacgaaagaaactaaaaccacgttggttggatgccagaatctactccgaccccctggccctaaaagaatttaaggaatttgccgccggaagaaaaagcctaactctaaacttaataaccgaaatgggaagattacctacattcatgacccaaaaagcaagaaatgcacttgataacttagcagtcttacatacagctgaggcaggaggtcgcgcttataaccatgcactatctgagttaccagaaactttggaaacgctgttattattgacacttctcgctacagtaacaggaggcatattcctgttcttaatgagcggaaagggaataggaaaaatgacgttaggtatgtgttgcataataactgccagtgtattactatggtacgcccaaattcaaccacattggatagctgcctcaataatattggaatttttcctaatagttttgctgataccagaaccagaaaaacaaaggacaccccaagataatcaactaacatatgtagtaattgcgatcttaacagttgtggcagccactatggctaatgaaatgggatttttagagaaaacgaaaaaggattttggattggggtctattgcaacacaacaacccgaatcaaacatattggatattgatttaagaccggcgagtgcttggactctttatgcagttgcaacgacatttataacgccgatgcttcgccattcgatcgagaatagtagcgtaaatgtgagcttaacggcgatagcgaatcaagctacagtattgatgggattaggcaaggggtggccattaagcaaaatggatataggagtaccactgttagccattgggtgctattctcaagtgaacccgatcaccctcactgctgcactattgttacttgtcgcccattacgctataatcgggccaggtttacaagcgaaagccacgagggaagcgcaaaaacgtgcagctgccggaataatgaaaaacccaacagtagatggcataacagtcattgacttagatcccataccatatgatcccaaattcgaaaagcagctagggcaagtaatgttattggtactttgcgtaacacaagtcttaatgatgagaactacttgggccttatgtgaagctctaacattagctactggtccaataagcacactatgggaagggaatcctggtagattttggaatactactatcgcggtctccatggcaaatatttttcggggttcctatctagcgggtgcaggactgttattttccataatgaagaacactgcaaatactagacgagggacaggtaacacaggtgaaaccttgggcgaaaagtggaagaatcgattgaacgcccttgggaaatcagaatttcaaatttataagaaatcaggtattcaggaagtcgatcgtactctcgctaaggaaggaatagaacgaggagaaacagaccatcatgctgtgtctcgggggtcagcaaaattgcggtgctttgttgaaagaaatctagtaacacctgagggaaaggtagtagatttgggatgtgggcgaggtgggtggtcctactattgtggtggactgaaaaatgtaaaagaagttaaaggtctcacaaaaggaggtccaggacatgaggagccgatcccgatgagcacttatggttggaacctagtgagactacagtcaggtgtcgacgtgtttttcacgccgccagagaagtgtgatacgcttctgtgcgatattggtgaaagcagtccgaatcctaccgtggaggctggcagaacattacgtgtattaaaccttgtagaaaattggctcaaaaataatacacaattttgcataaaggtgctaaatccttatatgccctcagttatcgagaaaatggaagccctacaacgcaagtacggcggtgccttagttcggaatccgctgagtcgaaacagtactcatgaaatgtattgggttagcaatgccagtggaaatatcgtcagcagtgtaaatatgatcagcagaatgttgataaaccgcttcacgatgcgccataagaaagctacctacgaaccagatgtggatcttggctcgggaacaagaaacattgggattgaaagtgaaatcccgaatttagacatcatcgggaaacgaatagagaaaataaaacaagaacatgaaaccagttggcactacgatcaggatcacccatataagacttgggcctatcatggatcgtatgagactaaacaaacaggatcggcaagcagtatggtaaatggggttgtccgactcttaacaaaaccgtgggatgtgataccgatggtaacacaaatggcgatgacggacacaacaccctttggacaacaaagagttttcaaagaaaaagtagatacaagaacgcaagaacctaaggaaggaactaagaaattaatgaagattacagcagaatggttgtggaaagaattagggaagaaaaagacaccaaggatgtgtactagagaggaatttaccaggaaagttcgtagtaatgcggcactaggagctatttttactgatgaaaataaatggaaatcagctcgggaagcggtagaggacagtggcttttgggaattagtagataaggaaagaaatctacatctcgaaggaaaatgcgagacttgcgtatataatatgatgggaaaaagggagaagaaattaggggaatttggcaaagcaaaaggttctcgggcgatatggtacatgtggctcggggccagatttttagagtttgaggctttgggcttcttaaacgaagaccattggtttagccgagaaaattccctaagtggagtcgaaggagaagggctacataaattaggctatatattacgggatgttagcaagaaagagggtggagcaatgtacgcagacgacactgcgggctgggacacacggataacgctagaggatcttaaaaacgaggaaatggtcacaaatcacatggaaggcgaacataagaaacttgccgaagcaatatttaaactaacctatcaaaataaagtagtgagagtacaaagacctaccccacgaggtacggtgttagatataataagccgccgagaccagagaggatcaggacaggtggtgacgtatggattaaatacctttacaaatatggaagcgcaattgattcgtcaaatggaaggcgagggagtattcaaaagcatccagcaccttactgtaactgaggaaatcgcagttaaaaattggttggcacgagtaggaagggaacgcttgagccgaatggctatctcgggtgacgactgcgtcgtcaaaccactggacgatcgtttcgcttctgcccttactgctcttaacgatatgggcaaagttcgaaaagatattcaacaatgggagccgagtcggggatggaatgattggactcaggtaccattttgtagtcatcatttccatgaattaataatgaaagacggacgcgtattagtagtaccctgtcggaatcaagacgaattaataggtagagctagaatttcccaaggcgccggctggtctttaagagaaacagcttgtctaggaaaatcctacgcacagatgtggtcacttatgtatttccatcgcagagacctaagactggccgcaaatgcaatatgtagtgcagtacctagtcattgggttccaacatctcggacaacatggagcatccacgcgacacatgaatggatgacaacggaagatatgttaactgtgtggaatcgtgtatggatacaagagaacccgtggatggaggacaaaacaccagtagagtcatgggaagagataccttatctcggaaaacgtgaagatcaatggtgtgggtctttgataggcttaacgtcgcgtgcgacctgggccaaaaacatccagacagcaattaatcaggtcagatctctaattggaaatgaagaatacacagactacatgccttcgatgaaaagattccgccgcgaggaagaagaagcaggagtgctttggtaa

SEQ ID NO: 22167 - RNA, 9876 nt, synthetic construct
  misc_feature 1..9876: note = derived and/or modified CDS sequence (opt6) from DENV-2__AB189124__SS-prME
  source 1..9876: mol_type = other RNA
acagctggagtaataattatgatgatacctacggtaatggcctttcatttaacgaccagaaatggagaaccacatatgatcgtttcaagacaggagaaaggtaaatcactcctttttaaaacggaaaatggggtcaatatgtgcacgttgatggctatggacctaggcgaactttgtgaagatacaattacatataactgtcctctgcttagacagaatgaaccagaagatattgattgttggtgtaactcaacgagcacgtgggtaacgtacggtacatgtactgcaacgggagaacatcgccgtgaaaaaaggtctgttgctttggctccccatgtaggaatgggactcgaaactagaacagaaacatggatgagcagtgagggggcatggaagcatgctcagcgtatcgagacatgggtattgcgccacccggggtttacaattatggcggctattcttgcatatactataggtacaacatactttcagagagttctgattttcatcctattgaccgcagtagccccgtcgatgaccatgcgctgtataggaatatcgaatcgcgactttgtagagggcgttagtggtggttcctgggtggacattgtactagaacacggatcttgcgtaacaactatggctaaaaataaacccacgcttgactttgaactaataaaaaccgaagccaagcatcccgcaacactaagaaaatattgcatagaggcaaaacttacgaacacaacaactgcctcgaggtgcccaacgcaaggagagccatcattaaacgaagaacaagacaaaagattcgtatgcaaacactctatggttgatcgtggatggggtaacggatgtggtctatttggcaagggtgggatagtaacttgcgcgatgtttacatgtaaaaaaaacatggagggtaaagtagttcaacctgaaaatttagagtacaccatagtgataacaccgcactccggtgaggaaaatgctgttgggaacgacactggaaagcacggtaaggaaataaaagtaactccccagagctccataaccgaggctgaattaacaggctacggaacagttacaatggaatgttcgccaagaacaggcttagatttcaacgaaatggtactgttgcaaatggaaaataaagcgtggttagtacacagacaatggtttttagacttaccactaccctggctccccggcgctgacacacagggttcaaattggattcaaaaagaaaccttggttacatttaaaaatccacacgcgaaaaaacaagacgttgtggtacttgggagccaagaaggtgcgatgcatacagcgttaactggcgcaacagagatacaaatgtcatcaggaaacttgctcttcactggacatctaaaatgccggttgagaatggacaaattacaattaaaaggtatgtcttatagcatgtgtactggaaaatttaaggtagtgaaagaaatcgctgaaacacaacacgggacgattgtgattagagtccaatacgaaggcgatggtagtccttgtaagatccccttcgaaataatggatttggaaaaaagacacgtattaggaaggcttataactgtcaacccaatagtaactgaaaaagactctcctgttaatattgaagctgaacctccgtttggtgattcctacattatcatcggggtagaaccaggacaattaaaactaaactggtttaaaaaaggatcatctatcggacaaatgtttgaaacaacaatgagaggggccaaaagaatggctatcttaggcgacacagcctgggattttggaagcttgggaggcgttttcacatcgattggtaaggcactccatcaagtatttggagccatatatggtgctgccttctctggtgtgtcctggacaatgaaaatacttataggcgtcgtcatcacctggattggcatgaacagccgtagcacaagcttgtcagttagtctagtcttagtcggtgtcgtaactctatatctgggcgttatggtgcaagctgatagtgggtgtgtagtaagctggaagaataaggaattaaaatgtggtagcgggatcttcataaccgataatgtacatacgtggacagaacaatacaaatttcagcccgaatctcctagcaagctagcctcagcgatacaaaaagcacatgaagaaggaatatgtggtattaggtcggtaacaagactggaaaatttaatgtggaagcaaattactcccgagttaaatcacatactaagtgaaaacgaagtaaagttaacgataatgacgggggacatcaaaggaataatgcaagccggaaagcgtagtttgcggcctcaaccaaccgagttgaagtatagttggaaagcttggggtaaagcaaaaatgctgagcacagaactacataaccacacattcttaattgacggaccagaaacagccgaatgcccaaacaccaatcgagcttggaacagtttagaagtagaagattacgggttcggagtattcactactaatatctggcttaaactcaaagaaagacaagatgtattttgcgattcaaagctgatgtccgcggcgattaaagacaacagagctgtccatgccgatatgggatattggatagagtcagcactaaatgacacttggaagattgagaaagcctcatttattgaggttaaatcatgtcactggccaaaaagtcatacattatggagcaacggtgtgctagaatctgaaatgattatacctaagaacttcgctgggccggtctcgcaacataattacagacccgggtatcatactcagactgccggtccatggcacttaggaaagctagaaatggattttgatttttgtgaaggaacaactgtggtcgtcactgaggattgtggtaaccggggtccctcactacgaaccacgacagcgtcaggaaagttaattaccgagtggtgctgccgctcatgtactctccctccactaagataccgaggggaagatggttgttggtatggtatggaaatcagaccccttaaagaaaaggaagaaaacttagtgaacagcttggtgactgccgggcatggccagatcgacaacttttcacttggagttttaggcatggctttatttttagaagagatgttgcgcactagggttggtactaagcatgcaatcttgttagtggcagtgtcatttgttacgctgattactggaaatatgtcttttcgcgatttgggacgagtaatggtgatggttggagctacaatgacagacgatatcgggatgggcgtgacttatctagctttattagcggcgtttaaggtaagaccaacattcgcagcagggttactgttgcgaaaattgaccagcaaggagctaatgatgacaactataggtattgttttattatctcagtctacaatacctgaaacaatactagaacttacagatgccctggcgttaggtatgatggtactcaaaatcgtaaggaatatggaaaaataccaacttgcggtaaccataatggctattctgtgtgtacctaacgcagttatacttcaaaatgcctggaaagtttcatgcacaactttagcggtagtaagtgtaagtccattgcttttaaccagctcccaacagaaagctgattggatacctttagctctcaccataaagggtctaaatccaaccgccattttcctcacgacgcttagtagaacaagtaagaaacgtagctggccacttaacgaagcgataatggcagtcggtatggtcagtatactagcatcctcacttttaaaaaatgatataccaatgactggccctttagtagcagggggattactaactgtatgctatgtactcacaggtagatcagcagacctagaactcgaacgggctgccgatgtaagatgggaagaacaagcagaaatatcaggttctagtcccatcctgtctatcacaataagcgaagacgggtccatgtccattaaaaacgaagaggaggaacaaactctgacgattcttattagaaccggactcttagttatatcaggactattcccagtatccataccaataacagcggcggcgtggtacctatgggaggtgaaaaaacaacgggcaggagtgctttgggatgtaccatcacctccgcctgtaggtaaagctgaactagaagacggtgcataccgaataaaacagaaaggaatactaggttatagtcaaatcggagcaggagtatataaagaaggaacctttcatacaatgtggcacgtgacacgcggagccgtattgatgcacaaaggaaaacgcatagaacccagttgggctgacgtcaaaaaagatttaattagttacggaggcggttggaagttagaaggtgaatggaaagaaggagaagaagtgcaagttttagcactagaaccgggcaagaacccgcgagcagtgcagacaaaacccgggctatttaaaactaatacaggaactataggcgccgtctcccttgatttcagtccaggtacttcaggctctcctatagtggacaaaaagggaaaagtggtcggtttgtatggtaatggggtggttacgcgcagtggaacttatgttagtgccatagcacagactgaaaaaaatatcgaagataaccccgaaatcgaagatgacatatttagaaaaaagaggttaaccataatggacttgcatcccggggctggtaaaactaaaagatacctaccagcaatagtcagagaggcgattaaacgaggactaagaactttaatcttggcaccaacgagggtagtcgccgcagaaatggaagaagccctcagaggtttaccgattagatatcaaaccccagctataagagcagaacatacaggacgcgaaattgtggacttaatgtgtcatgcaactttcacgatgcgattattatctccaattagagtacctaattacaatttaataataatggacgaggctcatttcactgatccagcctcgatcgcagcaagagggtatattagtactcgagttgaaatgggtgaagcagcaggcatcttcatgacagcaacgcctccagggagcagagatccgtttccacagtcaaatgcccctattatggacgaagaacgtgaaataccagaacgtagctggaattcaggacacgaatgggtaacagactttaagggcaaaaccgtctggtttgtaccatcgattaaagcaggaaacgacatagctgcatgcttacgaaagaatgggaaaaaagttatacagctcagtcgaaaaacttttgactccgaatatataaaaacaaggacaaatgattgggattttgtggtaacaaccgacatatcggaaatgggcgcaaattttaaagctgaacgagtgattgatccacgccgctgtatgaaacctgtaatactaacggacggagaagaacgagtcatactcgcaggaccaatgcctgtgacgcatagctcagcagctcaaagacgtggtcgtgtgggacgtaatcctaaaaatgagaatgaccagtatatctacatgggcgagccacttgaaaacgacgaagattgcgctcactggaaggaggcaaaaatgctattagataacataaatacacccgagggaattataccatcgatgttcgagcctgaacgtgaaaaggtagatgcgattgatggggagtatagactccgtggggaagcaaggaaaacattcgtggatttaatgagaagaggagacctgccagtatggttagcctatagagttgcagcagaagggataaattatgcagatcgccgctggtgctttgatggagtgaaaaacaatcaaatacttgaagaaaatgtagaggtagaaatatggactaaagaaggtgaaaggaaaaaattaaaacctagatggctagatgcaaggatatattcagacccattagccctaaaagaatttaaagaattcgcggctgggcgaaaaagtcttactttaaacttaataactgaaatgggtagactaccaactttcatgacacaaaaagccaggaatgcgctcgataacctagcggtgctacatacagctgaagctggaggacgcgcctataatcatgcgctaagcgaattaccggaaacgctagaaacactacttctactaacgctattagcgacagtaacgggaggaatttttttattccttatgtcaggaaaaggaataggtaaaatgacactggggatgtgctgcataataactgcttccgtcctattatggtacgcccaaatacagccacactggattgcagcttcaattattttagaattttttctcattgtactgcttatcccagagcccgaaaaacaacgaactccgcaggacaatcagctaacatacgtagtaattgccatattaacggtagttgccgccacaatggcaaacgaaatgggtttccttgaaaagacgaaaaaagatttcggattaggcagcattgcgacacaacaaccggaaagtaatatactagacatagatttaagaccagcgagtgcatggactttatatgcggttgccaccacatttataacacccatgttgagacattctatcgagaattcatcagtaaacgtatctctcaccgcaatagcaaaccaagccaccgtacttatgggattaggaaaagggtggccactatccaaaatggatataggggtcccactgttggcaattgggtgttatagtcaagttaatcctataactttgaccgctgctttactcctattagtggcacattacgcaataatcggtccaggactacaagctaaggcgaccagagaggcgcaaaaacgcgccgccgcggggattatgaaaaatcctacggtcgacggcattaccgtcattgatttagatcctatcccctatgatcccaagttcgaaaaacagctgggtcaggtaatgctactagtactctgtgtgacgcaagtactaatgatgcgcacaacatgggcactttgcgaagctctcacactagctaccggccctataagcacgctgtgggaaggcaatccgggacgtttttggaacacaactatagcggtatcaatggctaatattttcagaggatcctatctggccggagccggtttgttattttcaatcatgaaaaacaccgcaaatacgcgaagaggcacagggaacactggagagacactaggggagaagtggaaaaacagactgaatgcactagggaaatcagaattccaaatttacaagaaaagtggaatacaagaggttgacaggaccctagcaaaagaaggtatagaaagaggagaaacagaccatcatgcggtatcgcgtggatccgcaaagttaagatggtttgttgaacgaaatttagtaactccagaaggtaaggtagtggatctcggatgtggacgaggagggtggtcgtactactgtggagggttgaagaacgtcaaagaagtaaaaggcttaacaaaaggtggcccagggcacgaagaaccaatacccatgagtacatatgggtggaatcttgttagactgcaatctggcgtcgacgtttttttcacgccacccgaaaagtgtgatacactgttgtgcgacatcggtgagagctcaccgaatccgacggtagaggcaggtaggacgctacgagtacttaacctagtcgaaaactggttaaaaaacaatacacagttttgcattaaagttttaaatccctatatgccctctgtaatagaaaaaatggaggcattacagagaaaatacgggggcgcactcgtacgtaacccattatctaggaacagcacccatgaaatgtactgggtaagtaatgcaagtggcaatatagtctcttcagtaaatatgatatcacgaatgttgataaatcggtttacgatgcggcataaaaaggctacttacgaaccagatgtagacttaggatctggaacaaggaacataggaatagaatcggaaattcctaatctagacataatcggaaaaagaatcgaaaaaattaaacaggagcatgaaacaagctggcactatgaccaagatcacccatacaaaacctgggcatatcacggtagttacgagacaaaacaaactggttcggcgagttcaatggtaaacggtgtcgttagattattgaccaagccatgggatgtgatcccaatggttactcagatggcaatgacagacaccaccccctttggacaacaacgggtttttaaagaaaaggttgacaccagaacccaagaacctaaagaaggaactaaaaagttaatgaaaatcaccgctgaatggctatggaaggaattgggaaaaaagaaaacaccaagaatgtgcacaagagaagaattcactagaaaggtaagaagcaatgctgccttgggagctatctttaccgacgaaaacaaatggaaatccgctagagaggcagtcgaggatagtgggttttgggaactagtcgacaaagaacgaaaccttcacctggaaggtaaatgcgagacttgtgtttacaatatgatgggtaaacgagaaaaaaaactaggcgaatttggaaaagcaaaagggtctagggcaatctggtatatgtggttaggagccagatttttggaatttgaagcgttaggtttcttaaacgaagaccattggtttagtagagagaattcattgagcggtgtagaaggtgaggggttgcataaattgggctatattttacgtgacgtatctaaaaaagagggtggtgcaatgtacgctgatgatacagcggggtgggacacccgtataacactggaagatctaaaaaatgaagaaatggtcacgaaccacatggaaggagagcataaaaaacttgcagaagccatttttaaactgacgtatcaaaataaagttgtaagagtgcaaaggcccacaccaaggggcacggtgatggatattataagtcggagggatcaacgagggagcggccaggtagtgacttatgggctaaatacatttacgaatatggaagcacagttaataaggcaaatggaaggagagggcgtatttaagagtatacagcacttaacggttacagaagagattgcggtgaaaaattggttagctagggttggaagagagcggttatcaagaatggctatctccggagatgattgtgttgtcaaacccctagatgatagatttgcctccgcactcacagcactaaatgatatgggaaaggtaagaaaagatatccaacaatgggagccatcacggggctggaatgattggactcaagtcccattttgcagccatcatttccatgaattaataatgaaagatggtcgagttttagtagtaccttgcagaaatcaagacgagttaataggacgagcacgaatctcacaaggtgctggctggtctttaagagaaactgcttgtttaggaaaatcatatgctcaaatgtggagtttaatgtattttcatcgacgagaccttagactagccgcaaatgctatatgcagcgcagtaccatctcattgggtccccacatccagaacaacttggagtattcacgcaacacatgaatggatgacaaccgaggatatgttgacggtatggaacagagtatggattcaagaaaatccgtggatggaagataaaactcccgtagaatcctgggaggaaataccgtatctaggaaaaagagaagatcaatggtgtggtagtttgatcggactgactagccgtgccacgtgggcaaaaaatatccaaacagcaataaatcaagttcgctcactaataggaaatgaggagtatacggactatatgccatcaatgaaacgttttagacgtgaagaggaagaggccggagtgctttggtaa

SEQ ID NO: 22168 - RNA, 9876 nt, synthetic construct
  misc_feature 1..9876: note = derived and/or modified CDS sequence (opt6) from DENV-2__AB122020__SS-prME
  source 1..9876: mol_type = other RNA
acagcaggcgttatagtgatgctcataccaacagctatggcttttcatttgacaactaggaatggggagccacacatgatagttggaaggcaggaaaaaggaaaatcattacttttcaaaacagaagatggcgtcaacatgtgtacattaatggcgatagatttaggcgaactttgtgaagatacaattacgtataaatgtcccctacttcgccagaatgaacctgaagatatagactgttggtgtaattcaacttctacatgggtcacctacggcacatgcaccactacgggagaacataggagggaaaaacgatctgtcgcactggttccacatgtaggcatgggtctggagacacgcacggaaacctggatgtcctcagaaggtgcatggaagcacgtacaaagaatcgagacctggatattaagacatcctggttttactatcatggcggcaatactagcatacacaatcgggaccactcactttcaacgagctttgatatttatattattaaccgctgtagctccgtcaatgaccatgagatgtatcggaatatctaaccgcgatttcgtagagggggtaagtggaggttcgtgggtagacatagttcttgaacatgggagttgtgtaactacgatggcaaagaataaaccgacactagatttcgagctgattaaaacagaagctaaacaaccggcaacattaagaaagtattgcattgaagcgaagttaaccaacactactactgagagtcgctgtcctacacaaggagaaccctcattgaacgaagaacaagacaaacgatttatatgtaagcactcaatggtagaccgagggtgggggaacggatgcggtttattcggaaagggtgggattgtcacatgcgcgatgttcacatgcaaaaagaatatggagggaaaaatagttcaaccagaaaatctcgaatacacaatagtaatcacgccgcacagcggggaagaacatgcagtgggaaatgatactggtaagcacggaaaagaaataaaaataacaccacagtcctcgactactgaagcagaactaacaggatacggcaccgtaaccatggaatgtagtccgcgtacaggcctcgattttaacgaaatggtgttattacagatggaagataaagcgtggttagttcatcgccaatggtttttggatctaccattaccctggttgccaggagcagatacacaaggttcaaattggatacaaaaagaaacactagttacatttaaaaaccctcacgctaaaaaacaagatgtagttgtgctaggcagtcaagaaggagccatgcatacagcactgacaggagcgacagaaattcaaatgtcctcaggtaatctgttattcacagggcacttaaaatgccgattgcgtatggataagttgcaactaaaaggaatgagctattcaatgtgcactggcaaatttaaaattgtaaaagaaatcgcagagactcagcatggcactatagtcatcagagttcaatacgaaggggatggcagcccttgcaaaataccatttgaaattactgacctcgaaaaaagacatgtgctaggaagactaataacagtcaacccaattgtaacagaaaaggacagtcctgttaatatagaagctgaaccgcctttcggtgatagctacataatcgtgggtgtagaacccggtcaattaaagcttaactggttcaaaaagggaagctctatagggcaaatgttcgagactacaatgaggggtgctaagcgaatggcaatcctgggagacaccgcctgggattttggatccttgggtggagttttcacgagtataggaaaggcattacaccaagtctttggtgcgatttatggggctgcgttctcaggagtaagctggactatgaagatattaataggtgtcatcataacatggatcggaatgaatagtcgaagtacgtctttaagcgttagcttggttctggtaggagtcgtcacactttatctaggagcaatggtgcaggcagattcagggtgcatcgtttcatggaaaaataaagagctaaaatgtggaagtggcatatttatcacagataacgtacatacctggacagaacaatataaatttcaacccgagagcccttctaaattagccagcgcaatacagaaagcacatgaagaaggaatatgtggcatacgaagtgtgaccagactcgaaaacctaatgtggaaacagataacaccggaacttaatcatatactgtcggaaaatgaagtcaaactcactattatgacaggtgacattaaaggtattatgcaagccgggaaaagatccctccgtccacaaccaacggaattaaagtatagctggaaaacttgggggaaagccaaaatgctttcaactgagagtcataaccaaacttttctaatcgacgggcccgaaaccgctgaatgtccaaatacaaaccgagcctggaatagtcttgaggttgaagactatggattcggggtcttcactactaacatttggcttaaattgcgagaaaagcaagacgttttttgtgactcaaaactcatgtctgctgccattaaagacaaccgagcagtgcatgcagacatgggatattggattgagagcgctcttaatgatacttggaaaatggaaaaagcatcatttatagaggtaaagtcatgtcactggccaaagtctcatacattatggagcaatggtgtgctagaatcagaaatgataataccgaagaatttcgccgggccggtatcgcagcataattataggcctggataccatacacagacagccgggccctggcatcttggtaaactagaaatggatttcgacttctgcgaaggaacaaccgttgtagtaaccgaggattgcggtaacagaggtccgagtttacgcaccaccaccgcttctggaaaacttataactgaatggtgctgcagaagttgtactttgccccctctacggtatagaggagaagatggatgttggtatggaatggaaattcgcccgcttaaggaaaaagaagaaaatcttgtgaactcgctggttaccgcaggtcatggccagattgataatttctcactaggtgtactaggaatggcattatttttagaagagatgcttagaacgcgtgtaggaactaagcatgccatattgttagttgccttatctttcgtcacactaataacaggaaacatgagcttcagagaccttgggagggtgatggtaatggtcggagccactatgacagacgatataggtatgggagtaacatacctagcactactagctgcctttaaagtgaggccaaccttcgcagctggcctactattacgcaagttaacttcgaaagaactaatgatggcaactatcggcattgcgttacttagtcaatctactcttccagaaacaattctcgaactaacagatgcattagcactagggatgatggtgttaaaaatagtaagaaatatggaaaagtatcaactagcggtcacgatcatggccataagctgcgtacccaacgctgtaatactccagaatgcttggaaagtgtcatgcaccatattagctgcagtatcagtttcaccattattactaacatcatcgcagcaaaaagcagattggataccattagcactcacgattaaagggctaaatccaacggcaatatttttaacaactcttagccgaactagcaaaaaacgtagttggccgctaaatgaagctatcatggcagtcggtatggttagcattttagcatctagtctattaaaaaatgacatccctatgaccggtcccttagtggcaggtggacttttgacggtttgttacgtattaactggcaggagcgcagacctcgaacttgaaagggcagctgatgtgaaatgggaagatcaagccgaaataagcggatccagccctatccttagcatcactatctcagaggacggttccatgtccataaagaatgaagaagaagaacagaccttgactatattaatccgaactggattattagtaatatcgggtgtttttcctgtgagtataccgattacggccgcagcatggtatctatgggaagtaaaaaaacaaagagcaggcgtattatgggatgtacctagtcctcccccagtcggtaaagcagaactagaagacggtgcctatcgaattaagcagcgaggaattttgggatactcccaaattggggcaggtgtatacaaagaaggaacttttcataccatgtggcacgtaacacgtggtgcagtattaatgcataggggtaagagaatagaaccatcatgggcagacgttaaaaaggatttaattagctatggtgggggatggaaacttgaaggtgaatggaaagaaggtgaagaggtccaggtattagcattagaacccggaaaaaacccgcgggcggtacaaacgaaaccaggtatatttaaaaccaacaccggaacaataggagccgtgagccttgattttagtccaggcacaagcggtagtcctatagtagatcgcaaaggtaaagtggttggcctttatgggaatggggtagtaacgaggtcaggagcgtatgtatcagctatcgcgcaaacagaaaaaagtatagaggacaaccccgagatagaggatgacatatttcgtaaaaaacgcctcaccataatggatttacatccgggggccggaaagactaagcgctacctaccagccatcgttcgagaggcgatcaaaagaggtcttcgtacacttattctagcaccaacacgggttgtagccgcagaaatggaggaagctctaaggggcctaccaatacgttaccagacgccggcaatacgagccgaacatactggacgggaaattgttgatctaatgtgtcacgccactttcacaatgcgactgttatcgccagtcagagttcccaattataacctaataataatggatgaagcccatttcactgacccagcatctatagccgcaagaggatacatatcaacccgagtagaaatgggagaggctgcaggaatcttcatgacggctacacctccagggagccgagacccatttccacaaagtaatgctccaataatggatgaggagagagaaatccccgaacgtagttggaattcgggtcacgaatgggtcacagactttaaaggaaaaacggtatggtttgtgccatcaattaaagctggaaatgatatcgcagcatgcctgaggaaaaatggaaagaaggtcatacagctatccagaaaaacttttgattctgaatatgttaagacacgtgcaaacgactgggactttgtcgttacaaccgatatatccgaaatgggagcgaactttaaagcggaaagagtaatagatccacgtagatgtatgaaaccagttatcttaacagatggagaggaacgagtcatactagcaggtccaatgccggtgacccacagttcagccgcacaaaggcgcggaaggatcggaagaaacccaaaaaatgaaaacgatcagtacatttacatgggcgaacctctagaaaatgacgaggattgtgcccattggaaagaagccaagatgctgctagacaatataaacactccagagggcataataccatcaatgtttgaaccggagcgggagaaagttgatgctatagatggagaataccgtcttagaggagaggcaagaaaaacattcgttgatctgatgagacggggagacctaccagtctggttagcatataaggtagctgcagaaggcataaactatgcagatagaaaatggtgctttgacggaataaagaataatcaaatacttgaagaaaatgtcgaagttgagatttggactaaagaaggagaacgtaaaaagctgaaaccaagatggttggatgctcgaatatatagtgaccctctggcgttaaaagagttcaaagaattcgcagctggtcgaaaaagcttaacattgaacctgattactgagatgggccgtctccctacgttcatgacacagaaagcacggaatgcgctagataatttagcagttttacacacagcagaggtcgggggtagagcatataatcacgcattgtccgaattaccagagacattagaaactttgttgttactgacactactagctacggtaaccggtggcatattcttatttcttatgtcagggaaaggaataggtaaaatgacccttggcatgtgttgcatcataactgcatctatccttctctggtacgcccaaatccaaccacactggattgcagcgtcaataatacttgagttctttctaatagtacttttaatacccgaacccgagaaacaaagaaccccacaagacaaccaattgacatatgttgtcatagcaatattaaccgtagtggcagcaaccatggcaaacgaaatgggtttcttagaaaagacgaaaaaagacctaggatttggcagtattactacacaagaatccgagtcaaacatactagacatagatctaagaccggcaagtgcttggactttatacgcagtggctaccacattcgtaactccaatgcttagacactctattgaaaatagtagtgtcaatgtttccttaactgcaatagcaaatcaagcgacagtattaatgggcctaggaaagggctggccgctatcaaaaatggacataggcgtaccactattagctatcgggtgctattctcaagttaacccaataactctaaccgctgctctactattactagtggcacattatgcgattatagggcccggcttacaagcaaaagcaacacgcgaagcccaaaaaagagctgctgccggaattatgaaaaacccaacggtagacggtatcacggttatagacctcgaacccataccttacgacccgaaatttgaaaaacaattaggccaagtaatgttgctaatattatgtgttacgcaagtgttaatgatgagaacaacttgggcattatgtgaagcacttacattggctacgggtccaatatcgacattatgggagggtaatccaggcagattctggaacacaacgatagcagttagtatggccaatatatttcggggtagctatttagcgggagcaggtttacttttcagcataatgaaaaatacgactaacacgcgtcggggcacgggaaacgttggcgaaactctcggcgaaaaatggaaaagccgtttgaacgccttaggaaaatcagaatttcaaatatacaaaaaaagcgggatacaagaggtagatagaacactagccaaggagggaataaaacggggggagacagatcaccatgcagtcagccgtggcagtgctaaattgaggtggttcgtagagaggaatatggtgacccctgaaggcaaagtagtagatctgggatgcggacgtggagggtggtcatactactgcgggggtttaaagaatgtcagggaggtaaaagggctaacaaagggtggacccggacatgaagagccaattccaatgtcaacatacggatggaacctggttcgcttgcagtcgggtgttgatgtctttttcacaccaccggagaaatgtgatacgttattgtgtgacataggagagagctctccaaatccgactatagaagcaggtagaacattacgagtcctgaatctagtcgaaaattggcttaacaataacactcaattttgtataaaagttctgaatccatatatgccgtctgtgatagaaaaaatggaaacactgcaacgcaaatacggcggagctttggtccgaaacccactttcacgtaacagtacacatgaaatgtattgggtatcaaatgccactggaaatatagtttcatccgtgaatatgattagtagaatgttaataaaccggtttacaatgaaacataaaaaagctacttatgagcctgatgttgacctaggcagcggaacgaggaatataggtattgaaagtgagattcccaacttagatattatcggcaagcgaattgagaagatcaaacaggaacatgaaacctcgtggcattacgatcaagatcatccatataaaacgtgggcctatcatggcagctatgaaacgaaacagaccggttcagcgtccagtatggtaaatggagtggtacgacttctcactaaaccctgggacgtagttcccatggtgacacaaatggcaatgactgatacaacaccattcgggcaacaacgagtatttaaagaaaaggttgatacaagaacgcaggagcctaaagaggggactaagaaactgatgaagataacagccgagtggttgtggaaagaactcggaaaggagaaaacacctcgaatgtgcacacgggaagaatttacgagaaaagttaggtcaaacgccgctttaggagccatttttacagacgaaaacaagtggaaatcagcaagggaagcggttgaagatggtcgattttgggaactagtcgatagagaaaggaatttacatctcgaaggaaaatgcgaaacgtgtgtttacaacatgatgggcaagagggaaaaaaaattgggggaatttggtaaagcaaaaggatctagagctatatggtacatgtggttaggtgcaagatttttggaatttgaagcactaggctttttaaacgaagaccactggttttccagagggaatagtctatcaggtgtagaaggtgaaggtcttcataggctaggttatatattaagagaagttggaaaaaaagaaggtggggccatgtatgccgatgacactgcaggatgggatacgcggattacgttggaagaccttaaaaatgaagaaatggtaactaatcacatgaaaggagaacataaaaaactggctgaagcaatcttcaaattaacttatcagaataaagtagttcgagtccaaagaccaaccccgcgcggaacggtaatggatatcatatctcggaaagatcaacgtggatcaggacaagtcggtacatatggtctcaatacgttcacgaatatggaagcccaactaattcgccaaatggaaggggaaggcatttttaaaagtatccaacatcttacagcaactgaagaaatagcagtgcaaaattggttggccagagtcgggagagaacgtctgagccgaatggcaatttctggcgatgactgtgtcgtcaaacctatagacgatcgttttgcgagtgctctaacagctcttaatgatatggggaaagttaggaaggatatacagcaatgggaacctagtagaggatggaatgactggacacaggtaccgttttgctcacatcactttcacgaactagtcatgaaggacggtagggtactagtagttccatgtaggaaccaagacgagctcataggacgagcgaggatatctcagggtgccgggtggtcattaaaagagacagcgtgcctaggcaaatcctatgcacaaatgtggacattaatgtattttcatcgccgagatctaaggttagctgctaacgccatatgcagtgcggtgccctctcattgggttccaacgagtagaactacttggtcaatccatgcgaaacatgaatggatgacaactgaagatatgttagcagtttggaatcgtgtttggattcaagaaaacccatggatggaagataagacgcccgtcgaaagttgggaagaagttccatatttaggtaaaagggaagatcaatggtgcggttcactaataggcctaacatctagagccacatgggcaaagaatatacaaacggcaataaatcaagttcgttctttaatcgggaatgaagaatacacagactacatgcccagtatgaaaagatttagaagagaagaagaagaagctggagtgctatggtga

SEQ ID NO: 22169 - RNA, 9876 nt, synthetic construct
  misc_feature 1..9876: note = derived and/or modified CDS sequence (opt6) from DENV-2__LC121816__SS-prME
  source 1..9876: mol_type = other RNA
accgtagggatgatcataatgctaataccaaccgcgatggcatttcacctcactactcgtaatggagaaccgcatatgattgtttcaagacaagaaaaaggaaaatccttgttgttcaaaactgaagatggtgttaatatgtgtactctaatggcaatggatcttggagaactttgtgaagacactgtcacttacaactgtccattgctacgacagaatgaaccggaagacatcgattgctggtgtaactccacaagtacctgggtcacatacggaacgtgtacagcaacaggagaacaccgacgagagaaacgaagtgtagcacttgtacctcacgtgggaatgggactcgaaactagaactgaaacttggatgtcaagcgaaggcgcatggaaacatgctcaaagaattgaaacatggatactacggcaccctggatttacaattatggctgcaatattagctcacacaataggcactacctactttcagagagttctgatatttatcctgctgactgctgttgccccttcaatgacaatgcgatgcataggcatttctaatcgtgacttcgtagaaggtgtaagcggaggttcatgggtagatattgtattagaacacggtagctgtgttacgacaatggctaaaaataaaccaacattagactttgaactcattaaaactgaagctaaacaacctgcaaccttgagaaaatattgcatcgaagcaaaactcacaaatactacaacggcttccagatgtcccactcaaggcgaaccctccttaaatgaagaacaagacaaaagatttgtatgtaaacattcgatggttgatcgcggctggggcaacgggtgtggattatttggtaaaggtggcatagtcacttgtgccatgtttacgtgcaaaaagaatatggaaggaaaaatagtacagccagaaaatctcgagtatactatcgtgatcacaccccatagcggggaggagaatgctgtgggaaatgatactggaaaacatggaaaagaagtaaaagtgacgccgcaatccagtattactgaagccgagcttactggatatggaaccgtcacaatggaatgctcacctcgaacagggcttgacttcaatgaaatggtactcttacagatggaaaataaagcctggctagtccatcgccaatggttcctagatctgccgttaccatggttacccggagctgatacacaaggtagcaactggatccagaaagaaacactcgtaacatttaaaaaccctcatgctaagaaacaggacgtagtcgtactcggtagccaggagggagccatgcataccgccttaactggagcaactgagattcagatgagtagtggaaatttattgttcacgggtcatctaaaatgtcggctacggatggataaactccaactaaaaggaatgtcatatagcatgtgtacaggtaaatttaaagtagtcaaagaaatagccgaaactcaacacgggactatagtaataagagtacaatacgagggcgatgggtcaccctgtaaaattccgttcgaaataatggatttggagaaaagacacgtcctgggaaggctaatcacagtaaacccgatagtcacggaaagagactccccggtcaacattgaagcagaaccaccattcggtgatagttatataattattggtgttgaaccaggccaacttaaactatcatggttcaagaaaggatcttccattggacaaatgtttgaaacgacgatgcgtggggcgaaacgaatggcaatcttaggagacactgcttgggactttggatcacttggaggagttttcacctctataggaaaagcacttcatcaggtatttggagcaatatatggagctgctttttccggagttagctggacaatgaagatactaattggtgtagtgatcacgtggataggaatgaacagtcgttctacttcactgtccgttagccttgtgctagttggtgtagtgactctatatttaggagtgatggttcaggccgactcaggctgcgtggtaagctggaagaacaaagaactgaagtgcgggtctggcatattcatcacagataatgttcacacctggactgaacaatataagttccaaccggaaagccccagcaaattagcatcggcaatacaaaaagcgtacgaagaaggtatatgtggaatacggtcagtgacaagattagaaaacctaatgtggaagcaaataactccagaattaaatcacatactaagtgaaaatgaagtcaaattaacaattatgacaggtgacataaaaggtataatgcaagctggtaagcgatctttaagaccacaaccaactgagttaaagtactcatggaaaacctggggaaaagcaaaaatgttatccaccgagcatcataatcaaacacttttaatagatggaccggaaacagcggaatgccccaacacgaatagagcatggaactcattagaagtagaagactatggctttggagtctttactacaaacatatggttgaagttaaaagaacggcaagatgttttctgtgattctaaattaatgtctgctgcaatcaaagataatcgagctgttcacgcagatatgggttactggattgaaagcgctttaaatgatacatggaaaattgaaaaagcaagttttattgaagtgaagagttgtcattggccaaaaagtcacacgctatggtcgaatggtgttctagaaagtgaaatgataattcccaaaaattttgcgggaccggtttcgcaacacaattatcgtccaggatatcacacccaaacagcgggtccgtggcacttaggtaaattagaaatggatttcgatttctgcgaaggtacgactgtcgtagtaacagaagactgtggaaacagagggcctagcctgcgaaccactactgcaagtggtaaactaataacagagtggtgctgccgatcatgtactttacccccattgcgttatagaggggaagacggttgctggtatggcatggaaattcgcccgttaaaagagaaggaagaaaatctggttaattcattagtaacagcaggacatggacaaatagataacttttctctaggagtacttggaatggcactatttttagaagaaatgcttaggactcgcgtcgggactaaacacgctctgctgttagtggccgtgtcatttatgaccctaataaccggcaatatgtcatttcgagacctgggaagagttatggtaatggtaggtgcagctatgacagatgatattggaatgggtgtaacttatttagcgttactcgccgctttcaaagttcggccaacgttcgctgcgggattgttgctaaggaaattaacaagtaaagaactaatgatgacaacaatcggcattgttctattatctcaatcaacaatccctgaaacaatcctggagcttacggatgcactggccttaggcatgatgatacttaagatagtcagaaacatggaaaaataccaacttgcggtaacaataatggcgatactatgtgtccctaatgctgtaattttgcaaaatgcatggaaagtaagttgcaccatcttagctgttgtgtccgttacccctttattgttaacttcaagcagacagaaggccgattggattcctctggcccttactataaaaggtcttaatcccacagcaatattcttaacaacgctgtctagaaccaataagaaaagatcttggcctctaaacgaagcaataatggcagtaggcatggtatctatacttgccagttcattactaaagaacgatatacccatgacgggcccattagtcgctgggggtttactaacagtatgctacgtattaacagggaggtctgcggatttagaactagagagagctgcagatgtgcgatgggaagaccaagctgagatatcaggatcatcaccgattttgtcaataacaattagtgaagacgggtccatgtcaatcaaaaatgaagaagaagaacaaacgttaaccatactaataagaactggtttactcgtaataagcgggttgttcccagtctcaattccaattacagctgccgcatggtacctttgggaagtcaagaaacaacgtgccggtgtattatgggacgtaccttcaccaccgccagtggggaaagccgaactcgaagatggcgcatatagaattaaacaaaaaggtatcttaggatattcacaaattggtgcaggagtttataaagaaggaacgtttcatactatgtggcatgtaacgcgaggcgcagtattaatgcacaaaggaaaacggatcgaaccttcatgggctgacgtacgtaaagatctgatatcgtacggcgggggctggaaattagaaggagagtggaaagaaggagaagaggtacaagtgttagcattagagccaggcaagaaccctcgcgcagtacaaacaaaaccagggttatttaaaactgatacaggcactataggcgcagtatccttggacttttcaccgggaacaagtggatcacccatagtcgataagaaagggaaagtggtaggtttatacggtaatggagtggtcaccaggagtggtacttatgtatccgcaattgcgcaaactgaaaaatcaatagaggacaaccccgaaatagaagatgacatattcaggaaacgcaggctaacaataatggatttacatccaggggcaggaaaaacaaaaaggtacttaccagccattgtgcgggaggctataaagaggggactacggactctaatactagcaccgacaagagtggtagccgcagagatggaggaggcgttacgaggactccccatacgataccaaacgcctgctattagagccgaacatacaggaagagaaatagtagacctgatgtgtcacgctacatttaccatgagattgctatcaccagtacgggtacccaattataatttaattattatggatgaagcgcatttcacagacccagcatcaatagctgcacgtgggtatatcagtaccagggtcgaaatgggagaagcagcaggcatttttatgacggcaacaccgcctgggagtagggacccatttccccaaagtaacgcacctattatggacgaagaaagagaaattcctgaacgatcatggaactctgggcacgaatgggttacggatttcaaaggcaaaacagtttggttcgtaccaagtataaaagcaggtaatgatatagcagcgtgcctacggaaaaacggcaagaaagtaattcaattgagcagaaagacatttgattcagagtacattaaaacaagaacaaacgattgggatttcgtggtaacgactgacatatctgaaatgggagcgaatttcaaagccgagcgggttatagatccacgtcgatgcatgaaaccggttattctaacagatggcgaagaacgggttatcttagccggtcctatgccggttactcattctagtgcagcccagaggcggggccggattggaaggaaccccaagaacgaaaacgaccaatatatatacatgggggaacctttggaaaatgatgaagactgtgcccattggaaagaggccaaaatgctccttgataacataaatacaccggagggtattatacctagcatgtttgaaccagaacgggaaaaagtagatgcaatagatggagagtatcgtctcagaggagaagctcggaaaacgtttgtagatttaatgcgaagaggtgatcttccagtatggctggcctacagagtggctgcggagggcatcaactacgcagatcgccgttggtgttttgacggagttaagaataaccagattctagaggagaacgtcgaagttgaaatctggactaaagaaggggaaaggaagaaactgaagccacggtggttagacgctcgaatatatagtgatcctctagcgttgaaagagttcaaggagttcgcagcaggcagaaaatctctaaccttgaatttaattacagaaatgggacgactaccaacttttatgacccaaaaggcgagaaacgcattagataatttagcagtattgcacactgcagaagccggcggacgggcttataatcacgcattaagtgaactaccagagacacttgaaacactgctattattgacattattagctactgttactggtggaatattccttttcttaatgagtggcaaaggcatcggaaaaatgacacttggcatgtgctgtataataactgcgagtatactactgtggtatgcgcagattcaaccacattggattgcagcatcaatcattttagagttctttttgatcgtattactgattcctgaacccgaaaaacaacggactccacaagataatcagctaacttatgtcgtcatagcgatattaacagtcgtagcagcgaccatggctaacgaaatggggttcctcgagaaaaccaagaaagatttcggcctaggaagtattgcaacccagcaaccggaaagtaatatattggacatagatctacgaccagcttccgcctggacgctttatgcggtagctacaactttcatcactccgatgctcaggcatagtattgaaaacagtagcgtaaacgtctcactaactgctattgctaaccaagctacggtgctaatgggtctaggcaagggatggccattatctaaaatggatataggtgtacctcttcttgcaatcggatgctattcacaagttaatcctataacactcaccgctgcactattactccttgtcgcacattatgcgataattggaccaggattacaagcaaaggcaacaagagaagcacagaagagagcagctgcgggcataatgaaaaatccaactgtggacggaatcactgtaattgatctggaccccataccttatgatccaaaattcgagaaacaactaggacaggtgatgctcttggtattatgcgtaacacaagtcctaatgatgagaaccacttgggccctatgcgaagcactaacgcttgcgactgggccaatttcaaccctttgggaaggcaatccgggacgtttctggaacactacaattgcagtttctatggccaatatcttcagaggtagttacttagcaggcgccgggttactcttttctatcatgaagaacacgactaatacacgccgtggtacaggaaatacaggagaaacactgggcgaaaagtggaaaaatcgattaaacgccctgggtaaatctgaatttcaaacttacaagaaatctggaatacaggaagtcgacagaactttagcaaaagagggaataaaaagaggagagacggaccatcatgcagtgtcacgtggaagtgcgaaactacgctggttcgttgaacgaaacttagttacacccgaaggaaaagttgtggacttgggatgtggcagagggggatggtcttattattgcgggggacttaagaacgtgagagaagtcaagggcctcacaaaaggaggcccgggacacgaggaacccataccaatgagtacctatgggtggaatttagtgaggttacaatctggtgtagacgtatttttcaccccaccggaaaagtgcgatacactcctctgcgacattggcgagagctctccaaatccaacggtagaagcagggagaacattaagagtattaaatttagtcgagaactggcttaacaataacacgcaattctgcataaaggtgttaaatccatatatgccttcggtaattgaaaagatggaggcgctacaacgtaaatacggaggtgcacttgttcgaaacccacttagtagaaactccactcacgaaatgtactgggtatcaaacgcatcgggcaatatagtaagcagtgtgaacatgatatcacggatgctaattaacagattcactatgcggcataagaaagcaacatacgagccagacgttgatttaggaagtggtacacgaaacattggaatagagtctgaaacacccaacctagacataataggcaaaagaatcgagaagatacgccaagaacatgaaacttcatggcattacgatcaagatcacccatataagacgtgggcttatcacggtagttatgaaacaaaacaaactggcagcgcctcttcaatggttaatggggttgtccggttacttacaaaaccatgggatgtaattccaatggtaacccagatggcaatgacggacacaacaccatttgggcaacaacgcgtttttaaagaaaaggtagacacaaggactcaagagccaaaagagggaacgaaaaagttaatgaaaataaccgcgaagtggttgtggaaagagcttggcaagaagaaaacaccacgaatgtgcacacgagaggaatttaccaggaaagttagaagtaacgcggcccttggagccatatttacagacgaaaataagtggaaaagtgcccgtgaggcagtggaagatagtagattttgggaacttgtcgacaaggaacgtaatctacatcttgaaggcaaatgcgaaacatgtgtttataatatgatgggaaaaagagagaagaaactaggagagtttggtaaggcaaaagggagtcgagcaatatggtatatgtggctaggggccagatttcttgagtttgaagcgctcggttttcttaatgaggatcactggttcagccgtgaaaactctctctcgggtgttgaaggagagggactccataaattaggatatatactacgtgatgtgagcaagaaagaaggtggtgccatgtatgcagacgatactgctggctgggacactaggatcaccttggaagacctgaaaaacgaggagatggttaccaatcatatggaaggtgaacataagaaattagcggaagcgatatttaaacttacgtatcaaaataaagtagttcgtgttcaaagaccaactccccgagggactgtcatggatataattagcagaagagaccagcgagggagcggccaggtaggcacctatggtctgaacacctttactaacatgggagcacagttaatcaggcaaatggagggtgagggggtttttaaatcgattcaacatttaacagctacagaagaaatcgctgtacaagactggcttgcaagagtaggaagagagaggttaagtaggatggcaatatcaggagatgactgtgtagtaaaaccattggatgacagatttgcttcagcgttgactgcccttaatgacatgggaaaagtaagaaaagatatccaacaatgggagccttccagaggatggaacgactggacacaagttcctttttgcagtcatcatttccacgaactaattatgaaagatgggagagttttggttgtcccttgtaggaaccaagatgaattaataggcagagctagaatttctcaaggggccggttggagcttaagggaaacagcatgtctcggtaaatcctacgcacaaatgtggtctttaatgtatttccatcggagggacctaagattggccgcaaatgcaatctgttcagctgtaccgagtcactgggtcccaacttctcgcacaacatggagtatacacgcgaaacacgagtggatgacaactgaggatatgctaacagtatggaatcgcgtatggattcaagagaacccatggatggaagataagaccccagttgaatcttgggaagagattccgtatttaggtaagcgggaagatcaatggtgcggttctttaataggtctaacatcacgggcaacatgggccaaaaacatccaaaccgccataaaccaagtgagaagtcttattggtaatgaagagtacactgattatatgccttcaatgaaacgttttagaagagaggaagaagaggccggtgtcttatggtga

SEQ ID NO: 22170 - RNA, 9876 nt, synthetic construct
  misc_feature 1..9876: note = derived and/or modified CDS sequence (opt6) from DENV-2__LC111438__SS-prME
  source 1..9876: mol_type = other RNA
accgcgggtatcataattatgatgatcccgactgttatggcattccatctaactactcgaaacggtgaaccacatatgattgtttctaggcaagaaaaaggaaaatccttactatttaaaaccgaaaatggcgtaaatatgtgtactttaatggcaatggatctaggagaattgtgcgaagatacaattacctataattgccccctactgcgtcaaaacgaaccagaagacattgattgttggtgcaatagtacctcaacttgggttacttatggtacatgcacggctacaggagaacaccggagagaaaaacgatctgttgctctagttccacatgttggtatgggcttggaaacacgtacagaaacatggatgtcttcagagggtgcgtggaaacatgcacaacgcatagaaacatgggtactacgacacccagggtttactattatggctgcaatcctagcgtatacaataggtactacacattttcaaagagtcttaattttcatcctattaactgcggtcgctccttcaatgactatgcgatgcataggtatatcaaatagagatttcgtagaaggggttagtgggggaagctgggtggatattgttttagaacatggctcctgcgtaacgaccatggccaaaaataaacctacgctagattttgaactaataaaaacagaggcaaaacatcccgcaactttaagaaaatattgtatcgaagcaaaactaactaacacgaccactgcatctaggtgcccaacccaaggcgagccaagcctaaatgaggaacaagacaaaagattcgtttgtaaacattccatggtagatagagggtggggtaacggatgtggcttgtttggtaaaggagggatcgtgacctgtgcaatgttcacatgcaagaaaaacatggaaggaaaagttgtacaaccagaaaacttagagtataccattgtcataacaccgcatagtggagaagaaaatgctgtaggtaatgatacaggaaaacatggaaaagagataaaagtaacgccgcaatcttccatcacagaagcagaacttactggatatggaactgtaacgatggaatgtagtccccgcactggcttggatttcaacgagatggtactgttgcaaatggaaaataaagcatggctagtacatagacagtggttcttagacttaccgctgccctggttaccaggtgctgacacacaaggaagcaattggattcaaaaagagacgctagtcaccttcaaaaacccgcatgctaagaaacaagatgttgtcgtccttggtagccaggaaggagctatgcataccgcattaacaggagctaccgagattcaaatgtcaagcggtaatctactgttcacaggtcatttgaaatgcagattgcgtatggacaaattgcaacttaaagggatgagttattcaatgtgtaccggaaagttcaaggtcgttaaagaaatagctgaaactcaacatggcactatcgtaattcgggtgcaatatgaaggcgatggttcaccttgcaaaattccattcgagataatggatctagagaagagacatgtactaggtcgattgataactgtgaatccaatagttacagaaaaagattctccagtcaatatagaagcagaaccaccattcggcgacagctatattataataggggttgaaccaggccaactgaaactttcttggtttaaaaagggcagttcaataggtcaaatgtttgaaactaccatgcgtggcgcaaaaagaatggctatcctaggggatacagcttgggatttcgggagcttaggaggagtattcacttcaataggcaaagctctacaccaagtattcggcgcaatttatggagccgcattcagtggcgtatcatggactatgaagatactaataggtgtagttattacctggattggaatgaatagtcgatccacaagtctttcagtatctctagtcctagtaggagtagtcacattatatttaggtgtcatggtccaggcggactcaggctgcgtagtctcatggaaaaataaagaacttaagtgcggctcaggaatctttataactgacaatgttcatacctggacggaacaatacaaatttcaaccagaatcaccacccaaattagcaagtgccatacagaaagcacatgaagaaggaatctgcggtattcgttcggtcacaaggttggaaaatctaatgtggaaacaaatcacacctgagctaaatcacattttaagtgaaaacgaagtaaagctcacgatcatgacaggagatatcaagggaatcatgcaagcaggaaaacgcagccttagaccacaacccacagaattaaagtattcatggaaagcatggggtaaagctaagatgttgtccacagaactgcacaatcatacatttttaatcgatggcccagagactgcggaatgtccaaataccaatcgggcctggaactcactcgaagtagaagactatggatttggagtatttactactaatatatggctgaaattaaaagaaaaacaagatgtattttgcgatagtaaattaatgtctgctgcaattaaggacaatagagctgttcacgccgatatgggttattggatagaaagcgctttaaatgatacatggaagattgaaaaagcatccttcattgaagtaaagtcatgccactggccaaaatcgcacacgctttggagcaacggcgtgcttgagagtgaaatgattataccgaagaattttgctggtcccgtcagtcagcacaactaccgtcccggctaccatacccaaacagctggaccatggcatttagggagtctggaaatggatttcgatttttgtgaaggtactacggtagtagtaaccgaagattgtggaaacaggggaccgtctctaagaacaaccacagctagtggaaaacttataacggaatggtgttgtagatcctgtacactaccacctctacgttatcgtggtgaggatggttgttggtacggaatggagattagaccactgaaagaaaaagaagagaacctagttaattccctagtaacagcaggtcatggacaaattgataactttagtttaggtgtattaggtatggcgttgttcttggaggaaatgctgagaacaagggtaggaacaaaacacgccatattattggtggcagtatctttcgtgaccctaataacaggaaatatgagtttcagggacctaggaagagtgatggtcatggtaggagccactatgaccgatgatataggtatgggagtaacttacttggcactattggccgcttttaaaataagacccacatttgccgcaggtctgttactgagaaagttaacaagtaaagagctaatgatgacgacaataggaatcgtgctattatcgcaaagcacgatacctgaaacaatcttggaattaacagatgcgttagcactaggcatgatggtcctgaaaatcgtcagaaacatggagaaatatcagttggctgtcactattatggcgatactatgtgttccaaacgcagtaatccttcaaaatgcatggaaagtgtcatgtacaactttggccgtggtttcagtaagcccgttactcctaaccagctcacaacaaaaagctgactggatcccattagccctaaccataaaaggactaaatcccacagcaatattcctaaccacactaagtagaacttcgaaaaagcgaagttggccgttaaatgaagctataatggccgttggaatggtatcgattctcgcgtcctcgctgctgaaaaacgacatacctatgacaggaccactggttgccggtggtttgctcacagtgtgttatgtcttaacaggtcgatctgctgatctagaactagaaagagcagctgatgtacggtgggaagaacaagccgagataagtggctcaagtcccatattatcaataactatatcagaggatggttcaatgtccatcaaaaatgaagaggaggagcagactcttacgatactcataagaactggactccttgtaatttccggactcttccctgtttcgattcctatcacggctgcagcctggtacctatgggaagtcaagaaacaaagagctggggttttatgggacgtaccttcaccacctcctgttggtaaagcagaacttgaagatggcgcgtatagaataaaacaaaaagggatactaggatattcacaaataggtgcgggtgtttataaagaagggaccttccatacaatgtggcatgtgactcgaggagcagttttaatgcacaaaggaaagagaattgaaccctcctgggcagacgtcaagaaagacttaatctcctacggtgggggttggaaattagaaggtgagtggaaggagggagaagaggttcaagtactggcgctagaaccaggcaaaaatccgagagccgtgcaaacaaaacctggactattcaaaactaacaccggtacaataggagcagtatctctggatttttcacctggcacaagtggatctccgatcgttgataagaaaggcaaagtcgtaggtctttatggaaacggagtagtaacacgaagcggaacatatgtttcagccatagcgcagacagaaaagagcattgaagacaatcccgagatagaagatgatatatttaggaaaaagagattaaccataatggaccttcatcctggtgctgggaaaacaaagcgttatttgccggcaatagtacgagaagcaataaaaagaggattacggacgctgatattggctccaacccgtgtagttgctgcagaaatggaagaagcccttcgaggtttacctatacgataccaaacccccgcaataagagcggaacatactggccgagaaatagttgaccttatgtgccacgccacttttacaatgcggcttctatcacctattagagttccaaattataacctgataataatggatgaagctcactttacggatccagcttcaattgcggcgcgaggatacataagcacgagagtagaaatgggcgaagctgcaggaattttcatgactgcgacgcccccagggagcagagatcccttcccacaatcaaacgcgccaatcatggatgaggaacgagaaatcccggagaggagttggaactcaggtcacgagtgggttacagattttaaaggtaagacagtttggttcgtcccttcaattaaagctggtaacgatatagccgcatgtctcaggaaaaatggtaagaaggtaatacagctaagtcgcaaaactttcgattcagagtacataaagactcgaacaaacgactgggacttcgtagtaacaactgacataagtgagatgggagcaaacttcaaagccgagagagtgatagacccacgaagatgtatgaaacctgtgatactaacggatggagaagaaagagtgatcctcgcaggacccatgcctgttacacattcttcggctgctcaacgcagaggacgggtaggtagaaatccaaagaatgaaaatgaccaatatatatacatgggcgaaccattggaaaatgacgaagattgcgcacactggaaagaagcaaaaatgctcttagataacattaacacacccgaaggaattatcccgagcatgttcgaaccagagagagaaaaagtcgacgcgatagatggcgaatatcggctaagaggagaagcaagaaaaacttttgtagatctcatgcgaagaggggatctacctgtctggcttgcttacagagtagctgcagaaggaataaattatgcagacagaaggtggtgcttcgacggtgtcaaaaataatcaaatattagaagagaacgtggaagtagagatatggactaaagaaggggaaagaaagaagctcaaaccaagatggctagacgcccgaatatattctgatcctttagcattaaaagaatttaaagagttcgctgcgggccgcaagtctctagcactaaatctgattactgaaatgggacgattaccaacattcatgactcaaaaggcaagaaacgctctagataacctagctgtattacatacagcagaagcgggcggtcgagcttataaccacgctttgtctgagttacccgaaaccttagaaactttattgctactaacattacttgctactgtaacaggtggaatcttcctatttctaatgtcaggaaagggaatcggaaaaatgacaatgggtatgtgctgtatcattaccgccagtattttattgtggtacgcccaaattcaaccacattggatagcggcctcaataatactcgagttctttttaatcgtactcctaataccagaacccgagaagcaaagaacacctcaagataatcaattaacctacgttgtaatagcaatactaacagttgtcgcagcaacgatggcaaacgaaatgggatttcttgagaaaacgaaaaaggatttcgggttgggttcgatcgccactcagcaacccgagtctaatattctagatattgatttacgtccggcatcagcgtggacgttatatgctgttgctactacttttataacgcccatgttacgacatagtatagaaaactcgtcagtcaatgtctctctgacggctatagctaaccaagctacagtattgatgggactagggaaagggtggccgctatctaaaatggacataggggttcccctcctagctattggatgttattctcaagtcaacccgattactttaatggcagccttgttactacttgtagctcactatgccattataggacccggtttacaagccaaagccacaagggaagcccagaaaagggcagcggcaggtattatgaaaaacccgacggtagatggaataaccgtcattgacttagatcctattccatatgatccaaaattcgaaaaacaactcgggcaagtaatgctcctagtactgtgcgtaacgcaagtactaatgatgcgcacaacctgggcattatgcgaagcccttactctagcaacggggcccataagcaccctatgggaaggaaatccggggcgcttttggaatacaacgattgcagtgagtatggctaatatttttaggggatcatacctggcaggagcaggcttactattttcaattatgaaaaacactgctaatactcgtagaggtacgggcaacacaggagaaacgcttggagaaaagtggaaaaataggttaaatgctctgggaaaaagtgagttccaaatatacaagaaatcaggcattcaagaggtagatagaactctagccaaggaaggtatcaaacgtggggaaactgaccatcacgcagtctcccgcgggtcagcaaagttaagatggtttgttgagcgtaatctggttacacctgagggtaaagtcgttgatctcggttgcgggagaggaggctggagctattattgtggcggcctcaaaaatgtaaaagaggttaaaggcctcactaaaggcggacccggccatgaagaacctatccctatgtctacatacggatggaatctggtgagattgcagtcaggagtcgatgtatttttcacaccgccagaaaagtgcgatacacttttgtgcgacatcggtgaatcaagcccgaatccgacagtggaggccggtcgaacacttcgagtattgaatttggttgagaattggctcaataataatacacagttctgcatcaaagtattaaatccgtatatgccaagtgttatagagaaaatggaagcattacaacgcaagtacggtggagcacttgtccgaaacccgcttagcaggaactccacccatgaaatgtattgggtaagtaatgcttcaggtaatatagtcagttctgtaaacatgatttctagaatgctgataaatcgtttcacgatgagacacaaaaaggctacatatgagccagatgtcgacttgggatcaggtaccaggaatattggaatagaatccgaaacaccaaacctcgatattattggcaaacgaatagagaaaatcaaacaagaacacgaaacgagttggcactacgatcaagaccacccgtacaaaacatgggcatatcacggaagctatgagactaaacaaactggaagcgcctctagtatggttaatggagtagtccggttacttactaaaccatgggatgtaattccaatggttacacaaatggcaatgacagacacaactccgttcggacaacaacgagttttcaaggaaaaagtggatactaggacacaagaacccaaggagggaacgaaaaagctcatgaaaataacagcgaaatggttatggaaagagctcggaaagaagaaaactccaagaatgtgtaccagagaggagttcacccgaaaagtaagaagcaatgctgcattaggggcaatatttaccgacgaaaataaatggaaatcagctagagaagcagtcgaagattcaggcttttgggagttggttgacaaagaacgaaaccttcatctggaaggtaaatgcgaaacatgtgtgtataatatgatgggcaagagggagaagaaattaggggagtttggaaaagccaaaggaagtcgggcgatctggtacatgtggctaggtgcgagatttttagagttcgaagcactcggttttctcaacgaagatcactggttcagccgtgaaaacagcttatctggtgttgaaggtgaagggttacacaaactcggatatatactaagagatgtgtcaaagaaagaaggaggagcaatgtatgccgacgacacggcaggttgggacactcggatcacactagaagatctcaaaaacgaggaaatagtcaccaattacatggaaggtgagcataagaaactagcagaagccatatttaaactcacgtaccaaaacaaagttgtacgggtacaacgaccaactccacgtggcactgttatggacattatatcaagaagagaccagcgcggatcgggacaagtagttacttatggtttaaacactttcacaaatatggaagcacaactgataagacagatggaaggagagggggtattcaaaagtattcaacacctcacagtaaccgaagagatcgcggttgaaaattggttagtcagagttggcagagaaagattatcacgcatggcgatatcaggagatgattgcgtagtaaagccactagacgatagattcgccagcgcgctcacggcacttaatgatatgggcaaagttagaaaagacattcaacaatgggagccgtcgagaggatggaacgattggacacaagtgcccttttgttcccaccacttccatgaattaataatgaaagacggcagggtattggttgtaccctgcagaaatcaagatgaactgattggacgcgcacgaatctcacagggcgcgggatggagtttgagagaaactgcatgtcttggtaaaagttacgcccaaatgtggtcgttgatgtacttccatagaagagatttacgtttagctgccaatgcaatatgtagtgctgtaccctctcactgggtacccacatcaagaacaacttggtcaatacatgccacgcatgagtggatgactacagaagatatgctaacggtatggaacagggtctggatacaagaaaatccatggatggaagataagaccccagtagaaagctgggaagaaattccttatttgggaaagcgcgaggatcaatggtgtggtagcctaatcggtctaacttctagagcgacgtgggccaaaaatatacaaactgctattaatcaagtaaggagtctaatcggaaatgaagaatatactgactatatgccgagcatgaaaagatttcgaagagaagaggaagaagcaggagtgttatggtga

SEQ ID NO: 22171 - RNA, 9876 nt, synthetic construct
  misc_feature 1..9876: note = derived and/or modified CDS sequence (opt6) from DENV-2__KF744400__SS-prME
  source 1..9876: mol_type = other RNA
acagcaggaatgataattatgttgattccaacggttatggcatttcatctgactaccagaaatggtgaaccacacatgatagtatcgcgccaggaaaaagggaaaagcctactatttaaaacagaaaatggcgtgaatatgtgtacactaatggctatggatttaggtgaattgtgcgaagatacgataacatataaatgccctttactaagacaaaatgaaccagaagatatagattgttggtgtaattctacatctacttgggtgacttacgggacttgtacgactactggcgaacacaggcgagaaaaacgatcggtagctctagttccccatgtaggaatggggctagaaactagaactgaaacttggatgtccagcgaaggagcatggaaacatgcacaacgaattgaaacatggatattacgacatcccggattcactctaatggcagcaattctagcatacacaataggaacaacacattttcaacgagcgctgatttttattcttctgacggctgtcgcaccctcaatgacgatgagatgcattggaataagtaatagagactttgtggaaggagtctcaggaggatcttgggtcgacatagtactagaacacggctcgtgtgttacaactatggctaaaaataaaccaactctagattttgaattaattaaaaccgaagcaaaagaaccagcaacactccggaaatattgtattgaagctaaattgacaaacacgactactgaaagtcgctgcccgacacagggcgaacccagcttgaatgaagaacaagataaaagatttgtttgcaaacactcaatggttgatcggggatggggaaatggctgcggattatttggtaaaggagggattgtaacatgcgctatgtttacttgcaagaaaaatatggaaggaaaaatcgttcagccagaaaatctagaatacacaatagttattacaccccactcaggtgaagaacacgcagttggcaatgatactggaaaacatggaaaagaaatcaaaatcacaccccaatcatcgacaacagaagctgagttaaccggttatggcacggtaactatggaatgtagccctcgaactggactggattttaacgagatggtcctactacaaatggagaataaagcatggttggtacacagacaatggttcctagatttgccgttaccatggctcccgggtgcggatacgcaaggcagtaactggatccaaaaagaaactctagtgacatttaaaaacccacatgctaagaaacaggacgtggtcgttctaggatcacaagaaggcgcaatgcatacagcactgacgggtgcaaccgatatacagatgtcctcgggcaaccttctctttaccggacatctcaaatgtcgacttagaatggataaattacaattgaaaggaatgtcatacagtatgtgcactggaaaatttaaagtcgtcaaagaaatagcagaaacccaacatggaacaattgtggtaagagtgcaatacgaaggtgacggttcaccttgcaaaatcccattcgaaattatggatctggagaaaaggcacgtgttagggcgcctaatcactgtcaatcccatagtaacagaaaaggacagtcccgtaaacatagaagcagaaccaccgttcggggactcttacgtaatcataggagtagaaccaggacagctaaaacttaattggtttaagaaagggagttcaatcgggcaaatgttcgaaaccaccatgagaggagcaaaacgcatggctatattgggcgatacagcctgggatttcgggagcttaggaggggtgttcactagcataggaaaagcgctccaccaggttttcggtgcaatatatggcgcagcattcagtggggtaagctggactatgaaaattcttataggcgttataatcacttggataggcatgaactcaagatccacaagtctaagtgtatcacttgtacttgtaggtgtagtgacattatatctaggagtagttgtacaagcggattccggctgtgtagtatcatggaaaaataaagaattgaaatgtggctcaggaattttcatcaccgacaacgtacatacttggacagaacaatataaatttcaaccagaatcaccttctaaactagcaagcgcaatccagaaagctcaccaagaagggatttgcggaataagatcagtaactcgattggagaatctaatgtggaaacaaataactccggaactcaatcatatcttgagtgaaaatgaggtaaagctcactataatgacgggtgatattaaaggaattatgcatgcaggaaaaagatcattacgtccacaacccacagagctccgatattcatggaagacatggggtaaagcaaagatactcagtacagaatcacataatcaaaccttcttaattgatggccctgaaacggcagagtgcccgaatacaaatcgcgcgtggaactctctagaagtcgaggactatggctttggagtgtttaccaccaatatttggctgaaattgagagaaaaacaagacgcgttctgtgatccaaaacttatgtctgctgctataaaagacaatagagcagtgcacgcagatatgggttactggatagaaagtgcattaaatgatacatggaaaattgaaaaggcgtcatttattgaagtgaaaaattgtcattggcctaaaagtcacactctttggagtaacggcgtattagagtcagaaatgataatacccaaaaactttgcaggacctgtgtcacaacataactatagaccaggatatcacacgcaaacagcagggccctggcatttgggcaaactagaactagattttgatttttgtgaagggactacagtggtcgttacggaagattgcggaaacaggggaccgtctttaagaacgacgactgcatcaggaaaattaatcacagaatggtgctgtaggtcatgcacattaccaccactcaggtacaagggagaagatggttgttggtatggaatggaaataagacctttaaaggagaaggaagagaatctcgtgagctccctcgtaaccgcaggacacggccaaatagataatttttccttaggagtactaggaatggcactctttctagaagagatgctaaggacacgagtgggtatgaaacatgcaatattattagtagcagtgtcttttgtcactttgataactggaaatatgtcattcagggatctaggccgagttatggtgatggtaggtgctaccatgactgacgatatcggaatgggcgtcacgtacctagcattgttagctgcattcaaagtacgtccgacgttcgccgctgggttattattaaggaaacttaccagtaaagaattaatgatgacaacaataggtatcgtattattgagccaatcaaccataccggagactatactcgaattaaccgacgcattggcattgggtatgatggtattgaaaatagtcagaaagatggagaggtatcaattagcagttaccattatggctatcctctgcgtcccaaactccgtgatcttacaaaatgcttggaaagtatcgtgcactatactagccgtggtgagcgtgagcccgcttctgctaacttcatctcaacaaaaggcagattggatacctcttgcattaacgataaaggggctaaacccaacagctatcttcctcacgactttaagcagaacatctaagaaacgttcctggccactcaatgaagcaataatggcagttggtatggtcagcattctcgcgtcttctctactcaaaaatgatattccgatgactggaccgttggtagctggtggtttactaaccgtgtgttacgtccttactggacgttcagcagatttggaactagaaaaagcggcagatgtcaggtgggaagatcaagcagagataagtgggtcgtcacccatattaagcgtaatcgtttcagaggatggttctatgtcaatcaaaaatgaggaagaagaacaaattctgacgattctcatcagaactggactccttgtaatctcagggctattccctgtcagtattcctatcaccgcagcagcgtggtatttgtgggaggtcaagaaacaacgggccggtgtactttgggatgtgccatcacctccacccgtcggtaaagctgaactagaggatggcgcatatagaataaaacagaagggtatattaggatattcgcaaataggggcgggagtatataaagaaggtacttttcatactatgtggcacgtcactagaggggcagtgttaatgcacaaaggaaagcgtatcgagccctcatgggcggatgtaaagaaagatttaatatcatatggaggaggttggaaattagaaggggaatggaaggagggagaagaagtccaggtgctagcattggaacctggcaaaaatccccgagcggttcaaacgaagcccggcttattcaaaactaatgcgggcacaattggggccgtatccctagacttcagtccgggaacatctggttcacctatcatagacaagaaaggcaaggttgtaggtctgtacgggaacggcgttgtaactagaaatggatcatacgtatccgcgattgcgcagactgagaaatctatagaagataatccagaaatagaagatgatattttccgaaagaagaggttgactatcatggatctccacccaggggctgggaaaacaaaaagatacctacccgcaatagttagagaagcaattaaaaggggcttacgcacacttattctagctccaacccgagtagtagccgcagaaatggaagaagcactaagaggactacccataagatatcaaacaccagctatacgagctgaacacacaggacgggaaattgttgacttaatgtgtcacgcaacattcacaatgcgattacttagccctataagggtgcctaactataacctaataatcatggacgaggctcacttcactgacccggcatcgattgctgcacggggatacatatcaacgagagtagagatgggcgaagctgcggggatatttatgactgcaacaccgccaggaagtcgcgatcctttccctcaatccaacgcacctattatggatgaagaaagagagataccagaaagatcatggaactcaggacatgaatgggttaccgattttaaaggaaaaacagtttggtttgtcccaagtataaaagcaggaaatgatatagcagcttgcttacgcaaaaatggtaagaaagtgattcaactttcaagaaaaaccttcgatagtgaatatgttaaaactagaaccaacgactgggattttgtggtaacaacagatatcagcgaaatgggggcgaattttaaagctgaaagagtcatagacccacgccgatgtatgaagccagttattctaactgatggagaagaacgagttatactcgccggcccaatgcctgtaacgcacagctctgcagcacagcgcaggggccgaattgggcgaaatcccaaaaacgaaaatgaccaatatatatatatgggagaaccgctagagaacgacgaagattgtgcgcactggaaagaagcgaaaatgctacttgacaatatcaacacaccggaagggataattccttcaatgtttgaaccggaaagagaaaaagtagatgccatcgacggagaatatagacttcgaggcgaagctcggaaaacattcgtggatttaatgagacggggtgatttaccagtttggttggcgtataaagttgccgctgaaggaattaactacgccgacagaagatggtgctttgacggcataagaaacaatcaaatactggaagaaaatgtggaagttgaaatctggaccaaagaaggagaaaggaaaaagttaaagccacgctggctcgacgccagaatatacagtgatccactggcactaaaggagtttaaggagttcgctgccggccgcaagtcattaacattaaatcttattactgagatggggcgtctaccgacttttatgacacaaaaagctcgtgatgctttggacaacctagcagtattacataccgcagaggctggtggcagagcctacaatcatgcattgtctgaattaccagaaacgcttgaaacactcttactcttaaccctactcgcaacagtaacagggggtatctttttatttttaatgagtggaaggggtataggcaagatgaccctcggcatgtgttgtataattacggcttctatacttctttggtatgcacaaattcaaccacattggattgcagcctcaattatattggagttctttcttatagttttgttaattcctgaacccgaaaaacaaagaacgccgcaagataatcagttaacatatgttgtcatagcaatccttaccgtggtcgctgcaactatggcgaacgagatgggatttcttgagaaaacgaagaaggatctgggcctaggttcaatagccactcaacagcctgaatcaaatattttggatatcgatctgagaccagcgagtgcttggacgctttatgccgttgctaccaccttcatcacgccaatgctaagacattccattgaaaatagttcagtcaatgtcagtctaacagcaatagctaatcaagccacagttttaatgggtttaggcaaagggtggcccttatcgaaaatggacattggagtcccattgctagcaatcggttgttatagtcaagtcaatccaatcacgcttacagcagctcttttgttgttagtagcacattatgcaataatagggccaggattgcaagccaaagcaactcgagaagctcagaagagagctgctgccggaatcatgaagaatcctacagtagacggtattacggcaattgatctcgatccaataccttacgaccctaaatttgagaaacaactcggacaggtgatgctattagttctttgtgtcacgcaagtgcttatgatgcgaacaacttgggctctatgtgaagcactcacactagctactgggccaatatcgacgctctgggaagggaacccaggacgattttggaatacaactatagccgttagcatggcaaatatcttcagaggtagctatctagcaggggcaggtctactatttagtatcatgaagaatacgacaaacacacgacgaggaaccgggaacattggagaaactctaggagaaaaatggaaatcaagattaaatgcgcttggcaagagtgagtttcaaatatataagaaatcaggtatacaagaagtggatcgcacgctggcaaaagaaggaataaaaaggggcgaaactgatcatcacgctgtatcacgaggttctgcaaagttacgctggttcgtagagcgtaacatggtaacgccggaaggaaaagtagtagatttaggctgcggaagaggaggatggagctactattgcgggggtttgaaaaatgtaagggaagtaaaggggctaactaagggtgggccaggtcatgaagaacctattccaatgtctacttatggttggaacttggttagattgcaaagcggtgttgacgtattctttactccgccagagaaatgtgacacgctgttatgtgacataggggaatcaagccccaatcccacggtagaggccggaagaacattaagagtattaaaccttgtagaaaattggctaaataataatactcaattttgtataaaagtcctaaatccgtacatgccatcagtaatagagaaaatggaagcgttgcaaagaaagtatggaggtgccttagttagaaaccccttaagcaggaactctactcatgaaatgtattgggtatcgaatgcatcaggtaacattgtaagttcagttaacatgataagccgaatgctaattaatagatttaccatgaagcataagaaggccacatatgagccagacgtggacttgggttccgggacctgcaatatcgggatagaatcggaggtaccaaatttagacataattggaaaaaggatagagaaaataaagcaagaacacgaaacctcatggcattatgatcaagatcacccgtacaaaacctgggcataccacggaagctatgaagcaaaacaaactggtagcgcatcaagtatggtaaatggggtcgtgcgtctactcacaaagccgtgggacgtgattccgatggttacacaaatggcaatgacagatactacaccctttggacaacaaagagtgttcaaggagaaagtcgacacaagaactcaagaaccaaaagaaggtaccaagaaactaatgaaaattacggccgaatggttatggaaagaactggggaagaagaaaacgccaagaatgtgtactagggaagaatttactagaaaagtccggtcaaacgcagctctgggagctatatttaccgatgagaataaatggaaatcagcaagagaagccgtagaagatagtagattttgggaattggtcgataaagaaagaaatttacatctagaaggcaagtgtgaaacgtgcgtttacaatatgatgggaaaacgggaaaagaaattaggggagttcggtaaagcgaagggctcaagggccatctggtacatgtggctcggggcacggttcttagaatttgaagcactaggcttcctaaatgaagaccactggttttcgagagaaaacagcctaagtggggtagaaggtgaaggactatacaaattaggatacatccttcgagatgtatccaaaaaggaaggcggtgcaatgtatgcagatgatacagcaggatgggacacgcgcataacacttgaagatctcaaaaatgaagaaatggttacaaatcacatggaaggagagcataagaaactcgcggaagcaatatttaaactaacctaccagaataaagtggttagagttcagcgcccgacccctcggggcacagtaatggacatcattagcagaagagaccaacgtggcagcgggcaagttggaacatacggcctcaatacatttacaaatatggaagcccaattaataaggcagatggaaggtgaaggcatattcaaaagcattcagcacctaaccgcaaccgaagaaatagctgttcaaaactggttaacccgtgtcggaagggaaaggctttcgcgaatggcaatatctggggacgactgcgttgtgaaaccacttgatgatagatttgccagtgcgctaaccgcactcaatgacatgggtaaagtccgtaaagacattcaacaatgggaaccctcgcgcggttggaacgattggacacaggttcctttctgtagccatcacttccatgaactgatcatgaaagacggacgagtcttagtcgtcccgtgccgcaaccaagacgaattaataggtagagcacggatatcccaaggtgctggctggagtctaagagaaacagcatgtttgggtaaatcttatgctcaaatgtggagcttgatgtatttccaccggcgtgatttacgcttagctgcgaatgccatctgtagtgctgtaccatctcactgggtacctacctccagaactacgtggtcgatccatgctaagcacgaatggatgacaacagaagacatgttgactgtatggaaccgagtttggatccaggaaaacccctggatggaagataaaaccccagttgaatcttgggaggagattccctatttgggaaaaagagaggaccagtggtgcgggtcactgatcggcttgacttcgcgagccacgtgggctaagaatatccaaacagctatcaaccaagtaagatcactaattggcaatgaggaatatacagattatatgccttccatgaaaaggtttcgtagggaagaagaagaagcaggcgttttatggtaa

SEQ ID NO: 22172 - RNA, 9876 nt, synthetic construct
  misc_feature 1..9876: note = derived and/or modified CDS sequence (opt6) from DENV-2__KF744401__SS-prME
  source 1..9876: mol_type = other RNA
accgcaggtatgattataatgctaataccaacagttatggcttttcacttaacaactcgtaacggagaaccacatatgatagttagtcgtcaagaaaaaggaaaaagtttgcttttcaaaacagaaaatggagtaaatatgtgtaccctaatggcaatggatcttggagaactatgtgaagacacaataacatacaaatgccctctattaagacaaaacgaaccggaagatatagattgttggtgtaattctacatctacctgggttacctatggtacgtgtaccaccactggtgaacacagaagggagaaaagaagcgtagcactcgtaccccatgtcggcatgggcttagaaactagaaccgaaacttggatgagtagtgaaggagcatggaaacatgcacagcgcatagaaacatggatactaagacatccggggtttacactcatggctgcaattctcgcgtatacaattggcactacacacttccaaagagcgctaatcttcatattattgacagctgttgcaccctccatgactatgaggtgtattggtatctcaaatagagacttcgtagaaggggtatctggaggatcctgggttgacatagtgttagaacacggttcatgtgtgacaacaatggcgaaaaataaacctacattggactttgagttaattaaaactgaagcgaaagagccggcgactttaagaaaatattgcatagaagctaaattaacgaatactacaacggaatcgcgttgtccaacgcagggggaacctagtcttaatgaagaacaagacaaacgcttcgtgtgtaaacattcaatggttgaccgcggatgggggaatggctgtggattattcggaaagggagggatcgtaacttgtgctatgtttacctgcaagaaaaatatggaaggtaagattgtccaacctgaaaacttagaatacacaatagtaataactccgcatagtggtgaggagcacgctgtaggaaatgatacaggaaagcatgggaaagagataaaaatcaccccacaaagtagcacaacggaagcagaattgactggttatgggacagttacgatggaatgtagtccacggactgggctggattttaatgaaatggtattattgcagatggagaataaggcttggttagtacatcgtcaatggttcctcgatcttccgctgccgtggctgcctggtgcagatacacagggaagtaattggatacaaaaagagaccttagtaacattcaaaaatccacacgcgaaaaagcaggacgtcgttgttcttggaagtcaggaaggagcaatgcataccgcattaactggtgcaacagaaatacaaatgagttcaggaaatctattattcacaggtcaccttaaatgccgattacgtatggacaagttacagttaaaaggaatgtcatatagcatgtgtacagggaaatttaaggttgtaaaagaaattgcagaaacacaacacggtactattgttgtacgggtccaatacgaaggtgatggaagtccctgtaagatccctttcgaaatcatggacctcgagaaaagacatgtgttgggaaggcttattactgtaaaccccattgtaacagaaaaagattcgccagttaatatagaagctgaacccccattcggagacagctatgtcatcataggagtagaaccaggacaattaaaattaaactggtttaagaagggaagctcgattggacaaatgtttgaaaccactatgcgcggagctaagagaatggcaattttaggagacacagcctgggatttcggctcactcgggggagtttttacctctatcggaaaggctttacaccaagtatttggcgcaatatatggtgctgcgttcagcggagtatcgtggacaatgaaaattttaatcggagtcataataacttggataggaatgaactcacgatccaccagcctttcagtcagtttggtactggtaggagtggtaaccttgtatctgggcgtggttgtacaagctgactcgggatgcgttgtgtcgtggaaaaataaagaattaaaatgtggtagtggaatttttataaccgacaacgtacatacatggactgaacaatataaatttcaacctgaatccccgtcaaaattagcaagtgctatacagaaagctcatcaagagggaatttgtggaataagatcagttacaagactagaaaacctaatgtggaagcaaataacgcccgaactaaaccacatactaagcgaaaatgaggtaaagttgacaattatgacgggcgatatcaaaggcataatgcacgcaggaaaaaggtcactaaggccgcagccgacagaattaagatactcctggaaaacatggggtaaagcgaaaattctatcaacagaatctcataatcaaacattccttatagatggacccgaaaccgccgagtgtccaaacaccaacagagcatggaactcgctcgaagtagaagattatggttttggcgtctttacaacgaatatttggctgaaattacgtgaaaagcaagatgcattctgcgacccgaagttgatgagcgcagccataaaagacaatagagcagtacatgctgatatgggttactggatagaatcagcactaaacgatacatggaaaatagaaaaagcgtcatttatcgaagtaaagaactgtcactggcctaaatctcataccttatggtcaaatggtgtattggaaagcgagatgataatacccaaaaattttgccggtccggtatctcaacataattatcggccaggttatcatactcaaacagctggtccatggcacttaggcaagctggaactcgactttgacttctgtgaaggaacaactgttgtagtcacggaggattgtggaaatagaggcccgagtttacgaacgacaaccgcgtctggcaaactaatcactgaatggtgctgtaggtcatgtacactaccacctctccggtacaaaggggaggacggctgttggtatggaatggaaataagaccattaaaagaaaaagaagaaaacttggttagttcccttgtaactgccgggcacggacaaatcgacaacttttccctgggcgttctaggaatggcactttttctggaagaaatgctgagaacgagagttggaatgaagcatgccatccttctggttgcagtttcgttcgtgacactcatcacgggaaatatgagcttcagggatttaggccgtgtgatggttatggtgggtgcaacaatgacagatgatataggaatgggtgtcacatatttagctcttttagccgcttttaaggtaaggccaacatttgcagctggacttttactgcgaaagttaaccagtaaggaactcatgatgacgacaatagggatagtcttattatctcaatcgacaattccagaaacaatactggaactcactgatgcgttagctctgggcatgatggtactaaagatagtaagaaaaatggagcggtaccaattagctgtgacaataatggcaatcctatgtgtccccaattcggtaattttacagaatgcatggaaagtctcctgcacaattctagctgttgtgtcagtctccccattactcctcacttcaagtcagcaaaaagccgattggataccgttagcactcacgataaaaggattaaacccgacggcaatattcctaactactctgagcaggacatcgaagaaaagaagctggcccttaaacgaagcaataatggccgttgggatggtctcaatacttgcatctagtttacttaaaaatgatataccaatgacaggacccctggtggcagggggcttgttaaccgtctgctatgttctgacgggcagatcagccgacttagagctcgaaaaagccgctgatgtacgatgggaagatcaagcggaaatatctggatcatcacccatattgagtgtaatcgtttcggaagacgggagcatgtccatcaaaaatgaagaagaggaacagaccttgactatcctaatcaggacaggattactcgtaattagtggtctttttcctgtatccataccaattacagcagcagcatggtacttgtgggaagtaaagaaacaacgagcaggagtgttatgggacgtcccctcgccacctcccgtgggaaaggcagaactagaagacggagcctatagaataaagcaaaaaggaatacttggatattcccaaataggagccggcgtatacaaagaagggacatttcatactatgtggcacgtcacccgaggtgcagtattgatgcataaaggaaaaagaattgaaccatcttgggcggatgtgaagaaagatctcatctcatacggaggtggatggaaattagaaggagaatggaaagagggtgaggaagtccaagtgttggcattagaacccggcaagaacccacgagcagtacaaactaagcctggattattcaaaaccaatgcaggtacgatcggagccgttagcctagatttcagcccaggtacaagtgggtctcctataattgataagaaaggaaaagtggttgggttatatggcaacggagtagtaacaagaaatgggagctatgtaagcgcaatagctcagacagaaaaatcgattgaagataatccagagatagaggacgatatcttcaggaagaagagattaacaattatggatttacatcctggcgcaggtaagacgaaaagatatctaccggcaatcgttagagaggctatcaagagaggacttaggacactcatattagcaccaactcgagttgtagcggctgagatggaagaagcattacgagggttgccgataaggtaccaaacccctgcaattcgtgccgaacacactggaagagaaatcgttgatctaatgtgtcatgcaacttttactatgaggttgttgagccccattagagtacctaattacaacttaattataatggacgaagctcacttcactgatcccgcatcgattgcagctagaggttatataagcactagggtagaaatgggagaggcagccggaatattcatgaccgctacaccaccggggtcacgagatccattcccacaaagcaatgctccgataatggacgaagaaagagagataccggaaagatcttggaactcgggacatgaatgggtgactgactttaaaggaaaaacagtttggttcgtaccatcgattaaagcaggaaacgacatcgcagcatgcctaaggaaaaatggcaagaaagttattcaattatctcggaaaaccttcgactcagaatatgtcaaaaccagaacgaacgattgggattttgttgtgaccacggatatatcagaaatgggagctaacttcaaggcagaaagagttatcgacccaaggcgatgcatgaaacctgtaatcctaacggatggtgaagaacgagtgattctcgccgggcctatgcccgttactcatagttctgcagcgcagagaagaggacggataggaagaaatcccaaaaatgagaatgatcaatatatatacatgggagagccactagaaaatgatgaagactgtgcacactggaaagaagcaaaaatgctcttagacaatataaatacacccgaaggcattataccatcaatgtttgaacctgaacgcgaaaaggtagacgctatagatggcgagtatagacttcgaggtgaagcaagaaaaacgtttgtggacctaatgcgacgaggtgacttacctgtatggttagcttacaaagttgcggctgagggaatcaactatgctgatcgccgctggtgctttgacggaataagaaataatcaaatactcgaggaaaatgttgaggtagaaatatggacaaaggagggtgagcggaagaaactaaagccaagatggctagatgccaggatttatagtgacccattagccttgaaagaatttaaggaatttgctgccggcaggaaatcattaaccctaaatctcataacggaaatgggaagattgccaacatttatgacgcaaaaagcgagagacgctctcgacaatctagcggtacttcacactgcagaagccggtggacgagcatataaccacgcactttcggaattaccggaaacgttggaaacattgcttcttctgacactgttagccactgtcaccggtggcatctttctgttcctcatgagcggcagaggaataggcaaaatgacattaggcatgtgttgtataataactgccagcatactgttatggtacgcacagatacaacctcattggatagcagcaagtatcattcttgagttctttttgatagtattactaattcctgaacctgaaaaacaacgaaccccacaggataaccaacttacgtatgtagttatagccatactcaccgttgttgcagcaaccatggctaatgaaatggggttcctggagaaaaccaagaaagatctgggcttagggtctattgcaacgcaacaacccgaaagtaatatattggatattgacctgcgccctgcatcagcgtggaccctatatgcagtagcaacgacatttatcactcccatgctaagacattccatcgaaaatagttctgtaaatgtatcattaacagcaatagccaatcaagccacagttttaatgggactaggcaaaggatggccgctctccaaaatggacataggcgtccctctgttggcaattggatgttactcacaagtaaacccgattaccctaacggcagctttgttgttattagttgcacattacgctataattgggccaggattacaagccaaagcaacacgggaagcccaaaaacgtgcagctgcaggcattatgaaaaatccgaccgtcgatggtattacagccattgatcttgatcctataccctatgaccccaagtttgaaaaacagttaggccaagtaatgcttctcgttctctgtgtaactcaagtgttagttatgaggacgacatgggctttgtgtgaagcattgacattagcaacgggtcccatatcgacactgtgggaaggaaacccagggcggttttggaacacgactattgcagtctctatggcaaatatctttaggggaagttacctagctggtgcgggattactttttagtataatgaagaatacaacgaatacccgaaggggtactggtaacatcggagagacattaggcgaaaaatggaaatccaggctaaatgcactaggtaaaagtgaatttcaaatatacaagaagagtggaatacaagaagtagacagaacacttgcaaaagaaggaataaaaagaggtgaaacagatcaccacgctgtctcgcgtggaagtgctaaattgagatggtttgtagaacggaatatggtaacccccgaaggcaaagtagttgatctgggatgtggtagaggtggttggtcatattactgcgggggactgaaaaatgtgcgagaagtgaaaggcctaacaaaaggaggcccaggccatgaagaaccaattcctatgagtacgtacggatggaatcttgtgagactacaaagcggtgttgacgtattcttcacccctccagaaaagtgcgacacccttctctgtgatataggtgagagttcccccaacccaacggtcgaagcgggacggactcttcgcgtgttaaatttagtagagaactggctaaacaacaacacacaattttgtataaaagttttaaatccttatatgccatctgtaatagagaaaatggaagcgttgcaaaggaaatatggcggagccctagttagaaatccgttatcccgtaatagtacacacgaaatgtactgggtaagcaacgctagcggtaacattgtctcaagtgttaatatgattagtagaatgctgatcaataggtttaccatgaagcacaaaaaggctacatacgagccggacgttgatctaggcagcggtaccagaaatataggaatagaaagtgaagtaccaaacttagatataattggcaaaaggatagagaaaataaagcaagaacacgagacctcatggcattacgatcaggatcatccttataaaacgtgggcatatcatgggtcctatgaagctaaacagaccggaagcgcttctagtatggttaacggtgttgtaagattactcacaaaaccgtgggatgtaataccaatggttactcaaatggcaatgaccgacacaaccccttttgggcagcaacgcgtattcaaagaaaaagtggacacccgaacgcaagaaccaaaagaagggaccaagaaactcatgaaaatcaccgctgaatggctatggaaagaattaggaaagaagaaaacccctagaatgtgtacacgtgaagagttcacacgaaaagtaagatcgaacgcagccctaggagctatattcactgacgaaaacaaatggaaaagtgctagagaagcggttgaagatagtcgattttgggaattagttgataaagagagaaacctgcacctagaaggaaaatgtgaaacttgtgtgtataatatgatgggtaaaagagaaaagaaacttggtgagttcggcaaagcgaaaggatcacgagctatatggtatatgtggctcggagcaagatttttagagttcgaagctctaggctttttaaatgaagatcactggttttcgcgagaaaacagtttgtctggtgtcgagggcgaaggactatacaaactaggttatattttgagggacgtgtcgaagaaagaaggcggcgcaatgtatgcagatgacactgcggggtgggatacacgaatcactctggaagatctcaaaaacgaggaaatggtaactaaccatatggaaggtgagcataagaaactagctgaagcaatatttaagctaacgtatcaaaacaaagtagtaagagtgcagcgacctacgccaagggggactgtaatggacataattagcagaagagatcaacgcgggtcaggccaagtagggacatatggactaaacacttttacaaatatggaagcacagttgatacgccagatggagggtgaggggatattcaagtccattcaacacttgacagccacagaagaaatagccgtgcagaactggcttacaagagtaggaagagagcgtctcagccgtatggctatttctggtgacgattgtgttgtcaagcccctagatgatcgttttgcatcagcattaaccgcattgaatgacatgggtaaagtaagaaaagatatccaacaatgggaaccatctagggggtggaatgactggacgcaagtcccattttgtagtcatcacttccacgagctaattatgaaggacggaagagtacttgttgttccctgtaggaatcaagacgaactaataggcagagctcgtatttcacagggagcaggttggagtctacgagaaacagcatgtttaggaaaaagctacgcgcaaatgtggtctttaatgtacttccacagaagggatttaagactggcggcaaacgctatatgctcagctgtaccctcccattgggtacctacgtctagaacaacttggtcgatacacgctaaacatgaatggatgacaacagaagatatgttaacagtctggaatagggtttggatccaagaaaacccatggatggaggataaaacacctgttgaatcttgggaagaaattccctatttagggaaaagagaagatcagtggtgcggctctttgattgggctcactagccgggccacttgggccaagaatattcagactgcaataaatcaagtgagatctttaattggcaacgaggagtatacggactacatgcccagcatgaaaagattcaggagagaagaagaggaagcgggagtactgtggtaa

SEQ ID NO: 22173 - RNA, 9876 nt, synthetic construct
  misc_feature 1..9876: note = derived and/or modified CDS sequence (opt6) from DENV-2__KF744402__SS-prME
  source 1..9876: mol_type = other RNA
accgcaggaatgatcataatgctcatacccactgtaatggcatttcatttgacaacgaggaatggcgaaccacacatgatcgtgtccaggcaagaaaaaggcaaatcattattatttaaaactgaagacggagtaaacatgtgcactttaatggcaatggatttaggtgaactctgtgaagatactattacttataaatgccccttattgcgtcaaaatgaacctgaagatatcgattgctggtgtaactctacaagtacatgggtgacctatggaacatgtactactacgggcgaacatagaagagaaaaacgatccgtagctctagtccctcatgtcgggatgggattagaaacacgaactgaaacgtggatgtccagcgaaggcgcatggaaacatgctcagagaatagaaacttggattttaagacacccgggttttaccttaatggcggcaattcttgcatacacaattggtaccacgaactttcaacgagctttaatctttatccttttaaccgcagtggcgccgagcatgactatgcgctgcatcggcatatcaaaccgggattttgtcgaaggagtgtccggaggcagttgggttgacatagttttggaacacgggagctgcgttacaacaatggctaaaaataaaccgactctcgattttgaacttatcaaaactgaagcgaaacaccccgctacgcttcgtaaatactgtattgaagcaaaattaaccaacacaacaactgaaagcagatgcccgactcaaggtgaaccctcgttaaacgaagaacaagataaaagattcgtatgcaaacacagcatggttgatcggggttggggcaacggatgcggacttttcggcaaaggaggaatagtgacgtgcgcaatgtttacatgtaagaaaaacatggaaggtaaaatagttcaacctgagaacttggaatacaccattgtcatcacacctcacagtggagaagaacatgccgtcggcaatgacacagggaaacatggcaaagaaatcaaagttacaccgcaaagttctattaccgaagcagaattaacgggatatggaaccgtaactatggagtgttcaccacgcaccggtctggatttcaacgagatggtactgctacaaatggaaaataaagcatggctagtccatcgccaatggtttttagacttgcctctaccatggcttccaggagcagacacacaaggcagtaactggatacaaaaagaaacattagttacttttaaaaacccgcatgcgaagaaacaagatgttgtagtattaggttcacaggagggagcaatgcacactgcacttactggcgcgacagaaatccaaatgtcatcaggaaatcttctatttacaggacatctaaaatgtagactccgaatggataaattacagttaaaagggatgtcgtattcaatgtgcactggaaaatttaaagtcgtaaaggaaatagcagaaacccaacacggaactatagtggtgagggtacagtacgaaggtgacggaagtccatgtaaaatacccttcgaaattatggatttagagaaaagacacgttttaggaaggctcataacggtgaacccaatagttacggaaaaagatagccctgtaaatattgaagcagaacctccattcggagattcttatgttatcatcggagtggaaccagggcaactcaaactaaactggttcaagaaaggatcatcaatcgggcaaatgtttgaaaccacaatgagaggtgcaaagagaatggccattcttggagacaccgcttgggatttcggaagtttagggggcgtgttcacttcgataggaaaagccctacatcaggtatttggagctatttatggagcagccttttcgggtgtgagctggacaatgaagatcctaataggcgtaattattacctggataggcatgaatagtaggtcaacgtcactatcagtaagtttaattctggtaggagtggtcacgctatatttaggtgtagtcgtacaggcagacagcggttgtgttgtcagttggcgaaacaaagagctaaaatgcgggagtggcatatttataacggataatgtgcatacttggactgaacagtataaatttcaaccagaaagccctagtaagctagcatcagcaattcaaaaagcacatcaggagggaatatgtggtatacggtcagtaaccagactcgagaatctaatgtggaaacaaattacacccgaactcaatcacattttatccgaaaatgaggtaaagctaactataatgactggagacatcaaaggaattatgcacgctggaaaacgttccttaagaccacaacccactgagctacgttactcatggaagacatggggaagggcaaaaattttgtcgacagaatctcataaccaaacatttctgatagatgggcctgaaactgcggaatgcccgaataccaaccgagcctggaatagtctagaagtggaagactacgggttcggtgtattcactactaacatatggctaaaacttaaggagcgacaggatgtattttgcgattctaaattaatgagcgccgcaataaaagataatagggccgtgcatgcagatatgggctactggattgaatctgcattgaacgatacatggaaaatagaaaaggcctcattcatagaggtaaaaagctgtcactggcctaaaagccacacattgtggagtaacggagtgctagaaagtgagatgataatacccaaaaattttgcaggtcctgtgtcccaacataactatagaccgggctaccacacccaaactgcaggcccttggcacctaggtaagttagagatggactttgatttttgtgaaggaacgactgtagtcgttacggaggactgtggaaacagggggccaagcctccgaaccacaactgcttcaggaaagttaataacagaatggtgctgtcgctcttgcactctcccacctctgagataccgtggagaggatggttgttggtatgggatggagatcaggccattaaaagagaaagaagagaacctggtaaattcacttgtaacggcggggcatggacaaattgataacttttccttgggtgttttagggatggctttattcctggaagaaatgctcagaacaagagtgggcacgaaacacacgatactattagttgcggttagtttcgttacgttgatcacaggaaatatgtcgtttagagatcttggccgagtcatggtaatggttggtgccaccatgacggataatattggaatgggagtgacatatttagcacttcttgcagcttttaaagtacgtcctacgttcgctgcaggactattattgagaaaattaacttccaaggagctaatgatgactactataggtatagtactcctaagccagtctactatacctgagaccatattagaacttaccgatgcactggcattaggaatgatggtattaaaaattgtacgaaatatggaaaaataccaattagcagtaacaataatggcgatactctgtgtaccaaatgcagtaatattacagaatgcatggaaagttagttgtaccattttagcggtagtttcggtctctccactattgctaacatcgagccagcaaaaggcagactggatacctctcgcacttacaatcaaggggcttaatccgaccgctatattccttactacgctctccagaacgagcaagaaaagaagctggccacttaacgaagctatcatggccgttggtatggtatcaatactagcttctagcttgctaaagaacgatattccgatcaccgggccattagttgcaggcggacttcttactgtttgctatgtactaacaggaagaagcgcagacttagaattagagcgcgcagcagatgtacggtgggaggaacaggctgaaatctcaggatcttctccaatacttagcataataatatcagaggatgggtctatgtcaatcaaaaatgaagaagaggaacagacattaactatactgatacgaaccggtctcttagtaatcagtgggttattccccgtttcaatacccatcacggcggctgcttggtatttgtgggaagtaaagaagcagcgcgctggtgtactttgggatgtaccgtctcccccaccagtgggcaaggcagaactcgaagacggtgcatatcgtataaaacaaaaagggatattgggttacagccaaataggtgccggagtctataaagagggtacttttcacacaatgtggcatgtaacacgaggcgcagtgctcatgcataaggggaaacgaatagaaccaagctgggcagacgtcaaaaaggatttaatatcatatggaggtggatggaaactagaaggcgaatggaaggaaggagaggaagttcaagtgttagctttagagcctggcaaaaatccccgcgctgtacagacaaaaccaggcttattcaaaactaatgcaggcactataggtgcggtaagcctagacttcagtcccggtacgtcgggatcacccatcatagataagaaaggaaaagtcgtaggactatacggaaatggcgttgttacgagaaacggttcttacgtatctgcaatcgcgcaaacaggaaaaagtatagaagacaatcccgaaattgaagatgacatttttaggaagaaacggttgacaataatggacctccaccctggcgcagggaaaaccaaaagatatctcccagcaatagtaagggaggcaattaaaagagggctgcgtacattaattttagcgcccacacgagtagtagcagcagagatggaagaagcgcttaggggcttaccaattagataccaaacaccagctatcagagcggaacacacaggaagagaaatcgttgacttaatgtgccacgcgacctttactatgaggttattgagtcccattagagttccaaactataacctaattataatggatgaagctcatttcacagatccagccagtatagcagcccgcggttacataagtactagggtcgaaatgggcgaagctgcggggatttttatgacagccacgccaccaggatccagagacccatttccgcaatcgaatgccccaataatggatgaagaacgtgaaataccggaacggagttggaactcagggcatgaatgggtcactgactttaaaggcaagacggtatggttcgtaccatcaataaaggcaggtaatgacatagcggcttgtcttcgtaaaaatgggaagaaagttatacaactatctcgtaaaacatttgatagtgagtacgtaaaaacacgcacgaatgattgggacttcgtagtaaccacggatataagcgaaatgggcgcaaatttcaaagccgaacgggtgatcgacccccgtagatgcatgaagccagtaatccttacagacggcgaagaacgtgtaattttggcgggaccaatgccggtcacacacagcagcgcagcacagcgacggggtagaattggaagaaatcctaagaatgagaacgatcaatatatttacatgggggaacctttagaaaatgacgaagatcacgctcattggaaagaagctaaaatgttattggacaacattaatactccagaaggcattatacctagcatgttcgagccagagagagaaaaagtagacgcaatcgatggggaataccggcttagaggggaagctcgaaaaacattcgtagacctaatgagaaggggtgacctaccagtatggttggcctataaagtagcggcagaagggatcaattatgctgatagaaggtggtgttttgatggtataagaaataatcaaatactagaagaaaatgtagaagtagagatttggactaaagaaggtgagaggaagaaattaaaacccagatggttagacgcccgaatatatagcgatccactagcattaaaagagttcaaagaatttgctgctggacgaaaatctcttacattaaatttgatcacagagatgggacgtttgcctacatttatgactcaaaaagctagggacgcactcgataatttagctgtgttgcatacggcagaagctggtggcagagcttacaatcacgcacttagtgagctgcctgaaacccttgaaacacttttgctactaacattactagcaactgtaacaggcggcatctttctctttctaatgtcgggcaagggtattggcaaaatgacattaggaatgtgttgcattataacggccagcgtgttgttgtggtatgcacaaatccaacctcactggatagcggcaagcataatactcgagttctttttaattgttcttcttatccccgaacccgaaaagcaacgaacaccacaagacaatcaacttacgtatgtcgtaattgcgatattaacagtagtcgcagcaacaatggcaaacgagatgggctttctagagaaaaccaagaaagattttggcctagggtcgatagctacccaacaaccagagtcaaatatcttagatatagacttaagaccggcaagtgcctggactttatatgccgtagccacgacttttataaccccaatgttgagacacagcatagaaaattcaagtgttaacgttagcttaacagctatagcaaaccaagcaacagtacttatgggtttaggcaaaggttggccattatcaaaaatggatataggagtgccgctcctagccatcggttgctattctcaagtgaaccctataacattaacagccgcattactattattagtagctcattacgctataattggaccgggattacaagccaaagcaactcgagaagcacagaaaagggcagctgctggaataatgaaaaacccaaccgtagacggtattacagtaattgatcttgacccaataccatacgatccgaaatttgaaaaacaactaggtcaggtcatgctgctagtattatgcgtgacacaagtacttatgatgcgcaccacttgggctctttgcgaggctttgacccttgcaactggacccataagcactttgtgggaaggtaatcccggccgattttggaataccaccatagcggtttctatggccaacatttttagaggtagttatctagcaggagcaggactactcttttcaatcatgaagaacacgaccaatacacgaagagggactggaaatataggcgaaactctaggcgagaaatggaaatcacggttaaatgccctgggcaagtccgaatttcaaatatacaagaagtcaggaatacaggaagtagaccgtacgctagccaaagaaggaattaaacgtggtgaaactgaccatcatgcagttagtagaggatctgctaaattaagatggtttgttgaacgaaatatggtcaccccagagggaaaagtagtcgatctagggtgcggtagagggggttggtcatactattgtggaggactaaagaatgtaagagaagtaaaaggattaacaaaaggtggtccaggacacgaggagcccatccccatgagtacatacggctggaatcttgtccgactacaatcaggagtagatgtattctttactccaccggagaaatgcgatactctactatgtgatatcggtgagagctccccaaaccccaccgttgaagcaggaagaactttaagggtactgaatttagttgaaaactggctaaacaacaacactcaattttgcataaaagtccttaacccatacatgccatccgttattgagaaaatggaggcacttcaacgtaagtatggtggagctctagtaaggaatcctttgagccgcaatagcactcatgaaatgtattgggttagtaatgcttccgggaatattgtttcgtccgtaaatatgatttccaggatgctaatcaaccgtttcacaatgaggcacaagaaagctacttacgaaccggatgttgatttaggaagtggtacgaggaatatcggaatagagtcagaagtacctaacttagatataatcggcaaaaggatagagaaaatcaaacaagaacatgaaacctcgtggcattatgaccaagaccatccatacaaaacatgggcttatcatggaagttacgaaacaaaacaaacgggttcagcatcaagtatggttaatggagtagtccggctactaacaaaaccctgggatgtaattcccatggtgacacaaatggcaatgacagataccacacccttcggacagcagagagtattcaaagaaaaagtagacacacgaacccaagaaccgaaagagggaacaaagaaattgatgaaaattacagctgaatggttatggaaagaacttggaaagaagaaaactccacgcatgtgtactcgagaggagttcactaggaaagttaggtctaatgcagcactaggggcaatatttacagatgagaataaatggaaatctgccagagaagctgtagaagactcacgtttctgggaattagttgataaagaaaggaacttacatttagaaggaaaatgtgaaacatgtgtttataatatgatggggaagcgcgagaagaaattaggagaatttggtaaagcaaaaggaagtagggcgatatggtatatgtggttaggcgcgcgttttcttgaatttgaagccctaggcttcttaaatgaagatcactggtttagcagagagaacagcttgtcgggtgtagagggagagggattgcataaacttggatacattttaagggacgtatcaaagaaagagggcggggcaatgtacgcggatgatactgcaggatgggatacgagaataactttagaagatcttaaaaacgaggagatggttaccaatcatatggagggtgaacataagaaacttgcagaagcaatcttcaaacttacatatcaaaacaaagtagtgagagttcagcgaccaacacctagaggaacggtaatggatattatctcgaggcgagaccaacgcgggtcaggccaggtggggacatatggtttaaatacatttactaatatggaagcccagctgatacgacaaatggaaggagaaggcgtgtttaaaagtatacagcacttaactgcgacagaagaaatagctgttcaaaattggttagctagagtgggccgcgagcgtctctcaagaatggctatatccggggatgactgtgtggtaaagcccttagatgatagatttgcgtctgcattgaccgctcttaacgatatgggtaaagtcagaaaagatatccaacagtgggaaccgagtcgaggatggaatgattggacacaagttcccttctgttcccatcattttcatgaactaataatgaaggacggcagggtcctagtcgtaccctgccgaaatcaagacgaattaataggcagagctcgaatatctcaaggagccggatggtctctcagagaaaccgcgtgcctaggaaaatcatatgcacagatgtggtcccttatgtatttccaccgcagagatttacgtctcgcggccaacgcaatatgctctgcagttccatcccattgggtgccgacaagcagaacaacttggagtatacacgccaagcatgaatggatgaccacagaggacatgcttacagtatggaacagagtttggatacaagagaacccctggatggaagacaaaacaccggtcgaatcatgggaagaaatcccatacctcggtaaaagggaagatcaatggtgcggatccttgataggtttaacttcccgagcaacgtgggccaaaaatatccaaactgctataaatcaagtacggtctctgatcggcaatgaagagtatacagactatatgcccagcatgaaaagatttagacgagaggaagaggaggcaggagtactatggtag

SEQ ID NO: 22174 - RNA, 9876 nt, synthetic construct
  misc_feature 1..9876: note = derived and/or modified CDS sequence (opt6) from DENV-2__KF744408__SS-prME
  source 1..9876: mol_type = other RNA
acagcgggtatgataataatgctcatacctacagtaatggctttccatttaactacaagaaatggggaaccacatatgatagtatcgaggcaagaaaaaggaaaatcactactcttcaaaacagaagatggtgtaaacatgtgcactttaatggcaatggatttaggagaactgtgcgaagacactattacatacaaatgcccattattaagacaaaatgaacccgaagacatcgactgttggtgcaattcaacgagcacgtgggtgacatatggaacttgtacaaccaccggggaacaccgaagagagaaaagatccgttgcattagtaccacatgtcggaatgggtttagaaaccagaacagaaacatggatgagttctgaaggtgcttggaaacatgcacaacgtattgaaacttggatattaagacaccctggttttaccctcatggcggcaatccttgcttacacgattgggactaccaacttccaacgagctctcatattcattctattaacagcagtagcaccaagtatgactatgcggtgcataggaatcagtaatagggattttgttgaaggtgtgtctggtggttcatgggtcgatattgttctcgaacatggatcatgcgttacaaccatggccaaaaataaaccaaccttagatttcgaattaatcaaaactgaagcaaaacaccctgcgacattgcgtaaatattgcatagaagctaaactaacaaatacaacgactgcatcaaggtgcccaacgcaaggagaaccttcgctaaatgaagaacaagacaaaagatttgtttgcaaacactcaatggtagacagaggctgggggaacggatgtggcctcttcggaaaaggtggtatagtgacatgtgcgatgtttacatgtaagaaaaatatggaaggtaaaatagtacaacccgaaaatttagaatacacaattgtcataacgccacattcaggtgaagaacatgcggtaggtaacgacacaggcaaacacggtaaagaaattaaaataacaccacaaagtagtataactgaagcagaactcacaggctatggcaccgtaacgatggaatgttctccaagaacaggactgggcttcaacgaaatggtactattacagatggaagacaaagcatggctagtccaccgccaatggttccttgacttacctttgccctggcttcctggtgcggatacgcaaggtagtaattggattcaaaaagaaactcttgtgacttttaaaaatccacatgccaagaaacaagacgtcgttgtcttgggtagtcaggagggtgctatgcataccgcactcacaggagctaccgaaatacaaatgagtagcggaaacctactctttacaggtcacttaaaatgtagattacgcatggacaaactacaattaaaaggaatgtcgtacagtatgtgcactggcaaattcaaagttgttaaagagatagctgaaacccagcatggtactatcgtcgtcagagtgcaatatgagggagacggttctccctgtaaaatcccgtttgaaataatggatctagagaaaagacacgtactcggcagactaataaccgtcaaccctatcgtaaccgaaaaagactctccagttaatatagaggccgagccaccctttggtgattcttacgttataataggcgttgaaccgggacaacttaaactcagctggtttaagaaagggagttcaatcgggcagatgttcgaaacaactatgcgaggagcaaagagaatggcaatattgggtgacacggcttgggattttgggtctctaggaggagtcttcacgagtatcggaaaggctctccatcaggtgtttggagcaatatacggagcggccttttcaggggtaagctggaccatgaaaatcttaattggagtgatcattacctggataggaatgaatagcagatcaacaagtttatcggttagtctagtcctcgttggagtagtgaccttgtatctaggagttgttgtacaagctgattcaggatgtgttgtcagctggaggaataaagaactgaagtgcgggagtgggattttcataacagacaatgtacatacttggacagaacaatacaagtttcaaccagaatcaccgtcaaagttggccagtgcaattcagaaggcccaccaagaaggaatctgcggcataagaagcgtaacaagactggaaaacttaatgtggaaacaaataacgccagaattgaaccacatacttagtgaaaacgaagtcaaactcacgattatgacaggtgacataaagggaatcatgcaagctggtaaaagaagcctgagaccccagccaacagagctgcgctattcatggaaaacatggggaaaagcaaaaatactaagtaccgaatcacataatcaaacctttttaattgatgggcctgaaaccgcagaatgcccgaacactaaccgtgcttggaatagtctggaggtagaggattatggattcggcgtattcacaacaaacatatggttacggttaagagagaaacaagacgctttctgtgactcgaaattaatgtccgcagcgataaaagacaaccgagcagtacatgctgacatggggtattggatcgaaagtgcgcttaacgatacttggaaaattgaaaaagcgagcttcattgaagttaagtcctgccattggccaaaaagccatacactatggtcaaatggggtacttgaaagcgaaatgataatacccaaaaactttgctgggcccgtaagccaacacaattatcggcctggataccatacacagacagcaggaccgtggcacctaggaaagctagaaatggattttgacttttgtaagggaacaacagtagtagtaactgaagattgtggtaatcgaggaccaagtttaagaacgacgacagcaagtggaaaactaatcactgaatggtgttgtaggagctgtacactcccacccctgcggtatcggggagaagatggttgctggtatggcatggaaattaggcccttgaaagagaaggaagaaaaccttgttaattctctagtaaccgcaggccacgggcaaatagataatttttctctaggtgttctaggaatggccttgttccttgaagagatgctaagaacacgagttggaacaaaacacgctattctgctcgtagctgtttcgtttgtaacactaatcaccggtaacatgtcattcagggacttaggcagagttatggttatggtaggtgcaacaatgacggacgacattgggatgggcgtaacgtatctagccttactagccgcctttaaagtaagaccaacatttgctgcggggctattattacgaaaattaacgagcaaagaattaatgatgaccacaataggcattgtcttactaagtcaaagtacaattcccgagacgattttagaattaaccgatgcattagcgctaggaatgatggtcttgaagattgtcagaaatatggaaaaatatcaattagctgttacaatcatggccatactatgcgtgccaaatgcagtaattttacaaaatgcatggaaggtatcctgcacaattttagctgttgttagtgtgagtccattactgttaacatccagtcaacaaaaggcagattggattccacttgcattaaccataaagggactaaatcccacggctatattcctaacaactctttcaaggacctctaaaaagagaagttggcccttaaacgaagcaatcatggcagtcgggatggtaagcatattggcatcttcactattaaagaacgatataccaatgacaggacctttagtagcaggaggcctactcacggtatgttacgttctaactggaaggagtgcagacctcgagttggaaaaagcagcagacgtcagatgggaagaccaagcagaaatatcaggatcaagcccgatattaagtattataatatcagaagatgggtcgatgtctatcaaaaatgaagaagaagaacaaacactcacgatcttgattagaactggtctattagtaatatcaggattgttccctgtatcaatacctatcacagctgcagcttggtacttgtgggaggtgaagaaacaacgcgctggggtcctttgggacgtgccatccccgccaccggtgggtaaagctgaactcgaggatggcgcatacagaataaaacaaaaaggcattttaggttatagccaaattggtgctggagtctataaagaaggaacattccataccatgtggcatgtcacacgtggagccgtactgatgcataaaggtaaaagaattgaaccatcctgggccgatgtcaagaaagacctaatttcatacggaggagggtggaagttagaaggagaatggaaagagggtgaagaggtacaagttctcgccttagaaccaggtaaaaaccccagggcagttcaaaccaaacctggtctattcaaaacaaacgcagggactataggtgcagtttcacttgactttagccccggtacatcaggcagccccataattgataagaaaggcaaagtcgttggactttatggtaacggagtggtcactcgaaacgggtcgtatgtttcggcaattgcacaaacggagaagtccattgaagataaccctgaaatagaagatgacatttttcgtaagaaaaggttaacaataatggaccttcacccaggagccggaaaaactaaaagatatttacctgcaatagttcgagaggctataaaaagaggacttcgtacattaatcctagcaccaacaagagtagttgcagcagagatggaagaggccctaaggggacttcccataagatatcagactccagcaatacgtgctgagcataccggcagagaaatagttgacctcatgtgtcatgcaacgtttaccatgcgtttactatccccaattcgtgtaccaaattacaatcttataataatggacgaagcccactttacagatccggcttctatcgcggccaggggatatatttccacacgagtggaaatgggtgaagcagcaggcatcttcatgacggcaacaccaccgggttcgagagacccgtttccccaaagtaatgcaccaataatggacgaggagagagaaataccggaaagatcatggaacagtggtcacgagtgggtcaccgattttaaaggtaaaacagtgtggtttgtacctagtattaaagctggaaatgatattgcagcgtgcctcaggaaaaatggaaagaaagttatacaattgtcgagaaaaacgtttgatagcgaatacgtcaaaacacggacaaatgattgggacttcgtagtcacaacagatatttcagaaatgggcgccaacttcaaagcagagcgtgtcattgacccaagacggtgcatgaaaccggtgatactgacggacggtgaagaaagggtcatattagctggaccaatgccggtaactcatagttcagccgcacaaagacgaggccggataggacgaaatcccaaaaatgaaaacgaccagtatatctacatgggtgagccacttgaaaatgacgaagactgtgcccattggaaggaagccaagatgctacttgacaatataaacacccccgaaggcattataccaagtatgtttgaaccagagagggaaaaggtagacgcaatcgacggtgaatatagattgaggggagaggctcgcaagacgttcgttgacttgatgcggcgaggcgacctaccagtgtggttagcgtataaagtcgctgcagaagggattaattatgctgaccgacgttggtgcttcgatggtatccgaaacaatcagattttagaggaaaacgtagaagttgaaatatggactaaagagggagaacggaaaaagttaaagccaagatggttagacgcaagaatatatagcgacccattggccttaaaggaatttaaagagtttgcagctggtaggaaatcactaaccttgaacctaattacagaaatgggaagactccctacattcatgacccaaaaagcacgtaacgctttagacaatttagcagtattacatacagcagaagccggtggtagagcctacaatcacgcgttatcagaactgccggaaaccttagagaccctcctattacttacgttgctggcgaccgtaactggcggaatttttctatttttgatgtccggcaaagggataggcaaaatgacccttgggatgtgctgcataattacagcctcagtattactttggtatgcccaaatacaaccgcattggattgcagcttctataatactagagttctttttgatagtattattaatccccgaacctgaaaaacagaggacaccacaggataatcagctgacgtacgtagtaattgcgattctaacagtcgtggccgcaactatggcaaatgaaatgggatttttagagaaaacgaaaaaggatctagggcttggaagcataactacacagcagccagagtcaaatatactagatatcgatctaaggccagcgagtgcatggacactttatgccgtagcgacaaccttcataacaccgatgcttcgtcattcaatagaaaattcctcagtaaatgtatccctaacagctatagcaaatcaagcaactgtgctgatggggctgggcaaaggatggcctctctcgaagatggacataggtgtaccccttcttgctatagggtgttacagtcaggtaaatcccattactttaacagcagcactgctcttgttagttgcacattacgccatcatagggcccggactccaagcaaaagccacacgtgaagctcagaaaagagctgctgcaggaataatgaagaacccaacagtagacggaatcacggtaatcgatttagatccgatcccctatgatcctaaattcgaaaaacaacttggacaagttatgttgttagtgctgtgtgtaacacaagtcttaatgatgcgtactacatgggcactgtgcgaagcacttaccctagcgacaggcccaataagcactctatgggaaggtaatccaggacgcttctggaacaccacaatcgcagtatctatggcgaacattttcagagggtcatatttggccggtgcaggattattattctccataatgaagaatacgacaaatacacgaagaggaaccggaaatatcggagaaacacttggggagaaatggaaatctcgattgaacgccttagggaaaagtgaatttcagatctataagaaatcagggattcaagaagtagataggactctagcgaaagaaggaataaaacgaggagagacggatcatcatgcagtatcaagagggtcagcaaaattgagatggtttgtagagaggaatatgattactcctgaaggaaaagtagtagacctaggctgcggacgaggagggtggagctattactgtggtggcctaaagaacgttcgtgaagtaaaagggctaacaaaaggcggacctggtcatgaagaacctatcccaatgagtacttatggatggaacttagttaggcttcaaagtggagttgatgtcttctttacgccaccagagaaatgcgacacattgctctgtgatataggggagtccagtcctaaccctacggtagaagccggacgaaccctaagagtactcaatttggttgaaaactggttaaataacaacacacaattctgtataaaagtcctcaacccttacatgccttcggtaatagagaaaatggaagctctccagcgtaaatacgggggtgctcttgtaagaaatcctctttcacgcaacagtacacatgaaatgtattgggttagcaatgcttctggcaatatcgtgagtagcgtaaatatgattagtcgtatgctcataaatcgatttaccatgaaacataagaaagccacttatgaacccgatgtcgatctcggaagcggaactaggaacattggaattgaaagcgaagtccccaatctagatatcataggaaaacgcatagagaaaataaaacaggaacacgaaacatcttggcattacgatcaagaccatccatataaaacgtgggcttatcatggatcatatgagactaaacagactggttcagcatcttcaatggttaatggtgtggtaagactactaaccaagccctgggacgtcataccaatggtaacgcaaatggcaatgacagacaccacaccgttcggtcaacaaagagtttttaaagaaaaagtggacactaggacacaagaaccaaaagaaggtacaaagaaacttatgaaaatcaccgctgagtggctatggaaagaactgggcaagaagaaaacgccaagaatgtgcacacgcgaagaatttacgcggaaagttcgatcaaatgccgcgctcggtgcaatttttactgatgaaaacaaatggaaaagtgcaagggaagctgtagaagattcaagattttgggaattagtagataaagaacgaaatctacacttggaaggtaaatgcgaaacttgcgtatacaatatgatgggaaaacgtgagaagaaacttggtgagttcggcaaagcgaagggttcacgagctatatggtacatgtggttaggagcgcgatttctagaatttgaggccttaggttttctaaatgaagatcattggttctcacgggaaaattcgctaagtggtgtggagggagaaggactccataaattagggtatatacttagagacgtgagcaagaaagagggaggagccatgtatgcagacgatactgcagggtgggacacacgcatcactctcgaagacctgaaaaatgaagaaatggtaactaatcatatggaaggggaacacaagaaattagcagaggctatctttaaacttacttaccagaataaagtggttagggttcaacgcccaacaccacgcggtacagtgatggacataatttctcgtagagatcaacgaggaagtggacaagttggaacctacggtttaaatacttttacaaacatggaggcgcaattaattaggcaaatggagggcgaaggagtcttcaaatccattcaacaccttaccgctacagaagagatagcagtacaaaactggctggcaagggttgggagagaacgactgtcgaggatggcgatatctggcgatgactgtgtagtaaagccgctagatgaccgattcgcatcagcactaacagccctaaacgatatgggtaaagttcgcaaggatattcaacagtgggagccgtcaaaaggttggaatgattggacacaggtcccattttgtagtcatcatttccacgaactaataatgaaagatggacgtgtgctagttgtaccctgcagaaatcaggatgaacttatcggcagagctagaataagtcaaggtgctgggtggagtctccgagaaactgcctgtctcggtaaatcgtacgcgcaaatgtggagtctaatgtatttccaccgaagagatcttcgattggccgcgaatgctatatgtagtgccgtgccttcacactgggtccccacaagcaggaccacttggagtatacatgcaaagcatgaatggatgactacagaagacatgctaacagtatggaaccgtgtatggatacaagagaacccctggatggaagacaaaacgccagttgagtcatgggaagagatcccgtacttaggaaaacgggaagaccaatggtgcgggtcactcattgggttgacgagtcgtgcaacatgggctaaaaacatacaaacagcaattaaccaagtcagatcacttatcggcaacgaagaatatacagattatatgccgagtatgaaacgattccgacgagaagaagaagaggccggtgtcctctggtaa

SEQ ID NO: 22175 - RNA, 9876 nt, synthetic construct
  misc_feature 1..9876: note = derived and/or modified CDS sequence (opt6) from DENV-2__JX669476__SS-prME
  source 1..9876: mol_type = other RNA
actgccggggtaatagtaatgctaatacctactgcaatggctttccacctaactacaagaaacggagaacctcacatgattgttggacgtcaagaaaaagggaaatcacttttatttaaaactgaagatggagtcaatatgtgtactttaatggctatagatctaggggaattatgtgaagacacaattacatacaaatgtccattacttcgccaaaatgaacctgaagacatagactgctggtgtaactctacatctacatgggttacatacgggacatgtacaacgacaggtgaacatagacgagagaaacgttccgttgcattagtacctcacgtggggatgggattagagacccgaacggaaacatggatgtcctcagagggggcatggaaacatgtacaaaggatagagacttggatactaagacatccgggattcaccataatggccgcaatattagcttatactattggaacaacacatttccaacgggcattaatcttcattctgctaactgcagttgcgccttctatgaccatgcgttgtatcgggattagcaacagagatttcgttgagggggtatcaggagggtcttgggtagatatagtattagaacacggttcatgcgtcaccactatggctaaaaataaaccaacactggactttgaactaatcaaaacagaagcgaaacagcctgcaacactacgaaaatactgtatagaagcgaaactaacaaacactaccactgaatcacgctgtccaacacagggagaaccttcactgaacgaagaacaggataaaaggtttatatgtaaacacagtatggtcgaccgaggatggggaaatggatgcggattatttggaaaaggtggaattgttacttgcgcaatgtttacatgcaagaaaaatatggagggaaaaatagttcaatcagaaaacttggagtacactatagtaataacaccccactcaggagaagaacacgcagtcggtaacgacacaggaaaacatggtaaagagattaaaattacaccgcaatcgtcgaccacagaagcagagttaacagggtacggaacagttactatggaatgctcacctaggacaggattagattttaacgaaatggtgctgttacaaatggaagacaaagcgtggttagtacatcgccaatggttcttagatttacccttaccatggttgcctggagcagacacgcaaggttctaactggattcaaaaagagacactcgtaacgttcaaaaatccacacgcgaagaaacaagatgttgtggttttagggagtcaggaaggagctatgcatacagcattaacaggggctaccgagattcaaatgtcctcaggtaatttattatttactggccatctcaaatgtagattacggatggacaaactacaattaaaaggaatgtcgtactccatgtgtaccggtaaatttaaaattgttaaagaaatcgccgagacccaacacgggacaatagtaattagggtccaatacgaaggagacggatccccatgtaaaattcctttcgaaataaccgatcttgagaaaagacatgtattgggcagactaatcacagtaaacccaatagtaactgaaaaagattcgcccgtcaatatagaggccgagcctccatttggtgacagctacataatagttggtgtagaacccggtcaattaaaactgaattggttcaagaaaggttctagtataggccaaatgttcgagacgacgatgagaggagcaaaaaggatggctattctaggtgacacagcttgggacttcggtagcttaggtggagtattcacttcgatagggaaagccctgcaccaggtatttggtgcgatctatggggcagcattttcaggtgtatcttggacaatgaaaatattaataggagtcattattacttggataggaatgaactccagatcgacaagtctgagtgtaagtcttgtcctcgttggggtggtcacgttgtacctcggtgcgatggtacaagcagattctggatgcatagtatcatggaaaaataaagaactcaaatgcggaagcggaatatttataacagacaatgttcatacttggactgaacaatataaatttcaacccgaatttccaagcaaattggcaagtgccatacagaaagcacatgaggaaggtatatgtggaatacgatcggtaactagattagaaaacctgatgtggaaacaaatcacacctgaattaaatcatatattatctgaaaatgaggtcaaactaactataatgacaggcgacataaaaggaatcatgcaagccggcaaaaggagccttcgaccccaacctaccgagttaaaatactcttggaaaacatggggaaaagccaaaatgctatctacagaatcacataaccagactttcttgatagacgggcctgaaacagcggaatgccctaacacaaatcgagcctggaactctctcgaagttgaagattacggattcggggtttttacaactaatatatggttaaaattacgagagaaacaagacgtattttgtgatagtaaattaatgtcagcagctattaaagataatcgagcagtacatgcagatatgggatattggattgaaagtgccctaaacgacacttggaaagtagaaaaagcctccttcatagaagtaaaatcctgtcattggccaaaaagccatactttgtggtctaacggagtcctcgaatctgaaatgatcatacccaaaaatttcgcaggtccagtctcacaacataattataggcccggttaccacacacaaacagcaggtccgtggcatctaggcaaactggagatggattttgatttctgtgagggaactaccgttgtagtaacggaagattgtggtaatcggggtccatcactcagaacaacaactgcgtcaggaaaattgattacggaatggtgttgtcgttcgtgcaccttaccacccctccgatatagaggagaagatggttgttggtacgggatggagatccgacctttaaaagaaaaagaggaaaacctagtcaatagcctcgtaacggcaggtcatggtcaaatagataactttagtttaggtgtattaggtatggctctatttctggaagagatgctacgtacacgcgtgggcacgaaacatgcaatcctacttgtggctctatcgtttgtaacattaataacaggaaatatgtcttttagggatttgggaagagtcatggtgatggttggagcaacaatgacagatgatatcgggatgggcgttacttatctggcattacttgcagcctttaaagtacggccaacttttgcggctgggctattgctacgaaaattgacaagcaaagaactgatgatggctaccattggtattgcgcttctatcacaaagtacgcttccagaaactatcctagaattgactgacgcgctggccttaggcatgatggcacttaaaattgtaagaaatatggagaaataccaattagcagtcacaatcatggctataagctgcgtacctaatgcagttatcttacaaaacgcgtggaaagtatcgtgtaccattctcgctgcagtttctgtttcacccctcttattaacaagcagccagcagaaaactgattggatacctcttgccttaacaattaaaggactaaatcccacggcaatcttcctgaccacattatcacgaacaagtaagaaaaggagctggccattgaacgaagctattatggctgttgggatggtatccattctggctagctctttgcttaaaaatgacatacccatgacaggacctctagtagcgggtggtttactaaccgtatgttacgtcctcacaggaaggagtgcagacctagagttggaacgggcagcagatgtcaagtgggaagaccaagcagaaatcagcggatcatcaccaatactatccataacaattagtgaagatggttctatgtcaatcaaaaatgaagaagaagaacaaactttaacgatattaataagaacgggcctattagtgatctccggcgttttcccagtcagtattcccattacagctgctgcttggtacttatgggaagtgaagaaacaacgtgccggcgtactgtgggacgtacccagtccaccaccggtagagaaagctgagctcgaagatggagcatataggattaagcaaagaggaattttgggttactcacaaattggggctggagtctacaaagaagggacatttcatacaatgtggcatgtgactcggggagctgtgttgatgcaccggggtaagaggattgaaccatcatgggcggatgttaagaaagaccttatatcatacgggggagggtggaagctagaaggagaatggaaagaaggtgaggaagttcaggtcctcgctctggaaccgggcaaaaacccaagagccgtacaaacaaaacccggtatatttaaaactaacactggcaccatcggtgcagtatcactcgatttctcacctggaaccagcggctctccaatagttgaccggaaagggaaagtagtaggactatacggtaatggagtagtaacgaggagtggggcgtatgtttctgctattgcacaaacagaaaaatccatcgaagataatccagaaatagaggatgatattttccgcaagaaacgccttacaatcatggacttacatccaggagcaggcaagacaaagaggtaccttcccgcaatagtccgggaagcaatcaaacgaggattaagaaccctcatcttggctcccactcgggtagtagccgctgaaatggaagaagcattaagaggcttaccgattcgctaccaaacaccggcaatacgagcagagcatacgggacgagagatagtagatcttatgtgccatgctacattcacaatgaggctactaagcccggtccgagttccgaattacaatttaataataatggacgaggctcattttactgaccccgcaagtattgcggcccgaggttatatttccacccgagtggaaatgggggaagcagctggtatctttatgactgctacaccccctggcagcagggatccatttcctcaatcgaacgctcctattatggatgaagaaagagaaataccagaaagatcatggaactccgggcacgaatgggtaacagacttcaaaggtaaaaccgtctggttcgtcccatcaataaaagcaggtaatgatatcgcagcctgcttacggaaaaacggtaagaaagtgattcagctgtcaagaaagacatttgattctgaatatgtaaaaacacgagcgaatgactgggatttcgtagtaactactgatatatcggagatgggagccaattttaaggcggaaagagtaatagatcctagacgttgcatgaaaccagtaatcctcacagacggagaagaacgagtgatactggccggacccatgccagtgactcactcaagtgcagcacaacgtaggggaagaataggaagaaaccctaaaaatgaaaatgaccaatatatttatatgggcgaaccgctagaaaatgacgaggattgcgcacattggaaagaagctaaaatgttactagataacatcaatactccagaaggtattataccaagcatgttcgaaccggaacgtgagaaagttgatgcgatcgacggggaatatcggcttcgaggtgaagctcggaagacatttgtcgatctcatgagacggggcgatcttcccgtttggttggcatataaggtagcggccgagggtataaactacgcggatcgcaaatggtgctttgatggtatcaaaaacaatcaaatactcgaggaaaacgtagaagtggagatatggacgaaagaaggtgagcgcaagaaattgaaaccacgatggttagatgctcgaatttacagtgatccgctagcgttaaaggaatttaaggagttcgctgcaggacggaaaagtctaactttaaatttgataactgaaatggggcgcctaccgacattcatgactcaaaaggcccgtaacgctctagataatttggcagtcctccatacagccgaggtcggtggacgggcttatacacatgctttgtctgaactgccagaaacgttagaaacattactactgttgacattgttggcagcggtaacaggaggtatatttctattcttaatgagcggtaaaggcataggtaaaatgacgctaggaatgtgctgcataataactgcctcaatcttactatggtacgcacaaattcaaccacattggatagcagcgtcaattatactggaatttttcctaatagttttgctgataccagaaccagagaagcaaagaactccccaagataatcaactcacttatgttgtaatagcaatcctaacagtagtcgcagctacaatggcaaatgaaatgggattcctagagaagactaagaaagacctaggcttcggtagtatcactacccaagagtctgaaagtaatatcctagatattgacctgaggcccgcatcagcatggactctttacgcagtagcaacaacttttgttacgcctatgcttcggcactctatcgaaaatagtagcgtaaacgtgtcattgacagccatcgcaaaccaagcgacggtactaatgggattagggaaaggatggccactgtcgaaaatggacattggagtccccttacttgcaatcggatgttatagtcaagtaaatccaataacgctgacagccgcactactactattagttgcccattacgctattataggaccaggtttacaggctaaagccacaagggaagcacaaaagagggcagccgctggcataatgaagaaccctacggtcgatggcataactgttattgatcttgagcccattccatacgatcccaaatttgaaaaacagttaggccaggtaatgttattaatattatgtgtaactcaagtactaatgatgagaactacctgggccctatgcgaagcacttacactcgccacaggaccaatatccacactgtgggaaggcaaccctggaagattttggaacacaacaatcgctgtatcaatggcaaatatctttaggggatcatatctggcaggggcgggtcttctatttagtataatgaaaaatacaacgaatacaagaagaggtaccggtaacgtgggagagacgcttggtgaaaagtggaaaagccgtttaaacgccctagggaaaagcgagttccaaatttacaaaaagtcaggcatacaagaagtagatcgaacgcttgctaaagaaggcattaaacgaggtgagaccgatcaccatgccgtaagtcgtggtagcgcaaaattaagatggtttgttgaacgtaacatggttacgccagaagggaaagtagtagatttggggtgcggaaggggcggttggagttattactgcggcggcctgaaaaatgtccgggaagtgaaaggcttaactaaaggtggaccgggtcatgaagaaccgattccaatgagtacttatgggtggaacctagttagactccaatcaggcgtagatgtcttctttacaccgccagaaaaatgcgacacgttgttatgtgatattggagaaagttcgccaaatccaaccatagaggcaggtagaactctacgggttttgaacctagtggaaaattggctcaacaataatacacaattttgcattaaagttctcaatccatacatgccttcagttattgagaaaatggagacacttcaacgtaaatacggaggtgctcttgtccgtaatccattaagtaggaactcaacacacgaaatgtattgggtctcaaatgctaccggtaatattgtctcatcggtaaatatgatatctcgcatgcttattaatagatttacgatgaaacacaagaaagcaacatatgagcccgatgttgaccttgggagcggcactcgtaacatcggaatagaaagtgaaattcccaatctagacatcattggaaaacgtatagaaaagataaaacaagaacacgagatttcatggcattatgaccaagatcacccctacaaaacttgggcctaccacggatcttacgaaacaaagcaaacggggagtgctagtagtatggtcaacggcgttgtacgcctgttgaccaagccatgggatgtagttcctatggtgacacaaatggcaatgacagatacgacgccctttgggcaacaacgggtgttcaaagaaaaggtagacacccgaacgcaggaacctaaggaaggtactaagaaattaatgaaaataacagcggaatggctgtggaaggaattgggtaaggagaaaactccacggatgtgtacgagagaagaatttaccagaaaagtacgaagtaacgcagcgttaggagctgtgttcaccgacgaaaataagtggaagtctgcaagggaggcggtcgaggacgaccgattttgggaactggtggatagagaacgaaatttacatctagaaggaaaatgcgaaacatgtgtatataacatgatgggtaagcgagagaagaaattaggcgagttcggaaaagcaaaaggatcgagggcgatctggtacatgtggttgggggcacgattcctagagttcgaggcattaggctttttaaatgaagatcattggttcagtaggggaaattccctaagtggagtggaaggagaaggtctgcataggttgggttacattttgagggaagtaggtaagaaagagggaggtgcaatgtatgccgacgacacggcagggtgggatacccgtataacactcgaagacttgaagaatgaagaaatggtgactaatcatatgaagggggagcataagaaactagctgaggcaatattcaaactcacatatcaaaataaagtagtacgagtccagaggccaacacccagaggaactgttatggacataattagtaggaaagaccaaagagggtcaggacaagtagggacatatggtttaaatacttttacaaatatggaggctcaattaatcagacagatggaaggagaaggtatattcaagagtatccaacatttgactgcaacagaagaaatagcggtacaaaactggttagcacgtgtaggaagagagagactgtcaagaatggcaatcagtggagatgattgcgtagtaaaaccgatagatgaccgattcgcaagcgctctaaccgcattaaacgacatgggtaaagtaaggaaggatatacaacagtgggaaccatcacgcggctggaatgactggacacaagttccattctgttcacatcacttccacgaattggtaatgaaagatgggagagtcttagtagtaccatgtagaaatcaagacgagctgattggcagagcaaggatatcgcagggtgctggttggagcctaaaggaaaccgcatgtttaggtaaaagttacgcccagatgtggacactaatgtatttccaccgacgagatttaaggttagccgcgaacgcgatatgttcggcagtaccaagtcattgggtacccacaagtagaaccacatggagtattcatgcaaagcatgagtggatgacgacagaagacatgcttacagtctggaaccgtgtatggatacaagaaaatccttggatggaagataaaacgcccgtggaaagttgggaagaagtgccttatctaggcaaaagggaagaccaatggtgcgggtcgctaattggtttgacttcaagagcgacttgggccaaaaacatacaaacagcaatcaaccaggtaaggtctttaatagggaatgagggatacactgattacatgccctctatgaagcgattcagaagagaagaagaagaggctggagttctttggtaa

SEQ ID NO: 22176 - RNA, 9876 nt, synthetic construct
  misc_feature 1..9876: note = derived and/or modified CDS sequence (opt6) from DENV-2__JX475906__SS-prME
  source 1..9876: mol_type = other RNA
acagttgggatgataattatgctaattccaacggcgatggcatttcatcttacgacccgtaacggagaaccacacatgatagttagcaggcaagaaaaaggaaaaagtttgctgttcaaaaccgaagacggggtaaacatgtgtaccttgatggcaatggatcttggcgaattatgtgaagataccgttacatacaactgtcccttactgagacaaaatgaaccagaagatatagattgttggtgtaatagcacaagtacttgggtaacatatggaacctgtacggcaaccggagaacatcgaagggagaaacgaagcgttgcattagtacctcacgtgggaatggggttagaaacacggaccgaaacgtggatgtcgtccgaaggtgcttggaaacatgcgcaaagaattgaaacttggatattaaggcatccggggttcaccatcatggctgcaatattggcatacacaataggcacaacgtacttccaaagagtattaatcttcatcctattaactgcagtggctccttctatgaccatgcgttgcattggaatatcaaatagagactttgtcgaaggcgtaagtggtggatcctgggtagatatcgtattggaacacgggagttgcgtaacaacaatggccaaaaataaacccactcttgatttcgaactcataaagaccgaagcaaaacaaccagccactcttagaaaatattgtattgaagctaaactaacaaacactacaacagcaagtagatgtccaacacaaggagaaccatcacttaatgaagaacaagacaagcgatttgtatgtaaacactcaatggtagatagaggttggggtaatgggtgcggactattcgggaaaggaggtatagtaacatgcgcgatgtttacctgcaagaaaaatatggagggcaaaatagtacaaccggaaaacttagaatatacaatcgtaatcactcctcattcaggggaagaaaacgcggtcggtaatgatacgggaaaacacggaaaagaagtaaaagtaacaccacaaagtagtattacagaagctgaactcacagggtatggaacggtaacaatggaatgcagtccaagaacgggacttgattttaacgaaatggtactattgcagatggaaaataaagcatggctagtacatagacagtggtttcttgacttaccactaccctggctgcctggagctgatacgcagggctctaattggatccaaaaagaaactttagtaacattcaaaaatccacacgccaagaaacaagatgttgtagtactcggttcccaagagggggctatgcatacagcattaacaggtgccactgagatacaaatgagctctggaaatctcctttttacaggtcacctcaaatgtcgtctgagaatggataaactgcaattaaaagggatgtcttatagcatgtgcactggtaaatttaaagtggtaaaagagatcgcagaaactcaacacgggacgatagtgatacgcgtgcaatacgaaggggatggttctccctgtaaaatacctttcgaaataatggatcttgagaaaagacatgtattagggaggctaataacagtaaatccaatagttacagaaaaggatagccccgttaatatcgaagccgaaccccctttcggcgatagctatattattataggtgtggaaccagggcaattaaagctgtcatggtttaagaaaggaagtagtataggtcaaatgtttgagaccacaatgaggggagcaaagagaatggctatactaggtgacactgcgtgggacttcggatcattaggaggggtctttacatcaattggcaaagcactacatcaagtattcggtgcaatatacggagcggcattcagtggtgttagctggactatgaaaatattaataggagtagttataacctggatcggaatgaatagtagatcaacatcactaagcgtttcattagtgctagtaggcgttgtcacattgtaccttggagtcatggttcaagccgactcgggatgtgtagtatcttggaaaaacaaagaattaaagtgtggttctggaatttttataactgataatgtacatacttggaccgaacagtataagtttcaaccggaaagtccttccaaacttgcgtcggcaattcaaaaagcacatgaagagggaatatgtgggataagatctgtaactcgcttggaaaacctaatgtggaaacaaattacacctgaattaaaccacatcctcagcgagaacgaggtcaaactaacaataatgaccggtgacattaaaggaattatgcaagcaggaaaaagatcgctgagacctcaaccgaccgaattaaaatatagttggaagacttgggggaaagcgaaaatgctatcgacagaaccccataatcagacctttctcattgatggacctgaaacagcagaatgtccaaataccaacagggcatggaactcactggaagtagaagattacggttttggtgttttcacaactaacatctggttaaaattaaaagagagacaagatgttttctgcgacagcaaactcatgagtgctgccataaaggacaatcgcgcggtacatgcagacatgggatattggatagaaagtgcgctcaacgacacatggaaaatagaaaaagccagcttcatagaagtgaaatcatgccattggccaaaatctcataccttatggtcaaatggggtccttgaatcggaaatgattatcccaaagaactttgcaggaccggtatcacagcataattatcgaccagggtatcacacgcaaacagctgggccttggcatcttgggaaactcgagatggactttgacttctgtgaaggaacaactgtcgtagtgacagaagactgcggcaaccgagggccctccttgcgtaccacaacagcaagcgggaagttaataaccgaatggtgctgtcgttcatgcacgctacctccgcttcgatataggggagaagacggctgttggtacggcatggagataagaccactcaaagaaaaggaagagaacttagtaaacagtctggtcaccgccggacacggtcagatagacaacttctccctaggtgtattaggaatggcgcttttcttagaagaaatgcttaggacaagagtaggaactaagcatgcattactactcgtagcagtaagtttcatgactttgataacaggcaatatgtcctttcgagacttaggccgtgttatggttatggtaggagcagcaatgacagatgacattggaatgggggttacttatttagcattactagcagcatttaaagtaagacccacattcgcagcaggattgcttcttcggaagctcacttctaaagagctgatgatgacaactattggaatagttctacttagtcagtccacaataccggaaaccatacttgagctaacagacgcactagctttaggtatgatgatattaaagattgtgcgaaacatggaaaaataccaactagctgtcactatcatggctatactgtgtgttcccaacgctgtgattctacaaaatgcatggaaagtttcctgtacaattcttgctgttgtatcggtatctcccctactgttgacttcttcacgtcaaaaagcagactggatacctttagctctgacgatcaaagggctaaatccaacagcaatattcctcacaacactatcaaggacaaacaagaagagatcttggcccctaaacgaggcaataatggcggttggcatggtcagtatcctcgcatcgagtctactgaaaaatgatataccgatgacaggaccattagttgctggcgggttactgactgtgtgctacgtacttacaggtcgatcagcagatctcgaattggaacgagccgccgacgtacgctgggaagaccaagcagaaattagcggctccagccctatattgagtattactataagtgaagacggaagtatgagtattaaaaacgaagaagaagaacaaacgcttacaatcctcatcagaactggattgttagtcattagcggcctttttccggtatctatccccattacagcagcggcatggtacctgtgggaagtcaagaaacaaagggcaggagttctgtgggatgtaccctcaccccctcctgtgggaaaagcagaattagaagatggagcttatagaatcaagcaaaagggaatacttggatactctcagattggtgcaggagtttataaagaaggaacctttcatacaatgtggcatgtcacaagaggcgctgtgttgatgcataaaggaaagaggattgagccctcttgggcggatgttagaaaggacctcatctcgtatggagggggttggaagctagaaggagaatggaaagaaggtgaagaagttcaggtgctagcattagagccaggcaaaaatcctagagcagtacagacaaaacctggattgtttaaaacaaatacaggtactataggggctgtatcactcgactttagcccgggaacaagcgggtcacctatagtcgacaagaaaggaaaagtagttggtttgtacggaaatggagttgtcacgcgtagtggtacatacgtttccgcaatagcccaagcggagaaaagcatagaagacaatccagagatcgaagatgacatttttagaaaaagaagactgacgatcatggacctacatcctggagcggggaagactaagcgatatttacccgctatcgttagggaagcaatcaaaagaggactgcgaactctgatattagcaccaactagagtagttgccgcagaaatggaagaagctctaagaggattgcctattcgatatcaaacccccgccattcgagctgaacataccggaagagagatagtagacctcatgtgtcatgcaacttttacgatgcgcttactaagcccggtcagagtcccaaattataatctcataataatggatgaagcgcactttacagacccggctagtatcgcagcacgggggtatatctcaacgagggtagaaatgggtgaagctgcgggcatattcatgaccgctactccacctggaagtagggatcctttcccgcagagtaatgcaccaatcatggatgaagagagagaaataccagagagaagttggaatagcggtcatgaatgggttacagattttaaaggaaaaacagtatggtttgtcccatctattaaagccggtaatgatatagcggcctgcttgaggaagaatggcaagaaggtcatacagttgtccaggaaaacgtttgattcagagtacataaagaccaggaccaacgactgggactttgtagtaacaactgatattagtgaaatgggtgcgaattttaaagcagaaagagttattgaccccagaaggtgtatgaagccagtgatcttaacagacggtgaagaacgtgtaatacttgcaggacccatgcccgtgacgcattctagcgcagcacagaggaggggaagaattgggcgtaatccaaagaatgaaaatgaccaatatatatatatgggagaaccccttgaaaatgatgaagattgtgcacactggaaagaagccaaaatgcttcttgataatatcaatacacctgaaggaatcatacccagcatgttcgaacctgagcgagaaaaggtcgacgctatagatggcgaatacaggttacgaggagaggcaagaaagacattcgttgacttaatgagacgaggtgacttgccggtctggttagcatatagggttgcagctgaaggaataaattacgcagaccgaagatggtgcttcgacggggtgaagaataatcaaatcttagaagaaaatgtagaggtagaaatatggacaaaagaaggagaaagaaagaaattaaagcctagatggcttgatgcacgaatttactctgacccgttggcccttaaggagttcaaggaatttgcagcaggaagaaaaagtctaacgttaaatttaattaccgaaatgggaaggttaccgacttttatgacacaaaaagcacgaaacgcattggacaatctagccgttcttcatacagcagaagcagggggtagagcttataaccatgctctttcagaactacctgaaacactagaaacactcttattactaactttattagcaacagttacgggtggaatatttttatttctaatgtccggaaagggcattgggaaaatgacgctaggaatgtgctgcatcataaccgcctcaattcttttgtggtatgcacaaatacaaccgcattggattgctgcgagtatcatactggagttcttcttgatagttcttcttatccctgaacctgaaaagcaaagaacaccccaagacaaccagttgacttatgtcgtcatagcaatattaacagtcgtagctgccaccatggcaaatgaaatgggtttcctagagaaaacaaagaaagattttggacttggttccatagccacccagcaaccagaatcgaacatcttagatatcgacctaagaccggcctctgcatggacgctgtatgcggttgctactacttttatcacgccaatgttacgtcattcaatagaaaatagttcagtcaatgtatctctcactgccatagcgaatcaggcgacagtactaatgggtcttggaaaaggctggcccctatcaaaaatggatataggagtacctttacttgctataggatgctattcacaagtcaatcccatcactttaacagcagccttactattactcgtggctcattatgcgataataggaccaggtttacaagctaaagcaacaagggaagcacagaaaagagcagctgctggtattatgaaaaaccctacagtagatgggataacagtcatagacctggatccaataccgtacgacccaaaattcgaaaaacaacttgggcaagtgatgttacttgtattatgcgtgactcaagtcttgatgatgagaaccacatgggcgttatgtgaagccttgacattggcaacaggacctattagtacgttgtgggagggtaatccggggagattctggaatactacgattgcggtttcaatggctaacatattcagaggctcatatcttgctggtgcagggttactcttttcaattatgaagaacactacaaatactagaagaggtaccggaaatacaggagaaacactaggcgaaaaatggaaaaatagattgaatgcattgggcaaaagcgaatttcaaatttataaaaagtccggtatccaagaagtagatagaacgctcgcgaaagaaggaataaaaagaggcgagactgatcaccacgccgtcagtcgcggtagtgcaaaattacgttggtttgtagaaagaaacctggtaacacccgaaggtaaagtagtggatctaggctgtggaaggggaggctggtcatactattgcggaggactaaagaatgtaagagaggtaaaaggattaacgaaaggcggacctggacacgaagaacctattccaatgtcaacatacggatggaacctggtcagactgcaaagcggtgtggatgtgttctttaccccacctgaaaaatgcgacaccttattatgtgacataggagaatcatctcctaatcccactgtagaagcgggaagaacactccgggtattgaatttagtagaaaactggttaaataataatactcaattctgcattaaggtcctgaatccttacatgccaagcgttattgagaaaatggaagcattgcaaagaaaatatgggggagccttagtacggaacccgttgtcacgaaacagcacacatgaaatgtactgggtatcaaacgcttcgggaaacatagtctcatcagtcaacatgattagtcgaatgctaatcaatcggtttacgatgcgacacaagaaagccacctacgaacccgacgttgaccttggatcgggaacacgaaatatcgggatagaaagtgaaaccccaaatctagatattataggaaaaagaatagagaaaataaaacaagaacacgaaaccagttggcattacgaccaggatcacccctataaaacatgggcgtaccacggatcatacgaaactaagcagacaggttcggcatctagtatggtaaacggagtagtccgtctattgacaaaaccctgggacgttattcctatggtaacgcaaatggctatgacagacactacaccgttcgggcaacaaagagtattcaaagaaaaagtggatacacgaacacaggaaccaaaagaaggtactaagaaattaatgaaaattactgcggaatggctttggaaagagttgggaaagaagaaaactccgagaatgtgcacacgggaggaatttacaaggaaagttagaagtaatgccgctttaggagccatctttaccgacgaaaacaaatggaaatcagcaagagaagcagttgaagactctagattctgggaacttgtagataaggagagaaaccttcatcttgaagggaaatgtgagacctgtgtctacaatatgatgggaaagcgtgagaagaaactcggagagttcggaaaagcaaaaggctccagggccatttggtacatgtggcttggagcgcgatttctcgagttcgaagcgctaggatttttgaatgaagaccactggtttagcagagaaaattccttatctggagttgaaggtgaagggttacataaattaggctatatcctaagggacgtttctaagaaggaaggtggagcaatgtatgcagacgacacagcggggtgggacacgaggatcaccttagaagatttgaaaaatgaagaaatggttacaaatcatatggaaggagagcataaaaagctagctgaagctatcttcaaattgacctatcaaaataaggtcgtgcgtgtacagaggccaacaccgcggggaactgtcatggatataatatcacgcagggaccagaggggctctggtcaagtagggacatatggattaaacaccttcacaaacatgggagcgcaattaatcagacagatggagggagaaggtgtttttaaaagtatacaacaccttacagctactgaggaaatagcagtgcaagactggcttgccagagtaggacgtgaacgtctaagccggatggcgattagcggagatgattgcgtagtaaaaccactagatgacagatttgcaagtgcactaaccgcactaaacgatatgggtaaagtacgcaaagatatacaacaatgggaaccaagtagggggtggaatgattggacacaagtacccttttgctcgcatcattttcacgaactgataatgaaagatggcagggtcctagtggtaccctgtagaaatcaagatgagctaataggtagggcaagaatctctcagggtgcaggttggagcttacgagaaaccgcatgtctgggcaagtcatacgcgcaaatgtggtctctgatgtactttcacagaagagacctcaggttagcagctaacgcgatatgctctgcagttccttctcactgggtcccgacttcacgtactacttggagtatacatgcgaaacacgaatggatgacaaccgaagatatgttgacagtctggaacagagtttggatccaggagaatccgtggatggaggacaaaacgcctgttgaatcttgggaggagataccctaccttggtaaacgcgaagatcaatggtgtggttcactcattggccttacgagtagagcgacctgggccaagaatatacaaactgctataaaccaagttaggagtttgataggtaatgaggaatatactgactatatgcccagtatgaaacgttttcgcagagaagaagaagaagctggtgttctgtggtag

SEQ ID NO: 22177 - RNA, 9876 nt, synthetic construct
  misc_feature 1..9876: note = derived and/or modified CDS sequence (opt6) from DENV-2__JX669477__SS-prME
  source 1..9876: mol_type = other RNA
acggctggagtgatcgtaatgctgatacctacggctatggctttccatttgacaactcgcaatggtgaacctcatatgattgtaggacgccaggaaaaaggtaaaagtcttttattcaaaacagaagatggcgtaaatatgtgcacgctgatggcgattgatcttggtgaattatgcgaagatacaataacttataaatgtcctttactaaggcaaaatgaaccggaagacatagattgctggtgcaacagcacctccacttgggtaacatacggaacatgtacaactacaggcgaacatcggcgagaaaaacgttccgttgctttagtgccacacgtaggtatggggttagaaactaggacagaaacttggatgagttcagaaggagcatggaaacacgttcaaaggattgaaacctggattttgcgacatcctggatttaccatcatggcagctatcttggcatacacaataggcaccactcacttccagagggcccttatatttatcctattaaccgcagtagcaccaagcatgacaatgcgatgtataggtatctcaaatcgagacttcgtagaaggagtaagcgggggctcatgggtcgatatagtattagaacatggttcatgtgtaacaacaatggcgaaaaacaaacccacactagatttcgaactcattaaaacagaagcaaaacaacctgcaactctccggaaatactgtatcgaagcgaaattaaccaacacaacgacagaaagtagatgcccaactcaaggcgaaccatcacttaatgaagaacaagataaaagatttatctgcaaacactcaatggtcgatagaggctggggtaatggatgtggactgttcggcaaaggtggtatagtaacctgtgcaatgttcacttgtaaaaagaatatggaaggtaaaatagttcaaccagaaaacttagagtacacaatagtcatcacgccacacagtggagaggaacacgccgtgggcaacgataccggtaaacacggaaaagaaattaaaatcactccccagagcagcacaaccgaagccgaattaacaggatatggtacggtaacaatggagtgctcacctagaacaggcttagattttaacgaaatggttctgctacaaatggaggataaggcatggttggtacaccgacaatggtttttggatttgccattaccgtggctcccaggcgcggatacacagggtagtaattggatacaaaaggaaactttagtaacgttcaagaacccccacgctaagaaacaagacgtagtagtattaggcagccaagaaggagctatgcataccgcattaacgggtgcaacggaaattcagatgagttcagggaatctactattcactggtcacttaaaatgcaggttacgaatggataagttacaattgaaaggtatgtcttattcaatgtgcactggaaaatttaagatcgtaaaagaaatcgctgagacccaacacggtaccattgttataagagttcagtatgaaggagatggctcaccttgcaaaattccttttgagataaccgatctagagaaaagacatgttctgggtagacttataactgtgaatcccatagttaccgagaaggacagtccagtaaatattgaggctgaacccccatttggcgatagttatatcatcgttggtgtagaaccaggtcaattaaaattaaattggtttaaaaagggtagcagtattggtcaaatgttcgaaacaacgatgcgcggtgcaaagcgaatggcaatactaggagatacagcatgggattttggatccctaggtggagtcttcacctcaataggaaaggcgctacatcaagtatttggagctatttacggtgcagcattctcaggtgtaagttggacaatgaagatactaataggagtcataattacttggattggaatgaactcacgtagcacatctctcagcgtatcacttgtattagtgggagtcgttacgctttatctgggagcgatggtacaggccgatagtggttgcatcgttagttggaaaaacaaagaactaaaatgcggaagcggaattttcataactgacaatgtacacacatggacggaacaatacaaatttcaaccagagagtccatcaaaattagctagtgctattcaaaaagcccatgaagaaggaatatgcggcattcgctcagtgacccgtttggaaaatctaatgtggaaacaaatcactccagaattaaaccacattttaagtgaaaatgaagtaaaactaacaataatgacaggggatataaagggcattatgcaagccgggaagcgatccttgcgaccacaacctacagaacttaaatattcatggaaaacatgggggaaggctaagatgctgagcacagaaagtcataatcaaacatttctaatagatggaccagaaactgcagaatgtccaaatacaaaccgagcgtggaactccttagaagtcgaagattatggcttcggagtgtttacaaccaatatatggttaaaactaagagaaaaacaagacgtcttttgtgactctaaattaatgagtgctgcaataaaagacaacagagccgtgcacgcagatatgggatattggatagaatcggctctaaatgatacttggaaaatggaaaaagcctcctttattgaagtgaaaagttgtcattggcctaaaagccacactctgtggagtaatggtgtcctagaatccgagatgatcattcccaaaaattttgctggtcccgtatcccagcataactacagaccaggataccatacacaaacagctggaccatggcaccttgggaaacttgaaatggactttgatttctgcgaaggtacaacggtagtagtaactgaagattgtggaaacagaggtccaagtttgagaacaactacagcctccggtaaactcattacagaatggtgttgtagatcttgtactttgccgccgctccgatataggggagaagacggatgttggtatggcatggaaatacgaccattaaaagaaaaagaagaaaatctagtaaatagccttgtgacagcgggtcatggccaaatagataatttctcactaggagtattgggaatggccttatttctagaagaaatgttgagaacaagagttggaacgaaacatgcgatcttgctagtggcactatcatttgtcactctcattacaggtaacatgtcttttcgggacctcggcagagtaatggttatggtaggagctacgatgactgatgacatcggtatgggtgttacatatctagcgctactcgcggccttcaaagtacgccccacattcgcggctggactcttacttagaaaattaacatccaaggaattaatgatggctacaatagggatcgcattgttaagccaatcgactctgcctgaaaccattctggaactaacagatgcattggccttaggtatgatggctttaaaaatagttcgaaacatggaaaaataccaattggccgtaacaatcatggcgatatcatgtgttcctaacaccgttatccttcagaacgcgtggaaggttagttgtactatattggctgcagtctcagtgtcaccattattattgacgtctagtcaacagaaggcagactggattccattggctcttacaattaagggattgaatcctacggctatcttcctaacaacccttagtcgaacaagtaagaaacgttcatggcctctaaatgaagcgataatggctgtaggaatggtaagcatactagcgtccagtctcctcaaaaatgacatacctatgacaggcccgcttgtggcgggtggattactaactgtttgttatgttctaactggccgtagcgctgatttggagcttgaaagagccgcagacgtaaaatgggaagaccaggcagaaattagcggttccagcccgatattatcaataactattagcgaagatgggagtatgtcaattaagaacgaggaggaagaacaaactctcacgatattaatccggacaggactattggtaatatcaggggtattccccgtgtctataccaataacagcagctgcatggtacttgtgggaagttaaaaagcagagagcaggagtattatgggacgtcccatcaccgccacctgtggggaaagctgaactagaagacggtgcatatagaattaaacaaagaggaattttaggttattcccaaatcggggccggagtttacaaagaaggaacgttccatacaatgtggcatgttacgcgaggggcagttctgatgcatagaggtaagaggattgagccaagttgggccgatgtcaagaaagatttaatctcatatggcggcggttggaaattagaaggtgaatggaaggaaggggaagaagtccaagtacttgctctagagcccggtaaaaatcctcgggctgttcaaactaaaccgggtatctttaaaacaaacactggaacaataggagcagtatctttagatttctctcctgggacatccggatcacctatagttgataggaaaggaaaggttgttggattatatgggaatggagtagtcaccagaagcggggcttatgtatccgcaatcgcgcaaacagaaaagtcgatagaagacaacccggaaatagaagatgatatattccgtaaaaagagactaacaataatggatcttcatcctggagcgggaaaaacaaaaagatatctgcccgcgatcgttagagaagcaattaaaagaggattacgtacactaatcttggcaccaacacgagtagtagctgcagaaatggaggaagccctacgaggtttgcccatacgatatcaaacaccggctataagggccgaacacacaggaagggaaattgtagatttaatgtgtcatgctacattcacaatgaggttattgagcccggtgcgggtccctaattacaatctaatcataatggacgaggcacatttcacagaccctgctagtattgcggcgaggggttacatatcaacaagagttgaaatgggagaggctgcaggcatattcatgacggcaactccacctggttctcgagatccatttccgcaatcgaatgcacctataatggacgaggaacgcgagattcctgaaagaagttggaatagcgggcatgaatgggtaacagactttaaaggaaaaacagtctggtttgtgccctccataaaagcgggaaatgatatcgctgcatgcctaagaaagaatggcaagaaagtcattcaattgagccggaagacctttgactcggagtatgtaaaaacaagagctaacgattgggattttgtagttacgacagatatatccgagatgggtgctaatttcaaggctgaacgtgtaatcgacccaagacgatgtatgaaaccagttatcctaacagatggtgaagaaagggtaatacttgcaggtcctatgcctgttacgcattcaagcgcagcgcaacgccgaggaagaataggccgcaacccaaagaacgagaatgatcaatatatatatatgggagaaccgctagaaaatgatgaagattgtgcacattggaaggaagctaaaatgttattagataacattaacacacctgaaggtataatacctagtatgtttgaaccagaaagagagaaagtggacgcaatagacggggaataccggttaaggggtgaagcgcgcaagacattcgttgatctaatgagaagaggggatcttcctgtttggctggcgtataaggttgcagctgaaggcataaattacgcagatcgtaaatggtgctttgatgggattaaaaataatcaaatattggaagagaatgtggaagttgaaatatggacgaaagaaggagaaagaaagaaattaaaaccgagatggctcgacgctcgaatttattctgacccattggcattaaaagaatttaaagaatttgccgcaggccgaaaaagtttgaccctgaatttaataacagaaatggggagattgccaacctttatgactcaaaaagcgagaaatgcgctcgataacttagcggtgctacacacggcagaggtaggtggaaaagcacatacccacgcactaagtgaacttccagaaaccttagaaacattactcctactgaccctcttagcggccgtgacaggcggaatatttttgtttttaatgtctggaaaaggcataggcaagatgacccttggtatgtgttgtatcattaccgcatcaatattattatggtatgcacaaatccagccacactggatagccgcgtccatcattctggagttctttttgatagtattacttattccagaacctgaaaaacaaagaacgccgcaagacaaccaacttacgtacgtcgtaattgcgatattaaccgtggttgcagcaacaatggcaaatgagatggggttcttggagaaaaccaagaaagacttaggctttggaagtattacaactcaagagtccgaaagcaatattctcgatatagacttaaggccagctagcgcttggacactatatgctgtagcgacaacgtttgtaactcccatgctaagacacagcatagaaaactcatcagttaatgtgtcattaacagcaatagccaaccaagctacagtcttaatgggactgggaaagggatggccgttgagtaaaatggacataggagtgcctttgttggctataggatgctatagtcaagtaaatccaataacacttacagctgctcttttattactcgtggcccactatgcgatcataggacctggcctacaagccaaggcgacaagagaagcacaaaaacgggctgctgcaggcataatgaaaaatcccacggttgatggaatcaccgttatagacttagaaccgataccttatgatccaaagttcgaaaaacaactcggccaggttatgttactcatcctgtgtgtaacgcaggtattaatgatgaggactacatgggcactttgtgaggctttaacactagctacaggcccgattagcactttgtgggaaggaaatcccggccgtttttggaataccactatagccgtctcaatggcgaatattttccggggcagctacttggctggagccggtcttctgttttcgatcatgaaaaatacgactaacacaagaagaggaacaggaaatgtgggtgaaactctcggcgagaaatggaaatcacggttaaacgctttgggcaaatctgagttccaaatctacaaaaagtctggaatacaagaagtggataggacattggctaaagaaggtattaaaagaggagaaacggatcatcatgccgtatcgagagggtccgcaaaactcagatggtttgtggaaagaaacatggtaacacccgaaggtaaagtcgtggatttaggatgcgggaggggtggctggtcatactactgcggaggacttaaaaatgttagagaagtcaaggggctaacaaagggtggtcctggacacgaggaaccgataccaatgagtacatacggttggaacctagttcgcttacagtcaggggtcgatgtgtttttcaccccacctgaaaaatgtgacactttgttatgcgacattggagaatcatcaccaaacccgacaatagaagcaggaaggacattgcgcgtactcaacttagttgaaaattggcttaacaataatacgcaattctgtataaaagtattaaatccatatatgcccagcgtcattgagaaaatggaaacattacaacggaagtacggaggagcgctggtccgtaatccgctatctaggaactcaacccacgagatgtattgggtgagtaacgctactggaaatatagtaagctctgtcaacatgatatcaagaatgctaataaatcggttcacaatgaaacataagaaagcaacttacgaaccagatgtagacttaggttcaggcacgcggaatataggaattgagtccgaaataccaaacttagacattataggaaaacgcatagagaagataaaacaagaacatgaaacatcatggcactacgaccaggaccacccatataaaacctgggcgtatcatggatcatacgaaactaagcaaacaggatcggcctcgtctatggttaacggggtcgtgagattactcactaaaccatgggacgtggtacccatggtaactcagatggcaatgaccgacacaaccccttttggccagcagcgagtatttaaagaaaaggttgatacaagaacgcaagagcctaaagagggtacaaagaaattgatgaaaataacagcagaatggttatggaaagaacttggtaaagagaaaacacctagaatgtgcactagagaagaatttactagaaaagtaagaagcaatgcagcgcttggggccgtgttcactgacgaaaacaaatggaaatccgcacgtgaggcagttgaggatggaagattttgggaactcgttgatcgagaacgaaatttgcatttggaagggaaatgtgaaacctgtgtctataacatgatgggaaaacgagagaagaaactgggtgaatttgggaaagccaaaggatcacgcgccatatggtacatgtggttaggggctaggttcttagagttcgaggcactcggttttctgaatgaagatcactggttttcgcgcgaaaattcattatccggagtagaaggtgaaggactccaccgtctagggtatatacttagagatgtgtcaaagaaagaaggaggagctatgtatgcggacgataccgcgggctgggatacaagaatcacattagaagatctgaaaaatgaggagatggttacgaaccatatgaagggcgaacataagaaattggcagaagcaatattcaaactaacataccaaaacaaagtagtaagggtgcaacgacctacacctcgtggtaccgttatggatataataagtcgaaaagaccagagaggttcaggccaggtgggaacttacggcttaaacacgtttactaatatggaagctcagctgattcgtcaaatggagggagaagggatatttagatctatacaacatcttactgctactgaagaaatagcggttcaaaattggcttgcgcgtgtcggacgcgaaagactatctcgtatggccatttcaggcgatgattgcgttgtaaagccaatagacgatcgattcgcgtcagctttaacggcactaaacgatatgggtaaggttaggaaggacatccaacaatgggaaccatcccgagggtggaacgactggacacaagttccattttgttcacatcacttccacgagttagttatgaaagacggtcgggtcctagtggttccatgccgtaatcaagacgaacttatagggagggctcgtatatcacaaggcgctggatggtcgttaaaggagacagcatgtttaggtaaaagttatgcacaaatgtggactttgatgtatttccatcgtagggatcttaggctagcagctaacgcaatctgttcagcggtaccatcccattgggttcccacttcaagaacaacctggtctatacatgctaaacacgaatggatgacgacagaagatatgctagctgtatggaaccgagtatggatacaggaaaatccatggatggaagataaaacaccagtagaatcatgggaagaagttccatatttagggaaaagggaggaccaatggtgcggcagtctaataggcttaaccagccgtgcgacatgggccaaaaacatccaaaccgccataaatcaagtcagatcgttaataggaaacgaaggatacacagattacatgccatcgatgaaaagattccgaagggaagaagaggaagcgggagtcctttggtga

SEQ ID NO: 22178 - RNA, 9876 nt, synthetic construct
  misc_feature 1..9876: note = derived and/or modified CDS sequence (opt6) from DENV-2__JX669478__SS-prME
  source 1..9876: mol_type = other RNA
acagcgggtgttatagttatgctaattccaaccgcgatggcatttcatctaaccaccagaaacggagaaccacatatgatagtaggaagacaagaaaaaggaaaatccttgttattcaaaacagaagacggtgtcaacatgtgcacacttatggcaatagatttaggagaattatgtgaagatactataacatacaaatgtccattattacgacaaaacgaacctgaagatatcgactgttggtgcaacagtacttctacctgggtaacttacggaacgtgtacaacaacgggggaacatcggagagaaaaacggagtgtggcattagtgccgcacgtcggaatgggactagaaactcgtacagaaacttggatgtcatcagaaggtgcatggaaacacgtacagagaatcgaaacgtggatattacggcatccgggcttcacgatcatggcagcaatcttagcttatacgattggcacaacacacttccagagagctctaatcttcatactactcactgcagtcgcccccagcatgactatgcgctgtattggcatatcaaatcgagatttcgtagagggagtcagtggaggaagctgggtagatattgtccttgaacatggatcttgcgtcactaccatggctaaaaacaaaccgaccctagacttcgaacttataaaaacggaagcaaaacagcctgcaacattaagaaaatactgtatagaagcaaaattgacaaatacaactaccgaatcgcgctgccccacacaaggagaaccctctcttaatgaagaacaggataaacggtttatttgtaaacacagtatggtggatagaggttgggggaatggctgcggactatttggaaaaggcggcatcgtgacgtgtgcgatgtttacttgcaagaaaaatatggaaggtaaaatcgtgcaacccgaaaatttggaatatactattgtgataaccccacatagcggagaagaacatgccgtgggaaatgatacaggaaaacatggtaaagaaataaaaataacgcctcaatcatctacaactgaagctgaactgacgggttatggcactgtgactatggagtgctcacctaggaccggattagattttaatgaaatggttttactacaaatggaagataaagcatggttagtacatagacaatggtttctggatctacctttaccatggctacctggagctgacacacagggttcaaactggatccagaaagaaaccttagttactttcaaaaatccacatgccaagaaacaagatgtcgtagtactcggcagtcaagagggagcaatgcatacagccttaaccggagcgaccgaaattcagatgagtagcggcaacctcctttttacaggacacctcaaatgtaggctaagaatggacaaattgcagttaaaaggaatgtcttattctatgtgcactggcaaattcaaaatcgtaaaagagattgccgaaacacagcatggaacaatagtaatcagagtgcaatacgaaggtgatggatcaccatgcaaaatcccctttgaaataacagatttagagaaaagacacgtcttgggtcgacttataacggtaaaccctatagtaacggaaaaagatagcccagtaaatatcgaggccgaacccccatttggtgacagttacatcattgtcggcgtagagccaggacaactgaaattaaattggttcaagaaaggatcttcaataggtcagatgtttgaaacaactatgaggggagccaaaagaatggctattctgggggataccgcttgggactttggaagtctaggcggtgttttcacaagtatcgggaaagctctgcaccaagttttcggtgcgatttacggggccgcattttcaggagttagctggaccatgaaaattcttataggcgttattatcacgtggattggcatgaactcaagatccacgagcttatccgtaagcctcgtactggtcggagtagtaaccttatacttgggcgcaatggtacaagcggatagcggttgtatagtaagttggaaaaataaagagctaaaatgcggctccggtatattcataacagataatgtccacacgtggacagaacaatacaaatttcaacctgaatctccatccaaactagcgtcagctattcaaaaagcacatgaagaaggaatatgcggaataagatctgtcactaggttagaaaatttaatgtggaaacaaataaccccagaactgaaccacatcttatcagaaaatgaggtgaaactcactataatgactggtgatataaaaggaatcatgcaagcaggaaaacgaagtctaagaccacagccaaccgaattaaagtactcgtggaaaacgtgggggaaagctaaaatgttaagtactgagagtcataatcaaacgtttttaatagacggcccagaaacagcagaatgcccaaacacaaacagggcatggaatagcctcgaagtagaggattacggctttggagtattcactacaaatatatggttaaaattaagggaaaaacaagatgtattttgtgacagtaaactgatgagtgcggcgataaaagataatcgagccgtccacgcagacatggggtattggattgagtccgccttaaacgacacgtggaaaatggagaaggcttcctttatagaggttaagagctgtcattggccaaaaagccacacactgtggtccaacggggtactggaatcagaaatgatcataccaaagaacttcgccgggcctgttagccaacataactacagacctggatatcacacgcaaacagccggtccatggcatttagggaaattagaaatggattttgatttttgcgaaggtactacggttgtagtaactgaagattgtggtaatcgtggaccgtctctcaggacaacgaccgcgtcaggcaaactcataactgagtggtgctgccgctcttgtacacttcccccactaagatatcgaggagaggatgggtgctggtatggaatggaaataagacctcttaaagagaaggaagagaatctagtaaatagcttagtaacagcagggcatggacagatcgataactttagtcttggcgtgctaggtatggcactatttttggaagagatgctacgaacacgtgttggaaccaagcatgcaatcttattagtggctctcagctttgttacgttaatcactggtaacatgtctttccgagatttaggcagggtaatggtgatggtaggagcaacaatgacggacgatattggaatgggagtgacatacctagccttacttgctgccttcaaagtacgcccgacttttgcggccggcttgcttttgcggaagctgacatctaaagagttaatgatggccactatcggcatagccctattaagccagagtacattgcccgaaacaattttggagctcactgacgcgttggccctagggatgatggccttgaagatcgtgagaaatatggaaaaataccagctagctgttacaattatggcaatttcatgtgtacctaacgccgtcatcttgcaaaatgcatggaaagtttcgtgcacgattctagcagccgtgagtgtgtcgccactattattgacctcgtcacagcagaaagctgactggattccactagcgctgacaatcaagggcttgaaccccactgcaatattcctgacaacgctttctaggacttctaagaaacgatcttggccgctaaacgaggcaattatggccgttggaatggtatctatacttgctagctcactactcaaaaatgacatcccaatgactggccccctagtagcgggaggtttattaacagtatgttatgtgctaacggggagaagcgccgatctagagttagaacgcgcggcagacgtcaaatgggaagaccaggcggaaatatcaggaagcagcccaatcttgtccatcacaatttcagaagacggatccatgtcaataaagaacgaagaggaagaacaaaccctaacaatattaattagaacaggactattagtaatatcaggggtattcccagttagtataccaattacagctgccgcgtggtatttatgggaagttaagaaacaaagagctggggtcttgtgggatgtgccatccccgcctcccgttggtaaagcggaattagaagatggggcatatcgcataaaacagagaggcatttttggatacagtcagattggggcaggagtttataaagagggaacgtttcatactatgtggcatgtcacgaggggtgccgttttgatgcatagagggaaaaggatagagccatcctgggcggacgttaagaaagacttaatctcttatggagggggatggaaactagaaggcgagtggaaagagggtgaagaggtacaagtattagcacttgaacctggcaaaaatccacgagcagtacaaaccaagccaggtattttcaaaacaaataccggaaccattggtgctgtctctctcgattttagcccgggcacaagcggatcgccgatcgttgatcgaaaaggaaaagtggtcggactttatggtaacggggtagtaacaagatcaggcgcttatgttagtgcaatagctcaaactgagaaaagtatagaagacaatccggaaattgaggatgacatatttaggaagaaaaggttaacaataatggatcttcaccccggtgccggaaaaacaaaacgctacctccctgcgatcgtccgagaagcaataaaacgaggtttaaggacgttaattctagcacccacacgcgtagtagcagctgaaatggaagaagcattacgaggacttcctattaggtatcagacgcccgccatacgcgcggagcataccgggagagagatagtcgatttaatgtgtcatgcgacttttactatgagactactaagccccgtcagagtccctaactataaccttattatcatggacgaagctcacttcaccgatccagccagtatagcagcgcggggttacatcagcacacgagtggaaatgggagaggcagcgggaatctttatgacagctacaccaccaggatcacgcgacccatttccccaatcaaatgcgccaatcatggatgaggaacgtgaaatacccgaaaggagttggaactcaggtcacgaatgggtaacggactttaaaggaaaaacggtctggtttgtcccaagcataaaggcaggaaatgacattgcggcttgtctaaggaaaaatggaaagaaagtcatacagctatcacgcaaaacttttgacagcgaatatgtaaaaacgagggcgaatgactgggattttgtggtaacgacagatatatcggaaatgggagctaattttaaagctgaacgggttatagatccaagacgctgcatgaaacccgttatcctaacggacggagaagaaagagttatcctagcaggccccatgccagttacgcattcatctgctgcacaacgtcgaggtaggattgggagaaatcccaaaaatgaaaatgatcagtatatatacatgggagaacctctagaaaatgacgaagattgcgcacattggaaggaagccaagatgttactcgacaatataaacacacctgaagggatcataccctcaatgttcgaacccgaaagagaaaaagtagatgccatagacggtgagtacagattaagaggcgaagcacgcaaaacttttgttgatttaatgcgacgcggggatctgccagtttggcttgcttacaaggttgccgcggaaggcataaactatgcagaccgaaaatggtgtttcgatggtatcaaaaataatcagatactggaagaaaatgtagaggttgaaatatggacaaaggaaggtgaaaggaagaaactaaagccgcggtggttagatgcaaggatatactcagatccgttggcattaaaagaatttaaggaatttgcagcaggaaggaaaagtttaactttgaatctaataacagaaatgggaagacttcctacattcatgacgcaaaaagcacggaatgctcttgacaatttggcagtgttacacacggcagaagtaggtggaaaggcttatacacacgcattaagcgaattaccggagacactagaaacacttctactcctaacactacttgctgcagtaacaggtggtatctttctatttttaatgtctgggaaaggcattggtaaaatgactttaggcatgtgctgtattataacagcgtctatattattatggtacgctcagatccagccgcactggatagccgcttcaataatattggagttctttctaattgttctattgataccagaaccggaaaaacaacgtacgccccaagacaaccagctaacctacgtcgtcatagcaatattgaccgtcgtggcagcgacgatggcaaatgaaatgggattcttagagaaaacgaagaaagacttgggcttcggctcaataactactcaagaaagtgaaagtaacatcttagacatagatctccgaccagctagcgcgtggacactctacgcagtggctaccacgttcgtaactcctatgctcagacatagtatagaaaatagcagcgttaacgttagtctaaccgctatagccaaccaagctactgtactcatgggactaggcaaaggttggccattaagtaagatggatataggagtcccattactagcaataggatgttattctcaagttaatcccattacactaacagcagctctgttacttcttgttgcacattacgcgataatagggccaggtttacaagccaaagcaacaagagaggcccagaaacgagcggctgcaggaataatgaagaatccaacggtagatggaataacagtaatagatctagaaccaataccctacgaccctaaattcgagaaacaattgggacaagtaatgctattgatactgtgcgttacacaagtccttatgatgagaacgacgtgggctttatgtgaagcgcttacattagccacaggaccgatttcgacattatgggaaggaaaccccggaaggttttggaacacgactatcgcggttagtatggctaacatcttccgaggatcttatttagccggcgccggtttgctattttcaattatgaagaacaccactaacactcgccgcggaacagggaacgtgggcgaaacattaggagaaaagtggaaaagcaggcttaacgcccttgggaaaagcgaatttcaaatatataagaaatctggcatacaggaggtagacagaaccctcgcaaaagaaggaataaaaaggggtgaaacagaccatcatgcggtatccagggggtcggccaaactacgctggtttgtggaacgcaatatggttacaccagagggaaaagtcgtcgatcttggttgtgggagagggggttggtcatattattgtggaggattaaagaacgttagggaggtaaaagggttaactaagggaggtcctgggcatgaagaaccaattcctatgtcaacctacggatggaatctagtgagactacagagcggagttgacgtattctttacaccgccagaaaagtgtgatacacttctgtgtgacataggcgagagttcaccgaatcctacgatagaagctggcagaaccttaagagttttgaacttagtagaaaactggttaaacaataacactcaattttgtataaaggtattaaacccctatatgccttcagtaattgagaaaatggaaacccttcaaaggaagtatggaggagctttggttagaaaccctttatcacgaaattcaacacatgaaatgtattgggttagcaatgcaacgggaaacatagtaagcagcgttaatatgataagccggatgctcataaatcgatttaccatgaaacataagaaagccacatacgaaccggatgttgatttaggttctggcacgagaaatataggtatagaatcagaaataccaaatctggacataattgggaaaaggattgagaaaattaaacaggagcatgaaacaagctggcattacgatcaagaccatccctataagacatgggcatatcatggctcatacgaaactaaacaaactggtagcgcgtcatcaatggtgaatggagttgtacgcctgcttactaagccttgggatgtaattccaatggtgactcaaatggcaatgactgatacaacaccatttgggcaacagagagtattcaaagagaaggtcgatactagaacgcaagaacctaaagaaggtactaagaaattaatgaaaattaccgccgagtggctttggaaagaattaggcaaagagaagacacctaggatgtgtacaagggaagagttcacgcgaaaagtacgtagcaacgctgcattaggagccgtttttacagatgaaaataaatggaagagtgcaagggaagccgttgaagacgggagattttgggagttggtggatcgtgaaagaaacttacatttagaaggaaagtgcgagacatgtgtgtacaacatgatgggcaaacgagagaaaaagctaggagaatttggtaaagcgaaaggtagccgtgctatttggtacatgtggctgggagcgcgcttcttagagttcgaagccctcggcttcctaaatgaagatcattggttctctcgcggtaactcactcagtggagtcgaaggcgaaggtctacacagactaggatacatattacgagaggtaggcaagaaagaaggcggagctatgtatgctgatgacacagcaggatgggatacaagaataactttagaggatctcaaaaatgaagagatggtaacaaatcatatgaagggagaacacaagaaattagctgaagcaatattcaagttaacttaccagaacaaagttgtgcgagtacaaaggcctacaccgcgcggtacagttatggacatcatatcaaggaaagatcaaagaggatcaggccaagttggaacgtacggactaaatacttttacaaatatggaagctcaactcataagacaaatggaaggagaaggtattttcaaaagcattcaacatctcacagcaaccgaggagatagcagtgcaaaattggcttgctagagtaggaagagaacggttaagcagaatggctatttcgggcgacgattgcgtggtaaaaccaatcgatgacagattcgcgtctgctctgacagcattaaatgacatgggaaaggttcgtaaagacatccaacaatgggaaccatctagaggatggaacgattggacacaagtgcctttttgcagtcaccattttcacgagctagtaatgaaagacgggcgcgtcctagtcgtaccgtgtagaaatcaagacgagttaatagggagagctagaataagtcaaggggcgggttggtcgttaaaagagaccgcgtgcttaggaaagtcttacgcccaaatgtggacactgatgtattttcaccgcagggatttgcggttagcggcaaacgctatttgctcagccgtaccttcacattgggtgccaacctcccgtacaacttggtctatacacgcaaagcacgagtggatgacaacagaagatatgttagcagtttggaaccgcgtatggatacaagagaacccatggatggaagataaaactccagttgaatcctgggaagaagtaccctatctaggcaaacgagaggaccaatggtgtggaagtttgataggcttaacttcacgggctacttgggctaaaaacattcaaacagctatcaatcaggtacgttcattaattggtaatgaaggatatatcgactatatgccttcaatgaaacgattcaggagagaagaagaagaagcgggcgtgttatggtaa

SEQ ID NO: 22179 - RNA, 9876 nt, synthetic construct
  misc_feature 1..9876: note = derived and/or modified CDS sequence (opt6) from DENV-2__JX669480__SS-prME
  source 1..9876: mol_type = other RNA
actgctggagttattattatgcttattcccactgcgatggcatttcatctgaccacccgtaatggtgaacctcatatgatagttggaaggcaagaaaaaggtaaatctctcctgtttaaaacggaagacggtgtaaacatgtgcacactgatggccattgatctgggcgaactgtgtgaagataccattacgtacaaatgccctttattgaggcaaaatgaaccagaagacatagattgttggtgcaattccacgtcaacctgggtaacctatggaacatgcacgactactggcgaacatagaagggagaaaagaagtgtcgccttggtaccgcatgtaggaatggggctcgaaacaagaacagaaacatggatgtcaagcgaaggcgcttggaaacatgtccaaaggattgagacatggattcttaggcacccaggatttgctataatggcagcaatattagcatatacaatcggaaccactcacttccaacgcgcccttatatttattcttctcacagcagtcgctccttctatgactatgagatgtataggaatttcaaatagggatttcgtggaaggcgtatcgggaggaagttgggtcgatatagtcttagagcatggctcatgtgtaacaacgatggcgaaaaataaaccaacattagactttgaattaataaaaacggaggccaaacaaccagcaacacttagaaaatattgtatagaagctaaactaaccaacacaacaactgaaagtcgttgtccaacccaaggtgaacctagtttaaatgaagaacaagataaaagattcatttgcaaacatagtatggtggacagaggttggggaaatgggtgtggacttttcggaaaaggagggatagtaacgtgcgcaatgttcacatgcaagaaaaacatggaagggaaagtggtccttccggaaaacttagaatacaccattgttataacaccacacagcggagaggaacatgccgtaggtaacgacacaggaaaacacggggaagaaataaaaataacaccgcaaagttcgatcactgaagcggaattgaccggttatggtacagttacaatggaatgttcgcctagaacaggactagattttaacgaaatggtgttgctacagatggaggaaaaagcctggttggtacaccgccaatggtttctggacctccccctgccttggctcccgggagccgatactcaaggaagtaattggatacagaaagaaactttagtaacatttaaaaatccccatgctaagaaacaagatgtagtcgtgcttgggagccaagaaggagcaatgcatacagcactaacaggagcgactgaaatacagatgagctcgggaaatctactcttcactggacatctgaaatgtcgattgcgaatggataaactgcagctaaaaggaatgtcttactctatgtgtacgggtaaatttaagatagtaaaagagattgcggaaactcaacatgggacgatagtaatccgtgttcaatacgaaggagacggtagcccatgcaagataccattcgagataatggatttagagaaaagacatgtattaggacgactaatcaccgtaaacccaattgtcactgaaaaagacagcccggtaaatattgaagccgagcccccatttggagatagttatattataattggtgttgaacctgggcaattaaaattaaattggtttaaaaagggatcatctatcggtcagatgttcgaaacaacgatgagaggtgcgaaaagaatggcgatcctaggagacacagcctgggacttcggaagtctaggtggagtgtttacaagtatagggaaggcattgcaccaagtgttcggtgcaatttacggtgccgcattttctggtgtgtcgtggacgatgaaaatccttatcggtgtaattataacgtggataggaatgaacagtcgatcaacaagtttaagcgtaagtttagtgttagtcggagtagtaacactatatttaggtgcgatggtacaggcagactcaggatgtgtggtatcatggaagaataaagaattaaaatgtggaagtggcatatttataacagataatgtacatacgtggacagaacaatataaattccaaccggaatctccatcaaaactagcgtcagcaatccaaaaagcgcacgaagaaggtatctgcggtataagatccgtaacacggttagagaacttaatgtggaaacaaattacacccgaactaaatcatatattatctgaaaatgaagtgaaactgacaatcatgacaggagatataaaaggaataatgcaggcaggcaaacgatcccttcgacctcagccaacagaactaaaatactcttggaaaacatggggaaaagcgaaaatgttaagtacagaatcacacaaccaaacattcctgatagacggtcctgaaacagccgaatgtcctaatacgaaccgagcctggaactcactggaagttgaagactatggctttggcgtattcactacaaatatctggcttaaattgcgcgaaaaacaagatgtgttttgtgattcgaaactaatgtccgcagcaattaaagataaccgggcagtccatgcagatatgggttactggatagaaagtgcactaaatgacacatggaaaatggagaaagcatccttcattgaagtcaaatcttgtcattggccaaaatcgcacacgttatggagtaatggcgttctcgaatcggaaatgatcatacctaagaactttgcagggccggtctctcagcacaattatcggcctggatatcacacgcaaacagctggcccgtggcacctaggcaaattagaaatggattttgatttctgcgaagggactacagtagtcgtaacagaagactgcggtaataggggcccatcgctgagaacgacaacagcaagcggtaaattaataaccgagtggtgttgccgatcgtgcacgttgcctccacttagataccgtggggaagatggatgctggtatggaatggaaatacgaccgttgaaagagaaagaagaaaaccttgtaaattcgctcgttaccgcaggacacggccaaatcgataatttctcattaggtgtcctaggaatggccctatttttagaagagatgctaagaacaagagtaggaacaaaacatgcgatacttctagtagcggtgtcctttgtaacgttgataacagggaatatgtcattccgcgatttaggtagagtaatggtaatggtaggagtaacaatgactgatgatatcgggatgggtgtaacctatctagctctgttagctgcgtttaaggttcgaccaacttttgcagcaggtttgttactgaggaagctaacatccaaagagctaatgatggcgacaataggaattaccctcttatcacaatcaaccattccagaaaccatattagaacttactgatgcactagctttggggatgatggtgttgaaaatagtaagaaatatggagaaataccaactcgcagttacaattatggcaatctcatgtgtacctaatgcagtaatcctgttaaacgcttggaaagtctcttgcaccatactagctgctgtatctgtatccccgttgctgttaacttccagccaacagaaaaccgactggattcctcttgcactaacaatcaaaggattaaacccaacagctatatttttaactactctcagcagaaccagcaagaaaaggagttggccactaaacgaagctgtcatggctgttggtatggtttcaatactagcatcgagcttactgaaaaatgatataccaatgacagggccactggtggctggaggattacttaccgtatgttatgtgctaactggtaggagtgctgacttagaactagaaagagcagcggatgtgaaatgggaagaccaagcagagatatcgggctcaagcccaattctctccataactatatcggaagatgggagcatgtcaataaagaacgaagaggaagaacaaacccttacaatattaatacgcactggattgctggtcataagcggtgtatttccagtttcaatcccaatcactgctgcagcctggtacttatgggaagttaagaaacaaagagcaggggttctctgggatgttcctagcccgccaccagtcggcaaagcagaattggaagatggtgcttatagaatcaaacaacgaggaatactaggatacagtcaaataggagccggtgtatataaagaaggaacgtttcacacgatgtggcatgtcactcgtggtgctgtactaatgcatcgaggaaaaaggatagaaccatcctgggctgatgtgaaaaaggatttaatcagttatggaggtgggtggaaattagagggggagtggaaggaaggagaagaggtacaggttttagcactcgaacctggcaaaaacccgcgagcagtacagacaaaaccagggctatttaaaacgaatacgggtacgataggcgcagtatcactagatttctcaccagggaccagtggctcaccaatagttgatagaaagggaaaagttgttggactatacggaaacggtgtagttacaagatctggcgcctacgtaagcgctatagcacaaacagagaaaagcatagaggacaatccggaaatcgaggacgatatattcaggaagaaaagactaacaataatggacttacatccaggagcaggtaaaacaaagcgttacctccccgctattgttagggaggcaataaaacgaggtctacgaaccttgattctagcacctacacgagtagtagctgcagagatggaagaggcgttaagagggttacctattaggtaccaaacaccggcaataagggccgaacacacgggtagagaaatagttgatttaatgtgtcatgcaactttcacaatgcgcttactaagcccggttcgtgtacctaattataatctaattataatggatgaggcccattttaccgatccagcgtctatcgcagcgaggggctacatatctacgagagtagaaatgggtgaggctgcgggcatattcatgacagcgacaccacctggctcaagggatccatttcctcaatcgaatgcaccgattatggatgaagaacgcgaaataccagagcgtagttggaacagtgggcacgaatgggttacggactttaaggggaaaactgtatggtttgttccgagcattaaagccgggaatgatatcgcagcatgtttacgaaagaacggaaagaaagtcatccaattatctagaaaaacgttcgatagtgaatacgtgaaaactagagccaacgattgggacttcgtagtaacaacagatataagtgaaatgggtgccaactttagagcggaaagagtgattgatccaagacgttgcatgaagcctgttatacttactgatggtgaagaaagagtgatcttagcaggtcccatgcccgtcactcattcttcggcagcacagcgacgaggcagagtcggcagaaatccgaaaaatgaaaatgatcaatatatctatatgggtgaaccccttgaaaacgacgaagattgcgctcattggaaagaagcaaagatgttgttagacaatataaacacgccagaagggattatcccatcaatgttcgagccagaacgagaaaaagtagacgcaatcgacggagaatatcgcttaagaggtgaagcaaggaagacctttgtcgatctaatgagacgaggtgatttgccggtatggttagcatatagagtagctgcggaaggaattaattatgcagatcgaagatggtgcttcgatggaatcaaaaacaatcaaatccttgaagaaaacgtagaagtagaaatctggaccaaagaaggggaaagaaagaaactaaaaccacgatggttagacgcgagaatatatagtgaccctctcgccttgaaagagttcaaagaatttgcagctggaagaaaaagcctaacacttaatctgataaccgaaatgggacgactgccaacctttatgactcagaaaactagagatgcactagataacctagcagtactacacacggctgaggcgggtgggagagcatataaccacgcactatctgaactacccgaaactttagaaacattgctattactcacactacttgctactgtaactggagggatttttctatttttaatgagcgggaaaggtatcggaaaaatgactctcgggatgtgttgcattataacagcctccatccttctttggtatgcacagattcaaccacactggattgcagcgtctataatactagagttcttccttatagtattacttattcccgagcctgaaaaacaacggacaccgcaggataaccagttaacatacgtcgtaatcgctatactgactgttgtggccgcaactatggctaacgagatgggctttcttgagaaaacgaaaaaggacctcggacttgggagcataaccacacaagaatccgaaagtaacattctagacatagatttaagaccagcctccgcctggacactctatgccgtagctactacgtttgtgactcctatgttgcgacatagtattgaaaattcctcggttaacgtgtccttaactgcgattgctaatcaggcaacagtactaatgggtttgggcaagggatggccactatctaaaatggacatcggcgtaccgctgcttgccatcggttgttactcacaagtaaatcccattacacttaccgcggcgctactattgttagtggctcattatacaataatagggcccggtcttcaagcaaaagccacacgagaagcacagaaaagggcagcagctggaataatgaagaatccaacagtcgatggtataacagtaatcgacctagaacccattccttacgatccgaaatttgagaaacagttaggccaggtcatgttattgattttatgtgtaacacaagttctcatgatgagaacaacgtgggcactctgcgaagcactaacactagcaactggtcctataagtactttatgggaaggaaatcccgggaggttttggaacactactatagcagtatctatggcgaatatttttcgcggatcatacttagccggtgcaggactattattttccataatgaagaacactacaaacactagaaggggtaccggtaacattggagagacacttggagaaaaatggaagtcacgccttaacgcgttaggtaaaagtgagttccaaatatataagaaatcaggaatacaagaagtggatcgaacattggcaaaagaaggaatcaagagaggcgagacggatcatcatgctgtatcaagaggtagtgcgaaactaaggtggttcgtggaacgtaacatggttacacctgaaggaaaagttgtggatcttggttgtgggagagggggatggtcctactactgcggagggctcaagaatgttcgagaggttaagggattaactaaaggaggaccaggtcatgaagaaccaattccaatgtcaacctatggctggaatttagtccgcttgcaatccggagttgacgtattctttaccccaccagaaaaatgtgatacattattatgcgatattggcgagtcctcaccgaacccaacaatagaagcaggaagaactcttagagtactgaatctggtagaaaattggttgaataacaatacgcaattttgtataaaggtgttaaatccttatatgccctcggtaattgaaaagatggagacactccaacgaaaatatggtggagcattagtgcgaaacccacttagtcgaaattcgacccatgaaatgtactgggtttcaaatgccacaggcaatatcgtttcatctgtaaatatgatttctagaatgcttataaacaggtttacgatgaagcataaaaaggcgacatatgaaccagatgtcgacttagggtcaggtacaagaaatattggaatagaatcggaaataccaaatctagacataattggaaagcgaatagagaaaatcaaacaggaacatgaaacaagctggcactacgaccaggaccatccgtataaaacttgggcatatcacggatcatatgaaacaaagcaaacaggtagcgccagctccatggtaaatggggtggtgcgtctcctgaccaaaccatgggacgttgtacctatggttactcagatggcgatgactgataccaccccattcggacaacagagagttttcaaagagaaggtggacacccggacacaagaacccaaagaaggcaccaaaaagctaatgagaattaccgccgagtggttatggaaagaattgggcaaaaagaagacaccacgaatgtgcacccgagaggagttcactcggaaagttcgttctaacgccgcattaggcgcaattttcactgacgaaaataaatggaaatcggcaagagaggcggttgaagactcgagattttgggaattagtcgatagggagaggaatctgcacttagaaggaaaatgcgaaacatgtgtttacaacatgatgggcaaacgggagaaaaagctcggcgagttcggtaaagcgaagggcagcagagcgatatggtatatgtggctaggagccagatttttagaatttgaagcacttgggttccttaacgaagatcactggttttcccgcggtaactcgttgtcgggtgtagaaggtgagggcctacatagactaggatatatccttagagatgtatccaaaaaggaaggcggggcaatgtacgcagacgacacagcaggttgggatactagaataacactagaagatctaaagaacgaggagatggtaactaaccatatgaaaggggaacataagaaattagcagaagccatttttaaactaacttatcaaaataaggttgtacgagtacaaaggccaacaccccggggcacagtaatggacatcatctcaagaagagatcagcgaggatctgggcaggtagggacctatggattgaacacatttacaaacatggaagcacaactaattagacaaatggaaggagaagggatttttaaaagtatacaacatctaacagtaactgaagagattgcggtacagaattggttagcgcgagtcggcagagaacgactgtcccgaatggcaataagtggagatgattgtgtagtcaaaccattagatgatagatttgcatcggcactcacggctcttaacgacatgggtaaagttagaaaagatatacaacaatgggaaccaagtagagggtggaacgattggacacaagtaccgttttgttcgcatcattttcatgagctcgttatgaaagacggcagggtactggttgtaccgtgcagaaaccaagatgagttaattggaagggcacgtatcagccaaggcgctgggtggagcctaaaagaaaccgcatgcctcggaaagagttatgcgcaaatgtggacgctaatgtattttcataggagagatttaagacttgccgcgaatgcgatatgttctgccgtcccgtcacattgggtacctacttcacgaacgacgtggtcaattcacgcaaagcacgaatggatgacgacagaagacatgttggcagtctggaatagggtttggatacaagaaaacccctggatggaagataagacacctgtggaaagttgggaagaagtgccataccttggtaaacgagaagaccagtggtgcggctccctgattgggcttacatctcgcgcaacttgggcgaaaaacatccaaacagccattaatcaagtacgctccttaattggtaacgaagaatatacggactacatgcccagtatgaaaagattcaggcgagaagaagaagaagccggagtactttggtaa

SEQ ID NO: 22180 - RNA, 9876 nt, synthetic construct
  misc_feature 1..9876: note = derived and/or modified CDS sequence (opt6) from DENV-2__JX669483__SS-prME
  source 1..9876: mol_type = other RNA
acagctggggtgattataatgttaattccaacggcaatggcttttcatcttacaacacgaaacggtgaaccacatatgatagtaggacgacaggaaaaaggaaaatcattattatttaaaacagaagacggtgttaacatgtgtacgctcatggcaatagacttaggagaattatgcgaagacacaattacctacaaatgccccctattacgtcaaaatgagcctgaagacatcgattgctggtgcaattccacaagtacatgggtaacatatggtacttgcactacaacgggtgagcatcgacgagagaaacgaagcgtcgcattggtaccacatgttggtatgggacttgaaacccgaaccgaaacatggatgagctccgaaggagcatggaaacatgtccaacgtattgaaacgtggatactgaggcatcccggatttgcgataatggcagcgatactggcatatacgataggtactactcactttcaacgggcgctaatcttcatcctactaacggcggtcgcaccatctatgactatgcgttgtattggtatctcaaatcgagacttcgtggagggggtttctggtggttcctgggtagatattgtgctcgaacatggatcgtgcgttactactatggccaaaaataaaccgacactagatttcgagttgattaaaactgaagctaaacaaccagcgaccttgcgtaaatactgtattgaagctaaattaactaacactacaacagaaagtaggtgccccacacaaggggaaccgtcccttaatgaagaacaagataaacgctttatttgcaaacattcaatggtagatcgcggttggggtaatgggtgcggcttattcggaaaagggggaattgtcacctgtgctatgttcacttgcaagaaaaacatggagggaaaagtagttcttccggaaaatctagagtacacaatagtgataacacctcattcaggagaagaacatgctgtcggtaatgatacggggaaacacggagaagaaataaaaattacgccgcaaagttcaattaccgaggcggagttaactggatatggaaccgtaacgatggagtgtagtcccaggaccggcttagactttaacgaaatggtcttactgcaaatggaggaaaaagcctggttagttcaccgacagtggttcttggacctaccgttaccatggcttccgggtgctgacacgcaggggagcaactggattcaaaaagaaaccctggttacatttaaaaacccacacgccaagaaacaagatgttgttgtcttaggttcacaagagggtgcaatgcatacggcactaacgggcgccacagaaatccaaatgagttcaggaaacttattgtttacaggccatttaaaatgtagactgaggatggacaaactacaactcaaaggaatgtcatatagtatgtgtacaggaaaatttaaaatagttaaagaaattgcggagacacaacatggtaccatcgtaatcaaagtacaatatgaaggtgacggctcaccatgtaagattccctttgaaataatggatcttgaaaagagacatgtactaggccgtttaataactgtaaatccaattgtgacagaaaaagattcaccagtgaatatagaagcagagccaccattcggagatagctatataataattggagtagaaccagggcagctaaagttaaattggtttaagaaagggagcagcattggccagatgttcgaaacaacgatgagaggggccaaaagaatggcgattttaggtgatacagcatgggattttggaagtttaggcggagtattcacgtcaataggaaaggctttacatcaagtcttcggagctatatacggggctgcgttttcgggtgtaagttggacaatgaagatactaataggagtaataataacttggattggaatgaacagtcgttccacctcactttcggtatcactcgtacttgttggagtagtaactctgtatttgggtgcgatggtgcaagctgattcgggctgtgtcgtaagttggaaaaataaggaactaaaatgtggttcagggatatttatcaccgataacgttcacacttggacagagcagtacaaatttcagcctgaatcacctagtaaactcgctagtgctattcaaaaggcccatgaagaaggcatatgcggaataagaagcgtgacgaggttagagaatttaatgtggaaacaaataacaccggaattaaatcatattctaagcgaaaatgaagttaagttgactataatgacaggggatataaagggaataatgcaggcgggtaaaagatcattacgaccgcaacctaccgaattgaaatattcttggaagacttggggaaaagctaaaatgctctcaacagaatctcacaatcaaactttcttaattgatggaccagaaacagctgagtgccccaataccaatcgagcctggaatagcttggaagtagaagattatggttttggcgtcttcacaacgaacatatggttaaaacttcgagaaaaacaggacgtgttttgtgattcaaagttgatgagcgcagccataaaagacaatagagctgtacacgccgacatgggctattggatagagtcagccctcaatgatacttggaaaatggaaaaagcaagtttcatcgaggtaaaatcctgccactggcccaagtcacatacactttggagtaatggcgttctagaaagtgaaatgatcatcccgaagaactttgcgggccccgtttctcaacataactacagaccagggtaccacacccaaacggccggtccttggcatctgggaaaattagaaatggattttgatttctgcgagggaacgacagtagtagtaacagaggactgtggaaatagaggaccatcattacgaaccactactgcatctggtaaattaattaccgagtggtgttgtcgttcatgtactcttccgccattaaggtatagaggagaagatggatgttggtatgggatggagatacgacctttgaaagaaaaagaagaaaacttagtaaatagcttagtgacagctggtcatggacaaattgacaatttttcactaggtgtcctcggaatggctctgtttctagaagagatgcttagaacacgtgttggcaccaaacatgcaattcttttggtagcagtatcattcgtcacactaatcacaggaaatatgtcgtttagagacttaggccgagttatggttatggtcggtgtaacaatgacagatgacatagggatgggcgtaacctatcttgccttattggctgcgtttaaagtcagacccacctttgcagctggtctattactaagaaaattgacatccaaagaattgatgatggccacaattgggattacactgctttcacaaagcacgatacctgaaaccatactcgagctaacagacgcactggctcttggtatgatggtgttgaaaatagtaagaaacatggaaaagtaccaactcgcagtaaccataatggcaatcagttgcgtaccgaatgcagtaatactactcaacgcctggaaagtgtcttgtaccatattagctgcagtatcagtcagtccattactgctgacatcatcacaacagaagacagattggatcccattggctcttacaataaaaggcttaaatccaaccgccatatttttaactaccctaagccgaacaagcaagaaaagatcatggcctctaaatgaagcagtgatggcagtcgggatggtctcaatactcgcatcatcattgttaaagaatgacattcctatgactggcccacttgtagctggcggactcttaacggtttgttatgtattaaccggaagatcggcagatctagagttagaacgtgcggcagacgtcaaatgggaagatcaagccgaaatttctggatctagtcctatattatcaataactattagtgaggatgggagcatgtccattaaaaatgaagaggaagaacagactttaacaatcctgattagaacaggtttattagtaatcagcggagtatttcctgtaagtataccaataacagctgcagcctggtatctgtgggaggtcaaaaagcaaagagccggtgtattgtgggatgtgccgtcaccgcccccagtcgggaaagcagaacttgaagatggtgcctacagaatcaaacaacgtgggattcttggctactcccagataggggctggtgtctataaagagggtacttttcacactatgtggcacgtaacgcggggagcagttttaatgcaccgtggtaaaagaatagaaccatcctgggccgacgtcaagaaagacttaataagttatggtggaggttggaaattagaaggagaatggaaggaaggagaagaggtacaagtcttagcattggaaccaggcaaaaatccgagggctgtacaaactaaaccaggtctttttaaaacaaatactggtacaattggagcagtatcgttagactttagccccggaacaagcggctcaccaatcgtagatcgaaaaggtaaagtggtcggactatatggaaatggcgttgtaaccagaagtggagcctacgtctcagcgatagcacaaacagagaaaagtatagaggacaacccagagatagaagacgatatatttaggaagaaaagattaacaattatggacttgcacccaggggctgggaaaaccaaaaggtatttaccagctatagtcagagaagcaataaagagaggtttacgaactttgatacttgcaccaactagagttgtcgcagctgagatggaagaggcattacgaggtctccccatccgataccagaccccagcaataagagctgagcatacagggagagaaatcgtggatttaatgtgccacgccacattcaccatgcgactcctatcgccagtgagagtaccaaactataatctgataataatggatgaagcacactttacagaccccgcgtcaatcgcagcgcgtgggtatatcagtacacgtgttgaaatgggagaagcggcaggtatattcatgacagcgacacctcccggtagtagggatccgtttccgcagtccaatgcgccgataatggatgaagaacgtgaaatcccagagagatcatggaatagcgggcatgaatgggttacagatttcaaaggtaagactgtctggttcgttccctccataaaggctggcaacgacatagctgcgtgtttacggaaaaacggtaaaaaggtaattcaattaagccgaaaaacattcgatagcgagtacgtaaaaacacgtgccaatgactgggacttcgtcgttaccacagatataagtgaaatgggtgctaatttcagggcggagagggtaatagatccccgtagatgcatgaaaccagtgatattaacagatggagaagaacgggttatattggcagggccgatgcccgtgacccattcaagtgcagcccagcgtagaggcagggtaggacggaatcccaaaaatgagaacgatcagtacatatacatgggagagccattagaaaatgacgaagattgtgcacattggaaagaagccaagatgttattggataatataaacactccagaaggaataataccttcaatgtttgaaccagaacgagagaaagttgatgcaattgacggagaatacagactaagaggggaggctaggaaaacattcgtcgatcttatgagaagaggggacctgccggtctggttggcgtatcgggtggctgccgaagggatcaattatgcggatcgaagatggtgtttcgatggaatcaaaaataatcaaatattagaagagaacgtggaggtagagatttggacaaaggagggagaaaggaagaaacttaaaccaaggtggttagatgcacgaatatacagtgatccccttgcgttaaaagaatttaaagagtttgccgctggtaggaaaagtttaaccttaaatctaataacggaaatgggaaggttgcccacgtttatgacacaaaagacccgagatgcattggacaatttggcagttcttcacactgcagaagctgggggtagagcatacaatcatgcactctcagaacttccagaaactttagaaacccttttattactaacgctattagcaacagtaacaggaggaatattccttttcctaatgtctggtaaagggatcggaaaaatgacacttggtatgtgttgcataattacagcaagtatactactatggtacgcgcaaattcaaccacattggatcgctgctagtatcatactagagttctttcttatcgtactacttatacctgagccagaaaaacaacgtactcctcaggacaaccaattaacatacgtagtgatagctatcctgaccgtggttgcagcaaccatggccaatgaaatggggttcttggagaaaaccaagaaagacctaggcttaggatccataactacacaagaatcagaatcaaatatattagacattgatcttcgcccagcaagcgcttggactttgtacgcagtagctacaacatttgttacaccaatgctacgacattccatagaaaactcatcggtaaacgtctcactgacggcaatagctaaccaagcaactgtcctgatgggtttaggtaaaggctggcctctttcaaaaatggacattggagtaccattgttggcaataggatgctactcgcaggtaaaccctataacactgacggcagccctgcttctattagttgcccattatactataatcgggccaggactacaggcaaaggcaacaagagaagcacaaaaacgtgcagcagcgggtataatgaaaaaccccacagtggacggtattaccgttatcgacctcgaaccaattccatatgacccaaaatttgaaaaacagttaggacaagtaatgttattgatattatgcgtaacccaggtactaatgatgcgaaccacgtgggccctatgtgaagcactgactctcgctacaggaccgatctctacattgtgggaaggaaaccctggccgcttctggaatactactatcgccgtctcaatggcaaacatatttagggggtcatatctcgctggggcagggttgttattttcaattatgaagaacacgacaaacacgagaagaggtacaggaaatattggcgaaacgctcggggagaagtggaaatcacgattaaacgctctaggaaaaagcgaatttcaaatctataagaagtccggcatccaggaagtggacagaactttagcgaaagagggaattaaacgtggagaaactgatcaccatgcagtttctagaggatctgcaaaattgaggtggtttgtagaacgcaacatggtaactcctgaaggaaaagtagtggacctcgggtgtgggagaggtggttggtcgtactactgtggaggactaaagaatgttagggaagttaaagggttaacgaagggtggtccgggacacgaagaaccaataccaatgagtacatatgggtggaacttagtgcgactacaatctggtgttgatgtcttctttacaccacccgagaaatgcgacaccctattatgtgatataggcgaatcatcaccaaatccaactatagaagcaggcaggacgttacgtgttttaaatttagttgaaaactggctaaataataacacacaattttgcattaaagtattaaatccatatatgccatcagtgattgagaagatggaaacgctgcaaaggaaatatggaggagcgttagtaagaaatcctttaagtcgtaatagtacccacgaaatgtactgggtatctaacgcaactgggaacatagtatcatctgtgaatatgatatcaagaatgctcataaacagattcactatgaaacataagaaagcgacatacgaaccagacgtcgacctcgggagtggcacaagaaacattggaatcgagtcagaaataccaaatctagatataataggtaagcgtatagagaagattaaacaagaacacgagacgagttggcattacgatcaagaccatccttataagacctgggcatatcatggatcgtacgagacaaagcaaacgggaagtgcatcgtctatggtaaatggcgtagttcgcttactgacaaagccctgggacgtagtacccatggttactcaaatggcgatgacggacacaacaccgtttgggcaacaacgggtttttaaagagaaagttgacacaaggactcaggaacctaaggaagggaccaaaaagctaatgcggattaccgctgaatggctatggaaagaactagggaaaaagaaaacccctaggatgtgcacgagggaggaatttacacgtaaggtaagatcgaacgcagcattaggggcaatatttaccgacgaaaacaaatggaaatctgccagagaggcagtcgaggattcaaggttttgggagttagtggatagagagagaaatttacatcttgagggaaaatgcgaaacttgcgtgtataatatgatgggtaaacgggagaagaaattgggagaatttgggaaagcaaaaggaagtagagccatatggtatatgtggttaggagccagatatctagaatttgaggcacttggatttttaaatgaagatcattggttttctagaggaaattccctaagcggagtagaaggcgaggggttgcatagattaggctatattttaagagatgttagcaagaaagaaggcggtgccatgtatgcagacgacacagctggttgggatacaagaataactttagaagacctcaaaaacgaggagatggtaacaaaccacatgaaaggagaacataagaaactagccgaagcgattttcaaacttacttaccaaaacaaagttgtgagggtccaacgtccaaccccacgcggaactgtcatggacattatatcaaggagagaccaaagagggagcggacaggtgggcacgtacggacttaatacctttacgaatatggaagcacaacttatacgtcagatggaaggagaaggaatctttaagagtattcaacatttaacggtgacggaggaaatagcagttcaaaattggttagcaagggtagggcgagaaaggctatccaggatggcaatttcaggggacgattgcgtcgtcaagcctcttgatgacagatttgctagcgcattaacagctttaaatgatatgggaaaagttagaaaggatatacaacaatgggaaccaagccgtggatggaatgattggacccaggtgcctttttgctcacatcatttccacgaactcgttatgaaggacggacgagtattagttgtcccttgcaggaatcaagacgaactaataggacgcgcgaggataagtcaaggagcgggctggagcctaaaagaaactgcatgcctggggaagtcatacgcccaaatgtggacactgatgtacttccatagacgagacctacgcctagccgcgaacgcgatatgctctgcggtaccatctcattgggtccctacaagtcgaaccacttggtctatccacgctaaacacgaatggatgacgaccgaggatatgctagcagtatggaacagagtatggatacaggaaaacccgtggatggaagacaagactccagtagaaagttgggaggaggtaccatatcttggtaaacgcgaagatcagtggtgtggtagcttgatagggctaaccagccgagcgacatgggccaaaaatattcaaactgcaataaaccaggtacgttcgcttataggtaatgaagaatacaccgactatatgccgtccatgaaacgattccgacgagaagaagaagaagcaggagttctgtggtaa

SEQ ID NO: 22181 - RNA, 9876 nt, synthetic construct
  misc_feature 1..9876: note = derived and/or modified CDS sequence (opt6) from DENV-2__JX669484__SS-prME
  source 1..9876: mol_type = other RNA
accgcaggagtaataataatgcttataccaactgcgatggcatttcatttaacaacacgaaatggagaacctcatatgatagtcgggcgccaagaaaaagggaaaagtttattatttaaaacggaagatggagttaacatgtgtacgttaatggcaattgatttaggggaactatgtgaagacacaataacctacaaatgtccattactacggcaaaacgaaccagaagacattgactgttggtgtaatagcaccagcacttgggtcacctatggtacttgtactactaccggagaacacagacgtgaaaaacgctcagttgcactcgtaccacatgtaggaatggggttagaaacaaggactgaaacatggatgtccagcgaaggagcttggaaacatgtgcagagaattgaaacatggatacttagacatcccggattcgcaataatggcagcaattctagcgtatacaattggtaccacccactttcaaagggcactaatatttatactacttaccgcagtggcacctagcatgacaatgcggtgtatagggatttctaatagggatttcgtggaaggagtctctgggggttcgtgggtagatatagtccttgaacacgggagttgcgtaaccaccatggccaaaaataaaccaaccttagatttcgaactaattaaaacagaagcaaaacagccagcaactcttagaaaatactgcatagaagctaaacttacaaatactaccactgagtcacgctgccctacacaaggagaaccaagtctaaatgaggaacaagacaaacgtttcatatgtaaacactccatggtagatcgaggatggggaaatggttgtggtctatttgggaaaggtggaattgttacatgcgcgatgtttacttgtaagaaaaatatggaaggtaaagtcgtacttcctgaaaatcttgaatatactatcgttatcacaccccatagcggagaggagcacgcagtgggtaacgacactggaaaacatggtaaagaaattaaaataacaccgcagagcagtataactgaagccgagctaacaggatatggaactgttactatggagtgttcaccaagaacaggtctggattttaacgaaatggtattattacaaatggaagaaaaagcgtggttagtacaccgccaatggttcttagatcttccccttccatggctaccaggagcagacactcagggatctaactggatacaaaaagagacgctagtaacgtttaagaatccccatgccaagaaacaggatgttgtggtattagggagccaagagggagctatgcacacggcattaactggtgcaactgaaatacaaatgagctcgggaaacttactatttactggacacttaaagtgtcgactgaggatggacaaactacaacttaagggaatgtcatactctatgtgcacaggaaaatttaaaatagttaaagaaattgcggaaacacaacacgggaccatagtaattagagtacaatacgaaggggatggatcgccttgcaaaatcccttttgaaataatggaccttgagaaaaggcatgtactcggccgtttaataacggtcaatccaatagttacagaaaaggactcaccggttaatatagaagcggaacctcctttcggagattcttacataattatcggggttgaaccaggccaacttaaattaaattggtttaagaaaggcagctcaatcgggcaaatgtttgaaacaactatgagaggcgctaaacgtatggcaatactcggcgacacagcctgggacttcggcagcttaggaggtgtattcacctctatcggtaaagcactgcatcaagtgtttggagcgatatatggagctgcattttctggagtctcatggaccatgaagatattgatcggtgtgattataacatggattggtatgaactcaagatccacaagtttatctgtctcattagtattagtcggtgttgtaacattatatttaggggcaatggtgcaagcagattctggttgtgttgtatcgtggaagaataaagaattaaaatgcgggtcggggatattcattacagataacgtacatacatggacagagcagtacaagtttcagccagaatcccctagtaaactagcatccgccatccaaaaagcacacgaggaaggaatatgcgggattcgaagcgtaacacgactagaaaacttaatgtggaaacaaatcactcctgaacttaatcacattttaagtgagaatgaagttaaattaacgataatgacaggtgatatcaaaggaattatgcaagcaggaaaacgttctctacgaccacagcccactgaattaaaatatagttggaaaacatggggaaaagccaagatgcttagcacggagagtcataatcagacgtttctaatagacggccctgaaacggcggaatgtccgaatactaatagagcttggaacagtttagaagttgaagactacggattcggagtttttacaacaaatatatggctaaaactacgggaaaaacaagacgttttctgcgatagtaaattaatgtcagcagctataaaagacaatcgcgctgtccatgcagatatgggttattggatagaatccgcactaaacggtacatggaaaatggaaaaagcgtcatttattgaggtaaaaagctgtcattggccaaaaagtcatacgctttggtccaatggcgtcttagaatcagaaatgataattcccaagaattttgctggaccagtatcacaacataactacagaccagggtatcacacacaaacagccggtccatggcacctaggaaagttagaaatggacttcgatttttgtgaaggcactactgtcgtcgtaacagaagattgcgggaacagagggcccagccttcgtacaacgacagcatcaggaaaattgataacggaatggtgttgtcgatcttgcacactgcctcccttacgatataggggagaagatgggtgctggtacggaatggaaataaggccattaaaagaaaaagaagagaatcttgtaaacagtctcgtcacagctggtcatggacagatagacaatttttcacttggagtcttggggatggctctgtttttagaagaaatgttgagaactcgcgtcggaaccaaacacgccatactattagttgcggttagtttcgtaacattaataacagggaacatgtcctttaaagacctaggccgggtaatggttatggtaggggtcgcgatgacagacgatatcggaatgggcgtaacttacttagcactacttgcagcgttcaaagttagaccaacatttgctgctggactacttctgagaaagttaacctccaaggaattaatgatggcaacaatcggcataactttgttatcacaaagtactatccccgagacaattcttgagctcacggatgcgctcgcattaggaatgatggttctaaaaatagtgcgtaatatggaaaaatatcagctagcagtgactattatgacaataagctgtgtaccaaatgcagtcatactattaaatgcatggaaagtatcttgcacaatactcgccgcagtctctgtatcacccttacttttaacatcaagccaacaaaagacagattggataccgcttgcgctaactataaaaggtctaaatcccactgctatctttttaacaacactatcaaggacttctaagaaacgtagttggccactaaatgaagccgtaatggcagttggaatggttagcatacttgccagtagcctgttaaagaacgatatccccatgacaggtcctctagtagctgggggtcttttgactgtttgttacgtgctaaccgggaggtcggccgatctagaattagagagggccgctgacgttaaatgggaagaccaagccgagatctcgggatcaagcccgattctaagtattaccatatccgaagatgggagtatgtctatcaaaaatgaagaggaggagcagactttaacaatattgatcagaacaggattgctcgttattagtggagtatttcctgtgagtatccctataacagccgcagcttggtacctttgggaagtcaagaaacaacgtgcaggagtattatgggacgtaccttcaccaccacccgtaggaaaggccgaattggaggatggagcgtaccggattaaacaaagagggatacttggctattcacagatcggcgcgggggtttacaaagaagggacgtttcacacaatgtggcatgtgactagaggtgcagtattgatgcatcgaggcaaaaggattgagccgtcatgggcggatgtcaagaaagatttgatttcttatggaggcggatggaaattggaaggggagtggaaggagggagaagaagtacaggtattagctctggaacccggtaaaaatccaagagcagtccaaacaaaaccaggactattcaagacaaatacaggcactataggcgcggtatcattagattttagtcccggaacgagcggcagtcctatcgttgatagaaaaggaaaagtagtaggcttatatggaaacggagtcgtaacacgatctggggcatatgtaagtgccatagcgcaaaccgagaaatccattgaggataaccccgagatcgaagatgatatatttcgcaaaaagagattaacgatcatggacctacatcccggagctggcaagacaaaaagatacttgccagcgatagttagagaagctataaaacgaggactaagaactttgatactagcacctacccgagttgtcgcggccgaaatggaggaagcactaagagggttaccaataagatatcaaacccctgcaatacgtgcagaacataccggtcgtgagattgtagatcttatgtgccatgcaacgtttactatgcggcttttgtcgcctgtacgggtaccaaattacaaccttatcattatggatgaggctcatttcacagacccagcaagcattgcggcacgggggtacataagtactcgagttgagatgggggaggccgccggtatcttcatgactgcaacgccacctggatcaagggatccgttcccccaaagtaacgcaccaataatggacgaagaaagagaaatccctgagaggtcctggaactcgggacatgaatgggtaacagatttcaaaggaaaaacagtatggttcgtcccttcaatcaaagcgggaaacgatatcgcagcttgtcttcgcaagaatggcaagaaagtcatccaattaagccgtaaaacgtttgacagcgaatacgtcaaaacccgagcaaatgactgggattttgtagtaacaaccgacatatcagaaatgggagcaaattttagagcagagagagtaatagatcctcgccgatgtatgaaacccgtaatattaaccgacggtgaagaaagggtaattttagccggtcccatgcctgtgacgcatagtagtgccgctcaaagaagaggtcgcgttggtcgtaaccccaaaaacgaaaatgatcaatacatctatatgggagagcccctagagaacgatgaggactgtgcacattggaaggaggcaaaaatgctacttgataacattaacacacccgaaggcataatcccttcgatgttcgaaccagaaagggaaaaagtagacgctatagatggagaatatagacttcgaggagaagcgaggaaaacatttgtagatttaatgagacgtggagacttacctgtatggcttgcatatcgagtagcagccgaggggataaactatgccgatcgccgatggtgcttcgatggcatcaaaaacaaccaaattcttgaagaaaatgtagaagtagaaatttggactaaagagggggaaagaaagaaacttaaacctcgttggctcgatgcaagaatatatagcgacccccttgctcttaaagaatttaaagagttcgccgcaggacggaaatcactaacattaaatttaataaccgaaatgggacgcctgccaacttttatgacacagaaggctcgcgatgctctcgataacttggcagtactgcacacagccgaagctggcggcagggcatataatcacgcattgagtgaacttccggagacactagaaaccttgttgttgttaactctactggcaacagtaactggaggtatattcctcttccttatgtccggaaagggagtaggaaagatgactttggggatgtgttgtatcatcacggcgtctatactattatggtacgcacagattcagccacactggattgcagcaagtattatactagagttctttcttattgtccttcttattcccgaacctgaaaaacaaagaacaccacaagacaatcaactaacttatgtcgtaattgccatactaactgtggtagctgctacaatggcaaacgagatgggtttcctagagaagactaagaaagatttgggtttagggagcattacaacacaggaaagcgagtcaaacatattagatattgatctacgaccagcttcggcttggactttatacgccgttgcgacgacatttgttactcccatgttgaggcatagtattgaaaattcctccgtaaacgtgagtctgacagctatcgccaatcaggcgacggtactaatgggtttaggtaaagggtggccgcttagcaaaatggacataggagtaccacttttagcaatcgggtgttattctcaagtaaaccctattacactaacagccgccctcctacttctggttgcgcattacgcaataatcgggcctggattacaagcaaaagccacccgagaagctcaaaaacgggcggcggctggcattatgaaaaaccccactgtggacggtatcacagtaatagatttggagcccattccctatgatccaaaatttgagaaacagcttggacaagtcatgctattaattttatgtgtgacacaagtccttatgatgcgaacaacttgggccttgtgcgaagcactaactttagctacaggcccaataagtacgctttgggaaggaaaccctggacggttctggaatactacaattgcggtttcgatggccaacattttcagaggcagctatctggccggggccggccttctgtttagcataatgaaaaatactacgaacactagaagaggaactggtaatataggagaaactttaggcgaaaaatggaaatcacggttgaatgcactaggaaagtcagagttccagatatataagaaatccggcattcaagaagtagaccggacgttagccaaagaaggcattaaacgaggagaaacggaccatcacgcagtttctagaggcagcgctaaattaagatggtttgtcgaaagaaacatggttaccccagaaggaaaagtagtagacttgggatgtggcagaggcggatggtcctattattgtggcggactaaagaacgtaagggaagtaaaagggctaacgaaaggaggccccggtcatgaagaaccaatacccatgtcaacttatggttggaatttagtaagattacaatcaggggtagatgtattctttaccccaccagaaaaatgtgatacattattatgtgatataggcgaatcgtcgccgaacccgacgatcgaggccggtagaaccctaagagtactaaatttagtggaaaattggctgaataacaacacacaattctgtataaaagtactaaatccatatatgccaagtgtaatcgagaaaatggaaactctacagagaaaatatggtggcgctcttgtaagaaatccattgtcccgtaacagtacccatgaaatgtactgggtttctaatgccacaggcaacattgttagcagcgtgaatatgataagtaggatgcttataaatagatttacaatgaaacacaaaaaggcaacgtatgaaccagatgtagacttaggttccgggacgcgaaatatcggcattgaatctgaaattccaaacctcgacataatcggaaaaagaatcgagaaaatcaaacaagaacatgagacgtcctggcattacgatcaagatcacccatacaaaacgtgggcatatcatggaagttacgaaactaagcagaccgggagtgcaagttccatggttaatggcgtagtccggttactcacgaaaccttgggacgtggtaccgatggtcacacaaatggcaatgacagacacaacgccctttggacaacaacgtgtgtttaaagagaaagtcgataccagaacacaagagcctaaagagggcacaaagaaacttatgcgcattacggcggaatggctctggaaggaattaggcaagaagaaaacgcctaggatgtgcacccgagaggagttcacacggaaagtaagaagtaatgcagcactcggagcaatcttcacagacgaaaacaagtggaaatcagcaagagaagcggtagaggattctcgattttgggaactcgtagatcgtgaacgtaatttacacctagagggcaaatgtgaaacgtgtgtatataatatgatgggaaaaagagaaaagaaactaggggagttcggaaaagcaaaaggaagtagagcaatttggtatatgtggctgggagcgaggttccttgaatttgaagctcttggatttctaaacgaagatcattggtttagccgaggcaatagtctttctggtgttgagggtgaaggcctccaccgattaggttacatacttcgcgatgtaagcaagaaagaagggggagcaatgtacgcagatgataccgctggatgggacacccgtattacattagaagatttaaagaatgaggaaatggttataaatcatatgaagggtgaacacaagaaactagctgaagcaatattcaaactcacataccaaaacaaagtggttcgggtccaaagacctactcctcggggaacggtaatggacataatatcaaggagagaccagaggggctcaggacaagtaggtacgtacggcttaaacacattcacaaatatggaagcacaattaataagacaaatggagggtgaaggaatattcaaatcaattcaacatcttactgttaccgaagagatagcagttcaaaattggcttgcacgagttggaagagagaggctgtcacgtatggccatcagcggagacgactgcgtagttaaaccattagatgataggtttgcatctgctctcacggcccttaatgatatggggaaagtgagaaaagatattcaacagtgggaaccaagcagggggtggaatgattggacccaagtaccattttgtagtcatcacttccatgaattagtcatgaaagatggtcgagtattggttgtcccttgtagaaatcaagatgaactaattggtagagctagaatatcacaaggtgccggttggagtctcaaagagactgcttgcctcgggaaatcttatgctcaaatgtggacccttatgtattttcacagaagggatctgagacttgctgcgaacgctatatgctcagctgtacctagtcactgggttccaacatctcgtaccacctggtctatccatgcaaaacatgaatggatgacaactgaagatatgttagccgtttggaatagagtatggattcaagagaatccatggatggaggacaagactccggtagaaagttgggaggaggtaccgtatctcggaaaacgtgaagatcaatggtgcggttcactaataggtctcacaagtagagccacatgggccaaaaatatacaaactgccattaaccaagtcagatcacttattggcaacgaagaatacacagattatatgccttcgatgaaacgattccggagggaagaagaggaagccggtgtactgtggtag

SEQ ID NO: 22182 - RNA, 9876 nt, synthetic construct
  misc_feature 1..9876: note = derived and/or modified CDS sequence (opt6) from DENV-2__JX669485__SS-prME
  source 1..9876: mol_type = other RNA
actgcgggggttataataatgttaataccaactgcaatggcatttcacctaacgacgcgaaatggagaaccccacatgatagtaggtaaacaggaaaaaggaaaatcccttctgttcaaaaccgaagacggagtaaatatgtgcactttgatggcaattgatctcggagaactctgcgaagatactataacctacaaatgtccattgctacgtcagaatgaacccgaagatatcgattgctggtgtaactccacatcaacgtgggtaacttacggaacctgtactacaaccggcgaacatagaagagaaaaacgcagtgtagccttagtgccacacgtcggaatgggcttggaaaccaggacagaaacatggatgagttcagaaggcgcatggaaacatgtacagcgtatagaaacatggattttaagacaccctggctttgcgataatggcagctatccttgcatataccataggcactacgcattttcaaagagcattaatattcatactcctaacagcggtagcaccatctatgactatgcgatgtatcggaatctcgaatcgagattttgtcgaaggagtatcaggaggtagttgggtggacatagtccttgaacatggatcctgcgtgacaactatggctaaaaacaaacctactttagactttgaattaattaaaacagaagctaaacaaccagcaactttaaggaaatactgtatagaagcaaaactgacaaacacaactaccgaaagtcgttgtccaacgcaaggggaaccatccttgaatgaagaacaagacaaaaggtttatatgcaaacatagtatggtagacaggggatggggaaatggttgcggtttattcggaaaaggtgggatagttacatgcgcaatgttcacatgtaagaaaaacatggaaggaaaagtcgttctaccggaaaatttggagtatacaatagtgatcacgcctcacagtggcgaggaacatgccgtaggcaacgacactggaaaacacggtaaagaaatcaaaataacaccccaatcgagcattactgaagcagaattgacaggatatgggactgttacaatggaatgctccccacgaacaggtttggatttcaacgagatggtcttattacagatggaggaaaaagcatggttagtgcacagacagtggttcttagatttacccctaccttggctaccgggcgcagatactcagggaagtaattggatacaaaaagaaacattggtgacattcaaaaatccgcacgctaagaaacaggatgttgttgttttagggtcacaggaaggcgcgatgcataccgccttgacaggcgctactgagatacaaatgtcatcaggaaatttgttatttacaggacacctgaaatgcagactccgaatggacaaactacaactgaaaggtatgagctacagtatgtgtaccggtaaatttaaaatagtaaaagaaatagcggaaacgcaacatggtacaatcgtaataagagtacaatatgaaggcgacggcagtccttgtaaaattcctttcgaaataatggacttagagaaaaggcacgtgttgggtcggttaatcacagtgaatcctatagtcacagaaaaagatagtccagtaaatatagaagctgagccacccttcggagactcttatataattataggcgttgaaccaggacaattaaaactaaattggtttaagaaaggaagcagcataggacaaatgtttgagactacaatgcgaggagccaaaagaatggctattctcggcgataccgcgtgggattttggttcgctaggtggtgtatttacaagtataggtaaggcgctgcatcaagtattcggagcgatctacggagcagcgttcagcggggtatcatggaccatgaaaattcttatcggagtaattattacatggatcgggatgaatagtaggtcaacaagtctatcggtatcactcgttctagtaggagtcgtaacattatatttaggcgcaatggttcaggcggactcaggttgcgttgtttcatggaaaaataaagagttgaaatgtggaagcggaatattcatcacagacaatgttcacacatggacagaacaatataagtttcagcctgaaagccctagcaaactagcctccgcgatacaaaaagcgcacgaagaggggatatgtggcattagatcggtaacacgacttgaaaatttgatgtggaagcaaattacgccagaattaaaccatatactgtcagaaaatgaagtaaaactaacaataatgacaggagatatcaagggaataatgcaagctggtaagcgatcattacgtcctcaaccgacagaacttaagtattcttggaaaacgtggggtaaagcaaagatgttgtctactgagagtcacaatcagacattcttaatagatggcccagaaaccgcggagtgtcccaatacaaatcgagcgtggaacagtctggaagtagaggattatggattcggggttttcactacgaacatatggctaaagttacgagaaaagcaagatgtattttgcgattctaaattaatgtcagcagcgataaaggacaatagggcggtacatgcagatatgggatattggatagagagtgctctgaatgggacttggaagatggagaaagcatctttcatcgaagtcaaaagttgtcactggccaaagagccatactttatggagtaatggtgtactggaaagcgagatgatcataccgaagaacttcgccggaccagtatcacagcataattatcgtccaggctatcatacacaaaccgccggaccctggcatcttggaaaattagaaatggactttgatttttgtgaaggtactacagtagttgtcacagaagattgcggaaataggggacctagtttaaggacaactacggcgagtggaaaacttataacggagtggtgctgcagatcatgtaccttacctccgttaagatacagaggtgaagatggttgctggtatggaatggaaattcgaccactgaaagaaaaggaagagaaccttgtaaattcgttagtaaccgccggtcatggacaaatagataacttttctctaggagttttgggtatggcgctgttcctagaagagatgttaagaacacgagttggaacaaagcacgcaattttattggtagccgtatcattcgttactctaatcacaggtaatatgagctttagagacctaggcagagtgatagttatggtaggtgtaacaatgaccgatgacatagggatgggagtaacttacctcgcgttgttagctgctttcaaagtgagacctactttcgctgcaggactcctattacggaaactgacgtctaaagaattgatgatggcaacaatcgggataacgttattatcccaaagtacaataccggagacaatactcgaacttacagatgctttagcactaggtatgatggtgcttaaaattgtgagaaatatggaaaaatatcaattagccgtaacaataatggctatatcgtgcgtaccgaatgcagtaatattattaaacgcctggaaagtgagttgtacaattctagcagtagtgagtgttagcccactgctgttaacaagtagtcagcagaagaccgattggatccctctggcactgacaataaaaggtttaaatccaacggcaatatttttaacaacgctctcgcgaacaagtaagaaacgctcatggcctcttaatgaagcggtcatggcggttggtatggtctcaattttagcttcctccttactgaaaaacgatatcccaatgactggacctttggtcgcgggtggcttactgacagtttgctatgtattaacaggtaggtcagcagaccttgagttggaaagagcagcggatgttaaatgggaagatcaagccgagataagcggtagttccccaatcctaagtataacaatatcagaggacggatcaatgtcaatcaaaaatgaagaagaagaacaaacactcacaatccttattcgcactggactcctagtaatttccggtgtatttcccgtttctatacctatcactgcggctgcctggtacctatgggaagtaaagaagcaacgagctggtgtattgtgggatgtcccaagtccaccaccggtagagaaagcagaattagaagacggagcataccgcataaagcaacgcggtatcctagggtacagtcagataggagccggtgtatacaaggaggggacattccacacaatgtggcatgtgacaagaggtgctgtattaatgcatagaggcaaaaggatagaaccatcctgggccgatgtgaagaaagacctgatctcttatggaggtggatggaaactagaaggagaatggaaagaaggcgaagaggtgcaggttctagcattagaaccaggtaaaaatccaagagccgttcagacgaaaccaggcctattcaagactaacacaggcacaattggagctgtttctctagatttctcgccggggacaagtgggtcgccaatagtagaccgaaaaggaaaagtagttggtttatatggaaatggagtagttacacgaagcggggcgtatgtcagtgctattgcacaaacagaaaaatcaatcgaggataatcctgaaatagaagatgatattttccggaagaaacgattaacgattatggatttacatcccggtgctggaaaaaccaagagataccttccggcaatcgtccgcgaggcaataaaaaggggtctcaggaccttgatattagcaccgacacgagtggtggcggcagaaatggaggaagcattacgaggtctccctatccggtatcagactcctgccatacgtgcagaacatacaggcagagagatcgtagaccttatgtgtcatgccacctttacgatgagattattatcgcccgtgagagtgcccaattataaccttataataatggatgaagctcactttacagaccccgcgtctatagccgctcgtggttatattagcacaagggtggaaatgggcgaggcggcaggtatatttatgactgcgacgcctcccgggtcacgggatccatttccacaatctaatgcacctataatggacgaagaaagagaaataccagaacgatcgtggaacagcggtcacgaatgggtaacagatttcaagggaaagacagtctggtttgtcccctctattaaagcagggaatgacattgctgcatgcttaaggaaaaacggtaagaaggtgattcaattgtcccgcaaaacgtttgatagtgaatacgtaaaaacccgggcaaacgactgggattttgtagtaactacagatattagtgagatgggagctaactttaaagcagaaagagtaattgacccaagacggtgtatgaaaccagtaattttaaccgatggggaagaaagggtgatattagctggtccaatgccggtaacacattcgagcgcagcacaaaggcgcggacgcgtcggtaggaatcctaaaaacgagaatgatcaatatatatacatgggagaaccactagagaacgatgaagattgtgcacattggaaggaagcaaaaatgctgctcgataatataaatacacccgaaggaataataccctcaatgttcgagcccgaacgagaaaaagtagatgcaatcgacggagaatatcggctaagaggagaggctagaaaaacgtttgtcgatctaatgcgaagaggcgatttaccagtgtggttggcttaccgcgtggcagcagaaggtatcaattatgcggataggagatggtgctttgacgggattaagaataatcaaatacttgaagaaaatgttgaagttgaaatttggactaaagaaggggagaggaagaaactaaaaccacgctggttagacgcccgaatatatagcgaccctctagctttaaaagagttcaaagagtttgcagccggaagaaaaagtctaaccctgaatttaataacggaaatgggccgattacccacatttatgacccaaaaggcaagggatgcactagacaatctagctgttttacatacggcggaagctggtggcagggcgtacaatcatgcacttagcgaactaccagaaacgctcgaaaccttactgctcctcacactattagctactgtaaccggtggaatttttcttttcctcatgagtgggaaaggtattggaaagatgacgttaggaatgtgttgtattattaccgctagtatattactatggtacgcacaaatacaaccgcactggattgctgcctccattattctagagttctttcttatagttctcctaattcctgaacctgaaaaacaaagaactccacaggacaaccagctcacttatgtagtaatcgccatactcaccgtagtagcagccacaatggctaatgagatggggtttctagagaaaactaagaaagacctaggtctcggaagtataacgacacaagagagtgaatcaaacatcttagacatagatttacggccagcatccgcatggactctatacgcagtagctacaacatttgttactccaatgttaagacattcaatagaaaattcaagcgtaaatgtctcattaacagccatcgctaatcaagcgactgtactaatgggtctgggcaaaggttggcctctaagcaaaatggatattggagtccccctactagctattggatgctattcccaggtgaacccaataactcttacagctgcactcctgcttttggttgcacactatgctataatcggtccaggattacaggcaaaggcaactagagaagctcaaaaacgtgcagctgctggaattatgaaaaacccaaccgtagatggtatcacggtaattgaccttgaaccaattccctacgacccaaaattcgaaaaacaacttggacaagtcatgcttttaatcctttgtgtgacacaagtattgatgatgcggacaacatgggctttatgcgaagccttaacgttggccacgggtcctatatcaacattatgggaaggtaatccaggtcgcttttggaatactaccattgccgtatcgatggctaacatttttcgtgggtcttatcttgctggggccggattgttgttcagtataatgaaaaacactactaacacccgtagaggaaccggaaacatcggtgaaactttaggtgaaaaatggaaaagtaggttgaacgctttagggaaatcagagtttcagatttacaagaaaagtggcatacaggaggtcgatagaacactagcgaaagaaggaataaagaggggagaaacagatcatcatgctgtatcaagaggatctgcgaaattgaggtggtttgtcgaaagaaatatggtaaccccagaaggaaaagttgtcgatttagggtgtggtagaggaggttggtcatactactgtggtggccttaaaaacgtcagggaggtcaaaggactcacaaagggaggcccaggacatgaagaaccaataccaatgagcacctatggatggaacttggtacgcttacaatctggggtcgatgtgtttttcacaccaccagaaaaatgcgacaccctattatgcgatataggcgagagttcaccaaacccaaccatagaggctggtcgaaccttacgagtactaaatttggtcgagaattggttaaataataatactcagttttgtataaaagtattaaacccctatatgccctctgtgatagagaaaatggaaactctacaaagaaaatatggaggcgccctagtaagaaatcctttgtccagaaattcaacccacgaaatgtattgggtttctaacgccactggaaacatagtcagttcagtaaacatgatatcgagaatgctaatcaatagatttacaatgaagcataagaaagcaacctacgaactagacgttgatttaggctccggaactagaaacatagggattgagtcagaaacgccaaacttagacatcattggcaaacggatagagaaaattaaacaagaacacgaaacgtcttggcattacgatcaggatcatccttataaaacgtgggcgtaccacggctcttatgaaactaagcaaacgggaagcgcatctagcatggtcaacggagtcgtaaggttactaaccaaaccttgggacgtggtaccaatggttacccaaatggcaatgactgacaccaccccatttggacaacaaagggtatttaaagagaaagttgacactcgaactcaagagccaaaagaaggaactaagaaattgatgcgaataacggcagagtggttatggaaagagctaggtaaaaagaaaactcctcgtatgtgcacccgtgaagagtttactcgaaaggttcgatccaatgcggctttaggagctatttttactgacgaaaacaaatggaaatcagcccgagaagctgtggaagattcgaggttctgggaacttgtcgacagagaacggaatttgcatcttgaaggaaaatgtgagacgtgtgtctacaacatgatggggaaacgggagaagaaacttggagagttcggaaaagctaagggtagtagggccatttggtatatgtggttaggagcacggtttttagagttcgaagctctcggatttttaaatgaagaccactggtttagtcgtggaaacagtctaagtggcgtggagggggaaggcttgcacaggttgggctatattctaagagatgtaagtaagaaagaaggaggtgcgatgtacgcggacgacacggctggttgggacactagaataaccctcgaagatctcaaaaatgaagagatggtaacaaatcatatgaaaggagagcataaaaagttggctgaagcgatcttcaaacttacatatcaaaacaaagtcgtaagagttcaacgcccaacgccaaggggaacggttatggatattatctcgcggcgcgaccaaagaggcagcgggcaagtagggacatacggacttaatactttcactaacatggaagcacaattgataagacaaatggaaggcgagggaatattcaaatcaattcagcatctgacagttactgaagaaattgcagtacaaaattggctagcaagggtaggaagagaacgactatcgaggatggctatatccggagatgactgcgttgttaaaccattagatgatcgattcgctagtgccttaacggctttaaatgatatggggaaagtaagaaaagacatacaacaatgggaaccctcaagaggatggaatgactggacacaagttccgttctgctcgcaccatttccatgaattagtcatgaaggatggccgggtattagtggttccatgcagaaatcaagacgagttaataggcagagctagaattagtcaaggagctggatggagtctaaaggagaccgcatgtttaggaaaatcctacgcccaaatgtggacactgatgtacttccatcgccgtgatttgcggctcgcggcaaacgctatatgttcagctgtaccaagccactgggtcccaacatctagaaccacgtggtcaatacacgcaaagcacgaatggatgacaacagaagacatgttggcagtctggaacagagtatggatccaagaaaatccatggatggaagataagacgcccgtcgaaagttgggaagaggtaccgtatcttggcaaaagagaggaccaatggtgcgggtcacttatcggtctaacgtctcgcgctacttgggctaaaaacattcaaaccgcaataaaccaagttcgtagccttataggaaatgaagaatatacagactacatgccatccatgaaaaggtttcgaagagaagaggaagaagcaggagtcttgtggtga

SEQ ID NO: 22183 - RNA, 9876 nt, synthetic construct
  misc_feature 1..9876: note = derived and/or modified CDS sequence (opt6) from DENV-2__JX669486__SS-prME
  source 1..9876: mol_type = other RNA
acggctggcgtgataataatgctcatacctactgcgatggcatttcatttgactacccggaacggggaacctcacatgattgttggaagacaggaaaaaggcaaatcgttgttatttaaaacggaagatggagtaaatatgtgcactctaatggctatcgacttaggggaattatgcgaagatacaattacctacaaatgccctttgcttcgacagaatgaaccggaagatatcgactgctggtgcaactccacaagtacttgggtaacttatggaacgtgcactacaacaggcgaacacagacgagagaaaagatcggttgctctcgtgcctcatgttggcatgggtctcgaaacaagaacggaaacctggatgagtagcgaaggggcatggaaacatgttcaaagaatagaaacttggatattacgacatcccgggttcgcaattatggcggcaattttagcatacacgataggaaccacccactttcaacgtgcacttattttcatacttctaacagccgttgcaccatccatgactatgcgatgtataggaattagcaatagggacttcgtagaaggagtatcaggtggttcatgggttgacattgttctcgaacatggatcatgtgttaccactatggccaaaaataaacctactttagattttgaattaattaaaaccgaagctaaacaaccagcaacactgagaaaatattgcatcgaagcgaagttaacaaacaccaccacggaaagtcgatgtccaacacaaggagaaccatccttgaatgaagaacaagataagagattcatttgtaaacacagtatggtagacaggggatggggaaatggttgcggtttattcggcaaagggggcatcgttacctgtgcaatgttcacatgtaagaaaaacatggaaggaaaagtagtactaccagagaatttggaatacacaattgtaataacgccgcattcgggagaagaacacgcagtgggaaatgatacaggcaaacacggtgaggagattaagattacacctcaatccagtataaccgaagccgaacttacaggatacggaactgtaacaatggaatgcagtccaagaaccggccttgacttcaatgaaatggtcctactacaaatggaggaaaaggcttggctagtccaccgtcaatggtttttagacctaccattaccttggttgccaggtgcagacacccaaggatccaactggatccaaaaagaaacattagtaacttttaaaaatcctcatgccaagaaacaagacgtagtggttctaggttcacaagaaggagcaatgcacaccgcactgactggagctactgagatacaaatgtcatcaggcaacctattattcactggacacctgaaatgtagacttaggatggacaaacttcaacttaaagggatgtcctactctatgtgtactggtaaatttaaaatagttaaggaaatagcagaaacgcaacatggtaccatagtaattagggtccagtatgaaggagatggttcaccctgtaagataccctttgaaattatggatctagaaaaacgacatgttttgggaagattaatcactgtcaatccgatcgtaacggaaaaagactcaccagtcaacattgaagcagaacctccatttggtgattcatacataatcataggtgtagagccgggccaactgaaacttaactggttcaagaaaggcagcagtatcggacagatgttcgaaacgacaatgcggggtgctaagagaatggctatacttggtgatactgcgtgggattttggttcactgggaggtgtatttacgagtatagggaaggctttgcaccaggtattcggggctatatatggcgcggcgttcagcggagtttcatggacaatgaaaattctaattggggtgatcattacttggataggaatgaactcacgttccacctccttgtccgtatctttagttctcgtgggtgtagttacattatatctcggggcaatggtccaagctgacagtggatgtgtagtaagttggaaaaataaagaattaaaatgtggttcaggcatttttataacggacaatgtacatacatggacggaacaatataaattccaacctgaatcaccatcaaaattagccagcgcgatacaaaaagctcatgaagagggcatctgcggtatcagaagcgtcacacgtcttgaaaacttaatgtggaaacaaattactcctgagttgaatcacatcctaagtgaaaatgaggtcaaacttactatcatgactggagatataaaaggcatcatgcaagcgggaaaaaggtcattgaggcctcagccaactgaattaaagtattcgtggaaaacttggggcaaagcaaagatgctttcaacggaatcacataaccaaacgtttttaatagacggacccgaaacagccgagtgtccgaataccaatcgagcatggaactcgctcgaagttgaagattatggatttggagtgtttacaaccaacatatggctcaaattacgagaaaaacaagacgtcttttgtgattccaaattaatgtcagcagctataaaagacaaccgtgcagtacacgcagacatggggtactggatagagtctgcgcttaacgatacctggaaaatggagaaggcctccttcatagaggttaaatcatgccattggccaaaatcgcataccttatggagtaatggcgttttagagagtgagatgattataccaaagaattttgcaggaccggtatcacagcataattatcgaccaggttatcatacacagacagctgggccgtggcatctaggcaaactagagatggactttgatttctgtgaaggaactacagtagttgtcacggaagactgtggaaaccgcggacccagtttacgaacaacaacagcctccggcaaattaataacggagtggtgttgcaggagttgtacattaccccctctgagatacagaggagaagatggatgttggtacgggatggaaatcagaccactgaaagagaaagaggaaaatctcgtaaattctttagtgaccgcgggccacggacaaattgataacttctcattgggcgttttgggcatggctttatttctggaagagatgttgagaacaagggtcggcacaaagcacgcaatcctattagttgcggtcagctttgtcacgttaataacaggaaacatgagtttcagagatctcggaagggttatggtaatggtaggcgtgactatgacggacgatatcggaatgggcgtaacgtatctagcattactagctgctttcaaagtacgacccacatttgcggctggactcttacttagaaaacttacttcgaaagaactaatgatggcgactatagggattacattattgtcccaatcaactacaccagaaacaattctagagcttactgacgctctggcactaggtatgatggtcctgaaaatcgtaagaaatatggagaaataccagctcgcagttaccataatgactattttatgtgtaccaaatgcagtgatcttattaaatgcttggaaagtaagttgtacgatactagccgtagtctcggtctcaccactgttgctcacgagtagtcaacagaaaactgattggattcctttggctctcacaatcaaaggattaaacccaacggcgatttttctaactacattatcaagaacaagtaagaaaagatcgtggcctcttaatgaagctgtgatggcagtagggatggtctcaatactagcttcatcacttttaaagaacgacatacctatgacgggtccattagtagctggtggtttacttacggtatgttatgttttaacaggtagatcagcagatcttgaattggaaagagccgctgatgtcaagtgggaggaccaagccgagatatctggatcatcacccatactttcgataacaatatcagaagacggatcgatgtccatcaaaaatgaagaggaggaacagacactgacgatactgataagaacagggttactggtaataagtggggtcttccctgtcagcatccctattaccgccgctgcttggtatttatgggaagtcaaaaagcaaagagcaggagttttatgggatgtgccgtcaccacccccggtagaaaaagctgaactagaagatggagcataccggataaaacagagaggtattttgggttactcacaaataggtgccggagtctacaaagaaggaacatttcatacaatgtggcatgttactagaggggctgttcttatgcatcgaggtaaaagaatcgaaccctcatgggcagatgtcaagaaagatttaataagctacggaggaggctggaaattggagggtgaatggaaagaaggagaagaagtacaagttttagcgttagaaccggggaagaatcccagagcagttcagacaaaacccggtctctttaagaccaatactggaactataggagcagttagtctggatttttcaccgggaacttcaggaagccctatagtagatcgaaagggaaaagtagtaggcttatatggaaatggagtcgtgacccggagtggagcatatgttagtgctatcgcgcaaactgaaaaatctatagaggataacccggaaatagaggatgacatatttaggaagaaaagactaacgatcatggacttacatccaggagcggggaaaacaaaacgttaccttcctgcgatcgttcgtgaagcgataaaaaggggattgagaacgctcatactggctcctacgagggtagtggctgcagaaatggaagaggctttacgaggtctgccaattcgttatcaaacaccggcgatcagggcggaacatacaggaagagaaattgtagacttaatgtgccatgcgacttttactatgcgactactatcccctgtcagagtaccaaattataatctcattataatggatgaagcgcacttcacagacccagcttcaatcgcagccagaggatatatatctacgcgtgtagaaatgggtgaagcggcaggtattttcatgactgcgacaccaccaggaagtagagacccgtttccacaatcaaacgctccaattatggatgaagaaagggaaattccagaacgatcatggaactcaggtcacgagtgggtaacagactttaaaggaaaaactgtatggtttgttccaagtattaaagctgggaacgatatagcagcttgtctcagaaagaatggaaagaaagtaatccaactgtcaagaaagacattcgattcagagtatgtgaaaacgagagcaaatgattgggattttgttgttacaactgacatttctgagatgggagccaactttcgcgcagaacgtgtaatagacccaagaagatgtatgaaaccagttatactgactgacggagaggaaagggttatcctcgcaggacctatgccagtaacccatagctcagccgcacaaaggaggggacgagttggcagaaatccaaagaacgaaaatgatcaatatatatatatgggtgaaccactagaaaacgatgaagactgtgcgcactggaaagaggcgaaaatgttgttagacaacatcaacactccggaaggaataataccttctatgtttgaacctgaacgcgagaaagtggacgctattgatggagaataccgactaagaggagaggctcgaaaaacatttgtagatttaatgagacgaggagatctacccgtttggctagcataccgtgtggcagcggaaggaataaattatgctgataggagatggtgctttgacgggatcaaaaacaaccagatattagaagaaaatgtagaggtcgagatatggacaaaggaaggcgaaaggaagaaacttaagcccagatggctcgatgccagaatttatagcgatcccctagccttgaaagaatttaaagaatttgctgctggacgaaaaagtttgacattaaacctcattactgagatgggtaggttacctacttttatgacgcaaaaagcccgcaatgctctagacaatttagcagttctgcacacagcggaggcaggagggcgagcatacaaccacgcgttatcagaactcccggaaactctagaaactttactactactaacgctacttgcaacagtcacagggggtatcttcctatttttaatgtcaggtaaaggcatcggtaaaatgactttaggaatgtgctgcattattactgcatcagtattattatggtatgctcaaattcagccgcactggatagcagcctccatcattttggaatttttcttaatcgtactccttataccagaaccggaaaaacaaagaacaccacaagataatcaactcacatatgttgtaatagcaatattaacggtcgtcgcggctacgatggccaatgagatgggtttccttgaaaagacgaagaaagatcttgggctggggtcgataacgacccaggaaagtgaaagtaacattttagatatagacttgagaccagcatcagcatggacactatacgccgtagctaccacattcgtaacaccaatgttgcggcacagcattgaaaacagctcggttaatgtcagccttactgctattgctaaccaggcgactgtactaatgggtttaggaaaaggatggccgttaagtaaaatggacatcggggtgccattattagcgataggttgctacagtcaagttaatccaattacactaacggctgcactactcctgctagtggcgcactatgctatcattggaccgggattacaggcaaaagcaactagagaagcccagaaaagggcagctgcaggcatcatgaagaatccgacagtagacggaataaccgttgtcgatctagaaccgatcccctatgatccaaaattcgaaaagcaactaggacaagttatgttacttatattgtgtgtgactcaagtactcatgatgaggacaacgtgggctctatgcgaagcactaactcttgcaacaggaccgattagtacgttatgggaaggtaatccaggaagattctggaatactacaatcgcggtaagcatggccaacatcttcaggggatcatatctcgctggtgcaggtctattatttagtataatgaagaatacaactaacaccaggagaggcactggaaacattggagaaactttaggcgaaaaatggaaatcacgactaaatgcgttgggtaagagcgaatttcaaatatataaaagaagcggtattcaggaagtagatcgtacactggcgaaggaaggcataaagagaggagaaaccgaccaccacgcagtttcaagaggttcggcaaagctaaggtggttcgtcgagcgtaatatggtaaccccagagggaaaagttgtcgatttaggttgtggaagaggcggatggtcatattactgcggtggattaaagaatgtccgagaggttaaaggactaacgaaaggtggacctgggcatgaagaacctattcccatgtcaacttatggctggaatctagtgcgattacagtcgggggttgatgtattctttaccccacctgagaaatgtgatactctattatgtgacataggcgaatcttcgcctaaccccaccatagaggccggtcgaacattgagagtactgaatttagtggaaaactggcttaacaacaatacacaattttgtatcaaagtactaaacccatacatgccttcagtaatagagaaaatggagacgctacaaagaaagtatggaggtgctttagttcgaaatcctttatcgcgaaattcaactcacgaaatgtactgggtttcaaatgcaaccgggaacatagtgtcctctgtaaacatgatatctagaatgcttattaaccgttttactatgaagcacaagaaagcgacttacgagccagatgtggacttaggttccggaaccagaaacattgggatcgaatccgaaataccaaacttggatattattgggaaaaggatcgagaagataaaacaagaacacgaaacaagctggcattacgatcaagatcacccttataagacttgggcttatcacggctcctacgaaactaagcaaacaggttcagcctcgtctatggtaaacggagtagtacgactattaacaaaaccttgggatgtcgtaccgatggtaactcaaatggcaatgacagataccacaccattcggtcaacaaagagtattcaaggaaaaggttgacacgagaacacaggaaccaaaggaaggtacaaagaaactaatgcgaattactgcggaatggttatggaaggaactaggcaagaagaaaacccctcgaatgtgtacacgagaagaatttaccaggaaggtcaggagcaacgcagcattaggcgctatatttaccgatgaaaataaatggaaaagtgcgagggaagccgtagaagactcacgtttttgggagctagtggatagagagagaaatttgcatcttgaaggaaaatgcgaaacctgtgtttataatatgatggggaagagagagaagaaacttggcgagttcggcaaagcaaaagggagtcgggcaatctggtatatgtggttaggcgcccgatttttggagttcgaagccctaggatttctaaatgaagaccattggtttagtcgcggcaatagcctctctggcgttgagggtgaaggccttcacagattgggttacatactacgcgacgtatccaagaaggaaggaggagccatgtacgcagatgatacagcaggatgggatacaagaattacactagaggacttaaagaacgaagaaatggtaacgaaccatatgaaaggcgagcacaagaaattagcggaagccgtatttaaacttacctaccaaaacaaggtagttcgcgtccaaagacccacaccgcgaggaaccgtgatggatataatatcacgtagggatcaacgaggtagtggacaagtcggaacctacgggctcaatacatttaccaatatggaagcacaattaattagacaaatggaaggagaaggcatatttaaatcaattcagcacctaacagttactgaggaaattgctgtgcaaaattggttggcccgagtagggagagaacgcctgagtagaatggcaatatcaggggatgactgtgtggtaaaaccattagatgatcgttttgcctccgctctaaccgctttaaacgacatgggcaaagttcggaaagatatacaacaatgggaaccttcacgtgggtggaatgactggacccaagtaccattttgctctcaccactttcatgaactcgttatgaaagatggacgagtcctggtagtaccatgtaggaatcaggatgaactcataggcagagccaggatctcccaaggagcaggatggtcattaaaagagacggcatgcttagggaaaagctatgctcagatgtggacgttgatgtactttcatagaagagacctaagattggctgcaaatgcaatatgcagtgcggttccttcccactgggtacctacgagcagaaccacatggagcatacacgcaaaacacgaatggatgaccacagaagacatgttagcagtgtggaatagggtatggattcaagaaaatccctggatggaagataagacgcctgtcgaatcatgggaagaagtgccgtaccttggaaaacgggaagatcagtggtgtggttcactgattggccttacatccagagctacctgggccaaaaatatacaaaccgctatcaatcaagtacgatccttaataggaaatgaggagtatactgactacatgccatctatgaaacgctttagaagggaagaagaagaagccggcgtcttatggtag

SEQ ID NO: 22184 - RNA, 9876 nt, synthetic construct
  misc_feature 1..9876: note = derived and/or modified CDS sequence (opt6) from DENV-2__JX669487__SS-prME
  source 1..9876: mol_type = other RNA
acagctggagtcataattatgttaataccgacagcaatggcatttcacttgaccacacgtaatggcgagccgcatatgattgtaggacggcaagaaaagggaaaaagtttactttttaaaacagaggacggtgtaaatatgtgtactctaatggctatagatttgggcgagttgtgcgaggataccataacctacaaatgcccattactccggcaaaacgagccagaagatattgattgttggtgtaatagcacaagtacatgggtgacctatggaacttgtacaaccacaggagaacatcgacgcgaaaaacgttcagtagctcttgtaccacatgtaggaatgggcctagaaacacgtactgaaacgtggatgagttccgaaggggcgtggaaacacgttcaacgtattgaaacttggattcttcgccatcccggatttgcaataatggcagcaattcttgcctatactattggtactacacattttcaacgtgcactgatatttatactgttaactgccgttgcacctagcatgacaatgagatgtattggtattagtaatagggatttcgtagaaggcgttagcggtggctcatgggtagacattgtattagagcacggctcgtgcgtgacaactatggccaaaaataaacctacattggatttcgaacttataaaaacagaagccaaacaaccggcaaccctccgaaaatattgcatagaagcaaagttgacaaatacgacaaccgaatcaaggtgtccaacacagggcgaaccgagtttaaacgaggagcaagacaagagatttatttgtaaacatagcatggtagatagaggttggggaaatggttgcggtttgttcggtaaaggtggaatagtgacatgtgcgatgttcacctgtaaaaaaaatatggaggggaaagtggttctacctgagaacctagaatatactatcatgatcacacctcacagcggagaagaacatgcagtaggcaacgacaccggaaagcacggcaaggaaattaaaataacaccacagtcttccattacagaagcagagttaactgggtacggcaccgttacaatggaatgcagcccacggacgggtttggacttcaatgagatggtgttacttcagatggaggaaaaagcttggttggtacacagacaatggtttctagatctaccgctaccatggttaccaggagcagatactcagggtagtaattggattcaaaaggaaactctagtcacgttcaagaatcctcacgcaaaaaaacaggatgtagtagttttgggatcccaagaaggtgcaatgcacactgctctgacaggtgctactgaaatacagatgtccagtgggaatttgttgtttacaggacatttaaaatgtcgactgaggatggacaaattacaattaaaagggatgtcatatagtatgtgtacggggaaatttaagattgtcaaagagattgcggaaacccaacatggaactatcgtcattagggtacaatacgaaggagacggctcaccgtgcaaaattccattcgaaataatggatcttgaaaaaagacatgttctaggccgtttaataacagttaatccgatcgtaacagagaaagatagtcccgtcaacatcgaagccgaaccaccttttggagactcttacataataataggcgttgaaccaggacaactaaaattaaactggttcaagaaaggttcatctataggtcaaatgtttgaaacaaccatgcgaggagctaagcgtatggctatattaggagatacggcatgggactttggcagcctcgggggagttttcacatctatcggaaaagcgctacatcaagtatttggagccatatatggggccgctttttctggcgtatcttggaccatgaaaattctaataggagtaataattacctggattggtatgaatagtagatccacatcactttccgtaagtctagtactagttggcgttgtaacgctatacctaggagcaatggtacaggcggactctggttgtgttgtatcatggaaaaacaaagagttaaaatgcggttcaggcatttttataactgataatgtacacacgtggactgaacaatacaaatttcaacccgaaagcccatccaaactcgcatcggcaattcaaaaggcacatgaagaaggtatatgtggaattagaagtgtaacgagactcgaaaacttgatgtggaaacaaataaccccggaattaaaccatattttaagcgaaaatgaagtaaaactaacaataatgacaggggatattaaaggcattatgcaagctggaaaacggtctcttcgcccgcaacccacggagttaaaatattcttggaaaacttggggaaaagcaaaaatgttaagtactgaaagtcacaaccaaacgtttctaatcgatggtcctgaaacagcagagtgtccaaacacgaatagagcatggaattcactcgaagtcgaagactatggtttcggcgtattcacaactaacatctggctaaaactcagggagaaacaggacgtattttgtgattctaaactaatgtccgcggctataaaagataatagagccgtacatgctgatatggggtactggattgaatctgctctcaacgatacgtggaaaatggagaaagcatcatttattgaagtaaaatcttgccattggcccaaatcacatacgctatggtctaatggagtgttggagagtgaaatgatcattccaaaaaactttgcggggccagtttctcagcacaattacaggcctggataccacacccagacagccggtccatggcatttaggtaaactggaaatggactttgatttctgtgaaggtacaacagtggtcgtaactgaagattgcggtaatagaggtccttccctaaggactacaactgcgtcgggaaaattaattactgaatggtgttgcagatcgtgcaccctaccaccattaagatacagaggtgaagatggttgctggtacggaatggaaataaggcctttaaaagagaaagaggagaacttagtgaactcgctcgtaacggcagggcatggacaaatcgataatttttccctaggagtgttaggtatggccttatttcttgaagagatgcttcgaacacgagtaggtaccaaacacgctattttattagtggccgtatcctttgtaaccctaataaccggtaacatgagttttagagacttaggacgagtgatggtaatggtgggagtgaccatgacggacgacattggcatgggagtcacctatctcgccctattagcggcttttaaagtaagacctacatttgccgcaggtctactattaaggaagctaacaagcaaagaactaatgatggcgacaatcggcatagctttgttatcacagtcaacaattcctgagacgattttagagttgacagacgcattagcattgggaatgatggtactgagaatagtaagaaatatggaaaagtatcagttggcagtaactattatggcaatatcatgcgtgcctaacgccgtaattttgttgaacgcctggaaagtaagttgtacaatcttagccgcggttagtgtaagcccattattacttactagtagccaacaaaaaacggattggataccccttgcattaacaataaagggcttaaatccaacagcaatattccttacaactcttagtcgtacctcaaagaaaagaagttggcccttaaatgaagcagtgatggcagttggcatggtatcgattctagcatcaagtttattaaaaaatgatattccaatgacaggcccattagtagctgggggtttacttacagtttgctacgtactaaccggaagaagtgccgatttggaactcgaacgggcggcagatgttaagtgggaggatcaggcagagatttctgggagttcgcctatcctttctataacaataagtgaagatggttctatgagcatcaaaaatgaggaagaagagcaaacactgacaattttaattagaacaggcttactcgtgatatcaggagtattcccggtaagcatcccgattacagcagcggcttggtacctatgggaagtgaagaaacaacgtgccggagtattatgggacgttcccagtccgccaccagtggaaaaagccgagttagaagatggagcttataggataaagcaaagaggaattctaggttacagccaaattggggcgggggtctacaaagagggaacatttcatacaatgtggcacgtgacaagaggagcagtgctgatgcatcgcggcaaaaggatcgaaccaagttgggcagacgtaaaaaaagatttaatttcctatggcggtggttggaaactggagggggaatggaaagagggtgaagaagtgcaagtattggcactagaaccgggaaagaatccaagggcggttcaaacgaaacccggacttttcaagaccaataccggaaccatcggagccatatccttagattttagtccaggaacaagtggctcaccaattgtcgatagaaaaggaaaagtagtcggactctacggtaacggggtcgtcaccagaagtggtgcttatgtttcggctatagctcaaacggaaaaatcaatagaagataatcctgagatagaagacgacatatttagaaaaaagcgattaacaataatggatctccacccgggagctgggaaaacaaaaagatatcttccagcaatagtaagagaggccattaaacgaggtctgcgaacactaatactagcccctacgcgggtagtagctgctgaaatggaggaggcactaaggggtcttcctataagatatcaaactccagcaatacgggccgagcacactggaagggaaattgtcgatctgatgtgccacgccacctttactatgagattattatcacctgtaagggttccgaattacaacttaatcataatggatgaagcccatttcaccgatcctgcttcgatagcagcgaggggttatatcagtacgagagtggaaatgggtgaagctgccggcatctttatgacagcaacaccaccaggatcaagagatccttttccacaaagcaatgctccgatcatggatgaagaacgtgagattccagaaagaagttggaattctggacacgaatgggtaaccgatttcaagggaaaaactgtatggtttgtaccgtcaataaaggcaggaaacgacattgcagcctgcctacgaaagaatggaaaaaaggttatacagttgtcgaggaaaacattcgactcagagtatgtgaaaacacgtgcaaatgactgggacttcgtagtcacgacagacatttcggaaatgggagcaaatttcagagcagaaagagtcattgatccgaggaggtgtatgaaacccgtgattctaacagacggtgaagagagggtcatactagcgggtccgatgccggtaacacacagttccgcagcacaacgtagaggcagaataggacgtaaccctaagaacgaaaatgatcagtacatatacatgggggaaccactagaaaatgatgaagattgtgcccattggaaggaagcaaaaatgttgttagataatatcaatacaccagaaggaataattccctctatgttcgaacccgaaagggagaaagtggacgcaattgacggagagtaccgcctacgaggtgaagcccgtaaaacgtttgttgatttaatgagaaggggtgatctaccagtgtggctcgcatatagagttgcagcagaaggcataaactatgcagacagaagatggtgtttcgatggcattaagaataaccaaatattggaagaaaatgtagaggtcgaaatatggacaaaggaaggcgagagaaaaaaattaaagccacgttggttagatgcccggatatactctgacccattagcactcaaggaatttaaggagtttgcagcagggagaaaatcgttaacactaaacctaataacagagatgggacggctacccacttttatgacacaaaaagcacgtgacgccttagacaacctcgcggtgttacacaccgccgaggcaggaggaagagcatataaacatgcactatcagaattacctgagaccctggaaactctcctactactaacacttttagcaacagtgaccggcggcatattcttatttttaatgagtggtaagggaattggaaaaatgacactgggcatgtgttgtataattacggctagtatccttttatggtacgcgcaaatccaacctcattggatcgctgcaagcatcatcttagaattcttcttgatcgtccttctaattccggaaccagagaagcaaagaactccccaagataaccaactaacatatgttgtcatagctattcttactgtggtagcggcaacaatggctaatgagatgggtttcttagaaaaaaccaaaaaggacttggggctcggtagtataaccactcaagaaagtgaatcaaacatactagatattgatttaagaccagcctcggcatggactttgtatgcagttgcgactactttcgtgactccaatgttaagacattcaattgaaaactcatcagttaacgtatcactcactgcgattgctaatcaggctacagtattaatgggtcttgggaaaggttggcctctctctaaaatggacattggcgtgcctttgcttgcgataggctgttatagtcaggttaaccccatcacacttacagctgctcttctcctcttagtcgcacattacgcaattatcggaccagggttacaagccaaagcaacaagagaagctcagaagagggcagctgctggaataatgaaaaaccctaccgtcgatggtattacagtaattgatttagaacctattccgtacgatcctaagtttgaaaaacaactgggacaagtaatgctactgatactatgcgttacacaagtgttgatgatgagaacaacatgggccttgtgtgaagcgttaacacttgcaacaggccccatctctaccctatgggaaggtaatcctggaagattttggaacactacaatcgcagtcagcatggcaaatatattcagaggttcctacctggcaggagctgggttattatttagcataatgaaaaatacgaccaacacaagaagaggcacgggaaatatcggggaaaccttaggcgagaaatggaaatcacgtctaaacgcgttaggaaaatcagaatttcagatatacaagaagtccggaatccaggaagtagatcgcacactcgcaaaagaaggtataaagagaggcgaaaccgatcaccatgcagtatcacgaggttcggcaaagctccgctggttcgtagaacgcaatatggtaacgccagaaggcaaggtagtagatcttggttgcggacgaggaggttggtcgtattactgcggcgggttaaaaaacgtgcgtgaggttaaaggacttacgaaaggtgggccggggcacgaagagcccataccaatgagcacatacggctggaatttagtacgcctccaaagtggagtcgatgtcttctttacgccaccagagaaatgcgatacactactatgcgatattggtgaatcctcgcccaacccaaccatagaagcgggacggacattacgcgtgttaaatttagctgaaaattggctaaacaataacacacagttctgcatcaaagtacttaatccttatatgccaagtgtaatagagaaaatggaaacattgcagaggaagtatgggggcgcacttgtccgaaatcctctctctcgaaattctactcatgaaatgtattgggtgtcaaatgcgacggggaacatagtcagttcagtgaacatgatttcacggatgttaatcaatagatttactatgaaacacaaaaaggcaacatatgagcctgatgtagatttaggaagcggaacgcgtaatataggaattgagtcagagatccctaatctagatattataggaaagcgtatagaaaagatcaaacaggaacatgaaacatcctggcattatgaccaagatcatccgtataaaacgtgggcctatcacggctcatatgaaacaaaacagacaggttcagcatcttctatggtcaatggagttgtgagactcctgactaaaccctgggatgtagtacctatggtaacccaaatggcaatgacagacacaacgccatttggacaacagagagtgttcaaagaaaaggtcgatacgcggacacaagaacctaaagagggaacgaaaaaactaatgcgcataacagctgaatggctatggaaagagttaggaaaaaaaaaaactccgcgaatgtgtacgagagaagagtttactaggaaggttagatctaacgcagctctaggtgcaatctttactgatgaaaacaaatggaagagtgcaagagaagctgtagaggattctcggttttgggagttggtagacagagaacgcaacctacatttggaaggtaaatgtgaaacttgtgtttacaacatgatgggcaaacgagagaaaaaacttggagaattcggaaaagccaaaggttctcgtgcaatatggtatatgtggctgggtgccagattcctcgagtttgaagctcttggctttctaaacgaagatcactggttcagcagaggcaactccctctcaggtgtggaaggagagggactacacaggcttggatatattctaagagatgtctcaaaaaaagagggaggtgctatgtatgcggatgacacagctggttgggatacgagaataacattagaagacttaaaaaacgaggaaatggtcacgaaccatatgaaaggagaacataaaaagttagctgaggctatattcaaattgacgtatcagaacaaagtagtacgagtccaaagaccaacaccacggggtacggtaatggatataataagtcgaaaagatcaacggggtagcggacaggtagggacatacggattaaacacgtttacgaacatggaagcccaactaataaggcaaatggagggagaaggtatttttaaatcaatacaacacttgacggtaacagaagagatcgcagttcaaaactggttagcaagagttggaagagaacgcctttctagaatggcaatctcaggcgacgattgtgttgtgaaacccttagacgatagattcgctagtgcactgacagcgttgaacgatatgggtaaggtcagaaaggatatacagcagtgggaaccaagtaggggatggaacgactggacgcaagtcccgttttgcagccatcacttccatgaactggtaatgaaagacgggcgcgtgttagtcgtaccatgcagaaatcaagatgaactaataggtagagcccgtatttcacaaggggcgggatggagcctgaaagagaccgcatgcctagggaagagctacgcccaaatgtggacacttatgtactttcaccggagagatcttcgattggccgcgaatgcaatctgttcggcggtaccatctcattgggtgccaactagtaggacgacatggagtattcatgcgaaacacgagtggatgacgaccgaagatatgttagctgtatggaacagagtttggatacaggaaaacccatggatggaagataaaacaccagtcgaatcttgggaagaagttccatatctaggaaagcgcgaagaccagtggtgcgggagcctaataggacttacatctcgtgcaacatgggcgaaaaatatccaaacagctataaatcaggtcaggtcactcatagggaatgaagaatacactgattatatgcccagcatgaagagattcagaagagaagaagaagaagcaggtgtactttggtaa

SEQ ID NO: 22185 - RNA, 9876 nt, synthetic construct
  misc_feature 1..9876: note = derived and/or modified CDS sequence (opt6) from DENV-2__JX669488__SS-prME
  source 1..9876: mol_type = other RNA
acagctggagtaataataatgttaataccgacagcaatggcattccatcttacaacccgaaatggcgaaccacatatgatcgtaggtagacaagaaaagggtaaatctttgctctttaaaacagaagatggtgtaaacatgtgcacgttgatggcaatagatttgggagaattatgtgaggacacgattacatataagtgccctttactaaggcaaaacgaacccgaagatatagactgttggtgcaacagcacttccacatgggtaacgtatgggacctgcacaacgactggtgagcataggagagaaaaacggagcgtagccttagtccctcatgtaggtatgggactagaaactcgaacagagacatggatgagtagtgaaggagcctggaaacacgtgcaaagaatagagacctggatcctcagacatccaggttttgcgataatggcggcgatactcgcatacactataggcaccacccattttcagagggcattaatatttatactcttgacggctgtggctcccagtatgactatgaggtgtattggaatatcgaaccgggattttgtagaaggcgtgtccggtggatcatgggtagatattgttttagagcatgggtcatgtgtaacaacaatggcaaaaaataaacccaccttggactttgaactgattaagacagaagcaaagcaacccgccactcttaggaaatattgtatcgaagcaaaattaactaacacaacgaccgaatcccgctgccccacacaaggagaaccttcgttaaatgaggaacaagataaaagatttatatgtaagcatagtatggttgaccgaggctggggtaatgggtgcggactatttggcaaaggaggcattgttacttgtgcgatgttcacatgtaagaaaaacatggaaggaaaagttgtccttccagaaaatctcgaatatacaatagttatcacaccacactcaggggaagagcatgcggtaggaaacgatactggaaaacacggaaaagaaataaaaattacaccacaatcttcgatcacagaggcggaattaacagggtacggaacggtaactatggagtgttcaccgagaacagggctagattttaatgagatggtattactacaaatggaagaaaaagcatggctcgtacataggcaatggttcttagacttacctctaccttggctaccaggagcggatacgcaaggttcaaactggatccagaaagaaactttagtcacttttaaaaacccccatgcgaagaagcaagatgtagtcgtactaggaagtcaagaaggagcgatgcatacggcgctaaccggagcaactgaaattcaaatgtcaagcggaaatttgctcttcaccggtcacctgaaatgtagactacgaatggataagctgcaactcaagggaatgagttatagcatgtgtaccgggaagtttaagatagtaaaagaaattgcggaaactcaacatgggacgattgtaattagagttcagtacgaaggagatgggtcgccgtgtaaaatcccttttgaaatcatggacttagaaaaaaggcatgtgctagggagacttataacagtcaatcctatagtgactgaaaaagattcaccagtaaatatagaagctgaaccgccgttcggagactcatatatcattataggtgttgaacctggacaactaaagttaaattggttcaaaaaaggaagcagtataggacaaatgtttgaaactacaatgagaggggccaagaggatggcaatacttggagacactgcatgggatttcggttcgttaggtggagtatttaccagtataggcaaagcattgcaccaagtgtttggggcaatctacggtgcggccttctcaggagtatcctggactatgaaaatactaataggcgttattattacatggataggaatgaatagtcggagcacctcactaagtgtttcattggttttagtaggagttgtcacattatatttgggcgcaatggtccaagctgactcggggtgtgtcgtgagctggaaaaacaaagagttgaaatgcggatccggcatatttataaccgataatgtacatacctggactgagcaatataagttccaacccgagtcgccaagtaaattagcatcagcaatccaaaaagcgcatgaggaaggaatatgcggaattcgatcagttacacgcttggagaatttaatgtggaagcagatcacccctgaattaaaccatattcttagcgaaaatgaagttaaacttactattatgacgggggatataaagggtatcatgcaggccggcaagcgttcgttgagacctcaacctaccgaattaaaatactcctggaaaacgtggggaaaggcaaaaatgcttagtactgaaagccacaatcaaactttcttaattgacggcccagagacagccgagtgccccaatacaaatagagcttggaattcgttagaagttgaagattacgggtttggcgtctttacaacgaacatttggttgaaattaagggaaaagcaagacgtattttgtgactctaaattaatgtcagcggctatcaaagataatcgggctgtccatgctgatatgggctactggattgaatcagcattaaatgatacctggaaaatggaaaaagcaagcttcatcgaagtaaaaagctgtcattggcctaaatcacacactttatggagtaatggtgtactcgagagtgagatgataataccgaaaaactttgccggtcccgtcagccaacataattatagaccgggataccatacgcagacagccggaccttggcacttaggaaaattagaaatggacttcgatttctgcgaaggaacgacagtggtagtaacggaagattgtggaaacagaggaccgtcattacgtacaacaacggcatcaggaaaactaataactgaatggtgctgccgctcctgtacactaccacctcttagatatcgtggggaggacggatgttggtacggtatggaaatacgacctcttaaggaaaaggaagaaaatcttgtaaactccctagtgacggccggacatggtcaaatagacaattttagtcttggtgtactggggatggcattgttcctagaagagatgttaagaacccgtgtgggaacaaagcatgctatattacttgtagccgcgtcatttgtaacgttgataactgggaacatgagtttccgtgatctgggaagggtaatggtaatggtaggtgcgaccatgacagacgacatagggatgggtgtcacttatctcgcacttctcgctgctttcaaggtacggccgaccttcgccgcaggactacttcttagaaagctaacgtcaaaagaattaatgatggcaacgatcggaattgcgttactttctcagtctacgattccagaaaccattctcgaactaacagatgctttggccttaggcatgatggtgcttcgaatagtgagaaacatggagaaataccaactagcagtcacaattatggccatttcgtgcgtaccgaatgcagtgatactactaaacgcttggaaggtctcatgcacaattctcgcggcggtgtccgtatccccgttattactaacaagttctcaacaaaagactgattggattccactcgctttaacaataaaaggattaaacccgaccgcaatctttttaacaacactaagtagaacgagcaaaaaaaggtcatggccactaaatgaggccgtaatggcagtaggaatggtgtcgatcttagctagtagcttattaaaaaatgacataccaatgactggaccactagtggcggggggccttctaaccgtttgttacgtattaacgggaagaagcgcagatctagaattagagagagcggcagatgttaagtgggaagatcaggcagaaatttccggcagctctcctattctgtcgattaccatctcagaagatggtagtatgtcgataaagaatgaagaggaagagcaaacacttaccattttaattagaacaggactacttgttatatctggtgtatttccagtgtctatacccataaccgccgcagcgtggtacttatgggaagtaaagaaacaaagagcgggcgtattatgggacgtacccagtccacctccagttgaaaaagcagaactagaagatggagcgtaccgaattaagcaacgaggtatacttggatattcccaaataggtgcaggtgtatataaggaagggacatttcatactatgtggcatgtaactagaggggcagtattaatgcaccggggcaaaagaattgaaccgagctgggcagacgtaaagaaagatttaataagctatggcggagggtggaaattagagggggaatggaaagaaggcgaggaagttcaagtattagccctagaaccaggaaagaatccgcgtgcagtacaaaccaaacccggattgtttaaaacaaatactggaactataggagccatatctttagattttagtcctggaacttcagggagcccaattgtcgaccgcaaagggaaagtagtcggactctacggcaacggtgtagtaactcgatctggtgcttatgtaagcgcaatcgcacaaacagagaaaagtattgaagacaatccagaaatcgaagatgacatttttagaaaaaaaagactgaccattatggatttacatcctggagcgggtaaaacaaaacgttatcttccagccatagtcagagaagcaataaagagaggattaagaacgttaatacttgcgcctactagagtagtcgcagcggagatggaagaggcactccgcggattacctattcggtaccagacaccggcaattcgtgcagaacacacaggtagagaaatagtagatcttatgtgtcatgcgacctttacaatgcggctattaagccctgtgcgagtacctaattataatttgataatcatggatgaagcccatttcactgatccagcttctatagcagcacgaggttacataagtacaagagtagagatgggtgaggcggcaggtatatttatgactgccacaccaccagggagtcgtgacccatttccacagagcaacgcacccataatggacgaagagagagagataccagaaagatcttggaatagtggacatgagtgggtaacggatttcaaaggaaaaacagtatggtttgtcccttcaatcaaagccggtaacgatatagcagcttgtctcaggaagaatggtaagaaggttatacaattgtcaagaaaaacatttgactccgagtatgtaaagacaagagccaacgattgggacttcgtcgtaacaacggatattagtgaaatgggagcaaattttcgagcggaacgtgtaatagaccccaggagatgtatgaaaccagtaattcttacggatggtgaagagcgagtaattttagcgggcccaatgccggttacacatagcagtgctgcgcagcgtagagggagaatagggagaaacccaaaaaacgaaaacgatcaatatatatacatgggagagccattggaaaatgatgaggattgtgctcattggaaggaggcaaaaatgttactagacaatatcaacaccccggaaggaataattcctagcatgtttgagccagaaagagagaaagtagacgcgattgacggtgaatacagactacgaggtgaagcgcgaaagactttcgtcgatcttatgaggagaggcgacctaccggtctggcttgcgtataaagtagcagcagaaggtataaactatgctgatagaagatggtgttttgacggaatcaaaaacaatcaaatcctcgaagagaatgttgaagtggaaatatggacaaaagaaggtgaaaggaaaaaattaaagcccagatggttagatgctcgtatatactcagaccccttagcattaaaggaattcaaagagttcgccgcaggaagaaaaagccttacgttaaacttgattaccgaaatgggacggttacctacatttatgacacaaaaagcacgagatgctctagataatttagctgtacttcatacggcagaagcaggtggccgtgcatacaaacatgcattgagtgaattgccagagacgctagaaacacttcttttacttactttactagctacagtgactggaggtatattcctattcttaatgagtgggaaaggcattggtaagatgactttgggaatgtgttgtattattacagcgagtatcctcctttggtatgctcagattcaacctcattggatagctgcatcaatcatactcgaatttttcctaattgtcttgctaatcccggagccagaaaagcaaagaacacctcaagataaccaattgacgtatgtggtaatcgctatattgaccgttgtagccgcaactatggctaacgaaatggggttcttagaaaaaacaaagaaagaccttggacttggttccatcacaacgcaggaaagtgaaagtaacattcttgatatagacttaaggccggcgagtgcctggacgctttatgcggttgctacgaccttcgtcactcctatgcttagacattcgatagagaattcaagtgtaaatgtttctctcacggctatcgcgaatcaggcaacggtactgatgggattaggcaaagggtggcccttatctaaaatggacattggagtaccattgttagcaattggatgttactcacaggtgaatccaataactttgacggctgctctgttacttctcgtagcacattacgcgattataggtcctggattacaagcaaaagcgacacgtgaagctcaaaagcgggccgccgcagggataatgaaaaatccaactgttgatggaataactgttatcgatctcgaaccaattccttatgatcctaaattcgagaagcagctaggacaagttatgttacttatcctatgtgtaactcaggtgctgatgatgcgaacaacttgggcattatgtgaagcattgaccttagccaccgggcccatcagcactctttgggaagggaacccaggacgcttctggaataccacaatagccgtaagtatggctaatatctttcgcggaagctacttggcaggagcgggtttactattctccataatgaaaaacacagccaacacacgacgagggacagggaatatcggggaaactttgggagaaaaatggaaatccagacttaacgctctaggaaaaagcgaattccagatttataagaaatctggtatacaagaagtggacagaacactagcgaaagaaggcataaaacgtggagaaaccgatcaccatgcagtatctagagggtcagcgaagctcagatggttcgtagaaaggaatatggtaaccccagaaggcaaagttgtagacttaggttgcggacgcggggggtggagttattactgtggggggttaaaaaatgtgcgtgaagtcaaaggtttaacaaaaggcggtccaggacacgaagagcctatcccgatgtcaacatatgggtggaatttggtacgactacaaagtggtgttgatgtttttttcaccccaccagaaaaatgcgatacgctcctatgtgatataggcgaatcttcgcctaatccaacaatagaagccggcaggaccttaagggtcttgaatcttgcagaaaattggttaaataacaatacacaattttgtatcaaagtccttaatccatatatgcctagtgttatagaaaagatggagacattacaacgaaaatacggcggagctttagtgcgcaatcctctatcacgcaattccactcacgaaatgtattgggtgagtaacgcaactggaaacattgtcagcagcgtaaacatgatatctaggatgttaataaaccgtttcacgatgaaacataaaaaggcgacatatgagccggatgtggacctaggaagtggtaccagaaatattgggattgaaagcgagatcccaaatctagacattataggaaagagaatagagaaaatcaaacaagagcatgaaacatcatggcattatgatcaagatcacccatataaaacgtgggcgtaccacggctcctatgaaaccaagcagactggaagcgctagctcgatggtcaacggagtggtacgacttttaactaagccttgggatgttgtaccaatggtaacccagatggcaatgacagatacgacgccattcggtcagcagagagtatttaaagaaaaagttgatacacgcacccaagagccgaaagaaggaacaaagaaacttatgcgtatcacggcggaatggttatggaaagaactagggaagaagaaaacaccgagaatgtgcacgcgggaggaatttacaagaaaagtcaggtccaatgcagcattaggagcaatattcactgacgaaaacaaatggaagtcggcacgagaagctgtagaggatagtcgcttttgggaattagtggaccgagaacggaatttacacttggaaggcaagtgcgaaacctgcgtgtacaatatgatgggaaaacgagaaaagaaacttggtgaatttggaaaagcgaaaggaagtagagcaatctggtatatgtggttaggggcacggtttctagaatttgaagcactgggtttcctaaacgaggatcattggttctcacgggggaattctcttagcggagtagagggagaaggattacataggttaggatacatattgagggacgtaagcaagaaagagggtggagcaatgtacgctgatgacacagctgggtgggacacaagaattactttggaggatttaaagaatgaggaaatggtaactaatcatatggaaggggagcataaaaaattagcagaagcgatattcaaactaacataccaaaataaagttgtacgtgtccaaaggccaactccacgagggacagtcatggacattataagtagaaaagaccaaagagggtctggtcaagtcggtacttatggattaaacaccttcaccaacatggaagcacaactcattagacaaatggaaggagaagggatcttcaaatcaatccaacacctaacagtaactgaagaaatcgccgtacaaaactggctggctcgagttggtcgcgaaaggctctcgcgcatggccatttccggcgatgattgcgtagtcaaaccgttagatgaccgatttgcatcggcactaaccgcactgaatgatatggggaaggtaagaaaagatatacaacaatgggagcctagcagaggttggaatgattggactcaagttccattctgttcacatcacttccatgaactggtgatgaaagatggacgtgtcctagtcgtcccgtgcagaaaccaagacgaattaataggtagagctcgaatttcccaaggagcagggtggagcctgaaagaaacagcatgtcttggaaaaagttatgcccaaatgtggacattaatgtatttccacaggagggacctacgattagccgctaatgcaatttgttctgcggtaccttcacattgggtaccgacatctagaacgacatggtccatccacgcaaagcacgagtggatgacaaccgaagatatgttggcagtctggaatcgagtatggattcaagaaaatccttggatggaggacaaaactcctgttgagagttgggaagaagtaccatatcttggaaaacgggaggatcagtggtgtggcagtttaatcggactgacaagtcgagctacctgggctaagaatattcaaacggcaatcaaccaagtacgatccctaataggaaacgaagagtatacagactacatgccaagcatgaagagatttcggagggaggaagaagaagcaggagttctatggtaa

SEQ ID NO: 22186 - RNA, 9876 nt, synthetic construct
  misc_feature 1..9876: note = derived and/or modified CDS sequence (opt6) from DENV-2__JX669479__SS-prME
  source 1..9876: mol_type = other RNA
actgcaggagtaatagtaatgttaatacccactgcaatggcatttcacctaactacgcgaaatggtgaacctcatatgatagtcggaaggcaagaaaaaggtaaaagtcttttatttaaaaccgaagatggcgtgaatatgtgcaccttaatggccatagacctaggcgaactatgtgaagatactattacgtacaaatgtccgttactacgccaaaacgaacctgaagatatcgattgttggtgcaatagtacgagcacatgggtgacatatggtacttgcactaccacgggcgaacatcgacgagaaaaacggtcagtagcattagtaccacacgtaggtatgggtctggaaacacgtacagaaacgtggatgtctagtgaaggagcatggaaacatgtacaacgaatagaaacatggatcttaaggcatccaggatttacaattatggccgcaatacttgcttacaccatagggacaactcatttccagcgagcattaattttcatcctattaacagccgtagcgccaagcatgactatgagatgtataggaataagcaacagagatttcgtcgaaggggtatccggaggtagttgggtagatattgttctagaacatggtagttgtgtaactactatggcgaaaaacaaacctacattagacttcgaattgatcaaaactgaagccaaacaacccgcgacacttaggaaatattgtatagaagcaaaattaacaaataccacaactgaatcacgatgccctactcagggcgaaccgtcgctaaatgaagaacaggataaacgattcatatgcaaacattcaatggtcgatcgagggtggggaaatgggtgcggactattcggtaaaggaggaatagtaacatgcgccatgttcacatgtaagaaaaacatggaaggcaaaattgttcaatctgaaaatctagaatatacaatagttataacaccgcattcaggtgaagaacacgccgtcggaaatgataccggtaaacacggcaaagaaatcaaaataactccacaaagctccacaactgaagcggaattaacaggatacggaacagtgacaatggaatgctcaccaagaacaggtcttgatttcaacgaaatggtcctactacagatggaggataaagcctggttagtacatcgacagtggttcctagacttaccacttccatggttaccaggcgccgacacacaaggaagtaactggatacaaaaagaaacactcgtaacgttcaaaaatcctcatgccaagaaacaggacgttgtagtacttggatctcaagagggagcgatgcacactgccctaacaggcgcaacagaaattcaaatgtctagtggaaacctgctatttacaggacatcttaaatgtcgactcagaatggataaactccaactaaaaggaatgtcttattcaatgtgtacaggtaaattcaaaatagtaaaagagattgcggaaactcaacacggtacgattgtaattcgcgttcaatacgaaggcgatggcagtccatgtaaaatacctttcgaaataaccgatttagagaaacgtcatgtactaggcagactaattacagtaaatccaattgttactgaaaaagactcaccagtgaacatcgaggcagaacctccctttggcgattcttacataatagttggagtcgaaccaggacaactaaaactaaattggttcaagaaagggtcatctataggacaaatgttcgaaactacaatgcgaggcgccaagcgaatggcgattctaggcgacactgcctgggactttgggtcgctcggaggagtatttacctctattggtaaagcacttcatcaagtgtttggtgccatctacggtgccgccttctcaggggtaagctggactatgaaaatcttgatcggtgtaattataacatggataggaatgaatagcagatcaacatcgctcagcgtttctttagtacttgttggtgtggtaaccttatatctgggcgccatggttcaggctgacagcggatgcattgtatcatggaaaaacaaagaactaaaatgcggatcaggcattttcataactgacaacgtacatacatggacggagcaatacaaatttcaaccagaatctccatctaaactagcatcggcgatacaaaaagcgcatgaagaaggaatctgcggaataagaagtgttacgcgactcgaaaatctgatgtggaagcaaattacaccggaactaaaccacatattgtcggagaacgaagttaaacttacaataatgactggagacatcaaagggataatgcaagcaggtaagagatcactgagaccccaacctacagaactaaaatacagctggaaaacgtggggcaaagccaaaatgttaagtacagaaagccataaccaaacatttttgatagatggacctgaaacagcggaatgtccgaacacaaacagagcatggaactctctagaagtagaagactatggatttggagtattcacaacaaatatctggctaaaactacgagaaaaacaggacgtcttttgtgattcaaaattaatgtcagccgctataaaagataaccgggcggtacatgcagacatgggttattggatcgaatctgctctcaacgatacatggaaaatggagaaagcatcgttcatagaggtaaaatcttgtcattggcctaagtcacacaccttatggtcaaatggtgtattagaatcagaaatgattattcctaaaaattttgcgggcccagtctcccagcataattaccgcccaggataccatacacaaacggctggaccatggcatttgggtaaattggaaatggattttgatttttgtgaaggtacgactgtggttgttaccgaagactgcggtaacaggggtccatcattaagaaccacaactgcttcaggaaaactgataactgagtggtgctgtcgatcctgtactttaccacctcttcgttatcgcggtgaagatggttgttggtatggcatggaaataagaccactaaaggaaaaagaggagaacctagtcaactctctagtaaccgccggacacggtcaaatagacaacttctcattgggagtccttggtatggccttattcctcgaagagatgttaagaacacgggtgggaacaaagcacgcaatactgttagtggccttgtcattcgtaactttaattaccgggaatatgtctttcagagatttgggtcgtgtcatggtaatggttggggcaacaatgacagatgatattggcatgggggttacctacctagcattattagcagcgttcaaagtcaggcccactttcgcagctggtttactattaaggaaattaacatccaaagagttaatgatggcaacaataggtattgctctacttagtcaaagtaccttaccagaaaccattttagaattaacggacgcactagcactaggtatgatggcgttgaaaatagtaaggaatatggaaaagtaccagttagcagtgaccataatggcaatcagttgtgtccccaacgctgttattttacaaaatgcttggaaagtctcatgcacaattcttgcggctgtttctgtttccccgttattgcttacctctagtcaacaaaaagctgattggattccactggcccttaccatcaagggattgaatccaacagcgatctttcttactacactatctcgtacaagtaagaaacggagctggcctttgaacgaagccataatggcggtcggaatggtttctatccttgcctcgtcgctactcaaaaacgatatacctatgacaggaccacttgtggccggcggactcctaacagtatgctatgtgttaacagggcggagtgcagacttagaattggaacgagcggcagacgtaaaatgggaagatcaggcagaaataagtggttcctcaccaattttaagcattacaataagtgaggacggctcaatgtcaataaagaacgaggaagaagaacaaactctaacgatactcatccgaacaggattattggtaatttcgggagttttcccagtatcaataccaataacggcagcagcatggtacttatgggaagtgaagaaacaaagagctggagtgttatgggacgttccaagcccacccccagttgaaaaggcagaattagaggacggggcatacaggataaagcaaagaggtattttggggtacagtcaaataggcgctggggtatacaaagaaggtacattccacacaatgtggcatgtcacacgcggagcagtgttgatgcaccggggaaaaagaatcgagccatcatgggcagatgttaagaaagacttaatatcttatggaggaggatggaagctagagggtgagtggaaagaaggcgaagaagtccaagtattggcattagaaccaggaaagaatccccgggcagttcaaacaaagccaggtatattcaaaacaaatacgggtactattggagcggtaagtcttgattttagcccaggtacatcaggctcgccgatcgtagatcgaaagggcaaagtcgtaggcttatatgggaacggcgttgtaacaagatccggcgcatatgtctcagcaattgctcaaacagagaaaagtatagaagacaatccagagatagaggacgacatcttcagaaagaaacgactgacaataatggacttacacccgggtgccggaaaaacaaaacgttacttacccgcaatagtaagggaagcgataaaacgaggattgagaactttaattctagcgccaacgcgagtcgttgcagcggaaatggaagaagcactaagaggcttacccattcgataccagactccggcaataagagctgagcatacaggccgtgaaatagttgatttgatgtgccatgctacgtttacaatgagattattaagtccagtccgagttcccaattacaatttgataatcatggatgaagctcactttacagatccagcttctatagcagctagaggatacataagtacgcgggtagaaatgggagaagcggcagggatattcatgacagctacgccaccaggtagtcgcgaccccttcccgcaaagtaatgcacccataatggatgaagaaagagaaataccagaaagatcatggaactcgggacatgaatgggtgacagattttaaaggtaagactgtttggtttgttcctagtataaaggcagggaacgatattgctgcatgtctgaggaaaaatggcaagaaagtaatccaattatcgagaaaaacattcgatagcgagtatgttaaaactagagcaaacgactgggattttgtcgtaacaaccgacatctccgaaatgggagcaaactttaaggctgaacgagtgattgatcccagaagatgtatgaaacccgtcatcttaactgatggtgaggaacgagttattcttgccggcccaatgccagttacgcattcaagcgcagcacaaagacgaggcagaatcggtcgaaaccccaaaaacgaaaatgatcagtatatatatatgggagagccattagaaaacgatgaagactgcgctcattggaaagaagcgaagatgttgctagataatataaatacacctgagggcataatcccctccatgtttgaacccgaacgtgaaaaagttgacgccatcgatggagaatatcgactacgtggagaggctaggaaaacattcgtcgatttgatgcgaaggggtgatcttccggtatggcttgcgtataaagtcgcagctgaaggaatcaattatgccgatagaaaatggtgttttgatggaattaaaaacaaccaaatattagaagaaaacgtagaagtagaaatctggacaaaagaaggcgagagaaagaaattaaaaccacgatggctcgatgctaggatctactcagatccattggcgctcaaagagtttaaggaatttgctgcaggaaggaaaagtttgacgttaaatctcattacggaaatgggaagattacccacgttcatgactcagaaagcaagaaatgcattggacaatcttgcagtattgcataccgctgaagtaggagggcgagcgtacacacatgcactaagtgaacttcctgaaacacttgaaaccctactcttactaacactactagcagcggtaacaggaggaatcttcctatttttgatgtcgggaaaaggaattggaaaaatgactttaggaatgtgttgcataattaccgcttccatattattgtggtacgcacaaatccaaccgcattggatagcagcaagtataattttagagtttttcctaatagtactattaattcccgaacccgaaaaacaaagaacgcctcaagataatcaactcacatatgtagttatagccatactaacagttgtagcggcgactatggcaaacgaaatgggatttcttgagaagactaagaaagaccttggttttggaagcatcacaacacaggaatcagaatctaacatactagacattgacttgagaccagcatcggcctggacgttatacgctgttgcaactacattcgttactcccatgctaagacattcaatagaaaactcctctgttaacgtatcactaaccgcaatagcaaatcaagcaacggttctaatgggattaggtaagggttggcccctttctaaaatggatataggtgtaccactcttggcgatcggctgttactctcaagtcaaccccatcacattaacggcagctttgttattactggtggcccactacgcaattataggacccggattacaagcgaaagcaacgcgcgaagctcagaaaagggcagcagcaggtattatgaaaaaccctactgtagacggcataacagtgatagatttggaaccaattccgtacgaccctaaattcgaaaaacaactgggacaggttatgttgcttattttatgcgtaacacaagtactaatgatgaggacaacatgggcattatgcgaagctcttaccctcgccaccggcccaatatctacactctgggaaggtaatcctggcaggttttggaataccaccattgcagtgtcaatggctaatatattcaggggaagctatttggccggtgctggattgttattctctataatgaagaatactacaaacacaagacgcggaaccggaaacgtaggagaaacactaggtgaaaaatggaaaagtagactgaaagcgttgggaaaatcagagttccaaatatacaaaaagagtggtattcaggaagtggataggacacttgccaaagaaggtattaaacgtggagaaaccgaccatcatgcggtgtcgagaggaagcgccaagctgagatggttcgtagaaagaaacatggtgacaccagaagggaaagtagttgatttgggatgtggccgtggaggatggtcgtactattgtggaggtctgaagaacgttagagaagttaaaggattaacgaaaggaggcccagggcacgaagaacctatcccaatgtcgacatacgggtggaatctagttagactccagagcggtgtcgacgttttcttcacacctccagaaaagtgtgacacactgctatgtgacattggcgaaagctcacctaatcctactatcgaagcagggagaactttacgggtgctgaacctcgtcgagaactggttaaataacaatacacagttttgtataaaagtattaaacccatatatgccctcagtaatcgagaaaatggaaactttacaaaggaagtacggcggagcgctcgtccgaaatcctctgtcacgaaactctacacacgagatgtattgggtctcaaatgcaaccggtaatatagtctccagcgtgaacatgatttccaggatgttgataaacagatttacaatgaaacacaaaaaggcaacatatgaacccgacgtggatctcggctcgggcactcgtaacatagggatcgaatcagagataccaaacttggacattataggaaaacggatcgagaaaataaaacaagaacatgagacaagttggcactatgaccaagaccatccatacaaaacctgggcctatcacggaagttacgagacgaaacagacaggcagcgctagtagtatggtgaatggagtagtgcgtctgttaacaaaaccatgggacgtagtaccgatggttactcagatggcaatgacagatacaacgccattcggccaacagcgagtattcaaggaaaaagttgatacacggacccaagagcccaaagagggaactaaaaagctcatgaaaataacagcagaatggttatggaaggagttaggtaaagagaaaactccgagaatgtgcacaagagaagagttcacacgaaaggtacgatcgaatgctgctctcggagcggtttttacagatgaaaacaagtggaaatccgccagagaagcggttgaagatggaagattttgggagctagtagatagggagagaaatctacatctagagggaaagtgcgagacttgtgtctataatatgatgggtaagcgtgagaagaaactgggcgagtttggcaaagctaaaggatcaagagcaatttggtatatgtggttgggcgcgcgcttcctagagttcgaagcacttggatttttgaacgaagatcattggttttctcgtgggaatagcttgtcaggtgtagaaggagaaggacttcatagacttggttacatattacgggaagtcggcaagaaagaaggaggagctatgtatgcagatgatacagcaggttgggatacaagaataacactagaggacctcaaaaatgaagaaatggtaacaaatcatatgaaaggagaacacaagaaattagctgaagcgatatttaaattgacctatcagaacaaagtggttcgagtacaacggcctactcccaggggaactgtcatggatattattagtcgaaaagaccagcgaggaagtggacaagtaggaacgtacggattaaatacattcacaaatatggaggcacagctcataaggcaaatggaaggagaggggatcttcaaatcgattcagcatctaacggcaactgaagaaattgctgtacagaactggctagccagagtaggccgagagaggctgtcaagaatggcaatatcaggcgatgactgtgtggtaaaaccaatagacgataggtttgccagcgcacttacagctttaaatgacatgggtaaagtaaggaaagacatccaacagtgggaacctagtagaggttggaatgattggactcaagtcccattctgtagccaccacttccatgagcttgtaatgaaagacggtagagtacttgttgtaccatgccgcaatcaagacgaattgattggacgagccagaatcagtcaaggtgccgggtggagccttaaggaaactgcctgtctaggaaaaagctatgcccaaatgtggaccctaatgtatttccatcgtcgtgacttacgtctagccgccaacgcaatatgtagcgcagtgccgtcacactgggtgccaacaagtcgaactacttggagcattcatgcaaaacacgaatggatgacaactgaagacatgctcgcggtatggaatcgcgtctggatacaagaaaatccctggatggaggacaaaacccctgttgaaagctgggaggaagtaccatatctaggaaaacgcgaagaccagtggtgtggttctctaataggtctaacttcgcgagcaacctgggccaaaaacatacaaaccgcaataaaccaggttagatcattaatagggaacgaaggatatactgactacatgccaagtatgaaacgctttcgtagagaagaagaagaagccggcgttctatggtaa

SEQ ID NO: 22187 - RNA, 9876 nt, synthetic construct
  misc_feature 1..9876: note = derived and/or modified CDS sequence (opt6) from DENV-2__KF744403__SS-prME
  source 1..9876: mol_type = other RNA
actgcagggatgataataatgttgatcccaacagtgatggcattccacctgacgactcgtaatggagaacctcatatgattgtctctagacaggagaaaggaaaaagtcttttattcaaaacagaagatggagtcaacatgtgtacattaatggctatggacttgggagaactttgtgaagatacgataacatataaatgccctcttctgagacaaaatgaaccagaagatatagattgttggtgtaattcaacatcaacgtgggtgacatacggcacatgtacaacaacaggagaacacagaagagaaaaacggtcggttgcacttgtccctcacgtcggaatgggtctagaaaccaggacagaaacatggatgagctcagaaggcgcatggaaacatgcacaacgcatcgagacgtggatcctcagacatccagggtttactttaatggctgctatattagcatacacaatcggaacgacgaactttcaaagagcacttatttttatcttattaacggccgtcgccccaagcatgaccatgcgatgtataggtatctccaatcgcgacttcgtagaaggggtcagtggcgggagttgggttgatattgtactagagcacggatcctgtgtcactacaatggccaaaaataaaccaacactagatttcgaactgataaaaacagaagcaaaacagcctgccacactcagaaaatattgtatagaagctaaactaacgaatacaacaaccgaatctaggtgtcctactcaaggtgaaccaagcctaaatgaagaacaagacaaacgattcgtttgcaaacattctatggtcgatagaggttgggggaatggttgcggacttttcggtaaaggtggaatcgtaacctgtgctatgttcacatgtaagaaaaatatggagggtaaaatcgtacaaccggaaaacctcgaatatacaatagttatcacgccgcatagcggagaagaacatgccgtaggcaacgataccggaaaacatggtaaagagattaaaataacgccccaatcctccataacagaagccgaattaacgggttatggaacagttacaatggagtgctcccctagaactggattggattttaacgagatggtattattgcagatggaaaacaaagcatggctggtgcacaggcaatggtttctcgatctccccctaccttggctaccgggagcagacactcaaggttccaattggattcaaaaagaaacgctagtgacgtttaaaaaccctcacgccaagaaacaggatgttgtagtccttggatcacaagagggcgcaatgcatactgcgttaacgggcgcaaccgagatacagatgagctcagggaacctcttatttacagggcacttaaaatgtaggttacgaatggataaactacagttaaaaggaatgtcttattcgatgtgcactggaaaattcaaagtagtaaaagaaattgctgaaacacagcatggtacaattgtcgtaagagtccagtacgaaggggatggctcaccatgtaaaataccttttgaaataatggatttggagaaaagacacgtgttaggacgcttaataacagtgaacccgatagtcacagaaaaagacagtccagtaaacattgaagctgaaccacctttcggtgatagttacgtaattattggtgtagaaccaggtcaattgaaactaaactggtttaagaaaggtagttctatagggcaaatgtttgagacgactatgagaggcgctaaaagaatggctatactaggagacacagcgtgggatttcggctcactaggcggcgtttttacaagtattggtaaagcattacatcaggtgttcggagcaatatacggcgctgccttttcaggggtaagttggacgatgaaaatacttataggggttattataacatggatcggcatgaactcaagatccacatcattatcagtatcattggtcttagttggagtggtcacgctttatttaggtgtcgtcgtacaagccgactcagggtgtgtagtttcttggcgaaataaagaacttaaatgtggatctgggatttttataacagataatgttcacacgtggacggagcaatataaattccagccagaatccccttcaaaattggcttcagcgatacaaaaagcgcaccaagaaggaatctgcggaatacgctccgtgacaagactcgaaaacttgatgtggaaacaaattacacctgaattaaatcatattctctctgaaaatgaggtaaaactaactattatgacgggggatatcaaaggaattatgcatgccggaaaacgttcgctccggccacaaccaacagaactacgatattcttggaaaacttggggcaaagccaaaatactcagtactgaaagtcataaccaaacatttctcattgatggaccagaaacggctgagtgcccaaacacaaatagagcatggaactcactagaggtagaggattatggttttggagtattcaccacaaatatctggcttaggttaagagaaaaacaagatgcattctgcgactccaaactcatgagtgcagccataaaagataatagagctgtacacgcggatatgggttactggatagaatcggccctaaatgatacttggaagatagagaaggcaagtttcatagaagtaaagtcatgccactggccaaaatcacatacactgtggagtaatggagttctagaatctgaaatgataataccaaagaattttgcaggaccagtaagtcaacataactatcgccccggataccatacgcaaaccgcggggccttggcacttagggaaactagagatggattttgatttttgtaaagggacgactgtagttgtcactgaagattgtggaaatagaggaccctcattaagaactactacggccagtggtaagttgataacagaatggtgttgtcggtcatgtacactcccaccattacgttatagaggtgaagatgggtgctggtacggtatggagataaggcccctcaaggagaaagaagaaaatctcgtttccagcttggtcacagctggtcacgggcaaatcgataatttcagtttaggtgtcttagggatggctttgtttctagaagaaatgctcagaacacgagtcggaacaaaacatgcgatcctattagtcgccgttagtttcgtgactttgattacggggaacatgtcttttagagacctaggcagagttatggtgatggttggtgccacaatgacagatgatataggcatgggcgttacttatttagcgcttttagccgcgtttaaggtacgaccaacatttgctgcaggattattgctacggaaattaacatcaaaagaattaatgatgacaactataggaatagttcttctaagtcaaagcactataccagagactatcttagaattaaccgacgctcttgcattgggaatgatggtattaaaaatagtgaggaagatggaacgctaccagttagcagttactataatggcaattttgtgtgtgccgaacgcagtgattctgcagaacgcatggaaagtgtcgtgcaccatcctcgcagttgtgtcagtatcacctttgttgttaacctcatcccagcaaaaggcagactggatacccctagctctcactataaaaggactgaatccaaccgcaatattccttacaactttgtcaagaacaagcaagaaacgtagctggccattaaacgaagcaataatggcagttggtatggtatcaatacttgcttcatcactattaaagaatgacattcctatgaccggtcccctagtggctggtggattactgacagtgtgctacgttctgacaggtcgctctgcagatttagaactagaaaaagcagcggacgtgaggtgggaagatcaagcagaaatttcggggtcgtctcctatactgtctatcataataagtgaagacggttctatgagtatcaaaaatgaagaagaagaacaaactttgaccatactaattagaacagggttattagtaatatccggtctattcccagttagtataccaattaccgccgcagcatggtatttatgggaagttaagaagcagcgagcaggcgtgctttgggatgtcccctctccaccgccagtaggcaaagcggaactagaagatggagcgtacaggataaaacaaaagggaatcttgggatactctcaaattggtgcaggagtgtacaaggagggcaccttccataccatgtggcacgtaactcgaggggctgtacttatgcataaaggtaagagaatcgaaccatcctgggcagacgtaaagaaagatttgatctcatatgggggaggttggaaactagaaggcgaatggaaagaaggagaagaggtacaagttctcgcattagaaccaggaaagaatccaagagctgtacaaacaaaaccaggtttattcaaaacaaacgcaggcactatcggagcggtttccttggatttttcaccaggtacttctggctcaccaataatagataagaaaggaaaagtcgtaggtctttatggaaatggtgtagtaacaagaaatggtagctatgtatctgctatagcccaaactgagaagtccattgaagataatcctgaaattgaggacgatatttttagaaagaaacgacttactataatggatttgcatcctggggctggtaaaacgaaaaggtacctaccagcaatcgtgagagaagcaattaaaagaggattgcgtacactaattctggcacctactagagtggtggctgccgaaatggaggaagctctaagaggtcttccaataaggtaccaaaccccagcgataagggcagaacacacaggcagagagatcgtagatctaatgtgccacgcgacctttacgatgcgcctacttagccctatcagagtacctaattacaacttaataataatggatgaagcgcattttactgatcctgcatctattgcggcacgaggttacatctcaaccagagtagagatgggagaagctgcagggatatttatgactgccacgccacccggtagtcgagatccttttccacagagtaatgctccgataatggatgaggaacgcgaaattccagaaagatcgtggaactctggacatgaatgggtaacggactttaaaggaaaaacagtatggttcgtacctagtattaaagctggcaatgatattgcagcatgcctaaggaaaaacgggaagaaagtaattcaattgagtcggaaaactttcgatagtgaatacgttaaaacaagaactaacgattgggatttcgtagtgacaacggatattagtgaaatgggtgcaaacttcaaagctgaaagagtcattgaccctagaagatgcatgaagcccgtgattctgactgacggtgaggaaagggtgatactcgccggaccaatgcccgtaacccatagctcagcagctcaacgacggggccgaattggaaggaaccccaaaaacgaaaacgatcagtacatatatatgggcgaacccctcgaaaatgatgaggactgtgcacattggaaggaagcaaagatgctcttagataatataaacacaccagaaggaattataccctctatgtttgaacctgaaagggaaaaggtcgacgcaatagatggagagtatagattgagaggtgaagcgcgaaagactttcgtggatttaatgcgacgaggcgatctacctgtctggttagcatataaagtagccgcagaagggataaactacgcggatagacgttggtgttttgatggaataagaaataatcagatactagaagagaacgtagaagtagagatatggacaaaagaaggggaaaggaagaagttgaaacctagatggcttgacgcccgtatatatagcgatccgctcgctcttaaggaatttaaagagtttgcagcgggtagaaaaagtctgactctaaacttgattacggaaatgggaagactaccgacatttatgactcagaaagcaagagacgccttggataacttagcagtgttgcatactgccgaagccggcggccgagcgtacaaccacgcccttagcgaactacccgagacactcgaaattttattactattaaccttacttgcgaccgtaacaggcggaatcttcttgttcttaatgtctggaagaggtataggaaaaatgacactaggaatgtgttgcattataactgcaagcattctactatggtatgcacagattcagccacactggatcgctgcatctatcattttggagtttttcctaattgtacttttgatacccgaaccagaaaaacagagaacaccccaagacaatcaactaacttatgtagtcatcgcgattctcactgtagtagcagctactatggccaatgaaatgggatttctcgagaaaaccaagaaagatctaggactagggtcgataactactcaacaaccagaatcaaacatcctcgatatcgacctgcggcccgcatccgcctggacattgtacgcagttgccacaactttcataacacctatgttacgccacagcattgagaacagcagtgtaaatgtgagtctaactgcaatagctaatcaggcaacggttttgatgggccttggaaaaggatggccactatctaaaatggatatcggggtcccattgttagcaatagggtgttatagtcaagtaaacccaataacactgacagctgcactattacttttagtggcacattacgcgataataggacctggacttcaagccaaagctacgagagaggcacaaaaacgcgccgccgcaggaataatgaagaaccctacagttgatggaatcacggtcatagatcttgatccaataccttatgatcctaagttcgaaaagcaactaggtcaagtcatgctattagtcctatgtgttacacaagtgttaatgatgcgtacaacttgggcactatgtgaagcacttacactggctacaggtcccatctccacactctgggaagggaaccccggtagattctggaataccactatagcagtatcaatggctaatatatttagaggatcttatctagctggtgccggactgctattttccataatgaaaaacacaactaacacccgcagaggtaccggaaatatcggtgaaacgttaggtgagaaatggaaatcacgcttaaatgctctggggaaatcggaatttcagatatataagaaatctggaatacaggaggttgatagaacattagctaaagaaggcataaaaagaggtgaaactgatcaccacgctgtgagtaggggtagtgcaaaactccgttggtttgtagaacgaaacatgattaccccagaaggcaaagtggtagatttgggatgcggcagaggtggatggagttactattgcggagggttaaagaacgtgagagaagttaaaggcctaaccaagggcggtccgggccatgaagaaccgattcctatgagcacatatggctggaatctcgtcaggctacaaagtggtgttgatgtattctttactccaccagaaaaatgtgatactctcctgtgtgatataggtgaatcttcaccaaatcctacggttgaggcaggtagaactctgagagttcttaacttagtagaaaattggctcaataataatacgcagttttgtataaaagtattgaatccttacatgccaagcgtaattgagaaaatggaagccttgcagaggaaatatggaggtgcgttagtaaggaatcctttgtctagaaatagtacgcatgagatgtattgggtatctaatgcctcaggaaacatcgtttcttctgttaatatgatatcacgaatgttgatcaataggtttacgatgaaacataagaaagcaacgtatgaacctgatgtcgaccttggatctggtacgagaaatatagggatcgaaagcgaagtcccaaatttagacatcataggtaagaggatagagaaaataaagcaggaacatgaaaccagttggcactatgatcaagaccatccatacaaaacatgggcatatcatggatcatacgaaacgaaacaaaccggatcagcgtcttcgatggtaaatggggtggtcaggttactaaccaaaccgtgggacgtaatacctatggttactcagatggcaatgacagatacgacaccattcggacaacaaagagtcttcaaagaaaaggttgatactagaactcaagagcctaaagaagggaccaagaaactaatgaaaataacagcagaatggttatggaaggaacttggtaagaagaaaactccacgcatgtgtacaagagaagaatttacaagaaaagtgagatcaaatgcagccttgggcgcaatatttacagacgaaaacaagtggaaatcagcgagagaagcagtagaagacagtagattctgggaactggtcgataaggagaggaatttacatttagaaggtaaatgtgaaacatgcgtttacaatatgatggggaagagagagaagaaattgggagaatttgggaaagccaaagggagcagagcaatatggtatatgtggttaggggcgagatttttggaatttgaagcgttagggtttctcaacgaagaccattggttcagccgagaaaatagcttatctggtgtcgaaggcgaaggactccataagctcggatacatcttgcgagatgtcagcaagaaagaaggaggggcaatgtatgcagatgatacagcaggttgggataccaggataacacttgaagacttaaagaatgaggaaatggtcactaaccatatggaaggcgaacacaagaaattagcagaagccatatttaaactaacctaccagaacaaggtagtgcgagttcagagaccgacacccagaggaaccgtaatggatatcatatcacgtcgcgatcaaagaggatcaggtcaggttgggacgtacggtcttaatacttttacgaatatggaagctcaattgatacggcaaatggagggtgagggggtttttaaatccatacagcatctaaccgcaacagaagaaatagccgttcaaaattggctcgcaagggtcggacgcgagaggttatcccgaatggcaatttctggagacgactgcgtcgtgaaacctcttgatgaccgttttgcttcagcactaaccgctttaaatgacatgggaaaagttcgaaaagacatacaacagtgggaaccatcgaaaggatggaatgattggactcaagtacctttttgctcgcatcacttccatgagctaataatgaaggacggtcgagtcttggttgtaccttgcaggaatcaagacgaattaattggacgggcacgaatttcccagggcgcaggctggagcttaagagaaaccgcatgcctaggcaaatcatatgctcaaatgtggtcactcatgtactttcatcgaagagacctcaggttagccgcgaatgcgatctgcagcgctgtcccttcacactgggtgcctacatcaagaacaacatggtctatccatgcaaaacacgagtggatgaccactgaagacatgttaaccgtatggaacagggtttggatccaagaaaatccatggatggaagacaaaacaccagttgagtcgtgggaagaaataccatatttgggcaaaagggaagatcaatggtgtggtagtctaatcggcttaacatctagagctacgtgggccaaaaacatacagaccgcaataaatcaagtccgatctctcatcggtaacgaagaatacactgactatatgccatccatgaaacgttttagacgggaagaagaggaagctggagtactatggtaa

SEQ ID NO: 22188 - RNA, 9876 nt, synthetic construct
  misc_feature 1..9876: note = derived and/or modified CDS sequence (opt6) from DENV-2__KF744406__SS-prME
  source 1..9876: mol_type = other RNA
acagcgggtatgattataatgttaattccgacagtgatggctttccatctgaccactagaaacggtgaaccgcacatgatagtgtctcgtcaagaaaaaggaaaatccttactatttaaaactgaagatggtgtaaacatgtgtactctaatggcaatggatttaggagaactttgtgaggacactataacgtataaatgcccacttttacgccaaaacgaacctgaagatatagattgttggtgcaactcaaccagtacatgggtaacatatggaacatgcactactacaggtgaacatagaagagagaaaagatctgtggcattagttccgcacgtaggaatgggcttagaaactcgaactgaaacatggatgtcatcagaaggagcatggaaacatgctcaaagaatagaaacatggattcttcgacacccaggattcacacttatggcagcaatattggcatataccatcggaaccacaaatttccaacgagccttaatatttatccttctaactgcggtcgcaccttcaatgactatgagatgtattggaataagcaatcgagattttgtagaaggcgtttccggagggagttgggtagacatagttctagagcatggttcatgcgtaacaacaatggccaaaaataaaccaacccttgatttcgaattgataaaaactgaggctaaacagccggctacacttcgaaaatactgtatagaggctaaattgacaaacactacaacagaatcccgctgccctactcagggggagcctagtttaaatgaggaacaagacaaaagattcgtatgcaaacattcaatggttgataggggctgggggaacggatgcggtttatttggtaaaggcgggatagttacctgtgccatgtttacttgtaagaaaaacatggaaggaaaaatagttcaaccagaaaacttagagtacacgattgtaataacaccgcatagtggagaagaacacgcagtcggaaacgataccggcaaacacggaaaagagataaaaataacaccccagtcgtctataacagaagcagaactcacaggttacggcacagtgactatggaatgcagtcctcggacaggccttgactttaacgagatggttttattacaaatggaaaataaggcctggctcgttcatagacaatggttcttagacctaccattgccatggttgccaggagcggacacacaagggtctaattggattcaaaaagaaacgttagtaacattcaagaacccgcatgccaagaaacaagatgtcgtggtgttgggatcacaggaaggagctatgcatacggcattgaccggagccaccgaaatacagatgagctcgggaaatctactcttcacggggcacttaaaatgtcgtctcagaatggataaattacaattaaaaggcatgtcctacagtatgtgtaccggtaagtttaaagtcgtgaaggaaatagccgaaacccaacacggcactatagtcgtccgtgtgcaatatgaaggtgacggttctccatgcaagatcccatttgaaataatggatttagagaaacgacatgtattgggacgattaattactgtgaatccaatcgttactgaaaaagattctcctgtcaacattgaagcagaacctccctttggggattcatatgtaataataggagttgagcctggacaattaaaactgaattggtttaagaaaggaagcagtatagggcagatgttcgaaaccacaatgcggggagcaaaacgaatggccatattaggtgatactgcatgggactttggaagccttggaggtgtattcacatcaattggaaaggccttacatcaagtcttcggtgcaatatatggcgcagcattctcaggagtttcatggactatgaaaatattaattggtgttattataacctggatagggatgaacagtagaagtacatctctcagtgtttcgttagtactcgtcggggtagtgacactttatcttggcgttgtagtacaggctgattccgggtgcgtggtttcgtggagaaataaagaattaaagtgtgggagcgggatttttataacagataatgtacatacttggacggaacaatacaagtttcaaccagaatctcccagtaaactagcatcagctatacaaaaagcacaccaagaaggaatttgcggaatcaggagcgttacacggttagaaaacctaatgtggaaacaaataacgcccgaattaaaccatatactatcagagaacgaagtaaagttaaccataatgacaggggacatcaaaggtataatgcacgctggtaaaaggtcattaaggccacaaccaactgagcttaggtattcatggaaaacctggggaaaggccaagatccttagtacagaaagccacaaccaaacatttctaatcgacggcccagaaacagccgaatgccccaacacaaatagagcctggaactcactagaagttgaggactatggattcggcgtgtttacaacaaatatctggctgagattacgtgagaaacaagacgcattctgcgacagtaaattgatgagtgcagcaattaaagataaccgagctgtgcatgcggatatggggtactggatcgaatctgcactgaacgatacgtggaagattgaaaaagcatcatttatcgaggtaaaatcttgccactggcctaaatcgcacacactatggtctaacggcgttttggaaagtgaaatgatcatacccaaaaatttcgcgggaccagtatcccaacataattaccgtccaggatatcatactcaaacggccgggccatggcaccttggaaaacttgaaatggactttgacttttgcaaagggacaacagtggtggtaacagaggactgcggtaatagaggaccatcactcagaaccacgactgcatcggggaaactgattacagaatggtgctgcagaagctgcaccttgcctccattacgatatagaggtgaagacggctgctggtatggaatggaaataagacccttaaaggaaaaggaggaaaatcttgtatctagtctggtcacagcaggtcatgggcagattgataacttttcattgggtgtcttagggatggcactatttttagaagaaatgctaagaacccgagtgggaacaaaacacgcaatactattagttgctgtatcgtttgtaacgctaattacagggaatatgtcgttcagagacttaggaagagtcatggtgatggttggtgcgaccatgactgatgatataggaatgggtgtaacatatttagcgttactggctgctttcaaagtccgcccaacctttgccgcgggtctactcttaagaaagttgacttcaaaagaattgatgatgaccaccattggaatcgtcttgctttcacagtctacaatacccgaaactatattagaactgaccgatgcgctcgcacttggaatgatggtgttaaaaatagttcgaaagatggagagatatcaactcgctgtaaccataatggccattctctgcgtaccaaacgccgtaatcttacaaaatgcttggaaggtatcgtgcacgatacttgctgttgtctctgtatcacctcttctattaacaagctcacagcaaaaggcggactggataccacttgcgcttacaataaaaggccttaacccgacggccatatttttaactacgctctccaggacatccaaaaagcgatcttggccattaaacgaagcaattatggctgtaggcatggtttccatacttgccagttcccttcttaaaaatgatatacctatgacaggccccctcgtcgcaggaggactattgacagtatgttatgtattaacggggcgttccgcagatttagagttagaaaaggccgctgatgtacgttgggaggatcaagctgagatcagcggatcaagtccaatattatcaataatcatatccgaggatggctctatgtctatcaaaaacgaagaagaagaacaaacgcttaccatactgatccgaactggtctacttgtaatatcagggctatttcccgtgtcaatccccataacagcagctgcttggtacctgtgggaagtcaagaagcaacgagctggagttctgtgggacgtcccatcgccgcctccggtagggaaagcagagctagaagacggagcttatcgtattaaacaaaaaggcatattaggttattcccaaataggagctggtgtatacaaagaaggtacattccatactatgtggcatgtgactaggggagccgttcttatgcataagggtaaacgtattgagccttcatgggcagacgtaaagaaagatttgatatcatatgggggagggtggaaactagagggagagtggaaagagggagaagaagtccaggtattagccttagaaccaggtaagaatccacgcgcagttcagacgaagccaggattatttaagacaaacgctggtacgataggtgcagtaagtttagacttctcgccaggtacaagcggatcacccataatagacaaaaagggcaaggttgtaggcttatatggtaacggggtagttacgcgaaacggatcgtatgtttcagcgatcgcacaaactgaaaagagcatagaggataatcctgaaatagaggatgacatttttagaaagaaacgattgaccataatggacttacatcccggcgcggggaaaactaaaagatacctcccggccatagtacgagaagcaataaaaagaggcctccgaactctaattctagcgccaacaagggtcgtcgccgccgaaatggaagaagccctacgtgggctaccaatcagatatcaaacacccgcaattagagcagagcacacaggaagagaaatagtcgatttaatgtgtcatgccaccttcacaatgcgactactcagcccgatcagagtaccgaattacaatttaataattatggacgaagcacactttactgatcctgcaagtatagctgcgcggggatatataagtacacgtgtagagatgggagaggcagctggaatattcatgactgcaacaccacccggtagtcgagatccttttccgcaatcaaatgctccaataatggacgaggaacgagagatacctgagcgatcatggaactctggacacgaatgggtgacagactttaaaggaaaaaccgtgtggttcgttccaagtatcaaagctggcaacgatatagcagcatgtcttaggaaaaatgggaagaaagtaatacaactgtctcgtaaaacttttgacagtgagtatgtcaaaacaagaacaaatgactgggactttgttgtgacgacggatatttctgagatgggagctaattttaaagcggagagagtgatagatccaagaagatgcatgaaaccagttatcctaacggatggcgaagaaagggtcatattagcaggaccaatgccagtcacgcatagtagtgctgcacaaaggcgaggtcgtattggaagaaatcccaaaaatgagaacgatcaatacatatacatgggagagccattagaaaatgatgaagattgtgcgcactggaaagaagcaaaaatgctgcttgataatatcaacacgccagaaggcatcatcccaagtatgtttgaacctgagagagaaaaagtagatgcaatcgatggtgaatacagattgaggggcgaggcaagaaagacatttgtcgatttaatgaggagaggtgatctaccggtctggttggcctataaagtggctgccgaaggtataaattatgccgacagaagatggtgcttcgatggtattaggaataatcaaatacttgaggagaatgtcgaagtagaaatatggaccaaagaaggtgaaaggaagaaactcaaaccacgatggctagatgcaagaatatatagcgatcctcttgcccttaaagagtttaaagaatttgcggcgggtagaaaatcattaaccttaaacttaataacagaaatgggtaggcttcctacattcatgacacaaaaggccagagacgccttggataacctagccgtgctacatactgcagaagccggtggtagagcatacaatcatgcactatctgaacttcctgaaacactagagataagcctgctcttaactctactagcaacggttactgggggaatattcctgttcctgatgagcggaagaggcattggtaaaatgactttaggcatgtgttgtataataactgcatcaatacttttgtggtatgcacaaatacaaccacactggatcgcggcgtcgatcatattggaatttttcctcatagtattacttatcccagagcctgaaaaacaaagaacccctcaagacaaccagctaacctatgtagttatagcgatcttaacagtagtagcagccacgatggctaatgaaatgggatttttagagaaaactaagaaagatctcggactgggaagtataaccactcaacagccagaaagcaacatcctagatattgatttgcgtccagcctcagcatggaccctctatgccgttgccaccacgttcataacgccaatgctgaggcatagtattgaaaactccagcgtaaatgtgtccctaactgcgattgcaaatcaagccactgttctaatggggctcgggaaagggtggccactatcaaaaatggacataggagtaccactgctagcaatcggatgctattcacaagttaacccaataactttgacagcagcattattactattagttgcccattatgcgataataggacccggactacaagccaaagcaacaagagaggctcaaaaacgcgcagctgcaggaattatgaagaatccaactgtagatggcataaccgtcatcgacttggaccccataccttatgatccaaaatttgaaaaacaactaggtcaggtaatgctcttagtgctatgcgtgacacaagtcctaatgatgcgcacgacgtgggcactgtgtgaagcattgactcttgctacaggaccaatctccacattatgggagggaaatccagggagattctggaatacaacgatagctgtatcaatggcaaatatattcaggggatcttacctcgcaggcgccgggctactatttagtataatgaaaaatactaccaatactcggagaggcactggtaatataggagaaaccttaggtgagaaatggaaatcgcgtttgaatgccctaggaaaaagcgagttccaaatatataagaaaagcggtatacaagaagttgacaggacgctggctaaagaaggtataaaaagaggagaaactgatcatcatgcagtttccaggggctctgctaaactcagatggtttgttgaacgtaacatgataacaccggaaggtaaagtagtcgatcttggctgcgggcgtggaggttggtcatattactgtggtggactcaaaaatgtaagagaagtgaaagggctaactaaaggagggcccggtcatgaagaacctatccccatgagtacgtacggctggaacctggtcagattacaatctggcgtagatgtatttttcactccaccagagaaatgtgacacattactatgtgatataggagaatcatcaccgaatcctacagttgaagcaggacgaactttaagggtattaaatcttgtcgaaaattggctcaacaacaacactcagttctgtataaaagtactcaacccctatatgccatcggttatagaaaagatggaagcgctacaacgaaagtatgggggagccttagtacggaaccctttaagccggaatagtacacatgagatgtattgggtatctaatgcctcgggcaatatagtttccagcgtaaatatgatatctcgaatgttaattaatcgatttacaatgaaacataagaaagctacgtacgaacctgatgtggacttaggatcaggaacgagaaatattggcattgaatcagaagtaccgaaccttgacataataggaaaaagaatagagaaaataaaacaagaacatgaaacgtcttggcattatgatcaagatcatccttataagacctgggcgtaccacggatcatatgaaactaagcaaacaggctcagcatcgtcaatggttaatggtgtggtacgactactaacgaaaccttgggatgtgatacctatggtaactcaaatggccatgactgacacaacaccatttggacaacaaagagtctttaaagaaaaagtagatactagaacacaagaaccaaaagaaggcaccaagaaattaatgaaaataaccgcagaatggctatggaaagaactaggaaagaagaaaacgcctcggatgtgtacgcgggaagaatttaccagaaaagtacggagcaacgccgcattaggtgcgattttcacggacgaaaacaagtggaagagtgccagggaagctgtagaggacagtcgtttctgggaacttgttgataaagaaagaaacctgcacctagaggggaaatgcgaaacttgtgtctataatatgatgggaaaacgtgagaagaaattaggagaatttggtaaagccaaaggaagcagggctatttggtatatgtggttgggggctcgatttttagagttcgaagccctaggatttttgaacgaagaccactggttttctagagaaaattctttaagcggagttgaaggagaagggctccacaaactagggtatatactaagagacgtttctaaaaaggaaggtggtgcaatgtacgccgacgatacagctggatgggatactagaatcacactagaagatcttaaaaatgaagagatggtaacaaatcacatggaaggagaacacaagaagctggccgaggcaatattcaaattaacttaccaaaataaggtagtgagggttcagcggccaacacccaggggtacagtaatggacatcatctcccgcagggatcagcgtggatctggtcaagtgggaacttatggattgaacacattcacaaatatggaagcgcagttaataagacaaatggaaggtgaaggtgtgttcaaatccatacaacacttaactgcaacagaagagatagccgtacaaaattggcttgcaagagtaggcagggagcgtctaagccgaatggcaatctctggagatgattgcgtagtaaaaccattagatgatcggtttgcctcggcgcttacagccctgaacgatatgggaaaggtaagaaaagacatacagcaatgggaaccctccaagggatggaatgattggacacaagtaccgttttgctcgcaccattttcatgaactaataatgaaggacggtagagttcttgtagttccttgtcggaatcaagacgagcttattggaagggcccggataagccaaggggcaggatggagtcttagggaaacagcatgcttgggcaagtcatacgcacagatgtggtcgctgatgtactttcacagacgggacttacgtttagccgccaatgccatatgtagtgcagtacccagtcattgggttccaacctcgcgaactacctggagcattcatgcaaaacacgagtggatgacgaccgaggatatgttaacagtatggaatagagtttggattcaggaaaacccatggatggaagataagacgcctgtcgagagttgggaagaaataccatatctaggtaaaagagaggaccagtggtgcgggtcactaatcgggctaacatcaagagcaacgtgggccaaaaacattcaaacagctataaatcaagtgaggagtttgataggaaacgaagaatacacggattacatgccgtctatgaaaagattccgtagagaggaagaagaagctggagtactgtggtga

SEQ ID NO: 22189 - RNA, 9876 nt, synthetic construct
  misc_feature 1..9876: note = derived and/or modified CDS sequence (opt6) from DENV-2__KF744404__SS-prME
  source 1..9876: mol_type = other RNA
acggctgggatgattataatgttaataccaacagtgatggcattccatctaacaacaaggaatggagaaccgcacatgatagtaagtagacaagaaaaaggaaaatccttgctatttaaaacagaagatggggttaatatgtgcacgctaatggctatggacctaggcgaactctgtgaagacaccataacctacaaatgtccattattacgacaaaatgaaccagaagacatagactgctggtgcaatagtacatctacgtgggtaacctatgggacgtgtacaaccaccggggaacaccgacgtgaaaaacgttcagttgcattagtgccgcatgttggcatgggactcgaaacgagaactgaaacatggatgtcctctgaaggggcatggaaacacgctcaaaggattgaaacatggatacttaggcacccgggattcacgttaatggctgcaatactggcttatacaataggcaccaccaacttccaacgtgctttaattttcatactcttgacagcggtagcaccaagtatgacaatgaggtgtataggaatatccaatagggattttgttgaaggtgtatcaggaggaagctgggtcgacatagtactggaacatgggtcctgtgtaacaacaatggccaaaaataaaccgacactcgatttcgaacttataaaaacagaagcaaaacaaccagcaaccttgagaaaatattgtatagaagccaaactgactaatacaacgacggaatctaggtgccctacacagggagaaccctccttaaatgaagaacaagacaaaagattcgtttgcaaacattccatggtcgaccggggatggggcaacggatgtgggttgtttggcaaaggtggaatagtaacgtgtgcaatgttcacatgtaagaaaaatatggaaggcaaaatagtgcagccagaaaacctcgaatatactatagtcattacaccccattctggcgaagaacacgccgttggcaatgatactggaaaacatggaaaagaaataaaaatcaccccacaaagctctatcaccgaagcagaattaacgggttatggaacggtcacaatggaatgtagtcctagaacaggcttggattttaatgagatggtattactgcaaatggaaaataaagcatggctagtgcacagacaatggtttctggatctccctctcccgtggctaccgggcgcagatactcaaggatcaaactggatacaaaaagaaactctagtgactttcaaaaatccgcatgctaagaaacaagacgtcgtagtattaggatctcaagaaggcgctatgcatactgctttgacgggcgcaaccgaaattcagatgtcaagtggaaacttacttttcacaggacatctaaaatgtaggttacgcatggataaactacaactaaagggcatgtcatactcaatgtgcaccggaaagttcaaagtggtaaaagaaattgcagaaactcaacatggcacaattgtggtgagagtacaatacgagggagatggctcgccatgtaaaatcccattcgaaataatggacctcgagaaaagacacgtattaggtcgcttaattactgtgaacccgatagtcacggaaaaagacagtccagtcaatatagaagcagaaccgccctttggtgattcttacgttataattggagtcgagccgggtcagcttaaattgaattggttcaagaaaggctcaagtatagggcagatgtttgaaactaccatgcgaggagcaaaacgcatggccattctaggcgacacagcatgggacttcgggtcgctcggcggtgtgtttacaagtatcggaaaagctctccatcaagtgttcggagcaatatatggcgcagcattctcaggtgtgtcatggacaatgaaaattctcattggagtcataataacgtggataggaatgaactctagatccacatcacttagtgtgtcgttagtcttagtcggagttgtcaccttatacctaggagtagttgtacaggccgattcgggatgcgtcgtctcttggagaaataaagagctaaaatgtggatctggcatatttatcactgataacgttcacacctggaccgaacaatataaatttcaaccggaatccccatcgaagttagcatcagcaatccaaaaagcacatcaagaaggaatttgcggaatacgaagcgtaaccagactcgaaaacttgatgtggaagcaaataacccctgaattgaaccacatcttatcagagaacgaagtaaaattgacaataatgacaggtgacataaaaggtattatgcacgcagggaagcggtctttgcgaccacaaccaaccgaactcaggtatagttggaaaacttggggtaaggccaagatattaagtacagaaagtcacaaccaaacatttctgatagacgggccagagacagcagaatgtccgaatacaaaccgggcttggaacagcctggaagtggaggattatgggtttggggtattcactacaaacatctggcttcggttgcgtgagaagcaagatgcattctgcgactcgaagttaatgagcgcagcaataaaagacaatagggccgtacatgccgatatgggctattggattgaatcggctctcaatgacacctggaaaatagaaaaagcatcatttattgaagtaaaatcatgtcactggccgaaatcacatacactatggagtaatggagttcttgaaagtgaaatgatcatccccaaaaattttgcaggccccgtaagtcagcataactatcgtcctgggtatcatacgcaaacagccggtccatggcatctgggaaaattagaaatggattttgacttttgtaaaggaactacagtagtagttactgaggactgcggaaatcgaggaccctcattaaggaccacgacggcatcgggcaagttaataacagaatggtgctgccgcagctgtacgttaccccctttacggtatcgcggagaagacggatgttggtacggtatggaaataagacctttaaaagaaaaagaagaaaacttggtcagttcacttgttacggcgggccacggacaaattgacaacttcagtttaggtgtgctcggtatggcactctttctagaagagatgttgagaacacgtgtaggtactaaacatgcgatacttttagtagctgtctcttttgtgacactcattacaggtaatatgtctttcagggaccttggacgagtgatggtaatggtaggggcaacgatgactgatgatataggaatgggggtaacatacttagctttgcttgccgcatttaaggtaagacctacgttcgcagctggtctcctattaagaaaactcacctccaaagaattgatgatgactacaataggaatagtcctactctcacaatcaactattccagagacaatcttagaacttaccgatgccttagcattaggaatgatggtgttaaaaattgtacgaaaaatggaaaggtatcaattggccgtaacaatcatggccatattgtgtgttccgaatgcagttatattacagaacgcatggaaagtaagttgcacaatcttagccgtcgtatcagtatcgcccctgcttctgacatcatcacagcaaaaggcggactggatacccttagcattgacaataaagggtctaaatcccaccgctatattcttaactactctatcacgaactagcaagaaacggtcatggccgctcaacgaagctataatggcggtgggaatggtttcaatcttagcttcatcattacttaaaaatgacattccgatgacaggtcctttggtcgctgggggacttttaactgtctgttacgttttaactggtcgcagcgcggacctcgaacttgagaaagcagctgatgttaggtgggaggatcaggcggagatatcaggttcatctccgatacttagcataataatatctgaagacggatcgatgagtatcaaaaatgaagaagaggaacagacattaacaattctgataaggacagggctactcgttataagcggattatttccagtatcgattccaataacagcagcggcatggtatttatgggaagtaaagaaacaacgagccggtgttctttgggatgttccctcgccacctccagtaggcaaggctgaactagaagacggagcatacaggattaaacaaaaaggaatactgggttactctcaaattggggcaggagtgtataaagagggtacgtttcacacaatgtggcatgtaacccgcggggcagtactcatgcataaaggaaaaaggattgaaccatcttgggccgatgttaagaaggatcttatatcttatggtggcggttggaagttagagggagaatggaaagaaggtgaggaagtacaggtactcgctttggaaccaggcaaaaaccctagggccgtccagaccaaaccgggcttatttaaaacaaatgcaggaacaataggcgcggtatctttagatttcagtccaggcacatcaggtagccctataatagacaagaaaggtaaggtagtaggtttatacggtaacggcgtagtgacaagaaacggttcatacgtatccgcaatagctcaaacggaaaaatcaatagaagataatcctgaaatagaggatgatatatttcgcaaaaagcgccttactataatggacctacatcccggagcaggaaaaacaaaacgatatttaccagctatagttcgggaggcaattaaacgaggacttaggactcttatactagctcctacccgagtagtagcagcagaaatggaagaagcactccgaggactacctatacgatatcaaactccagccattagagccgaacatactggcagggaaatagtagacttaatgtgccacgctaccttcacgatgagattattatcacccatccgtgtaccaaactataacttaattattatggacgaagcgcactttaccgacccagcttcgattgctgctagaggctatatatcaacaagggtcgaaatgggagaagccgcaggaatatttatgactgctactccacccggctccagagatccatttcctcagtcaaacgctccaataatggatgaagaacgcgagatacctgaaagaagctggaatagcggccacgaatgggtgacagacttcaaaggtaaaactgtctggttcgtccctagtattaaagctggaaatgatattgctgcttgcctgaggaaaaatggaaagaaagtaattcaactgtcaagaaagacttttgactctgaatacgtaaaaacaagaaccaacgactgggacttcgtagtcactacagatattagtgaaatgggtgcaaattttaaagcagaaagagtgatagaccctaggagatgcatgaaaccggttatactgactgatggagaggaaagagttatactggcgggtccaatgcccgtaacacatagcagcgcagctcaaaggaggggtagaattggtagaaaccccaaaaatgaaaatgaccaatatatatatatgggagaacctttagaaaacgacgaagactgtgcacattggaaagaagcgaaaatgttgttagataatataaatacaccggaaggtattattccaagtatgttcgagccagagcgagaaaaagtcgatgcaattgatggcgaataccgactccgtggcgaagcacggaaaaccttcgtggatctgatgcgcagaggggatctacctgtatggctagcatataaagtagctgctgaaggaataaattatgcggaccgcagatggtgctttgatggcatcagaaacaaccaaatactcgaggagaatgtagaagttgaaatttggacaaaagaaggcgaaagaaagaaattaaaacctaggtggcttgacgcccgcatctactcagatccattagcattaaaagaatttaaagaatttgcagcaggtaggaagagtcttacactgaatttaattacagaaatgggcagattacctacattcatgacgcaaaaagccagagatgccttagacaatttagcagttttacacaccgccgaagctggtgggcgagcgtacaatcatgcgctgagcgaattgccagagacgctacagataagtctcctcctgactttgttagcaacagtgacaggaggaatcttcctattcttaatgagtggacgtggcattgggaaaatgactctcggtatgtgctgcataattacagccagcatattgctctggtacgcacagattcaaccacattggatagccgcatccattatacttgagttcttcctcattgtcttattaataccagaacctgaaaaacaacgaacaccacaggacaaccagttgacatatgtagtcatagctattctgacagttgtcgctgcgaccatggcaaatgaaatgggatttctagagaaaaccaagaaagacttagggctaggaagcataaccactcaacaaccagaatccaacatcctagacatagacttacgtccagctagcgcttggactctatacgcagtggcgaccacatttataactcccatgttaagacactcaatagaaaattcatcggtaaatgtctccctgaccgcaatagcaaaccaagctacagttctcatgggacttggaaagggatggcctttaagtaaaatggacataggcgtaccgctattagctatcgggtgttattctcaagttaacccgataactctcactgctgcactacttttactcgtagcacactatgctatcatcggacctggcctacaagccaaagccacacgagaagctcagaaaagagccgccgccgggataatgaaaaaccctaccgttgacggaataacggtgattgatctggaccctattccttatgacccaaagttcgaaaagcaacttggtcaagttatgttactcgttctatgtgtaacgcaagtacttatgatgagaacaacatgggccctatgtgaagcattaacactagctactggacctattagtactttatgggagggtaatccgggtcgtttttggaataccactattgcagtttccatggcaaacatattcagaggaagctatttagctggtgcaggattgctattctccataatgaagaatacaacaaatacgcgtagaggtacaggaaacatcggtgagactttaggtgaaaaatggaaatcaagacttaatgccttgggtaaaagcgagttccaaatttataaaaagagtggtatccaagaagtcgatagaaccttggcaaaagaaggaattaaaagaggagaaacagatcaccatgcggtcagccgtggcagcgcaaaactccgatggtttgtggaaagaaacatgattactcctgagggaaaagtggtagatctgggctgcggcagaggaggttggtcgtactactgcggtggtttaaagaatgtcagggaagtgaaaggactaacaaaaggtggacctggacacgaggaaccaataccgatgagcacatatggatggaatttggtgagactgcaatctggtgtagatgtgttctttacgccacccgaaaaatgcgatactcttctttgcgatataggtgaaagtagtccgaacccgacagtggaggcaggaagaactcttagagtcttgaacctggtggaaaattggttaaacaataacactcaattttgcataaaagtgttaaatccatacatgccatctgtgatcgagaaaatggaggctttacaacgaaaatatggaggggcgctagttagaaatccattgtcccgaaactccacgcatgaaatgtattgggtttccaacgcatctggaaatattgtaagcagcgtgaatatgatctcacgaatgttgataaatagatttacaatgaagcataagaaagccacgtatgagccagatgtagatctgggaagtgggacacggaacataggaatcgagtcagaagtcccaaacctagatattataggtaaaaggatagagaagatcaaacaagagcacgaaacaagttggcattacgaccaagatcatccatataaaacatgggcatatcatgggtcgtatgaaaccaaacaaacggggagtgcgagtagtatggttaacggtgtagtgaggcttttgacaaagccttgggatgtaataccaatggtaacgcaaatggcgatgacagatacaaccccattcggacaacagagagtattcaaggaaaaagtagacaccagaacccaggaaccaaaagaaggaacgaagaaactcatgaaaatcacagctgagtggctttggaaagaactaggtaagaagaaaactccacgaatgtgcactagagaagagttcacccgtaaagttcgaagtaacgcagcactaggtgccatttttaccgacgaaaataaatggaaaagtgcacgagaggcagtagaagactcacgattttgggaattggttgataaagaacgtaatctacacctggaaggcaagtgtgaaacatgcgtctataatatgatgggtaaaagagagaagaaattaggtgagttcggtaaagcaaaaggtagtcgtgccatctggtatatgtggctaggcgctcgcttcctagaatttgaagcactaggttttctcaatgaagaccactggtttagccgagaaaattcactatctggtgtagaaggtgaaggactgcacaaattaggatatatcttaagagatgtatcaaagaaagaagggggcgcaatgtatgcggacgatacggcaggatgggacacacgtattacactagaagatcttaaaaacgaagaaatggttacaaaccacatggaaggagaacataagaaattggcggaagctatatttaaactgacgtatcaaaacaaagtagtaagagtccagaggccgacccctagagggacagttatggacattatatcgcgaagagaccaacgtgggtctggccaggttggaacctatggacttaatacatttacaaatatggaagctcaattgatacgtcagatggaaggagaaggtgtatttaagtcgatccaacacctcaccgctacagaagaaatcgcggtacaaaactggttagcacgtgttggaagggaacgactaagtcgaatggcaatctccggggatgactgtgttgtaaaacccctcgatgatagatttgcgtccgctcttacagccctcaacgatatgggtaaagttaggaaagatattcaacaatgggaaccgagtaaagggtggaatgactggacacaggttccattttgtagtcaccatttccatgaattaataatgaaagacggtcgagtattagtagttccgtgtagaaaccaagatgaattgataggacgagctagaatatcacaaggcgcgggatggtcattacgggaaacagcctgtttaggaaaatcgtacgcacagatgtggtctctgatgtatttccaccgaagagacctacgattagcggccaatgcaatatgcagtgcggtgccatcccattgggtacctacttcaaggacaacttggagcattcatgctaagcacgaatggatgactacagaagacatgttaacagtgtggaaccgtgtttggattcaagagaacccttggatggaagataaaactcctgtggagtcatgggaggaaataccatatcttggtaaaagagaagaccaatggtgtggaagcctcatagggttgaccagcagagccacttgggccaaaaacatacaaactgcaattaatcaagtcagaagtcttatcggtaatgaagagtatacagactatatgccgtctatgaaaaggtttaggagagaagaagaagaggctggagttctttggtaa

SEQ ID NO: 22190 - RNA, 9876 nt, synthetic construct
  misc_feature 1..9876: note = derived and/or modified CDS sequence (opt6) from DENV-2__KF744407__SS-prME
  source 1..9876: mol_type = other RNA
acagcaggaatgattataatgttaattcccacggtaatggcatttcatttgacaacacgtaatggcgaaccccatatgatagtgtcgcgtcaagaaaaaggcaaatcattgttattcaaaaccgaggatggggtgaacatgtgtacgctgatggccatggatctcggagaattatgcgaggatacgattacttataaatgcccattattaagacagaacgaaccggaggacatagactgttggtgcaactctacctccacctgggtcacatatggaacttgcacaacaacgggagaacacaggagagaaaaaagatctgtagcactcgttccccacgtaggtatgggtctagaaaccagaaccgagacatggatgagctctgaaggggcatggaaacatgctcaaaggatagaaacatggatattgcgacaccctggatttacactaatggcggcaatactcgcatacacaataggtacgacgaactttcaacgtgcactaatatttattcttctcacggcggtagcacctagcatgacaatgagatgtataggcattagtaatagagattttgtggaaggggtaagtgggggttcatgggtggacatcgtactagaacatggtagttgtgtgacaactatggctaagaacaagccgacactagattttgaattaattaaaacggaggcgaaacatccggcaacattaagaaaatattgcatagaagcaaagctgacaaatacaacaacagcaagccgttgtcccacacaaggtgagccaagtctaaatgaagaacaagacaaaagattcgtatgtaaacatagcatggtagaccgaggttggggaaacggctgcggattatttggaaaaggaggaattgtaacatgtgcaatgttcacttgtaaaaaaaatatggaaggcaaagtggtgcaaccggaaaatcttgagtatacgatagtcattacacctcactctggcgaggaacatgccgttggaaatgataccggaaaacacggaaaggaaatcaagataacgccccagagctcaataaccgaagcagaactcactggatacggcacagtaacaatggaatgctcaccacgtactgggttagattttaacgagatggtcctacttcaaatggaaaataaagcatggttagtccaccgacaatggtttcttgacttaccattaccctggttaccaggagcggacactcaaggatctaactggatacaaaaagaaacactcgtgacattcaaaaatccacatgcaaaaaagcaggacgtggtcgttttagggagtcaggaaggtgctatgcataccgcgcttactggtgcgacagaaattcaaatgtcctcgggaaatttactctttaccgggcatctaaaatgtcgactgaggatggataaacttcaacttaagggaatgtcgtatagcatgtgtaccgggaagttcaaagtagtaaaagaaatcgcggaaactcaacacggcacaattgtagttagggtacagtacgaaggagacggatctccatgcaaaataccattcgaaataatggatttggaaaaaagacacgttttaggacgtcttataactgtcaaccccatagtaaccgaaaaagattcacctgtaaatattgaggccgagccaccatttggcgatagttacgttattattggtgtagaacctgggcagcttaaactaaactggtttaagaaaggatcctctattggacagatgtttgaaactactatgagaggcgcaaaaaggatggcgattcttggagacactgcttgggatttcggtagtcttggtggcgtatttacaagtattggcaaggcactacaccaagtatttggcgccatatatggagccgcattttcgggcgttagctggactatgaaaatattaattggcgtaatcattacttggataggtatgaactcgagaagtaccagtctgtctgtatcactcgtattggtcggggtagtgacactttatctaggggtaatggtccaagccgattccggctgcgtagcatcttggaaaaacaaggaattaaagtgcggcagtggcattttcattactgataatgtacacacttggaccgaacaatacaagtttcagccggagtcgcccagcaagttggcctccgcaatacaaaaggcgcatcaagaaggcatttgtggtataagaagtgtaaccagactagaaaatttaatgtggaaacagattacacccgagttaaaccatatactatctgaaaatgaagttaaacttactataatgacgggagacataaaaggtataatgcatgcagggaaaagaagcttacgtccgcaacctactgaactcaggtatagttggaagacttgggggaaagccaaaatactatcgacagaaagccataaccagacgttccttatagacggtcctgagacagctgaatgtccgaatacaaatagagcatggaatagcctggaagtcgaagactatgggttcggtgtcttcaccacaaatatttggttaagattaagagagaaacaagacgcattttgtgactcaaaactaatgagcgcagcaattaaagataatcgcgctgtgcatgcggacatggggtactggattgagtctgcattaaatgatacttggaagattgaaaaggctagcttcatagaagttaagagttgtcactggcccaaaagtcacacgttgtggagtaatggtgtcctggaatctgaaatgataataccaaaaaactttgcaggaccagttagccaacataactacagaccgggatatcatacccaaaccgcgggtccttggcatcttggtaaacttgaaatggattttgatttctgtgagggcacaaccgtagtagttactgaagattgcggcaatcgaggacctagtttaagaacaactacggcaagtggaaaattgatcacagagtggtgttgtcgtagctgtacgcttccgccgttaagatatagaggagaagacggatgctggtatggaatggaaatacgtcctttaaaagaaaaggaagaaaatttagtgagttctttagttaccgctggccacggacaaatagataacttctcgctgggagtattgggaatggctttatttcttgaagaaatgctgaggactagagtgggaactaaacatgcaatattattggttgctgtctcattcgtaacactcataacaggtaacatgtccttccgagatttaggccgagtgatggtaatggttggtgctacgatgactgatgatatcgggatgggtgtaacctatttagccttattggcagcattcaaagtaaggcccacattcgctgcaggactactcttacgtaaacttacttcaaaagagttaatgatgacaacaataggaattgtactcttgtctcaatcaactataccggaaactattcttgaactcacggacgcgttagcattggggatgatggtcttaaagatagttagaaacatggaaaaatatcagttggcagttaccataatggcaatactgtgtgttcccaacgcagtcattctccaaaacgcatggaaagtgagttgcacgatcctagcggtagtttctgtaagcccattattattaacatcgtcccaacaaaaagctgattggattcctcttgccctaacaataaaaggacttaatccaactgctatcttcctaacgactcttagtagaacgtcaaagaaaagaagctggccactaaacgaagcgatcatggcagttggcatggtcagtatccttgccagctctttactcaaaaatgacataccgatgacaggccccttagttgctggcggattattaactgtatgctatgtattgaccggacgatctgcggacctggaactcgaaaaagctgctgatgtgcgatgggaagaacaagcagaaatttctggcagctctccaattctaagtataattatatcagaagatggaagtatgagtataaaaaatgaagaagaggaacaaactcttacgattctaattagaactggattgttagttatatcgggtctcttcccagtcagtattcccataacggctgctgcatggtatttatgggaagtcaaaaaacaaagggcaggagtcttatgggacgtaccatcaccaccaccagtaggtaaagcggagctagaggatggcgcgtaccgaatcaaacaaaaaggaatcctgggttactcgcaaataggtgctggcgtatataaagaaggcacatttcatacaatgtggcacgtaacacgcggtgctgtactgatgcataaaggaaagcgaatagaaccctcatgggcagatgtaaagaaagacttaatcagttacggaggaggatggaaactagagggcgaatggaaagaaggagaagaggtacaggttctcgctttagaaccaggaaaaaacccacgggcagtacaaaccaaaccgggtctattcaagacaaacgctggcacaatcggagcagtaagtcttgactttagtcccggcacgagtggctcacctataattgacaaaaaaggaaaagtagttggattatacggtaacggagtcgtaacaagaaatgggtcctatgtaagtgccatagcacaaactgagaaatcaatagaggataatcccgaaattgaagacgacatttttcgaaaaaaaagattgaccatcatggacctacacccaggtgcaggaaaaactaaacgttatttaccagcaatagtgcgcgaagctataaaaagaggtctcagaaccttaattctagcaccaacacgcgttgtagcggcagagatggaggaagcgttaagaggtcttccaattcgttatcagacacccgcaataagagccgaacacacaggtagagagattgtcgatttaatgtgccacgccacatttactatgaggttgcttagtcctatcagagtccctaattacaatctaataataatggacgaagcacactttaccgacccagcctcgatcgctgcaagaggatacatttctacaagagtggaaatgggagaggcagcgggtatttttatgactgccacgccaccaggatctagagatccgtttccacaaagtaacgcccccataatggacgaagagcgagagatccctgaacgctcatggaactcaggtcacgaatgggtaacagacttcaagggaaaaacggtttggtttgtaccatctatcaaagccggtaatgacatcgctgcctgtctaaggaaaaacggaaaaaaagtaatacagttatcgagaaaaacctttgactctgagtatgtaaaaactcgtactaacgactgggattttgttgtaacaacagatatctcagaaatgggagcgaattttaaggctgaacgagtaatagatccaaggagatgcatgaaacccgtcatattaacggatggcgaggaaagggtaatcctagcaggtcccatgccagtaacacatagtagcgctgcccaacgacgagggcgaattggtagaaaccccaaaaatgaaaacgatcagtacatatatatgggtgaacctttagaaaatgacgaggactgtgcacactggaaggaagcaaaaatgttgttagataatattaacacacctgaagggataattccgtcaatgttcgaacctgaacgtgagaaggtggatgctatagacggggagtacagattaaggggagaagcgcgaaagacatttgtagatttaatgagaaggggagacctacctgtatggttagcatataaggtagcagcagaaggtattaattacgcagacagaagatggtgcttcgatggtattcgaaacaatcagatactagaagaaaacgtagaagtagagatatggacaaaagagggggagcgaaaaaaactgaaaccaaggtggctagacgcaagaatttacagcgatcctttggctttaaaagagttcaaggaatttgctgcaggtcgtaaatcccttactcttaatttgataacagaaatgggtcgtcttcctacctttatgacacaaaaggcgagggacgcattagacaatttagcggttctacacacagcggaagcaggtggaagagcatataatcatgcattatcagaactcccagaaacattagagactctcttattactaacgttattagcgacagttaccgggggaatttttttatttttaatgtctggaaagggaatcggtaagatgactctcggaatgtgctgcataattacagcaagcgtactactttggtacgcacaaatacagccgcactggatagctgcaagtataatactagagttttttctcatagtactattaataccggaacccgaaaaacaacgtactccacaagacaaccaactgacctatgtcgtaattgccatcttaactgttgtggcagctaccatggctaatgagatgggatttctagaaaaaacgaaaaaagactttggcttagggagcatagcaacgcaacaaccagaatctaacattcttgatatcgatttgcgaccggctagtgcatggacgttatacgcagttgccactacgttcataactcccatgttaagacatagtatcgaaaatagcagtgttaacgtgtcactcactgctatagctaaccaggcaactgttttaatgggattagggaaaggttggccactctcaaaaatggatataggggtgccattattagctataggatgttattcccaagtaaatccaataactctcactgcggcacttcttttactggttgcacactacgctataattggcccgggactacaagctaaagcgacgagagaggcacaaaagagagcagcagcaggcattatgaagaatccgactgtagatggcattacggttatcgacctggatcctataccgtatgatccaaaattcgagaaacaattaggacaagttatgctactagttctctgcgtaacacaagtgctgatgatgagaaccacttgggcactatgtgaagcgcttaccttagcaactggacccatctcaacactttgggaaggtaatccaggtaggttttggaatacaacgatagctgtgtctatggctaacatttttagaggaagttacttagcaggcgcaggattattattttccataatgaaaaacaccaccaatactcggcggggcaccggtaatattggagaaacattaggtgagaaatggaagagtaggctcaatgctctgggaaaaagcgaatttcagatctataagaagtcaggaatacaagaggtggatagaacccttgcgaaagaaggaataaaaagaggggaaaccgatcatcatgcagtaagccggggttccgccaaactgcgctggttcgttgaaagaaatatgataacaccggaaggtaaagtagtggaccttggatgtgggcgtggcggttggtcttattactgtggaggacttaaaaatgtgagagaagtaaaaggtttaaccaagggaggtccgggccacgaagaacctatacctatgagcacatacggttggaatctagttagacttcaatcgggcgtagacgttttcttcacacctccagaaaaatgcgatacccttctatgtgacatcggtgaatcatcaccaaacccaaccgtagaagcgggccgaactttacgggtcctaaacctagttgagaattggttaaacaataatacgcaattttgcataaaagtgttgaacccctatatgcccagcgtaatagagaagatggaggctctacagagaaaatatggtggagccttagtacgaaatcctttaagcagaaatagcactcatgagatgtactgggtaagcaacgcatcagggaatatagtgagcagtgtcaacatgatttcaaggatgttaattaatcgctttacaatgaaacataaaaaggcaacgtacgaacctgacgtagatctgggatcaggtactagaaacatagggattgaaagcgaagtccctaatcttgacataatcggcaaaaggatcgaaaaaataaaacaagaacatgaaacatcatggcattatgatcaagaccatccatataaaacatgggcataccatggtagctatgagaccaaacaaacagggtcggcaagttctatggtaaacggcgtagtcagactactcaccaaaccgtgggatgtcattcctatggttacccaaatggctatgacagatacaacaccttttggtcaacagagggttttcaaagaaaaagtagatacaagaactcaggaaccaaaagaaggtactaaaaaactaatgaagattacagctgaatggctatggaaagaactaggaaaaaaaaaaacaccccggatgtgtactcgtgaagaatttacacggaaagtgcgatctaatgcggccttgggggcaatctttacggatgaaaataagtggaaatcggcaagagaagcggttgaggattcgagattttgggaactagtcgataaagagcgcaaccttcacctggaaggcaaatgtgaaacatgtgtgtacaacatgatgggcaagcgggaaaaaaagctcggtgaatttggcaaagcgaaaggcagtcgagcaatttggtacatgtggcttggggcacgcttcttagaatttgaagcattaggctttctaaacgaagatcattggttttctcgagaaaactcactaagtggagttgagggggaaggattacataaacttggttatatcttaagagacgtctcgaaaaaagaaggtggcgctatgtacgcagacgacactgcaggatgggatacaagaataacgttagaagatttaaagaatgaggagatggttactaatcacatggaaggcgaacacaagaaactagcggaagctatatttaagctgacttatcaaaacaaagtggtacgtgtccagagacctactccacgaggcacagtaatggatataataagcagaagggatcaaagaggaagcggtcaagtaggtacttatgggttgaatacctttacaaacatggaagcgcaattgataagacaaatggaaggtgagggcgtatttaagagcatccaacatttaacggcaactgaagaaatagcagtacaaaattggttaactagagtaggtcgtgaacgcttgtcaaggatggcaatatcgggagacgattgcgtagtaaaacctttagatgacagattcgcttcagctttgactgcgttaaatgacatgggaaaagtgcgcaaagatatacaacaatgggagccaagtaagggttggaacgactggacccaagtacctttttgctcacaccattttcatgaactaattatgaaagatggtcgtgttcttgtagtaccctgccgtaaccaggatgagttgatcggaagggcaagaatatcccaaggggcgggttggtccctacgggagacagcgtgtctgggaaaatcatatgcacaaatgtggtcgttaatgtactttcataggcgcgaccttcggcttgcagcaaacgcgatctgttccgcggtaccatcgcattgggtccctacttcaagaacgacttggtctattcacgcaaaacacgaatggatgacgaccgaggacatgctaacggtttggaatagagtatggatacaagaaaatccttggatggaagataagactccagtagagagctgggaagagattccctatttaggtaagcgcgaagatcagtggtgcgggagcctgatcggattgacatcgagggccacctgggcaaaaaatattcaaaccgcaatcaaccaagtgagatctctgatcggaaacgaagagtacactgactacatgccatcaatgaaaaggttccgaagagaagaagaagaagcaggagtattatggtga

SEQ ID NO: 22191 - RNA, 9876 nt, synthetic construct
  misc_feature 1..9876: note = derived and/or modified CDS sequence (opt6) from DENV-2__KF744399__SS-prME
  source 1..9876: mol_type = other RNA
acagccggtatgataataatgttaatacccacagtaatggcgttccacctaaccacaagaaacggagaaccccacatgatcgttagcagacaagaaaaaggaaaatcactattattcaaaactgaagatggagttaacatgtgtacgctaatggcaatggatttaggagagctctgtgaagatactatcacttataagtgtccactattgcgacaaaacgaaccagaggatatcgattgttggtgtaatagtacaagtacatgggttacatacggcacgtgtactaccacgggagaacacagaagagaaaaaaggtccgttgcattggtgcctcatgtagggatggggctggaaacaagaaccgaaacttggatgtcctctgagggtgcctggaaacacgcacaacgtattgaaacatggatattgaggcaccctggtttcaccctcatggctgcaatactggcctataccattgggactaccaatttccaacgcgcattgatttttatattattgacagcagtagcaccatcaatgacgatgcgctgtattggtattagtaatcgggattttgtggaaggtgtctctggcggatcttgggtggacattgtattagaacatggatcatgtgtaacaacgatggctaaaaacaaaccaacattggatttcgaattaattaagacagaagcaaagcaccctgccactcttagaaaatattgtatagaggccaaactcacaaatacaacgactgaatcaagatgcccgacacaaggagagccatcattgaacgaagagcaagataaacgttttgtctgtaaacattcaatggtcgaccgaggttggggtaatggatgtgggctatttgggaaaggggggatagtcacttgtgcgatgttcacgtgtaaaaaaaatatggaaggaaagatcgtacaacctgagaacttggaatacactatagttattaccccacactcgggtgaggaaaacgccgtagggaatgacactggaaaacacggaaaggaaataaaagtgactccccaatcatcaataacagaggctgaattaaccgggtacggtaccgttacaatggaatgcagtccacgaactggcctaggtttcaatgaaatggttcttttgcagatggagaacaaagcttggttagttcatcgacaatggttcctagatttgccattgccctggctgccaggggcagacacccaaggctctaattggatacaaaaagagacgttagtcacattcaagaacccacacgccaaaaaacaagatgttgtagtgttagggtcccaagaaggggctatgcatacagccttgaccggagcgacagagatacagatgagtagtggaaatctattgtttacaggccatttaaaatgtagattacgaatggataagctccaacttaagggaatgagctacagtatgtgtacagggaaattcaaagtagtaaaagaaattgccgaaacccaacatggcaccatagtcgttagagttcaatacgaaggcgatggatcaccatgtaagatcccattcgagatcatggaccttgaaaaacggcatgttttaggtcgtctaataacagtaaatcctatcgttactgaaaaagacagtccggtcaatatcgaagccgaaccccccttcggagacagctacgtgattattggagtcgaaccaggccaactaaaactaagctggtttaaaaaaggttccagtataggccaaatgttcgaaacaactatgcgaggtgccaaacgtatggcaattctaggcgacacagcttgggattttggctcgctggggggagtatttacaagcattggtaaagcgctgcaccaagtttttggggccatatatggagcagcattttcaggtgtatcttggactatgaagatcttgataggagttgtaatcacctggattggaatgaattcccggagcactagtctcagtgtatctctagtattagtgggcgtggtaacattatatttgggtgttatggtccaggcagactccgggtgcgtagtgagttggaaaaacaaagagttaaagtgtggttctgggatatttataacagataatgtgcatacctggaccgaacaatacaagttccaaccagaaagtccttcaaaattggcaagtgctatacaaaaagcccatcaggaaggaatatgcgggataagatcagttactaggttagaaaatctaatgtggaagcaaataaccccagaattgaatcatattttatctgaaaacgaagttaaacttacaataatgacaggtgacatcaaaggaataatgcacgcgggtaagagatctctaagacctcaacccactgaactgagatattcttggaaagcatggggaaaagctaaaatcttatccacagaattgcataatcaaacgtttttgatagacggtcccgaaacagcagaatgtcctaacacaaatcgcgcgtggaacagcctcgaggtcgaagactacggtttcggagtatttacgactaacatatggctaaagctacgagaaaaacaggatgcgttttgcgatagtaaacttatgtctgctgcaataaaagataacagagcggtccatgcagatatgggttactggattgagagtgcactgaatgatacatggaaaattgaaaaagcgtcctttattgaggtaaaatcctgtcattggccgaaatcacacacgttatggagcaatggagtattagaatccgaaatgataatacctaaaaattttgcagggcccgtcagccaacataactatagacccggctatcatacgcagacagccggaccgtggcatctaggcaaacttgaaatggattttgacttctgtaaaggaacgacagttgtagtgactgaagattgtggcaatcgcggtccttccctacgcactacaaccgcatccggcaaactcataaccgagtggtgttgcagatcatgcacactacctccattgcgttatcgaggggaagatggatgttggtatggtatggaaatacgaccattgaaagaaaaagaggaaaatttagtaaactcacttgtaactgcaggtcatggtcagatcgataacttttcactgggagtactgggtatggcgttattcttagaagaaatgttaagaacccgtgttggtaccaaacatgcaattctcttagtagctgttagctttgtaactttaataacaggaaatatgagttttcgcgatttaggtagagtaatggtcatggttggggctacaatgaccgacgatatagggatgggcgtaacttatctggctctcttagcggcattcaaagtccgtccaacattcgcagcgggattgctccttcgaaaactaaccagtaaagagctcatgatgacaactataggaatagtcctcctaagccaaagcacaatacctgaaacaatcttagagttaacggacgcactcgccctgggcatgatggtattgaaaatagtacgtaaaatggaacggtatcaactggcggttaccatcatggcgattttatgtgtccccaacgctgttatattacagaatgcctggaaagtttcttgcacaatactggcagtcgtaagtgttagcccattgttactaacatcttctcaacagaaagcggattggattcctctagcacttacaataaagggtctaaaccctacagctatattcttaactacgctatcgaggacatcaaaaaaacgtagttggccactaaacgaagctatcatggctgtaggaatggtttccatcttagctagttctctactcaaaaacgatattcccatgaccggaccgctagtagcgggaggcctacttaccgtctgttatgtgctgaccggtcggagtgctgatttagagctcgagaaagcagccgacgtaagatgggaagaacaagcagaaatcagtggctcttcacctatactcagtataataattagtgaagatgggagtatgagtataaaaaatgaagaagaagagcaaactttgactatacttattcgtacggggttattggttatcagcggattattcccagtatctattcccataactgctgccgcatggtatctatgggaagtcaaaaagcaaagagctggtgtattgtgggatgtcccaagccctccacctgttggcaaggcggaattagaagacggtgcctatagaataaaacagaaagggatcctgggttactcgcaaataggagcgggagtatacaaagaaggaacctttcacacaatgtggcatgtaactaggggagcagtactaatgcacaaaggaaaaagacttgaaccctcatgggcagacgtgaaaaaagacttaatttcatatggcggtggttggaagctcgaaggagaatggaaagaaggcgaagaagtgcaagtgttagcattggaacctggcaaaaacccaagggcggttcagacaaaacctggtttatttaaaaccaatactggcaccattggtgcggtctctttagatttctcaccaggcacgtcaggcagtccaataatcgacaaaaaagggaaagttgtgggcttatatggaaacggggtcgtaacaagaaatggatcctatgtaagcgctatagctcaaactgagaaatcgatagaagataatccggaaatagaggatgatattttcagaaagaaacgcttaacaataatggatcttcatccaggtgcgggaaaaacaaaaagatacttacccgcaatagtaagggaagcgatcaaaagaggacttagaacactaatactggcaccaacaagagtggtagcggcagaaatggaggaggcattgagaggcttgcctataagataccaaactcccgcaatccgtgctgaacataccggcagagaaattgtggacttaatgtgccatgcaacctttacaatgaggctactctcaccaataagagtgccgaactataatttgattataatggacgaagcacattttacagatccggcgtccatagcagcaagaggctatatttcaacaagagtagagatgggtgaagctgccgggatttttatgacagcaaccccgccaggatcgagagacccttttccacaatctaatgcacctatcatggatgaagaacgagaaataccagaaagatcttggaattccggccatgagtgggtaacagactttaagggaaagactgtttggtttgtgcccagcataaaagcggggaatgatatcgccgcttgcttgcgaaaaaatggcaagaaagtaatacaattatcacgaaaaaccttcgactcggagtatgtaaaaaccaggaccaacgattgggattttgtcgtaacaactgatatttcagaaatgggggctaattttaaagctgaacgtgtcattgacccgcgacgatgcatgaaaccagtaatactaacagacggagaggagcgtgtgattctagcagggccaatgcctgtaacccactctagcgcagcacagcgacgtgggaggatagggcgaaatccaaaaaatgaaaatgaccagtatatttatatgggagaaccgctcgaaaacgacgaagattgtgcacactggaaagaagccaaaatgctgctagataatataaacactccagaaggaattatcccatctatgtttgaaccggaaagggagaaagtagacgctatagacggggaatatcgattacgaggagaagccaggaaaacatttgttgacttgatgaggagaggagatttgccagtatggttagcttataaagtagcagccgagggaataaattatgcggatagaaggtggtgctttgatgggattagaaataatcaaatattagaagaaaatgtagaggtggaaatatggacaaaagaaggggaaagaaaaaaattaaaaccacgatggctagatgcgaggatatatagcgaccccctagcgctaaaagaatttaaagaattcgctgcgggaagaaagagtttaaccttaaatttaatcacagaaatgggaaggttacctacatttatgactcagaaggcgagagatgcattagacaatttggctgtattacatactgctgaagcaggtggacgggcttataatcatgctttgtctgagctgccagaaacgctcgagacattattattgctaaccctattggctacagtaactggagggatatttctattcttaatgtccggtaaaggcataggtaaaatgacactaggaatgtgttgcatcattaccgcttcagtactgttatggtatgctcaaattcagccccactggattgccgcaagtataattctcgagttttttctaatcgtattgttaatacctgaaccggagaaacaacgcacgcctcaagacaatcaactaacctacgtagttatagccatattaacagtggttgcagcaaccatggcgaacgagatgggcttcctggaaaaaaccaaaaaggattttggtctaggcagtatagcaacacaacaacccgaaagtaacatcttagacattgatttacgaccagcgagcgcatggactttatatgcggtagcgaccacattcatcacaccaatgttgcgacactcgatagaaaactcatcagtcaacgtgtcactcaccgctatagctaaccaagctacagttttgatgggccttgggaagggatggcccctcagcaagatggatataggtgtcccactgctggcaataggttgttattcccaggtgaatccgattacgttaactgcggcactactactcctagttgcccactacgcaataataggaccaggcttgcaagcaaaagctaccagagaagctcaaaaacgagctgcagcaggaatcatgaaaaacccgacggtggatggaatcactgtcattgacttagatccaataccctatgatcccaagttcgagaagcaactaggtcaggtaatgctgcttgtgttatgtgtgacacaagtactaatgatgcggaccacatgggcactatgtgaggcacttactctagcaaccggtcctatctcaaccctttgggaaggcaatccaggccgattttggaatacaacaattgctgtttcaatggctaatatttttagaggatcctaccttgcaggcgctggattattgttcagcatcatgaagaatacaacaaatacaagaaggggtaccggcaatattggtgaaacactaggggaaaaatggaaaagtaggctgaacgccttgggcaaatctgaattccagatctacaagaagagtggtattcaagaggttgataggacactagctaaggaaggaatcaagagaggagaaacagatcaccacgctgtcagccgtgggagtgctaaattaagatggtttgtagagagaaatatggtgacacctgaaggaaaggtagttgatctaggctgtggaagagggggttggagttattattgtgggggacttaaaaatgttcgggaggtgaaaggattaacgaaaggaggacctggtcacgaggaacctattccgatgagcacatacggatggaacctggttaggttgcaatccggtgtcgacgttttttttacaccacctgaaaaatgtgatacattgttatgtgatatcggggaaagttccccaaatcccacagttgaagcaggaagaacattaagggttcttaatttagttgagaactggctcaacaacaatacacaattttgtataaaagtactaaatccgtatatgcctagtgttatagaaaaaatggaagctttgcaaagaaaatacggaggggcattagtacgaaatcccctctcacgcaacagcacccatgaaatgtattgggtttctaacgcaagcgggaatattgtgagttccgtgaacatgatatcgagaatgctaataaatagatttacaatgcgtcataagaaagcaacatacgaacctgacgtggatttaggatcaggaactcggaatatcggtatagaatctgaaattccgaacctagacataataggtaaaaggatagagaaaataaagcaagaacatgagacatcttggcattacgatcaggaccacccgtataaaacttgggcatatcatggatcttacgaaactaaacaaaccggctcggcatccagtatggtaaatggagttgtacgacttttaactaaaccttgggacgtgattcctatggtaacacaaatggcaatgacggatacaactccattcggacagcaacgtgtttttaaggaaaaagtagatacaagaacacaagaaccgaaagagggaacgaagaaattaatgaaaataaccgcggaatggttatggaaagaactaggaaaaaaaaaaacaccaaggatgtgcactcgtgaggagtttactaggaaagtgcgaagcaatgcagctttgggggcaatatttactgatgaaaataaatggaaaagcgctcgagaggcagtagaagatagtcggttttgggaattagtcgacaaagagagaaacttacatctagaagggaaatgtgaaacctgcgtgtacaatatgatgggtaaacgtgaaaaaaaattgggagagttcgggaaggcaaaaggctctagagccatttggtatatgtggcttggggctcgatttctggaatttgaagcattaggtttcctgaatgaggatcactggtttagtcgagaaaacagtctgtctggggttgaaggtgagggtctacacaagttaggttatattttacgtgaagtaagcaaaaaagaaggcggtgcgatgtatgccgatgataccgccgggtgggacactcgtattacattagaagatttgaaaaatgaagaaatggtaacaaaccacatggaaggcgaacataagaaactcgcggaagctatatttaagctcacatatcagaataaggtagtccgagtacaacgacctacacctcgtgggacagtgatggatatcatttctcggcgggatcaaagggggtctgggcaagttggtacctacggcctaaataccttcacaaacatggaagcccaattaatcagacaaatggaaggtgaaggagttttcaaaagcatacagcatttaaccgctactgaagagaacgcagtacaaaattggttagcacgagttggccgagagagactatcaagaatggcgatatctggagacgattgcgtcgtgaaacctctagatgatcgtttcgcatcagcactaactgctctaaatgatatgggaaaagtacgtaaagacattcaacaatgggagccgagccgaggatggaatgattggacacaagttcccttctgcagccatcattttcacgagcttataatgaaagatggtagggtattagtagttccctgtcgcaaccaagacgaattaattggtagagctcgcataagtcaaggtgccggatggagtttgcgtgaaacagcgtgcttggggaagagctatgcacaaatgtggtcccttatgtactttcaccgacgagatttacgccttgctgcaaatgctatatgcagcgcagtgccatcacactgggttccaacttcaaggacaacatggagtattcatgcaaaaaatgaatggatgaccaccgaggacatgttgactgtttggaatagggtgtggattcaagaaaacccgtggatggaggacaaaactccagtggaatcttgggaagagatcccctatctgggaaaaagagaggaccagtggtgcggcagcctgatcggacttacatcaagggctacttgggcaaagaatattcaaacagctataaatcaagtccgaagcttaataggcaatgaagaatacacagattatatgccgtcaatgaaaaggttccgccgggaagaggaggaagccggtgttctttggtag

SEQ ID NO: 22192 - RNA, 9876 nt, synthetic construct
  misc_feature 1..9876: note = derived and/or modified CDS sequence (opt6) from DENV-2__JX286516__SS-prME
  source 1..9876: mol_type = other RNA
accgcaggagtaatagttatgctaattccaaccgcgatggcattccatttaacaacccgaaatggggaaccgcatatgatagtaggtcgacaagaaaaaggtaaaagcctgttgtttaaaacagaagatggtgtgaacatgtgtacgctcatggcaatagatttgggagaactatgtgaagataccataacctataaatgtccgttgttacggcagaatgaaccagaagatatagactgttggtgtaactcaacaagcacatgggtaacatatggcacttgtacaacaactggggaacaccggcgtgaaaaacgatccgtagcattggttccacacgtagggatgggactcgaaacgagaaccgaaacttggatgtcatctgaaggggcatggaaacacgttcagcgaattgaaacatggatactaagacatccgggatttactataatggcagctatattggcatacactatcggtactactcatttccaaagagcattaatattcatccttctaacagctgtagctcctagcatgacgatgagatgcataggaatctcaaatagagactttgttgaaggagtgtccggaggaagctgggtggatatcgttctagaacatggtagttgtgttacaacaatggccaaaaataaaccaacactggatttcgaattaattaaaaccgaagcgaaacagccggctacattacgtaaatattgtattgaagcaaaactgaccaacaccacaacagaatccagatgtcctacccagggagaacccagtcttaacgaagaacaagacaaacgtttcatatgtaaacacagcatggtagacagaggatggggaaacggatgtggattatttgggaaaggagggatagttacatgtgcaatgtttacgtgcaagaaaaacatggagggaaaaattgtgcaacccgagaacctggagtatacaattgtgataacgccacacagcggagaggaacatgccgtaggtaatgatactggtaaacacggaaaagaaattaaaattacgccgcaatcatctacaactgaggccgagttaacgggctatggaatcgttaccatggagtgttctccaagaacgggcctagactttaacgagatggttcttcttcagatggaagacaaagcctggttggtccatagacaatggttcctagatctaccccttccatggttgcccggagcggacacgcaaggcagtaactggatacagaaagaaactcttgtaacctttaaaaaccctcacgccaagaaacaagatgtggtagttcttggatcacaagaaggggcaatgcatacagcccttacaggagccaccgagatacaaatgagctcaggaaacctattattcacaggacacctaaaatgccgacttcgaatggacaaattacaacttaaaggaatgtcgtattctatgtgtacaggaaaatttaaaattgtaaaagaaatagcagaaactcaacatggaacaattgtaattcgggttcaatatgagggggacggttcaccttgtaaaataccatttgaaattacagatttagagaaacgacatgtactaggaagactgataactgttaatcctatagttactgaaaaagattccccagtcaatattgaggcggaaccaccgtttggagacagttatatcattgtaggagtggaaccaggacagttaaaattaaactggttcaagaaaggttcttccataggccagatgtttgagactacaatgagaggagcaaagagaatggcaatcctgggtgacactgcctgggattttggctctttaggaggcgtatttacgagtataggcaaggccttacatcaggtgttcggggcaatatatggcgcagctttttccggagtaagttggactatgaaaatacttatcggcgtaataataacatggataggtatgaatagccgcagtacatctcttagtgtatcattagttctcgtaggagtagtcacgttatacctcggtgcgatggtccaggcagactctggatgtattgtttcatggaaaaacaaggaactgaaatgtggatctggtatattcataactgataatgtacatacatggactgaacaatacaaattccagccagaatcaccgtcaaaacttgcaagtgcaatccaaaaagcgcacgaagaaggaatatgcggaatcagatccgtcacccgattagaaaaccttatgtggaaacagatcacgcctgaattgaaccacattttatcagagaacgaagtcaaactaacgatcatgacaggagacatcaaaggtataatgcaggcaggcaaaagaagtttaagaccacagccgacagagctaaagtactcttggaaaacatggggtaaggctaaaatgttgtctacggaatctcataatcaaacatttctaatagacggccctgaaacagctgaatgtccaaacactaaccgcgcgtggaactctcttgaggttgaggactatggattcggtgttttcacaactaatatttggctgaaactaagagagaagcaagacgtattctgtgactcaaaacttatgtccgcagcaatcaaggataaccgagctgtgcatgctgatatgggatattggatagaatcagccctaaatgatacctggaagatggaaaaggcttcgtttattgaagttaaatcctgtcactggccaaaatctcatactttgtggagtaatggggtattggaatctgaaatgatcattccaaagaattttgcagggccagttagccaacacaattaccgccccgggtaccatacacaaaccgccggtccttggcatttaggcaagttagaaatggatttcgacttctgcgaaggaactactgtagtcgtcacagaagattgtggtaaccgcggaccatcactacgaaccacaactgcgagtggcaagctaatcacagaatggtgctgtagatcgtgtactttaccacccctaagatatcgaggagaggacggctgttggtatgggatggaaatacgtccgctaaaagaaaaggaggagaaccttgtaaactcgttagttacagcggggcatggacagatagacaatttctctctaggtgtgttaggaatggccttgtttttggaagaaatgctaagaacccgtgttggaaccaaacacgctattttgttagtagcgttatcctttgttaccttaataaccggtaacatgagttttagagatcttggacgagttatggtaatggtaggtgcaacaatgacggatgacatcggcatgggcgtgacatatctagcgctcttggctgctttcaaggtcaggcctacttttgccgctggcttactactacgcaaactgactagcaaagagttaatgatggctacaataggtattgcactactctcacaatctaccctgcctgagactatactagaactaacagatgcactggctcttggaatgatggctctaaaaattgtacgcaacatggaaaagtatcaattagctgttactatcatggctatatcatgtgttccgaatgcagtcatactccaaaacgcatggaaagtttcatgtacaattttagcagcagtttcagttagtccactcttgctaaccagtagtcaacaaaaggcagattggatccctttagcacttacaataaaaggattaaatccaacggcgatattccttacaacactttcgcgtacttcaaagaaaagaagctggcccttaaatgaagcaataatggcggtcggtatggtttcaatacttgcctcttcgctacttaaaaacgatatacccatgacaggaccattagtcgcaggaggcttgttaacagtctgttatgtactgaccggaaggagtgcagatttggagctagaaagagcggctgacgtaaaatgggaggatcaggccgagatctcaggaagctctccgattttgtcaatcacaataagtgaggatggttcgatgagcatcaaaaacgaagaagaggagcaaacactgaccatattaatcagaaccggattgttagtgattagcggagtattcccagtatcaataccaattactgccgctgcctggtatctctgggaggtcaagaaacaaagagccggagttttatgggacgtacctagtcccccaccagtgggaaaagctgaactcgaagacggtgcctacagaattaaacagcgaggcatactaggatactcacaaataggggcgggagtatataaagaaggaacatttcacactatgtggcatgtaacacgaggagctgtccttatgcatagagggaaaagaatagaacctagctgggctgacgtcaagaaagatctgatttcctatggaggagggtggaaattagaaggggagtggaaagaaggggaagaggttcaagttctagcacttgagccaggaaagaacccaagggccgtacaaacaaaaccgggtatctttaaaacaaatacgggaactattggggctgttagtttagatttttccccaggaactagcggaagtcccatagttgatcgcaaaggaaaagttgtaggattgtacggcaacggtgtggtaacaagatccggagcgtatgtctctgcaattgcacaaacagaaaaatcgatcgaagacaatcctgaaattgaagacgatatcttcagaaagaaacgcttaacaattatggaccttcatcctggagcaggtaaaactaaacgctacctgcccgctatagtgagagaagcaatcaaacgtggacttcgtacattaatcctagcaccaacgagagtcgtggctgctgaaatggaggaggcacttagaggcctacccataagataccagactcctgcaataagagctgaacacactgggagggaaatagtagatcttatgtgtcacgctacgttcacaatgcgactactgtcaccagtgcgagtaccaaactacaacctgataataatggacgaagcacatttcactgatccagcatcaattgcagccaggggttacattagcactagagtggagatgggtgaagcagcaggaatcttcatgacggcaacacctccaggttctcgagacccattccctcaatcaaatgcccccatcatggatgaagaaagggaaattcccgaaagatcttggaatagtggacacgagtgggtaactgattttaaaggaaaaaccgtttggttcgtaccctccataaaagctgggaacgatattgcagcctgcctcaggaaaaatgggaagaaagtaatacaattgtcaaggaaaactttcgattctgaatatgtaaaaacacgcgctaatgactgggacttcgtcgtaactacagatatatctgaaatgggcgcaaattttaaagcggaaagagtaattgacccacgaaggtgcatgaagcccgtaatacttaccgatggagaagagagagtaatcttagcaggaccaatgccagttactcacagtagcgcggcacaaagacgcggaagaattggtcgaaaccccaaaaatgagaacgatcaatacatatacatgggagagcccctagagaatgatgaggattgcgcacattggaaagaggctaaaatgctattagataacatcaatacacctgagggaattatacctagtatgtttgagcctgaacgagaaaaagtcgatgcaattgatggtgaatatagattaagaggtgaagctcgaaaaaccttcgtcgatttaatgcggaggggagacctaccagtgtggctagcgtataaggtggccgcagagggcataaactacgcagatagaaaatggtgctttgacggaatcaaaaataatcaaatattggaagaaaacgtagaggtagaaatatggacgaaagaaggagaaagaaagaaactcaagcctaggtggttagacgctcgaatatactccgatcctttagccttgaaaggctttaaagaatttgcagcggggcgcaagagcttaacgttaaatctcatcaccgaaatgggcagattacctacgtttatgactcagaaagcacgaaatgcactagacaacctggcagtgttacacacagcagaagtaggtggtaaagcgtatacacacgcactcagcgaactcccagaaactctggaaactttactgcttttaactttattagccgccgtgactggtggtatcttcttgtttttgatgtcaggaaagggtattggtaaaatgactcttgggatgtgttgcattataacagcatcgattctattatggtatgcacaaatacagccacattggatagccgcaagcataatattagagttctttcttatagtcttactaataccggagcccgaaaagcaaagaacgccgcaagacaaccaattaacatatgtcgttatcgcgatactaacagtagtagcagcaacaatggctaacgaaatgggcttcttagagaaaactaagaaagatttaggttttggaagtattacaacccaagaaagtgaaagcaatatactcgacatagatctgcggcccgccagtgcatggacactctacgcagtcgccactacattcgtaaccccaatgttacgacattctattgaaaacagttctgtaaatgttagtctgaccgctatagctaaccaagcaaccgtattaatggggttggggaaaggttggccgctcagtaaaatggatataggagtcccactactcgctataggctgttactcacaggtaaatccaattacactcaccgctgctctcttgctattagtagcgcactacgcgattataggccctggcttacaagcaaaagcgactagagaagctcaaaaacgcgcagcagcggggataatgaaaaaccctactgtagatggcatcactgtgatcgatctcgaaccaataccatatgacccgaaattcgaaaaacaattaggacaggtaatgctcttaatattgtgtgttacgcaagtattaatgatgaggaccacttgggccctctgtgaggctttaaccctagcaacaggaccaatttctacactctgggaaggtaatccggggaggttttggaacacaacaatagctgtgagtatggcgaacatctttcgtggtagttacttggccggtgcgggccttttattctcaattatgaaaaacacaacaaacacgaggagaggtacgggcaatgtgggggaaacattgggcgaaaagtggaaaagcaggttgaatgccctaggaaaaagcgaatttcaaatatataagaaatcgggcatacaggaagttgatagaaccttagctaaagaaggcataaaaagaggagaaactgatcatcatgcagtgagtagaggatcagcaaagttgagatggttcgtagaacgaaacatggtaactccagaaggcaaagtcgtcgatttgggatgtggtagaggagggtggagttactattgtggtggcttgaaaaatgtacgagaagtaaagggcttaacaaagggtggacctggacacgaagaaccaatacctatgtcgacctatggatggaatttagtgagactccaatccggagtggatgtattctttacaccacctgagaagtgtgatacgttattatgtgacattggagaaagttcaccgaatcccacgattgaggcaggacggacacttcgagtattaaacttagttgaaaattggctcaataataatacccaattttgtataaaagtgctaaacccttacatgccttcagttatagaaaagatggaaacgttgcaaagaaaatatgggggtgcacttgtacgcaacccattatcacgtaactcaacacacgaaatgtattgggtatcaaacgctacggggaatattgtttctagtgtaaacatgatttctcgcatgcttataaatagatttacaatgaaacacaagaaagcgacgtacgaacccgacgtagacctaggcagcggaaccaggaatattggtattgagtccgagataccaaacttggatatcataggcaaacgcatcgagaaaataaaacaagaacacgaaacatcatggcattatgaccaggatcacccttataagacatgggcataccatggaagttatgaaaccaaacagacaggtagtgcatcctccatggtgaatggcgtggttagactattaacaaagccatgggatgttgtacctatggtaacgcaaatggcaatgacggacaccacaccctttggtcaacaaagagtgttcaaggaaaaagtagacactcggacccaagaacctaaagagggtaccaagaaattaatgaaaataactgctgagtggctgtggaaagaacttggaaaggagaaaactccccgaatgtgtactagagaggagttcactagaaaagttcggagtaatgcggccttaggagccgtatttactgatgaaaacaagtggaagtcagctagggaagcagtcgaggatggacgattctgggaacttgtagacagagaaagaaatcttcaccttgaaggaaagtgtgaaacttgcgtctacaacatgatgggaaaacgagagaagaaactaggtgagttcggaaaggcaaaaggatcgcgcgcaatatggtatatgtggcttggagctagattcttagagttcgaagcgctgggatttcttaacgaggatcactggttctctagaggaaatagtctaagtggtgtagaaggtgaggggttacatagacttggttacattttgagagaggtagggaagaaagaaggaggagcgatgtacgctgatgacactgcagggtgggacacacgaattactttagaagaccttaaaaacgaagagatggtaaccaatcatatgaaaggcgaacataagaaattagcagaggccatttttaaactaacctaccaaaataaagtggtgcgggtacaaaggccaactccacggggcacggtcatggatataatctcgcgaaaagaccagagaggaagtggtcaggtaggtacatacggtcttaacacatttactaatatggaagcacaattgatacgccaaatggaaggagaaggaatatttaaatccattcaacatctaactgcaaccgaagaaatagcggtgcaaaactggttagctcgggtcggaagggaaagattatctcgaatggctatcagcggtgatgactgtgttgtaaaacctattgatgatcggttcgcaagcgcgcttacggctctgaatgatatgggcaaggtaagaaaggacatacagcagtgggagccctcgcggggctggaatgactggacacaggtacccttctgctcccaccatttccatgagttagtcatgaaagacgggcgagtcctagtcgttccttgtagaaaccaggatgaattaataggccgggctaggatcagtcaaggggcaggctggagccttaaagaaactgcatgcttgggtaaaagctacgctcaaatgtggaccttaatgtacttccacagaagagatttgaggttggctgccaatgcaatctgttccgctgtaccgagtcattgggtacccacaagtcgaactacttggagtattcatgccaaacacgagtggatgactacggaagatatgctcgctgtttggaaccgggtgtggatacaagaaaatccatggatggaagacaaaacaccagtagagagctgggaagaggtaccctatctcggtaaaagagaggatcaatggtgtggtagcctaatagggttgacatccagagctacgtgggctaaaaacattcagaccgcaataaatcaggtgagaagtctaatcggaaacgaagggtacactgattatatgccgtccatgaagagattccgaagagaagaagaagaagctggggtactttggtga

SEQ ID NO: 22193 - RNA, 9876 nt, synthetic construct
  misc_feature 1..9876: note = derived and/or modified CDS sequence (opt6) from DENV-2__JX286518__SS-prME
  source 1..9876: mol_type = other RNA
acagcaggagtaatagtgatgttaataccaactgctatggcttttcatttaaccacaaggaacggagaaccgcatatgatagtaggtaggcaagaaaaagggaaaagtctgctatttaaaactgaagacggcgtaaacatgtgtaccttaatggctatagatctgggagaattatgcgaagacaccataacatataaatgtcccttattgcggcaaaacgaaccggaagatatagattgctggtgtaactcgacatctacatgggttacttacggtacgtgtactacgaccggcgaacataggagggagaaaaggtcggtagcattagttccacacgttggaatgggactagaaacccgaactgaaacttggatgagcagtgaaggtgcatggaaacacgtacagagaatagaaacatggatattgagacacccaggttttactataatggcagcaattttagcatatacaataggaacaacacacttccaacgtgcattaatattcatcctgctcacagctgtagccccgtcaatgacaatgagatgtataggaattagcaatagagattttgtagagggcgtgtcaggaggttcatgggttgacatcgtgctagaacacggctcttgtgtaacaaccatggctaaaaacaaaccaacactcgacttcgaactaataaaaacagaagcaaaacaacctgcaactctcagaaaatattgtatcgaagctaaattgactaatactacaacggaatccagatgcccaacgcagggtgagcccagtcttaacgaggaacaagataaaagatttatatgcaaacatagtatggttgacagagggtggggaaatggctgtggtcttttcggaaaagggggcattgtaacatgcgcaatgtttacatgtaagaaaaacatggaaggaaaaattgtacaaccagaaaatctagaatatactattgtcattaccccacattctggcgaagaacacgcagtaggtaatgatacaggcaaacacggaaaagaaataaaaatcacgccacagtccagcacaactgaagctgaattgaccggttatggtactgtcacgatggaatgcagcccccgtacaggacttgactttaatgagatggtgttattgcagatggaggataaagcctggcttgtgcatcgacagtggttccttgatttaccattgccatggcttcctggagcagacacccaaggcagtaattggattcaaaaagaaactttggttacatttaaaaatccccatgcaaagaaacaagatgtagtggtactaggttcccaagaaggcgctatgcatacagcactcacaggtgcaacagaaatacaaatgagctcgggtaaccttctcttcacaggacatttaaaatgtagactccgcatggataagctacaactaaagggaatgtcatatagtatgtgcacgggaaaatttaaaatagtaaaagagatcgccgagactcaacatggaaccatcgtaattagggtccaatatgaaggagatggaagcccttgtaaaataccttttgaaataacagatttagagaaaaggcacgttttgggacggctcattacagtaaatccgatagtcaccgaaaaagacagtcctgtaaacattgaggctgagccaccattcggtgactcttacataatagtcggtgtggaacctggtcaattaaagttgaattggttcaagaaagggtcgtcgataggacaaatgttcgaaacgaccatgagaggagctaaaaggatggctattttgggagacacagcttgggatttcggttcattgggaggagtatttacctcaattggcaaagcattacaccaggtgtttggagcaatctacggcgcagcgtttagcggcgtttcctggaccatgaagattctaattggagtaattattacatggataggaatgaacagtcgatctacttctttatcggtcagcctagttcttgtgggggtggtaacattatatctgggcgctatggttcaagcagactcaggatgtatcgtaagttggaaaaataaggagttaaagtgcggatctggcatttttattacagataatgttcatacgtggacagaacagtacaagtttcaaccagaatcacctagtaaactagctagcgctatccagaaagcacacgaagaaggtatatgcggcataagaagtgtgacacggctcgaaaatctgatgtggaagcaaataacaccagaacttaaccatatcctgtccgaaaatgaagtgaaattgacgattatgacaggagacattaaaggcattatgcaggcggggaaacgctcactacgaccccaaccaacagagttgaaatactcatggaagacttgggggaaggccaaaatgctaagtacagaatctcataatcaaaccttcctaattgatggtcctgaaacagctgaatgccccaacactaatagagcttggaactctttagaagtagaggattatggattcggtgtttttacaacaaacatatggctgaaattgagagagaaacaagatgttttctgcgattcgaaattaatgtccgcagctataaaagataatcgagcagtacatgctgatatgggttattggatcgagtctgccttaaatgacacctggaaaatggagaaggcttcgttcattgaagtaaaatcgtgtcattggccaaaatctcacacactatggtctaatggtgtgttggaatccgaaatgataatccccaaaaacttcgccggaccagtatctcaacacaactatcgtcccggatatcatacacagacagctggtccatggcatttaggtaaactagagatggactttgatttctgcgaaggcacaacagttgttgttactgaagactgtggaaatcgaggcccaagccttcgaaccacaaccgcatcaggaaaactcataaccgaatggtgctgccgttcttgtacactacccccactacgctaccgcggagaagatggatgctggtacgggatggaaatacgtcccctgaaggaaaaagaggagaatttggtgaatagcctagtaaccgctggacacggacaaattgataatttttcattaggagtgcttggcatggctctgtttttggaagagatgttacggacacgtgtaggaactaaacatgcaatcctattagtagcgctatcattcgtaacgctaatcacagggaacatgagtttcagagatttaggtcgtgtgatggttatggtcggagcaactatgactgacgacattggcatgggtgtaacatatttggcattattggccgcttttaaagtgaggcctacatttgccgctgggctattacttagaaaactaacttcgaaagaattaatgatggcaacaataggtattgctttattatcacaatcgaccttacctgaaactatcttggaactaacagacgccttagcactaggcatgatggccttgaagatagtccgaaatatggagaaataccaactagccgtcacaataatggcaatcagttgtgtaccgaacgccgtaatattacaaaatgcatggaaggtatcttgtacgatattggctgcggtgtcagttagtccacttctccttacctccagtcaacaaaaggcagattggattccactagctctaactataaaaggattaaacccgactgcaatttttctaacaacattatcacgaacatctaagaaaagaagttggcctctaaacgaagctataatggcagttggcatggtcagcatcctcgctagttcgctattaaagaacgacatccctatgacaggacccctggtagccggaggattgttaacagtatgctacgtattaactggacgtagcgcagatctagaactcgaaagagcagcggatgtcaaatgggaagatcaggctgagatttcaggaagttcgcctatactttctattactatttccgaagacggcagtatgagtattaaaaacgaagaagaagaacaaacactgactattctaattcgcaccggccttttagttataagcggagtctttcctgtttcgatacctataactgctgcggcatggtatctttgggaagttaagaaacaaagggcgggcgtactgtgggacgtccccagtcctcctccagtagggaaggcagaactggaggacggagcttataggatcaaacaaagaggtatattgggatattcccaaataggtgctggggtttataaagaaggaacttttcacacaatgtggcatgtaacaagaggcgccgtattgatgcataggggaaaacggatagaaccctcttgggccgacgtcaaaaaggatttgatcagttatggaggcggttggaagttggaaggagaatggaaggaaggagaagaagtacaggtactagccttagaacctggaaagaaccccagagccgttcaaactaaacccggaatatttaagacaaacacaggaaccatcggggcggtgtctttggatttctctccaggaaccagtggaagcccaatcgttgaccgaaagggaaaagtagtcgggctctatggaaacggcgtagttactcgttcgggagcatatgtaagcgctattgcacaaaccgagaaaagtatagaagacaacccggaaatcgaagatgacatattcagaaagaaacgactaactattatggatctccacccaggagcgggtaagaccaagcgttaccttcccgcaattgtcagggaagcaatcaaacgcggcttacgaacgcttatcttagccccaacccgtgtcgttgccgcagagatggaagaagctctacgcggactaccgataaggtatcagacccctgcaatacgggcggagcatactggcagagaaattgttgatttaatgtgccatgcaacatttacaatgcgtcttctaagccccgtcagagtgccgaattataatttaatcattatggatgaagcgcattttactgatccagcaagcattgccgcacgtggatatatatcgactcgagtcgaaatgggtgaagcggcaggtatttttatgacagcaaccccacctggcagcagggacccttttccccaaagtaatgcaccgattatggatgaagaaagagaaataccggaaaggtcatggaacagtggtcatgaatgggtaaccgacttcaaaggaaaaacagtctggtttgttccctcaataaaggcgggcaacgacatagcagcatgtctaaggaaaaacggaaagaaagttatccaattatcgaggaaaaccttcgattccgaatacgtaaaaactagagcgaatgactgggattttgtggtcaccactgacatttctgaaatgggagcaaatttcaaagcggaacgtgtgatcgacccgagacgatgtatgaaaccggtaattttgaccgatggtgaagaaagggttatactagcaggtccgatgccggtcacacacagctcagcagcacaaaggagagggcgcatcggaagaaatcctaaaaacgagaatgaccagtacatctatatgggtgaacctctagagaatgatgaggattgcgcacattggaaggaagccaaaatgttactcgataacataaatacacccgagggcataatcccttccatgttcgaacctgaacgtgaaaaagtggatgcaatagatggcgagtacaggctaaggggcgaagcaagaaaaactttcgtggatttaatgaggagaggtgacttaccggtgtggctagcataccgagttgctgctgaaggcattaattatgctgacaggaagtggtgttttgacggaatcaaaaacaaccaaattcttgaagaaaatgttgaagtcgaaatatggaccaaggagggggaaaggaagaaactgaaacccaggtggctagatgcaagaatatattctgatccactagcactaaaggagtttaaagagttcgccgcagggaggaagagtctaaccctgaatctaataacggagatgggcagattgccaacctttatgacacagaaagcacgtaacgcattagataacctggcagtacttcatacagcagaagtcggaggaaaggcttatacacatgccttaagtgagctccctgaaacactagaaactctcctcttactaacactgctcgcagcggtaacgggtggaattttcttgtttctgatgtcaggtaaaggtatcggtaagatgacattgggtatgtgctgtattataacggcctcaatcctattatggtacgcacaaatacaaccgcattggatcgccgcttccataattttagagttctttttaattgtacttctcataccggaacctgagaaacaacggactccccaagacaaccaattgacttacgttgtaatagctatattaacagtagtagcagctacaatggcaaacgaaatgggattcctagagaaaacgaagaaagatctcggattcggaagtatcacaacacaagaaagcgaaagcaatatactcgatattgatctccgaccagcttccgcctggactttatatgctgtcgcaacaacctttgtaacgccgatgctacgtcatagcatcgaaaacagctcggtaaatgtttcgcttacagctatcgccaaccaagcaacggtactcatgggcttagggaagggttggcctttgtccaagatggacattggcgttccgttactcgccattggatgttattctcaagttaatccaataacattaacagccgcattgcttttattggttgcacattatgcaatcatcggaccaggacttcaagcaaaagcaacccgcgaagcccaaaagagggccgcagcaggaattatgaagaacccaactgtggacggtataacggttatcgatttggaacccattccgtatgacccaaaatttgagaaacaactaggacaggtaatgctattaattttgtgtgttacacaagtactcatgatgagaacgacctgggctttgtgcgaagccctaactttagcaactggccccatctcaacattatgggaaggcaatccaggtaggttttggaatacaaccattgcggtcagcatggccaatattttccgaggtagttatttagccggtgcagggctcctattctctatcatgaagaataccacaaatacacgtagaggaactggaaatgtaggagaaacattaggtgagaaatggaagtcaagacttaacgcattgggcaaatctgagttccaaatatacaagaaaagtggaatccaagaagtagacagaacactagcaaaggaaggaattaagaggggcgaaacagatcatcacgcagtaagtagaggttcagcgaagctacgatggtttgttgaaagaaatatggtcacgcctgagggaaaagttgtagacctagggtgtgggagagggggttggagctattactgtggtggactcaaaaacgtcagagaagtaaaaggcttgacaaaaggcgggccaggccatgaagaaccgatacccatgagtacttatggatggaatttagtacgtctacaaagtggtgtagatgtatttttcacacccccagagaaatgtgataccctattatgtgatatcggagaatcaagccccaatccaacaattgaagccgggcgcacattacgcgtacttaatcttgtagagaattggttaaataacaacacacaattttgcattaaagtcctaaatccatatatgccatctgtaatagagaaaatggaaactttgcagagaaaatatggaggagccctagtcaggaatcccttgtctagaaattcaacacatgaaatgtattgggtttcaaatgcaacaggaaatatcgtttccagtgtcaatatgataagtcgtatgctaatcaatcgatttacaatgaaacacaaaaaggctacctacgagccagacgttgatctcggatcagggacacgaaacattggcattgaatcagagattccaaatttagatataataggcaaaagaatcgagaaaataaagcaagaacatgaaacatcgtggcattatgatcaagaccatccatataagacatgggcttatcatggaagttatgaaactaaacagactgggtctgcctcatcaatggttaatggagtagtaagattgctgacaaaaccatgggatgttgtcccgatggtaacccagatggcgatgacagacaccacgccttttgggcaacaacgagtgttcaaagaaaaagtcgacactcgcacccaagaaccaaaggaaggaacaaagaaattgatgaaaattaccgcagaatggctatggaaagaactggggaaagagaaaactcctaggatgtgcacacgcgaagaatttacaagaaaagtacggtcgaatgccgcattaggcgccgtattcacggatgaaaacaagtggaaatcagcgagagaagccgtagaagatggacgattctgggaattagtagatagagagagaaatctacatttagaaggaaaatgcgagacttgtgtttacaatatgatgggcaaaagagaaaagaaactaggggaatttggaaaagcgaaagggtcaagagccatatggtacatgtggctgggtgccaggttcttagaatttgaagcattaggattcttgaacgaagatcactggttctcgaggggtaatagcctgtcaggagtcgaaggtgagggattacatagactaggttatattctaagagaagttggcaagaaggaaggaggtgcaatgtatgcggatgataccgcaggttgggatacgcgaattacactcgaagaccttaaaaacgaagaaatggtcacaaatcatatgaaaggtgagcacaaaaagctagcagaagccatctttaaattgacatatcaaaacaaggtagtgcgagtgcaacgaccaacacctcgagggacggtaatggacataataagcagaaaagatcaaagaggtagcggacaagtaggaacctacgggttaaatacgttcactaacatggaagcccagttgattcgtcaaatggagggagaaggcatatttaaatctatacaacatctaacagccaccgaagaaatcgcagttcaaaactggcttgcgcgggtaggaagagaaaggctatctagaatggcaatatcaggtgacgattgtgtggttaagccgatcgatgatcgattcgcatcagctctaactgcactaaacgatatggggaaggtacggaaagatatacaacaatgggaaccttcgagaggttggaacgattggacacaggtacctttttgttctcatcacttccatgaactggtaatgaaagatggaagggtattagtagtaccatgtagaaaccaagatgaattaattggaagggcaagaatcagtcaaggagccggctggtcacttaaggagacagcttgcctcggaaaatcgtatgcccaaatgtggacactaatgtactttcataggagagacttaagacttgcagccaatgccatatgctcagcagtacctagccattgggttccaacgtcaagaacaacatggagtatacatgcaaagcacgaatggatgacgactgaagatatgcttgctgtttggaatagagtgtggatacaggaaaatccatggatggaggacaaaacccccgtggaaagctgggaagaggttccatatcttggaaaacgagaagatcaatggtgtgggtctttaataggtttaacgagtcgtgctacatgggctaagaacatccaaactgcaatcaatcaagttcgttctctaattgggaatgaagggtacacagattacatgccctcgatgaaacgtttccgaagggaagaggaggaagcgggtgtcttatggtaa

SEQ ID NO: 22194 - RNA, 9876 nt, synthetic construct
  misc_feature 1..9876: note = derived and/or modified CDS sequence (opt6) from DENV-2__JX286519__SS-prME
  source 1..9876: mol_type = other RNA
actgcgggagtaattgtcatgcttataccaaccgcaatggcatttcatttgacaacaaggaatggtgaacctcacatgattgttggtcggcaagaaaaaggtaaaagtttattgtttaaaactgaagatggtattaatatgtgcacactaatggcaatagatctaggtgaattatgcgaagatactatcacatataaatgtccacttttaagacaaaatgaaccagaagacatagactgttggtgcaatagcacttcaacttgggtaacttacggtacatgtacgaccacaggagaacatagacgagaaaaacgaagtgtagcgctagtcccacacgtagggatgggtttggaaaccaggacagaaacatggatgtcttcggaaggagcatggaaacacgtacagcggattgaaacgtggatacttcggcatccaggttttactataatggctgcaattttggcttatacaataggtacaacacacttccagcgagcgctgatattcattctgcttactgcagtcgcaccatcaatgacaatgcgttgcataggtatatcaaacagagatttcgtagagggagtctcaggaggatcctgggttgatatagtgttagagcacggctcctgcgttaccaccatggccaaaaataaacctactctagacttcgagctaatcaaaactgaggcaaaacaacctgctacgttgcgtaaatattgtatagaagcaaaactaacaaacacaacgacagaatcacgatgtcctacacaaggggagcccagcctaaacgaagaacaggataaaagattcatatgtaaacattctatggtagataggggatggggaaatggttgcgggctatttggtaaaggagggattgtaacctgtgcaatgtttacctgtaaaaagaacatggaagggaagatagtacaacccgaaaatttagaatatacgatagtgattacaccacatagcggggaggaacatgccgttggtaacgatacgggaaaacatggcaaagaaataaaaatcacaccgcaaagttccaccactgaagcagaactaactgggtacggaacagttacaatggaatgcagccctcgaacgggacttgattttaatgaaatggtcctactacaaatggaagataaagcatggttggtacatagacagtggttcttagatctgccactcccatggctcccgggagcagacacacaaggttctaattggatacaaaaagagactctcgttacatttaaaaatccacatgccaaaaagcaagatgtggtagttctcgggtctcaagaaggagcaatgcataccgctcttacaggagccacagagatacaaatgagtagtgggaatcttctcttcactggtcacctaaaatgccggttacgtatggataaacttcagttaaaaggaatgagttattcaatgtgcacgggaaaatttaaaatagtaaaagaaatcgctgagactcaacacggcacaatcgtgataagagtacaatacgaaggtgacgggtcaccttgcaaaataccatttgaaattacggatcttgagaaaagacacgtcttaggaaggctgataaccgtaaacccaatagttactgaaaaagattctcccgtaaatatcgaagcagaacccccttttggagatagttatataatagtaggagtggaaccaggtcagctcaaactaaattggtttaagaagggtagctctattggacagatgttcgaaactacaatgcgcggcgcaaaaagaatggcaatacttggggatacagcttgggactttggttctttaggaggtgtattcacatctattggcaaagcacttcatcaagtgtttggggcaatctacggcgccgccttcagtggagtttcttggacaatgaaaattttgattggagtgattataacgtggattgggatgaactcaagatctacatctttatctgtgagtttagttcttgtgggagttgtaacactgtatttaggagcgatggtccaggcagattctggttgcatagtaagctggaagaacaaagaattaaaatgcggaagcggcatcttcataaccgataacgttcatacttggaccgaacaatataaattccaacctgagagtccctcaaagttagcaagtgcgatacaaaaagcacatgaagaaggcatttgtggaattagatccgtaactaggctagaaaatctaatgtggaaacaaattacaccggagttaaaccacatattgtcagagaatgaagtaaagttgaccataatgacaggagacataaagggaatcatgcaggcgggaaaacgctcactccgtccccaaccaacagagttgaaatacagttggaaaacgtggggaaaagcaaaaatgctgtcgacagagtcacataatcaaacctttcttatagacggacctgaaacagcagaatgcccaaatacgaatagagcatggaactcactcgaagttgaggattatggattcggagtttttactacaaatatatggttaaaactacgagaaaaacaagacgtgttctgtgattcaaaacttatgagtgcagctatcaaggacaatagagccgtccacgctgatatgggatattggatagaatcagcattaaacgatacttggaaaatggagaaagcatcctttatagaggttaaaagttgccattggcctaaaagtcatacattgtggtcaaatggggtattagaaagtgaaatgataatccccaaaaattttgcgggtcctgtatctcaacataattataggcctggctaccacacccaaactgctgggccgtggcacctgggtaaactcgaaatggactttgatttctgtgaaggaacaaccgttgtagtaacagaagattgtggaaatagaggcccttcattaaggacaacaaccgcttctggtaaactaattacagaatggtgctgtcggagttgtacactgcctcccttacgatatagaggcgaagatggttgttggtacggtatggaaatacgtccattaaaagagaaagaagaaaatttggtaaatagtttagttacagctgggcacggtcagatcgataatttttcgcttggtgtcttggggatggcgttatttcttgaggagatgctacgaacaagagtaggaactaaacatgcgattctattggtagcattatcatttgttacactaataaccggcaacatgtctttcagggacttaggccgggtcatggtgatggtaggagcgacaatgactgacgatataggaatgggcgttacgtatttggccctcttggcagcgtttaaagtaagaccaacttttgcagccggtctgttattacgaaagttgaccagtaaagaacttatgatggccactataggaattgcactacttagtcaatccacattgcctgaaacaatacttgaactgacagatgcgttagcgctaggcatgatggctctaaagatagtgagaaacatggaaaagtatcaactcgcggtaacaattatggcaataagctgcgttcctaatgcagtaattctgcaaaacgcttggaaggttagttgcacaattctagcagccgtatcggtgtcccctttactattgacatcaagccaacaaaaagcagactggattcctcttgcactaacgatcaaaggactcaacccaaccgctatatttttaaccacgttgtcaaggacaagcaagaaacggagctggccacttaacgaagctataatggctgtaggaatggtcagtatcttggcttcatcattattaaagaacgatatacctatgaccggacctttagttgccggaggattgctcactgtttgctatgttttaactggacgcagtgctgaccttgaactagagcgtgcagcagacgtcaagtgggaagatcaagctgagatcagcgggtctagtccgatcttatccataacgatatccgaagatggctccatgtcgataaagaatgaagaagaagaacagactcttacaatactaattagaacgggtttattggtaataagtggtgtgtttccggtatcaataccaattactgcggcagcctggtatctctgggaggtgaaaaagcaaagagctggagttttatgggacgtcccaagcccaccgcccgtaggtaaagcagaattggaagacggcgcatatagaattaaacaaagaggcatactaggatacagtcagatcggcgcaggagtctataaagaaggaacgttccacacaatgtggcatgtcacaagaggagctgtactaatgcataggggaaaaagaatagaaccgtcatgggcagatgtcaagaaagaccttatatcatacggtggtggttggaaactagaaggggagtggaaagaaggagaagaagtccaagtcttagcactagaaccaggcaaaaatcctagggcggtacaaacaaaacccggtattttcaaaactaacacaggcacaataggtgccgtttcactggacttctcccccgggacaagcggaagccctattgtagataggaaaggtaaggtagtcggactatatggtaatggagtagtaacgcgttccggagcatatgtaagcgcgattgctcaaacagagaaaagcatcgaggataatccggaaatagaggacgatatattcaggaagaaacgtttaactataatggacttgcacccaggagcaggaaaaactaaaagatacttgcctgcaattgtaagggaagcaataaaacggggtttaaggacgctcattcttgcccccacaagagtagtggcagcagaaatggaagaggctttaagaggtctaccaatacgctaccaaactccagccattagagccgaacatactggaagagagatcgtggaccttatgtgtcacgctaccttcacgatgaggctattatcaccagttagagtaccaaactataatttgatcattatggatgaagctcacttcaccgaccccgcatcaattgcagcaagaggatacatttctacacgcgttgagatgggagaagcagctggtatatttatgacagcaactcctcccggatcacgggacccttttccgcaaagcaatgctccaattatggatgaggaaagggaaatcccagaacgatcatggaactctggacacgaatgggttacagattttaagggcaaaactgtatggtttgtgccatctataaaggctggaaacgacatcgcggcttgtctgcgaaagaatggcaaaaaggtgatccagttatcaagaaaaactttcgattcagaatatgtaaagacacgagcaaatgattgggatttcgtggtgacaacggacatatcggagatgggagctaacttcaaagcagaaagagtaatagaccctcgacgttgtatgaagcctgtcatcctgactgatggcgaagaacgggtaattttagctggacccatgcctgttactcatagctcagcggctcaaagaagaggtcgtattggtcgaaatccgaaaaacgagaatgatcagtacatttacatgggggagccattggaaaacgatgaagattgtgcgcattggaaagaggcgaaaatgttactggacaatataaatacgccagaaggaattgtcccgagtatgtttgagcccgagagagagaaggtcgatgccatagacggggaatacagattaaggggagaagcacggaaaacctttgtggacttaatgagaaggggagacttacccgtgtggctggcatataaggttgcggctgaaggaatcaattacgcagacagaaaatggtgctttgatggcattaaaaataaccagattctcgaggaaaatgtggaagtagagatatggacaaaagaaggtgaaaggaagaaactcaaaccccgctggttagatgctagaatatattcggaccctttagcattaaaagaatttaaagaatttgcggccggaaggaaatctttaactttaaatttaataacggagatgggaagactgccgacttttatgacacaaaaagcacgatcagcactcgacaatttagcagttcttcatacggccgaggtgggaggtaaggcttacacccatgcattgtcggaactgccagaaactttagaaacactactattactaacacttctagcagccgtcacagggggaatctttttatttttaatgagtggaaaaggtataggaaaaatgacgctgggtatgtgctgtataatcactgcgagtattttactatggtacgcacaaatccagccacactggattgcagctagcataattttagagttcttcttaatcgttttactaatacccgaacctgagaaacaaagaacgccgcaagacaatcaattgacctacgtggttatcgcaatattaaccgtagtggcagcaactatggcgaatgaaatgggcttcctagaaaagaccaagaaagacctaggatttgggtcgattacaacacaagaatccgaatcaaatattttagatatagacttgcgtccagccagcgcgtggacattatatgcagtagcaacgacttttgttaccccaatgttgcgacacagcatagaaaattcgagcgtaaatgtatcattaactgctatagctaatcaggcaaccgtgttaatgggattagggaaaggttggcctttgtcaaagatggacataggggtgcctttattagctatcgggtgttatagccaggtcaatccaatcacgttaactgcagcattattattgttagttgctcactacgctataatcggacccggcttacaggcaaaagctactcgtgaggcgcaaaagagagcggctgcagggatcatgaaaaatccaacggttgatgggattaccgttatcgatctagaaccaataccttatgacccaaagttcgaaaagcaactgggtcaggtaatgctactaattttatgcgtaacgcaagtattgatgatgagaactacatgggcgctttgtgaagcactaaccttagccactggacctatctcaactctttgggagggaaatcctgggcgattttggaatactacaattgcagtaagtatggcaaatatttttcgtggctcctacttagccggtgcaggcctattgtttagtataatgaaaaacactactaatacaagacggggaacagggaatgttggagaaactctaggagagaaatggaaaagtagattaaatgctttaggcaagagcgagtttcagatatacaagaaatcaggaatccaagaggtagaccgtacattagcaaaagaaggcatcaagcgtggggagaccgatcaccatgcagtatccagaggtagtgccaaactgagatggtttgtcgaacgaaacatggttacaccggaaggtaaagtagtcgacctaggatgtggtcgaggtggatggagctactattgtggcggactcaaaaatgtacgtgaagtaaaaggattaacgaaaggtggcccgggccacgaggaaccgatacctatgagtacatatggttggaacttagtacgattacagtcaggagttgatgtgttctttaccccaccagaaaaatgtgacaccttgctatgtgacataggagaatcatcaccaaaccccacaatcgaagcgggaagaaccttaagagttttaaatctagtagaaaactggctcaataataatacgcaattttgcattaaagttctcaatccatacatgccgtcagttatagagaaaatggaaactctacagcggaaatacggtggggccctagtacgtaatccactaagtagaaattcgacgcacgagatgtactgggtaagcaacgctacaggcaatatagtctctagcgtcaacatgattagtcgcatgctcatcaatcgatttactatgaaacacaagaaagcaacatacgagcctgacgtagacttaggatcgggtacacgtaacattgggattgaaagtgaaataccaaatctcgatataattgggaaaagaatcgaaaagataaaacaagagcacgagaccagttggcactatgaccaagatcacccctacaaaacttgggcctatcacggatcgtatgaaaccaaacagacaggaagtgcttctagcatggtgaatggagtagttaggcttctcacaaagccctgggacgttgttcccatggtaacacaaatggctatgacggatacaacaccattcggccagcagagggtcttcaaagagaaggtagataccagaacccaagaacctaaagaagggacaaagaagctaatgaaaataacagcagaatggctatggaaagagttaggaaaggagaagacacccagaatgtgcacccgtgaagaatttacacgaaaggtaagatcaaacgcagcgctaggtgcagtatttactgatgaaaacaaatggaaaagtgcccgagaagcagtggaagatggcagattctgggaactggtagaccgagaaagaaatctacatcttgaggggaaatgcgaaacttgtgtgtataatatgatgggtaagcgtgagaagaaattaggagaatttggtaaagctaaggggtcaagagctatatggtatatgtggcttggggccagatttttagagttcgaagctctaggattcctgaatgaagaccattggttttcgagaggaaatagccttagcggtgtggagggagaaggactacacagattaggatatatattgagggaagtcggcaagaaggagggaggcgcaatgtacgctgatgatacagcaggctgggatactagaataacactggaggatctaaagaacgaagagatggtaacaaatcatatgaaaggagaacataagaaactagctgaagcaatatttaagttaacttatcaaaacaaagttgtgagagtccaaagacctactcctcgaggaacagtcatggacataatatcaagaaaggatcaacgcggaagtggccaggtaggaacatacgggctaaacacgtttacaaatatggaagcccaactaattagacaaatggaaggggaggggatatttaaatcaatccagcatttaacagccactgaagaaatagcagtccaaaattggttggcaagggtgggtagagaaaggctaagcagaatggccattagcggcgatgattgcgtagtaaaacctattgacgatagattcgcatcggccttgacagcattaaatgatatgggaaaagttcgaaaagatatacagcaatgggaacccagtcgaggttggaacgattggacccaagtgccattctgttctcaccatttccacgaattagttatgaaagatggccgcgtcttggttgtaccgtgccgcaaccaagacgaattaatagggcgagccagaattagccagggcgctggttggagcttgaaagagactgcgtgtttaggaaagagctatgcgcaaatgtggacattgatgtactttcatcggagagatttgcgtttagcagcaaacgcaatatgctcagccgttccaagtcattgggtaccgacttcgagaacaacttggtccatccatgcaaaacacgaatggatgacaaccgaggacatgttagctgtttggaaccgtgtatggatccaagagaacccctggatggaagacaaaacccccgtagaaagttgggaagaagtcccataccttggaaagagggaagaccaatggtgtggaagtctaataggtctaaccagccgtgctacttgggccaaaaatatacaaaccgcaatcaaccaagtaagatcactgataggaaacgaaggttatactgattacatgccatcaatgaaacgattccgaagggaagaagaggaggctggggttttatggtaa

SEQ ID NO: 22195 - RNA, 9876 nt, synthetic construct
  misc_feature 1..9876: note = derived and/or modified CDS sequence (opt6) from DENV-2__KP188549__SS-prME
  source 1..9876: mol_type = other RNA
acagcaggagtaattgttatgcttatacccacagctatggccttccatttaactacaagaaatggtgaacctcatatgatagttggaagacaagaaaaagggaaatctcttctatttaaaacagaagatggagtgaatatgtgcaccctgatggcaatagacctaggagaattgtgcgaagatactataacatataaatgcccactattgagacaaaacgaaccagaagatatcgattgttggtgcaactcaacgtcaacgtgggttacttatggaacctgtacaactaccggggaacatagacgggaaaaacgaagtgttgctctagttccccatgtggggatgggattagaaacgagaacggaaacatggatgagttcagaaggagcctggaaacacgtacaaaggatagaaacatggatactaaggcacccaggtttcactataatggcggcaattttagcttacacaatcggaactactcacttccaaagagctctgatattcatactattaactgcagtagcgccaagtatgacaatgaggtgtattggcatttcgaacagagattttgtcgaaggagtatcaggcggcagctgggtagacattgtactagaacatggctcatgtgtaactactatggctaaaaataaaccaacattagatttcgagctgattaaaaccgaagccaaacaaccagcaactttacgcaaatattgtattgaagcaaaattaacaaatacaactacagaaagtcgctgtcctacgcaaggagagccttccttaaatgaagaacaagacaagagatttatatgcaagcattccatggtcgaccgtggctggggtaatggatgtggattatttggaaaaggaggaatcgtaacgtgtgctatgtttacgtgcaagaagaatatggaggggaaaatagtacaacccgagaacctagaatatacgatagtcatcacacctcattcgggagaagaacatgctgttggaaacgacacaggaaagcacggtaaagaaatcaaaattacgcctcaaagttcaacaacagaagcagaacttaccggatatggtacagttacaatggaatgttctccacgtacaggtctcgattttaacgaaatggtattactgcaaatggaagataaagcatggctcgtacatcgtcaatggtttttggacctccctctgccttggctaccaggtgcagatactcagggctctaactggattcaaaaagaaacattagtaaccttcaaaaaccctcacgcaaagaaacaggatgtagtcgttttggggagtcaagaaggtgccatgcacacagcattaaccggagcaacagaaatacaaatgtctagtggaaacttgctatttaccggacatctaaagtgtcgactacgaatggataaactacagcttaaagggatgagctattcaatgtgtacgggtaaattcaaaatcgtcaaagaaatagctgagacacaacatggaacgatagttatcagagtacaatatgaaggtgacgggagtccatgcaaaattccgtttgaaataacagatttggaaaaacgtcacgtactgggaagactaattacagtaaatcccatagtaacagaaaaagattctccagtaaatatagaagcagagccacctttcggtgacagttatataatagtgggagtggaaccgggacaacttaaacttaactggttcaagaaaggatcctctatagggcaaatgtttgaaacaactatgcggggtgccaaaaggatggctatacttggggatacagcatgggactttggatcgctagggggtgtcttcacatcaattggtaaagcactacaccaggtatttggagcaatatacggtgcggctttttctggtgtctcatggacgatgaaaattttaattggagtgattataacctggataggcatgaactcgagatccacatctctctcggtaagcctagttttagtaggagtcgtaaccttgtatttaggtgcaatggtgcaagctgattcaggctgcatcgtatcgtggaaaaataaagagttaaaatgcggatcaggtatctttataactgacaatgtacacacttggactgaacagtacaagtttcaacccgaatcaccatcaaaactagcatctgctatacagaaggcgcacgaggaagggatttgtggaatcagatcggtaactcgattagaaaatttgatgtggaagcaaataacacccgaattaaaccacatcttatccgaaaatgaagtaaaattgacaataatgactggagatattaaaggcataatgcaagctggtaaacgcagcctaagaccgcaacccacggaacttaaatatagctggaaaacctggggaaaagcgaagatgctaagtactgaatctcacaatcaaacattcttaatcgacggacctgaaaccgcggagtgtccaaacactaatagagcttggaatagcctcgaagttgaagattacggatttggcgtctttacaacaaacatatggttgaagttacgagaaaaacaggatgtcttttgcgactctaaacttatgtccgcagcaattaaggacaatcgagcagtccacgctgacatgggttactggattgagtcagctctcaatgacacatggaaaatggagaaagctagtttcatagaggtaaaatcatgccattggcccaaatcacatactctctggtctaatggagtgttggaatctgaaatggtcattcctaaaaactttgcaggtcctgtctctcaacacaactatcgtcccgggtatcacactcaaacagccggaccttggcacctaggaaaacttgagatggattttgatttttgcgagggaacaacggtcgtcgttactgaagattgtgaaaagaggggaccgtcgctacgaacaacgacagctagtggtaaactaataactgagtggtgctgcagatcctgcactcttccacctctaagatatcgcggagaagacggatgttggtacggtatggaaataaggccgttgaaggaaaaagaagagaatcttgtaaatagtcttgtcacggccggtcacgggcagattgataactttagcttaggtgtattaggcatggcattgtttttggaggagatgctgcgaaccagagtgggtactaaacacgctatactattagtggccctatcttttgtaactctaatcactggaaatatgagttttcgagacctaggaagggtcatggtaatggtcggtgctacgatgacagatgatataggaatgggtgttacgtatctggcgttgctagcagcgtttaaggtacgcccaacttttgcagcaggattgttacttcgaaaattaacatcaaaagaactaatgatggccacaataggcattgcgctcctatcgcaatcaacactccctgaaaccatccttgaactgactgatgcattagcattgggcatgatggcgctgaaaatagtgcgaaatatggagaaatatcaactagcagtgaccataatggccatatcatgcgttccaaacgcagtcatcctacaaaatgcatggaaagtctcttgtactatcctggctgctgtaagcgtatcaccactgttactgacaagctcacagcaaaaggctgattggatcccattggcccttacgataaaaggattaaacccaactgctatatttctaacaactttatccagaacaagcaaaaagcgaagttggccactgaatgaggctatcatggcagtgggaatggtaagtattttagcgtctagtctcttaaagaatgatattcccatgacgggacctctcgtggcaggagggttattaacagtttgttatgtgttgaccggccgctctgcagaccttgaactcgaaagagccgccgatgtaaaatgggaagaccaagcggaaatatccggatcttctcctatcttatctattactattagcgaagacggtagtatgtcgatcaaaaatgaagaagaagaacaaaccttaactatcttgattcgaactggattgctagtaataagcggagtttttcctgtcagtataccgataactgcagcggcttggtatctatgggaagtgaagaaacaaagagcaggagtattatgggacgtaccatctccaccacctgtgggaaaagcagaacttgaagacggtgcatacagaatcaaacaaagaggaatactaggctactcgcaaataggagcgggtgtgtacaaagaaggtacatttcatacaatgtggcatgtcactaggggtgccgtgttgatgcatagaggaaaaaggattgaacctagttgggccgatgtcaagaaagatttaatatcatacggcggtgggtggaagctggaaggagaatggaaggaaggagaagaggtgcaggtcttggcacttgagccgggcaaaaatccaagagcggtacaaaccaaacctggaatttttaaaacaaataccggcactattggggcggtcagcctcgacttttcgcctggcacaagtggaagcccaattgtagatcgtaaaggaaaggttgtaggtctgtatggaaacggagtagttaccagatctggagcatatgtttcagcaatagcacagaccgagaagtctatagaagataatccggagatagaggacgatatcttcaggaagaaacgacttacaataatggatctacatccaggggcgggaaaaactaaaagatatctcccagccatcgttcgagaagcaataaaaagaggcttgcgcacgctaatccttgctcctacaagggttgttgcagccgagatggaagaagcactaagaggtttaccgatacgctaccaaacacccgccataagagctgaacacactgggagagagattgttgatttaatgtgccatgctacatttaccatgagactgctatccccagtgcgcgttcccaattataatctcataataatggacgaagctcattttacagatccagctagtatagcggcaagaggatatataagcacgcgtgtagagatgggagaagctgcaggcatattcatgacggcgaccccaccgggatcacgagacccatttcctcaatcaaacgcaccgataatggatgaagaaagagaaataccagaaagatcatggaacagcggacacgaatgggtgaccgattttaagggtaaaacagtatggttcgtgccatcgataaaggcgggtaacgacatcgcagcatgtctaaggaagaacggcaagaaagtcatacagctatcccggaaaacttttgactcagaatatgtaaaaacgcgagcaaatgattgggacttcgtcgtaaccacagacatttccgagatgggcgccaattttaaagcagagagggttattgatcctcgtagatgcatgaagcctgtaatactaactgatggtgaagaacgagtaatacttgctggcccaatgccagtgacacattctagcgctgctcaaagacgaggaaggattggaagaaaccctaaaaacgaaaatgaccagtatatatatatgggtgagcccctagaaaacgatgaagattgtgcacattggaaagaagctaaaatgcttctagacaatattaacacaccggaaggtattatcccatccatgtttgaaccagaaagagaaaaggtcgatgcgatcgatggagaatacagactgcgaggagaagcccgaaaaacatttgtagacctaatgaggagaggagacttacctgtatggcttgcgtataaagtagcggcagaaggaataaattatgccgatcggaaatggtgcttcgatggaattaaaaataaccagatactagaagaaaatgtggaggtagagatatggaccaaggagggtgaacgaaagaagctcaaacctaggtggcttgacgcaagaatatattccgatcctctagcgttaaaagaatttaaagagttcgctgctggtaggaagtcactaacattaaacctaataactgagatgggtagacttcccaccttcatgacccaaaaagctcgtaacgccttggataatctcgcagtattgcacaccgctgaagttggtggaaaggcttatacacacgctttatcagaactaccggagaccctggaaaccttgctattgctcacgttattagctgctgtgacaggtggaatctttttgtttttaatgtcaggaaaaggcataggaaaaatgacacttgggatgtgttgcattataaccgcctcaatattactatggtatgcacaaattcagccccactggattgccgcttcaataatcctggagttctttcttatagtactactaataccagaaccagaaaaacagcgtacaccacaagacaatcaattaacatatgtagtaatagctatacttacggtagttgctgctacgatggcgaacgaaatgggatttctagaaaagacgaagaaagatcttggattcgggtccatcaccacgcaagaatcagaatcaaatatattggacatagacctacgtccagcttctgcctggacgctttatgctgttgcaacaacatttgtcactccaatgttaagacattcaatagaaaatagctcagtcaatgttagtttaacagcgatcgccaaccaggctacagtcctgatgggtttaggcaaaggttggcctttaagcaagatggatattggagttccattactagcaatcggatgttattcccaagttaatcccattaccttgactgcggccctacttctgttagttgcacactacgccattattggacctggattacaagccaaagctacgagagaagcccaaaagcgggcagcagcaggtataatgaaaaaccctactgtggatggaatcacagtcatagatctcgaaccaataccttacgaccccaaatttgaaaagcaacttggacaagttatgcttctaatcctttgtgtaacccaagttctaatgatgagaacaacttgggcgctttgtgaagcactaactctggcaacgggtcctatatctacgctgtgggaagggaatccaggaagattctggaatacaacaatagcggtgtcaatggctaatatttttagggggagttacttagctggagcaggcctattgtttagtatcatgaagaatacgaccaacacacgacggggaactggtaatgtcggagagactttgggcgaaaaatggaaatccagactaaacgcgctaggaaaatccgagttccaaatttacaaaaagtcagggattcaggaagttgatagaactttagccaaggaaggtataaaacgaggggaaacagaccatcacgcagtaagcagaggaagtgctaaactccgttggttcgtagaaaggaacatggtgacccctgaaggaaaagttgttgatttaggatgtggtagaggcggatggtcgtattactgcggaggtctcaaaaacgttagagaggtaaaaggattaactaaaggaggtcctgggcatgaagaacctataccaatgagtacttatggctggaacctagtgagactccaatctggagtggatgtcttctttacaccaccagagaaatgcgacactcttctatgtgatataggagaatcatcgccgaacccgacaatcgaggctggtagaacactgagagtattaaatcttgtggaaaactggcttaacaataatacacaattttgcataaaagtattaaacccatatatgccttctgtaatagagaaaatggaaacgctacagagaaaatatggtggtgcgttggtgcggaaccccttatctagaaatagtacccatgagatgtattgggtgagtaatgcgacgggaaacattgtgagttcagtcaatatgatatcgagaatgctaattaaccgcttcacaatgaaacacaagaaagcgacttatgaacctgatgtagatctagggtcgggcactagaaatatcgggatagaaagtgagacacctaatctagatataataggcaaaagaattgaaaagataaaacaagaacacgaaacaagctggcactacgatcaagatcacccgtacaagacctgggcataccacggtagttacgagaccaagcagactggtagtgcaagcagtatggtcaatggggtagtcagactgttaacaaaaccctgggatgtcgtaccgatggtaacccaaatggcaatgacagatacaacaccattcggtcaacaaagagtctttaaagaaaaagttgacacaaggactcaagaaccgaaagaaggtactaagaaacttatgaagatcacggcagaatggttgtggaaagagttaggtaaagagaaaacaccgcgaatgtgtacacgagaagagtttactagaaaagtaagaagtaacgccgcgctcggcgctgtatttacagatgagaataaatggaaatccgcaagagaagcggtagaagatggacgcttttgggagctagtagatcgggaaagaaacctacatctcgagggaaagtgtgaaacttgtgtatacaacatgatgggcaaacgcgagaagaaattgggtgaatttgggaaagcgaaaggatctagagcaatatggtacatgtggctaggcgcaaggtttttggagttcgaagcactaggatttcttaatgaagatcattggttctcaagaggaaactcattaagtggtgtcgagggagaaggattgcataggttaggatatatcttaagagaggtaggcaagaaggaaggcggcgcaatgtatgccgatgacaccgcaggttgggatacaagaataacactcgaagatttgaaaaatgaagaaatggtaacaaaccacatgaaaggagaacataagaaattggcagaagctatcttcaagttaacataccaaaataaagtagtaagagtacagcgacccacacccagaggaactgtaatggacataataagtaggaaagaccagagaggtagtggacaagtaggaacctatggacttaacacctttaccaacatggaagcccaattgataagacaaatggaaggggagggtatatttaaatccatacaacatctaacagccacagaagagacagctgtacaaaattggttggcgcgagtcggcagggaacgcttgagccgaatggcaatttcaggagatgactgcgtagttaaaccaatcgatgataggtttgctagcgcgctgacagcccttaacgatatgggcaaggtccgaaaggacattcaacaatgggaaccaagtcgtggctggaatgactggactcaggtgccattttgcagtcaccatttccatgagctagttatgaaagacggacgagttttagtagtgccatgccgtaatcaagatgagttaattggcagggcacgcatatctcaaggtgcagggtggtcattaaaagagactgcatgcctaggtaagtcctacgcacagatgtggacattaatgtattttcatcgacgcgatctacggctcgcagctaatgcaatctgttcagcggtaccaagtcattgggttcccacgtctcgaactacttggtccatacacgcaaaacacgaatggatgactaccgaggacatgcttgcggtctggaacagagtgtggattcaagaaaacccatggatggaagataagactcctgttgaaagctgggaagaagtgccgtacttaggaaagcgtgaagaccagtggtgcgggtctctaattggactgacatctagagccacatgggctaaaaacatacagacggcgattaaccaagtgagaagcctaataggtaatgaaggctatactgactacatgccaagcatgaagcgatttagaagagaggaggaggaagctggtgtgttatggtga

SEQ ID NO: 22196 - RNA, 9876 nt, synthetic construct
  misc_feature 1..9876: note = derived and/or modified CDS sequence (opt6) from DENV-2__KP188550__SS-prME
  source 1..9876: mol_type = other RNA
acagcaggagtaattgttatgctaattccaacagtaatggcgttccatttaacaaccagaaatggagagccacatatgatcgtcggacgacaagaaaaaggaaaatcacttctatttaaaacggaggacggtgtaaacatgtgtacattaatggctatagatttaggggaattatgtgaagatactataacttataaatgtccacttctgagacaaaacgagcccgaagatatcgattgctggtgtaatagcacatccacatgggtaacgtacggaacatgcacaacaaccggagagcacagacgggagaagagaagcgtagctctagtaccacatgtcggtatgggattagaaactcggacagaaacatggatgagttctgaaggtgcctggaaacacgttcagagaattgaaacatggatacttagacatcctggctttacaataatggcggcaattttagcatatacaattggaacaacgcatttccaaagagcgttaatttttatactactaaccgcggtagcgccatccatgacaatgagatgtataggaattagcaatagagattttgttgaaggagtaagtggaggatcttgggtagacatcgttttagaacatggcagctgtgttactaccatggctaaaaacaaacccacattagattttgaattaattaagaccgaagccaaacaaccggctacgttgagaaaatattgcatcgaagcaaaattaactaatacaaccacggaatccagatgcccaacacagggggagccttccttaaacgaagagcaagataaacgctttatttgcaaacactcaatggtcgaccgaggatggggaaatggctgcgggctatttggaaaaggaggtattgtcacttgcgcgatgttcacctgcaagaaaaacatggaaggcaagatagtccaaccggagaacctcgagtataccatagtaataaccccacatagcggagaagaacatgcagttggaaacgatacgggaaaacatggcaaagaaataaagatcacgccccaaagttcaacaactgaagccgagctcactgggtacggtacagttaccatggaatgtagtccaagaactggcttagatttcaacgaaatggtgctattacaaatggaagacaaggcctggttagttcacagacaatggttcctagatttgccattgccctggctccccggagcggatacgcaaggcagtaattggatacaaaaagaaaccctcgttaccttcaaaaatcctcacgctaaaaagcaagacgtcgtggttctaggttcacaagaaggtgcaatgcacacagcattgactggagcaacggaaatacaaatgtcgagcggtaacctgctttttacgggacatttaaagtgtcgtctacgaatggacaagctgcaacttaagggaatgagttatagtatgtgtaccggaaaattcaagatagtaaaagaaattgcagaaacacagcacggtacaattgtaattcgcgtacagtatgaaggggatgggtcaccttgcaagattccctttgaaataacagatctagaaaagagacatgtattaggacgattaattacagtaaatccaatcgttacagaaaaagactcacctgtgaatattgaagctgaacccccttttggtgacagttatatcatagtaggcgtagaaccaggtcaactgaaattaaattggttcaaaaaaggttcatcaataggtcagatgtttgaaacgacaatgcgtggtgcaaaacgaatggctattttaggtgatacagcttgggattttgggtctctcggaggagtctttacgagtataggtaaagcgctgcatcaagtattcggggctatctatggtgcagccttcagcggtgtttcatggacgatgaaaatattgataggagtgattattacatggataggaatgaacagtcgatcaacctcactatcagtttctctcgttttggtcggtgttgttaccttatatctaggagcgatggtacaagcggatagtggctgcatcgtaagttggaaaaacaaggagttgaaatgtggatctggaatattcataacggacaatgtacacacatggactgaacaatataaatttcaacccgagagcccatcaaaactagcctcggctattcaaaaagcacacgaagaaggtatctgcgggattcgcagtgtaacacgacttgaaaatttgatgtggaaacaaattacaccagaattaaatcacatattatccgaaaatgaagttaagttaacgattatgacaggcgacattaaaggtattatgcaagctggcaaacgttcgttgagaccacaacccactgaacttaaatattcatggaaaacatggggcaaagcgaagatgttatcaactgaatcacataaccagacattccttatcgacggaccagaaacagcagaatgcccaaatactaacagggcctggaattcacttgaagtcgaagattacggttttggcgtatttactacaaatatctggctcaagttaagagaaaaacaagacgtattttgtgattcgaaactaatgtctgcagcgataaaggacaatcgggccgttcacgcagacatgggatattggattgaatcagcattgaacgacacttggaagatggaaaaggcttcatttatagaagtaaagtcgtgtcattggccaaaatcgcatactctatggtcgaatggtgtactagaatctgaaatgataatacctaaaaatttcgcggggcccgtctctcaacacaactatcgtccaggatatcacacacagactgcaggaccctggcacctcggaaaattagaaatggacttcgatttttgcgagggtaccactgtagttgtgacagaagattgtggaaatcgaggtccgtctcttagaacaactacagcgagtggaaaactaataacagaatggtgctgccgatcatgcacgttgccaccactgcgttacagaggggaagatgggtgttggtacggcatggaaataagacccctgaaggaaaaagaggagaacctcgttaactcgttagtcacagctggacatggtcaaatagacaacttttctctaggagtactcggtatggcactgtttttggaggaaatgctaaggacaagagtaggaacaaaacatgcgatattattagtagccttaagttttgtcactctgattacaggaaacatgtcatttagggatcttggacgagttatggttatggttggcgcaactatgacggacgatataggaatgggtgtaacgtatttagccttattggcagcctttaaggtgcgaccgacattcgcggcaggcctcctactgcgcaaactaacgtcaaaagaactaatgatggctaccataggaattgcgctattatcccaaagcacgctacctgagactatattagagctaaccgacgctcttgcattaggaatgatggcattaaaaatagtcagaaacatggaaaaataccaattagcagtcaccataatggcaatatcctgcgtgcccaacgcagtaatactacaaaatgcctggaaagttagctgcacaatactagcagcagtgagtgtgagtcctttgcttctcacttcaagtcagcagaaagctgactggataccacttgcattaaccattaaaggtttgaatccgactgccatatttctgacgacattatcaaggacgtcaaagaaaagatcttggcctttaaatgaagcaatcatggccgtcggtatggtatccatattggccagcagcctcctaaaaaatgatatacccatgactggacccctagttgcagggggcctgttaacagtttgctacgtgctaaccggaagaagtgctgatctggagcttgagagggcagctgacgtaaaatgggaagaccaagctgagatatcaggatcttctccaatcttgagtattacaatttccgaagatggttcaatgagtataaaaaatgaggaagaagaacagacattaacaattttaatcagaaccggcttattagtaataagcggtgtcttcccagtatctatacccatcacagcagcggcgtggtatttatgggaagtgaaaaagcaacgagcgggcgtcttatgggatgtgccatcaccaccacctgtgggcaaagctgagttggaagacggtgcatatagaattaaacaaagaggcattttgggatattctcaaattggcgctggtgtgtataaagagggaacttttcatacaatgtggcatgtcacacgaggagcagtacttatgcatagaggaaaacgtattgaaccatcatgggcggatgttaaaaaagacctaatcagctatggtggagggtggaaactagaaggcgaatggaaagagggcgaggaagtgcaagttttagcattagaaccgggaaaaaatccgagagcggtacaaacaaaaccggggatcttcaaaactaacaccggaacaattggagctgtgagtcttgatttttcaccaggaaccagtggttccccgattgtagatagaaaaggtaaagtagtgggcttgtatggtaatggagtggtaacacggtcaggcgcttatgtgagtgccattgcacaaaccgaaaagtcaatagaagataatccagagatagaggatgatatatttagaaaaaaaagacttacaataatggatctacatccaggtgcgggaaaaacaaagagatatttgccagcaatagttagggaagctataaagcgaggacttagaaccctcatactagcccccacacgtgtagtcgcagccgaaatggaagaggcgttaaggggtcttcccattagataccagaccccggctattcgagccgaacatacaggcagagaaatagtagatctaatgtgccacgctacctttactatgaggttattaagtccagtgagagttccaaactacaacttaatcattatggatgaagcacatttcaccgatccagcatctatagcagctcgtgggtacatttcaacaagagtagaaatgggagaagctgctggcatctttatgacagctacgcccccaggctcacgggacccgtttccccagagcaatgcgccaatcatggacgaggaaagagaaatcccagaacgttcctggaattccggacacgagtgggtcaccgacttcaaaggaaagactgtctggtttgtaccaagtattaaggcgggtaatgatatagctgcgtgtttacgcaagaatggaaaaaaggtgatacaactaagccgcaaaacctttgattcagagtatgttaaaacgcgagcgaacgattgggactttgtggtaactacagatatttctgagatgggagccaattttaaagcagagcgtgtcatagatccaagacgctgcatgaagcccgtaatcttgactgacggagaggaaagagtgatattagcgggaccaatgccagttacacactctagtgctgcgcagagacgtggaagaatcggaagaaaccccaagaacgagaatgatcagtacatatacatgggagaaccactagagaatgacgaagattgcgcacattggaaagaagcaaaaatgttactcgataatataaatactccagaaggcattatccctagtatgtttgaaccagagcgagaaaaagttgacgcaattgatggggagtatcgtttaagaggcgaagcaagaaaaacatttgtggacttaatgagaagaggagatttgcccgtgtggttagcctacaaagtggcagccgaggggataaactatgctgaccgtaaatggtgtttcgacggaataaaaaacaatcaaatactggaggaaaacgtcgaagttgagatttggacaaaagaaggtgaaagaaaaaaattaaaaccgcgttggttggacgcacgaatttactcagacccattggcattaaaagaattcaaagaatttgccgcgggacggaaaagtctcacactaaacttgataactgaaatgggcagactaccaacgtttatgacacaaaaggcccgaaacgcattagataacctcgcagtactgcatacagcagaggtaggaggcagggcccacacgcatgcactatcagaattaccagagactctcgaaactcttcttcttttaacattactagcaactgtaacggggggaatattcctatttttaatgtctgggaaaggcattggtaagatgacacttggcatgtgctgtatcataacagcgagtatcctactgtggtacgcccaaatccaaccacattggatagctgcaagtatcatactcgaatttttcctcattgttctgttaatacctgaacctgaaaagcaacgaactccacaagataaccagcttacatacgtcgtcatagcgatattaacagttgtagcagctactatggcgaatgaaatgggatttctcgaaaaaactaagaaagaccttggctttggaacaataaccacgcaggagagcgaatcaaatatactagacattgatctgcggcctgcatcagcatggaccctatatgctgttgcgacaacattcgttacccccatgttgaggcacagtatagagaattcaagtgtcaatgtaagcctgacagcaatagcaaatcaagccacggttctgatgggattaggcaaggggtggccactaagcaaaatggatattggtgtcccattattagcaatcggttgctacagtcaggtgaatcccattacactaaccgctgcattactcctcttagtagcccattatgccataataggaccaggacttcaagctaaagcaacaagagaagcccaaaaacgtgcagccgcaggcatcatgaagaatccaacagtcgatggaattaccgtcatagaccttgagcctataccatatgatcccaaatttgaaaagcaattaggccaggtgatgttgttaatcttatgcgttactcaagtactaatgatgcgaacaacctgggcattatgtgaagcactaacattggcaactgggccgatatcaacattatgggaaggaaatcctgggagattctggaacacgacgatagctgtaagtatggcgaacatattcagaggatcatacctagcaggagcgggtttattatttagcatcatgaaaaatactactaacacgcgacgagggactggaaatgtgggggaaacgctaggagagaagtggaagtcgaggctaaatgctctaggtaagtcagaatttcaaatatacaaaaaaagcggaattcaagaggtggaccgtactctagccaaagagggtattaagcgaggtgaaaccgatcaccatgcagtgtctcgaggttctgctaaattgcgatggtttgtagaaagaaacatggtgactccggaaggaaaggtagtagatcttggatgtgggagaggtgggtggtcatactactgtggaggtttgaaaaatgtcagagaagtaaaagggcttaccaagggagggccaggtcatgaggaacccatcccaatgtcaacttatggctggaatctagtgcgattgcaaagcggagtcgatgtctttttcacaccgcctgagaagtgtgacacgttactctgtgacataggggagagctcaccaaatcctacaatagaagccggaagaacattaagagtattgaatttagttgaaaattggcttaacaataatactcaattttgtataaaggtgctgaatccgtatatgccgtcggtgattgaaaaaatggaaacattgcagcgcaaatatgggggagcattagtaagaaaccctcttagtcggaactcaactcacgaaatgtattgggtttcgaatgcaacaggtaacatagtttcatcagtgaacatgatatctcgaatgcttattaacaggtttacaatgaagcataaaaaagcaacatatgagcccgacgtagatctcggctcaggaacacgtaatattgggattgagagtgaaataccgaacttagatattataggaaaaaggattgagaaaatcaagcaagaacacgaaacttcttggcattacgatcaggaccatccatacaagacctgggcatatcacggatcatatgaaaccaaacagactggaagcgcaagtagtatggtaaacggtgtggtacgcttactcacaaaaccgtgggatgtcgtccccatggtgacccagatggctatgactgataccactccatttggtcaacagagagtctttaaggaaaaagttgatacacgtactcaggaaccaaaagaagggacaaagaaattgatgaaaataactgcaaaatggctctggaaagaactgggcaaagaaaaaacccctagaatgtgcaccagagaagaatttacacgcaaagtgcggagtaacgccgcactgggagcgatatttacagatgagaataaatggaaaagtgcgcgtgaagctgttgaagatggtaggttctgggagttggtagatagagaacggaatctgcatctagaaggaaagtgtgagacgtgcgtatacaatatgatgggaaagagagagaaaaagcttggagagtttggtaaggcaaaaggttcccgggccatatggtatatgtggttaggagctaggttcttggaattcgaagccttaggatttctgaatgaggatcactggttctcaagaggaaatagcctaagcggagtagaaggtgaaggactacatagattaggatatatactacgtgaagtcgggaaaaaagagggaggggcaatgtacgcagatgacactgcaggctgggacacgaggataacactagaagatttaaaaaacgaagaaatggtaacgaaccatatgaaaggtgaacataaaaagctagcagaggcaatatttaagttaacgtatcagaacaaagttgtgagagtacaacgaccaacacctagaggaacagtgatggacattatatcaagaaaagatcaaagaggatccggacaagtaggaacatacggtttgaatactttcactaatatggaagctcagcttattcgacaaatggaaggcgaaggaatctttaagaatatacaacacctcactgctaccgaagagatcgcagttcaaaattggctggcaagagtcgggcgagaaaggctgtccaggatggcaattagcggagatgattgcgtggtgaagccaattgatgaccgttttgcatctgcattgactgctttaaatgatatgggaaaagttcgaaaagacattcagcaatgggaaccttctcggggttggaatgactggacccaagtgcctttctgtagccatcattttcatgaacttgttatgaaggatggcagagtgttagttgtcccttgcaggaaccaggacgaacttatcgggagagcgagaatttctcaaggtgccgggtggtctttaaaggaaactgcgtgtttaggaaaatcatacgcacagatgtggactttaatgtattttcataggagagatctacgacttgctgctaatgcaatatgcagtgctgtcccaagtcactgggtgcccactagtaggacaacttggagtatacatgctaaacacgaatggatgacgacagaagacatgttggctgtttggaatcgtgtatggatacaagaaaacccttggatggaagacaaaacgccggtagaatcctgggaagaagttccatatctaggaaaaagggaagatcagtggtgcggaagtttgattgggttaactagtcgagcaacgtgggcaaagaacatacaaactgcgattaaccaagttagatccttgatagggaatgaaggatatacggattacatgccatccatgaagagatttaggagggaggaggaggaagccggggtactctggtga

SEQ ID NO: 22197 - RNA, 9876 nt, synthetic construct
  misc_feature 1..9876: note = derived and/or modified CDS sequence (opt6) from DENV-2__KP188553__SS-prME
  source 1..9876: mol_type = other RNA
acggcaggagttattgtaatgctaatcccaacggcaatggcgtttcatttaacgactagaaatggtgaaccgcatatgatagtaggaagacaggaaaaagggaaatcattgctattcaaaactgaagacggggtgaatatgtgcacattgatggctattgatttaggcgaattgtgtgaagacacaattacttataaatgcccacttctaaggcagaatgaaccggaagacatagattgttggtgcaacagcaccagtacatgggtaacttacggtacatgcactaccacaggagaacaccgacgagagaaaagatctgtagccctagttccgcacgtaggtatgggtttagaaactcgaactgaaacgtggatgtcttcagaaggagcatggaaacatgtccagagaatcgaaacgtggatactacgacatccagggtttacgatcatggcagctatattggcatatacaataggaacaacacattttcaacgagcattgatcttcatattgctgacagcggtagcgccctccatgacaatgcgctgcataggaataagtaatcgggactttgttgaaggagttagtggcggaagttgggtcgatatagtattagaacacgggtcatgtgttacaacaatggcgaaaaataaaccaacattagatttcgaattaataaaaacagaagcaaaacaacccgcaaccttaagaaaatactgcattgaagcaaaacttacaaatacgacaactgaatcgagatgtcctacacaaggcgaaccttcattgaacgaagaacaagataaaagatttatttgtaaacacagtatggttgaccgtggatggggaaatggatgcggcctttttgggaaaggtggaatagttacatgtgcaatgtttacatgcaagaaaaatatggaagggaaaatcgtacaaccagaaaatctagaatatactatagttattacgccacattcgggagaagaacatgcggtaggtaatgatacggggaagcacggaaaagaaattaaaatcactcctcaatcatccacaacagaagcagaattaacaggctatgggacagtgaccatggaatgttcccctcgtacaggtttggatttcaacgaaatggtattattacaaatggaggacaaagcatggctggtacatcgccaatggttcttagacttaccgctcccttggctacctggagctgacactcagggatcgaattggattcaaaaggaaacattagtcacttttaagaacccccatgccaagaaacaagatgtggtagttctcggatcacaagagggggcaatgcatacagctttaaccggtgcaacggaaatacaaatgagttcagggaaccttctcttcacagggcacctgaaatgcagacttagaatggacaaattacaattaaaggggatgtcttactccatgtgcactggaaaattcaaaatagttaaagagatagccgaaacacaacatgggactatagtaataagagtgcaatacgaaggtgacggttccccgtgcaaaatcccctttgaaatcactgacctggagaaaaggcacgttttaggaagacttataactgttaacccaatagtaacagagaaagactcgccagtcaatattgaagccgaaccaccattcggagatagctatataatagtaggggtagagccgggccaattaaaactaaactggttcaagaaaggatcatcgattggtcaaatgtttgaaactacaatgcgaggcgcaaaacgcatggcgatcttgggtgacacagcttgggacttcggttcactgggcggagttttcacctcaattggaaaggctctgcatcaagtattcggagctatatatggagcggcatttagcggcgtgtcttggactatgaagatattgattggtgtcatcataacttggatcggtatgaactcaagatcaacgtcgctttcggtatctctcgtcttagtcggagttgtaacattgtatctaggagctatggtacaagcagattcagggtgcatagtatcatggaaaaacaaagagttaaaatgtgggtctggaatctttataacggataacgttcatacttggactgaacaatataaattccaacctgagtcaccttcaaaattagctagcgctattcaaaaagcacacgaagagggaatatgtggtatacgtagtgttaccagacttgagaaccttatgtggaaacagattacacctgaactcaatcatatattgtctgagaatgaagtaaaactgacaataatgactggagacatcaagggcataatgcaggcaggaaagagatctctacgaccacaacctactgaattaaagtatagttggaaaacatgggggaaagcaaaaatgttatcgacagaaagtcacaatcaaacatttcttatagacggtcctgaaaccgcagagtgtccaaacacaaatagagcatggaactcgttagaagtggaggattatggttttggggtctttacgacgaacatttggttaaaactgcgtgaaaagcaggatgtattttgtgacagcaaactcatgtcagcagcgataaaggacaacagggccgtacacgcggatatgggttattggattgaaagtgccttaaacgacacgtggaaaatggagaaagcctcgttcatagaggtcaaatcttgccattggccaaagtctcatacactgtggtcaaacggggtattagaaagtgaaatggtgatacccaaaaacttcgctggacccgtttcacagcacaattatagaccgggttatcatacccagactgcaggcccctggcacctaggaaaattagaaatggattttgatttctgcgagggaacaaccgtcgtagtaacagaagactgtgaaaaacgaggcccttccttgagaaccactactgcaagcgggaaactcataactgaatggtgctgcaggagttgcactttaccaccattgcgttatcgtggagaagatggatgctggtacggaatggaaataaggcctttaaaggaaaaagaagaaaatctggtcaacagcctagtaacggcagggcatggtcaaatagacaattttagtctgggggttttagggatggcattatttctcgaagagatgcttaggaccagggtcggtacaaaacacgctattcttcttgttgcattatctttcgtaactttaatcacaggaaatatgtccttccgagacttgggaagagtcatggtcatggtaggagcaacaatgacagatgatattgggatgggtgtcacctacctagctctacttgctgcattcaaagtacgacctacttttgccgcgggacttctactaagaaaacttacgtctaaagagttaatgatggcgactattggtatagcattattgagtcaaagcacactaccagaaacaatccttgaactaacagatgccctagctttaggaatgatggctttaaagatagtaagaaatatggaaaagtatcaattggcggtaacgattatggcaatcagctgtgtgccaaacgcggtcatccttcagaatgcctggaaagtttcctgcaccattttagcagcagtcagtgtctcacctctattactaaccagcagtcaacaaaaggctgactggatacctttagctttgacaattaaaggactaaacccaaccgcaatatttttaactacattgagtcgaaccagtaagaagcgaagctggccactaaatgaagcaataatggcagtagggatggtttcaatattggcgagttcgctccttaagaacgatattcccatgactggacctttagtagcaggaggcctgctaactgtatgttacgttctaacaggtaggtcagcagacctagagctagaacgagctgcggatgttaaatgggaagatcaggcggaaataagtggatcatctccaattctctcaattacaatcagtgaagatggcagcatgagcataaagaacgaggaggaagaacaaacccttacaatcctgatccgaaccggcctcctagtgataagtggggtattcccagtaagtatccccataactgctgcagcttggtacctttgggaagtgaaaaagcaaagagccggagttctatgggacgtgccaagtccaccacctgtaggcaaagcagaacttgaggatggggcctataggattaaacaaagaggtattctaggctatagtcaaataggagccggtgtgtacaaggaagggacttttcataccatgtggcatgtaacaaggggcgcggttttaatgcaccgtggaaaacgtatagaacccagctgggcagacgtcaagaaagatttgatctcatatggcggtggctggaagctcgagggtgaatggaaagaaggtgaagaagttcaagttttagccctagaaccgggtaaaaatccccgtgcagttcaaacaaagcctggaatattcaagacaaatacaggaacaataggagccgtaagtttagatttttctcctggtacttcaggttcgccgattgtagaccgtaagggaaaagtagtaggtctatatggcaacggtgtggtaacaaggagtggtgcatatgtaagtgcaatagcacagactgaaaaatctatagaagataacccggaaattgaggacgacatttttagaaagaaaagactgactataatggacctgcaccctggagccggtaaaacaaaaagatatctgccagcaatcgttagggaagcaataaaacgtggattgcgcacacttattttagcaccgacacgtgtagtagcagcggaaatggaagaggctttaaggggtttacctatacgttatcaaaccccggcaatcagagccgaacataccggcagagagattgttgaccttatgtgtcacgcaacctttacgatgagactattaagcccagtaagagtgccaaactacaatttaataataatggatgaggcccattttacggacccagcaagcattgcagcacgggggtatatcagtacgagagtggagatgggtgaagctgcaggaatcttcatgacagcaacgccaccaggctccagagatccttttcctcaaagtaacgccccaataatggacgaagaacgagaaatcccagaaagaagctggaactccgggcacgaatgggtgaccgattttaaagggaaaacggtatggtttgtcccttcaatcaaggcaggtaatgacattgccgcatgtttgcgtaaaaatgggaagaaagtcataccgtattcgagaaaaacatttgattcagaatacgttaaaacaagagcaaacgattgggattttgtcgtaacaactgatatttcagagatgggcgctaactttaaagcagagagggtcattgacccaagaagatgcatgaaaccagtcatattaactgatggtgaagagagagtgatactagctggtcctatgcccgtaacgcatagtagtgccgcacagcgccgagggcgtattgggaggaaccctaaaaatgaaaatgatcaatatatctatatgggagaacccttagaaaatgatgaagattgcgcacactggaaagaagcaaaaatgcttctagataatattaatacaccagagggaattatcccgagcatgttcgaacccgagcgcgagaaagtggatgctattgacggagaataccgtctaagaggcgaggcacgtaagaccttcgtagatttaatgaggcgaggtgacctacctgtatggttggcatataaagttgctgcagaaggcatcaactacgcagatcgtaagtggtgctttgacggcattaaaaataatcaaatccttgaggaaaacgtagaagttgagatctggacaaaggaaggagagcgaaagaaattaaaacctagatggttagatgcaagaatatactcggacccgttagcactaaaagaatttaaagaatttgcagccggaaggaaatcacttactcttaatttaattaccgaaatgggtagactccccacatttatgacgcaaaaagcaagaaatgcactcgataatctagctgtattacatactgcggaggtgggaggaaaagcctacacacacgcccttagtgaactccccgaaaccctagaaacactacttttattaacattactagccgcggtgacgggtggtatatttttatttcttatgtcgggaaaaggtattggaaagatgacacttggtatgtgctgtataattacggcatcaatactactatggtacgcccaaatacaacctcactggattgctgcctctataatcttagagttctttttaatagtattactaattcctgaaccagaaaaacaaagaacaccacaagataaccaactgacatatgtagttattgccatattgaccgtggtcgcagccacaatggctaatgaaatgggatttttagagaaaacaaagaaagacctaggttttgggagcataacgacccaggaaagcgagtctaatattttagatattgatttgcgaccagctagcgcttggaccttatatgcggtagcgacaacctttgttacaccaatgttaagacactctatagaaaattcaagtgtaaatgtctcactaactgcaattgcaaaccaggcaacggtactcatgggtcttggaaaaggatggcctttatctaaaatggatataggtgtccctctactagctatagggtgttatagtcaagtcaaccctataaccctaacagcggcattactgcttctagtagcacattatgcgataattgggcccggtcttcaagccaaagctactagagaagcccaaaaacgggctgccgcgggaattatgaaaaacccaacagtagatggcatcacagtaatagacctagaaccaattccttatgacccaaagttcgagaagcaattaggacaggtcatgctgctgatattatgtgtaacacaagttctaatgatgagaactacttgggcgttatgcgaagccttgaccctagcaacaggtcccatttcaaccttatgggaaggaaatcccggacgtttttggaatacaacgatcgccgtgtcaatggccaacatatttcgcggatcgtatcttgcaggggctggtctattgttctcaataatgaaaaacactacgaatacccgacgaggaacaggtaacgtaggcgagacacttggtgaaaaatggaaatccaggttaaatgccctaggaaaatcagaatttcagatatataagaaatcaggaatacaagaagtagatagaactctagcaaaagaaggtataaagagaggtgaaactgaccatcacgcagtaagcagaggaagtgcaaaattacgatggtttgtagaaaggaatatggtaactccagaaggcaaagtggtggatctaggatgtggcagaggaggatggagttactattgtggaggacttaaaaacgtacgcgaagtcaaaggcctaacaaaaggcggacccggccacgaggaaccgataccgatgtccacttatggatggaatcttgtaagactccaatctggcgtcgatgtattctttactcctccagagaaatgcgatacattgttatgtgatataggagaatcttccccaaacccaactatagaagccggcagaacactaagggtcttgaacttggttgaaaattggcttaacaataacacacaattctgcattaaagtgttgaacccttacatgccgtcggtaatagagaaaatggagaccttacaaagaaaatatggtggcgccttggttaggaatccgctcagtagaaactcaacacacgaaatgtactgggtttcgaacgctacagggaatatcgttagctcagtaaacatgatttcaaggatgttgataaatcggttcacaatgaaacataagaaagcgacgtatgaacctgatgtcgacttgggatctggaacacgtaatattggaattgagtcagaaacccctaaccttgacatcataggtaagcgaatagaaaagataaaacaagaacacgagaccagttggcactacgaccaagatcacccatataaaacctgggcatatcacgggtcctacgaaactaagcagactggatccgcatccagtatggttaatggggttgttcgcctcttgacaaagccttgggatgttgtcccgatggtaacacaaatggcaatgaccgacacaaccccatttggacaacaacgggtattcaaagaaaaagtcgataccagaacacaagaaccaaaagagggaaccaagaaattgatgaaaatcacagcggaatggttatggaaggaactaggcaaggaaaagacaccaagaatgtgcacacgagaagaatttactcgaaaagtgaggtctaatgcagctttgggagcagtattcactgatgaaaataaatggaagagtgcaagagaagctgtagaggatggccgattttgggaattggtggatcgagagcgaaacttacatttagaaggaaaatgtgaaacttgtgtgtataatatgatggggaaaagagagaagaaactaggtgaatttggtaaagctaaaggctctagagctatctggtatatgtggctgggtgcaagattcctagagttcgaggccttaggctttctaaacgaagatcattggttctcgcgagggaacagtctatcaggcgtagaaggggaaggcctgcaccgactaggatatatcttacgtgaagttggtaagaaagaaggcggagcaatgtacgcagatgacactgctggctgggacacgagaattacgctggaagatctcaaaaatgaagaaatggtaactaatcacatgaaaggtgaacataagaaactggcagaggccatatttaaattgacgtaccagaataaagtggtgcgtgtccaacgcccgacacctcgaggaacagtgatggacattatttctagaaaagatcaaagaggctctggacaagtaggtacttatggtttaaatacgtttacgaacatggaggcccaactaatacgccaaatggaaggcgagggaatatttaaatccatccaacatctcacagctacagaagaaaccgctgttcaaaactggttagcaagagtaggccgtgagagactttcgcgcatggctatatcaggagacgactgtgtagttaaaccaatagacgacaggttcgcgtctgcacttactgctttgaatgatatgggtaaagtcaggaaagatatacaacaatgggaaccatcaagaggatggaatgactggacacaagtgccattctgttctcatcatttccatgagctagtaatgaaggatggaagagttttagtagtgccctgccgaaatcaggacgaacttatcggacgagctagaatttctcaaggagcaggttggagtctaaaagaaactgcctgcttaggaaaaagttacgctcagatgtggacactaatgtactttcatcgccgcgatctacgtctagccgcaaatgctatttgttcagccgttccttcacattgggtccctacgagtaggactacatggtccatacacgcaaaacatgagtggatgacaacagaagatatgttggcggtttggaatagagtatggatccaggaaaacccgtggatggaagataaaacacccgttgaaagctgggaagaggttccatacctgggtaaaagagaagaccaatggtgtggaagcctaattggactcacaagcagggcaacttgggctaaaaatatacaaactgcgataaatcaagtaaggtctttaatcggtaatgaaggctacacagattatatgccatctatgaagcgctttagaagagaagaagaggaagcaggagtcttatggtag

SEQ ID NO: 22198 - RNA, 9876 nt, synthetic construct
  misc_feature 1..9876: note = derived and/or modified CDS sequence (opt6) from DENV-2__KP188556__SS-prME
  source 1..9876: mol_type = other RNA
actgctggtgtgattgtgatgcttataccaactgcaatggcatttcatttaactactagaaacggggaacctcatatgatagtaggtagacaagaaaaagggaaaagtttactatttaaaactgaagatggggtcaatatgtgcacattaatggctatagatttaggggaattatgcgaagacacaataacctacaaatgtcctttattaaggcaaaatgaacccgaagacatagattgttggtgtaacagcacttcaacctgggtcacatacggtacttgtacaaccacaggtgaacataggagagaaaaacgttcagtagctttagtaccacatgttgggatgggtttagaaacacgaacggaaacgtggatgagcagtgaaggcgcatggaaacatgtacaacgaatagaaacatggattctgagacatcctgggttcacgattatggcggccatactggcatacaccatagggactacacatttccaacgtgcattaatatttatactgcttaccgcagtggcaccctccatgaccatgaggtgtataggaataagcaatagagattttgttgaaggagtcagtggtggttcatgggttgatatagtcttagaacacggctcttgtgtaactacaatggccaaaaataaacccacattagattttgaactaatcaaaaccgaagccaaacaaccagctaccctaagaaaatattgcattgaagctaaactaacaaatactaccacggaatctagatgtccaactcaaggggaaccatcattaaacgaagaacaagacaaacgcttcatctgtaaacacagcatggtcgaccgtggttggggcaacggatgcggtttgttcggtaaaggtggaatagttacttgcgcaatgtttacatgcaagaaaaacatggaaggtaaaatagtacaacccgaaaacctcgaatatactattgtaataactccacattcgggagaggagcacgctgtaggtaatgacactgggaaacacggtaaagaaataaaaataacaccacaatcctcgaccacagaagcagaattgacgggctacggtacagttaccatggaatgttctccacgcactggactagatttcaatgaaatggtcctattacaaatggaggataaggcttggttagttcatcgacaatggttcctagatctcccactgccatggttaccaggggcggacacgcaaggctcgaactggatacagaaagaaactcttgtaactttcaaaaatccacacgctaagaaacaggacgtggtggtactgggaagtcaagaaggagcgatgcacaccgcactaactggagcgactgaaatacagatgtctagtggcaatttattattcacaggacatctaaaatgcagattaagaatggacaaactacaacttaaaggcatgtcgtactctatgtgtacgggaaagttcaaaatagttaaagaaattgctgaaacacaacatggtacaatagtaataagagtacaatacgagggtgatggtagtccttgcaagataccattcgaaataaccgatttagagaaacgacacgtgcttggacgattaattactgttaatcccatcgtaacagaaaaagattctccagtgaatatagaagcggagccgcccttcggtgattcttatataatagtcggtgttgaaccaggtcagctaaaacttaactggtttaagaaaggatccagcataggccaaatgtttgaaacaaccatgaggggagcaaaaagaatggcaattttaggagacactgcatgggattttggtagtctgggcggagtatttacaagtataggaaaagcattacatcaagttttcggcgcaatatacggagccgccttttccggtgtctcatggactatgaaaatactaattggagtaataataacatggataggcatgaatagcagaagtaccagtttatcagtctccctagtattagttggagtagtaaccttatatctgggcgctatggtacaagcagactccggatgtatcgtgagttggaaaaacaaagagcttaaatgcgggagtggaatttttataactgataacgttcatacctggactgagcagtataaatttcagccggagagtccctcaaaactagcatcagcaatacagaaagcgcacgaagaaggaatatgtggcattagatcagtaactcgactagaaaatttgatgtggaaacaaatcacacctgaattaaaccatatattgtcagaaaacgaagtgaaattgaccataatgacgggagacattaagggaattatgcaagcggggaaaagatctttacgacctcaaccaacagaattgaaatattcgtggaaaacatggggtaaggcaaaaatgctgtctactgaatctcataaccaaacgtttttaatcgacggacccgaaactgctgaatgccccaacacgaatagagcttggaactcacttgaagtggaggactatggatttggtgtttttaccacaaacatatggttaaaactcagagaaaaacaagatgtattctgcgattcgaaactgatgagtgcggcgataaaagataatcgtgcagttcatgcagatatgggatactggatagaatccgcactgaacgatacgtggaagatggagaaagcatcctttatagaggtaaaatcttgtcattggcccaaatcccatacgctttggtcaaatggagtcctagaatcagagatggttatccccaaaaatttcgctgggcctgtatcacagcacaactaccgaccgggctatcatacacaaacagcaggcccgtggcatctaggaaaactagaaatggattttgatttctgcgaaggcacaacagttgtagtgaccgaagattgtgaaaagaggggaccatcattaagaacaacgacggcatcaggtaaattgataacagaatggtgttgtagatcttgtaccttaccaccactccgatacaggggagaggatggatgctggtacgggatggaaatacggccactcaaagaaaaagaagaaaacctggtaaatagtctagtgaccgcaggtcatggtcaaattgataacttctctctgggagtactaggaatggcactattcctcgaagaaatgcttaggactcgagttgggaccaagcatgcaattttattggtagcattaagttttgttacactaataacagggaatatgtcattcagggacttaggaagagttatggtaatggtaggcgcaacaatgacggatgacataggaatgggtgtgacatatctggcactacttgcggcttttaaggtccgacctacattcgccgcaggtctattgcttagaaaattgacctcaaaggaattgatgatggctactatcggaatagcgttactaagtcagagcacactccccgaaacaatattggaactcaccgacgccctagcactaggaatgatggcgttaaagatagtcaggaacatggaaaaatatcaattagcggtaacaataatggcaatatcttgtgttcctaacgctgttatactacagaatgcctggaaggtaagttgcactattctagcagcggtaagcgtgagccccctacttctgacatcatcgcaacaaaaagcagattggatcccgcttgcgttaactataaagggactaaacccaacagccatatttctcacaacgctatcaagaactagcaagaaaaggagctggccactaaacgaagccataatggctgtcggtatggtaagcattctagccagctcattacttaaaaacgatatacctatgaccgggcctttggtcgccggaggacttcttacagtctgttatgtcctaacaggcagatcagcagacctggagttagagagggcagcagatgttaaatgggaagaccaagctgaaatctcgggaagctcgccgatcctatctataacaatctcagaagatggctcaatgtcgatcaaaaacgaagaagaagaacagacgcttacgattcttatacgcacaggcctattagtcatttctggggttttcccagtatcaataccgattacagcggcagcttggtatctatgggaggttaagaagcagagagcaggcgtcttgtgggatgtacctagccctccaccagtaggcaaagcagaactagaggatggagcgtacagaattaaacaaagaggaatactaggatatagtcaaatcggggctggtgtttataaggagggtacgtttcacactatgtggcatgtaacgcgaggagccgttcttatgcatagaggaaaaaggatcgaaccaagttgggcggatgttaagaaggacttaatttcctatggtggaggatggaaactagaaggcgaatggaaagaaggggaagaagtgcaagtgttggcactagaaccaggaaagaatccacgggccgtacaaacaaaacccggtattttcaaaacgaataccggaacaataggtgctgtttcccttgactttagtccaggaacatcagggtcacctatagttgacaggaaaggtaaggtcgtaggcctatacgggaatggcgttgtaacaagatcaggtgcttacgtcagcgccatagctcaaacagaaaaatcaatagaagataaccccgaaattgaggatgacatttttagaaagaaaagattaacaattatggatctccaccccggggctggtaaaacaaagaggtatttaccagcaatagtacgagaagcgataaaaagaggtttaagaacacttatactggcacctacgcgcgtggttgcagcggaaatggaggaagctctcagagggctgcctattagatatcaaactcctgcaattagagccgaacatacgggccgcgaaattgtagatttgatgtgccacgcaacgtttactatgagactattaagtccagtgcgagtacccaattacaatttgattattatggatgaagcacattttaccgatccagcgagcattgcagcaagaggatatatcagcacacgcgtagagatgggcgaagccgctggcattttcatgaccgcgacaccaccaggcagtcgtgaccctttcccgcaatctaacgcacccataatggatgaagagagggagatccccgagagatcttggaactcaggtcatgagtgggtcactgacttcaaaggcaaaaccgtttggtttgttccgtcaataaaagcagggaatgacatagctgcatgcttacgtaaaaacggtaaaaaggtgattcaactttcgaggaaaacttttgattcagaatatgtaaaaaccagagcaaacgattgggacttcgtagttacgacggatatatcagaaatgggcgcaaacttcaaggcggaaagggtaatcgacccaagaaggtgcatgaaaccggttattttaacggacggtgaggaaagagttattttggcaggcccaatgccagtaacacatagtagtgctgcacagagaagaggcagaataggacgaaatcccaaaaacgaaaatgatcaatacatatacatgggggaaccattggaaaatgatgaagattgtgctcattggaaagaagctaagatgctattagataatattaatacaccagagggaataattccctcgatgtttgaaccagaaagagaaaaagtagatgctatcgacggagaataccgtttaaggggagaggcaagaaagactttcgtcgatttaatgagacggggagatcttccggtatggttggcatataaagtagcagccgagggtataaattacgcagataggaagtggtgttttgatgggatcaaaaacaaccaaatccttgaggaaaatgtagaagtggaaatatggacgaaagaaggagaacgaaagaaattgaaaccaaggtggttagacgcaagaatatattccgacccattggctctaaaagaatttaaagagttcgcagccggaagaaagagcttaaccttaaatttaataactgaaatgggccgactaccaacgtttatgacccagaaagcaagaaatgcactagataacctagcagttctacatactgccgaagtaggaggtaaagcatatactcatgcacttagtgaattaccagaaacgttagaaacactattgttactcaccttattagctgctgtgactggaggcatattcctgtttttaatgtctgggaaaggaataggaaagatgactttaggaatgtgttgcatcattacagcatcgatactgctttggtacgctcagatacagccacattggattgcagccagtatcatcttagagttcttcttaatagtattattaatcccagaaccagaaaaacagagaacaccccaggacaatcaattaacgtacgttgtcatagctattttaacagtggtcgcggccacgatggcgaatgagatgggattcttagagaaaaccaagaaagatcttgggtttggttctatcactacacaagaaagtgaatctaacattttagatatagatctaagacctgccagtgcctggacattatatgcagtagctacgaccttcgtcacaccaatgcttagacacagcatagaaaatagtagtgttaatgtgagtcttacggctatagcaaatcaagcaactgtactcatgggtctggggaaggggtggccactctccaagatggacattggagtgcccttgcttgcgataggatgttactcacaggtaaacccgataactttaacagctgctttgttattattagtagctcattacgctataataggacctggtcttcaagcgaaagcgacgagagaggcgcagaagcgtgctgccgccgggatcatgaagaatccaacggttgatggtatcacagtgattgacctcgaacccattcctcatgatccaaagtttgaaaaacagttaggtcaagttatgttactgattctgtgcgtaacccaagttttgatgatgcgtacaacatgggcactctgtgaggctttaacattagctacaggcccaatttcaacattgtgggaaggtaacccgggaagattttggaacacaacaatagcggtgagcatggctaacatatttcgtggatcatatctagctggcgctggtttgctattttctataatgaagaacactactaatactcggagaggaactggtaatgtaggtgagactcttggggaaaagtggaaatcaagactaaatgcgctcggtaaaagcgagttccagatttacaagaaaagtggaatccaagaagtcgacagaacattagctaaagaaggtatcaagcgaggtgaaacagatcaccatgcggtttctcggggaagtgcaaagttaagatggtttgtagaaagaaacatggtcacgccagaagggaaagtggtagatctaggatgtggtagaggaggatggagctattattgtggcggactaaagaacgttcgagaagttaaaggtctcacgaaaggagggcccggacatgaggagcctataccaatgagcacatatggctggaacctggttagattacagtctggggtcgatgtcttcttcactcctcccgagaaatgcgacacgttattatgcgacataggcgagagcagtcctaatccaactatcgaagctgggcgaacacttagggtacttaacttagtcgaaaactggttgaacaataacacacagttttgtataaaagtattaaatccctatatgcccagcgtaatagagaaaatggaaacgttacaacgcaagtacggtggagcattggttagaaatcctttatcaagaaattcgacgcatgaaatgtactgggttagtaatgcgacgggtaatattgttagctctgtaaatatgataagcagaatgctgataaacaggttcacgatgaaacacaagaaagcgacttatgagccggacgtagatttaggaagcggcacgagaaatattgggatcgaatcagaaacacccaatctagatataatcggtaagcgaattgaaaagataaaacaagaacatgagacgtcttggcattacgatcaggatcacccctataagacttgggcgtatcacggatcgtatgagacgaaacagacaggtagcgcttcatcaatggtgaacggagttgtacgtcttctaaccaaaccatgggacgtcgtaccgatggttacgcagatggctatgacagatactacgccattcggtcaacaacgagtttttaaagaaaaggttgacacacggacacaagagccaaaagaagggactaagaaattaatgaaaattaccgctgaatggctgtggaaagaactaggaaaggagaaaacaccaagaatgtgtacacgagaagaatttactcgcaaagtaagaagtaacgctgcattgggcgccgtattcacagatgaaaataaatggaaatcagcgcgagaagcagtagaggacggaagattttgggaactggtagaccgagaacgcaatctacatttggaaggcaaatgcgaaacatgtgtatataatatgatgggtaaaagagagaagaaattaggtgagttcggcaaagcaaaagggagtcgagcgatatggtatatgtggctgggagccaggtttctggaatttgaagcactaggatttctaaatgaggatcattggttctcgagaggaaactctttgtctggtgtcgagggcgaaggattacacagattaggttacatattacgagaagtgggaaagaaagaaggaggggcaatgtatgccgatgatacggcgggttgggacactcgtatcacattagaagatcttaaaaacgaagagatggtgaccaatcatatgaaaggtgaacataagaaactagcagaagcgatatttaaactaacatatcaaaataaagtagttcgcgtacagagaccaactccacgcggtactgtcatggacataatatcacgtaaagatcagcgaggatcgggacaagtgggaacgtatggattgaataccttcaccaacatggaggctcaactgattcgtcaaatggaaggagaagggatcttcaaatcaatacaacatttaacagcaacggaagaaacagcagttcaaaattggctagctagagtaggtcgagaaagactttcaaggatggcaataagtggggatgactgtgtggttaaacccatagacgatagatttgctagcgcacttactgcactcaatgacatgggaaaagtccgaaaagatatacaacaatgggaaccgtcgcgagggtggaacgactggacccaagtcccattttgcagtcatcatttccacgaactggtaatgaaagatggacgtgtcttggttgtcccatgccggaatcaagatgaattaattggtagagcgagaataagccaaggagcagggtggtccttaaaggagactgcttgtttaggaaagtcttacgcccaaatgtggacactcatgtattttcatcgcagggacctaagattagcagcaaatgcaatatgctccgccgtcccgtcgcattgggtcccgacctcacggacaacttggagtatccacgctaagcacgagtggatgactactgaagatatgttagccgtttggaatagagtctggattcaagagaatccttggatggaagataaaactccagtagagagttgggaagaagtaccatatctgggcaaaagagaagatcaatggtgtggctcgctaatcggcttaacatcacgtgcgacctgggcgaaaaacatacagacagcaataaaccaggttaggtccctgatcggtaatgaaggatatacggattatatgccatctatgaaacgatttcgtagagaggaagaagaagctggtgtcttatggtaa

SEQ ID NO: 22199 - RNA, 9876 nt, synthetic construct
  misc_feature 1..9876: note = derived and/or modified CDS sequence (opt6) from DENV-2__GU369819__SS-prME
  source 1..9876: mol_type = other RNA
accgcaggcgtcatagtgatgttaatacctacagcaatggcatttcatttaactacgagaaacggcgaaccacatatgatcgtcggacgtcaagaaaaagggaaatctttgttatttaaaacggaagatggagtgaatatgtgcaccttgatggcgatagatctgggggaattatgtgaagatacaataacttataaatgtccattattaagacaaaatgaaccagaagatattgattgttggtgtaattcaacgagtacatgggtaacttatggtacatgcacgactaccggagaacatcgtagagaaaaacgatctgtggctttagtcccgcatgttgggatgggtttagaaacaagaactgaaacctggatgagctctgaaggagcatggaaacacgtacaaagaatagaaacatggatcttaagacatccgggttttaccattatggctgctattcttgcatacacgataggcacgactcatttccaaagagcattaatctttatactcttaactgcagtagcgccctcaatgacaatgagatgcattggtatatcaaatagagatttcgtagagggggtcagtgggggctcatgggtagatattgtattggaacatggttcatgcgtcacgactatggctaaaaacaaaccaacactagacttcgagctaatcaaaactgaagcaaaacagcctgcaacattgcggaaatattgtatcgaagcgaaattaacgaatacaaccacggaatcacgatgtccaacccaaggagagccttctttaaacgaagaacaagataaaagattcatatgtaaacattctatggttgatcgtgggtggggtaatggatgtggcttatttggaaaaggaggtattgtgacatgtgcaatgtttacttgcaagaaaaatatggaaggaaaagtagttcagcccgaaaacctggagtatacgatagtgattacgccacatagtggggaggaacatgctgtaggaaatgacacaggaaaacacggcaaagaaattaaaataacacctcaatcgagtattacagaagctgaacttacaggctatggtacggttacaatggaatgttctccaaggacggggctagattttaatgagatggtattgctacagatggaaaataaggcatggctagtacacagacagtggttcctcgacttgccactaccatggctgcctggtgctgacacgcagggaagcaactggattcaaaaagagaccttagttactttcaagaatcctcatgcaaagaaacaagatgtggttgtgctaggaagtcaggagggagcaatgcacacagcattaacaggagctacagaaatccaaatgtcttcagggaatctcttgtttacagggcatctaaaatgcagattaagaatggacaaactacaattaaaaggaatgtcctacagtatgtgtaccggaaagttcaaaatagtcaaggagatcgctgaaacccagcatgggacaatcgtaataagagtacagtacgaaggtgacggtagcccatgtaaaataccattcgaaataacagacctagagaaacgccatgtactgggaagacttattacagttaatcctatagtgacagaaaaggactcgcctgtgaatatagaggctgaacctccgttcggtgatagttatataattattggagtggaaccaggtcaacttaagttgaattggtttaagaaaggatccagtatcggccagatgtttgagactaccatgagaggagcaaaacgaatggctatattgggtgatacagcctgggactttggaagtctagggggtgtctttacatcaatcggcaaggcgctacaccaagtctttggagctatttatggcgcagcattctcgggagtttcatggaccatgaagattttaattggagtcattattacatggataggaatgaactccagaagcacaagtctatcggtgtctctagttctggtaggagttgttacgttatacctaggagccatggttagagctgacagtggttgtgtggtcagttggaaaaataaagagttaaaatgtggatcaggaatattcataacagataatgtacatacatggaccgagcaatacaagttccaaccagaatcccctagcaaattagcaagcgccattcaaaaggctcatgaagaaggcatttgcggtattcgcagtgtcactcgattggagaatttaatgtggaagcagataacgcctgaactcaaccatatactctcagaaaatgaagtcaaattaacaatcatgaccggagatatcaaagggatcatgcaagcaggaaaacgtagtcttcgcccacaacccacggagttgaagtattcatggaaaacctggggaaaagcgaagatgctgtctactgagagccataatcaaactttccttatagacggaccagaaacggcagagtgcccaaacacaaatagagcatggaatagccttgaagttgaagactatggattcggtgtatttacaacgaacatttggctcaaactccgggaaaaacaagatgtattttgtgattccaaactaatgagcgctgcgataaaggataaccgcgcggtacatgcggatatgggatattggattgaatcggcactgaacgatacctggaagatggagaaagctagttttatcgaagtaaaaagctgtcattggccaaaatcacatactttatggagtaacggagtcctagagtccgaaatgataatccccaagaatttcgctggacctgtaagtcaacataactatagaccaggctaccatacacagacagctggcccatggcatctaggaaaactggaaatggattttgatctatgtgaaggtaccacagtagttgtgacagaggactgcggaaaccgtggacccagcttgagaacgacgaccgccagtggaaagctaataacggaatggtgctgcagaagctgcaccctacctccgctcagatatagaggggaagacgggtgttggtacggaatggagataaggccattaaaggagaaagaagaaaatttagtgaactccttagttacagccggacatggacagatcgacaatttttctttaggtgtactaggaatggcattattcttagaggaaatgttgagaacacgtataggaactaagcacgcgatactattagtggccgtttcattcgtcacattaattactggaaatatgtcctttagggatttagggagagttatggtaatggtaggtgctaccatgacagacgatataggcatgggcgtaacatacctagcgctactggcagcatttaaggttagacccacctttgcagcaggtttactactgcgaaaactgacaagcaaagaattaatgatggcaacaattggaatagcactattaagccagtccacgataccagaaacgatcctcgaactaactgacgccctagcattaggaatgatggttctgaaaatagtccgaaatatggaaaaataccaattagcagtaacgataatggccatatcatgtgtacccaatgcagtcattctacaaaatgcgtggaaagtatcctgtaccattctggctgcggtttccgtatcacccttgttattgacaagttcacaacaaaaagcagactggatacctttagccttaaccattaaaggattgaacccaacagcaatattcttaacaactcttagccgtacatccaaaaagagaagctggccgctaaatgaagcaataatggcagtcggcatggtatcaatactagcatcatcactgttaaagaacgatattccaatgacaggcccattagtagctggcggtctactaactgtgtgctacgtgctaacaggtaggagtgctgacttggaactggaacgcgcggcagacgttaaatgggaagatcaggcggaaatatctgggtcctcacccatcttatccataacgatttccgaagatgggtcaatgagtatcaagaacgaagaggaggagcaaacgttaactattttaataagaacaggactgttagtaatatccggagtgttccctgttagcatacctataacagccgccgcatggtatttatgggaagtgaagaaacaaagagccggtgttctatgggatgtaccgtctccgccacccgtcgggaaagctgagttagaggatggcgcatatcgtataaagcagaaaggtattctaggttatagccaaattggagcgggtgtgtataaagagggaacattccacacaatgtggcatgttactcgcggtgcagtcttaatgcaccgtggtaaacgaattgagcctagttgggctgacgtaaagaaagaccttatctcctatggtgggggctggaaacttgagggcgaatggaaggagggagaggaagttcaagtccttgctttggagcctgggaagaacccaagagcagtacaaaccaaacccggtattttcaaaactaatacaggaaccataggtgcagtaagtttagatttcagtccagggacaagcggtagccctatagtagatagaaaaggaaaggtcgtcggcctttacggtaatggcgttgtaactaggagtggagcctacgtatctgcgatagctcaaacagagaaaagcattgaggacaatcctgaaattgaggacgatatatttaggaagaaacgattaactataatggatcttcatccaggagcgggaaaaactaaacgttacctaccagcgattgtcagagaagcaataaagcgcggtctgagaacactaatactggccccaacgcgagtagtggcggcagagatggaggaagcactgaggggactacctataaggtatcagaccccagccataaaaactgaacacacgggcagagaaattgtggaccttatgtgccatgcaacatttaccatgagattactatctccagtaagggtacccaactacaatttgattataatggatgaagctcactttacagatccagcctctattgcggctagaggatatatatcaacccgagttgaaatgggagaagcggctggcatcttcatgacagccacaccaccaggttcgagagatccttttcctcagtctaacgctccaataatggatgaggaacgagagatacccgaaagatcatggaactcagggcacgaatgggtaacagatttcaaaggaaaaacagtatggtttgtaccgagcataaaagccggcaatgacatagcagcttgtcttaggaaaaatgggaagaaagttatccagctgagcaggaagacttttgactcagaatatgttaagactagagcgaatgattgggattttgtggtaacgactgatatcagcgaaatgggagcgaattttaaggcggagagagttatcgacccaagaaggtgtatgaagccagtaatactaactgacggcgaagaacgtgtcatcctcgctggcccaatgcctgtgacccatagtagtgcggctcaaagaagaggaagaatagggagaaatcccaagaacgaaaatgatcaatacatatatatgggggaacccctcgaaaacgatgaggattgtgctcattggaaagaagcaaaaatgcttctcgacaacataaatacgcctgaaggcatcattccaagcatgttcgagcctgagcgtgagaaagttgacgctatcgacggggagtatcgccttagaggagaagcaagaaaaacttttgtagacttaatgcgacgtggtgatttgcctgtctggttggcatacaaagttgccgcagagggaatcaattacgctgatcgaaaatggtgtttcgacggaattaagaataatcaaatcctagaagaaaatattgaggttgaaatatggacgaaagaaggtgaaagaaagaaacttaagccacgatggttagatgcgcggatatatagtgatcccttagcacttaaagaatttaaggagtttgctgcaggaagaaaatcattaaccctaaatctgattacagagatgggtcgtcttcctactttcatgacacaaaaagcaagaaacgcattagacaatttggcagtattacacacagcagaagcaggaggccgggcgtacaaccacgctttaagcgagttgccagaaacactagagaccttattacttctcacattactagcgactgttactgggggcatatttttgtttttaatgagtggtcgagggatagggaaaatgaccttaggcatgtgttgcataatcactgcttctatacttctatggtatgcacaaatacaaccgcactggattgctgcatcaattatattagagttcttccttatagtattattaataccagagcccgagaaacaaagaacgccacaagataatcaactaacctacgttgtgatcgctattctcaccgtagtggcagcaactatggcaaatgagatgggatttttagaaaagaccaagaaagacttaggtttgggaagtatcaccactcaagaaagtgagtctaatatattggatattgatttacgcccggcttctgcttggacactttatgcagtagccacgacatttgtcacgcctatgttaagacactcaatagaaaattcgagcgtaaatgtgagtctaaccgcaatagcaaatcaagcaaccgtccttatgggactcggtaagggatggcctttgagcaaaatggatatcggggttcctctactagccattgggtgttactcacaggtgaatccaataactctcacggcagcgttactattgctagtcgcacactacgcaatcattggtcccgggttgcaagcgaaagcgacaagggaggcgcagaaacgggcggccgccgggataatgaaaaacccaactgtggacggaattacagtaatagacctagagcccataccttatgaccctaaattcgaaaagcaattgggccaagttatgttattaatcctgtgtgtaacacaagtactaatgatgagaacaacatgggcactatgcgaagccttgacattagcaactggccctatctcgacattatgggaagggaatccaggtcgattttggaatacgacgatcgcagtaagtatggcaaatattttcaggggtagctacctcgctggggcaggacttttgttttcgattatgaaaaatacaactaatacacgccggggaacgggaaatattggtgaaacattaggtgaaaaatggaaaagtagattaaatgcactaggaaagtccgagttccaagtgtataagaaatcggggatacaggaagtcgacagaactttagcgaaagaaggaatcaagagaggagaaactgaccatcatgcggtcagccgagggtcggcaaaactaaggtggtttgttgagcgtaacatggttaccccagaaggtaaggtagtagatcttgggtgtggcaggggtggttggagttattattgcgggggactaaagaatgttcgagaagtgaaaggattaactaaagggggacctggacacgaagaacccatacctatgtctacgtatggatggaacttagttcggctacaatcgggggtggacgtcttcttcacacccccagagaaatgtgacacactactatgtgatataggggaatcctctccaaatccaacgatcgaggcagggaggacacttagagtcctaaacttagttgaaaattggctcaacaataacacacagttctgcataaaagtacttaacccttatatgccaagtgttatagagaaaatggaagcattacagagaaaatatggcggggctctggtcagaaatcccttatctcgtaactctactcacgagatgtattgggtaagcaatgcaactggaaatatcgtaagctctgtgaatatgattagccggatgttaataaatagattcactatgaaacataaaaaggcgacatacgaacctgatgttgatttgggctcgggcacacgaaacatcggcatcgaatcagaaatacctaatttggatattataggtaaacgaatcgagaaaataaaacaggagcatgaaactagctggcactatgaccaagaccacccttacaagacatgggcataccatgggagttacgaaactaaacaaaccggttccgcaagttcaatggttaacggggtcgtgcgactattaacaaaaccctgggacgtgttacccatggtaactcaaatggcaatgacagacaccacgccgttcggacaacaacgagtctttaaagagaaggtggacacacgtacacaagaaccgaaagagggtactaagaaattaatgaaaataacagccgagtggctatggaaagaattaggaaagaaaaagactccaaggatgtgtactcgcgaagagtttactcggaaagtcagatcaaatgcagcgctcggtgcaatttttacggatgaaaataagtggaaaagtgcacgcgaagcagtcgaagatggaagattctgggagctagtggatagagaacgtaatttacacctagaaggtaaatgcgaaacgtgcgtatataatatgatgggaaagagggagaagaaactcggagagttcggaaaagccaaaggcagccgtgcaatttggtatatgtggctaggagcacgatttctagagttcgaggcattgggattccttaacgaagatcattggttctcacgaggaaattctcttagcggggttgaaggtgaagggctacatagacttggttatattctcagggatgtaggaaagaaagaaggcggagctatgtatgcagacgatactgccggctgggatacccggatcacgttagaagatcttaaaaatgaagaaatggtaacgaatcatatgaaaggggaacacaagaaattagcagaagctatttttaaattgacctatcaaaataaagttgtgagagttcaaaggcccactccacgaggcacagtaatggatataatatcaaggcgtgatcagaggggtagtggacaggttggaacatacggtctgaatacttttaccaacatggaagcacaactaattcgacaaatggaaggcgaaggaatctttaaatctatacagcatcttacggcaactgaagaaatagcggtacaaaattggctggcgagagtcggtagagagcgattaagtagaatggcaatctctggagacgactgcgtcgttaaaccaatagatgaccgttttgctagtgcattaacagcactaaacgatatgggtaaagtgcgaaaagatattcaacagtgggaaccttcacgcggctggaatgattggactcaagtacccttctgtagtcaccactttcatgaattagtcatgaaagacggtagggtacttgtcgtcccttgcagaaatcaggacgagcttataggtagagcacgaatttcacaaggggcaggatggtcactgaaagaaacggcgtgtcttggaaaatcctatgcacaaatgtggacgcttatgtactttcatcgtagggatttacggttagctgcaaatgcaatttgtagcgctgtaccccctcattgggtacctacgagtagaactacatggtcaatccatgcgaaacatgagtggatgactactgaagatatgctggcagtatggaatagagtctggattcaagagaatccatggatggaagataaaacgcctgtagaatcatgggaagaagtgccatatctgggcaaacgagaggaccaatggtgcggttctcttattggtctgacaagcagagcaacttgggcgaaaaatatacagacagctattaatcaagttaggtcactaataggtaatgaagaatatacagattacatgccatccatgaaaaggttcagacgtgaggaagaagaagcaggcgtactatggtga

SEQ ID NO: 22200 - RNA, 9876 nt, synthetic construct
  misc_feature 1..9876: note = derived and/or modified CDS sequence (opt6) from DENV-2__JX649147__SS-prME
  source 1..9876: mol_type = other RNA
acagctggtgtaattattatgttaatccctacagcaatggcatttcatttaacgacaagaaacggagaaccacatatgattgtggggcgacaagaaaaagggaaatcattattattcaaaactgaagacggggtaaacatgtgcactttaatggcgatcgacttaggagaactttgtgaagatactattacgtacaaatgcccactattaagacaaagtgaaccggaagacattgattgttggtgcaatagtacctcaacttgggtaacttacggtacatgtacaactacaggagaacacaggcgggaaaaacgtagcgtagctcttgtacctcatgttgggatgggtcttgaaacacggacggaaacgtggatgtcaagcgaaggtgcctggaaacacgcacaacgtattgaaacttggattttaagacatcctgggtttacaatcatggccgctatacttgcctatacaataggcacaacacattttcaaaaagcactcatttttatcctactaactgccgttgcacccagtatgacgatgagatgcattggcatatcaaatcgtgattttgtagaaggagtatcaggcggtagctgggtagatatcgtattagaacacgggagttgtgtaacaaccatggccaaaaacaaacctactcttgattttgaattaatcaaaactgaagccaaagaacccgccactctgagaaaatactgcatagaagcaaaactcacaaatactacaacagaatcaagatgtcctacacagggtgagccatcacttaatgaggaacaggacaaacgttttgtatgtaaacacagcatggtggataggggatgggggaacggatgcggcttattcgggaaagggggcatagtcacttgtgcaatgtttacctgcaagaaaaatatggagggaaaaatcgtacaaccagagaatctagagtacactatagtaattacaccccattcgggagaagaacatgcggtaggaaatgacacagggaaacatggaaaagaaataaaaataacaccacaatctagtatcactgaagcagagctcacgggctacggaacagtaaccatggaatgctctccaaggacgggactcgattttaatgaaatggtgcttcttcaaatggaagataaggcttggcttgtacaccgacaatggttcctagatttgcctcttccttggcttccaggtgcggatacccaaggttcgaattggattcagaaagaaaccctcgttacattcaaaaatccccatgcgaagaaacaagatgtagtcgtactcgggtcacaagagggtgcgatgcataccgccctgacaggcgcaactgaaattcaaatgtcatcaggaaacttattatttacaggtcatttaaaatgccgtttacgtatggataaactacagttaaaaggtatgtcatattcaatgtgcacgggaaaatttaaaattgttaaagaaatagcagaaacccagcatgggacaattgttattagagtccaatatgaaggggacggatcgccgtgcaaaataccattcgagatcatggacttggaaaaacgtcacgtacttggacgactgataacggtaaatcccatcgtaacagaaaaagacagccctgtaaacattgaagcagagcctccatttggcgacagctatattatcataggggttgagcctggccaactcaaattaaattggttcaagaaaggttcatcaatcggacaaatgttcgagacaacgatgcgaggagccaaaagaatggcaattcttggagatacggcttgggattttggttcactgggaggagtatttacgtctataggtaaagctctacatcaggtattcggcgcaatttatggagcagcgttttcgggagtatcttggactatgaaaattcttataggggtaattattacctggatagggatgaacagtcgatctacgtcattgtctgtgagtcttgtcttagtaggtgttataactttgtacttgggagcgatggtgcaggccgacagtggctgtgtagttagttggaaaaataaagaactaaaatgcggtagtgggatttttattaccgataacgttcatacttggactgaacaatataaatttcaaccagagtccccttcgaaattagcttcagcaatacagaaagctcatgaagaaggtatctgcggaataaggtcagtaacacgactggaaaatctaatgtggaaacaaattacccctgagttaaatcacatactaagtgaaaacgaggttaaattgacgattatgactggtgacatcaaagggattatgcaggcgggcaaacggtctctgcgaccacagcccacagaacttaaatattcgtggaaaacatggggaaaggcaaaaatgttaagcaccgagtcacataaccaaacctttctaattgacgggccagaaacagcagaatgtcccaacaaaaatagagcatggaactcgttggaagtagaggattatggatttggtgtatttacaacaaatatatggttgaagctaagagagaagcaggacgtattctgcgattcgaaactaatgtccgccgctattaaagataatagagctgtacacgcggatatgggttattggatagaatcagctcttaatgatacgtggaaaatggaaaaggcaagttttatcgaagtaaaaagttgtcactggccaaagagccatactctatggagtaacggagttctagaatctgagatgataatccctaaaagtttcgcaggtcctgtctcacaacacaattataggcccggttactacacccaaactgcaggaccatggcatttaggaaaactggaaatggactttgatttctgtgaaggtaccactgtagtcgtcacggaagattgcggcaatagaggaccttcattaaggactactacagcgtctggcaaactaattactgaatggtgctgccgaagttgtacactcccaccattacggtatagaggggaagacggatgttggtatggaatggagattcgtcccctcaaagagaaagaagaaaacttagttaacagtctagtgactgcaggccacgggcaaatagataatttcagcttaggggttctaggaatggcgctttttctagaagagatgttgaggacccgagttggaacaaaacatgcaatcttacttgtagcggttagcttcgtaacgctgataacaggtaatatgtcatttagggatttggggcgagtgatggtaatggtaggtgcgactatgacggacgacataggtatgggcgtaacttatctagcattgttagcagctttcaaagtgaggcctacattcgcggctggactactgctgaagaaattaacaagcaaagaattaatgatggctaccatcgggatagcgctactttcccaatcaactataccagaaacaatattggaactcacggacgctttagcactcggaatgatggtgttgaaaatcgtgaggaacatggaaaaataccaattagcagtgacaataatggcgatatcatgcgtgccaaacgcggtaatacttcagaatgcttggaaagtttcctgtaccatactagcagcagtttcagtctcacccctactactgacatcatcacaacaaaaggccgattggatacccctcgcgttaacaattaaagggttgaatcccaccgcgatttttctaaccacgctgagtcgaacgagcaagaaacgaagttggccgttgaatgaagcaataatggcagtaggcatggtgtcgattctcgcgagcagtctactaaagaacgacattccgatgacagggccattggtcgcaggaggactattaacagtatgttacgttctaacaggaagatcagcagatcttgaattagaaagggctacagatgtaaaatgggaagaccaagcggaaatctctggatcaagtcccatattatccattacaatctctgaagacggctcaatgagtatcaaaaatgaggaagaggaacaaactctgaccatcttgattcgcacgggcctactggtcataagtggactattcccaatgtcgatacctatcacagcagccgcgtggtatctatgggaagttaagaaacagcgggccggtgtattatgggacgttccatcaccccctccggtaggtaaagctgaattagaagatggtgcttacaggataaaacaaaaaggcattcttggttatagccaaattggggcgggtgtttataaagaaggaacattccatacaatgtggcatgtcacacggggagcagtattaatgcacagaggaaagcgaatcgaaccttcctgggcggatgttaagaaagaccttatctcatatggcggaggttggaaattagaaggagaatggaaagaaggcgaagaagtacaagttctggcattagaaccgggcaaaaacccaagagccgttcaaacaaaacccggtctatttaaaactaatacaggaacaataggggcagtttctctagatttcagtccgggaacttcaggatccccaatcgtagataggaaaggtaaagtagtaggtttatacggcaacggcgtagttacaaggtcaggagcctatgtctctgcgatagcacaaaccgaaaaatctatagaagacaatccagagattgaggatgacatatttagaaagaaacgccttacgattatggatctacacccgggtgcaggaaagaccaaacgatatctaccagcaattgtcagggaagctattaaaagggggttacgtacactgatattggctccaacgagggtagtagcagcagaaatggaggaggctttaagaggattgccaatccgatatcaaacgcccgctataagggcagaacatactggacgagagattgttgatttaatgtgtcatgcaacattcactatgcggttattatcacctgttagagttccaaattacaatttaatcataatggatgaagcccatttcacagaccctgcctctatagcagcaagggggtatatcagtaccagagtggaaatgggggaagcagcaggtatttttatgactgcaacgcctcctggatcaagagatccgtttccacaaagcaatgctccgattatggacgaagaaagagaaattcctgaaagaagttggaactcaggccatgagtgggttaccgattttaaaggtaagacggtctggttcgtgccttctatcaaagcaggaaatgatatagcagcgtgcttacgtaaaaatggtaagaaagtaatacagttaagtcgaaaaacgtttgacagtgaatatgtaaaaacgagaacaaacgattgggacttcgtagtaacaactgacatatcagaaatgggcgccaatttcaaagcagaaagggttatagaccctagaaggtgcatgaaaccggtcatcttaacagatggggaggaaagagtgatattagctggaccaatgccagttacacattccagtgcagctcagcgtcgtggccgtattggacggaaccccaaaaacgaaaatgatcagtacatctatatgggagagccactagaaaacgatgaagactgtgctcattggaaagaagctaagatgctactagacaatataaataccccagagggaataataccttctatgttcgaacctgaaagagaaaaggtggacgcgatagacggggaatatcggttacgaggcgaggcacgaaaaacgtttgtagacctgatgcgacgtggggatctcccagtatggctagcatatcgtgttgctgcggaaggtataaactacgctgatcgacgatggtgttttgatggagtcaaaaacaatcaaatcttggaagaaaatgtggaagtggagatatggacaaaagaaggagaacgaaagaaattaaaaccacgctggttagatgctagaatatacagtgaccctttggcgctaaaagagtttaaagaatttgctgccggtagaaaatcactaacactaaacttaattacagaaatgggtaggttaccaacttttatgacacaaaaggcaagagacgcactagacaatctagcggttttgcatactgctgaggcaggcggaagggcttataatcatgcactaagtgaattaccggagacattagaaacgttattattgctaacactactagccacagttacaggtggaatatttttatttctaatgagcggcaaaggtgtaggtaaaatgacactaggcatgtgctgcattatcaccgcaagtattctgctatggtatgcacagatccagccgcattggatagcagcctctattattctagagttctttttaattgttctgcttatcccagaaccagaaaaacagagaactcctcaagataatcagctgacatacgttgtaatagcaattttaaccgtagtcgcagctactatggccaatgaaatgggatttcttgagaaaacaaagaaagatttaggcttgggtagcattgccacacaagaacccgagtcaaacattcttgatattgaccttcgaccagcttctgcgtggaccctctatgcagttgcgaccacattcgttacacctatgctacgacatagtattgaaaatagttcagtaaatgtcagcctaacagctatagcaaatcaagcaaccgtattaatgggtttaggaaagggctggcccttatcaaaaatggacattggggtaccattgttggcaataggttgttatagtcaagtgaatcccattactttgactgccgccctactgctactgattgctcactatgcaataattggtccgggactccaagcaaaagcaactcgtgaagcgcagaaacgcgcagcagcaggaatcatgaaaaaccccactgtagatggaatcactgtaatagatctagatcccataccatacgaccctaaatttgaaaagcagttaggtcaggttatgctattgatattatgcgtaacacaagtgcttatgatgcgcacaacgtgggccctatgcgaggcgttaactctagcaacaggaccgatttcgacactctgggaaggtaaccctggccgtttttggaacacaaccatcgctgtatctatggctaatatttttcgaggatcatatctagccggcgctggactcttattctcgataatgaagaataccacaaacacccggagaggtacgggtaacattggtgaaacattgggtgaaaagtggaaaagccgattgaatgcccttggcaaatcggagtttcaaatatataagaaatctggtatccaagaagttgatagaacccttgctaaagagggcatcaagcgtggggaaacggaccatcatgccgtgagcagaggcagtgcaaagctaaggtggtttgtcgaacgcaatatggtgacacccgaaggtaaagttgtcgatcttgggtgtggaagaggaggctggagttattattgtggcggacttaaaaatgtaagagaggttaaaggactaacaaaaggaggaccgggtcatgaggaaccaatccccatgtctacctacggttggaacctagtacggcttcagagcggggtagacgtatttttcaccccacccgaaaaatgcgacactttgctatgtgacataggtgagtcaagtcccaacccgacgatcgaagccggacgcactcttcgagttttgtcgctagttgaaaattggctaaataatgacacacaattttgtataaaagttcttaacccgtacatgccatcggtaatagagaaaatggagacacttcaacgaaagtatggtggtgcattagtaaggaacccattaagtcgtaatagtacccacgagatgtattgggtttctaatgcaaccgggaatattgtaagctccgttaacatgatctcacgcatgttgatcaacaggtttacgatgaaacataagaaagctacatacgaaccggacgttgatttaggttcaggcacaagaaacatcggcatcgaatcagaaattccaaatttagatattatcggcaaacggattgagaaaataaaacaagaacacgaaacatcttggcactatgatcaagatcatccatataaaacatgggcttatcatgggagttatgaaacaaagcaaacgggatcggcaagcagcatggtaaacggcgtcgtaagattattgacgaaaccctgggacgtagttccaatggtcacacaaatggcgatgactgatacaacacccttcggtcaacagagagttttcaaagaaaaagtcgatacaagaacacaagaaccgaaggaaggaaccaagaaattaatgaaaatcactgcagagtggctgtggaaagaactagggaagaagaaaactccgagaatgtgcaccagagaagaatttactcgaaaagtacgtagcaacgcagctttaggtgctattttcacggatgaaaacaaatggaaaagtgccagagaggcagtagaagattcgagattttgggaattggttgataaggagcggaacttacatttggaaggaaaatgtgagacctgcgtttataatatgatgggaaaaagagagaagaaattgggagagttcggcaaagcaaaaggatcaagagcgatctggtatatgtggttaggtgctagattcctagaatttgaagcattaggatttttaaacgaggaccactggttctctcgagaaaactctctttcaggagtggaaggcgagggtttgcacaaactaggatacatattacgtgacgtaagcaaaaaggagggaggggcaatgtatgcagacgacaccgctggttgggatactcgaataacattagaggatctcaaaaatgaggagatggtcactaaccacatggagggcgagcacaagaaactagcagaagcaatttttaaattgacttatcaaaataaagtcgtgcgtgtgcaaagaccaacccctcgcggtacagtaatggacataatcagcagaagagaccagagaggctctggacaagtcggtacgtacgggctaaatacttttacaaatatggaggcccagttaatccgacaaatggagggtgagggcattttcaaatctatccagcacttaacagtcacggaagagatagcagtacaagattggttagcacgagtaggccgagaaagattaagtcgcatggcaatctcaggtgacgactgcgtcgtcaagcccttagacgacaggttcgcaagcgcgcttacagcgttaaacgacatgggaaaagtcagaaaagacatacaacaatgggagccttcacgaggttggaatgattggactcaggtccctttctgctcacaccactttcatgaacttattatgaaagatgggagggtattagttgtcccctgtcggaaccaggacgaattgattgggcgagcgcgtataagccagggcgcaggttggtcccttaaagagaccgcatgtctagggaaaagttacgcacagatgtggtctttaatgtactttcaccgccgagacttgagattagcagccaatgccatttgttcggcagtaccgtcccactgggttccaacgtctagaactacctggtcgatacatgcaaaacatgagtggatgacaacagaagacatgctaacagtatggaatcgagtatggatacaagaaaatccatggatggaagacaagacaccggtagagagttgggaggaggtcccttatttaggaaagagggaagaccaatggtgcgggagcctaataggattaactagcagggctacttgggctaagaatattcaaacagcaattaaccaagtccgaagtctgataggaaatgaagagtatacagattatatgcccagtatgaagcgctttagaagagaagaagaagaggcgggggtcttatggtaa

SEQ ID NO: 22201 - RNA, 9876 nt, synthetic construct
  misc_feature 1..9876: note = derived and/or modified CDS sequence (opt6) from DENV-2__KF704356__SS-prME
  source 1..9876: mol_type = other RNA
actgcagggatgataataatgttaattcctacagtaatggctttccatttgacaactagaaatggcgaaccccacatgatagtttcaagacaagaaaaaggaaaatctcttctatttaatactggagatggtgttcacatgtgcacattgatggcaatgcatttaggagaattgtgtgaagatacaataacatataaatgccccctcttaagacaaaacgaacctgaagatatagattgttggtgcaattccacaagtacatgggtaacatatgggacatgcactacaacaggtgaacataggcgtgagaaaaggagtgtcgcactcgtaccacacgttggaatgggacttgaaacccggactgaaacctggatgtcatctgagggtgcatggaaacacgcgcagcgaattgaaacatggattttgcgacaccccggatttaccatcatggcggcgatactagcatatacaattggaacaacacatttccaacgagcgcttatatttattttgttgactgcagtcgctccctcaatgactatgcgatgtattggtatatcaaacagggattttgtggagggcgtttctgggggttcatgggtcgacattgtactagaacatggttcgtgtgtaaccacaatggccaaaaacaaacccacactagacttagaattaattaaaactgaggcaaaacaaccagcaacgttgcggaaatattgtatagaggcaaaactaacgaacactactaccgaatcaaggtgtccaacccaaggagaaccaagtctaaatgaggaacaggataaacggtttgtttgcaaacactcgatggtagatagaggatggggtaacggatgcgggttattcggaaaaggatccatagtaacatgcgctatgtttacgtgtaagaaaatcatgaaaggaaaagtagtacaaccggagaatttagaatatacgatcgtgataactccgcatagtggagaagaacatgcagttgggaatgatacaggaaaacacggcaaagaaataaaaatcaccccacaatcttcgatcaccgaagcagagctaacaggatatggtacagtcacaatggaatgctcccctcgtactggtcttgatttcaatgagatggtactcttacaaatggaggataaagcctggctagtacaccggcaatggttcttagatttgccactaccttggttaccgggtgccgatacacaagggtcaaactggatacagaaagagaccttggttacatttaaaaatcctcatgccaagaaacaagatgttgttgtgttgggttctcaagaaggtgctatgcatacagcattaaccggcgccacagaaatacagatgtcgtcaggaaacgtgctattcacaggacacttgaagtgccgtcttcgcatggacaaattacaattgaaaggaatgagttacagcatgtgcactgggaaatttaaggtagttaaagagatagccgaaactcaacatggtacaattgtaatacgtgtacaatatgaaggagatggaagcccttgtaaaataccattcgaaataatggatttggagaaaagacatgtattaggacgattaattacagttaacccaattgtaaccggaaaggattcacccgtaaacatagaagcggaaccacctttcggtgactcatatattattataggagtggaacccggtcaactcaaactcaactggttcaagaaaggatcctctataggccagatgtttgcaaccacgatgaggggtgcaaaaagaatggcgattttgggcgatacagcgtgggattttggaagtttaggaggggtattcacttccatcggaaaagcactacatcaggtgttcggagctatatacggcgctgcattcagcggtgtatcttggacaatgaaaatattaatcggagtaataataacctggataggcatgaactcacgcagtacatctctaagtgtgagcctagttctagtgggggttgtcacattgtatttgggtgtgatggtacaggctgacagcggttgcgttgtaagctggaagaataaggaattaaaatgcggtagcggaatatttatcacagacaatgtacatacctggacagagcaatacaaattccagcctgaaagcccatccaagttagcctcagcgatacagaaggctcacgaggaaggaatatgtggaattaggtccgtaactcgtctggagaacttaatgtggaagcaaataactcctgagttaaaccatatcttgtccgaaaatgaagttaaactaacaataatgactggagatataaagggcatcatgcaagcaggaaagcgaagtctcaggccgcagccaacagagttaaaatattcatggaaaacatgggggaaagcgaaaatgctctcaacggaaagccataaccaaacctttttaattgacggtccagagacagccgaatgtcctaacacaaatcgagcatggaactcacttgaagtagaagactatggtttcggggtattcacaacaaacatctggcttaaattgcgcgaagaacaagatgttttctgcgacagcaagttaatgtcagcagccataaaggataaccgggctgtacatgctgatatgggttactggatagaatcagcccttaatgatacctggaaaattgaaaaggcgtcgttcatagaagttaaatcctgccattggccaaaaagtcataccttatggtcaaatggagtgcttgaatcggagatgataatacctaaaaactttgcaggaccagtgtcgcaacacaactaccgccctggatatcatacgcaaacagcagggccatggcatttaggcaaactggaaatggatttcgatttctgtgaaggtacgactgttgttgtgacggaagactgtggtaatcgaggacccagccttagaacaactacagcatcaggaaagttgataacggagtggtgctgtcgatcatgcacactgccacccttgagatatcgtggagaagacggatgttggtacggtatggaaataagaccattaaaagaaaaggaagagaacctagtgaacagcctagttacagcaggtcatggacaaatagataattttagtctaggcgtcctaggaatggcactcttccttgaagaaatgctacgtactagagtcgggactaaacatgcaatcctattagttgctgtgtcattcgtgacattgattacagggaacatgtcattcagagatctaggtagagttatggtaatggtgggggctacaatgactgatgatattggtatgggagttacctatttagcactcctagcagcattcaaagtccgtccaacattcgcagccggtctattgttgcgaaaactaactagcaaagaactaatgatgacaacaataggcatagtattattgtctcaatcaaccataccagaaacaatattagaattaactgacgcgctggcgttggggatgatggtactaaaaatggtgcgtaagatggaaaaatatcaactggcagtaacaataatggcaatcctatgtgttcccaacgcggtaatattacaaaatacttggaaggtttcttgcactattcttgctgtagtctccgtgtcaccactcttcctgacttcttcacaacagaaagccgattggatacccctagcacttacaataaaaggactgaatccaactgcgatattcctaacaacattatcaagaactaacaaaaagcgatcctggccactgaatgaagcaatcatggcggttggtatggtctctatattagcatcttctttactcaaaaacgacatacccatgaccgggccgctagttgctggaggtcttttaactgtctgttacgtactcacaggtcgtagtgcagaccttgagctggaaagggccgctgacgtgaagtgggaagatcaagccgaaatatctggaagcagcccaattctttcaataaccatctcagaagatggtagtatgtctatcaaaaatgaagaagaggaacaaactctgaccattcttatcagaaccggtcttttagtaatcagcggactttttcctgttagcattccaataacagctgctgcatggtacttgtgggaggtcaagaaacaacgagcaggcgtactctgggatgttccctcccctccgcccgtaggtaaagccgaacttgaagatggagcatacaggataaaacagaagggaatcttaggctacagtcaaatcggagccggtgtttataaagaagggacatttcacactatgtggcatgtcacaagaggagcagtgcttatgcataaaggcaaacgaatagaaccttcatgggccgacgtcaagaaagatctgatatcgtacggtggtggatggaaactagaaggagaatggaaagagggagaagaagtacaagttttagcactggaaccaggtaaaaacccaagagcagtccaaacgaaaccaggattattcaaaactaatgctggaacaataggagcagtctcactcgactttagcccaggtacgagcgggagccctattattgatagaaaaggtaaggttgttggactttatggaaatggagttgtcacccgctctggagcatacgtatccgcaatagcgcaaactgaaaaatcaatagaagataatccggaaattgaagatgatatctttaggaagcgcaaattaaccatcatggatctacatccaggtgcagggaagacaaaacgttatttacctgctatagtgagggaagctataaaaagaggtttaaggacacttatattagctccaacgagagtcgtagccgcggaaatggaagaagctctaagaggccttccaatcagatatcaaacgccagccattagggctgagcacacgggcagagaaattgttgacctcatgtgtcatgccacattcactatgcgtttgttaagccctgtgagagtgccaaattacaatctaatcataatggacgaagcacacttcactgacccagcaagtatcgctgcacgaggatatatttcaactcgagtggaaatgggagaagcagcgggtatatttatgactgctacacctccaggtagtcgcgaccctttcccacaatcaaatgctcctataatggatgaggaacgagaaatcccagaacgatcctggtcgagcggacatgaatgggtaacagattttaaaggtaaaacggtgtggtttgtaccaagtattcgagctggcaatgatattgctgcttgccttaggaaaaatggaaagaaagtcattcagctcagtcggaaaacgttcgattctgagtacgtgaagacacgtaccaacgactgggacttcgtagtaaccacggatatatctgagatgggagcaaacttcaaagctgaacgagtcattgatccaaggagatgtatgaagccagtaatattaacggacggagaagaacgggtaatactcgcaggtccaatgccagtgacgcattcttcagccgcccaacgaagaggacgaataggacgcaatcccaaaaatgaaaacgatcaatacatttatatgggggaaccattggaaaacgatgaagattgcgcacactggaaagaagcaaaaatgctactagataatataaatacgccggaaggaattataccttcgatgtttgagccagaacgagaaaaggtcgacgcgattgacggagaatacaggttaagaggggaagcgcgaaaaacctttgtggatctaatgcggcgaggcgatctaccggtatggttagcatatagagtagccgcagagggcattaactatgcggatcgaaggtggtgttttgacggcattaaaaataaccagatactagaagaaaatgttgaagtcgaaatatggaccaaagaaggtgaacgaaagaaattaaagccaagatggttggacgcccgaatatattcagacccattagctcttaaagaatttaaggaatttgccgccggcaggaaatcattgacactgaatctcattactgaaatgggacgtcttccaacttttatgacacagaaagctagagatgcattagataatttggcagtattacataccgctgaagctggaggcagagcatataatcacgcactttctgagttgcctgagacactcgagacactactcctattgacgttattggcgacagtgactgggggaatatttttatttttaatgagtggacgaggcataggcaaaatgacgttgggaatgtgttgtataataactgctagcattctcctctggtacgctcaaattcaaccacactggattgctgcatcaatcatactagaatttttcctcattgttttattaataccagaacctgaaaaacaaagaaccccacaagataaccaattaacatatgtcgtaatcgctatactaacggtcgttgccgcaacaatggctaacgaaatgggattcttagagaaaacaaagaaagacctggggttaggaagcataacaacgcaacaaccagaaagtaatattttagatatcgatttgaggccggcttccgcttggacgttatatgcagtcgcaactacctttgtgacacccatgctgaggcatagtatagagaactcttctgttaacgtcagtttaacagcgatcgcgaatcaggcaacagtcttaatgggactcgggaaaggttggccgcttagtaaaatggatataggtgtacccttactcgcgattggatgttatagccaggtcaatcccattactcttactgcagccttattccttttagttgcacactacgctataataggaccgggtttacaagcgaaggccacaagagaggctcagaaaagagccgctgcaggaataatgaaaaatccaactgtagatggcataacggtgatcgatctggacccaattccatacgatcccaagtttgaaaaacaactaggtcaagtgatgttattggtactttgtgtaactcaagttcttatgatgagaactacatgggcgctctgcgaagccttgacattggcaaccggaccgatctcaactctctgggaaggaaatcccggtcggttttggaacacgacaattgccgtatctatggcaaacatctttaggggttcgtatctagcaggagctggtctgctattttccataatgaaaaatacgactaatacgcgtcggggaacgggcaacatgggtgaaacactcggcgaaaagtggaaaagtcgcttgaacgcgttaggcaaatctgagtttcaaatttacaaaaagtcaggcattcaagaagtagacaggacactcgcaaaggaggggataaagagaggtgaaacggatcatcatgcagtgagccgcggatcagccaagctgcgatggtttgtagaaagaaatatggttacaccggaaggtaaggtcgttgacttaggctgtggtagaggcgggtggagttattattgcggtggactcaaaaacgttagagaagtgaagggactcactaagggaggacctggccacgaagaaccgataccaatgtcaacttatgggtggaacctagtgagactacaatcgggagtggacgtattctttacaccgcctgaaaaatgcgatacgcttctatgcgacataggagaatcatcaccaaatcctacagtggaagccggccggacattaagagttctaaacctcgttgaaaactggctaaacaataatacacaattttgcataaaagttctaaatccctatatgcccagtgttattgagaaaatggaggctttgcaacgtaaatacgggggtgcgctagttagaaatccgttatcaaggaacagtactcatgaaatgtattgggtgagtaacgctagtggcaatatcgtgagtagtgttaacatgataagtaggatgttaattaaccgctttacgatgagacataagaaggcaacatttgaacctgatgttgacttaggatcgggaactcgaaacataggtattgaaagtgaaattccaaaccttgacataatcggcaaaaggatagaaaagattaagcaagaatacgagacatcttggcattatgatcaggaccatccctataaaacctgggcataccacggatcgtatgagaccaaacaaacaggttccgcaagttcgatggtaaatggagtagtacgtttactgacgaaaccatgggatgtagtaccgatggttactcagatggcgatgacagacactaccccatttgggcaacaaagagtttttaaagaaaaagtggatacgagaacgcaagaaccaaaagagggtaccaagaaactaatgaagattacagccgagtggttatggaaagagctagggaaaaagaaaacaccgagaatgtgtacaagagaggaatttaccagaaaagtaaggtcaaatgctgctctaggagctatatttacagatgagaataaatggaaatcagcccgggaagcagtcgaagattcaagattctgggaactcgtcgacaaagaaaggaacttgcacttagaaggaaaatgcgaaacgtgcgtatataatatgatgggaaaaagagagaagaaacttggcgaatttggaaaagctaaaggcagcagagcgatttggtatatgtggttaggtgcgcgctttctcgagttcgaagctctaggtttcctaaacgaggaccattggttttctcgagaaaactcgctttctggtgtagaaggggaggggctacacaaattaggttatattcttcgagatgtaagcaagaaagagggaggagctatgtatgccgacgacaccgcgggttgggatacaaggattaccttagaggatcttaaaaatgaagagatggtaacaaatcatatggaaggagagcataagaagctggctgaagctatcttcaagctaacatatcagaataaagtcgtaagagttcagagaccaactccacggggcaccgtaatggacataatatcacgtcgagatcaaagaggttctggacaagtaggaacatatggacttaatactttcacaaacatggaagcccaactaatccggcaaatggaaggtgaaggagtttttaaaaacattcaacacttaacagttactgaggaaattgcagtacaaaactggttggcgcgagttggacgagaaaggctaagcagaatggctatatcaggggacgattgcgtagttaaaccactagatgacagatttgcatcagcactaaccgcactaaacgacatgggaaaggtaagaaaagatatccaacaatgggaacccagccggggatggaatgactggactcaagttccattttgttcacaccattttcacgaattaataatgaaagatgggcgcgtattggtagtgccctgccgaaaccaagacgaactaataggtagggcccgtatatctcaaggggcaggatggtcgcttagggaaacagcctgcctaggtaaatcgtatgcccaaatgtggagtctaatgtattttcatcgacgcgatcttagactagctgcgaacgcaatctgcagtgccgtacccagtcactgggtgccaacctccaggaccacgtggagtattcatgcgaaacacgagtggatgacaaccgaagatatgctaactgtttggaaccgtgtgtggatccaagaaaatccctggatggaagacaaaactcccgtagaaagttgggaagaaataccttacctgggaaaacgggaagatcaatggtgtgggtctctaatcggactcacatcccgtgcaacttgggccaaaaacatccaaactgcgataaatcaggtacgaagtctgataggaaacgaagaatacactgattacatgccatcaatgaaacggtttcgaagagaggaagaggaggctggtgtactttggtaa

SEQ ID NO: 22202 - RNA, 9876 nt, synthetic construct
  misc_feature 1..9876: note = derived and/or modified CDS sequence (opt6) from DENV-2__KF704355__SS-prME
  source 1..9876: mol_type = other RNA
actgcagggatgattataatgttaattccaactgttatggcattccatttaacaactcgtaatggcgagccacatatgattgtaagtcggcaagagaaaggtaaaagtctactatttaaaactggggatggtgtgaatatgtgtacactaatggcaatggacctgggcgaactttgtgaagataccataacatataaatgtccgtttctacgacaaaatgagccagaagatattgactgttggtgcaattcaacaagtacttgggtaacatacggtacttgcacaactacgggtgaacatcgacgcgaaaaacgaagtgtagcactcgttcctcatgtcggaatgggtcttgaaacacgaactgaaacatggatgagttcggaaggtgcatggaaacacgcccaaaggatcgaaacttggatattgaggcaccccggatttaccattatggcagcgatactagcgtatacaatcggcaccacacatttccaacgagctttaatatttatactgttgaccgctgtggctccatcaatgacgatgcgatgtataggtatctccaatagagatttcgtcgaaggggtatcaggagggtcatgggtcgacatcgtacttgaacatggaagttgtgtcacaacaatggccaaaaataaacctacactggatcttgaactaattaaaacagaagcaaaacaaccagcaaccctcagaaaatactgtatagaagcgaaattgaccaacaccacaacggaatcaagatgcccgactcaaggggaaccatcattaaatgaagaacaggacaaacgattcgtctgcaaacacagtatggtggatcgggggtggggaaacggctgcggattatttggtaaaggatcaatcgtaacatgtgccatgtttacttgtaagaaaataatgaaaggaaaagtagtacagccggaaaacctagagtacactatagtaattaccccacattcaggtgaagaacacgctgtaggtaatgatactggaaaatatggaaaagaaataaaaataaccccacaaagtagtataactgaagcagagctaactggatatggcacggtaacaatggagtgttcgccacgaacgggcctcgatttcaacgaaatggttttattgcaaatggaagataaagcatggcttgttcatagacagtggtttcttgatctcccattaccatggttgccaggggccgatacacaaggatcaaactggatccaaaaagaaaccttagtaaccttcaaaaacccacacgcgaagaaacaagacgtcgtggttttgggctctcaagaaggtgcaatgcataccgccctaactggcgcgacagagatacaaatgtcttcgggcaacgtgttatttaccggacatttaaaatgtcgcctacgaatggataaacttcaacttaaaggcatgagttacagcatgtgtactggtaaatttaaagtagtaaaagaaatcgcagaaacgcaacacggtacgatcgtgattagagtgcaatatgaaggagacgggtctccttgtaaaattccatttgaaatcatggaccttgagaaaagacacgtcctgggtaggttaataacagtgaatccaatcgtcaccggaaaagattcgcctgttaatattgaagcagaaccaccctttggagactcctatataattatcggcgtggaacccggacaattaaaattaaattggttcaagaaaggcagctccataggacagatgttcgggacaacaatgcgaggtgccaaacgtatggcaatcctaggagacactgcatgggattttggatcacttggaggggtattcacaagcataggaaaggctttacaccaagtcttcggtgcgatatacggagcagcctttagtggcgtttcatggacaatgaagatcctaacaggtgttataataacatggattggcatgaactcccggtctacatcactgtcggtttcactggtattagtcggagtagtcactttatatctgggtgttatggtacaggcagatagtggttgcgtggttagttggaagaacaaggaattgaaatgtggtagtggcatctttataacagataacgtgcacacgtggactgaacagtataaatttcaaccagagtctccaagtaaattggcatcggctatccaaaaagcacatgaagaaggaatatgcggaataaggtcagtcactagactcgaaaatctcatgtggaaacagatcacgccggaactaaatcacatattaagtgagaacgaggtaaaactcacaatcatgacaggagatataaaaggtataatgcaagctggtaaaagaagccttaggcctcaaccaactgaactgaagtactcatggaaaacctggggaaaagctaagatgttgtctacagaaagtcataatcaaaccttcttgatcgatggtcctgaaacagccgaatgtcctaatacaaacagggcctggaactctcttgaagtcgaagactacggattcggagtttttacaaccaatatttggctgaagctgagagagaaacaggacgtattctgtgacagcaaacttatgagcgccgcaataaaagacaatagagcggtacacgcagacatgggctattggatagaaagtgcacttaacgacacctggaaaatagaaaaagcatcatttattgaagtgaaaagttgtcattggcccaaaagtcacactttatggtctaatggagtactcgagagcgagatgattatacccaaaaattttgcgggtccggtttcccaacataattataggccagggtatcacactcagacagcaggaccatggcatctcggaaaattagaaatggactttgacttttgtgaaggaacaacagttgtggtgactgaagattgcggaaatagaggcccatccttaagaacgacaacagcgtccggcaagttaataaccgagtggtgttgtagatcatgtaccctaccaccgttacgttatcggggtgaagatggatgctggtatggaatggaaatacgaccattaaaggaaaaggaagagaacttagtaaattccttagtaacagctggacatgggcaaatagacaatttttcgctgggggtgctaggaatggcattattccttgaagaaatgttacgtacgagagtaggtacaaagcacgcgattctacttgtagcggtgtcttttgttacactcatcactggtaatatgagtttccgcgacctaggaagagtcatggtaatggtaggagcgacgatgacagatgatataggtatgggagtcacttatttagcgttattggcagcatttaaagttagaccaacttttgcggctggactattattgagaaaactaacatccaaagaactcatgatgacgaccatagggatagtcctcttgtcgcaatcaacgatccctgaaactatactagagcttacggacgcactagcccttggaatgatggttctaaaaatggtgagaaaaatggaaaaatatcaactagctgttacgataatggctattttatgcgtacctaacgctgtcatactccaaaatgcatggaaagtgagctgcactatattggcagttgtatctgtttctccacttttcttaacaagtagtcaacaaaaagcagattggataccgctagcattaaccattaaaggtcttaatccaactgccattttccttacgactttaagccgaacaaataagaaaagaagctggccactgaacgaagcaatcatggcggttggaatggtttcgatcctagcttcatcattgttaaagaatgacattccaatgactggtccgctcgtagctggtgggcttctaaccgtgtgttatgtactaacaggacgctcagcagatctcgaactcgaaagagcagcggacgtcaaatgggaagatcaagccgaaatcagtggaagttctccaattcttagcataacaatatccgaagatggaagcatgtcgataaagaatgaagaagaagaacaaacgctaacgatattaataagaacgggtctattagtcatctctggtttgtttccagtatcgataccaattacagcagcagcttggtatctatgggaggtaaagaaacaacgcgctggagtattatgggacgtcccgagtcctccaccagtgggtaaagcagaactcgaagatggcgcttaccgtattaagcagaaaggtatactaggatattcgcaaattggcgcaggcgtatataaggagggtacattccataccatgtggcacgtaacgcggggtgctgttttaatgcacaaggggaaaagaattgaaccgtcatgggctgatgttaaaaaggacctaataagttatggagggggctggaaacttgaaggtgaatggaaagagggggaagaagttcaagttttagcattagaacctggtaaaaacccaagagctgtgcaaactaagcccggtctatttaagacaaacgctggaacaattggcgcggtatctcttgatttttcgcctggcacttcaggatcgcctataattgataggaaaggaaaagtagtcggcctttacggcaacggtgtagtcacgagaagtggagcgtatgtctcagcgatagcacaaactgagaaaagtatagaggataacccagaaattgaagatgatatcttcagaaaacgtaaacttaccatcatggacctacacccaggagcgggtaagactaaacgatacctacccgctatcgtaagggaagcaataaaaaggggtttaagaaccctcatattagcacctacaagagtagttgcagctgagatggaagaggccctaaggggtttgccgataagatatcagacgcctgcgataagagccgagcacactggtcgagaaatagtggatttgatgtgccatgctacttttaccatgcgactattaagtccagtaagggtacccaattacaatctaattataatggatgaagcacatttcactgatccagcgagcatagcagcacgtggatatatttcgaccagagttgaaatgggagaggctgctggaatattcatgaccgccacgccgccaggaagcagagatcccttcccacaatccaatgctcctattatggatgaagagagggaaattccagagagatcctggtccagtggacatgagtgggtcacagatttcaaaggaaagactgtttggttcgttccgtcgataagggcaggtaacgatatcgcagcctgtttgcgtaaaaacggcaagaaagttatacagctaagccgtaagacctttgactctgaatatgtcaaaactcgaacaaatgactgggatttcgtagtaacaactgatataagtgaaatgggagccaactttaaggctgaaagagttatcgaccctcgtcgatgcatgaaacctgttatacttactgacggagaggaacgcgtaattttagccggaccaatgccagtaacacactcatctgcagcacaacgcagaggtcgtataggcaggaaccccaaaaatgaaaacgatcaatacatatacatgggcgagccattagagaacgacgaagattgtgctcattggaaagaagcaaaaatgcttcttgacaatattaatacgcctgaaggaataattccttcaatgttcgagcctgaacgtgaaaaagtagatgcgattgatggcgagtatagattgcgcggtgaagcgagaaaaaccttcgttgacttgatgcgcagaggagatcttccagtatggctggcttatcgggtagcggcggaaggaatcaattacgccgacagaagatggtgttttgatggaatcaaaaataatcaaatcttggaagaaaacgtagaagtcgaaatttggacaaaggagggggaaaggaagaaattaaaacctagatggctggacgccagaatctacagcgacccattagccctgaaagaatttaaagaatttgccgcaggacgcaagtctctcactttaaacctgataacagagatgggtagattaccaacgttcatgactcaaaaggcacgagatgcactggataatctagcagtactacatacagctgaagcaggagggcgcgcttacaatcacgccctaagtgaactccctgaaacactagagactctattgctactcacgctactagccacagtgacaggtgggatattcttatttttaatgtctggcagaggtattgggaaaatgacgttgggtatgtgttgtataataactgcttccatattactttggtacgctcaaatccagccccactggatcgctgcttcaatcatactagagttctttctaattgtactactaataccagaaccagaaaagcagagaacacctcaagacaaccagctcacttatgttgtaattgctattttaactgtagtagcagcaactatggcaaatgaaatggggttccttgagaaaaccaagaaagacttaggattaggatccatcactacacaacagccagagagtaatattttggacatcgaccttaggccggccagcgcctggacactgtacgccgttgccacaacgtttgtgacaccaatgcttagacattctattgagaatagcagcgtaaacgtatctttaaccgccattgctaaccaagccacagtattaatggggttaggaaaaggatggccgctaagtaaaatggatataggagtacctcttttggccatagggtgttatagccaagtaaacccaatcactctaaccgcagctctcttcctgctagtggcacattacgcaataattgggccgggcctacaggcaaaagctactagggaggctcagaaaagggcggcagcaggtatcatgaaaaacccaactgttgatggaataacagttattgatcttgaccccattccatatgacccgaaattcgaaaaacagctaggccaagtgatgcttctagtattatgcgtaacccaagtgttaatgatgaggacaacgtgggcgctctgcgaggcgctaacattagctactggccctatatctacattgtgggagggcaacccaggacgattttggaataccactatcgcagtctctatggcaaatatctttagaggtagctatttagcgggtgcaggtctattattctcaataatgaaaaacacgactaatacacgtcgagggacgggaaatataggcgagaccctgggtgagaaatggaaaagtcgcctgaacgcactaggaaaaagtgagttccaaatatataagaaaagtggtatacaggaagttgatagaacattagcgaaggaaggaatcaaaagaggggaaacagatcaccacgcagtttccaggggtagcgctaaacttcgctggtttgttgagaggaatatggtcacaccagaaggaaaagtcgtagatctagggtgcggaaggggaggctggtcctactactgtgggggtctcaaaaatgttagagaagtcaagggccttacaaaaggaggacccggacatgaggaaccaataccaatgagcacctacggatggaatctcgtgcgcttgcaaagtggagtggacgtatttttcacaccacctgaaaaatgcgatacattattgtgtgatattggagaatcttcaccaaatcctaccgtggaagcaggacgaaccttacgcgttctgaacctcgtcgagaattggcttaataataacactcaattttgtatcaaggtattgaatccctatatgccatcagtcatcgagaaaatggaggcgcttcagcgcaagtacgggggagcattggtaagaaatccgttatctagaaattctactcatgaaatgtattgggtaagcaacgcgtctggtaatatcgtaagcagtgtaaatatgatatcgagaatgcttattaacaggtttacaatgcgacataaaaaggctacgtatgaaccagacgtagatctgggatcaggaacaaggaatataggaatcgaatcagaaatcccgaacctagacatcatcggtaagagaatcgaaaagataaaacaagaatacgaaacaagttggcactacgaccaggatcacccatataaaacatgggcataccatgggagttacgaaacgaagcagactggaagtgctagtagtatggttaatggggtagtccgtttattaactaaaccatgggacgtagttcccatggtgacgcaaatggcaatgactgatacaaccccctttgggcagcagagggtattcaaggagaaagtcgatacgcgaacacaggaaccaaaggaaggaaccaagaaattaatgaaaataacggctgaatggttatggaaagaattgggcaaaaagaaaacgccaagaatgtgcacaagagaagaatttaccagaaaagtaaggagcaatgccgccctaggggcgatttttactgacgagaataaatggaagtcggcacgcgaagcagttgaagattcacgattctgggagctagtagataaagaacgtaatctacatttggaaggtaaatgcgaaacttgtgtttataatatgatggggaagagagagaagaaacttggagaatttggaaaagcaaaagggtccagagccatctggtacatgtggctaggagcccgatttctggaatttgaagctctagggttccttaatgaagaccattggttcagtcgagagaactctctatcaggtgtcgaaggtgagggtctacataaactagggtatatattgcgggatgtcagcaagaaagaaggcggagctatgtacgcagacgatacggccggctgggatacacgcattacactagaggatctaaagaatgaagaaatggtcacaaaccatatggaaggtgaacataagaaattggctgaggctatatttaagttgacgtatcagaacaaagtagtaagagtccaacgaccaactcctaggggaacagtaatggatataatcagtaggagagatcagcgaggttcaggccaggtaggaacttatggattgaatacattcacaaatatggaagctcaattaatcagacagatggaaggcgaaggagtcttcaaaaacatacaacacttaactgtaactgaagaaatagcagtccaaaactggttagcacgagttgggagagagcggcttagccgcatggcaataagtggagatgactgtgtagtaaaaccactcgacgatagattcgcgtcggcactaactgcgttaaatgatatggggaaagtcagaaaggatatacaacaatgggagcctagtagaggctggaacgattggacgcaagtaccattttgctcccaccacttccacgaactcattatgaaagacggaagggtcctagtagtaccttgtcgaaaccaagatgagttgatagggagagcaagaatttctcaaggcgcgggatggagcctgcgggaaactgcgtgcttagggaagtcatatgcacaaatgtggagtttaatgtatttccatagaagggatttaagactagcagctaatgccatctgttcagctgtacccagccactgggttcctacatccagaactacctggagcatccatgcaaagcacgagtggatgacaacagaagatatgctgacagtatggaatagagtatggatacaagaaaatccctggatggaagataaaacaccagttgaatcttgggaggaaattccttatttaggaaagagagaggatcaatggtgtggctcgctaattggcctgacatcaagagctacgtgggcaaagaacatacaaactgctataaatcaagtacgatcgctaataggtaacgaagagtatacagattacatgccatccatgaaaagatttaggagagaggaagaggaagccggtgtattatggtaa

SEQ ID NO: 22203 - RNA, 9876 nt, synthetic construct
  misc_feature 1..9876: note = derived and/or modified CDS sequence (opt6) from DENV-2__KF704354__SS-prME
  source 1..9876: mol_type = other RNA
actgctggtatgataataatgttgataccgactgttatggcatttcatctcaccactcgaaatggtgaaccgcatatgattgtatcgcggcaggaaaaaggaaaaagtctactcttcaaaacggaagatggcgtaaatatgtgtacgttaatggctatggacttaggggaattatgtgaagatactataacgtataaatgtcctttcttgcgacagaatgaaccagaagacattgactgttggtgcaactcaacctccacatgggtaacttatgggacttgcacaacgactggggaacatcgaagagaaaaacggtcggtagcattggtaccacatgtaggcatggggctagaaactcgcaccgaaacatggatgtcttccgaaggagcgtggaaacatgcacagaggatagagacttggatacttaggcatccaggttttacaatcatggcagcaattttagcatacacaatcggaaccacacatttccagagagcgcttatatttatcttgctaacagcagtggcaccatcaatgacaatgaggtgtataggaattagtaatcgagacttcgtagaaggggtaagtggtggaagttgggtagatatagttctagaacatgggtcatgcgtaactacaatggccaaaaataaaccaactctagacttcgaactaataaaaacggaagcaaaacaaccagctactctacgcaaatactgcattgaggcaaaacttacaaacacaactacagagtcaaggtgtcctacacaaggcgaacctagcctaaatgaggaacaggataaaagattcgtatgtaaacactcgatggtagatagaggatggggaaatggctgtggcttgtttggaaaaggaggtatagtgacatgcgcaatgtttacttgcaagaaaattatgaaaggaaaagtggtgcaacctgaaaatctagagtacacgatcgtaataacacctcactctggcgaagaacacgcagtaggaaatgacaccggaaaacacggcaaagaaataaaaataacgccacaatctagtataacagaagcagagctgactggatatggtacagtgacaatggagtgttctccgaggacaggcttagactttaatgaaatggtacttttacaaatggaaaataaagcatggctcgttcacagacaatggtttttagatctaccattaccctggttaccaggcgccgacacacaaggaagtaactggattcaaaaagaaacgctggttacttttaaaaatcctcacgctaagaaacaagacgtggtagtgcttggatcacaagagggcgctatgcacacggccttgaccggagctacagagatacaaatgagtagtgggaacgtgttgtttacaggtcatcttaaatgcagactcaggatggacaaactacaactcaaaggaatgagttactctatgtgcacgggtaaatttaaagtggtcaaagaaatagctgagacgcaacacggtaccattgtaatacgggttcaatatgagggagatggttcaccttgtaaaattcccttcgaaataatggatctagagaaaaggcacgtattaggacgcttaataacggtaaatccaattgtaacgggtaaagattccccagttaatattgaagcagaaccaccatttggagatagctatataataataggcgttgaaccagggcaattaaaattaaactggttcaagaaaggcagttcaattggacaaatgttcgccacaacaatgagaggagcaaagagaatggctatcctaggagatactgcctgggacttcggttcattaggaggcgtatttacatctatcggtaaagccctccaccaagtgtttggagcaatctatggagccgcatttagcggcgtctcctggacaatgaagatactaatcggggtcataataacatggattggaatgaactctcgaagcacaagtctctctgtaagtctagtcttagtcggagtagtaacactttatctgggtgttatggtacaagccgatagtggatgcgttgtctcatggaagaataaagaattgaaatgcggcagtgggatatttattacagataacgtacatacatggactgaacagtataaattccaaccagaatcgccctccaagctagcatcagcgatacaaaaagcacatgaagaaggcatatgtggtattaggtctgtgacaaggctagagaatctcatgtggaagcaaataactcccgaactaaaccatatcctctctgaaaatgaggttaaactcacaattatgacaggtgatatcaaaggcattatgcaagcagggaagaggagcttacgaccacagcccaccgaactaaaatattcatggaaaacatggggaaaggctaaaatgttatcgaccgaatcacacaaccaaacgtttctgatcgatggaccagaaacagccgaatgccccaacactaacagggcatggaatagtcttgaggtggaagattatgggttcggtgtatttacaaccaatatttggctaaaacttagagaagaacaagatgtcttttgcgattcaaaactaatgtcagcggccattaaggataatagggcagtacatgcagacatgggatactggattgagagtgctctcaacgacacatggaaaatagaaaaggccagctttatagaagtcaagtcttgccattggccgaaaagtcacacattatggagtaatggagtcttggaaagtgaaatgatcataccaaagaatttcgccggtccagtaagtcagcacaattatagacccggataccatacacaaactgcaggaccgtggcacttagggaagttagaaatggattttgacttttgtgaaggaactactgttgttgtaaccgaggactgtggaaatcgcggaccatcattgcgaacgactacagcaagtggcaaactaataacagaatggtgttgtagatcatgcactctaccacctttgcgttaccgtggggaagatggatgttggtatggtatggagattcggccactgaaagaaaaagaggagaatctagttaattctctagtgaccgccggacatggtcagattgacaattttagtctaggagtgttaggtatggcactatttcttgaagaaatgcttagaactagggtaggcacaaaacacgcgatcttgctcgtagctgtttcttttgtaacactgataactggaaacatgtcattcagggatttggggagagtaatggttatggtaggagcaactatgacagacgatataggcatgggagtaacatatttagcattgcttgcggctttcaaagtacgaccaacattcgcagctggtctattattgcgcaaacttacttcgaaagaattaatgatgacaacaatagggatagtgctcttatcccaaagtaccataccggaaacaatcttggagttgacagatgcgctagcattagggatgatggtattaaaaatggttcgaaaaatggaaaaataccagttggcagtaaccattatggcaatactgtgtgttcctaacgcagttattttacaaaatacatggaaagtaagctgtacaatactagctgtggtttccgttagtccactattcttaacatcgtcacaacaaaaggcagactggattccactggctctaactatcaaaggacttaatcctactgcaatttttctgactactctatctagaacgaataagaaacgatcctggcctcttaatgaagcaattatggcagtgggcatggtgagcatattagcttctagcctcctgaaaaacgatattccaatgacaggccctctagttgcgggtggactacttacagtatgctatgttcttacagggagaagtgcagatttagaactcgagagggcggcagatgttaaatgggaggaccaggcagaaataagtggaagctcacccatcttatcaattacaatttcagaagacggatctatgagcatcaaaaatgaagaagaagaacaaaccctaacaatattgattaggacgggattgctcgtgatttctggactttttccagttagtatacctataactgctgcagcctggtatttatgggaagtcaagaaacagagggccggtgttttatgggatgtccccagcccaccgcccgttggcaaagccgagttagaagatggagcttatagaattaaacaaaaggggattttaggatatagtcaaataggagccggtgtatataaggagggaaccttccataccatgtggcatgtaactcgaggcgctgtattaatgcataaagggaagagaatagaaccttcatgggcggatgtcaagaaagatttgatatcgtatggagggggatggcgactcgagggtgaatggaaagaaggggaagaggttcaagttcttgcccttgaaccaggcaaaaacccccgtgcagtccagacaaaacctggcctatttaaaaccaacgccggcacaataggagcagtcagcttagatttctctccaggtacatcgggcagtccaataatagataagaaggggaaagtcgtaggtctatacggaaacggggtagtaacccgatcaggagcgtatgtatcagctatagcacaaacagaaaagtcgattgaagacaatccggaaatagaagacgatatttttagaaaaagaaagctgacaataatggacctccatccaggtgccggaaaaactaaacgttacttaccggccattgtacgggaggctataaagagagggttacgaactctaatcctggcacctaccagagtcgtcgcggctgaaatggaagaagcactccggggtttaccgataaggtaccaaacaccggcaataagagcggagcataccggtagagaaattgtagatttgatgtgccatgcaacttttacaatgagacttttgtcccctgtgcgcgtgccgaattacaacctaatcataatggatgaagcacactttactgacccagcgtcaatcgcagctagaggatatatatcgacacgagtcgagatgggcgaagcagctggcatatttatgactgcaacgccacccggatcacgcgacccatttccacaatcgaatgcaccgataatggacgaagaaagggagatcccagagcgatcgtggtcatcaggacatgaatgggtgactgacttcaaaggcaagactgtgtggtttgttcctagtataaaagcaggtaatgatatagctgcttgtcttagaaagaatggcaagaaagtaatccaattaagtcgtaaaaccttcgacagtgaatatgtaaaaactagaacaaatgactgggactttgtggtaaccactgacatctcggaaatgggtgctaactttaaagctgaaagagtgatagatccgcgtagatgcatgaaaccagtaatcctaacagatggagaagaacgggtaatattggctggcccgatgcccgttacacatagctcagcagcgcaacgacgtggtagaataggtcgaaaccctaaaaacgaaaacgaccaatatatctacatgggcgaacctctagaaaacgatgaagactgtgctcattggaaggaagctaaaatgctcttagataacataaacacacctgagggaataatcccgagtatgtttgaacctgagagggaaaaagttgatgcaattgacggtgaatacagacttagaggcgaagcaagaaaaacattcgtagatctgatgcgacgaggtgatttacccgtatggctcgcttaccgtgtcgctgctgaagggatcaattacgccgaccgtcgatggtgttttgacggaattaagaacaatcaaattctagaagaaaatgtggaagtggagatttggacaaaagagggtgagcggaagaaactaaagccaagatggctagacgcacgtatctattcagacccattagcgcttaaggaatttaaagagtttgcagccgggagaaagagcttaacacttaacttaatcacagaaatgggtcgcttgccaacattcatgacacaaaaggcaagagatgcgttagacaatttagccgtactgcataccgccgaggcagggggtcgtgcatacaatcatgcattgtcagaactccctgagactttagaaaccttactactcctcacactattggctactgttactggaggtatatttctcttcttgatgagcggaagaggtataggcaagatgacactagggatgtgctgtataatcactgcaagcatccttttatggtacgcacaaatacagccgcactggatagcagcatcaataattcttgagttcttcctaatagttctattgatacctgagccggaaaaacaaaggacgcctcaagacaaccaattgacctatgttgtgattgctatattaactgtcgtcgcggctacaatggctaatgaaatgggctttctagagaaaaccaagaaagatctaggctggggatcaatcacaacgcaacagccagaatccaacatacttgacattgatttacgtccggcaagcgcttggacactgtacgccgtggcgacgacttttgtaaccccgatgttaagacactcgatagaaaactcgtcagtgaacgtgtctcttacagcaatcgctaaccaagctactgttttaatgggtttgggaaaaggatggccattaagcaaaatggatataggtgtccccttactcgcgattggttgctactcacaggtcaatccaataacactaacggcagcactctttctattagtagcacattacgctataattgggcccggcctgcaagccaaagccaccagggaagcgcagaaaagggctgcagcaggaatcatgaaaaatccgacagtcgatggaatcaccgtaatcgaccttgacccaattccttatgatcctaaatttgaaaaacagttaggacaagtaatgttattagtattgtgcgtaacgcaagtcttaatgatgaggacaacgtgggccttatgcgaagctctaacgctggcaacgggtccaattagcactctgtgggaaggaaacccgggcagattctggaatacaactatcgccgtgtccatggccaatatctttcggggtagttaccttgctggagccggcttattatttagcataatgaaaaatactacgaatacaagaaggggcactggcaacatgggagaaacgttaggtgaaaagtggaaatctagactaaatgccttaggaaaaagcgagttccagatctataaaaagagtggcattcaagaggttgatcgcactttggccaaggaaggaattaagcgaggagaaactgatcatcacgcagtcagtaggggcagcgcaaaattacggtggttcgtagaaagaaatatggtaacgcctgaaggaaaagtagtagatttgggatgtggtcgcggaggctggtcttattactgtgggggactgaaaaatgtaagagaagtaaagggtctcaccaaaggtggtccaggtcacgaagaaccgattcctatgtctacgtacggatggaatttagtgcggctccaaagtggggtagacgttttctttaccccacccgaaaaatgtgatacgctactttgtgatataggtgaatctagtcctaacccaactgtagaggctggtagaactctacgcgtactaaacctagtcgaaaattggttgaacaataatacacagttttgtatcaaagttttaaacccatatatgccaagtgtgatagagaaaatggaagcactgcaaagaaaatatggcggtgccttagtccgaaatccattaagccgcaacagcacacacgaaatgtattgggtatccaatgcatcaggaaatatagtttcatcagttaatatgatatctagaatgctcattaatagatttacaatgagacataagaaagcgacgttcgagcccgatgtagatctgggttcaggtacaagaaatataggtattgaaagcgagatccctaatctagatataattggtaaaagaatagagaaaatcaagcaagaatatgaaacaagttggcactatgatcaagatcacccatacaaaacctgggcctatcacgggagctatgaaacaaaacagacaggatcagctagcagtatggttaacggagttgttcggttgttaactaaaccttgggatgtagttccaatggttacacaaatggctatgacagacacaacccctttcggacaacaaagagtattcaaggaaaaagtagatacacgcacccaagaacccaaggaaggaactaagaaattgatgaaaattacagctgaatggctatggaaagaacttggtaaaaagaaaacacctcgaatgtgtactagagaagagttcacgagaaaagtacgatcaaatgccgcccttggtgcaatcttcacggatgaaaacaagtggaaaagcgcacgagaagcggtagaagattcgagattctgggaattagtcgataaggaacgaaatctgcatttagaaggaaaatgcgagacgtgcgtttacaatatgatgggaaagagagagaaaaagctaggcgaatttggtaaagcaaagggaagtagagcaatatggtacatgtggctcggcgctaggtttctagagtttgaagcacttggatttttgaacgaagatcattggttcagcagggaaaattctctcagcggtgtcgaaggtgagggtctccataaactaggttatatactcagggatgtgagcaagaaagaaggcggagcaatgtatgcagatgacactgctggctgggatacaaggataaccctggaagatttaaagaatgaagagatggtgacaaaccatatggagggggaacacaagaaattagcagaagcaatttttaagttaacataccagaataaagtagtcagagttcaacgaccgaccccaagaggaacagtgatggatataatatctaggcgagaccaacgcggaagcggccaagtaggtacttacggtttgaatacctttaccaatatggaggctcaattgataagacaaatggaaggtgagggagtcttcaaaaatatacaacatttgacagtaaccgaggaaatagccgtacaaaactggcttgccagggtaggtagggaacgcttatctcgaatggccataagcggagatgactgtgttgtgaaacctttagatgaccggtttgcgtcagcgctaacggcacttaatgacatgggaaaagttcgcaaagacatacaacagtgggaaccgtctcgaggttggaacgattggacacaagtaccgttttgctcacaccattttcacgaactgattatgaaagatggcagagtattagtggtgccctgtagaaatcaagatgaattaataggtcgagcacgcatctcccaaggtgcaggatggagtctaagggaaactgcatgcctaggaaagagttatgctcaaatgtggagcttaatgtattttcacagacgtgatctccgattagcagcaaacgcaatatgtagtgcagttccaagccactgggtcccgacgagccgtacgacatggagcattcacgccaaacatgaatggatgacgactgaagacatgttaacggtttggaatagggtttggatccaagaaaatccgtggatggaggataaaacaccagtagagagctgggaagaaataccttatcttggaaaacgggaggatcaatggtgcgggtcccttatagggctaacaagtcgagcgacctgggccaaaaatatacaaacagcaataaatcaggtaagaagtttgataggaaatgaagaatatacagattatatgcctagtatgaaaagatttcgaagggaagaagaggaagccggtgttctatggtaa

SEQ ID NO: 22204 - RNA, 9876 nt, synthetic construct
  misc_feature 1..9876: note = derived and/or modified CDS sequence (opt6) from DENV-2__KF704357__SS-prME
  source 1..9876: mol_type = other RNA
actgcagggatgataataatgttaataccaacggttatggcatttcatttaacgacccgaaacggcgaacctcacatgatagtgtcaaggcaagaaaaagggaaatcactactctttaaaacaggagatggagttaatatgtgcacacttatggctatggatttaggagaactatgtgaagacacaataacatacaaatgcccgttgctaagacagaacgaaccagaagatatagattgttggtgtaacagcacatcaacctgggtaacatacggaacttgcactacaactggagaacaccgtcgggaaaaacgttcagttgctcttgttcctcatgttggtatgggactggaaacacgcacagaaacctggatgtcaagcgaaggtgcatggaaacatgcacaaagaattgaaacatggatcctcagacaccctggcttcacgatcatggcagcaatactagcttacacaatcggcacaacgcactttcaaagagcattaattttcattctattaactgcagtagctcccagtatgacaatgcgatgtataggtatatctaacagggactttgtagaaggtgtaagcggtggctcctgggttgatatagttctagaacatggttcctgtgtaactaccatggctaaaaataaaccgactttagatttagaactcatcaaaacagaagcgaaacaaccggcaacactgcgtaaatactgcattgaagctaaactaacaaatacaacgactgaatcccgatgtccgactcagggggaaccatctctaaacgaagaacaagataaaaggtttgtttgcaaacactcaatggttgacagaggatggggaaatgggtgtggattatttggtaaagggagcattgtcacatgcgcaatgtttacgtgtaagaaaattatgaaaggtaaagtcgtacaacctgaaaatttagaatatacaatcgttatcacaccccatagtggtgaagaacatgctgtagggaatgacaccggcaaacatggaaaagaaataaaaattactccacaatcgagtattactgaagcagaactcactggatacggaacagttacgatggagtgttctccacgtactggattggactttaacgaaatggtattactacaaatggaagacaaagcatggctagtgcatagacagtggtttctagatttaccattaccatggttgcctggagcagacactcagggaagcaattggatacaaaaagaaacattagtaacattcaaaaatcctcatgccaagaaacaggatgtggttgtactgggatcacaggaaggtgcgatgcacactgcgttaacaggtgcaactgaaattcaaatgagctccggaaacgttctatttacaggtcatcttaaatgtagactccgtatggacaaactgcaattaaaaggaatgtcgtacagcatgtgcacagggaaatttaaagtagtaaaagaaatagcagaaacccaacacggcactatcgtcattcgtgtgcaatatgaaggtgatggaagtccttgtaaaatcccgtttgaaattatggatttagagaaaaggcatgtcctagggcggcttattacagtcaaccctatagtcactggcaaagactccccagtcaatattgaagcggagcctccatttggagattcttatatcatcattggtgtagaacctggccagttaaaattaaactggttcaagaaagggtcatcaattgggcagatgtttgccaccacaatgagaggtgcgaaaagaatggccatcctcggggacaccgcctgggacttcggctccttagggggtgtttttacttcaatcggtaaagcactgcatcaagtcttcggagcaatatatggagccgctttttcaggtgtgtcgtggacgatgaaaattctaataggggttataataacatggataggcatgaacagccgctccacttcactatctgtaagccttgttctagtcggagtggttaccttatatctaggtgtgatggtccaagcagattctgggtgtgtagtttcatggaaaaataaagaattaaaatgcgggagtgggattttcattacagataatgtacatacttggaccgagcaatacaagtttcagcctgaatcacctagcaaacttgcaagcgccatccaaaaagctcacgaggaaggaatatgcgggatccgatcagtcactaggctagaaaatcttatgtggaaacaaatcacaccagagcttaaccacatcctatctgaaaatgaagtaaaactaacaataatgactggtgatataaaaggtattatgcaggcgggaaaaagaagtcttaggccacaaccaactgaactcaaatattcatggaaaacttggggaaaggctaaaatgctttctaccgaatcccacaaccaaactttcttaatcgatggtccagaaaccgcagaatgtccaaatactaatagagcatggaactctttagaagttgaagactatggttttggagtattcacgacgaatatttggctgaaactaagagaagaacaggacgtattctgtgactcgaaattaatgtcagcagcaattaaggacaatcgtgctgtacatgctgatatgggctactggattgaaagtgctctcaatgatacatggaaaattgaaaaagcgagttttatcgaagtaaaaagttgccactggcctaagtctcatacactttggtcaaatggagtcctcgaatccgaaatgattattcccaaaaatttcgccggtcccgtatctcaacataactatagacccggctaccatacacaaacagcaggaccctggcatcttggaaaactcgaaatggacttcgacttctgtgaaggcaccaccgtcgtggtcacggaagattgtggaaacagaggaccctcccttcgcactactacagcatctggaaaactgataacagaatggtgctgtcgaagttgcacattaccgccgttaagatatagaggagaagacggatgctggtatgggatggaaataagaccccttaaagagaaggaagagaatctagtcaatagcctagtaacagcaggacacggtcaaatcgataacttctccttaggagttctcggaatggcactatttctagaagaaatgctacggacgagggtgggaacaaagcatgcaatacttttagtcgcagtgagcttcgtgactttgataactggaaatatgagttttcgggacctcggaagggtaatggtaatggtcggggctactatgacggatgatatcggtatgggagttacatatttagctttactggcagcgtttaaggtcaggccaactttcgcagcgggacttttactaagaaaattgacatccaaagagttaatgatgacaactataggaatagtcttactttctcagagtacaatacccgaaacaatactcgaactcacagacgcgctagctcttgggatgatggtactaaagatggtgaggaagatggagaagtatcaattagcagtaacaataatggcaattctatgcgtacctaatgcagtgatactacaaaatacatggaaagtttcatgtactattcttgcagtagtatctgtgagcccactctttttaacaagcagtcagcagaaagcagactggattcccttggccctgactataaaaggtctaaatccgacggccatattccttactacactctctcgaacaaataagaaacgaagctggcctctgaatgaggcaatcatggcagttggcatggtatcgattctagcaagcagtcttctaaagaatgatatacctatgactggaccattagtcgcaggaggattgttaaccgtatgctatgtcctgactgggaggagcgctgacttagaactagaaagggcagcagatgttaaatgggaagaccaagcagagataagcggaagctccccaatattatcaattacaataagtgaagatggttctatgagtatcaaaaatgaggaggaagaacagactttgaccatcttaattagaaccggattactggtaatatcgggactttttcctgtctcaataccaataaccgccgcagcgtggtacttatgggaggttaagaaacagcgagcaggcgtcttatgggatgtcccgtcgccaccccctgtcggaaaagcagaacttgaagacggggcttataggattaaacaaaaaggaatattaggatactcgcagattggagcaggcgtctataaagagggtacgtttcatacaatgtggcacgtaacacgtggggcagtcttaatgcacaaaggcaaacgtatcgagcccagctgggcggacgtaaagaaggacttaataagctacgggggaggttggaaattagagggagaatggaaagaaggagaagaagtacaagttttagctctagaaccaggcaaaaatcccagagctgtacaaactaagccaggtttgtttaagacaaatgccggtaccattggggcagttagtttggatttcagtcctggtaccagcggatcccctattatagacagaaaaggtaaggtcgtaggtctatatggaaacggtgtcgtcacgagatctggggcttatgtgagcgctatagctcaaacagaaaaatctatagaagataacccagaaatagaggatgacatatttagaaaaagaaaactgactattatggatctgcatccaggagcaggaaagacaaagcgataccttcctgcaatagtgcgggaagcgattaaacgaggattacgaaccctcatcctagcgcctacacgagtagtagcggctgaaatggaagaagctctgcgaggactgccgatacgatatcaaacgcccgcaatccgagcggaacatacaggtagggaaatagtagatttaatgtgccacgcaacgtttactatgcgactgctaagcccggtgcgagttccaaattacaacttaataataatggatgaagcacactttaccgacccagcttctattgctgcgcgtggctatataagcacacgcgttgagatgggtgaggctgcaggcatattcatgactgctacaccacccggaagtagagatccgttcccccagtctaacgctcccattatggatgaggaaagagaaatacctgaacgttcctggagtagtggtcatgagtgggtgacagatttcaagggaaaaactgtatggtttgttccatcgatccgtgcaggtaatgacattgcagcctgtttaaggaaaaacggcaagaaagttatccaattgagtagaaaaacattcgattcagaatatgtgaaaacgagaactaatgattgggactttgtcgtaacaaccgacataagcgagatgggcgcaaattttaaggcagaacgcgtcatagatccacgtaggtgcatgaagccagtcatattgactgacggagaagagagagttatactagcaggacctatgcccgtaactcattcatcggcggcacaacgcaggggacgtatagggagaaatcctaaaaacgagaacgatcaatatatctatatgggggaaccactagaaaatgacgaagattgtgctcattggaaagaagctaaaatgttgctagacaatatcaacacacctgaaggcataataccgagcatgttcgaaccagagcgtgaaaaagtggacgccattgacggagaatatagattaaggggcgaagcacgcaaaacatttgtagatctgatgcgccgaggggacctccctgtatggttagcatatagagtagcagccgagggaataaattatgcggatcgtaggtggtgttttgatggtattaagaataatcaaatattagaagaaaatgtggaagtagaaatctggacaaaagagggtgaaagaaagaaactgaagccaaggtggctggatgctcgtatctatagcgacccattggctttaaaagaatttaaggaatttgcggctgggaggaaatcgctcacactaaatttaatcactgaaatgggtagattaccaacatttatgacacaaaaggcaagagacgctttagataacttggctgttctacatactgcagaagccggtggtcgagcttataatcacgccttgtcagagttaccagaaacactagaaactctcctgttactaacattgctagcaactgttaccggagggatctttcttttcttgatgtcaggcaggggtattggaaaaatgaccctgggcatgtgttgcatcataacagctagtatattgctttggtacgcacaaatacaaccacactggatcgcggctagcattattctcgagttcttcttaatagtactgttaataccggaaccagagaaacagcgcacgcctcaagacaatcagctaacatatgtagtgatcgccattcttacggtagttgccgctaccatggctaatgaaatggggttccttgagaaaactaagaaagacctgggtcttgggtccattactactcagcagccggaatctaatatattggacatagatcttcgcccagcatcagcgtggactctatacgccgtagctactacatttgtaaccccaatgttgcgacatagtattgaaaacagcagtgttaacgtatctctaacagctattgcgaaccaagctactgttctaatgggattaggaaaaggttggccactatcaaaaatggatataggcgtacccttgctagcgataggatgctattctcaggtgaatccgattacattaacagcagctttattcctgcttgtggcacactacgcaattatcgggcccggcttacaagccaaggctacccgagaagcgcaaaaacgggcagccgctgggataatgaaaaacccgacagtagatggtattaccgttattgacttagatcccataccatatgacccgaaattcgaaaaacaattaggccaagtaatgctgctagtactctgcgtaacacaagtcctaatgatgagaactacatgggccctatgcgaagctctcaccctggcgaccggacccatatctacattatgggaaggaaaccccggaagattttggaatacaacaatagccgtatctatggcaaacatatttaggggctcgtatttagcaggagccggattacttttctctattatgaaaaataccacgaacacgcgacgaggaacaggaaatatgggagaaacactgggggaaaaatggaaaagccgattaaacgctctaggcaaatcagagtttcaaatctataagaaatcagggatacaagaagtagatcggactttagcaaaagaaggaattaaaagaggggaaaccgatcatcatgctgtaagtcgaggttctgctaaactacgttggtttgttgaaagaaacatggtaacaccagaaggaaaagtagtagaccttgggtgtggtagagggggctggagttattattgtggaggactcaaaaatgtaagagaagttaagggtcttactaaaggaggccccgggcatgaagaaccgatcccgatgtccacttatgggtggaatctagtacgtttacaaagcggcgtcgatgtattctttacacccccagaaaaatgcgatactttactctgtgacatcggggaatcatcacctaatccgactgtagaagcaggcaggacattgagagtactaaaccttgttgaaaattggctaaataataatacgcaattctgcataaaggttttaaatccctatatgccgtctgtaatcgagaaaatggaggctttacaacgaaaatacggaggggccctcgtccgtaatcccttatcaagaaactcaactcacgaaatgtactgggtttctaatgcctcaggtaacatagtatcaagcgtgaatatgatctcaaggatgcttataaaccgttttaccatgagacataagaaggcaactttcgaaccagatgtcgatcttgggtctggaacaagaaatattggaatagaatctgaaatacctaacttggacataataggaaagagaatagaaaagattaaacaggaatacgaaacgagctggcactatgatcaagaccatccatataaaacttgggcataccatggtagttatgaaactaaacaaacggggtcagccagctcgatggtgaatggcgtagtgcgattacttaccaaaccatgggacgtagtccctatggtaacgcaaatggctatgactgacacaacaccattcgggcaacaacgagttttcaaagagaaagtagacaccagaacacaggaaccaaaggaaggaaccaagaaattaatgaagataaccgcggaatggttatggaaagaacttgggaagaagaaaaccccgagaatgtgtactcgggaagaatttacgcggaaggtaagatctaatgccgcgttaggcgcaatttttacagatgaaaacaagtggaaaagcgccagagaggcagtagaagattcaagattttgggaattagttgacaaagagagaaatttacaccttgaaggaaaatgtgaaacgtgtgtttataatatgatgggaaaaagggagaagaaactaggcgaatttggaaaggcgaagggctcgcgtgccatatggtacatgtggcttggtgcgcgatttttggagttcgaggctttgggttttctaaacgaggaccactggttctccagagaaaatagtcttagtggagttgaaggagaaggcctacataaactaggatacatcttacgggatgtgagcaagaaagaaggaggagccatgtatgcggacgacaccgcaggttgggatacaagaataactctagaagaccttaaaaatgaagagatggtgaccaatcacatggaaggagaacataaaaagctagctgaagcaatctttaaactaacataccaaaacaaggttgtcagggtacaaaggcccacaccaaggggaaccgttatggacataataagccgccgagaccaacggggcagcggacaagtagggacatatggactaaatacctttactaacatggaagcgcaacttatccgacaaatggaaggcgaaggagtcttcaaaaatatacaacatcttactgtaacagaagaaatagcggtacagaactggttggcgagagtcggacgtgaaagactttccaggatggcgatttccggtgatgactgcgtagttaaacctttggatgatcgatttgcatcggccctaactgcccttaatgatatgggaaaagtaagaaaagatattcagcaatgggaaccttcgaggggatggaacgattggactcaagtcccgttttgtagtcatcacttccatgaattaatcatgaaagatggtagagtacttgtagttccatgccggaatcaggatgaattgattggcagagccagaatttctcagggtgcaggatggagcttaagggaaacggcatgtttaggcaaaagttacgcccaaatgtggtcattgatgtatttccatagacgagacctaagattagcagctaacgcaatttgcagtgcagtaccatcacattgggttccaacatcccgtacaacatggtcaatacacgcaaaacacgaatggatgacgacggaagacatgttgactgtttggaatcgtgtatggatacaagaaaatccctggatggaagacaagactccagtcgaatcatgggaagagataccgtatctgggtaaacgagaagatcaatggtgcggatccttaatcggcttaacttccagggcgacatgggcaaagaacatccaaacagccatcaaccaagtgagaagcctgattggaaatgaagagtatactgactatatgcctagcatgaagcgtttcagaagagaagaagaagaagctggtgtattatggtaa

SEQ ID NO: 22205 - RNA, 9876 nt, synthetic construct
  misc_feature 1..9876: note = derived and/or modified CDS sequence (opt6) from DENV-2__KF704358__SS-prME
  source 1..9876: mol_type = other RNA
accgcaggtatgataataatgctgatacctacggtgatggcatttcatctcactacgaggaatggagaaccgcacatgatagtttcgcgtcaagaaaaaggtaaatcactactattcaataccggagacggagttcatatgtgtacacttatggcgatgcacttaggagaattatgcgaggacaccattacatataaatgtccgttattaagacaaaatgagccagaagacattgattgctggtgcaactcgacgtcaacttgggttacttacgggacatgcactacgaccggggaacatagaagagagaaacggtcagttgctctcgttccgcacgttggtatgggtctagaaacgaggaccgagacttggatgtcatctgaaggagcatggaaacatgcgcaaagaatagaaacttggatcctaagacatccaggctttacgataatggctgctatacttgcttatacaataggaacaacgcacttccaaagggcgttaatatttatattgcttacagctgtggctccaagcatgacaatgagatgcattggcatctcaaatagagattttgttgaaggggtgtcaggtggtagttgggttgacatagtacttgagcatggatcatgcgttacgacaatggccaaaaacaaaccaactctggatcttgaattgataaaaacagaggcgaaacagccggcgacattgcgcaaatattgcatagaagcgaaactcaccaatacaacaacggaatctcgttgtcccactcaaggtgagccaagtttgaatgaggagcaagataaacggttcgtatgtaaacatagcatggtagatcgtggatggggcaatggatgcgggctttttggaaaaggatccatagtcacttgcgcaatgttcacttgtaagaaaataatgaaaggaaaagtggttcaaccggaaaacctggaatacacgatagtaataacaccacattcaggggaagaacatgccgttggaaacgatactggcaaacacggtaaagagattaaaataactcctcaatctagtattaccgaagcggaactcacgggttacggaacggtgacgatggagtgtagtccgagaacaggattagactttaacgaaatggtgttactacagatggaagacaaagcatggctagtgcacaggcaatggtttcttgatctaccactaccgtggttaccaggagcagacacacaaggaagcaattggattcaaaaagaaacgttggtaacatttaaaaatccacatgctaagaaacaggacgttgtagttctagggtcacaagagggcgcaatgcatactgccttaaccggcgccaccgaaattcaaatgtcttcgggcaatgtattgtttactggacacctgaaatgcagactacgtatggataaattacaattaaaaggcatgtcttattcaatgtgtacaggaaaatttaaggtagttaaagagatagccgaaactcagcacgggaccattgtaataagagtacagtacgagggtgatggcagcccgtgtaagattccatttgagataatggatttggagaaacgacatgttcttggccgactcataacagtaaacccaatcgttacaggaaaagattcacccgttaatattgaagcagaaccaccatttggagattcatatattataattggagtagaacccggccaactaaaactaaattggttcaagaaaggttcttcgataggacagatgttcgccacaaccatgagaggagcgaaaaggatggcgatattaggagatacagcgtgggattttggctcgctgggaggtgtattcacttcaattggtaaggcgttgcaccaggtattcggagctatatatggcgccgcgtttagcggggtttcatggaccatgaaaatattaactggagtaataattacctggataggtatgaacagtaggagtacatcgttatccgtatcgttagtactcgttggagtggtaacactatatctgggagtgatggtacaggccgatagcggctgtgttgtatcatggaaaaacaaagaattgaaatgtggctctggcatttttataactgataatgtgcacacttggacggagcaatacaaattccaaccagaatctccttcaaagttggcttcagcaatccaaaaagcgcacgaagaaggtatatgtggtattcgttcagtcacaagattggaaaacttaatgtggaagcagataacaccagaactcaaccacatactgtcagaaaacgaagtcaaactaacaattatgacaggagatataaaaggaatcatgcaagcgggtaaaagatcactacgaccacaaccaaccgagcttaaatatagctggaaaacctggggaaaagccaaaatgttaagtacggaatcgcacaatcagacatttttaattgacggcccagagacagccgaatgtccaaacactaacagggcatggaactcattagaggtagaagactatggctttggggtcttcacgacaaatatatggttaaagttaagagagaaacaggacgtattctgtgacagtaaacttatgagcgcggcgatcaaagacaacagagctgtacacgcagatatggggtactggatagaaagtgcattaaatgacacatggaaaatagagaaagcctcattcattgaagtaaaaagctgtcattggccaaaatcccatactctctggtcgaacggggtattagaaagcgaaatgataatacctaaaaattttgcaggacctgtgagtcagcataactatcggcctggatatcatacgcagacagcaggtccgtggcacttaggtaaattagaaatggactttgacttctgcgaaggtacgaccgtggtggtgacagaggattgcggaaatcggggaccctcactcagaacaactacagcatcaggaaagttaataacagaatggtgctgtagatcttgtacccttccgcctctaaggtacagaggagaggatggctgctggtatggaatggaaattcgccccctgaaggaaaaagaggaaaatcttgtcaactccttagtaaccgcaggtcatggtcaaatagataacttttcacttggagtgctaggaatggcgttatttttggaagagatgttaaggacacgagtgggaactaaacatgcaatacttctagtagcggtgagctttgtaacacttataactggaaatatgtcttttagagatcttggtcgtgtgatggtaatggtgggggctacgatgacagatgacataggtatgggggtgacatatttggcgttactagcagcctttaaggttaggcccacttttgccgcgggacttctattacgaaaactcacaagtaaggaacttatgatgactacgataggaattgtactattaagtcaatcaacgatcccggagacgatattggagttaactgatgcgttagctcttggtatgatggttttgaaaatggttcgcaagatggaaaaatatcaactcgccgtaaccattatggcaattctttgcgttccgaacgccgtcattcttcagaacacctggaaagtgagctgtactatattagctgttgtaagcgtcagtccattgtttctaacaagttcgcaacaaaaagcagattggatccctttggcactaacgattaagggattaaatccaacagcaatatttctcacgaccttatctcgcaccaacaagaaaagatcatggcctttgaacgaagctataatggctgtaggtatggtaagtattttagcaagttcgttactaaagaacgacatacctatgactggtccgttggtcgctggcgggttgctcacagtttgttacgttttaacgggcagatctgcagacttagaattagaaagagccgcggatgttaaatgggaagaccaagcggagataagtggatcttcgccaatactgtcaattactatatccgaggatggatctatgtctatcaaaaatgaagaagaggagcaaacactcaccatattgataaggactggattacttgtaataagtgggttatttcccgttagcatacccatcaccgctgcagcctggtacctctgggaagtcaagaaacaaagagcgggtgtattatgggacgtgccgtcaccaccaccagtaggtaaagcggaactcgaagatggagcataccgtatcaagcagaaagggatattaggttactcccaaataggtgctggagtttataaagaaggaacatttcacacaatgtggcacgtcacccgtggcgccgtgctaatgcacaagggaaaaagaatagaacccagctgggcagatgtaaagaaagatctaataagttacggaggtggctggaaactagagggcgaatggaaagaaggcgaagaagtacaagtattagctctggaaccaggcaaaaatcctagggcagtacaaacaaagccaggtttatttaaaacaaacgctggaacaataggggcagttagtctagattttagccctggcacaagcggatcaccaataatagataagaagggtaaagtagtaggattatatggcaatggcgtcgtgacgaggtcgggggcgtatgtttcagcgatagcgcaaacagagaaatcaatcgaagacaaccccgaaatagaagacgatatatttcgtaagcgcaaattaaccataatggacttacatcccggggctggtaagacaaaaagatacttaccggccatagtacgtgaagcaattaaacgtggtctgcggaccttaatattagcgccgacccgagtagtggcagctgagatggaggaagctcttaggggccttccaataagatatcaaaccccagctataagagctgagcacaccggtagggaaattgtagatctaatgtgccatgcgacatttacgatgcgcttactaagtcccgtcagggtaccgaattataatttaataatcatggatgaagcccatttcaccgaccccgcctctatagcagctagaggatacataagtacaagggtagaaatgggagaagctgcaggtatttttatgacagctacgccaccaggctcgagggatccttttccgcaatctaacgcccctataatggacgaagaaagggaaatcccagaacgctcatggagcagtggccatgaatgggtaacggactttaaaggcaaaacagtatggtttgtaccgtcgatacgcgccggaaatgatattgctgcatgcctaagaaagaacggaaagaaagtcatacaattaagccgtaaaacgtttgattccgaatacgtaaaaactcgaacaaatgattgggattttgtcgtaacaactgacataagtgaaatgggagccaactttaaagcggaacgggtaatcgatcctagacgttgtatgaagcccgtaattttaaccgatggtgaggaacgtgttatattggccggacctatgccagtaacacacagttcagccgcacaacggcggggacgtatcggaaggaatcctaaaaatgaaaacgatcaatatatatatatgggggaaccgctcgagaatgatgaagattgtgctcattggaaagaggcgaagatgttactcgataacataaacacacccgaaggtataataccatctatgttcgaacctgaacgggaaaaagtggacgcgattgatggtgaatatcgccttagaggggaagcgagaaagacttttgtagacttaatgagaagaggagatttacctgtttggctagcttatagggtagcagctgaagggataaactacgccgataggcgctggtgttttgatggaattaaaaacaaccaaatattagaagaaaacgtcgaagtagaaatatggactaaagaaggtgaacggaagaaattaaagcccagatggttggatgctagaatatatagcgaccctttagcgttaaaagagtttaaagaatttgcggcaggtagaaagtcattaacattgaatttgattacagaaatgggtcgacttcccacttttatgacccagaaagccagagatgcactagataatctagctgtcttacacactgccgaagccggtggcagagcttacaatcatgccttgtctgaactaccagaaactttggagacattactcctcctaacattgttagcaacggttaccggtggaatattcttgttcttgatgtccgggaggggaataggaaaaatgacactcggtatgtgttgcataattacagcgagcatactattatggtacgcccagatacaaccccattggatcgctgcatcaattattttagaatttttcctaatagtgctattaattccagaacctgaaaaacaacgaacaccccaggataatcagctgacatacgtggtcattgccatactcacggttgttgcagcaaccatggcaaacgaaatgggatttttagagaaaactaagaaggatttgggcttaggctcaataacaacacagcaaccggaatctaatattctggatatagatttaagaccagcttccgcttggacactctatgcagtcgcaacaacgttcgttactccaatgttgaggcattcaattgaaaacagctcagtgaacgtatcattaactgccatagcaaaccaagctaccgtgctgatgggactcggaaaaggatggccattatcaaaaatggacatcggcgtaccgcttttagcaataggatgttatagtcaagtaaatccgattaccttaacggcggctttattcctgctcgtcgcccactatgccattatcggacccggtctacaagcaaaagcaacacgtgaagctcagaaacgagctgcggcaggtataatgaaaaatccaacagttgatggaattaccgttatcgacttagatcccataccttacgatccaaaatttgaaaaacagctagggcaagtcatgctattagttctatgtgtcacacaggtactaatgatgaggactacgtgggcactatgcgaggcgttaactcttgcaacgggtccaatatccacattatgggaaggaaatcctggcaggttttggaacacgacgatcgcggtatccatggcaaatatctttcgaggatcgtacttagctggagccggtctactgttttccataatgaaaaataccacaaacacgcgtagagggacaggtaatatgggagagacacttggtgagaagtggaaatcacgcctaaatgcattagggaagagtgagttccaaatatacaagaaatcgggaatacaggaggttgaccgaaccctagcaaaagagggtattaaaaggggtgaaacagaccatcatgcagtcagccgaggtagcgcaaaactaaggtggttcgtagaaaggaatatggtcacgccagaaggaaaagtggtagatttaggctgtggtcgaggaggctggtcgtattactgtggaggactaaagaatgtacgtgaggtgaaaggactcacaaagggaggaccaggacatgaagaacccatccctatgtcaacttacggatggaatctagtcagactccagtcgggcgtcgatgtattctttacacctccggaaaagtgtgatactctgctgtgtgatataggagaatcatccccgaatcccactgtcgaagcggggagaacattaagagttctcaatttagtcgaaaattggcttaataataatactcaattttgcattaaagtattaaacccatatatgccaagcgtgatagagaaaatggaggctttacaaaggaaatacggcggagcattggtacgtaaccccttatcgagaaacagcacgcacgagatgtattgggtgtcgaatgcaagtggtaatattgtatcttccgtgaacatgatttctagaatgctgattaatcgatttacgatgaggcacaagaaagcaaccttcgaacccgatgtcgatttaggtagcggaacaagaaatattggcatagagtctgagataccgaatttagacattattggtaagagaatagagaaaataaaacaagaatacgaaaccagttggcattatgaccaagaccatccctacaaaacttgggcataccacggttcctatgagacaaaacaaactggtagcgccagtagtatggtaaatggcgtagtaaggctattaacaaaaccgtgggatgtagtcccaatggttacacaaatggcaatgacggacacgacgccgtttggccaacaacgggtattcaaggaaaaagtagatactcgaacgcaagaacccaaagaggggacgaagaaacttatgaaaataacggcggaatggctgtggaaagaattaggtaaaaagaaaaccccaaggatgtgtacccgtgaggagtttacaaggaaagttaggtctaatgccgctttaggtgctatcttcactgatgaaaataagtggaaatctgcaagagaggctgtcgaagattcacgattttgggaattggtagataaagagcgcaatttgcatctagaaggaaaatgcgagacatgtgtttataatatgatgggcaaaagagagaagaaactaggagaatttggaaaagcaaaggggtcccgcgcgatatggtatatgtggctaggcgctagatttttggaatttgaggcacttggatttttgaacgaagaccattggtttagtagagagaatagtctatctggtgttgaaggagaagggttacacaaactagggtatatcttacgagatgtaagcaagaaagagggaggagctatgtacgccgacgacacagcaggttgggatactcgtattacattggaggatcttaaaaatgaagaaatggttactaatcatatggaaggtgaacataagaaattagccgaagcaatcttcaaattaacttaccagaacaaagtcgtccgcgtgcagagacccacgccaagaggcacggtaatggatataattagtaggcgggaccagcgtggtagtggtcaagtaggcacctatgggttaaatacattcacgaacatggaagcacaactaataagacaaatggaaggtgaaggagttttcaaaaatatacagcatttaacagttactgaggaaattgctgtacaaaattggttagcgcgtgtgggacgggagcgactgtcacgtatggctattagcggagatgattgtgtcgttaagcctctagacgacagatttgcaagtgcactcactgctctaaatgatatgggtaaggttagaaaagacatacaacaatgggaaccatcaagaggctggaacgactggacacaagtgccattctgctcacaccactttcacgagctaataatgaaggacggaagagtattagtcgtgccgtgtagaaaccaagacgaactaataggacgtgcaagaataagccaaggtgcgggttggtcactacgggaaactgcctgcctaggaaagtcttatgcacagatgtggtcgctcatgtactttcatagacgagatttacgactagctgcaaacgcaatatgctcagcagtgccatcacactgggttccaacgagcagaaccacgtggtcgatacatgcgaaacatgaatggatgaccacagaagatatgctaacagtctggaatcgcgtatggatacaagaaaatccgtggatggaggataaaactccagtcgaatcatgggaagaaatcccctacttaggtaaacgcgaagatcaatggtgtggtagtttgatcggacttacaagtagggcgacatgggccaaaaatatacaaactgcgataaatcaagtgagatctttaatcggcaatgaagaatatactgactatatgccctcaatgaagcgctttaggcgagaagaagaagaagcaggagtactctggtag

SEQ ID NO: 22206 - RNA, 9876 nt, synthetic construct
  misc_feature 1..9876: note = derived and/or modified CDS sequence (opt6) from DENV-2__KF041232__SS-prME
  source 1..9876: mol_type = other RNA
acagctggtgtgataattatgctcatccctacggcaatggcatttcacttaacaacgcgcaatggagaaccgcatatgatcgtatcaaaacaagaaaaagggaaaagtcttcttttcaaaactgaagatggggtcaatatgtgtacactgatggcaatggatcttggggaattatgtgaagacacaataacatataattgtccattacttcgacaaaacgaaccagaagatatagattgttggtgtaatgcaactagcacctgggtaacctatgggacatgtaccgcaaccggagaacatcgacgagagaaaagatccgtagcattagtcccacacgtaggaatgggtcttgaaacgagaacagaaacttggatgagcagcgaaggggcatggaaacacgcacagagaatagaaacatggatattgcgacaccccgggtttactataatggcggctattctcgcttatacaattggaactacgtactttcaacgggtactaattttcatcctacttaccgctgtggcaccgagtatgaccatgcggtgtataggaattagcaatcgagattttgtcgagggggtgagtggaggttcgtgggtcgacattgtattagaacacggaagctgtgttaccacgatggccaaaaataaaccaaccctcgactttgaattaattaaaacggaagccaaacagccagccacccttcgcaaatattgcatcgaagccaaacttaccaatacaacgacagcgagtaggtgcccaactcagggggaaccaagccttaatgaggagcaagataaacgttttgtctgtaaacatagcatggtcgatcgaggatgggggaacggatgtggactatttggtaaagggggaatagtcacttgtgcaatgtttacatgcaagaaaaacatggaaggaaaaatagtacaaccagaaaacctagaatacaccatagtagtgacgccacactcaggggaagaaaatgctgtcgggaatgacacaggaaaacacggaaaggaaataaaagttacgccccaatcctcaataactgaagctgagctaacgggttatggtactgtaactatggaatgcagcccacggacaggattggatttcaatgaaatggtactgctgcaaatggagaacaaagcgtggttagtacacagacaatggtttttagacctacccttaccctggctacccggagcagacatacaaggcagtaactggattcaaaaagaaactctagtaacattcaaaaatcctcacgccaagaaacaagatgtagtagtcctaggatctcaagaaggagcaatgcatacagctcttacgggggcgactgaaatacaaatgtcatcaggaaaccttcttttcactggccatttaaaatgtcgacttagaatggacaagctgcaattaaaagggatgtcttattcaatgtgtactggtaagttcaaggtagtgaaagaaattgcggagacccaacatgggacaatagtggtcagagtacaatacgaaggtgatggatccccttgtaaaataccttttgagataatggatttagagaaacgccacgtgttaggtcgactaataaccgtcaatcctatcgtaactgaaaaagactcgcccgttaatattgaggccgaaccaccgtttggtgatagttatattattataggggttgaacctgggcaactgaaactttcctggtttaagaaaggatcgagcatcgggcaaatgtttgaaaccactatgaggggcgcaaaacgcatggctatcttaggagacaccgcatgggacttcggcagcctaggaggggtatttacctcaataggcaaagcacttcaccaggttttcggtgccatctacggagctgccttttctggggtttcatggacaatgaaaatcctcattggcgtagtcatcacatggatcggaatgaactctagatccacctcgttatccgttagtctcgtgctggttggagtcgtcactttatatctgggagcaatggtccaagcagattctggatgtgttgtatcatggaaaaataaagaactcaagtgcgggtcagggatattcataacagacaatgtccatacatggactgagcaatacaaatttcaacctgagtctccgagtaagctagcatcagcaattcaaaaagcacatgaagaggggatatgtggaattagaagcgtaactagattagagaatttaatgtggaaacagataactcctgagcttaatcacatattgtccgaaaatgaagtaaagctatcaattatgactggtgatataaaaggcattatgcaagcaggtaaacgatctttaaggccgcaaccaacagaattaaaatactcttggaagacgtggggaaaagcaaaaatgctctccacggaaccgcacaatcaaacattcctaattgacgggccagaaacggctgaatgcccaaataccaatagagcttggaactcgcttgaagtagaagattacgggtttggggtattcactactaatatatggttgaagttaaaggaaagacaagatgtattttgtgatagtaagttaatgtccgctgctatcaaagataaccgggcagtccatgctgacatgggatattggatagaatccgctcttaacgatacatggaaaattgaaaaggcttcgttcattgaagtcaagtcatgccattggccaaagagtcatactttatggagcaacggtgttctggaatcagagatgattattcctaaaaattttgcgggtccagttagccaacataattaccgtccgggatatcacacacagacagctgggccatggcatttaggaaaactggagatggactttgatttttgtgaagggactacagttgtggtaactgaagattgcggtaacagggggccttctttgcggacgactacagcctcaggaaaacttataacggaatggtgctgccgtagctgtacattaccacctctcagatatcgtggtgaagatggttgctggtacggtatggagataaggccattgaaagaaaaagaagaaaatttagtgaatagccttgtaacagcgggacatggacaaatagataattttagccttggtgttttagggatggcgctatttttagaggaaatgctacgtactcgggtaggaacgaaacatgcagtattattggttgcagttagctttatgacgctcataactggcaacatgtcatttcgggatttgggacgggtcatggtaatggtaggggcagctatgactgatgacataggtatgggggtgacgtacctggctctgttagcagcatttaaagtacgacctacatttgcagcagggttacttttaagaaaacttacgagtaaggaacttatgatgactaccatagggatcgtattacttagccaatccacaactccggagacaatactggaactaactgacgccttagctctagggatgatgatactgaaaattgttagaaatatggaaaaataccagctcgcagtaacaataatggctatactgtgcgttccaaatgctgtgatcctacaaaatgcttggaaggtaagctgtactattttggcagcagtgagtgtatcacctctattacttacctcatctcaacaaaaagcagattggattccgcttgcgttaacaatcaaaggtttaaatcccaccgccatcttcttaacaacattaagtcgtacaaacaagaaaagatcctggccactcaatgaggctataatggcagttggaatggtatcaatattagcatcaagtttattaaagaatgatatacccatgacaggacctttagtagcaggagggttactaacagtctgttatgttctaactggacgctccgcagatttagaattagaaagagcagcggacgtacgctgggaagatcaggcagaaatcagtgggtcgtcaccgatccttagcattacgataagcgaggatggtagcatgtctatcaaaaatgaggaagaagaacagactttgacaatactaatacgaacgggtctacttgtaatatcaggcctttttccagtttccatcccgataacagccgcggcatggtacttgtgggaggttaaaaagcaacgggctggagttctatgggacgtcccaagtccacccccggtagggaaagctgagctcgaagacggtgcatatcggattaaacaaaaaggaatactgggatactcacaaattggagcaggagtatataaagagggcacgtttcacactatgtggcatgtaacacgaggagccgtattaatgcacaaaggaaaaagaatagaaccgtcctgggctgacgttcgaaaagatttaatttcctatgggggcggttggaaattagaaggcgaatggaaagagggcgaggaagtgcaggttctagctcttgaacctggcaaaaatcctagagctgttcaaacaaagcccgggttgtttaaaacaaacacaggaacgatcggcgctgtgagcttagacttcagtccaggaacaagtggaagtcccattgtagacaagaaaggaaaagtagtaggtctatatgggaatggggtagtgacaagatcgggtacttatgtatctgccatagcacaaacagagaaaagcatcgaagataatcctgaaatagaagatgatatttttcgaaagaaacggctcacaataatggatctacacccaggagccggaaaaaccaaacgttacctgcctgctattgtgagagaggcgataaaaagaggtctcagaactctaatcctcgcaccaacgagagtagtagctgctgaaatggaagaagctcttagaggactcccaataagataccagactccggccatccgcgctgagcataccggacgtgaaatagtagacctgatgtgccacgcaacatttacaatgagactactatcaccagttagagtacctaactataatttaattataatggatgaagcacattttactgaccctgcgtctatagcggctagaggctatatttcgacacgagtggaaatgggagaagctgctggtatattcatgacggcaacaccgcccggcagtagggatccatttccacaatccaatgcaccaataatggatgaggaaagggagatccccgaacgttcctggaactctggacatgaatgggtcactgactttaaaggtaaaactgtatggttcgtaccttctataaaggctggaaatgatattgcagcgtgtctgaggaaaaatggaaagaaagtaatacaactgagccggaaaacattcgactccgaatatataaaaacgaggacaaatgattgggacttcgttgtaacaacagatattagtgaaatgggggctaattttaaagcagaaagagttattgatccacgaagatgcatgaaacctgtgattctaacagatggagaagaaagggtcattttagcaggaccgatgccagtcacccactcctcagccgctcaacgacgtggaagaatcggacgtaaccctaaaaatgaaaatgatcagtacatttatatgggagaaccactagaaaatgacgaagattgtgctcattggaaggaagccaaaatgttattagacaacatcaataccccagaaggcattatcccatctatgtttgaaccagaaagggagaaagtggacgcaatagatggagaataccgattgcgtggtgaggctcggaaaacgttcgtagacttgatgaggagaggggatctcccggtttggttagcttatagagttgcggcagaaggcattaactacgctgacagaaggtggtgttttgatggaatcaaaaacaatcaaatacttgaagaaaatgtagaggtagagatatggactaaggagggggaacgtaagaaactaaaaccgcgttggttggatgcgagaatttattcagatcctttagcattaaaggaatttaaagagtttgctgccggaagaaagagcttgacgttaaatctaatcacggaaatgggcagattacccacctttatgactcagaaagctcgaaatgcactcgataaccttgcggtactgcacacggccgaagctggtggcagagcttataaccacgctttaagcgaattgccggaaactttagaaaccctcttacttctaacacttttagctaccgtgactggtggaatttttctctttctaatgtctggcaaaggaataggcaagatgactttagggatgtgctgtatcatcacggcctcaatattactgtggtacgcacaaatacaaccacactggatagccgcaagtattatacttgagttcttcctcatcgtcctactcataccagaaccagaaaaacagagaacacctcaagacaaccagctaacttacgtagtcatagcaatcttaaccgtagtagcggccaccatggcgaatgagatggggttcttagagaaaactaagaaagacttcggcttaggctctatagccacacaacagcccgaaagtaacatactcgacatagacttaaggccagcgtcagcatggacactttacgctgtagcaacaacatttattactcctatgctacggcattcgatagaaaactcaagtgttaacgtcagcttaacagccatagcgaaccaagcaaccgtattaatgggtttaggcaaggggtggccgttgtccaaaatggatattggcgttccattgctagcgataggctgttattcacaagtgaatcctatcacattaacggcagcgctgttgctcttagtagcgcattatgcaattattggtcctggtctacaagctaaagcaacgcgagaagcgcaaaaacgtgcggcagctggaataatgaaaaatccaacagtagatggtattacagtgatagatttggatccaataccttatgacccaaaattcgaaaagcaattgggtcaagttatgctattagttttgtgtgtaacccaagtcctcatgatgcgtacgacctgggcactatgcgaagcgcttaccctcgcgacaggtcccatatcaaccctttgggaaggcaacccaggtcggttttggaacacaactattgcagttagcatggcaaatatattccgcgggtcgtatcttgccggagccggccttctattctcgataatgaagaacaccacaaacactagacgaggtacgggaaacactggcgaaactcttggagaaaagtggaaaaataggttaaatagtttaggtaagtcagaatttcaaatctacaaaaggagtggcattcaagaggtagaccgtacgctagccaaagagggcataaaaagaggagaaactgaccatcatgcagtgagtagaggatctgcgaaattacgctggtttgttgaacgaaatttagttaccccagaagggaaagttgtagacttaggctgtggaagaggtggatggtcttattactgtgggggtttaaagaatgtaagggaagtaaaaggattgactaagggtgggccaggacatgaagaaccaataccaatgtctacgtatggatggaacctagtaagattgcaatcaggtgtcgatgtattctttacaccaccagagaaatgtgacaccttgctgtgtgacataggagaaagctcccctaaccccactgtagaagctggaagaacgctaagagtattaaatttagtagaaaattggttgaataataacacgcagttttgcataaaggttttgaatccatacatgccatcagttatagaaaagatggagacactacaaagaaaatatggaggagcgttggtaagaaatccattaagcagaaacagcacacatgagatgtactgggttagcaacgccagtggcaacatagtatctagcgtcaacatgatatcgcgtatgttaataaatagatttacaatgagacataagaaagcaacctacgaacccgatgtggatcttggtagtggtactcgaaacatcggaatagaatcggaaactccaaacctcgacattataggaaaaagaatagagaaaataaaacaagaacatgaaacaagctggcattatgaccaagaccatccatataagacatgggcttatcatggcagctacgaaacaaaacaaacaggcagtgcgagtagcatggtcaatggggttgtaagacttttgacaaagccctgggacgttatcccaatggtcactcaaatggcgatgaccgataccacgccctttgggcagcaaagagtttttaaggaaaaggtggacacaagaactcaagaacctaaagaaggcacgaagaaattaatgaaaataactgcagaatggctttggaaagaacttgggaagaagaaaacaccgagaatgtgtaccagagaagaatttgcgcgaaaagtccgatcaaacgctgccctgggagcaatatttaccgatgagaataaatggaagtccgcaagggaagcagtagaggattctagattttgggagctagttgataaggagagaaacttgcacttggagggtaagtgcgaaacgtgtgtttataatatgatgggaaagagagagaagaaaataggagaatttgggaaagcaaaaggaagcagagcgatatggtacatgtggctaggggccaggttcctcgagttcgaggcattaggtttcttaaatgaagaccattggttttcaagagagaacagcttaagtggtgttgaaggtgaaggtctacacaaactaggatacatcttgagagaagtctccaagaaagaaggtggagcgatgtatgcagacgatacggcaggatgggatacaaggatcacattagaagacctcaaaaatgaagaaatggttactaatcatatggaaggagaacacaagaaattagcagaagcaatcttcaaactaacataccaaaacaaagttgtaagggtgcaacgtccgacaccccgtggaacagtaatggatataatatcaagacgcgaccagcgaggttctggacaggttggtacatacgggttgaacacattcacgaatatgggcgcacaattaatacgacaaatggaaggtgaaggtgtgttcaagggtatacagcacctgaccgcgaccgaagaagtcgcagtgcaagattggcttgctagggtagggagggaaagactttcaagaatggcgataagtggagatgattgcgtagtaaaacccttagacgaccgatttgctaacgctttgactgcccttaatgacatgggaaaagtcagaaaagatatacaacaatgggaaccctcgagaggatggaatgattggacacaagttcctttctgctcacaccattttcacgaacttataatgaaagatgggcgtgttttagttgtaccttgtcgcaatcaagacgaacttattgggcgcgctaggataagccaaggggcaggctggagtcttagggaaactgcatgtttgggtaaatcttacgcacagatgtggtcactaatgtatttccatcgacgagatctcagactggcggcaaatgctatttgctctgcagttccatctcattgggttcctacgtcgaggactacatggtcaatacatgctagacatgagtggatgactacggaagatatgttgactgtttggaatagagtgtggatacaagaaaatccatggatggaagacaaaactcccgtcgaaagttgggaagaaattccataccttggaaaaagagaagatcaatggtgtggatctttaattggcctgactagcagagcaacatgggcgcgaaacattcaaactgcaatcaatcaagtacggtcattgataggaagtgaagaatacacagactatatgccgtccatgaagcgattccgaagagaagaagaggaggcaggcgttctatggtaa

SEQ ID NO: 22207 - RNA, 9876 nt, synthetic construct
  misc_feature 1..9876: note = derived and/or modified CDS sequence (opt6) from DENV-2__KF041233__SS-prME
  source 1..9876: mol_type = other RNA
accgcaggagttataattatgttgataccaaccgctatggcatttcacctcaccaccagaaacggagagcctcacatgatcgtatcaaaacaagagaaaggaaaatccctcctcttcaagaccgaagatggtgtcaacatgtgtacactcatggcgatggacctcggcgaactatgcgaagatacaataacttataactgtcctttattacgacaaaatgaacctgaagatattgattgttggtgtaactccaccagtacatgggtgacgtatgggacttgtaccgccacgggagagcatcgaagagagaagaggtccgtagcattagtgccccatgttggtatgggattagaaacaagaacagaaacatggatgagttcagagggggcatggaaacacgcacagagaatcgaaacatggatattaagacacccaggtttcacgataatggctgccatattagcctatactatcggaacaacatattttcaaagagtattaatattcatactattaacagccgtggcaccaagtatgaccatgcgatgtattggtatttccaacagggacttcgtggaaggggttagcggagggtcatgggtagacattgttttagagcacggatcatgtgttactacaatggctaagaataaaccgacgctagattttgaactaattaaaacggaagccaaacagcctgcaacactccgtaaatattgcatagaagcaaaattaacaaatacaacaaccgcaagtaggtgccctactcaaggtgaaccgagtcttaatgaagaacaagataagagattcgtatgtaaacactccatggttgatcggggatggggcaatggatgtggcttatttgggaaagggggtattgtcacttgtgctatgtttacttgtaagaaaaatatggagggaaaaatagtacaaccagagaatctagaatatactattgtggtgacacctcacagtggagaagaaaatgcagtcgggaacgatacaggcaaacacggcaaggaaatcaaggtcacgccccaatcgtcaattaccgaggcggaactcacaggatatgggactgttactatggaatgttccccccgcacagggctagatttcaacgaaatggtactcttacaaatggaaaataaggcgtggctagttcacagacaatggtttctagatctaccactaccatggttgcctggtgcagacattcaaggttcaaattggatacaaaaagagacgctagtaaccttcaaaaatccgcacgcaaaaaagcaggatgtcgtagtattaggatctcaagagggagctatgcatacagcattaacaggagcgacagagattcaaatgagctccggtaatttactgtttacaggccaccttaaatgtcgactacgaatggataaattacaactgaaaggtatgtcatacagcatgtgtacaggcaaatttaaagtcgtaaaagaaattgcagaaacacagcatggaacaatcgtcgttcgggtacaatacgaaggcgacggttcaccatgcaaaataccatttgaaattatggatctagaaaaaaggcatgtgttgggacgattaataacggtcaaccccatagtaacagagaaagactccccagtaaatatagaagctgaaccaccgtttggggactcctatataataattggagtagaacctggacaactaaaactctcatggtttaagaagggatcctcaattggtcaaatgttcgagaccactatgaggggcgcaaaacggatggcgatattaggcgatacagcatgggatttcggaagtctaggtggagtattcaccagcatcgggaaggccctgcaccaagtttttggggcgatttatggcgcggcttttagtggagttagctggaccatgaagattctaataggcgttgtaataacatggataggaatgaattcaaggtccactagtttgagtgtaagcttagtattagtaggagtagttacactatatcttggagtcatggttcaggcagattcgggctgcgtcgtgtcatggaagaacaaagaattaaaatgcggttctgggattttcatcacagacaacgtacacacctggacggaacaatataaatttcagccagagtcaccatcaaagcttgctgctgcaatccaaaaagcacatgaagaaggaatatgcggcataagatccgtaactagactcgaaaatttaatgtggaaacaaataaccccagaattgaaccacatcttaagcgaaaacgaggttaagctcagcattatgaccggggacattaaaggaataatgcaagcgggcaaaaggagtcttcgaccacaaccaactgaattgaaatattcctggaaaacttggggaaaagctaaaatgttatctacagaaccccacaaccaaaccttcctaatagacggtccggagacggccgaatgtcccaatacaaaccgagcttggaattcattagaagttgaagactacggattcggcgtttttactactaatatatggttaaaattaaaagaaaggcaggacgtcttctgcgacagtaaactcatgtcagccgctataaaagacaatagggcagttcatgcagatatgggttattggatagagagtgcattaaatgacacatggaaaatagaaaaggcaagcttcatcgaggtaaaatcctgtcattggccaaagagtcatacactttggtcaaatggagtccttgagagtgagatgataattccaaagaactttgccggcccagtctcgcaacataactatcgacctggatatcatacccaaaccgccggtccttggcatcttggtaaacttgaaatggactttgacttttgtgaaggcactacggtggtagttactgaagactgtggtaaccgtggaccaagtttaagaaccactactgcaagcgggaagctaataacagagtggtgttgtcgttcatgcaccctcccaccccttcgataccgaggagaagatggatgttggtatggtatggaaataaggccactaaaagaaaaagaagagaatttagtgaacagtctcgtaacagcaggacacggacaaatagacaatttcagtctaggtgtcttaggtatggcattattccttgaagaaatgctgagaactagagtaggaactaaacatgcagttttgttaatcgctgtatcctttatgactcttataactggaaacatgtcttttagagatttaggacgggtaatggtcatggtaggagccgcgatgactgatgatataggaatgggtgtcacatatctagcattattagcagcgtttaaggtaagacccacctttgctgctggattattactaaggaagctgacttcaaaagaactaatgatgactactattggcatagtcctattatctcaatcaactacacctgaaacaattttagagctcactgacgctctggcacttgggatgatgattctcaaaatagtcagaaacatggaaaaatatcaactagcagttacaataatggcaattctatgtgtaccaaacgcagtgattttacaaaacgcttggaaagtaagctgtacaatcttagctgcagtctcagtttcccctttattattaacttccagtcaacaaaaagcggactggattcccctagcgttaacaatcaagggcttaaatcctactgcaatctttctgactacattatcacgtactaacaagaagcgcagttggccactcaatgaggctataatggcagtcggcatggtcagtatactggccagctctctattaaaaaacgatattcctatgacaggccccctagttgcgggaggccttttaacagtatgctatgtcttgacaggcagaagcgcagatttagaactcgaaagagcagcagatgtccgctgggaagaccaagccgaaattagtggttcgtcaccaattttatcaattacgattagcgaagacggatcaatgtctattaaaaatgaggaagaagaacaaacactaacaattttaattcgaacgggtttactagtgataagtggcttatttccagtgtcaatccctataacagcggcagcatggtacttatgggaagtaaaaaaacaaagagctggagttttgtgggacgtacccagtcctccacctgtgggaaaagcagagttagaggacggagcttaccgaataaaacagaaaggtatacttggttattcgcaaattggggcgggtgtgtacaaagaaggtacttttcacacgatgtggcacgttacacggggagcagtactaatgcacaagggcaaaagaatagaaccatcttgggcggatgtaagaaaagaccttatttcttatggtggtggatggaagttagaaggtgagtggaaggaaggtgaagaggtacaagtactcgcactggagccaggtaaaaatcccagagccgtacagactaaaccggggcttttcaagactaatacgggaaccatcggcgctgtatccttagatttcagcccaggtacaagtgggagtccaattgtcgacaaaaaaggtaaagtagtcggattatacggcaatggggtagttacaagatctggcacctatgtctcagcaattgcgcaaactgagaaatctattgaagacaatcccgaaattgaggatgatatatttaggaaaaaaaaactcacaataatggatttacatcctggcgcaggaaaaacgaagagatatcttcctgctatcgtaagagaagctattaagcgaggattgcgtactcttatattagcaccaactagggtagtggcagccgagatggaagaagccttacgcgggctgccaatcagatatcaaaccccggccataagggcagagcatacggggagagagatagtagacctcatgtgtcacgccactttcaccatgagactattatcaccggtccgtgtacctaactataacctaatcattatggacgaagcacacttcacggacccagcaagtatagcggctagaggatatatttctacaagagttgaaatgggcgaagcagcagggatttttatgacagcgacccctcctggctcaagagatccgttcccccaaagcaacgcaccaataatggatgaggagcgcgaaataccagaacgttcttggaatagtggccatgaatgggtaactgattttaaaggtaaaacagtatggttcgtgccctcgataaaagcaggtaacgatatagccgcctgtctccgaaagaatggaaaaaaggtaattcagttaagtcgaaaaacattcgacagcgagtacatcaaaactagaaccaatgattgggacttcgtggtaacaacagacattagtgagatgggtgcaaactttaaagcagaaagagtaattgatccccgtagatgtatgaaacccgtaatcttaaccgatggtgaagaaagagtcatattggctggtccgatgcctgtaacgcacagtagtgcggcacaacgccgaggtagaataggtagaaatccaaaaaacgagaacgatcagtatatatacatgggcgagccgcttgaaaatgatgaagactgcgcacactggaaggaggctaaaatgttgctagataacataaatacgccagaaggaataataccgagcatgttcgaacctgagagagaaaaagtagacgcaatagatggtgaatataggttgagaggcgaagctcgcaaaacctttgtagatctcatgagacgtggtgatttacctgtatggctagcatatagggtcgctgcagagggcataaactatgcagatcgacggtggtgtttcgatggtataaagaataaccaaattttggaagagaacgttgaggttgagatctggaccaaagaaggcgaaaggaagaagttaaaaccacgctggctagacgcaaggatatactccgaccctcttgctctaaaagaatttaaagagtttgcagcagggcgaaaatcactgactttgaatttaataacagaaatgggcagattaccgacatttatgacacaaaaagccagaaatgctcttgacaatctagcggtactacacacagcagaggccgggggaagagcttacaatcatgcgttgtcagaactaccagaaactctggagacccttctactgttaacacttctagctacagtaaccggggggatatttttatttcttatgagtggaaaaggtatcggaaaaatgaccctgggcatgtgttgcataataaccgccagtattctactctggtatgcacaaatacaacctcactggatagccgcaagcataatcctagaattttttctaatagttcttcttatacccgaaccggaaaaacaacggacacctcaagataatcaactaacatacgtggtaattgcaattttaacagtagtcgcagctacgatggccaacgaaatgggattcctagaaaagactaagaaagattttggattagggtcaatagcaacacaacaacccgaatcaaacattttagacatcgacctccgtccggcatcagcttggacattatatgctgtagcaactacatttataacgcctatgctacgacatagcatcgaaaactcaagtgtaaatgtttcgttgacagcaattgccaaccaagccaccgtactgatgggattgggaaaaggctggccattaagcaaaatggatataggagttccccttttagcaattggttgttacagtcaagttaatccaatcactcttacagcagccctactactcctggtcgcacattatgccattataggaccaggtctgcaggcaaaagcaactcgcgaggcccagaaaagagcagctgcgggtatcatgaaaaatccgactgtagatggcattacagtgatagatttggacccaataccttacgatcctaaatttgagaaacaattaggtcaggtgatgttattggtactatgtgtcacacaagttctaatgatgagaaccacatgggctttatgcgaagcgctaaccctagctacgggacccatttcgacgctctgggaaggaaatccagggagattttggaatacaactattgcagtgtctatggcaaatatatttagaggaagttatctagcaggcgcaggactattattttcaatcatgaaaaacacaacaaatacgagacgaggaaccggaaatacaggcgaaacgcttggggaaaaatggaagaatagattaaacagcctcggaaaatcggaatttcaaatctataagcgctctgggatacaagaagtagatcgtactctggcaaaagaaggaataaagaggggcgagaccgatcatcatgcggtatcgcgaggctcggctaaattgcgatggtttgtagagcgaaatttagtcactccagaaggaaaagtcgtagacctcggatgtggaagaggcgggtggagttattactgtggaggtctaaaaaacgtacgagaggtaaaaggccttaccaaaggcgggccaggtcatgaagagccgatacccatgagcacttatggttggaacttagtaagattgcaatcaggggtcgatgtattttttactccccctgaaaagtgtgacacattattatgtgatataggagagtcaagtcctaatcccaccgtagaggcaggtcgcactctgagagtacttaatctggttgaaaattggttgaataacaatacacaattttgtataaaggtattaaatccatatatgccaagtgttatagaaaaaatggaaactctacagcgaaaatacggaggtgcactggtaagaaatccgttgtcacgtaactctacacacgaaatgtattgggtttcaaacgcttctggaaacatagtaagcagtgtcaacatgataagtcggatgctcataaaccgtttcacaatgcggcacaaaaaggcgacatatgaacctgacgtggacttaggtagcggtacgagaaatatcggcatcgaaagcgagacacctaacctagacatcatcggcaagcgcatagaaaagataaaacaagagcacgaaacgagttggcattatgatcaagatcatccatataagacctgggcatatcacgggagctatgaaacaaagcagactggtagcgcatcatccatggtaaatggtgttgtacgacttttaaccaaaccatgggatgtcatcccgatggtaactcagatggctatgacagacactacacccttcggtcagcaaagagtattcaaggaaaaagtagacactaggactcaggaaccaaaagaaggtacaaaaaagctcatgaagattaccgccgaatggctttggaaagaattgggtaaaaagaaaacgccgagaatgtgtacacgcgaagaattcgctcgaaaagtacgtagtaatgcagcattaggagcaattttcaccgatgaaaataaatggaaatctgcgagagaggccgtagaggactcaagattttgggaattagttgataaagagcgcaacttacatttagaaggaaaatgtgaaacatgtgtctacaacatgatgggaaagagagaaaaaaaaataggagagtttggaaaagcaaaaggtagtagagccatctggtatatgtggttgggagcccgttttctagaatttgaagcattaggattcttaaatgaagatcattggttttcaagagaaaactcattgagtggtgtggaaggcgaaggtctccacaagctaggatacatattacgggaggtgagtaagaaagaaggaggagctatgtacgcagacgataccgcgggatgggacacacgcataactctagaagacctcaaaaacgaggaaatggtaaccaaccatatggaaggagaacacaaaaagttagcggaagcgattttcaaacttacataccaaaataaagtagtaagagtccaacgaccaacaccaagaggtactgtcatggatatcatatcacgtcgtgaccagaggggatccggacaagtaggaacgtacggattgaatacatttactaacatgggcgctcaactcatacgacaaatggaaggcgaaggagttttcaaaggcatacaacatttaactgcaactgaagaagtggcggttcaggattggctagctcgagttggaagggaacgactatcaagaatggctataagcggtgacgactgtgtggtaaaacccttggatgatagatttgcaagtgcattaacagcgttaaacgacatgggaaaagtgagaaaagacattcaacagtgggaaccttcacgaggttggaacgactggacacaagtaccgttttgttcacaccattttcatgaactaattatgaaagacggaagagtattagtagttccatgtagaaatcaagacgagttaataggaagggcacgaatctcccagggcgctggttggagtttacgtgagacagcgtgtttaggaaaaagttatgctcaaatgtggtcgttaatgtactttcaccgaagggatttaagactcgcagccaacgcaatttgttcggcagttccttctcactgggttcccacctcgagaacgacatggagtatccatgcccggcacgaatggatgaccactgaggacatgttaactgtctggaatagagtatggattcaagaaaatccgtggatggaggataaaacattggtagaatcatgggaagaaattccctacctgggaaagcgggaagaccaatggtgcggttcgctaattgggctaacctcacgcgccacttgggcaaggaatatacaaactgcaataaatcaagtccggagcctaataggttccgaagaatatactgactatatgccctcaatgaaaaggtttagaagagaagaggaagaagcgggtgttctctggtag

SEQ ID NO: 22208 - RNA, 9876 nt, synthetic construct
  misc_feature 1..9876: note = derived and/or modified CDS sequence (opt6) from DENV-2__KF041234__SS-prME
  source 1..9876: mol_type = other RNA
actgcaggagtaattataatgctgattccaacagcaatggcatttcacctcacaacacgtaacggggaaccccatatgattgtgtctaaacaagaaaaaggaaaatcattattatttaaaacagaagacggagtaaacatgtgcacgctcatggcgatggacttaggagaactttgtgaagatacaataacctataactgtcctttgttaagacagaacgagccagaagacattgattgttggtgcaatgcaacgtctacatgggtaacatatggtacgtgcacggcaacaggtgaacatagaagggagaaaagatcagtggccctagtaccacacgtagggatgggattagagactagaaccgaaacttggatgtcttctgagggggcatggaaacatgcacagcggattgagacatggattttacgtcacccaggatttacaataatggctgcaatcctagcctataccattggtactacttattttcaaagggttttgatctttatccttctaactgcggtagcgccttcaatgaccatgcgttgtataggaattagtaatcgagattttgtagagggagtaagtggtgggagctgggtagatatagtattagagcatggctcttgcgtaacgacgatggccaaaaataaaccaacacttgacttcgaactaattaaaacggaagcaaaacagccagctacattaagaaaatattgtattgaggctaaattaacgaacacaacgacagcttcaagatgtcctactcagggggaacctagccttaacgaagaacaggataaaagattcgtttgtaaacattctatggttgaccggggatggggcaatggatgtggactatttggcaaagggggaatagttacgtgtgcgatgttcacatgtaagaaaaatatggaaggaaaaatcgttcagccagaaaatttggaatataccattgttgtgacacctcattctggtgaagaaaacgccgtagggaacgacactggtaaacacggaaaagagattaaagtaacaccgcaatcgagtatcacagaggctgaacttaccggttatggcacagttacaatggaatgtagtcctaggaccggtctagactttaacgaaatggtccttcttcaaatggaaaataaagcgtggctagtacacagacagtggttcttagaccttccgttgccctggttaccgggagcagatattcagggaagtaattggatacaaaaagagacattagtaacttttaaaaacccacacgctaagaaacaagatgttgtcgtactaggcagccaagaaggagcaatgcatactgcactcacaggcgccacagagatacaaatgtcgtcagggaatttgttatttacgggtcacttaaaatgtcgactcagaatggacaaattacaactaaaaggcatgagttattctatgtgcacgggaaaatttaaagtgatcaaagaaatagctgaaacacagcacgggacaatagtggtgagagtacagtatgaaggcgatggctcaccttgtaagatacctttcgaaataatggacttagaaaaacgtcatgtattaggaagattaattacagtcaatccaatagtgaccgaaaaggatagtcccgtaaacattgaagcagaacccccttttggtgactcatatattataatcggtgttgaacctggccagttaaagttatcatggtttaagaaagggtcttcgatcggtcaaatgtttgaaacaacaatgcgcggtgcaaaacgtatggccatactgggcgatacggcttgggacttcggttcgctgggaggagtattcacaagcatagggaaagcgttacatcaggtgtttggcgcaatatatggcgctgcattttctggagtatcttggacgatgaaaatattaattggcgtggttattacatggataggcatgaactctcgaagcacatctttatcagtgtcgttggtcttagtaggggtagttactctatatttgggcgtcatggtccaagcagatagtggatgcgtagttagttggaagaataaagaactaaaatgtggtagcggaatcttcataaccgataatgtgcacacttggacggagcaatacaaatttcaacccgaatcacccagcaaactagcaagcgcaatccaaaaagcgcacgaagaaggaatctgtggaatacgaagtgtaacacgcctggaaaatttaatgtggaaacagattacacctgaattaaaccatatacttagcgaaaatgaggtgaaattgtctatcatgacgggtgacataaaaggaataatgcaagcgggcaaacgttcactaagacctcagccaacagagctaaaatacagttggaaaacatggggcaaagctaagatgttgtccaccgagcctcataatcagacatttctaatagatggtccagaaacagcagaatgtccaaatactaatagagcttggaacagtttagaagttgaagactatggcttcggagtgttcaccacaaatatctggttaaaactaaaagaacgccaggacgtattctgcgattcaaagctcatgtcggcagcaataaaagacaaccgagcagtacatgctgatatgggatattggatagaatctgcactgaacgatacctggaaaatagaaaaggcatccttcattgaggtaaaatcctgtcactggccaaaatcccatacattgtggtcaaatggtgtcctagaatctgaaatgataatcccgaaaaattttgccggaccggtatctcagcataattatcgaccaggatatcacactcaaactgctggtccctggcacctgggaaagctggaaatggatttcgacttctgtgaaggcacaactgttgtagtgacagaagactgtggaaatcgaggcccttccctaaggactacgaccgcttcggggaaattaattaccgagtggtgttgtcgatcgtgtacactgcctccgctacgataccgtggtgaggacggatgctggtacggtatggagataagacctctaaaggaaaaggaagagaatttagttaacagtttagtgacagctggtcacggccagatcgacaatttctccctaggggtattgggaatggccctcttcttagaagagatgttaagaacgagagtaggcactaaacacgcagtactgttagtagcagtcagttttatgacactaataactgggaatatgagcttccgtgatctaggaagagtaatggttatggtaggagcagctatgacggatgacataggaatgggagttacatacctagcactattagctgcgtttaaagtgagaccgacatttgcagcaggacttttgttacgaaaattgacatctaaagaactgatgatgacgactataggtattgttcttttgtcgcaatctactactcctgaaactatattggaattaacagatgcactggccctgggaatgatgattcttaaaatagtgcgcaacatggaaaaatatcagctagcagtaacgattatggcgatcctctgtgttccaaatgcagtaattctgcaaaatgcatggaaagtatcgtgcaccatactggctgcggtatcagtttctccgctcctactaacatcgtcacaacagaaggctgattggattccattagcccttacgataaaaggactaaatcccacagcaatatttctaacaactctgagccgaactaataagaaaaggtcgtggcctctcaacgaagcaatcatggcggtagggatggtgtcgattttggcttcatcattgttgaaaaatgacatacctatgacgggtccacttgttgcaggaggtctactaaccgtatgttatgtattaactggtcggtccgcggatctagaactagagagagcggccgacgtgcgatgggaagatcaggcggagattagtggcagctcaccgatactatccatcactatatctgaagacgggagtatgagtataaagaatgaggaagaagaacagacattaacgattctaattcgaacgggactacttgtaatcagcggattatttcccgtctctataccaataaccgcagcagcgtggtatctttgggaagtaaagaaacagcgtgccggtgttctttgggacgtaccatcacccccgcctgtagggaaagcagaattggaagacggtgcttatagaataaaacaaaaaggaatattgggctatagtcaaatcggtgccggcgtctacaaggaaggcacatttcacacaatgtggcatgttacaagaggggcggtcttaatgcacaagggaaaacgcatagagccatcctgggcagatgttagaaaagacctcataagttacgggggcggatggaaacttgaaggagaatggaaagaaggagaggaagttcaagtattagccctcgaacccgggaagaacccacgtgccgtccagacaaaaccgggactatttaagacaaatactggaactattggcgcggttagcttagatttttcgccaggaacttcgggtagtcccatcgttgacaaaaagggtaaggtagttggtctatatgggaacggagtagtgacgcgctctggtacctatgtatcagcgatagcacaaaccgagaaaagtatcgaagataacccagaaatagaagatgacatattcaggaagaaacgactaacaataatggatttacacccaggggcgggaaagacaaagagatatctcccggctatcgtaagggaggccataaaaagggggcttcggacactgatcctagcacccactagagtagttgcagctgagatggaagaagcgcttagaggattaccaattcgctatcagacgcctgccataagggcagagcatacaggtagggaaattgtagatttaatgtgccatgctacgttcaccatgagacttctaagtcctgtcagagtacctaattacaatctaataatcatggatgaagcacattttactgatcctgcatctatagcagccagaggttatatatccacccgggtagaaatgggggaagcagcaggaatctttatgactgcaaccccacctggatcacgggatccttttccccagtctaatgctccaattatggatgaagagagagaaataccagagcgaagttggaatagtggtcacgaatgggtaacagatttcaaagggaagacagtttggtttgtaccaagtatcaaagctggaaacgacatagcagcttgtctacgaaagaacggcaagaaagtaattcaactaagtagaaaaacgttcgactcagagtatataaaaactcgtaccaatgattgggactttgttgtcaccacagatatctccgagatgggcgcaaattttaaagcggaacgtgtgatagacccaaggcgatgtatgaagccagtcattttaactgatggagaagaaagagttattttagcagggcctatgccagtaactcattcgtctgcagcccaaaggagaggaagaattgggagaaatccgaaaaacgaaaatgatcaatacatctacatgggagaacctctagaaaatgatgaggactgcgcccattggaaagaagccaaaatgttattagataatataaatacacccgaaggtataataccatcaatgttcgaaccagaacgggagaaagtagacgcaatagatggtgaatatagactgcggggagaagcccgaaaaacgtttgtcgacttaatgagaagaggcgacttgcctgtctggctcgcatatagagtagctgctgaaggaataaactacgcggatcgaaggtggtgcttcgatggtatcaaaaacaaccagatacttgaagaaaacgtcgaagtagaaatttggacgaaagaaggagaacgaaagaaacttaaaccacggtggctagatgctagaatctactcggatccgctggcattaaaagaatttaaagaatttgcagcgggaagaaaatcgctaacgttgaaccttatcacagaaatgggaagactacccacatttatgacccaaaaagcgagaaacgcattggataatcttgccgttctgcataccgcagaagctggcggcagagcttataatcacgcattatcagaacttccagaaacccttgaaaccctacttcttttgactctattggcaacagtaactgggggaatttttctattcctaatgtcaggtaaaggaataggaaaaatgacattgggaatgtgttgtataataaccgcaagcatactactttggtacgcacagattcagccacattggattgcagcgtcaataattttagagttctttctgatagtactcttgatacctgaaccggaaaaacagaggactccacaggataaccaattaacatacgtagttatagccattcttaccgtagttgctgctaccatggcaaatgaaatgggctttttagagaaaacaaagaaagattttggtctaggtagcatcgcgactcaacaacccgaatccaatatactagacatagatctccgccccgcttccgcctggaccttatacgcagtagcaacgacattcataaccccaatgttacgccacagtattgaaaactccagtgtcaatgtatcattaacagctatagccaatcaggccaccgtgctcatgggtctaggaaaaggatggcccttaagtaaaatggatattggtgtgcccctgcttgcaataggttgttatagccaggtgaatcctattacattgactgcagccctacttttattagttgcccactatgcaataattggaccaggattacaagcaaaagcgacacgagaagcacagaagagagcagcagctggtattatgaaaaatccaactgtcgatggaataacagttatagatttagatcccataccatacgatcctaagttcgaaaaacaattgggacaagtaatgttgctagtcctctgtgttactcaagttctaatgatgcgtacaacatgggctttatgtgaagcgcttactctagcaacaggacccatcagtacactctgggaaggaaatccggggagattttggaacaccacgatagcagtctctatggcaaatatattcagaggaagttatctggctggggccggcttactattttcaattatgaaaaatacgacgaacacgcggaggggaacagggaatactggagaaacattaggagaaaagtggaaaaatcgcttaaattctttggggaaaagtgagtttcagatttacaagaggagtggaatacaagaagtagatagaactctggcaaaagaagggattaaaagaggggagacagatcaccatgcggtaagcagaggatctgcaaaactaaggtggttcgttgaaagaaacttagtcacacctgaaggtaaagttgtggatcttggttgtggcaggggaggctggagctactattgtggagggctaaagaacgtacgagaagtaaaagggttaaccaaagggggacccggccatgaagaaccgatacctatgagtacctacgggtggaatttggtaagactacaaagtggagtcgacgtattctttacaccaccagagaaatgcgatacgttactgtgtgatattggcgaatcatcaccaaacccgacagtagaagccggtcgaacattaagggttctgaaccttgtggagaactggttaaataataacacacaattctgtattaaagttttgaatccttacatgccttcggttattgagaaaatggaaacactgcaacgaaaatatggaggggcattagtgagaaacccgctaagtagaaacagtacacacgaaatgtactgggttagtaatgcgtccggaaacattgtaagcagcgtaaacatgattagtaggatgttaattaacagatttacgatgagacataagaaagctacctatgagcctgacgtagacttgggctctggaactcgcaatattggtattgaatcagaaacccctaatctggatataataggaaagagaatagagaaaataaagcaggaacatgaaacttcatggcactatgaccaggatcatccttataaaacctgggcctaccacggtagttacgagaccaaacaaaccggaagtgcaagttcaatggtaaatggtgtagtgagattactaactaaaccatgggatgttattccaatggtaactcaaatggccatgacagatacaacaccgtttggccaacaacgtgtatttaaggaaaaagtagacacacgcactcaagaacctaaagaagggacgaagaaactaatgaagattaccgcagaatggttatggaaagaactaggcaagaagaaaacgcctcgcatgtgtactcgagaggaatttgcgcgaaaggttagatctaatgccgctctcggcgcaatcttcaccgacgaaaataagtggaaatccgcacgagaagccgttgaagattcgagattttgggaattagtagataaagaaagggatctccacttagaaggtaaatgcgaaacatgcgtatataacatgatgggaaagagagaaaagaaaataggagaatttgggaaagcaaaaggcagtagggccatatggtacatgtggcttggtgcccgatttttggaatttgaggcactaggattcttaaatgaggaccattggttctcccgggaaaatagtttatcaggagtagaaggtgagggtcttcacaaacttggatatatacttcgtgaagtaagcaagaaagaaggaggagcaatgtacgccgacgacactgcaggatgggacactagaattacgttagaggaccttaagaacgaagaaatggtcactaaccacatggaaggggaacacaagaaactggcagaagcaatattcaaacttacctatcagaataaagtagttagagtacaacgccctactccaagagggactgtaatggacatcatatcacgaagagatcaacgaggtagcggacaggtaggcacctacggtctaaatacttttactaacatgggagcacaactaattcgtcagatggagggagagggagtttttaaagggatacaacatctaactgctacggaggaggttgccgtgcaagactggctcgcacgcgtcggacgagaacgtctgagccgaatggctattagcggggatgattgcgttgtaaaaccattggatgatcggtttgctaacgcacttaccgctctaaatgatatgggtaaagtaaggaaagatatacaacaatgggaaccttctagaggatggtcagattggacacaagtacctttctgctcgcatcattttcatgagttgataatgaaagatggcagagtattagtagtcccgtgcagaaaccaagatgaactgataggccgagctagaattagtcaaggggctggctggagcttaagagaaacagcttgtctgggtaaatcatatgctcagatgtggagtctaatgtacttccacaggagggacctccgattagcagccaatgcgatatgcagtgctgttccatctcattgggtgccaacatcaagaacgacatggagtatacatgcgcgacatgaatggatgacaacagaagacatgctcacagtgtggaatagggtgtggattcaggagaacccttggatggaagataaaacgcccgtagagagttgggaagaaattccatatctcggaaagcgtgaggaccagtggtgtggttctttaatcggcttgaccagcagggcaacatgggcacgaaacattcaaacagccatcaatcaagtcaggagcttaatcggatctgaagagtatactgactatatgcctagcatgaagagattccgtagagaagaagaggaggccggcgtattatggtga

SEQ ID NO: 22209 - RNA, 9876 nt, synthetic construct
  misc_feature 1..9876: note = derived and/or modified CDS sequence (opt6) from DENV-2__KF041235__SS-prME
  source 1..9876: mol_type = other RNA
accgctggtgttataataatgctaatcccaactgctatggcatttcatttgactacaaggaacggtgaaccacacatgatagtgagtaaacaagaaaaaggaaagagcttacttttcaaaacagaagacggagtgaatatgtgcacattaatggcaatggaccttggagaattatgtgaagatacgataacatataattgcccactactgcgccaaaacgaacccgaagatatagattgttggtgcaactcaacaagtacatgggtgacgtatgggacatgcactgcaacgggagagcacaggagagagaaaaggtcggtcgcgttggtacctcatgtcggcatgggccttgaaacaaggaccgaaacttggatgtcaagcgaaggcgcatggaaacatgcacaacgaatagagacctggatattaaggcatccaggttttacgataatggcggctatattagcttatactattggtacaacatattttcaacgggtattaatctttattttattgacggccgtagctccaagcatgacaatgcgctgtatcggcatctcaaacagagattttgtggaaggcgtatcaggtggtagctgggtagacattgttcttgaacacggttcatgcgtcacgacgatggccaaaaacaaaccaacacttgactttgaactcataaaaacagaggccaaacaacctgctacactacgaaaatattgtatagaagccaaactaacgaatacaacaacagcgtccagatgtcctacacaaggagaaccaagtttaaatgaagaacaggacaaacgatttgtctgtaaacattcaatggttgaccgaggttggggtaacggttgtggtttatttggaaaaggtggaatagtcacgtgcgccatgttcacatgtaagaagaatatggaaggcaaaatcgtacaacccgaaaacctggaatacaccatagtagttaccccgcactcaggagaagaaaatgctgtaggaaacgacactggtaaacatggaaaagaaattaaagtaactccccaaagtagtataactgaggcagaattgaccgggtatgggactgtcaccatggaatgttcacccagaacgggtctagactttaatgaaatggtactattgcagatggagaataaggcttggctcgttcacagacaatggttccttgatcttcctctaccatggcttcctggtgcagatattcaaggaagtaactggatacaaaaagaaactttagtgacatttaaaaacccacatgctaagaaacaagacgtcgtggtcttaggctcgcaggaaggagcgatgcatactgctcttactggggctacagaaattcaaatgagttctggtaatcttttatttaccgggcacttgaaatgccgattgcgaatggacaaattgcaattgaaagggatgtcatatagtatgtgtactggaaaatttaaggtcgtaaaagaaatagccgaaacccaacacggaacaattgttgtaagggtacaatatgaaggtgacgggagtccctgtaaaatcccattcgaaattatggaccttgaaaaacggcacgttttagggagactaataactgtaaatccaatagtcaccgaaaaggatagtccagtaaatatagaagcggaacctccatttggggactcttacataattatcggtgtcgaaccaggccaacttaaactctcatggtttaagaaagggtcctcaattggtcaaatgtttgaaacaacgatgagaggggcaaaaagaatggctatcctaggggacacagcttgggatttcggttctctcggaggagttttcacttctataggaaaagctctccaccaagtttttggcgctatatacggtgcggctttctctggggtatcatggacaatgaagatcttaataggtgtagtaatcacatggatcggaatgaatagtagatctacgagcctttcagtaagtttggtactggtaggcgtagtcactctatacttaggcgtcatggttcaagctgattctgggtgcgtagttagttggaaaaacaaggaattgaaatgtggcagtggtatttttattacggataacgtacacacctggacggaacaatataagtttcaaccagagagccctagtaaactcgcttcagcgatacagaaagctcatgaggaaggcatatgtggtataagaagtgtaactcgattagagaatctaatgtggaaacaaataaccccggaactcaatcatatattaagcgaaaatgaagtcaaattgagtataatgactggagatatcaaaggtataatgcaggctggcaaacggtctttaaggccgcagccgacagaacttaaatacagctggaagacgtggggtaaagcaaaaatgctaagtaccgagccccataaccaaactttcttgattgatggcccagaaacagctgaatgtccaaatacaaaccgcgcctggaactcactggaagtagaggattatggattcggagtctttacaacaaatatctggttaaagttaaaagaaagacaggatgtgttttgcgattctaaacttatgagtgcagctataaaagataatagagctgtgcacgcagacatgggatactggattgaaagcgctttgaacgatacgtggaaaatagaaaaggcttcatttatagaagttaaatcctgccattggccaaaaagtcataccttatggagtaacggcgtgttagaaagcgagatgattattcccaaaaattttgccggtccagttagccaacacaactatcgacccggctatcatacccaaaccgcaggtccatggcaccttggcaaattagaaatggactttgatttttgtgaaggaacgaccgtggtggtaacggaagattgtggtaatagaggcccatcattacgaactaccacagcatctgggaaactaataacggaatggtgttgtagaagttgtacattacctcccttaaggtaccgaggtgaggatgggtgctggtatggaatggaaataagacccttaaaagaaaaagaggaaaacttagtaaattcactcgtaacggctggacacggtcaaatagataatttttcactaggggtcttaggaatggctcttttcttagaagagatgcttagaactcgagtcggaaccaaacatgctgtacttttggttgcagtatcgttcatgacattaataacaggaaatatgagcttcagagatctaggacgagttatggtgatggtaggtgccgctatgacagacgacataggaatgggagtgacctatttagcactgctagccgccttcaaagtcagacccacattcgcggcaggactattgctaagaaaattaacatccaaagagctcatgatgacaaccatagggatagttttactttcccagagtacaacgccagaaaccattcttgaattaacagacgcacttgctcttggcatgatgattttgaaaattgtacggaatatggaaaaatatcaattggccgtgaccataatggcaatactctgcgttccaaacgccgttattttacaaaatgcatggaaggtttcttgtaccattcttgcagcagtctcagtaagtcccttattgttaacaagctctcagcaaaaagccgattggatacccctagctttaaccataaaagggcttaacccaacggccatatttttaactactttaagcaggactaataagaaacgatcctggccactcaatgaagctattatggcggtagggatggtatcaatactggcttcgagtctactgaaaaacgacataccaatgacaggtcccttagtagcgggaggattgttgacagtatgctacgtcctgacagggagatcagcagatctggagttagaacgagcagcagatgtaaggtgggaggatcaggctgaaattagtgggtcaagtccaatcctgtcgattacaatttccgaagacgggagtatgagcattaaaaacgaggaagaagaacaaacacttacgattctcatccgcacaggactattggttataagtggtctatttccagttagcattcccattacagctgctgcatggtacttatgggaagtcaaaaagcaacgagcaggagtactctgggacgtaccaagtccacctcccgtggggaaagcagaattagaagatggagcttatagaattaagcaaaaaggaatcctcggatatagtcaaattggagctggtgtttacaaagaaggcactttccacacaatgtggcacgttacacgaggagctgtattgatgcacaagggtaaaagaatagaaccgagttgggcagacgtacgtaaagatctgatctcatacggcggaggctggaaattggagggagaatggaaagaaggagaggaggtgcaagttctggcgttagaaccgggcaaaaatccacgagctgtccaaaccaaaccaggtcttttcaaaacgaatacgggtacaattggggccgtctcccttgactttagtccaggtacaagcggatcacctattgtggacaagaaaggaaaagtggttggactttatggaaatggtgtagtgacaagatcaggcacttacgtaagtgctatagcacaaaccgaaaagtcaatcgaggataatccagaaatcgaagatgacatttttagaaagaaacggctcactataatggatttacatccaggagcaggtaaaacaaaacgatatctcccagcgattgttcgggaagctattaaacgaggtttaagaacactaatattagctcctacaagagtagttgccgccgaaatggaagaggctttacgaggtttacccatacgttatcaaactccggcaatacgagccgaacacaccggccgtgaaatagtagatttaatgtgccatgctacgtttaccatgcgccttctatccccagtgagagtaccaaactataacttaatcataatggatgaagctcactttactgatcctgcaagtatagcggcgagaggctatataagcaccagagtcgaaatgggagaagctgcaggcattttcatgactgcaacacctcctggaagcagggacccattccctcaaagtaatgccccaataatggatgaagagagagaaattccagaaagaagttggaactctgggcatgaatgggtaacagatttcaaaggtaaaacggtttggttcgttccatctatcaaagccgggaacgatatagcggcatgcctacgcaaaaatggcaagaaagtgattcagctgtctaggaaaaccttcgactcagaatatataaaaacgaggactaatgactgggattttgtagtcacaactgacatatcggaaatgggggccaactttaaggctgagcgtgtcattgatccacggagatgtatgaagcccgtaatcctaacggatggagaagaacgagtaatattggcaggacccatgccagtaacacactcttcagctgctcagaggcggggaaggatagggcgaaaccccaaaaacgaaaacgatcaatatatatacatgggtgaaccattggaaaatgacgaagattgtgctcactggaaagaagctaaaatgttactagataatatcaatacaccagaaggcattataccctcaatgtttgaaccagaaagagaaaaagtagatgcaatcgacggcgaatatcgactaagaggagaagcacggaaaactttcgttgacctgatgagacgaggggacctcccagtatggttagcctatcgagtagcagcagaaggcattaattacgccgacagaagatggtgctttgacggcattaaaaacaatcagatcctcgaggagaatgtcgaagtagaaatatggactaaggaaggtgaaaggaaaaagctaaaaccccgatggttggatgcgagaatttactccgatcctttagcccttaaagaatttaaagagtttgcggctggaagaaagtccctaacattgaatcttataacggaaatgggaagactgccaacctttatgactcagaaggccagaaatgcactagacaatttggcggttttacatacggcggaagcagggggccgagcatataatcatgctttgtcagaattaccagaaacactagaaacactactcctattgaccctattggctacggtgactggaggtatatttctatttttgatgtccggaaaaggaatcggtaaaatgactttgggaatgtgctgtataataactgcctcaatccttctatggtacgcacaaatccagcctcactggatagcagcatcgattattctagaatttttcctaatcgtgctattaatccccgagcctgaaaaacaaaggaccccacaagataatcaactgacatacgtagtgattgcaatactaaccgttgtcgctgcaaccatggcaaatgaaatgggattcttggagaaaactaagaaagattttggtctaggaagtattgcaacccaacagcctgaaagcaatattctagatatcgatctacggcctgcttcagcatggactttgtatgcagtggcgacaacgttcataactcctatgctacggcactcaatagaaaatagttccgtaaatgtctcgttaaccgctattgcaaaccaagctacagtacttatgggactaggtaagggctggcccctatcaaagatggatataggagtaccgttgttggcgattggatgttatagccaagttaatccgattactttgaccgcagctttacttctattagttgctcattatgctatcatagggcctggactccaagcaaaagccacacgcgaagcacagaaacgagcggcagcgggcataatgaaaaatccaacagttgacggaataactgtaattgacctcgaccctattccctacgaccccaagtttgaaaaacaattagggcaagtaatgctcctcgtattatgcgtgacccaagtgttaatgatgagaacgacttgggctctttgcgaagcccttacacttgcgacaggacccattagtaccctatgggaagggaacccgggaagattctggaacacgacaatagctgtcagtatggctaatatctttcgaggaagctatctagcgggtgccggtctcctcttttctataatgaagaatacgacgaatacaagaagaggaacgggtaacacaggcgaaacattaggagaaaaatggaaaaacagactcaattcattaggaaagtcagaatttcagatctacaagagatccggcatacaagaagtcgatagaactttagcgaaagaaggcattaaaagaggtgaaactgatcaccatgcggtttcgagaggatcagccaaactcagatggttcgtcgagagaaaccttgttacaccagaaggaaaagtagtagacttaggttgtggtcgcggaggttggagttattattgtggcggtctaaagaatgtaagggaggtaaaggggttgactaaaggcggaccgggccacgaagaaccaattcccatgtcaacgtacggatggaacctagtaagactacaatccggagtcgacgtgtttttcacaccgcccgaaaaatgtgatacactactatgtgacataggggaatctagtcccaatccaacggtcgaagccggtcgtactctacgtgtgttaaatcttgtggagaactggttaaataataacacacaattctgtataaaagttttaaatccttatatgccttccgtcatagagaaaatggaaacattacaaagaaaatatggaggagcgttagtaagaaacccactgagccggaactccacacacgagatgtattgggtgagtaatgcgtctgggaacatagtctcatcagtaaatatgatatcgcgaatgctgatcaatcgttttactatgagacataagaaagctacttacgagcccgatgtggaccttggtagtggaactaggaatataggaatagaatctgagacaccaaacttagatataataggaaagcgcattgagaaaatcaaacaagaacatgaaacaagttggcactacgatcaagatcatccctataagacatgggcgtatcatggatcatatgaaacaaaacagacaggaagtgcttcaagtatggttaatggtgtagtacgtttgttgactaagccatgggatgtgatcccgatggttacacaaatggcaatgacagacaccactccatttggtcaacaaagggtattcaaggaaaaagtagatacaagaacccaggaaccaaaagagggaacgaagaaattgatgaaaataactgctgaatggctgtggaaggaactcggtaagaagaaaactccaagaatgtgcacaagagaggagttcgcgcgaaaggtacgttcaaatgccgcacttggtgctatctttacagacgaaaataaatggaaaagcgctagagaagcagttgaagactcaagattttgggaactggtcgataaagaacggaatttgcatttagaaggtaagtgtgagacatgtgtatacaacatgatgggtaaaagagaaaagaaaatcggggaatttggtaaagcaaaaggttctcgtgctatctggtatatgtggctgggcgcacgctttctagaatttgaggcactaggctttctgaacgaagatcactggttttcgagagagaacagtctaagtggagtcgaaggtgagggtcttcataaattaggctatatccttcgagaggtcagtaaaaaggaaggaggggctatgtatgctgacgacactgcgggttgggatacacggataacacttgaagatttaaagaatgaggaaatggtgacaaaccatatggaaggtgaacacaagaaacttgcggaggcaattttcaaacttacctatcaaaacaaagtcgttagggtccaaagaccaacaccgagaggaaccgttatggatataatatcaagaagagaccaaagaggatcaggtcaagtcggaacgtacgggttaaacaccttcacaaatatgggtgctcaactaattcgacaaatggagggggaaggtgtattcaaaggtattcaacatttaaccgcaacagaagaggtcgcggtacaagactggttagcgcgtgtaggacgagaacgattatcacgaatggcaatatcgggggatgactgcgtggtcaaacctttagatgatcgttttgcaagtgccttaacagcactaaatgacatgggaaaagtccgaaaagatatacaacaatgggaaccgtcaagaggttggaatgactggactcaggtaccattttgctctcaccattttcatgaattaataatgaaagatggacgagtccttgttgtgccatgcagaaatcaagatgaactgatagggcgagcccgcatatcccaaggcgcggggtggtctttaagagaaacagcttgcctaggaaaaagctacgcacaaatgtggtcgctgatgtactttcaccgaagggacctaagattagcagcaaacgcaatatgctcagctgtgccttcacactgggtaccaacaagtaggaccacatggtccatacacgcaaggcacgaatggatgacgactgaggacatgctaacagtatggaaccgagtttggattcaagagaacccctggatggaggacaaaacgccagtagaatcatgggaagaaatcccatacttaggaaaaagagaggaccaatggtgcggctcactgataggactaaccagccgagcaacttgggcaagaaacattcaaactgctattaaccaagtccgtagcttaatcggatcagaggagtatacggattatatgccaagcatgaaaagatttcgaagagaagaagaagaagctggagtcctgtggtaa

SEQ ID NO: 22210 - RNA, 9876 nt, synthetic construct
  misc_feature 1..9876: note = derived and/or modified CDS sequence (opt6) from DENV-2__KF041237__SS-prME
  source 1..9876: mol_type = other RNA
actgctggagttatcattatgctaataccaacagctatggcattccatcttacgactagaaatggggaaccgcacatgattgtttcaaaacaagaaaaaggaaaaagtttactattcaaaacagaagacggtgtaaatatgtgcacactaatggctatggatttgggagaattatgcgaagacacaatcacgtataattgcccattgttaagacagaacgaaccagaagacatcgattgctggtgtaattctacaagtacttgggtgacatacggaacatgtacagctactggagaacatcgaagagagaaacgatcagtagctctagtgccacacgtcgggatggggttagaaacaagaacagaaacatggatgagttcagagggagcatggaaacacgcacaaagaatagagacatggatcttgagacaccctggattcaccataatggcggcaatattagcttacaccattgggacaacttactttcagcgcgtattaatatttattttattaactgctgttgcaccttcaatgactatgaggtgcataggaataagtaatagggattttgtagaaggtgttagcggaggaagttgggtggacattgtgctagagcatggaagctgtgttacaactatggctaaaaataaaccaacactagacttcgaattgataaaaactgaagctaaacagccagctaccttgaggaaatactgcattgaagcaaaattaactaataccacaaccgcaagtcgatgcccaacacagggagaaccttccttgaacgaagaacaggacaaaagattcgtatgtaaacattctatggtcgacagaggatgggggaatggatgtggactatttgggaaaggtgggatagtaacatgcgctatgttcacttgtaagaaaaatatggaaggaaaaattgtgcagccggaaaacctggaatacacgatagtagttactccacattcgggtgaggaaaacgccgtgggaaatgatacaggaaaacatggaaaagaaataaaagttacgccacaaagctcaatcaccgaagcagaactgacaggatatggtacagtaacaatggaatgttcacctagaactggtttggactttaatgaaatggtgctactacaaatggagaataaagcatggttagttcacagacaatggtttctagatttaccgcttccatggcttccaggtgcggatatacaaggtagtaattggattcaaaaagaaacgcttgtaacatttaaaaacccccacgccaagaaacaggacgtagtagtactaggcagtcaggagggagcaatgcacactgccttgacaggcgcaactgaaatacagatgtccagcggtaatttactcttcaccggacatttaaaatgtcgactaagaatggataaattacaactcaaaggaatgtcctattcaatgtgtacagggaaatttaaagtagtaaaagagatagcagaaacacagcatggcacaatagtggtgagagttcagtatgagggagacggaagcccatgcaaaatacccttcgaaattatggaccttgaaaagagacatgtcctcggtagactcataaccgtcaatcctatcgttacggaaaaagattcgccagtcaacatcgaggcagaaccaccatttggtgattcgtatattatcattggtgttgagcccggtcagctaaaattaagttggtttaaaaagggaagttcaatcggacaaatgtttgaaacaaccatgaggggcgcaaagagaatggctatattaggggatacagcttgggactttggatcattaggaggcgtctttacgagcataggtaaagccctacaccaagtttttggtgcaatatatggcgctgccttctctggtgtatcatggaccatgaaaattttgataggtgtcgttataacatggatcggaatgaactcaagaagtactagcttgagtgtaagcctggttcttgtgggcgtggtaacactctatttaggtgtgatggtacaagctgactctggctgtgtagtttcgtggaaaaataaagagttaaaatgtggttcgggaatatttattacggataacgttcatacgtggaccgaacaatataaattccagcccgaatctccttcaaagctagctagtgcaatacaaaaggctcacgaggaaggaatatgtggtataagatcggtgacaagactagagaacctgatgtggaaacagataacaccagaactaaaccacattttatccgaaaatgaggtaaagctcagtatcatgaccggggacataaaaggaataatgcaggcaggaaagagatcactacggccgcaacctacagaattaaaatactcctggaaaacatggggaaaggcaaaaatgctcagtacagaaccgcataaccaaacattccttattgatggaccagaaactgcagaatgccccaatacaaatagagcttggaactcattagaagtagaggattatgggtttggagtgtttaccactaacatctggttgaaactaaaagaacgacaggatgtcttttgtgatagtaaacttatgtctgccgctataaaagacaaccgcgctgttcatgctgacatgggatactggatcgaaagtgcattaaatgatacatggaaaatagagaaagcatcattcatcgaggtaaaatcgtgtcactggcccaagtcccatacactctggtcgaacggggttctagaaagcgaaatgataataccgaaaaattttgctggcccagtctcacaacacaattatcgtcctggataccacacccaaaccgccgggccttggcatttaggtaagttagaaatggattttgatttttgcgaaggaactactgtcgtagttacagaagattgtggaaatagaggcccatcactacgcaccacaacagcatcggggaaactgataacagaatggtgttgccgatcatgtacacttccgccactaagatacaggggagaagacgggtgctggtatggaatggaaattcgtcctctaaaagaaaaggaagaaaatcttgtaaacagtcttgtaactgcagggcacggacaaatagataatttcagcttaggcgtattggggatggcattatttttagaagaaatgttacgcacgcgcgttggaacgaaacacgcggtgctcttagtcgcagtaagttttatgaccctcataacgggcaatatgtcattcagagatcttggtcgcgtgatggtcatggtgggagctgctatgaccgacgatattggcatgggggtcacttatcttgcactattagcggctttcaaagtcaggcccaccttcgcagcgggattactactccggaaattgacgagtaaagaacttatgatgacaactatcggtatagtacttctctcgcaaagcaccacaccggaaacgatcctagaactaacagacgcactagctttgggaatgatgatcttgaaaatcgtacgtaatatggagaaataccagcttgccgttactatcatggcgatactatgcgtgccaaatgccgtcatacttcaaaacgcgtggaaagtctcgtgtaccatattggctgcagtaagtgtgagtccactattattaacatcctcccagcaaaaagcggactggatcccacttgctctaacaataaaaggtctaaacccgactgccattttcctaactacactttctaggacaaacaaaaagcgttcatggccattaaacgaagcgatcatggcagttggcatggtctcaattctagcgtcaagtttgctcaaaaatgatatacccatgaccggacccctagtagctggtggacttctgaccgtgtgctatgtattgacgggaaggtcagcagatcttgaacttgagcgggcagcagatgtacgatgggaagatcaagctgaaattagtgggagctcacctattctttctattacaataagtgaggatggctcaatgtcaatcaaaaatgaagaggaagaacaaaccctcaccattctgatccgaactggcctcctagtaattagcggtttattccctgtatccatccctattacagcagcggcttggtatttgtgggaggtcaagaaacaacgtgcaggcgtcctgtgggacgtaccatcgccaccacccgttggcaaagcggaattagaagatggcgcctacagaataaagcaaaagggaatattaggatacagtcaaatcggggcaggagtatacaaagaaggaactttccataccatgtggcatgttacacgaggagcggtgctcatgcacaaaggtaaacgcatagaaccgtcatgggcggatgtaaggaaagatttaataagctacggcggaggatggaaacttgaaggtgagtggaaagaaggagaggaagtacaagtcctcgctctagaacccggtaaaaatccgagggcggtgcaaacaaaacctggtttattcaaaactaacacaggtaccataggcgcggtatcattggatttcagtcctggaacttcgggtagccctattgtagacaagaaaggaaaagttgtcggtttatacggtaatggagtagtaactagatctggtacttatgtttctgcaattgcacagacagagaaaagtatagaagacaatccagaaatcgaggatgacatcttcaggaagaaacggctgacaatcatggatttacatccaggcgccgggaaaaccaaacgatatctgccggcaatagtacgcgaagcaattaaacgagggttaagaactttgatcttggctccaacccgagtcgttgctgctgaaatggaagaagcgttaagagggctaccgataagataccaaacacccgcgataagggctgaacacaccggacgagaaattgtggacttaatgtgccacgcaacatttactatgaggcttttgtctccagttagagttccgaactacaatttaataataatggatgaagcacattttacagaccccgcaagtatagcagctagaggatacatttcaactcgagtagagatgggtgaagctgcaggtatttttatgacggcgacgccgcctgggtctcgtgacccattcccccaatcaaacgcaccaatcatggacgaagaacgtgagattcctgaacgctcatggaatagtgggcatgagtgggttacagactttaaaggaaaaacagtatggtttgtaccatctataaaggcgggtaatgatatcgctgcatgtctgcgcaaaaacgggaaaaaggttattcaactaagtagaaaaacgtttgattccgaatatatcaaaacccggaccaatgattgggacttcgtggtcaccacagatatctcagagatgggagcaaactttaaggctgaaagagttattgacccgcgccgttgcatgaaacctgtgatactcacagatggtgaagaaagagtaatactcgcaggacctatgcctgtgactcatagctcagctgcacaaagaagaggaagaataggcagaaaccccaaaaatgaaaatgatcagtatatttacatgggagagccactggaaaatgacgaagattgcgctcattggaaagaagcaaaaatgctactagataatatcaacacacccgagggaattataccttcgatgttcgaacctgaaagagaaaaagtcgatgccatcgatggcgaatatagattgagaggtgaagctcgaaaaaccttcgtagatttgatgagaagaggggacctaccagtatggctggcatatcgagtcgcagctgaagggattaattatgcagaccgcagatggtgctttgatggaattaagaacaatcagatcctcgaagagaatgttgaggttgagatttggaccaaagaaggtgaacggaagaaactaaaaccccgatggctagatgcccgaatatatagcgaccccttagcattaaaagagttcaaagagttcgcagcagggcgcaaatctctaacccttaatctaattaccgaaatgggaagacttccgacattcatgactcaaaaagcaaggaatgcactcgacaatttagcagttctacatactgctgaggcaggagggcgagcttataatcatgcattgtcggaattgccggaaaccttagagacccttttgctactgactcttctcgctactgtaaccggcggaatatttttattcctgatgtctggaaaaggtataggtaaaatgacgcttggtatgtgttgcataattaccgcgtcgatattattgtggtatgcacagattcaaccccactggattgcagctagcatcatattagagtttttccttatcgttctgttaatcccagaacctgaaaaacaaaggacaccacaagataaccaactaacatatgtcgtgattgccattctaacggtcgtggcggccaccatggcaaacgaaatgggcttccttgaaaagaccaagaaagattttggcttgggatcaatagctacgcaacaacccgaatcgaatatattagatatagatcttagacccgcatcagcctggacactatacgcggttgcgactaccttcattacgcctatgctgcgtcattcgatagaaaattcaagtgttaacgtatctctgaccgcaatagcaaatcaggcaacagtattaatgggattaggaaaggggtggcccctttcaaagatggacatcggagtcccattactagccattggatgctacagtcaggtaaatccaataaccctaactgcagctctcctactactggtcgcacactatgctataatcggtcccggtttacaagctaaggcaacacgagaagcgcaaaagagagcagcagcaggaattatgaaaaatcctacggtcgacggaataacggtaattgatctggatcctataccatatgatccaaaattcgaaaaacaattaggtcaagttatgctgttggtactctgcgtaacgcaagtgttaatgatgcgtactacttgggctctctgcgaggctttaacactagccacgggaccaattagtacactatgggaaggtaatccaggacgattctggaatacaactattgcggtaagcatggcaaacatcttcagaggaagttatttagcaggagcagggctactcttttctatcatgaaaaacacaaccaatacgagacgaggtacaggaaatacaggtgaaactcttggagaaaaatggaaaaatcgacttaactcgcttgggaagtcggaatttcaaatatataaacggagtggcattcaagaggtcgatagaacactagcaaaagaaggaattaagagaggtgaaacggatcaccatgcagtaagtcgaggtagtgctaagctccgatggtttgtagaacgtaatttggtaacgccggaaggtaaagtagtggatctggggtgcggacgaggaggatggagttactattgtggaggactcaaaaacgtcagagaagtcaaggggttgactaaaggaggaccaggacatgaagaaccgataccaatgtcaacttacggctggaacctggttcgattacagtcaggagttgatgttttcttcacgccaccagaaaaatgcgacacgttgttgtgtgatataggtgaatcgtctccaaatccaactgtggaggcaggtagaacattacgagtcttaaatttagtcgaaaactggttaaataacaatacacaattctgtataaaagtgctcaacccttatatgccctctgtaattgagaaaatggaaacactgcaacgaaaatatggaggcgcactcgtgagaaatccattgtctcgcaactcaacgcatgaaatgtattgggttagtaacgcttctgggaacatagtctcgagtgtaaatatgatatctagaatgttaattaatcgatttaccatgaggcacaagaaagccacctacgagccggatgtagatttggggagtggaacaagaaatataggaatagaatcggaaacacctaacctagacattataggtaagagaatagagaaaatcaaacaagaacacgaaaccagctggcactatgatcaagatcacccatacaaaacgtgggcttatcatggctcatatgagacaaaacagacaggaagtgcttcatcaatggtgaatggggttgtcagattgctaacaaaaccctgggatgtaatccccatggtaacacagatggcaatgacagacacaacaccattcggccaacaacgagtctttaaggaaaaagtggacacgcggactcaagagcctaaggagggaaccaagaaattaatgaaaataactgcagaatggttatggaaggaattaggaaagaagaagacaccgaggatgtgtacgagagaagaatttgcaaggaaagtccgaagtaacgcagcattaggggccatatttacagatgaaaataagtggaaatcagcgagagaagcggtcgaagacagccggttttgggaattagttgataaagaacgaaatctacatcttgaaggtaaatgcgagacatgcgtatataatatgatgggaaaacgggagaagaaaataggagagttcgggaaagcaaaaggatcacgggcaatatggtatatgtggcttggtgccagatttctcgagttcgaagccctaggatttctaaatgaagaccactggttttcaagggaaaatagtctaagcggtgttgaaggggaagggctacacaaacttggttatattttgcgggaagtatcgaagaaagaaggtggagctatgtacgcagacgatacagcaggctgggataccaggattacgttagaagatctgaaaaatgaagagatggtaacgaaccatatggaaggtgaacataagaaattagccgaagccatatttaaactaacatatcagaacaaagttgtgagagtacaaagacctactcctcgagggaccgtcatggacattataagtagaagagatcaaagaggatcgggacaggttggaacctacggattaaatacatttacgaatatgggcgcacaactgataagacagatggaaggagaaggcgtattcaagggcattcagcatttaactgccactgaagaagtagccgtacaagactggttagcgagagtgggcagggaaagactttcaagaatggctataagtggtgatgattgtgtagtaaaaccactggatgataggttcgcatcggccctaacagcattaaatgacatgggtaaagtgcgtaaagatattcaacaatgggagccttctagaggatggaatgactggacacaagttccattctgtagccaccactttcacgaacttatcatgaaagacggcagagtgcttgttgtcccatgccgaaaccaagatgagctaattggccgagcacgtataagtcaaggagcgggatggagtcttcgtgaaacagcttgcttaggcaagtcctatgcacaaatgtggtcattgatgtactttcatcgaagagatctccggttagctgcgaatgctatatgctcggctgttccgtcccattgggtacctacctcaagaacaacatggtcaatacacgctggtcatgaatggatgacgacagaggacatgttaacggtctggaacagagtatggattcaagagaacccatggatggaagataaaacaccagtagaaagttgggaagagatcccataccttggaaagcgagaagatcaatggtgtggaagtttaatcggattaacttcaagagccacctgggcgcgaaacattcaaacagctataaaccaggtaagatcgctaatcggttcggaagagtatacggattacatgccgagcatgaaaagatttcgacgtgaagaagaagaggcaggcgttctttggtga

SEQ ID NO: 22211 - RNA, 9876 nt, synthetic construct
  misc_feature 1..9876: note = derived and/or modified CDS sequence (opt6) from DENV-2__KM217156__SS-prME
  source 1..9876: mol_type = other RNA
acagctggtgtcattataatgttaatacccacggcaatggcgtttcatcttacaacaagaaacggtgaacctcatatgatagtttcaaaacaagaaaaaggaaaatctttgctttttaaaacagaagatggagtgaacatgtgcacgctaatggcaatggacttaggggaactatgcgaagacacaataacgtataactgtccattattgagacaaaacgaaccagaagatatcgattgctggtgtaatgcaacaagcacttgggttacatatggaacttgtacagccacaggagaacatcgtcgtgagaaaaggtcagtggctttagtgccacacgtaggaatgggactagaaacaagaacagaaacatggatgtcaagtgaaggagcctggaaacacgcccaaagaatagaaacgtggattctaaggcaccctggttttacaataatggcagcaatactggcgtatactataggaacaacctactttcagcgagtactaatattcatattattgacagcagtagcaccatcaatgacaatgcgatgcattgggatttcaaacagagactttgtggagggtgtgagcggaggaagctgggtagacatagtactagagcacgggagctgtgtcacaacaatggctaaaaacaaaccaacactagatttcgaacttataaaaacagaggcgaaacagcctgcaacgttacggaaatactgtatagaagcaaaactcactaacaccacaacagcttcccggtgtcccacccaaggtgagccgtcactaaacgaagaacaagacaaaagatttgtatgtaaacacagcatggtagatcgagggtggggaaatggatgcggactctttggaaaaggaggaatcgtgacatgtgcaatgtttacatgcaagaaaaatatggaagggaaaatagttcaaccagaaaacctagaatacacaatagtagtaactccccacagtggggaggaaaacgccgttggaaacgatacgggaaaacatgggaaagagatcaaagtaacgccccaaagctcaataacggaggctgaactcacaggttacggtactgtcacaatggaatgttcacctagaacaggactagactttaacgaaatggtgctacttcaaatggaaaataaagcatggctagtacatagacaatggttccttgacctaccactgccttggttgccaggcgcagacatacagggctccaattggatccaaaaagagacattagttacattcaaaaatccccacgccaagaaacaggatgtcgtagttttaggcagtcaagagggtgcgatgcatactgcacttacaggagcgacagaaattcaaatgagctcgggaaatccattgtttacaggacatttaaaatgtcgactaagaatggataaattacaactaaaagggatgagctatagtatgtgtactggaaaattcaaagtagtgaaagagattgcggaaacccaacatgggactatagtagttagaatccagtatgaaggtgatggatctccctgcaaaatcccctttgaaatcatggatcttgaaaaacggcacgttctaggtaggttaataactgtaaatccaatagttactgaaaaagattctccagtaaacattgaagctgagcccccattcggcgacagttatataattattggagtagagcctggtcaactaaaactatcgtggtttaagaaaggctctagtatagggcaaatgtttgaaacaactatgagaggtgccaaaagaatggctattctaggtgatactgcgtgggactttggttcactcggcggagtattcacaagtattggcaaagcactacaccaggtctttggcgccatctacggcgcggcttttagcggtgtgagttggacaatgaaaatacttattggtgtagttatcacttggatagggatgaactcccgatcaacatctctttccgtgtcgctagtattagttggtgttgtaacattatacctaggcgtcatggtgcaggcagactcaggatgcgttgttagctggaaaaacaaagagctaaaatgcggttctggaatctttttcacagacaacgtacacacttggacggaacagtataaatttcagccagagtcgccttccaaattagcatcagcaatacaaaaagctcacgaagagggaatatgcgggatacgctccatcacgcgtcttgacaaccttatgtggaaacagattactccggagttaaaccatatactatcagaaaatgaagtgaaactcagtataatgacaggtgatataaaaggtataatgcaagctggaaaaagaagcctcagaccacaaccaacagagttaaaatatagttggaaaacctggggaaaagctaaaatgttaagcactgagccgcacaatcaaacatttcttatcgatggaccagaaactgcacaatgtccaaatactaacagggcctggaactccttggaagtagaggattatggattcggggtatttacaactaatatttggctaaaactgaaagaacgacaagatgttttctgtgatagtaagctaatgagcgctgcaataaaagacaatagagccgtacatgcagatatgggttattggattgaaagcgcattaaatgatacctggaagatcgaaaaggctagctttatcgaagtaaagtcgtgtcattggcccaaatctcacacactgtggagcaacggtgtactagaatcggaaatgattatacctaaaaattttgcggggcccgttagtcaacataattaccgaccaggatatcacacgcaaaccgcaggaccgtggcatctggggaagctagagatggacttcgatttttgtgaaggtacaacggttgttgtaacggaggattgtgggaaccgagggcctagcttacgaaccacgaccgctagcggaaaactaatcacagaatggtgctgccggagctgtacactaccaccattaagatatcgaggagaagacggatgctggtatggaatggaaatccgacctcttaaggagaaagaagaaaatttagtcaattccttagttacagcaggccacggccaaatagacaattttagcctaggagtgcttggaatggcgctatttttagaagaaatgcttcgaacgagagtagggacaaaacacgctgtcttactggttgcagttagtttcatgaccttgataaccgggaacatgtcctttcgggacctgggtagagtaatggttatggttggagcagccatgaccgacgatattggaatgggtgtgacatatctagcacttttagctgcctttaaagtccgtccaacttttgctgctggcctcctactcagaaaactgacaagtaaagagctaatgatgactaccatcggtatagttctattatcacaatccacaacccccgaaactattcttgaattaacggacgcactcgccttaggaatgatgatactaaaaatagtccgaaacatggaaaaatatcaattggccgttactataatggcaatattgtgcgtacctaatgcggtaattctacagaacgcgtggaaagtatcgtgtacaatcctggccgcggtctccgtgagtccccttctcttaacaagtagtcaacaaaaagcggattggataccattggcactgactatcaagggacttaatcccactgcaatattcttgacaacactttctcgcactaacaaaaagagatcatggccactcaacgaagcaatcatggccgttggaatggtcagtattttagcttcctctttactaaagaatgatatcccaatgactggcccattagtagccggagggttactcacggtatgttatgtactaacagggcgaagcgctgatttagagttagaacgagctgcagacgtaagatgggaagaccaggcagaaattagcggatcaagtccaatcctatctataacaatcagcgaagacgggtccatgagtatcaaaaacgaagaagaagaacaaactctaactatactaataagaactgggctcttagttatcagtggtttatttcccgtaagtataccaataacagccgcagcatggtacctatgggaggtcaagaaacaaagagctggggttttatgggatgttccgtcacctccgccagtgggaaaagcggaactggaagatggtgcgtacagaataaaacaaaagggcattctgggctattcacaaattggggccggtgtctacaaagaaggaacatttcatacaatgtggcatgtcacgcgtggagcagtactaatgcacaaaggaaagagaatcgagcccagttgggcggatgttagaaaagatctaataagttacggtggcggttggaaattagaaggtgaatggaaagaaggcgaagaagtgcaggtactagccttagaaccaggaaagaaccctagagcagttcaaactaaacctggactatttaaaacgaatacaggaacaattggggcagtttccttggatttttctcctggaacttctggttcaccaatagtcgataagaagggtaaagtggttggattgtatggaaatggcgtggtaactagatcaggcacctacgttagcgctattgcacaaactgaaaagtcaatagaagacaatcctgaaatcgaagatgacattttccgtaagaaaaggctaacaataatggatctacatccaggagctggcaagaccaagcgttatttacccgccatagtaagagaagcaatcaagagaggactaagaacattaattttggcaccaactagagttgtagccgccgaaatggaagaagcacttcgaggactgcctattagataccaaactcccgctataagagcagaacatacaggccgggaaatagtggatttaatgtgccacgctacgtttaccatgagattgctctctcctgttcgcgttccaaattacaacctgataattatggatgaagcccacttcacagaccccgccagtatagcagctcgtggttatatctcaacgcgcgtggagatgggagaggccgctggaatcttcatgacagccacccctcctggaagtcgagacccattcccgcaaagtaatgcacctattatggacgaggaacgagagattcctgaaagatcttggaatagtggacacgaatgggtcacagatttcaaggggaaaaccgtatggtttgtcccgtctataaaagcaggaaacgacatcgccgcatgcttaaggaagaatggaaagaaagtaatccaactctcacgtaagacttttgactcggaatatatcaagacacgtacaaatgattgggattttgtagtgacaacggatataagtgaaatgggggcgaattttaaagccgaaagagtaatcgacccgcgccgatgtatgaagcctgtaatactgacagatggtgaagaacgagtaattctggccggaccaatgccagttacacacagttctgcagctcaaaggagggggagaatcggcagaaaccccaagaatgaaaacgaccaatacatatacatgggggaacctttagagaatgacgaagattgcgcgcactggaaggaggctaaaatgttgttggacaatatcaacactcctgaaggaataatcccaagtatgtttgaaccggaaagagagaaagtagatgcaattgatggagagtaccgattacgaggtgaagcacggaagacatttgtagatttgatgcgacgcggtgaccttcctgtatggcttgcttacagagtggcagcagaaggtataaattatgcggatcggcgttggtgcttcgacggcattaaaaataaccaaatattagaagaaaacgttgaagtcgagatatggactaaggaaggagagagaaagaaactcaaaccgcgatggttggacgcgagaatttactccgacccccttgcactaaaagaatttaaagaatttgctgctgcacgaaaatccttaacattaaaccttataaccgagatggggagattacccacattcatgacacaaaaagcaagaaacgcactggacaatttagcggtactacatacagctgaggcagggggacgcgcatataaccacgcacttagcgagctacctgagacgttagaaacgctccttttgctcacacttctagccactgtcaccggaggaatatttctattcttaatgagcggtaaaggaataggtaaaatgacacttggaatgtgttgtatcatcacagcaagcatactgctatggtatgcgcaaatacaaccacattggatagccgcatctatcatattagagtttttcttgatagtattattgatacctgaacccgagaaacaaagaacaccacaagacaatcagctaacatacgtggtaatagccatcctaaccgtagtagctgccacaatggccaacgagatgggattcttagaaaagacgaagaaagattttggattaggttcgattgcaacacaacagcctgaaagtaacatactcgatattgacctccgcccggcctcagcctggacactctacgcagttgcaactacattcataaccccaatgctaagacacagtatcgaaaatagcagtgttaacgtttctttaactgccatcgctaaccaagcaaccgtattgatgggtttaggtaaaggttggcctctgagtaaaatggatatcggagtgccactactggcgatcgggtgttactcacaagtgaacccaattactttaacagctgctttattattgcttgtagcacattacgcaattatcgggcctggacttcaagcaaaagctagccgagaagcccaaaaacgcgctgcggcaggcatcatgaagaaccctactgtcgacggaatcacagtaatagatttagacccgatcccatatgatccaaagtttgaaaagcaactaggacaagtaatgctattgatactttgcgtaactcaagttctcatgatgcgtaccacgtgggcattatgtgaggctttaactctagcaaccggcccaatatcaacactatgggaaggaaacccgggaaggttctggaacacgaccatagctgtatcaatggcgaacatcttccgtggtagttatttagcaggagcgggactcttattctcaataatgaaaaatacaaccaatactaggaggggtacaggaaatacaggcgaaacattaggagaaaagtggaaaaacagagtatctttgctaggtaagtcggaatttcaaatatataagaggagtggcatccaggaagtcgatcgtacactagcgaaagaggggataaaaagaggcgaaacggaccatcacgcagtgagtcggggatctgccaaactaaggtggtttgtagaaagaaatctagttactccagaaggaaaggtagttgacctggggtgcggaagaggaggatggtcttattactgcggtggactgaaaaacgttcgtgaagtaaaaggtctaacaaagggtggaccaggccacgaggaaccaattccaatgagcacatatggctggaatctggttagattacttacgggggctgacgtattctttacgccgccggaaaagtgcgatacgttactgtgtgacataggagagtcatctccaaaccccactgtcgaagcaggtcgtaccttgagggtactaaatctcgtggaaaactggttaaataacaacactcaattctgcataaaagtactgaacccttacatgcccagtgttatagagaaaatggaaactttacaaagaaagtatggaggagcattagtaagaaaccctctatctagaaactcaacgcacgaaatgtactgggtgtcgaatgcaagtggaaatatcgtttcatcagtgaacatgatatcgagaatgctaataaatagatttactatgcgccataagaaagcaacgtacgatccagatgtcgatctaggaagcggcacaagaaacatcggaatagaatccgaaacaccaaatctagatataattggcaaacggatagagaaaataaaacaagaacacgaaacaagccgacattacgatcaggaccacccatacaagacatgggcctatcatgggtcctacgaaactaaacagacaggtagtgcgtcatcaacggtaaatggggtggttagactgttaacaaaaccctgggacgtcataccgatggtgacacaaatggcaatgaccgatactaccccattcggacagcagcgagtatttaaagaaaaagtagacactagaacacaggaaccgaaggagggaaccaagaaactaatgaaaattacagcagaatggttgtggaaagaactcggcaagaagaaaactccaagaatgtgtacgagggaagaatttgctaggaaagtacgaagcaatgcggccttgggtgcgatattcaccgacgaaaataaatggaaatcagcaagagaagccgttgaagattctagattctgggagctagttgataaagaaagaaatctccacctggaagggaaatgcgaaacatgtgtctacaatatgatgggaaaaagagagaagaaaattggtgagttcgggaaggcaaaaggctcaagggcaatatggtacatgtggttaggagcgcgattcctagaatttgaagccttaggattccttaacgaggatcattggttttcaagggaaaattctcttagtggtgttgagggtgaaggcttacacaaattgggatatatacttcgggaagtaagcaagaaagaaggcggtgctatgtatgctgatgatacagcggggtgggatacccgaattacattagaagacctcaaaaatgaggaaatggtcacgaatcatatggagggggagcataagaaactagcagaagctatcttcaaactaacataccaaaacaaagtcgtcagagtacaacgtccaactcctcgaggaactgtaatggatataatatcccgaagggatcagaggggttccgtacaagtgggtacatatggcttgggaacgttcactaatatgggcgcacagttaataagacaaatggaaggggagggagtatttaaaggcatacaacatcttacggcgactgaagaagttgctgtacaagattggttagccagggtgggtcgtgaacgattgtcaagaatggccatatccggggacgattgcgtcgttaaaccactagacgaccgtttcgcttctgctttaactgcccttaacgacatgggcaaagtcagaaaagacatacaacaatgggaaccatctcggggttggaacgactggacacaagtccccttctgtagtcatcactttcatgaactaatcatgaaggatggtcgcgtcttagtcgtcgcctgtagaaaccaggacgaattgataggcagagcaagaatctctcaaggggcgggctggtcccttagagagactgcctgtttaggcaagagttatgctcaaatgtggtcactgatgtatttccaccgaagagatctacgtttggctgcgaacgcgatttgttcagctgtaccgagtcactgggtcccgacctctcgaacaacgtggtcaattcacgcagggcatgaatggatgaccaccgaagatatgctgactgtatggaatcgagtttggattcaagagaatccatggatggaagacaaaacacccgtagagtcatgggaagaaataccatacctaggcaaaagagaagatcaatggtgtggttcactgataggactaacatccagagcgacttgggcacgaaatatccagaccgcaataaatcaagtaagatcgttaattggttcagaagaatataccgattatatgccaagtatgaaaagattcggacgcgaggaggaagaagcaggcgtattatggtaa

SEQ ID NO: 22212 - RNA, 9876 nt, synthetic construct
  misc_feature 1..9876: note = derived and/or modified CDS sequence (opt6) from DENV-2__KX380809__SS-prME
  source 1..9876: mol_type = other RNA
actgctggaattataatcatgatgatcccaaccgtaatggcatttcacttaacaactcggaatggtgaaccccatatgattgttagcagacaggaaaaaggaaaatcattacttttcaaaacggaaaacggcgtaaatatgtgtacgctgatggcaatggacttgggtgaactctgtgaagatactattacatataattgtcctttacttagacaaaatgaacccgaagatatagactgctggtgtaactcaacaagtacctgggtaacgtacgggacttgtactgcaactggtgaacatcgacgggagaaaagatcggtagcacttgtacctcatgttggaatgggactagaaactagaacagaaacttggatgagttcagaaggcgcatggaaacacgcacaacgtatcgaaacatgggtcttaagacaccctggatttactgttatggcagctatattagcatacacaatcggtacaacttacttccaaagagtcctcatattcatcctccttacggctgtagctccgtcaatgacgatgcgatgtataggaatatcaaatcgtgacttcgtcgaaggtgttagtggaggatcctgggtggatattgtcctcgaacatggatcatgtgtaactacaatggccaaaaataaaccaacattagacttcgaattaataaaaacagaagctaaacatccggcaaccctgagaaaatactgtattgaagctaaactaaccaatactacaacggcttcgagatgtccgacacagggagaacccagcctaaatgaagaacaagacaaaagattcgtgtgtaaacactcaatggtggaccgaggctggggaaacggatgcggactatttggcaaagggggtatagtaacttgcgctatgtttacttgcaagaaaaatatggaaggaaaaattgtacaaccagaaaatctcgaatatacgatagtaataactcctcactccggcgaagaaaatgcggtaggaaacgacacgggaaaacatggaaaagaaataaaagtgacaccgcaatcatccatcactgaggcagaattaacaggatatggaactgcaacaatggagtgttcgcctcgtactggacttgacttcaacgaaatggtgttattacaaatggagaacaaagcatggctcgtccaccgacagtggtttttagaccttccccttccatggctgccaggtgcagacacccaagggagtaattggatccaaaaagaaacgctcgtaacatttaaaaacccacatgccaagaaacaagacgtagtggtcttgggttcacaggaaggggcaatgcatacggcactaacaggggcgacagaaatccaaatgtccagtggtaacttactttttacaggccatttaaaatgccgtttaagaatggataaattacagctcaaaggcatgagctacagcatgtgcacaggtaaatttaaagtagttaaagagattgcagagacacaacacgggaccattgtaatccgagttcaatatgagggcgacggttcaccatgtaaaataccattcgaaattatggacttagaaaagcgtcatgtcctagggaggttaataactgtgaacccaatagtaactgaaaaagactctccagtaaatatcgaagctgaaccgccatttggagatagctacataataattggcgtcgaaccagggcagctaaaattgagttggtttaaaaagggaagctctattggacaaatgttcgaaacaacaatgagaggagcgaagagaatggccatcctaggtgatactgcttgggattttggatcattaggaggagtttttacaagtattggcaaagcactccaccaagtatttggagcaatatacggggcagcattttcaggagtatcgtggactatgaagattcttattggggtagtcataacgtggattgggatgaactcacggagtacatcactaagtgtgagccttgtccttgtaggcattgtaacactgtatttaggagttatggtacaagctgattcgggatgcgtcgtatcttggaaaaataaagaattaaagtgtggatcaggaattttcataacagacaatgtacacacctggactgaacaatacaagtttcaaccagagtctccgtctaaactagcatctgcaatacaaaaagcacacgaggaaggaatatgcgggataaggagcgtaacccgactagaaaatctcatgtggaagcagattacccccgaactaaatcacatccttagcgaaaatgaagtgaaactcacaataatgacaggggacataaaaggtatcatgcaggcaggaaaaaggagcttgcgtccccaaccaacggaattaaagtatagttggaaggcatggggaaaggcaaagatgttaagtaccgaactacataatcacacatttttgatagatggaccagaaactgcggaatgtcctaatacaaatagagcttggaacagtttagaggtcgaggattatgggtttggggtatttacaaccaatatatggttaaaactcaaagagcgacaagacgttttctgcgatagcaaattaatgtcggcagcaataaaagacaatagggcagtacatgcagacatgggatactggatagaaagtgcattaaatgacacatggaaaatagaaaaagcatcatttatagaggtgaaaagttgtcactggccgaagagtcacacgctatggagcaatggagttttagagtctgaaatgattattcccaaaaactttgcgggaccagtgtcgcaacacaactacagaccaggttatcatacacaaacagcgggaccttggcacctgggaaggctagaaatggacttcgacttctgtgagggaacgacggtggtagttacagaagattgtggcaatcggggaccaagtttgcgaactacgactgcttcaggaaaattaatcactgagtggtgctgtagatcgtgtacgcttccacctctgcgttatcgtggcgaagatggatgttggtacggaatggaaattcggccattaaaagagaaggaagaaaatttggtaaattccctagttacagctggacacggacaaatagataacttcagtctaggagtcttaggaatggccctgtttttagaggagatgttgagaaccagagtaggtacgaaacatgcaatactgttagttgctgtctcctttgtaacactaataaccgggaacatgtccttccgggatcttggaagagtgatggttatggtaggagcgacgatgaccgacgacataggaatgggagttacatatcttgctctcttagctgccttcaaagtgcggcctacctttgccgcaggactactactacgaaagttaacaagcaaggaactcatgatgacgacaatagggatcgttttactatcgcaatcaacaattccagaaaccattcttgaattaactgatgcattagcattgggcatgatggttttgaagatcgtcagaaatatggaaaaatatcagttagccgtaactatcatggctatactttgcgtccccaatgcggtcattctccaaaacgcgtggaaagtcagttgcaccattttagcggtagtaagcgtttcaccactattactcacctcatcccaacagaaagctgattggataccgctagcattaaccatcaaagggctcaaccctacggcaatatttttgactacactatcgcgcactagcaagaaaagatcttggcctctaaacgaagcaataatggcggtcggcatggtttcaatcttagccagttctctgctcaaaaatgatatccccatgacaggtccattagtcgcagggggtctattaaccgtttgttacgtattaacaggtagatcagcagacttagaacttgagcgagcagctgacgttagatgggaagaacaagcagagatctctggatcatcaccaattttatcaataaccatcagtgaagatggatcaatgtctattaagaacgaggaggaagaacaaacgttaactattctaataagaaccggacttctggtaataagcggacttttcccagtgagcattccaataacagcagcggcgtggtatctctgggaagtaaagaaacagcgtgcaggagtactttgggatgtaccatctcctccacccgtgggcaaagcggaactagaagacggagcatacagaatcaaacagaaaggtattttaggttactctcaaataggcgcaggagtgtacaaagagggaacttttcatacaatgtggcatgtcacaagaggcgcagtcttaatgcacaagggaaagcggatagaaccatcatgggcggacgtaaagaaagatttaatctcatatggcggaggttggaaattagaaggagaatggaaagaaggcgaggaagtacaagtattagctttagaacccggtaaaaatccgagggctgtacaaactaagccagggctatttaaaactaacacaggcaccataggagccgtatccttagacttttcacccggaacatcaggtagcccgatcgtagacaagaaaggcaaagtggtaggattatacgggaacggagtcgtaacaagatctgggacttatgttagtgctattgctcaaaccgaaaaatctatagaagacaatccagaaatagaagatgatatttttagaaagaaacgcctcacaataatggatctgcacccgggcgccggcaaaacgaaacgttacttacccgctattgtgagggaagccataaaaagaggactacggactctgatactagcaccaacacgggttgtagccgctgaaatggaagaagctcttagaggtcttcccatcagatatcaaactcctgccatcagagcagagcatacaggccgtgaaattgttgacctaatgtgtcatgcaacctttacaatgcggttactatctcccatccgggtaccaaactataatttaattattatggacgaggctcactttacggatccggccagcattgctgcaagagggtatatttctactcgtgttgaaatgggggaggctgctggaatatttatgacagccacaccgccgggaagtcgtgatccatttccacaatccaatgctccaattatggatgaagaacgagaaatacctgagaggtcctggaatagcggacacgaatgggtaacagacttcaagggaaagactgtgtggtttgttccatccataaaagcaggtaatgacatagccgcttgtctgaggaaaaacggcaagaaagtcatacaactgtcacgaaaaacttttgattcagaatatattaagacacgaacgaacgactgggatttcgtagttacaactgacatatcagagatgggtgcgaactttaaagctgaacgtgtaatagatcctagacgatgtatgaagcctgtaattctaacagatggagaagaaagagtcattctagcaggacctatgcctgtgacacacagctctgcagcacaacgcagggggagagtagggaggaaccctaaaaatgagaatgaccagtatatatatatgggcgaaccattggaaaatgacgaagattgtgcccactggaaagaagcaaaaatgttattggacaatatcaataccccagaaggcataattccatctatgtttgaaccagaaagagaaaaagtcgatgcaatagatggcgaatacagactaaggggtgaagccagaaaaacctttgttgacttgatgaggcgcggagatctaccagtgtggctagcttacagagttgcagctgagggaataaactacgcagatagaagatggtgttttgacggagtcaaaaataatcaaatcttggaagaaaatgttgaagttgaaatctggacaaaagaaggagaaagaaagaaattaaaaccaagatggctggacgcaaggatatactccgaccctctagctttgaaagaatttaaagagttcgcagccggaagaaaaagtctcactttgaatttaatcacagaaatgggcagattaccaacattcatgacgcagaaagcaaggaatgccctcgacaacctagcagtgttacacacagcagaagcaggaggtcgagcctacaatcacgcattatctgaactacctgagaccttagagacactactactactaacccttcttgcgacagtaaccggaggaatttttctgttcttgatgtcaggcaaaggcataggcaaaatgactctagggatgtgttgcatcattacggcaagtatacttctttggtacgcgcaaatacaaccccattggattgcagcatcaataatattagagttctttttaattgttttgttaatacccgagcctgaaaaacagagaacaccccaggacaaccaactaacatacgtagtaattgcaattctaactgtagtagcagccactatggcgaacgaaatgggatttttggagaaaactaagaaagattttggacttgggagtatcaccacgcaacaacctgacagtaatatactagatattgacttacggccggcaagtgcatggacactatatgcagtagccaccacctttattacgccaatgctacgtcatagcatagaaaatagcagcgttaacgtatctctaaccgcaattgcaaatcaagctacagtactgatgggtttaggaaagggatggccgttatctaagatggacataggagtcccgttgctcgctataggatgctacagtcaagtgaatccaatcacgttaaccgcggcgttactgttgttagtggcacactatgctataattggacctgggttgcaagcaaaagcaactcgagaggctcaaaaacgcgctgccgcgggtataatgaaaataccaacagtagacggaattaccgtaattgacttagacccgataccatatgatccaaaatttgaaaagcagttaggacaagttatgttacttgtgttatgcgttacacaggtactcatgatgcggacaacttgggccttatgtgaggctttaactttggcaacaggtcctatctcgacgctatgggaaggaaacccggggaggttttggaatacgacaattgctgtatctatggcaaacatttttagagggagctatttggcaggagcaggactattattctctatcatgaaaaatacggcaaatactcgcagaggtactggaaatacaggtgaaacattaggagaaaaatggaaaaatagactcaacgcgttaggtaaaagcgaatttcaaatatacaagaagtcagggatacaggaagtagaccggactttggcaaaagaaggaattaaacggggtgaaacggaccaccacgctgtctcaaggggttctgcaaaattacgttggttcgtggaacgtaacttagttactccagaaggaaaagttgttgacctaggttgcggtagaggcggatggtcctactattgtggaggcttgaagaacgttaaagaagttaaaggtcttactaaaggtgggccagggcatgaggaacccatcccgatgagtacatacggttggaatctcgttcgattacagtctggtgtagacgtgtttttcacaccgccagagaagtgcgacacactactctgcgatataggagagtcatcccctaaccctacagtagaggccggcagaacgctaagagtcttaaatcttgtagaaaattggctaaacaataacacacaattttgcatcaaggtattgaatccatacatgccaagtgttattgaaaagatggaagccctacaaagaaaatatggaggtgcattagttcgaaacccactcagtcgaaatagtacccacgagatgtactgggtttcgaacgcatccgggaacatagtatcgtcagtaaacatgatctctagaatgctaataaaccggttcacaatgaaacataaaaaggcaacgtacgaaccagacgtggaccttgggagcggaacaagaaacataggaattgagtcagagacacctaacctagacataatcggaaaacggatagagaaaatcaaacaagagcatgaaacatcttggcattacgaccaggatcacccctacaagacttgggcatatcacggaagctacgaaacaaaacaaacaggcagtgcgtcatctatggtcaacggtgttgtgcgtttgctgacaaaaccatgggatgttattccgatggtaacacagatggctatgacagatacaacaccattcggacaacaacgtgtctttaaagaaaaagtagacaccagaactcaggaaccaaaagaaggtaccaaaaagctaatgaagataaccgcagagtggctatggaaagaattaggtaaaaagaaaacaccccgcatgtgtacaagagaagagttcactcggaaagtcaggtcaaacgccgcactaggagcaatctttacagatgagaataaatggaaatccgcgagggaagcagttgaagacagcggcttctgggaacttgtggacaaagaacgtaatctacatctggaaggtaaatgtgaaacatgcgtatataatatgatgggcaagcgggagaagaaattaggtgagttcggaaaagcgaaaggctccagagccatatggtatatgtggctcggggctaggttcctagagtttgaagcattgggatttctcaatgaagatcattggttttcaagggaaaattccctctcaggtgtagaaggggaaggattgcacaagttggggtacatcctacgtgatgtatcgaagaaagagggaggtgcaatgtatgccgatgataccgcgggctgggatacgaggataaccctagaagacttgaaaaatgaagaaatggttactaaccatatggaaggagaacaccggaaactagcagaagcaatattcaggttaacatatcaaaataaagtagtacgtgttcaaagaccaaccccgcgaggaacagtaatggatataatcagcaggagagatcaacgcggtagcggacaagttgttacttatggacttaatacatttaccaatatggaagcacaattaattcgtcaaatggaaggggaaggagtgtttaaatcaattcaacacctgaccgtaacggaagaaatagcggttaaaaattggctcgaaagggttggcagagaacggttaagtagaatggccattagtggtgatgattgtgtcgtcaagccacttgacgacagatttgccagcgcgcttacagcactaaatgatatgggtaaagtaaggaaagatatccaacaatgggagccaagcagaggatggaacgattggactcaagttcctttttgttcccatcacttccacgaacttatcatgaaggatggaagagtattagtagtaccatgcagaaatcaagacgaattaataggccgagcacgaattagccaaggggcaggctggagcttgagagagacagcgtgcttagggaaaagctatgcacaaatgtggtcactcatgtattttcatcgacgagaccttagactcgcagcaaatgcaatctgttccgcagtaccatcacactgggtccccacttcaaggacaacctggagtattcacgcaacacatgagtggatgacgaccgaggatatgctcaccgtctggaatagagtgtggatccaagaaaacccgtggatggaagacaaaacccctgtcgagtcctgggaagaaataccgtatcttgggaagcgtgaggaccaatggtgcggcagtttgatcggattaacaagtagagctacatgggccaaaaatattcaaacagctatcaaccaagttaggtcgttgattggaaatgaagaatatactgactatatgccatcaatgaaaaggttcagacgcgaagaagaagaagccggtgtactatggtaa

SEQ ID NO: 22213 - RNA, 9876 nt, synthetic construct
  misc_feature 1..9876: note = derived and/or modified CDS sequence (opt6) from DENV-2__KX380810__SS-prME
  source 1..9876: mol_type = other RNA
actgctggaattataataatgatgataccaacagtaatggcatttcacttgacaacaagaaacggagaaccacacatgatagtatcgcggcaggaaaaaggcaaatcgctattgtttaaaacagaaaacggcgtgaatatgtgtacccttatggccatggacctaggagaattatgcgaagacacaataacttataattgtcccctgctgagacaaaatgaaccggaagatatagattgctggtgtaatagcacatcaacctgggtcacttatggaacttgcacggcaaccggtgaacacagaagagaaaaacgatccgttgctctagtcccacatgtcggaatgggtctcgaaacacgaacggaaacctggatgagtagcgaaggcgcatggaaacatgcccaaagaattgaaacatgggtgctccgccacccgggatttaccgtaatggcagctatacttgcatataccataggtaccacatattttcaacgcgtgcttattttcatattgttgactgctgtagccccttcaatgactatgcgatgcataggtatcagcaacagagactttgttgaaggtgtaagtggcgggagttgggtggacattgtgctagaacacggatcttgtgtgacaacgatggctaaaaacaaaccgacactagacttcgaactaatcaaaaccgaagcgaaacaccccgctactttgcgtaaatattgtatagaagcgaaactcactaacactactacggccagtcgatgtccaacacaaggggaaccatctttaaacgaagaacaagataaacgatttgtatgcaaacacagtatggtagatcgtggatggggaaatggttgtggactatttggaaaaggaggaatagtaacatgcgccatgtttacctgtaagaaaaatatggaagggaaaattgtacaaccagaaaatttggaatacacaatagtgattacaccacactcgggcgaggaaaatgccgtaggaaacgatactggaaaacatggtaaagaaattaaagtcaccccacaatcatccataacggaagcggaattaacgggatacggtaccgcaacgatggaatgttctccgcgaacaggtttggattttaatgaaatggtacttctgcaaatggaaaataaagcatggttggttcatcgacaatggttcctagatttaccattaccttggcttcctggagccgacacacagggttcgaactggatacaaaaagaaacacttgttacttttaaaaaccctcacgcaaagaaacaagatgtcgtggtcttaggcagtcaagaaggtgcgatgcacacagcgttgacaggagcaaccgagattcaaatgtcctcggggaatctcttatttactggccatttaaaatgtcgattaaggatggataagttacaactaaagggaatgagctatagcatgtgcacagggaagtttaaagtagttaaagaaattgccgagacacaacacggaacaatagtaataagagttcaatatgaaggggacggaagtccctgtaaaatccctttcgagataatggacttggagaaaagacatgtgctaggtagattaattacagttaacccaatagttacgggaaaagatagtccggttaacatcgaagcagaaccgccatttggcgactcatatattataattggcgtagagcctggacaacttaaactttcgtggtttaagaaaggatcttcaataggccaaatgtttgagaccaccatgcgaggagcaaagaggatggcgatcttgggggatactgcgtgggatttcgggtcactgggaggagtttttacgtctataggcaaggctttacaccaagtgtttggtgctatttatggtgcagccttctctggcgtctcttggacgatgaaaatcttaataggagtagtgataacttggataggtatgaactctagaagtacatcgttatccgtaagtctggtacttgtagggatagtaacactatatttaggagtaatggttcaagctgattctggatgtgtcgtttcatggaaaaacaaggaactaaaatgcggtagtgggatatttataacggataacgtacatacgtggacagaacagtataagtttcaaccagaatcaccttcaaaattggcttctgctatacaaaaagctcacgaagaaggaatttgcggaatacgttctgtcaccagactggagaatctgatgtggaaacaaatcacacctgaattgaaccacatactctcagaaaatgaagtgaaattgaccataatgacaggtgatatcaaagggataatgcaagctggaaaacgatcgctacgacctcaaccgactgaacttaaatactcatggaaagcatggggaaaagcaaaaatgttatctacggaattacataaccacacatttttgatagatggtcccgagaccgccgaatgtccgaacacgaaccgggcatggaatagcctggaggtagaggattacggattcggtgtgttcacaactaacatctggcttaaacttaaagaacggcaagatgtattttgtgactcgaagttaatgagcgcagcaattaaggataatcgagctgtacatgctgatatggggtattggattgaatccgcgttaaacgacacatggaagatagaaaaagctagcttcatcgaagtcaaaagttgccactggcctaaatctcacactctgtggagtaacggagtattagaatcagaaatgatcattcccaagaatttcgcagggccggtatctcaacacaattatcggcccggctatcacacacaaaccgcaggtccttggcatctgggaaggctagaaatggacttcgatttttgtgaaggtactacggtggtggtaaccgaggactgtggaaataggggaccaagtttaagaactactacagcatcaggtaaactaatcacagaatggtgctgcagaagttgcacgttgcctcccctaagatatagaggtgaggatgggtgttggtacgggatggagataaggccgcttaaagaaaaagaagaaaaccttgtaaatagtctcgtgacagctggacatggtcaaattgataacttcagcttaggagttttagggatggctttgttccttgaagaaatgttgcgcacaagagtggggacaaaacatgcaatactgctagtagctgtgagctttgtgactttaattacaggaaatatgtcatttcgggacctgggaagagtaatggtaatggtaggagcgactatgactgatgatataggtatgggagtaacatacctggcattactagcagcatttaaagtccggccaacattcgccgcaggtttattgctaagaaaattaacaagcaaggaactaatgatgacaaccattggaatagtattattgagccaaagtactataccagaaactattctagagttaactgacgcactcgcattaggtatgatggtattaaaaatagtaagaaacatggagaaataccaattggcagttacaattatggcgatcctctgcgtcccaaacgcagttatacttcaaaatgcatggaaggtatcgtgtacaatcttggcagtagtttcagttagcccacttctattaacctcatcacaacagaaagcagattggattccactagctctgacaataaaaggcctaaatccaacagcaatattcttaactacgctatcacgcactagcaaaaagaggtcttggccattgaatgaagcaataatggctgtaggtatggtaagtattctagcctcatccctcttaaagaatgatattcctatgacaggaccattagtagctggcgggttactcacggtttgttacgttctaactgggagatcggctgacttagaattggagagggcagcagacgtgcgctgggaggaacaagcggagatatcaggtagtagtccaatactatccattacgataagcgaagatgggtccatgagcatcaaaaacgaagaggaagaacagacactaacgatattaataaggactggactattggttatatccggcctttttcctgtaagcatacctatcacagcagcggcatggtatctttgggaagtcaagaaacaaagagcaggagtactctgggatgtcccttctccgccaccagtgggaaaagcggagctagaggacggggcataccggataaaacaaaaaggaatactaggatatagtcaaataggtgctggagtttacaaagaagggacgtttcacaccatgtggcacgtgacacgaggagcagttcttatgcataaaggcaaaaggatagagccaagttgggcggatgtcaagaaagatctgatctcgtatggaggcggatggaaactcgaaggagagtggaaggaaggtgaggaagtacaagtattggcacttgaaccgggcaagaatccgagagcggttcaaacaaaacctgggttatttaaaaccaataccggcacaatcggtgccgtatctctagacttttctccgggaactagcggatcgcctatagtggacaagaaaggaaaggtggtaggattatatgggaatggagtagtaacgcgatccgggacttatgtcagtgctatagctcaaactgagaagtcaatagaagacaacccagaaattgaagatgacatctttaggaagaaaagattaaccatcatggacctacatccaggagctggcaaaactaaaagatatctaccggcgattgtacgagaggccattaaaaggggtttacgaacactaattcttgcacccaccagagttgttgcagcagaaatggaagaagcactcagaggacttccaatacgctaccaaactccggcgatacgtgcggaacacaccggcagagaaatagtggaccttatgtgtcatgcgacgtttaccatgcggttgctctcccctatccgcgtcccaaattacaatctcataataatggatgaagcacactttacagatcctgcgtctattgcagcgcgggggtatatttcaacacgtgtcgaaatgggggaagcggcgggaatattcatgactgcaacaccaccagggtcgcgggatccattcccgcaaagcaacgcgccaatcatggatgaagaaagggaaataccagaacgatcatggaactcaggccacgaatgggtcacagatttcaaaggaaaaaccgtatggtttgtaccatcaataaaagctggaaacgatatagcagcatgtttgaggaaaaatggcaagaaagtaatccaattatccaggaaaaccttcgattcggaatatataaaaacaagaacaaacgactgggatttcgttgttacaaccgacatctcagaaatgggtgctaatttcaaggctgagcgtgttattgacccaagaaggtgcatgaaacccgtaatactaacagacggagaggaaagggtcatcttagccggccctatgccagtaacccattctagtgcagctcagcgaagagggcgagtaggtcgtaatcccaaaaacgaaaacgatcagtacatatatatgggtgaaccattagaaaatgatgaagattgcgcgcattggaaagaggcaaaaatgttactagataatatcaataccccggaaggtataataccatcaatgttcgaacccgaaagagaaaaggtcgatgcgatagatggcgagtatcgtttaagaggagaagcgcgaaagactttcgtggatctaatgcggaggggagatctcccggtttggcttgcttatagagtggctgccgaaggtatcaattacgcagaccgtcggtggtgtttcgatggagtgaaaaacaatcaaatactagaagaaaatgttgaagtagaaatatggaccaaagagggggagcgaaagaaactaaaaccgcgatggttagatgcacgaatatattctgatccactagcgctaaaagaatttaaagagttcgcagctggtaggaaaagtttaacactaaatctaattacagaaatggggcgattaccaacgtttatgacacaaaaggcaagaaatgctctagacaatcttgccgttttgcatacagcggaagctggtgggagagcatataatcatgccttaagcgagctgcccgagacgctagaaacattactattgctgaccttactagctacagtaacgggaggaatttttctgttcctaatgagcggtaagggtataggaaagatgacattgggtatgtgctgtataataacagcctcaatcttattgtggtatgcgcaaatacagccacactggatagcagcatcaataatactagaatttttcctgatagtattacttataccggagcccgaaaaacaaaggacaccacaagataatcaacttacttatgtcgtaatagcaatactgactgtagtcgcagccacgatggccaatgagatgggatttcttgagaaaacaaagaaagactttggcctaggatcgatcacaacccaacaaccggatagcaatatcctagacatagacctgaggccggcatcggcctggacactctacgcagttgcgacaacgttcatcacaccgatgttaagacattctatagaaaacagttcggtaaatgtatcgttaactgccatagcgaaccaagcaacagtactaatgggacttggaaaaggatggccactaagtaagatggatataggagtacccctcttagcgattggatgctacagtcaagtgaatccaattaccttaactgctgccttactattattggttgcacattacgccataataggcccaggattacaagctaaagcaacaagggaagcgcaaaagcgagcagcggcaggcattatgaagataccggcagctgatattggaacggttatagacctcgaccctataccttatgacccaaagtttgaaaaacaattgggacaagtaatgctactggtattatgttccactcaagtacttatgatgaggacgacttgggctctatgcgaagccttgacacttgcgacaggaccaatcagcactctttgggaaggcaacccaggacggttctggaatactactatcgcagtctctatggctaatatcttccgtggctcatacttagcgggagctgggttactcttctcaatcatgaagaatactgccaacacacgtaggggaacaggaaatacaggagagaccttaggagaaaaatggaaaaatcggctaaatgcgctaggcaaatccgaatttcaaatttacaagaaaagcggaatccaggaagttgataggacgcttgcaaaagaaggcattaaacgtggtgaaacggaccatcacgcagtatctcgagggtcagcaaaactcaggtggttcgtagaaagaaaccttgttacaccagaaggcaaagtagtagatctaggttgcggcagaggaggttggagttattattgcggtgggctcaagaatgtgaaggaagtgaaagggctaactaagggtggacctgggcatgaggaaccaatcccgatgtctacctatggttggaatttggtaagattgcagtcgggagttgatgtattctttacacccccagagaaatgcgacaccctactgtgtgatattggcgagtcatctccaaatccgacggttgaagctggccgaacgttacgtgtcttaaacctagtagagaactggttaaataacaatacacaattttgcataaaagtgctcaacccatatatgccgtctgttatagagaaaatggaggcgttgcaacgtaaatatggaggagcactcgtcagaaatcccttatcacgaaattctacacatgaaatgtattgggtaagtaatgcatctggaaacattgtcagctcagtaaatatgataagtcgtatgcttattaatcgcttcacaatgaaacacaagaaagccacatatgaacctgatgttgatttaggcagtggcacgcgaaatatcggaatagaatccgaaacccccaatttggacattatcggcaaaagaattgagaaaattaaacaagagcacgaaacgtcgtggcattacgatcaggatcacccatataaaacttgggcttatcatgggagctacgagactaaacaaacgggcagtgcgtcatctatggttaatggagtagtgcgacttttgaccaaaccatgggatgtgatcccgatggttacgcaaatggcaatgactgatacaacgccgttcggacaacagcgagtattcaaagaaaaagtcgatacacgaacccaagagccaaaggaaggcacaaagaaattaatgaaaataactgccgaatggctttggaaagaactaggtaagaagaaaacaccaaggatgtgtacgagggaagagttcacacgaaaggtccgctccaatgcggcactaggagcaatatttactgacgagaacaaatggaaatcggcaagagaggccgtagaggactccggcttttgggaattagtcgacaaggagagaaaccttcatttggaaggaaaatgtgaaacatgtgtttataacatgatgggaaaacgagagaagaaattgggggagttcggcaaagcgaaaggaagtagggccatatggtatatgtggctaggcgccagatttttggagttcgaagcactaggcttcctaaacgaggaccattggttttctagagaaaattcgttgagtggtgttgaaggggaagggctacataaactcgggtatatattaagagacgtgagcaaaaaggaaggaggtgccatgtacgcagacgatacggctggatgggatacccgaatcactctagaagacctcaaaaatgaagaaatggtcacaaatcacatggaaggggaacacagaaaactggcagaagccatattcagactaacctaccagaacaaagtagttagggtccaacgacctactcctcgaggaacagtaatggacataatttcacgtcgagatcaacgtggaagtgggcaggtagtaacttacggtttgaacacattcactaacatggaagcgcagttaattcgccaaatggaaggagagggtgtattcaaaagtatacaacatttaacagttacggaagaaattgcggtgaaaaattggcttgaaagagtaggaagagaacggctaagccggatggcaatatcaggtgacgactgtgttgttaaaccgctggacgaccgattcgcgagcgcacttacagcattaaatgatatgggaaaagttagaaaagacatccagcaatgggaaccctcgcgaggctggaatgattggactcaagtacctttttgttcacaccactttcatgaattaataatgaaggatggcagagtccttgttgtaccttgtcggaaccaagatgaattaataggcagagctaggatttcgcaaggggccggttggagcttaagagagacagcctgcctcggaaaatcatatgctcaaatgtggagtctaatgtattttcatcgaagagacttgaggctagcagcaaatgccatctgttccgcagtcccaagtcattgggtaccaatcagccggaccacttggagcatccatgcaactcacgaatggatgaccactgaggacatgctgacagtgtggaaccgtgtctggatacaggaaaatccgtggatggaagataaaactcccgttgaaagttgggaagaaattccttatctgggcaaaagagaagatcaatggtgtggcagtcttataggcctaacaagcagagcaacttgggccaaaaatatccagacggcgataaatcaagtaaggagcttaatagggaacgaagaatatactgattacatgccaagtatgaagagatttcgacgcgaggaagaagaagctggtgttctatggtaa

SEQ ID NO: 22214 - RNA, 9876 nt, synthetic construct
  misc_feature 1..9876: note = derived and/or modified CDS sequence (opt6) from DENV-2__KX380811__SS-prME
  source 1..9876: mol_type = other RNA
acagcggggattataataatgatgatacccaccgttatggcatttcatctaactacaagaaacggagaacctcatatgattgtgagcagacaagaaaaaggaaaaagcctgctattcaaaactgaaaatggtgtgaatatgtgtacattgatggctatggatctaggtgaactatgtgaagatacaattacatataactgtccattactacgacaaaacgaacccgaagacatagattgttggtgcaattctacttctacctgggtaacatacggaacctgtactgctactggggaacaccgtagagagaaacgatctgtcgctttagttccgcacgtcggtatgggtcttgaaactagaacagaaacctggatgagcagcgaaggagcctggaaacatgcccaaagaatagaaacctggattttgcgtcaccccgggttcacaataatggcggcaatcctagcgtatacaataggaactacatatttccaacgtgtactaatctttattttacttacagctgtaactccatcaatggccatgcgatgcatagggataagcaatagagatttcgtagaaggggtatcaggtggatcttgggtggacattgtacttgaacatggatcgtgcgtaacaactatggctaaaaacaaaccgactctggattttgaactgatcaaaactgaagcgaaacatctagctacactcagaaaatactgcgtggaagctaaattaacgaacacaactacggcatcgagatgtcccacccaaggtgaacctagtctaaatgaagaacaagataaaagatttgtgtgcaaacattcaatggttgaccggggctggggtaatggatgcgggctctttgggaaaggtggaatagtgacgtgtgctatgtttacatgtaagaagaatatggaaggaaaggtggtacaaccagagaatctcgaatatacgatagtaatcacacctcattccggcgaagaaaatgcggtcggtaatgatacaggaaaacatggcaaagaaatcaaagtaactccgcaatcttcgatcactgaagcagaacttacgggctacggcacagtcactatggaatgtagtccgcggacaggtcttgattttaacgaaatggtattattgcagatggaaaataaagcatggttggtacatagacagtggtttttagacttacctttgccgtggctaccaggggcagatacccaagggtcgaactggatccaaaaagaaacgctagtaacctttaaaaaccctcacgcaaagaaacaagacgtagtagtattaggttcacaagagggagcgatgcataccgcacttaccggagcaaccgaaatccaaatgtcatctggtaacctgctattcaccggtcacttaaaatgtcgtctaagaatggacaaattgcaactcaaaggaatgtcttactcgatgtgcacgggtaaattcaaagtcgtaaaagaaatagcggagacccaacacggaacgattgttatccgagtgcaatacgagggagatgggagtccatgtaaaatcccatttgaaatcatggatttggagaaaagacatgtacttggcagattaataaccgttaacccgattgtaactgaaaaagatagtcctgtgaatatagaagctgaacctccattcggtgacagttatataatcataggcgtggagcctggtcaattaaaactgagttggttcaagaaaggatcttcaattggacaaatgtttgagaccactatgagaggagcgaaaagaatggcaatattaggtgataccgcatgggacttcggcagcttgggaggagtattcacttcaattggaaaggctttacatcaagttttcggagctatatatggggcagcgtttagtggcgtcagttggaccatgaaaattttaataggggtagtcataacgtggataggtatgaactcaagatcaacttccttatcagtctctctagtcttagtcggagtagttacactttatcttggcgtgatggtacaggctgacagtggttgtgttgtgtcatggaaaaacaaagaactcaaatgcggttcaggaatatttataacagataatgtacacacatggacagaacaatacaaattccaacccgaatcaccgtcgaaattagcatcggcgatacagaaagctcatgaagagggaatctgtggaataagatccgttactagacttgaaaaccttatgtggaaacagataacgcccgaactaaatcatattctcacagaaaacgaggttaaattgacgatcatgactggagacattaaagggataatgcaggcaggaaaaaggtcattgagaccgcaaccaacagaactaaaatactcttggaaagcatggggaaaagcaaaaatgttatcaacagagttacataatcatacatttctcatagatggacccgaaactgctgagtgcccgaatacaaacagagcatggaactcattagaggtagaagactatggatttggagtcttcacaacgaacatatggctaaaactcaaggaaagacaggatgtgttctgcgattcgaacctaatgagcgccgctatcaaggacaatagggctgtacatgcagacatggggtattggatagagagtgcacttaatgatacatggaaaatagagaaggcgtcgtttattgaggtaaaatcttgccattggccgaaatcgcacactctttggagtaacggggttttagaatcagaaatgattataccaaagaatttcgcgggtccggtatcacaacacaattatagacctgggtaccatacacaaacagcgggaccctggcaccttggtagattggagatggattttgatttttgtgaaggaacgacagtagtggtaacggaagattgcggaaatagaggacctagcctgagaacgacaactgcatcaggtaaactcattacagaatggtgctgtaggagctgcacactaccaccattgagatatagaggcgaagatggatgctggtacggcatggaaatacgaccgcttaaagaaaaagaagaaaatctagtaaactctttagtaaccgctggtcatggacaaattgataactttagtctcggcgtactaggtatggcgttattcctagaagaaatgctgagaactcgagtgggtactaagcacgcaatcctattggtggcagtatcatttgtaacattaataacagggaatatgtcatttcgggatttaggaagggttatggtaatggtgggagcgacaatgaccgatgatataggaatgggagtaacctatttagcactactggctgcctttaaagtaagacctactttcgcagcgggattattgctgagaaagctgacttcgaaagaactaatgatgaccacaatagggatagttctactatcacagagtactatcccagagtctattctagaactaacagacgcactcgctttgggcatgatggtgttaaaaatagttaggaatatggagaaatatcagttagcagttactataatggctatcctctgcgtgccaaatgctgtcattctccaaaacgcttggaaagtatcatgtacaacgttagctgtagtttcagtgagcccactcctactaacctcaagtcaacagaaggcagattggataccactagccttaacaataaaaggattaaacccaacggctatctttttaacaaccctttcaaggacgagcaagaaaagaagttggcccctgaacgaagctattatggcagttggtatggtatcaatattagcaagcagccttctcaaaaatgatataccaatgaccggaccactcgtcgcaggaggtctgttaacagtctgttatgttttaactggacgttcggcggatttagagttagaacgggccgcagacgtaaggtgggaagaacaagcagaaatatccggcagttctcctatattaagtataacaatatcagaagatggtagtatgtccatcaaaaatgaagaagaggagcaaacactgaccatcttaataagaacgggtctccttgttataagtggattatttcccgtgtctattccgataacggcggctgcctggtacttatgggaggtgaagaaacaaagagctggagtattgtgggatgtcccaagcccacccccagtaggaaaggctgaattggaggacggcgcctatcgaataaaacaaaaaggtatattaggatattcgcaaataggagcaggcgtatataaagaagggacatttcataccatgtggcatgtaaccaggggtgctgtattaatgcataaaggaaaacgcatagagcccagttgggcagacgtaaagaaagacttgatctcatatggcggaggatggaaactcgaaggagaatggaaagagggtgaagaagtacaggtactcgcattggaaccaggtaaaaatccacgcgcagtccaaacaaaaccgggactatttaaaacgaataccggcacaataggggccgtgtcgttggacttctcgcccgggacttctggatctccgattgtcgacaagaaaggcaaagtagtaggattatacggtaacggtgttgtaacaagaagcggaacgtatgtgagtgccatagctcagacggagaaaagtattgaagacaacccagaaatagaagatgacatatttaggaagaaacgactgacaataatggatcttcacccaggggcgggaaaaactaaaagatacctccccgcgatagtaagagaagcaatcaaacgaggtttaagaacattaatattagctcctacaagagtcgtcgcagctgaaatggaagaagctctcaggggacttcccattcgataccaaaccccagcaatacgagcagaacacaccggtagggaaatcgtcgacttgatgtgccacgcaacatttaccatgcgtcttttaagtccgatacgagtaccaaactataatttaatcatcatggacgaagctcattttactgatcccgcgtcaatcgccgcacggggttacattagcacacgcgtcgaaatgggcgaagccgcagggatatttatgacagcaacgcccccaggatcgcgggatccctttccccaatcaaacgctcccattatggacgaggaaagagagatccccgagagaagttggaactcgggacatgaatgggtgaccgacttcaaaggcaaaacggtctggttcgtaccaagtataaaagcgggcaatgatattgccgcatgtttacgaaagaatggaaagaaagttatccagttgtcgagaaaaacattcgatagtgaatatataaaaacaagaacaaatgattgggattttgtcgtaacaacagacataagcgagatgggggctaattttaaggcagaacgtgtcatagaccctcgaagatgcatgaaaccagtaatattaaccgatggagaggagagagttatcctcgcaggtccaatgccagtaacccacagcagtgcagcgcaacgtaggggaagagtggggagaaaccctaagaatgaaaatgatcaatatatatacatgggagagcctttagaaaacgacgaagattgcgcacactggaaagaagcaaaaatgctgttggataacattaacactccggaaggcatcatacctagcatgtttgaaccggagagagaaaaagtggacgccatcgacggtgaatataggcttcgcggagaggctcggaaaactttcgtcgacctcatgcggagaggggatttgcccgtttggttagcatatagagttgctgcagaaggaattaattacgccgacagaagatggtgctttgacggggtcaaaaataatcaaatattagaggaaaatgtggaagtagaaatatggactaaagaaggagaaaggaagaaattgaaaccaaggtggctagacgcacgcatatatagtgacccattggcgctcaaagagtttaaagaatttgcagccggacgtaagtcactcaccttgaatctcataacagaaatgggacgtctccccacgtttatgactcaaaaagccaaaaacgcattggataatttggcagtcttacataccgcggaggcagggggtagagcttacaaccatgcactaagtgaattgccagaaacgttagaaactttgttattgttgactctattagcgacggttactggcggaatattcttattcctgatgagtggaaagggaataggaaagatgaccttaggaatgtgttgcataatcacagcctccattctgttatggtatgcgcaaattcaaccccactggatagctgcctctataatattggagttcttcttgatagtgctattaatacctgagccagaaaaacaacggacaccccaagacaatcagttgacatatgtcgtcatcgctatattgaccgtcgtagcagcaacaatggccaacgagatgggatttttagagaaaacaaagaaggatttcggactaggaagcattaccactcaacaaccagaatcaaatattttagacattgatctaaggcctgcatcggcttggactttatatgccgtagctactacattcataaccccaatgttaagacatagtattgaaaacagctcagttaacgttagcttgacagctatagccaaccaagcaactgtactaatgggtttaggaaaaggatggcccttaagcaagatggacattggcgtgccactattggcaattggttgttactcccaagttaacccgataacattaactgcagcgttactactactggtcgcccactatgcgataataggtccagggctacaagccaaagctacaagggaagctcagaaacgtgcagcagccggtataatgaaaattccaacagttgacggtatgaccgttatagaccttgatccgataccctatgatcctaaattcgaaaagcaactaggccaggttatgttattagtactgtgcgtaactcaggtactcatgatgcgtacaacatgggccctgtgcgaagcactaaccctagccacagggccaatatcaaccctatgggaaggcaatcctggacgtttttggaatacaaccatagcagtaagcatggccaatattttcagaggttcttatctagcaggcgctggactactattctccataatgaagaatactgccaatacaagaagaggaacagggaatacaggagagactctgggggaaaaatggaagaataggttaaacgcgcttggaaagtcggagttccaaatatataagaaatcaggcatacaagaggttgacaggacgctggcaaaagaaggaataaaaagaggagagacagaccatcatgccgtttcacgaggttcagcgaagctaagatggttcgtagagcggaatctagtaacaccagaaggcaaggtagtagatttaggatgcggacggggaggctggtcatactattgtgggggattaaagaatgtaaaagaagtgaagggcttaacgaaaggcggccccggacatgaagaacctataccaatgtctacgtatggatggaacttagtaagattacagagcggagttgatgtattctttacacccccagagaaatgtgatactctcttgtgtgatattggggagtcatctcctaatcccactgttgaagcaggacgaactttaagagtcctaaatttagtagagaactggttaaacaataatacacaattttgcataaaagtattaaacccctatatgccgtcagttatcgagaaaatggaagcccttcaacgcaaatacggaggagctctagtaaggaaccctcttagtagaaactcaacacacgaaatgtattgggtgagtaacgccagcggaaatatagtaagctcagtaaacatgataagtcgaatgctcataaatagattcacgatgagacataagaaagcaacgtatgagccagacgtcgatttaggaagtggaacgaggaatataggtatagagtcagagacacctaacctcgatattattgggaagcgtatagagaaaattaaacaggaacacgaaaccagctggcattacgatcaagaccatccttacaaaacgtgggcatatcacggaagctacgagactaaacaaacaggttcagccagctcaatggtaaacggagtagtaagactactcactaaaccatgggatgtaattcccatggtaactcaaatggctatgacggataccactccattcggtcaacaaagagttttcaaagagaaagttgacacacgtacacaagagcccaaggaaggaacgaaaaagttgatgaaaataaccgcggagtggttatggaaggagctcggtaagaagaaaacgccgcgtatgtgcacaagagaggagtttacgagaaaagtcagatctaatgcagcgttaggagctatttttaccgatgaaaacaaatggaaatctgccagagaagcagtagaagattctggtttctgggagctagtggacaaagaacgaaatctgcacttggaaggaaaatgcgaaacatgtgtgtacaatatgatgggaaagcgagagaagaaattgggagagtttgggaaagcaaaaggtagtcgcgcaatctggtatatgtggctaggggccagatttctagaatttgaggcactgggatttttgaacgaggaccactggttctctagggaaaattcattatctggagttgagggagaaggtcttcataaactgggatatattttacgcgacgttagtaagaaagagggtggagctatgtatgcagacgatacggccggctgggacacgagaatcaccttagaggacctcaaaaatgaagagatggtcactaaccatatggagggagagcataagaaattggcggaagcgatatttaaacttacctatcaaaacaaagtagtaagagtacagagaccaacgccccggggaacggtcatggacattatctcacgaagagaccaaagaggaagcggccaagtcgtgacatatgggttaaacaccttcacgaatatggaggcacagttaatcaggcaaatggaaggagaaggtgtattcaagtcaatacaacaactcacggtaaaagaagagattgctgttaaaaactggttaataagggtaggaagagaaaggctatcccgaatggcgatatcgggagacgactgtgtagtgaaacctctagatgaccgatttgcatccgcgttgacggcactaaatgatatgggaaaagtaagaaaagacattcaacaatgggaaccctcaagaggatggaacgattggacacaagtgcctttttgctctcatcattttcacgaacttataatgaaagatggacgagttcttgtagtaccgtgtcggaatcaagacgaattaattggacgcgctaggattagccaaggagctggatggtcattgagagagacagcctgcttgggaaagtcctacgcacaaatgtggagtttgatgtactttcatcggagggatctaagactagcagcaaatgcaatctgctcagcagttccgagtcattggatcccgacatcaagaacaacatggagtatccacgctactcacgagtggatgacgacagaagatatgttaacggtatggaacagagtctggatccaagagaatccatggatggaagacaagactccagtagaatcttgggaagaaatcccatacctcggaaaaagagaggaccaatggtgcggctccttgatcggacttacatcacgcgccacatgggctaagaatatacagaccgcaataaatcaagtaagaagtttaatcggaaacgaggaatacacggattacatgccctcaatgaagcgatttagaagggaagaagaagaagcaggagtactgtggtaa

SEQ ID NO: 22215 - RNA, 9876 nt, synthetic construct
  misc_feature 1..9876: note = derived and/or modified CDS sequence (opt6) from DENV-2__KX380813__SS-prME
  source 1..9876: mol_type = other RNA
actgctgggattataataatgatgatacccacagtaatggcattccacttaactactagaaacggtgaaccacatatgattgtatcacgtcaggagaaaggaaaaagtttgcttttcaaaaccgaaaatggagtaaacatgtgtactcttatggcaatggacttaggggaattatgtgaagacacaataacctacaattgcccattattgcggcaaaacgagcctgaagatattgattgttggtgtaacagtacgtcaacttgggtgacatacgggacatgtacagcgacaggagaacaccgaagagagaaacgttccgtagctttagtaccccacgtgggaatggggcttgaaacgcgaaccgagacatggatgtcaagtgaaggagcttggaaacatgcacaacgaattgaaacttggatcctaagacacccaggattcaccataatggcagcaatacttgcatatactattggaacgacctactttcagagagtgctaatattcatattactcactgctgtaacgccatcgatggcaatgaggtgcataggaattagtaatcgggattttgtagaaggtgtgtccggtggatcatgggtagatatcgttctggagcatggaagttgtgttacaacgatggctaaaaacaaacctactttggattttgaactaataaaaacagaagccaaacacttagcaactttaagaaaatactgcgtagaggcaaaattaacaaatacaacaacagcaagtagatgtccaacacaaggagagccgtctcttaatgaagaacaagacaaacgatttgtatgcaaacatagtatggtcgaccgaggatggggaaacggatgtggactattcgggaaaggaggaatagtgacatgtgcaatgttcacttgtaagaaaaatatggaagggaaagtagtgcagccagaaaatcttgaatataccattgtaatcacccctcatagtggggaagaaaatgcggtaggtaatgatactggtaaacatggtaaagaaattaaagtcacaccccaatcctccataacagaggccgagctaacaggttatggtactgttacaatggaatgtagcccccgtactggacttgattttaatgaaatggttttacttcaaatggaaaacaaagcatggttagtacatagacaatggttcctagatttaccgttgccttggttgccgggagctgatacacagggaagtaattggattcagaaagaaactctagttacatttaaaaatcctcacgccaagaaacaagatgtagtagtgctaggatctcaagagggggcgatgcataccgcccttacgggggcaaccgagatacagatgtcaagcggtaatttattattcactggacatttaaaatgtaggttaagaatggataaattacaacttaaaggaatgagttactctatgtgtacgggaaaattcaaagttgtaaaagaatctgccgagacgcaacatggaactattgtaattagagttcaatatgaaggcgacggctcgccatgcaaaatcccgtttgaaatcatggatctggagaaacgacacgttttgggaagattgataacggttaatcctatcgtcaccgagaaagactctcccgtaaacatagaggccgaacctccgtttggtgattcatacattattatcggcgtagagcctggacaacttaaactaagttggtttaagaaaggttcatcaataggccaaatgttcgaaacaactatgagaggtgcaaaacggatggcaatcttaggggatactgcatgggatttcggcagcttaggaggagtatttacttcaataggtaaggctttacatcaggtgtttggagcgatatatggagcagcgttctccggagtttcatggacaatgaaaattttaataggtgtggttatcacatggataggtatgaactctaggtcgacaagcctatccgtcagtttggtacttgtaggggtagtgacactatatttaggagttatggttcaagccgacagtggctgtgtagtatcgtggaaaaataaagagttaaaatgtggaagtggtatctttataaccgataatgtacacacttggacggaacagtacaaatttcaacctgaatcgccatcgaaacttgcgtctgccatacaaaaagcccatgaagaaggaatatgcggaatacgaagtgtgacaaggctagagaacttaatgtggaaacagataactcccgaactaaatcacatattaacggaaaatgaagtcaaattgaccatcatgactggtgacataaaaggaataatgcaagctggaaaacgaacattgagacctcaacccacggaattgaaatacagttggaaggcttggggaaaagccaaaatgttatctacagagctgcacaatcacacgttcttaatagatggacctgagaccgcagaatgtcctaatacgaaccgagcatggaatagtctggaagttgaagattacggctttggagtttttaccactaacatatggttaaaactaaaagaaaggcaagacgttttctgtgattcaaaattaatgagtgcggctattaaagataatagagcagttcacgccgatatgggatattggatcgaatcagcattaaacgacacgtggaaaatcgaaaaagctagttttattgaggttaaatcttgtcactggccaaaaagccatactctatggagcaatggagttttagagtcggaaatgattatcccaaagaatttcgctggacccgtaagccaacacaactatagaccaggataccacacccagactgccggaccatggcacctagggaggctagaaatggattttgatttctgtgagggaactacagttgttgtaactgaagactgtggcaataggggcccgtcgctgcgaactacaacagcatcaggcaaactgattaccgagtggtgttgtaggagctgtactctaccacccttgcgatatcgtggagaggatggctgctggtatggcatggaaatacgaccactaaaagaaaaagaagaaaatctcgttaactcactggtaactgcaggccatggacaaatagacaatttctctctcggagtattaggcatggcccttttcctggaggaaatgctaaggacgcgggtcggaacaaaacatgcaatcttacttgtggccgtctcatttgtaacactaataacaggtaatatgagcttccgggatttaggacgggtaatggtaatggtaggagccaccatgacagacgacatcggaatgggcgtaacctacttggctctactagctgctttcaaaataagacccactttcgcagcaggcctactcctacgaaaacttaccagtaaggagctaatgatgaccacaataggaatagtcttgcttagccaaagcacgataccggaaagcatactggaattaactgacgctttagccctaggtatgatggtattaaaaatagtaaggaacatggagaagtatcaattagcagtaacaataatggcaatattgtgtgtccccaatgccgtaatattacaaaacgcatggaaagtttcgtgtactacacttgctgtagtttctgtttcaccgcttcttcttacaagtagtcaacaaaaagcagactggataccgttagcgttgacaattaaaggattgaatcccaccgccattttcctaacaaccctatctcgaacttctaagaaacgttcatggccacttaacgaggccataatggcagtggggatggtcagcatcctcgcatcttcattattaaagaatgacataccaatgactggacctcttgttgctgggggattattaactgtctgctatgttctaactggaaggtcagccgatctggaactcgagagggcggccgatgttcgttgggaagaacaagctgaaatatccggatcatcacctattttgtcaatcacaattagtgaagacgggtcaatgtccattaaaaacgaagaagaagaacaaactctgactattttaatacgtacgggtttattagtaataagtggactcttcccggtatctataccaataaccgctgcggcgtggtacttgtgggaggtcaagaaacaaagggcaggcgtgttatgggacgttccaagcccaccacctgtaggtaaagcggagttagaagacggtgcgtaccgaatcaaacaaaagggaatcctaggttacagccaaatcggggcgggagtatataaagaaggaacgtttcatacaatgtggcatgttactagaggggcggtcctaatgcacaagggaaaacggattgaaccatcttgggctgatgtaaagaaagatttaataagctatggaggaggctggaaattagaaggagagtggaaggaaggtgaagaagtacaggtactagcactggaaccaggcaaaaatccaagagcggtgcagactaaaccgggtttatttaaaacgaacacaggaacgataggggctgtaagccttgacttttctcctggaacatctgggtcgccaatcgtagacaaaaagggtaaagttgttggtttatatggaaacggagttgttacaagatctggtacgtatgtctccgcaatagcacaaacagagaaatctatagaggacaatccagagattgaagacgacattttcaggaagaaaaggttgacaataatggacctccatccaggggcaggaaaaacaaaaagatatcttcctgcaattgtaagagaagcaataaaaagaggactgcgtactctaatactagcgcctacccgtgttgtagctgcagaaatggaggaagccctacgaggactacccataaggtaccagacccccgccattcgagcagaacatacgggaagggaaatagtagaccttatgtgccatgcaacttttacaatgagacttttgtcacccatccgtgtaccgaattataatctgattataatggacgaggcccatttcactgatccagcgtctattgccgcacgagggtatatcagtactcgagtagaaatgggagaagctgcaggtatattcatgacggcaactcctcccggctcaagggacccatttccccaaagtaatgccccaattatggacgaggaaaaagaaataccggaaaggagttggaactcaggacacgagtgggtgactgatttcaaaggaaagaccgtttggtttgttcccagtattaaagctggaaatgatattgctgcttgcttaagaaagaatggcaagaaagtcattcagctctcccgtaaaacattcgacagcgaatatataaaaacaagaaccaatgattgggactttgtagtaactactgacatttcagaaatgggagcgaatttcaaagcagagagagtgatagacccaagaaggtgcatgaagccagtaattctcacagatggggaagaacgagttattctggcagggccgatgccagtaacacattcatcagccgcccaaagaagaggtagagtaggccgaaatcctaagaatgaaaatgaccagtacatatacatgggtgaacccttggaaaacgacgaggattgtgcacattggaaagaagcgaagatgctcttagataatatcaacacacctgaaggaattattcccagtatgtttgaacccgaacgcgaaaaagtagatgcaatagatggtgaatatagactgcgtggagaagcgagaaaaacatttgtggacttaatgcgcagaggagatctaccggtatggttggcttatcgcgtggcagccgaaggtataaactacgccgatagacggtggtgttttgatggtgtcaaaaacaaccaaattctagaggagaatgtagaagtagaaatctggactaaagaaggagaaagaaagaaattaaaacctagatggctggatgctcgaatttacagtgatccccttgcattaaaggaatttaaagagttcgcagctggacgaaagtcactgactctaaatcttattactgaaatgggacgattgccaacatttatgactcaaaaagccaaaaacgcactagataatctagcggtgttgcatacagcagaagctgggggcagagcatacaatcatgcgctctccgaactgccggagaccttagagactttattactgttaactctgcttgccacagtcactggtggaattttcctatttctgatgagtggtaaaggtattggaaaaatgacgcttggtatgtgctgtataataacagcaagtatactgctatggtatgctcagatacaaccccattggatagctgcaagtattatcctagagttctttctaatagtgcttttaatacccgaacccgaaaagcaacgaactcctcaggacaatcagttgacatatgtagttatagcgatactaacagtggtagcagccacaatggccaacgagatgggatttttggagaaaactaagaaagactttggattaggtagtataaccactcaacaacctgaaagcaacatattggatatcgatctaagacctgcaagcgcttggacattgtacgccgtcgcaacaacatttatcacaccgatgctaaggcattcaatagaaaatagctcggtaaatgtcagtttaacagcaatagctaaccaagcaactgtattaatgggattgggtaaaggctggcctttatctaaaatggacattggtgttccgttgcttgccattgggtgttattctcaagttaatcctattacattaacagctgcactgctattactggtcgctcattacgctattattggcccaggcctacaggctaaagcgaccagagaagcacaaaaacgagcggccgctggaataatgaaaaatccaacagttgacggaatgacagtgatagatttagatccaatcccctacgatcccaaattcgaaaaacagctagggcaggtcatgttattagtactatgtgtgactcaagtcctaatgatgcgcaccacatgggcactctgtgaagcactaacgctagccacaggtcctatatcgacattatgggaaggaaacccaggacgcttctggaatacaacaatagcggtgagcatggccaatatctttcgaggaagttatctagccggtgctggtctcttgttctcaataatgaaaaacacagcaaatacacgaagaggtacgggtaatactggagaaactttgggagaaaaatggaaaaacagattaaatgcgctcggtaaatcggaatttcaaatatataagaaatcaggaatacaggaagtagatagaactcttgcgaaagaaggtataaagaggggagaaacagatcatcatgcagtaagtaggggatccgccaagttacgctggtttgtagaaagaaaccttgtcacgccggaaggtaaagttgttgacctaggatgtggaagaggaggctggagttattactgcggagggctaaagaatgtgaaagaagtcaaaggattaactaaagggggtcctggacacgaagaaccaattccaatgtcaacatacggatggaatttagtaaggctacaatcaggagtggacgtcttctttacttcgccggagaaatgcgatactttattatgtgatattggagaaagttcaccaaatccaacagtagaggctggtcgaaccttgcgagtcctaaacctggtagagaattggctcaataataacacacaattttgcattaaagtattgaatccttatatgccatctgtaatagagaaaatggaagccctacaaaggaaatacggaggagcactggttcggaacccgctttcacgtaatagcacacatgaaatgtattgggtatcgaatgcatctggcaatatcgtcagcagtgtcaatatgatatctcggatgcttataaatagattcacaatgaggcataagaaagctacatatgaacccgacgtagacttgggatctggtactagaaacataggcatagagagcgagacaccaaatttagatattatagggaaaaggatcgagaaaataaaacaagagcacgaaacaagttggcattatgatcaagaccatccatataaaacgtgggcctatcatggttcatacgaaacgaaacaaacaggatctgcgtctagcatggtaaacggagtcgttagattactgacaaaaccatgggatgtaataccgatggtgactcaaatggctatgactgatactacaccgttcggacaacaacgtgttttcaaggagaaagttgataccagaactcaagagcctaaggaaggaaccaagaaactgatgaaaatcaccgcggagtggctatggaaagaattgggcaaaaagaaaactcccagaatgtgtacaagggaagaatttacacgcaaagtaagaagtaatgcagcactaggtgctatattcacagatgaaaataaatggaaatcggctagagaggccgtggaagattcaggtttctgggaattagtggacaaagagaggaaccttcatttagaagggaaatgtgaaacgtgtgtatacaacatgatgggaaaaagagagaagaaactgggggaatttggcaaggcaaagggttcaagggcaatatggtacatgtggttgggtgctcgcttcctggaatttgaagctctaggattcttaaatgaagaccattggttttcacgggagaatagcctatctggtgtagaaggggaaggattgcataagttaggttatatacttagggacgttagcaagaaagaaggcggagccatgtatgccgatgacacggctggctgggacacgcgaattacattggaggaccttaaaaatgaagaaatggtaacgaaccatatggaaggcgaacacaagaaactagcagaggcaatcttcaaacttacgtaccaaaataaagtagtcagggtacagagacctacacctcggggaaccgtaatggacatcataagccgtagggatcagagaggatccggacaggtagttacttatggcctaaatacatttacgaacatggaggctcaactcattagacagatggagggagaaggagtttttaaatccatacaacagttaactgtgaaagaagagatcgcggttaaaaactggctcattcgagttggtcgagagaggctctcgcgaatggcgataagcggagacgactgcgttgtcaaaccactagatgacagatttgcatcagcactaacggctttaaatgatatgggaaaagtccgtaaagacatccagcaatgggagccgtctagaggatggaatgactggacacaagtacccttttgctcgcatcattttcacgagttaattatgaaagatggcagggttctagtcgtgccgtgtcgcaatcaagatgaattaataggtagggcacgaatcagccaaggagccggttggtctttaagagaaacggcatgtttaggcaagtcatacgcacaaatgtggtcacttatgtattttcacagaagagatttaagactagctgcaaacgcaatctgttctgccgtcccatcgcactggattccaacttccagaactacctggtcgatacatgcaacgcacgaatggatgactacagaagatatgttaacagtatggaatagagtctggatacaagagaacccttggatggaagataaaacacctgttgaatcatgggaggaaataccgtatttaggaaagcgcgaagatcaatggtgtggatccctaattggtcttacctcgagagccacgtgggctaaaaacattcagacagcgataaatcaagtcaggtcgctgattggtaacgaggaatatacagactatatgcctagcatgaaacgatttcggagggaagaggaagaagctggagttttatggtag

SEQ ID NO: 22216 - RNA, 9876 nt, synthetic construct
  misc_feature 1..9876: note = derived and/or modified CDS sequence (opt6) from DENV-2__KX380814__SS-prME
  source 1..9876: mol_type = other RNA
actgcaggaataattattatgatgatcccgacagtaatggcgtttcacttaactacaaggaatggagaaccccacatgattgtatcaaggcaggaaaaaggtaaatctctactttttaaaactgaaaatggtgtaaacatgtgtactcttatggctatggacctgggagaactttgcgaagacacaataacatataattgcccgttactaaggcaaaacgaaccagaagatatagactgctggtgtaactcaacatctacttgggtaacatatggaacttgtacagcgacaggcgaacatagaagggagaaaagaagcgtggcattggtacctcatgttggtatgggcctagaaacccggacagaaacctggatgagttctgaaggagcttggaaacatgcgcaaagaatagaaacatggatactaaggcacccaggctttacaataatggcagcaatcctcgcttataccatagggacaacatattttcagagagtactcatattcattcttctcacggccgtgacacccagtatggctatgagatgtataggaatcagcaacagagactttgtcgaaggtgtgtctggtggatcctgggtcgatatagtcctagaacatggtagctgcgtaacgactatggctaaaaataaacccactcttgactttgaattgataaaaacagaagcaaaacatctcgccacactgcgaaaatactgcgtggaagcaaaactcactaacaccacaactgctagccgttgtccaacacaaggagaaccatctttaaatgaagaacaagataaacgattcgtgtgtaaacatagtatggttgatcgtggctggggaaatggatgtgggctctttggtaaaggtgggatagttacttgtgccatgttcacttgtaagaaaaatatggagggaaaagtcgtacagccagaaaatttagaatataccatagtcataacacctcactctggggaggaaaatgcagtaggaaatgatactggcaaacatgggaaagaaattaaagtaacgccccaatcatcaataacagaggcggaacttacaggctacggaacagtaacaatggaatgtagccctaggacgggactcgattttaatgaaatggttttacttcaaatggaaaacaaagcatggttagtccacagacaatggtttcttgatctaccgctaccatggttaccaggagctgatacacaaggtagcaactggatacaaaaagaaacgttagtcacatttaaaaatcctcatgcaaagaaacaggacgtagttgtgttaggttcacaagaaggagccatgcatacggcattaacaggggcaactgaaatacaaatgagtagcggcaacctactatttaccggccatcttaaatgcaggcttaggatggataaattacaacttaaaggtatgtcatatagtatgtgcactgggaaattcaaagtagtaaaagaaattgcagaaactcaacatggcacaattgtaatacgagtgcagtacgaaggtgacggtagcccatgcaaaatcccattcgaaatcatggacctagagaaaagacacgtattgggacgtctaataacagttaacccaattgtaacagaaaaagactcacctgttaatatagaagcagaacctccctttggagactcatacataatcatcggggtagaaccagggcaacttaaactttcatggtttaagaaaggttcctctataggacaaatgtttgaaacgaccatgcgaggagctaaacgtatggcaatcttgggtgacactgcatgggatttcggatcattgggaggggttttcacctctattggcaaggcgttacaccaagtatttggagcaatttatggagctgcattctctggagtgagctggactatgaaaatcttaatcggtgtagtgataacttggattggaatgaactcgagatcaacttccctcagcgtaagtctggttctagtcggagtcgtaactctttacctgggagtaatggtccaagctgacagcggatgcgtagtgtcctggaaaaataaagaactaaaatgcggatcgggaatttttatcacagacaatgtacatacttggaccgagcaatacaagtttcagccagaatcgccctcaaaacttgcaagtgcaatccaaaaggcacatgaagaaggaatttgcggaataagaagtgtaactagactagaaaacctcatgtggaagcaaataactccagaattaaaccatatactcacggagaacgaagtcaagctgactattatgacgggtgatatcaaaggaataatgcaagcagggaaacgaacactgcgacctcaacctaccgaactgaaatatagctggaaagcgtgggggaaagcgaaaatgcttagcaccgaactacacaatcatacatttttgatagatggcccagaaaccgccgaatgtccgaacactaatcgtgcatggaactccctagaagtggaagactatggttttggagtgtttacgacaaacatttggctgaagttaaaggaaagacaagacgtattctgcgatagcaaattaatgagtgcggcaataaaggacaacagagcagtgcatgcggacatgggatattggatcgaaagtgcattaaacgacacttggaaaatagaaaaagcgtccttcatcgaggtaaaatcttgtcattggccgaagagtcatactttatggagtaacggagtgcttgaatcagaaatgataataccaaagaacttcgcaggacctgtatctcagcacaactatcgacctggttatcatacgcaaacagccggaccgtggcacctgggccgacttgaaatggattttgatttttgtgaaggtaccaccgtggttgttactgaagactgcggtaacagaggaccttctctccgtacaacaactgcttcgggaaagttaattacagaatggtgctgcaggtcttgtactttaccgcccctgagatatagaggagaggacgggtgctggtatggaatggaaatacggcctctcaaagaaaaagaagaaaatttagtaaatagcttagtcacggcgggacatggacaaatagataacttttccttaggagttttgggaatggctttgttcttagaggaaatgttgcgcacaagagtcggtaccaaacacgcaatcctcctagttgcagtatcttttgtaacactaataacaggaaacatgtccttccgagatttgggaagggtcatggttatggtaggggctactatgacggatgacataggaatgggggtaacatacctagcgctcctagcggcttttaaaattcgacccacctttgccgccggtctgctattacgaaaactcacatcaaaagaactaatgatgaccactataggtatagtactcttatcacaatcaacaatacccgaatcgatattggaattaactgatgcattagctttggggatgatggtactgaaaattgttagaaacatggaaaaataccaactcgctgttacaattatggcgattttatgtgtgccgaatgctgtaattttacaaaatgcatggaaagtatcatgtactaccttggctgtagtatcagtatcaccgctgttgttaacatcatctcaacaaaaagcagattggatccctttagccctaacgataaaaggacttaatccaacagctatattcttaacaactctaagcagaacaagtaagaaaagaagttggccgcttaacgaagctataatggcggtaggaatggtttcaatattggcttcttccctgctgaaaaatgatatacccatgacgggtccactggtcgctgggggattactaacggtttgttatgtacttaccggaaggtctgcagatctagaacttgaacgtgctgccgatgttagatgggaagaacaagcagaaataagcggatcatcaccgatattgagtatcacaatatcggaagatggaagtatgtcaatcaaaaacgaagaggaagaacagactctgactatattgattcgaacaggattactcgtgataagtggactctttcccgttagtataccgattactgcagccgcttggtacttgtgggaagtcaagaaacagagagcaggagttctatgggacgttccgagtccaccgcccgttggtaaagcggagctagaggatggcgcatacaggattaaacaaaaaggaatattaggatacagtcaaataggtgcaggggtttataaggaagggacatttcataccatgtggcatgtgaccagaggagcagtgctaatgcataagggaaaacgaatagaacctagttgggctgacgtcaagaaagacttaatatcatacggagggggctggaaactagaaggtgaatggaaagaaggggaagaagtacaagtccttgccttagaaccaggaaagaatccaagggcagtgcaaaccaaaccagggctgttcaaaacaaatacagggacaatcggggctgtttctctggatttcagcccgggtacaagtggatcacccatagtggacaagaaaggaaaagtcgtgggattatacggtaatggtgtggtaactcgatcaggaacatacgtatccgccattgctcagacagaaaagtcgatcgaggataacccagaaatagaagatgatattttcaggaagaaacggctgacaattatggatttacatcccggggcggggaaaacaaagcgttacctgccagctatagtaagggaagcgattaaacgaggattacgcaccctaattttggctccaacccgagtagttgccgctgagatggaagaggcactgaggggcctaccgataagatatcaaacaccggctatacgtgcagagcatacgggaagggagattgttgatttgatgtgtcatgctacctttactatgagactgctttcaccaatacgagtcccgaattacaatctaataataatggatgaagcacattttacagacccagcaagcatagcggccagaggctatatctcaaccagggtagaaatgggagaagcggcaggaatatttatgacggctacaccgccaggaagtcgcgacccctttccacaatctaatgctcccattatggacgaagagaaagagattcctgagcgatcatggaactcaggacatgaatgggtaactgactttaaaggaaaaacagtctggtttgttccaagtattaaagcaggaaatgatattgcagcatgtctacgtaagaacggcaagaaagtcattcaactatccagaaaaacctttgacagtgaatatataaaaacgcgcacaaacgattgggactttgtagtgacaactgatatatcagaaatgggagcaaactttaaagctgagagagtgattgatcccaggagatgtatgaaaccagtgatattaacagacggtgaagaacgagtaatattggcaggaccaatgccagtcactcattcatcagcggctcaaaggagaggaagggttggcaggaatcctaaaaatgaaaacgatcaatatatttatatgggggaaccgcttgaaaatgatgaagactgtgcacattggaaagaagcaaaaatgctcttggacaatataaacactcctgaagggataatcccctctatgtttgaaccagaacgagaaaaagttgatgcaatagatggagaatatcgtctgcgaggagaagccagaaaaaccttcgtcgacttaatgagacgtggagatttacctgtatggcttgcttatagagtagcggcggaaggaataaattatgctgatcgtagatggtgttttgacggtgttaaaaataaccaaatactagaagagaacgtagaagttgagatttggacaaaggaaggagaaagaaagaaattaaagccacgatggttagatgcgcgcatatacagtgatccacttgctcttaaggaatttaaggagttcgcagcggggagaaagagtctaacgctgaatctcattacagaaatgggtaggttgccgacgttcatgacgcaaaaggccaaaaatgccctagataatctagcggttctacatacagcggaagctggtggcagagcctataatcatgctctaagtgaacttcccgaaacgttagagactttactgttattgaccttacttgcaacagtgaccggaggtattttcttattcttaatgagtggcaaaggcatcggaaaaatgacgttaggaatgtgttgcatcattaccgcatcgatcttgctgtggtatgctcaaatacagcctcactggatagcagcatctataatattggagttctttctaatagtacttttaataccggaaccagaaaaacaaagaacaccacaggataaccaattaacttacgtagtaatagcgatattaaccgtggtagcagcaaccatggcaaacgaaatgggatttctagagaaaaccaaaaaggatttcggactcgggtctataacgacccaacaaccggaaagtaacatattagacatagatttaaggccagcatcggcatggactttatatgcggttgcaacaacattcattacaccgatgcttagacatagtattgaaaattcttcggttaacgttagcttaacagccatagcgaaccaagccacagtacttatggggctcggtaaaggatggccgctatcgaagatggacataggagtccctctattagcaataggatgctactcccaagtcaacccaattaccctaactgctgcactactgctcttagtggctcattatgctataataggaccgggacttcaggcaaaggctacaagagaagcacagaaaagagctgcggcaggaataatgaaaaacccgaccgtcgacgggatgacagtaattgaccttgacccgataccttacgaccctaaattcgagaaacaattgggacaagtaatgttattagtattgtgcgtgactcaagtcttaatgatgagaacaacttgggcattatgtgaagcattaactttggcgacgggtccaatcagtacgttatgggaagggaatccaggtagattctggaatacaacaattgcggtaagtatggcgaacatttttagaggttcctatctagcaggagcgggcttgttgtttagcataatgaaaaatactgcaaacacacgacgtggcacgggcaacacgggcgaaacattgggtgaaaaatggaaaaataggctaaacgcccttggtaaatcagaatttcaaatatacaagaaatctggtattcaagaggtggatagaacactggccaaggaagggatcaaaagaggggaaactgaccaccacgcagtcagtaggggatcagctaagctaaggtggttcgtagaaagaaatctggtcacaccagaaggtaaggtagtggatcttgggtgcggtcgcggcggttggagttattattgtggaggtcttaaaaatgtaaaagaagtcaaaggactaacgaaaggtgggccaggtcatgaagaacctattccgatgagtacatatggttggaatttagtgcgtttgcagagtggagtagatgtctttttcaccagcccagaaaaatgtgatacactattatgtgacataggggaatcttcaccgaaccccactgtagaagccggacggactttaagagtattaaacttagtagaaaattggcttaacaataacacacaattttgtataaaagtcctaaatccatacatgccatcggtaatagagaaaatggaggcacttcaaagaaaatatggaggggcgttagtcagaaatccgctatcccgaaactccacacatgaaatgtactgggtatcaaacgccagtggtaatatcgtgtcatccgttaacatgatctcccggatgctcatcaacaggtttaccatgcgacataagaaagcgacatacgaacctgatgtagatttgggcagcggaacccgtaatattggaatcgaatctgaaactccgaacctggacatcatagggaaacgtattgagaaaatcaagcaagaacatgaaacttcctggcactacgatcaagaccatccatacaaaacctgggcctaccatggaagctatgagaccaaacaaaccggatcagcatctagtatggtgaacggagttgtcagattattaacaaaaccctgggatgtgattccaatggtaactcaaatggcaatgacagatacaacacccttcggtcaacaacgcgtcttcaaagagaaagttgatacccgaacacaagaaccaaaagagggaaccaagaaattaatgaaaatcacagccgagtggctatggaaagaattaggaaagaagaaaaccccaagaatgtgcactcgagaagaatttacaaggaaagtacgatcgaatgctgcattgggagcaatcttcacagatgagaataagtggaagagtgcgagagaagcggtagaggattcaggattctgggaattagttgacaaagagcggaatctacacttagagggtaaatgcgaaacatgtgtgtacaacatgatggggaaaagagaaaagaaattaggtgaatttggcaaggcaaaaggctcgagggctatctggtacatgtggttaggcgcacgatttcttgagttcgaagcactaggtttccttaatgaagaccactggttctcgagagagaatagcctttctggagtcgagggagaaggattgcataagctaggctatatactgcgtgatgtgagtaagaaagaaggtggagctatgtacgccgatgatacagccgggtgggatacacgaataactctggaagatcttaaaaacgaggaaatggtaaccaatcacatggaaggagaacataagaaacttgccgaagccatatttaaattaacatatcaaaacaaagttgtaagagtacaaaggcccacacctaggggcacagtcatggacattatatcgagaagggaccaaaggggttcagggcaagtcgtaacatacggtttaaacacatttacgaacatggaagcccaacttataagacaaatggaaggcgagggagtattcaagtctatacaacaactaaccgttaaagaggaaatcgctgtgaaaaactggctcatacgagtaggacgagaaaggctatctagaatggctatctcaggggatgattgcgttgttaagccccttgacgacaggttcgcatcagccctaacggcattaaatgacatgggtaaagtaagaaaagacatccaacagtgggaaccatcacggggctggaacgattggactcaggtccctttttgtagtcaccatttccatgaattaataatgaaagatggaagagtactggtggtaccttgcagaaatcaggatgaattaatcggcagagcgaggatctcgcaaggagcgggctggagtttgcgagaaactgcgtgtttaggtaaaagttacgcacaaatgtggtcattaatgtattttcatagacgagacctaaggctagcagctaacgctatatgcagtgccgtaccttctcattggattcccacctcgcggacgacgtggtcgatacacgctacgcatgagtggatgacgacggaagacatgttgacggtatggaatcgagtatggattcaggaaaacccatggatggaggataaaacgccagtagagtcgtgggaagagataccttacctaggtaaacgggaagaccagtggtgcgggagtctcattggattgacttcacgggcaacatgggccaaaaatattcagacagctataaatcaagttaggtcattaatcggaaatgaagaatatacagactacatgccaagtatgaaacgattcaggcgagaagaggaggaggccggggtattatggtaa

SEQ ID NO: 22217 - RNA, 9876 nt, synthetic construct
  misc_feature 1..9876: note = derived and/or modified CDS sequence (opt6) from DENV-2__KX380807__SS-prME
  source 1..9876: mol_type = other RNA
acagcaggaattattatcatgatgattccaacagttatggcttttcacctaacaacccgaaacggagaaccacatatgatagtaagccgccaagaaaaaggaaaaagtctattgtttaaaacagaaaatggagtgaacatgtgcactttaatggctatggacttaggagaactttgtgaagacacaataacctataattgtccattgttaaggcaaaatgaaccagaagacatcgattgctggtgtaacagcacaagtacatgggtaacatatggtacatgtacagcaactggcgagcaccgaagagagaaaaggagtgtagcgttagcaccccatgtaggtatgggtttagaaactaggacagaaacgtggatgagttcagaaggtgcatggaaacatgcacaacgaattgaaatttgggtattaagacatccaggctttactataatggcagcgatcttagcgtatacaatcggaacaacgtattttcaaagagtactaatatttattttactaacagcggtagcaccaagcatgactatgcggtgtatcgggataagcaatagagatttcgttgaaggggtttcagggggaagctgggtggatatagtgttggagcacggcagctgtgtaactacgatggctaaaaataaaccaacgttagacttcgaattaataaaaaccgaagccaaacaccccgcaactctaagaaaatattgcatagaagctaaattaacaaatacaacaaccgcatccaggtgcccaacacaaggcgaaccaagcctaaacgaggaacaagataaaagatttgtatgtaaacacagcatggttgatcgcggatggggcaatgggtgtggtctttttggaaaaggaggaattgtaacgtgcgcgatgtttacatgtaaaaagaatatggaaggaaaaatcgtgcagcctgaaaacttagaatataccattgtaattacgcctcattcaggagaagagaacgcggtaggtaatgatacgggaaaacacggcaaagaaataaaagtaaccccacaaagtagcattaccgaggccgaattgacaggatatggcaccgtaacaatggaatgttcacctagaacagggttggattttaacgagatggtacttctacaaatggaaaataaagcctggttagttcatagacaatggttccttgatctgcctctaccttggttaccgggagcagacacgcaaggtagcaattggatacagaaagagacgttagtaacctttaaaaatcctcatgctaagaaacaagatgtagtagtactcggatctcaagaaggagcaatgcatacggctctcacaggagcaactgaaatacagatgtcatcaggcaatcttttgttcaccggtcatttaaaatgtagactacgaatggataaactgcagttaaaaggtatgtcatactcaatgtgtacaggaaaatttaaagtggttaaagaaatcgctgaaactcagcatggcaccattgtaattagggttcagtatgaaggtgatgggagcccttgcaagattccgtttgagataatggatttagaaaagaggcacgtactagggaggctaatcacggtaaaccccattgtcaccgaaaaggactctccagtaaacattgaggctgagccaccttttggtgattcatatattataattggtgttgaaccaggccaattaaaattgagctggtttaagaagggttcaagcataggacaaatgtttgaaactacaatgagaggggccaaaaggatggcaatactgggagacacagcatgggactttggcagcttaggaggggtcttcaccagtataggcaaggcactacatcaggtattcggagcaatatatggggctgcattttccggagtgtcatggaccatgaagatcctaataggagtggttattacatggataggtatgaatagcagatcaaccagtctatcagtctcgttagttttagttggagttgtaacgttgtaccttggagttatggtacaagctgattcgggatgcgtagtctcttggaaaaacaaagaactaaaatgtgggagtggcatatttattaccgacaatgtacatacttggacggaacaatacaaatttcaacccgagtcgccctcaaaattagcgtcagccatacaaaaagcacatgaagaaggaatttgtggaatacggtcggtgacaaggcttgagaatcttatgtggaagcaaataacaccagaattaaaccatatcttgtcagagaatgaggttaaactaacaatcatgaccggagatataaaagggataatgcaagccgggaagcgcagcttgcgtccacagccaacagagttaaagtactcatggaaggcgtgggggaaagcaaaaatgctaagtacagagttacataatcatacattcttgatagacggaccagagacagccgagtgtccaaatacaaatagggcttggaactccttagaagtcgaagattatggatttggcgtatttacaacgaacatatggttaaaactaaaagagaggcaagatgtcttttgtgattctaaactaatgagtgctgcaattaaagataatagagctgtccatgcggacatgggatattggatagagtcggcgttaaatgatacatggaaaatagaaaaggcttcgttcattgaggttaaaagttgtcattggccaaaatcacatactttatggagtaacggtgttctcgaatcagaaatgataattcccaaaaattttgctggccctgttagtcaacacaactatagacctggatatcacacccaaactgcaggtccatggcacctaggaagacttgagatggattttgatttttgtgagggcacaacagtagtagtgactgaagattgcggcaacagagggccatcgttgagaacaactactgcaagcggtaaacttattactgaatggtgttgtcgatcttgcaccttaccgcccttgaggtatagaggtgaagatggatgctggtatggaatggagattagacccctaaaggaaaaggaagaaaacttagttaacagcttagtaaccgctggacatggacaaatcgataattttagtttaggtgtcctaggaatggcactcttcctggaggagatgctaagaactagggtaggaaccaaacatgcaatcctgttggtagcagtcagttttgttaccctaataacaggtaacatgtcttttcgagatttaggtagggttatggtcatggtaggtgccactatgacagataatattgggatgggagttacctatttagctctgttagcggcatttaaagttagacctaccttcgctgcaggattattgttacgaaaactaactagcaaagaactgatgatgacgacgattggaattgtattattaagccagtctactataccagaaacgattttggaattaacagatgctctggcgttagggatgatggtattaaagatcgtaagaaatatggaaaaatatcagttggctgtaacgatcatggccatattatgtgtcccaaatgcagtaattttacaaaatgcttggaaagtttcctgcactattctagcagttgttagtgtatctcctttgcttttaaccagttcacaacaaaaagcggattggattccacttgctctgactataaaaggattgaacccaactgcaatattcttaactaccttatcaagaacgagtaaaaagagaagttggccacttaatgaagcaattatggcagtcggtatggtctcgatattagcatcttcactactcaaaaacgacataccgatgactgggcctttagtcgcaggagggctcttgacggtatgttatgtactaacagggagatccgctgacctcgaattagagagagcagcagacgttcgatgggaagaacaagcagaaatatcgggctcctcaccaatcctatccataaccataagcgaagatgggagtatgtcgataaagaacgaagaagaagaacaaactcttacaatattgattagaaccggactactggtcataagtggcttgttcccggtatcaataccaatcactgccgcagcgtggtacctatgggaggtcaagaaacagagggcaggggttttgtgggatgtaccaagccctccacccgtaggcaaggccgaattagaagatggagcttaccgtatcaagcaaaaaggaattttaggttatagccagataggagcgggggtctataaagaaggcacattccatactatgtggcacgtaaccagaggggctgtactgatgcataaaggtaaacgaatcgaaccaagttgggctgacgtcaagaaagatctaatatcatacggagggggctggaagctcgagggtgaatggaaagaaggagaagaggttcaggtattggcactagaaccaggtaaaaatcctagagctgtacaaaccaagccgggtttattcaaaaccaacacgggaaccataggggccgtatcactcgactttagtcccggtacatctgggtcccccatcgtggataagaaaggtaaagtggtaggcctgtacggaaatggagttgtaacaaggtccggcacctacgtatctgcgatagctcaaaccgagaaatctattgaagataaccccgaaattgaggacgatatattcagaaagaaacgtttgacaataatggacttacacccaggtgccggaaagacaaaaagatacctaccagcaatagtacgagaggcaataaaaagagggctaaggacgttgatcctcgctcccactagggtagtcgcagccgagatggaggaagcactgcggggactccctatacgctaccaaactccagcaataagggccgaacacacagggagggaaatcgttgacttaatgtgtcatgcaacatttacaatgagacttttatcacctattagagtacccaattataatttaatcataatggacgaagctcattttaccgatccagcatcgatagcagcacgaggatacattagtacaagagtggaaatgggcgaagctgccggcatttttatgaccgcgacgccgcccgggtctagagacccgtttccacaaagtaacgccccaataatggacgaagaacgcgaaatccccgagaggtcatggaactcaggtcatgaatgggtgaccgacttcaaaggaaagacggtctggtttgtaccctctattaaggccggaaatgatatcgcggcatgtttacgcaagaacggaaagaaagttatacagttaagtagaaaaacttttgatagcgaatatatcaaaactaggacaaacgattgggactttgtagtgacaacagatataagcgagatgggagccaattttaaagcagaaagagtaattgaccccagaaggtgtatgaaaccggttatcctaactgacggcgaagaaagggtaatcctagccggtccgatgccagtaactcactccagtgcagcacaaaggcgaggtagagtaggacgcaatcctaaaaatgagaatgatcaatacatctatatgggcgaaccacttgaaaacgacgaagattgcgcacattggaaggaagcaaaaatgctactagacaatattaatactcctgagggcataatccctagcatgtttgaaccggaacgcgaaaaagtagatgcagtcgacggagagtaccgattacggggagaagctcgtaaaacatttgtcgacttaatgaggcgaggagacttaccggtctggttggcatacaaagtagctgcagagggaataaactacgccgatcggagatggtgtttcgacggagtcaaaaataaccaaattctagaagaaaacgttgaagttgaaatatggactaaggaaggtgaacgaaagaagttgaaaccacgatggttagatgcccgaatctattcagatccattagctctaaaagaatttaaagagttcgcagcaggaagaaaaagtctaactctcaaccttatcacagaaatgggtcgactaccaactttcatgacacaaaaagcaagaaatgctttagataatctcgcagtcttacacacagcagaagctgggggacgtgcatataatcacgctctaagtgagttgccggaaaccttagagactctcttgttactcactttactcgctactgtaaccggtggaatatttctttttctaatgtcgggcaaaggcatcggcaaaatgactttagggatgtgctgcattataacggccagcatattactgtggtacgcacaaattcaacctcattggatcgcagctagcattattctagaatttttccttatcgttctacttatacctgagcctgaaaaacagcgaacaccccaggacaatcaattaacatacgtagtcatagcaatcttgacggttgtggcagctactatggcgaatgagatggggtttttagagaagactaagaaagattttggtttagggagtatcacaacacaacaacctgagtcaaatatactcgatatagatcttcgcccagcgtcggcctggactttatatgccgttgcaacgacctttataaccccaatgttaagacactctatagaaaacagttctgttaacgtaagtttaacggcgattgctaatcaagcaactgtccttatggggctaggtaaggggtggcctttatcaaaaatggacattggcgtgccattattagccatcgggtgctattcacaggtcaatccaataaccttaaccgcggcgcttttgttgttagtagcgcactatgctataataggtccgggacttcaggctaaagctactcgtgaagctcaaaaacgtacagccgccggaataatgaaaattcctgcggcactcatagttacggttatagatttggaccccataccatatgatccgaaattcgaaaaacaactcggacaagtcatgctgttggtcttgtgtagtacgcaagttctcatgatgagaacaacgtgggctctctgtgaagcccttacactcgcaacagggcctatctctacactttgggaaggaaacccaggaagattttggaatactacaatagcagtctccatggcaaatatttttcgagggtcatatctcgccggggctggtctactattttcaattatgaaaaacacagcaaacactagaagggggaccggaaataccggagaaaccttaggcgagaaatggaagaataggctaaacgctctagggaaatcagaatttcaaatatataaaaagagtggaatacaggaagttgataggacactggctaaagaagggataaaaagaggagaaacagatcaccacgcggtaagtaggggatcggctaagttacgttggtttgtagaacgtaacctagtaacgccggaagggaaagtggtggacctcggatgcggacgagggggctggtcctactactgcgggggactcaaaaacgtaaaagaagtaaagggattgacgaaaggcggaccaggccatgaagaacccatccctatgtcaacttatggttggaacttagttagattacaatcaggtgtagatgtcttctttacaccgcccgagaaatgtgacacactcttatgtgatataggtgaaagcagtcctaacccaaccgtagaagcaggccgcacattaagagtactaacgctagttgagaattggttgaataataatacacagttttgcataaaggtattgaatccatacatgccatccgttatcgagaaaatggaggcactccagaggaaatacggaggagcattggtcagaaatcccctttctagaaattcgacccatgaaatgtattgggtaagcaacgcatcaggaaacatagtttccagcgtgaacatgatttcacgaatgttaatcaatcgttttacaatgagacataagaaagctacttatgaaccagatgttgatctaggatctgggacgcgaaatataggcatcgagtccgaaacaccaaatttagatataatcggcaaacgaatagaaaagataaagcaagaacatgaaacaagctggcattatgatcaggatcacccgtacaagacttgggcttatcacggtagttatgagaccaaacaaaccggctccgcttcttcgatggtaaacggagtagtaaggctactgacaaagccatgggacgtaattccaatggtgacacaaatggcgatgactgatacaactccgttcggacaacaacgagtctttaaagaaaaagttgacacgagaacacaggaacctaaagaaggcaccaaaaagctaatgaaaattacagcggaatggctttggaaagaattagggaagaagaaaacaccaagaatgtgtaccagagaagagttcacgagaaaagtcaggtcaaatgcggcgttaggagcaatattcaccgatgaaaataagtggaaaagcgcaagagaagcagtagaggacagtggattttgggagctagtggataaggagaggaatctacatctggaagggaagtgtgaaacatgtgtatataatatgatgggaaaacgagaaaagaaattaggcgaatttgggaaagcaaaaggtagtagagcgatatggtacatgtggcttggtgcgagattcctcgagtttgaggctttaggatttctaaatgaagaccactggttctcgcgtgaaaatagcctctcaggagtggaaggtgaagggcttcacaaattgggttatatacttcgcgatgtatcaaagaaagaaggtggggctatgtacgcagatgataccgcaggatgggacactaggataactctcgaggatctgaaaaatgaggagatggtaacgaaccacatggagggagaacacaagaaattagcagaggcaatatttaaattgacataccaaaataaggttgtaagagttcagcgcccaacccctaggggaactgttatggatattatttcacgacgcgatcagaggggaagcggacaagtggtcacgtatggattgaatactttcacgaacatggaagcacagttaatacggcaaatggagggcgaaggcgtgttcaaaagtattcaacaactgactgcaacagaggaaatcgcagtgaaaaattggttagtacgagttggaagagaaagactgtcaaggatggcaattagcggtgatgactgtgtcgtaaagcccctagacgataggttcgcttcggccttaacggctctaaatgacatgggaaaggtgcgtaaagatattcagcagtgggaaccctcgcgaggttggaatgactggactcaagtacccttttgcagtcatcactttcacgaattaattatgaaggacggtcgagttcttgtggtaccatgcagaaatcaggacgaactaattggtagagctcgcatctcccaaggagcaggttggagtctccgagagaccgcctgcctaggcaaaagttatgcacaaatgtggagcttaatgtattttcacagacgagatctacgattagcagccaacgctatctgctcagcggtcccatcgcactgggtcccaacatctagaaccacctggtcaatacatgccacacatgaatggatgacgaccgaagatatgttaaccgtttggaatcgtgtttggatacaagaaaatccatggatggaggacaagacacccgtagaaagctgggaggaaataccgtacctcggaaaaagggaggatcaatggtgcggatccctcattgggctcacctcaagagctacatgggccaaaaatatccagacagcgataaatcaagttagaagtctaataggaaacgaagaatatactgactatatgccatccatgaagcggtttcgacgagaagaagaagaagcgggtgtcctctggtag

SEQ ID NO: 22218 - RNA, 9876 nt, synthetic construct
  misc_feature 1..9876: note = derived and/or modified CDS sequence (opt6) from DENV-2__KX380815__SS-prME
  source 1..9876: mol_type = other RNA
acagcaggaataattatcatgatgattccgacagttatggcttttcatctaactacgagaaacggagaaccgcacatgatcgtaagtagacaagaaaaaggaaaaagtctattattcaaaaccgaaaatggagtaaacatgtgtacattaatggcaatggacttaggagaactatgtgaagatactataacatataattgcccgcttttgagacaaaatgaaccggaagacatcgattgctggtgtaattcaacatcaacatgggtcacctacgggacatgcacggctaccggtgaacaccgacgagaaaaacgtagcgtagcgcttgtcccacacgtcggaatgggacttgaaactagaacggaaacgtggatgagtagtgaaggagcttggaaacatgcgcagagaatagaaacctgggtattacgccatcctggatttacaattatggcggcgatattagcttacacaataggaacgacatatttccaacgtgtactgatttttatattattgacggctgtagcacccagcatgacaatgagatgtatagggatatcaaacagggattttgtagaaggagttagtggaggatcctgggtcgacatcgtactagaacatggttcatgtgtaaccacaatggccaaaaataaacccacccttgattttgaactaataaaaacagaagctaaacatccagcgacacttagaaaatattgtatcgaagcaaaactgacgaatacaactacggcgtcacgctgcccaacccagggtgaaccatcattaaacgaagaacaagacaaacgtttcgtatgtaaacacagcatggttgatcgaggatggggaaatggatgtggtctttttggtaaaggtggtatagttacttgtgccatgtttacctgtaagaaaaacatggaaggcaaaatagtacagccagaaaacttagaatatacaattgtaatcacaccccacagtggtgaagaaaatgctgtgggcaacgatactggcaaacacggtaaagaaataaaagttacaccacaatccagcataactgaagcagaacttactggatacggtactgttacaatggaatgttctccaagaacaggcttagattttaatgaaatggtattactgcaaatggaaaataaagcctggttggtccaccgccaatggtttctagatctaccgctaccatggttacctggggccgatactcaaggaagcaattggatacaaaaagaaaccttggtaacctttaaaaatccgcatgcgaagaaacaagacgttgtagttttaggttcacaagagggagccatgcatactgcactgacaggtgcaactgagattcagatgtccagtggtaacttactatttaccggacatcttaaatgtcgcctgcgaatggataaactacagcttaaaggaatgtcctactcgatgtgtaccggaaaatttaaagtggtgaaagaaattgccgaaacccaacatggcacgattgtcatacgggttcaatatgaaggagacgggtctccctgcaaaataccgtttgaaattatggatcttgaaaaacgccacgttttaggcagactaattactgttaaccctattgtaactgaaaaagacagtccggtaaatatagaagcggaacctccttttggcgatagttatataataattggagttgaacccggacaacttaaactaagctggtttaagaaaggttcatcgattggccaaatgttcgagacaacaatgaggggagcgaaaagaatggctatcttaggagacaccgcgtgggacttcgggtctctaggaggggtatttacaagtatagggaaagcattacatcaggtctttggagctatatatggagcagctttcagcggagtaagttggactatgaaaatcttaataggggtcgtaataacgtggataggaatgaatagtcgatctacgtcactatcagtatcgctcgtcctagtaggagttgtcaccttatatttaggtgttatggtacaagcggacagtggttgtgttgtatcgtggaaaaacaaagagctcaaatgtggctctggcatattcatcacggataatgttcacacatggacagaacagtacaaatttcaaccggaatcaccgtcaaaacttgcgagtgcgattcaaaaagcccacgaagaagggatatgtggtatcagatccgtgactagattagaaaacttaatgtggaaacagataacaccggagttaaaccacatactaacggaaaatgaggtaaaactaacaatcatgacaggggacataaaaggtataatgcaagccgggaaaaggtcccttcgacctcagccaacagaattaaaatattcatggaaggcttggggcaaagccaaaatgttgagcacagaactccataaccacactttcttaattgatgggccggaaacggcagaatgtcctaacactaatcgtgcatggaactccttagaagtcgaagactacggtttcggtgttttcactacaaatatttggctcaaactcaaagaaagacaggatgtttcctgtgattcaaaactaatgtcggcagcaattaaagataatcgcgcagtccacgcggatatggggtattggatagaatcagcgttaaacgacacatggaaaattgaaaaagcatcatttatcgaagtcaaatcatgtcactggccgaaaagtcatacactctggagtaatggggtcttagagagtgagatgatcatacctaaaaattttgcaggaccagtaagtcaacacaactatcgacccgggtaccacacgcagactgcaggaccatggcatttagggcgactcgaaatggactttgatttttgtgaaggaactacagtcgtggtaactgaagactgcggaaatcgtgggccatctttgagaacaacaaccgcatcagggaaactgataaccgaatggtgttgtcgcagttgtaccctgccaccccttagatacaggggagaggacggatgctggtatggtatggagattagacccttaaaagagaaagaagaaaatctagtcaacagccttgtcacagccggacacggacaaattgacaatttcagtctgggagtattgggcatggcgttatttttggaagagatgcttaggacaagagttggaacaaagcacgccattctgcttgtggccgtctctttcgttacactcataactggtaatatgagttttcgtgacttaggacgagttatggtgatggtgggagcgactatgactgacgatataggtatgggagtgacttaccttgccctactagctgcatttaaagtacgacctaccttcgcagctggactgctactccgtaagctaacttctaaagagttaatgatgacaaccattggaatagtgttattatcgcaatcaacaattccagagactatcctagaacttacagatgcattggctttagggatgatggtgttaaaaattgtaagaaacatggaaaagtaccaattagcagtcacaatcatggctatattatgtgttcctaatgccgtcatattgcaaaacgcatggaaggtttcttgtacaactttagcagtagtaagcgtttccccactattacttacatcctcacaacagaaaacggactggattccgctggcgttgactataaagggcctcaaccccaccgcaatattcttaactactctatccagaacttcgaagaaaagatcgtggccactgaatgaggctattatggcagtgggaatggttagcattttagcgtcttcatttttgaagaacgacataccaatgacaggtcccttagtggcgggaggactacttaccgtatgttacgttctaacagggaggtccgcagacctagaactggaacgggctgctgacataagatgggaagaacaggctgaaataagtggatcatcccccatactctctataacaatatctgaggatgggtcaatgagtatcaaaaatgaagaagaagaacaaactctgacaatacttattagaacggggctcctggtgatatcgggcctattcccggtatctattcccataacggcggcggcctggtatttatgggaagtaaagaaacaaagggctggagttttatgggacgtcccaagtcccccaccagtgggtaaagcagagttagaggatggggcgtataggatcaaacaaaaaggcatactcggatatagccaaataggagcaggcgtctataaggaaggcactttccatacgatgtggcacgtcactcgtggggctgttcttatgcataagggtaagcgcatagagccttcatgggctgacgttaagaaagacttaatatcctatgggggtggctggaaattagaaggtgaatggaaagaaggagaagaggtccaagtacttgcactagaacccggcaaaaacccaagggcggttcaaactaaacctggattgtttaaaactaatacaggcacaattggcgctgtatcgctggatttcagtcctggcacaagtggcagtccaattgttgataagaagggaaaagtagttggcttatacggtaatggggtagtcacaagatctggaacgtacgtatccgcaatcgctcaaacggagaaaaatatcgaagataatccggaaattgaagacgacattttcaggaagaaacgactaacaataatggatctgcacccgggcgcgggtaaaaccaagagatatcttcccgctatcgttagagaggccataaaacgtggtttgagaacattaatacttgcaccaacacgtgtggttgcagcagaaatggaagaggctttgcgtgggcttcctattcgttaccaaacccctgcgataagggctgaacacacaggacgagaaatagtagacctcatgtgccatgcaacatttaccatgcgacttctaagcccaataagagttccgaattacaatcttataattatggacgaagctcatttcacagatccagctagtattgcagcacgaggttacatttcaacacgagtagaaatgggagaggcagcgggtatttttatgacagcaaccccaccaggatcgcgggacccatttcctcaatctaacgccccaatcatggacgaagaacgggagatacctgagagatcatggaacagtggacatgaatgggttacagatttcaaaggaaaaactgtttggtttgtcccgtcaataaaggcaggtaacgacatcgctgcatgtctaaggaaaaatggcaagaaagtaatacaactgtctagaaaaacatttgactcagaatacgtaaaaacacgaacaaacgattgggactttgtagtgacaactgacatctcagagatgggagcaaattttaaagccgaacgtgtaatagacccaagaagatgtatgaaaccggtaatccttacagatggggaagaacgtgtcatattagcaggccctatgccagtgacgcattcaagtgcggctcaacgacgaggtagggtaggcagaaaccctaaaaacgaaaatgatcagtatatatatatgggagaaccactcgaaaacgatgaagactgtgctcactggaaagaagcaaaaatgcttctagataatattaacacgcccgaagggataattccatcaatgtttgaacccgaaagggaaaaagttgatgcaatagatggcgagtatagacttcgtggcgaagcacgcaaaacatttgtagacctcatgcgtagaggtgatctacccgtgtggttggcatatagggttgccgcagaagggataaattatgctgacagaagatggtgctttgatggtgtcaagaacaaccaaatcttagaagaaaacgtagaagtcgagatctggacgaaagaaggtgaaaggaagaaactaaaaccgcgctggttagacgcacgaatatattcggatcctcttgccttgaaagaatttaaagagttcgctgccggcaggaaatcattgactttaaacttgattactgaaatgggacggctgcccacatttatgacccagaaagcgcgtaatgctttggataatttagcggttttgcataccgcagaagccggcggtcgcgcttacaatcatgctcttagcgaattgccggaaacactagaaactctcctactattaactctattagcgacggttactggtggaatcttcctatttctgatgtcaggtaagggtataggaaagatgacacttggcatgtgttgcatagtaactgcaagtatattactatggtatgcacaaatacagccccactggatagcagcaagtatcattctggagttctttctcatcgtattattgatccctgaacccgaaaagcaaagaacaccccaagacaaccaattaacatatgtagtcatagcaattcttactgtagtagcagctacgatggcaaatgaaatgggattcttggagaaaaccaagaaagattttggcctgggctcgattacaactcagcaacccgaatcaaatatacttgatatagatttaaggcctgccagtgcatggacgctatacgctgttgctaccacatttattaccccgatgttgaggcactcaattgaaaatagtagtgttaatgtatcattaacagcaatagcgaaccaggcgacagtactaatggggttgggtaagggatggcccctttcgaaaatggacattggagtaccattgttggccataggttgctattcgcaagtaaatccaatcactctaacggctgcattacttctattggttgcacattatgccataataggccccgggttacaagcaaaagcaacaagagaggcacagaaaagagcagccgcaggcataatgaaaatacccgctgctctaataatgacggttatagatttagatccaatcccatatgatccaaaattcgaaaaacagttgggacaagtaatgcttttggttctatgtagtacacaagtcttaatgatgagaacaacgtgggctctatgcgaggcactaacactagcaactgggcccatatcaacactctgggagggaaaccccggaaggttttggaatacaactatagcggtctctatggcgaacattttcagaggttcttacttagcaggggctgggttactattttccattatgaaaaatactgcaaacacacgcagaggaacaggtaacacaggagaaacgctaggggaaaaatggaaaaatcagctcaatgcactaggcaagtcagagttccaaatttataagaagtctggtatccaagaggtagacaggactttagctaaagaaggtattaagagaggtgagactgatcatcatgcggtatctaggggatcagcaaagctccgatggttcgtagaaaggaatttggtgacaccagagggcaaagttgtcgatctgggatgtggtagaggaggatggagctattactgcggcggattgaaaaatgtgaaagaggtgaaaggcctaacaaaaggaggtccaggtcatgaagaaccaatacctatgtcaacctacgggtggaacttagtgagattacaatctggagtggatgttttctttactcctccggaaaaatgtgacaccctactatgtgatatcggtgagtcctcacccaaccccactgtggaggcggggcgcacgttacgggtccttaatttagtggaaaattggctcaacaataatactcaattttgtataaaggtcctaaatccgtatatgcctagtgtcatcgagaaaatggaagcattacaacgaaaatatggaggtgcattagttagaaatcctttgtcaagaaacagtactcatgaaatgtattgggtttcaaatgcctctgggaatattgtgtcaagtgtgaatatgatatctagaatgctcataaatcgatttacaatgaggcacaagaaagcaacgtatgaacccgacgtggaccttggaagcggaacaagaaatataggaattgaatcagaagtacctaatttagacatcataggtaaaaggattgagaaaataaaacaagaacatgaaacatcatggcattatgaccaagaccacccttacaaaacatgggcttatcacgggagttatgaaactaaacaaacgggctcagcgagtagtatggtgaacggggttgtacgactactaaccaagccgtgggatgtaattccaatggtaacacaaatggcgatgacagatactacacctttcggccaacagcgagtattcaaggaaaaagtcgacacaaggacccaagaacctaaagaaggaaccaagaaacttatgaagattacggcagaatggctatggaaagaattaggtaagaagaaaacaccgaggatgtgcacgagagaagaatttaccaggaaagtcagatcaaatgctgctctaggagctatatttacggatgaaaacaaatggaaatcagctagagaagctgtagaggactcaggattttgggaattagttgataaggaacgcaacttacatttagaagggaaatgtgaaacctgcgtctacaatatgatggggaaaagagagaagaaactcggcgagttcggtaaggcaaagggctcgagagcaatctggtatatgtggctaggtgccagattcttagagttcgaagcattgggctttctaaatgaagaccattggttttcaagagaaaacagcctttcaggggtggaaggagaaggattacataaattaggttacattttaagagatgtgagcaagaaagagggtggcgctatgtatgctgacgacactgcgggatgggatactagaataacgttggaagatctcaaaaacgaagaaatggtaaccaatcacatggaaggcgaacataaaaagctagctgaggcaatcttcagactcacctatcagaataaggtagtacgcgtacaaagaccaacgcctaggggaactgtgatggacataatatcaaggcgagaccaaagaggcagcggtcaagtagttacctacggtttgaatacttttacaaatatggaagctcaattgataagacaaatggaaggggaaggagtcttcaaatcaatccaacatcttacagctacggaagaaatagctgtcaaaaattggctagttcgcgtgggcagggaaagacttagtagaatggctatcagtggtgatgattgtgtggttaaaccactagatgatagattcgccaatgcactaaccgcattaaatgacatgggtaaagttcgaaaagatattcaacagtgggaaccttcgagaggttggaatgactggactcaagtccctttttgtagccaccatttccatgaattgataatgaaagacgggcgcgtgttggtcgtcccctgcagaaatcaagatgaattaataggtagggcacgaatatcgcaaggcgcaggttggagtctccgagaaacagcttgtttaggaaaatcctatgcgcaaatgtggtcactaatgtattttcaccggagggatcttaggttagcagcaaacgctatctgctcagcagttccgagccactgggtcccgacatcgagaacaacatggtctatacatgctactcacgaatggatgacaactgaagatatgttgacggtatggaatagagtgtggatacaggagaacccctggatggaagataaaacaccagtggagagctgggaggaaataccttacttaggaaaacgtgaagatcaatggtgcggatctttaataggattgacatcacgggcaacatgggccaaaaatatacaaacagcgataaatcaagtaagatcattgataggtaatgaggaatacacagactacatgccaagtatgaaacgtttcaggcgtgaagaagaagaagcgggggtgttgtggtga

SEQ ID NO: 22219 - RNA, 9876 nt, synthetic construct
  misc_feature 1..9876: note = derived and/or modified CDS sequence (opt6) from DENV-2__KX380816__SS-prME
  source 1..9876: mol_type = other RNA
acagcaggaataataattatgatgattcccacggttatggcgtttcatctgactactagaaacggtgaacctcatatgatagtaagtagacaagaaaaaggtaaaagtctgctgtttaaaacagaaaacggggtaaatatgtgcacattaatggcaatggacttaggagaattatgtgaagatacaattacatacaactgccccctcttacggcaaaacgaaccagaagatatagattgctggtgtaactctacctcaacgtgggtaacctacggaacatgtacagccacgggggaacatcgtcgagagaaaaggtcagtagcccttgtaccccatgttgggatgggccttgaaactagaacggaaacgtggatgtcttcggaaggagcttggaaacacgcccaaaggattgaaacatggattttgcgacaccccgggtttactatcatggcagcaatattggcttacacaatagggacaacttatttccaaagagtattaatattcattctgctaacagccgtcaccccaagtatggcgatgaggtgtattggtatatctaaccgtgatttcgtggaaggagtaagcggtggaagttgggttgatattgttcttgaacacggctcgtgcgtaactacgatggccaaaaataaaccaaccctggatttcgaattaataaaaactgaagcaaaacaccttgcaactttacgaaaatattgtgtggaggctaaacttacaaacacaactaccgcctctcggtgccccacgcaaggtgaaccgagtctaaacgaggaacaggataaaagatttgtatgtaaacattcaatggtcgacagaggttggggtaacggatgtgggctattcggtaaaggaggtatagttacatgtgctatgtttacatgtaaaaagaacatggagggaaaagtagttcagcccgaaaacctcgagtatactatagtcattactcctcatagcggtgaagagaacgcagtagggaacgatactggaaaacatgggaaagagataaaagttacacctcagagtagtataacagaggcagagcttaccggctatggcacagttacaatggaatgctcacctcgaacaggtctagatttcaatgaaatggttttattacaaatggaaaataaggcgtggctcgttcacagacaatggttcttagacttgccgttaccttggctaccgggggctgatacccagggatcaaattggattcaaaaagaaaccctagttacattcaaaaatccccatgccaaaaagcaagacgtagtagtcttaggaagtcaagaaggtgcaatgcatacagctctaacgggagcaactgaaattcaaatgtcttcaggtaatcttctgttcacaggacacttaaaatgcaggctcagaatggataagctacagcttaaaggaatgagttactctatgtgtacagggaaatttaaggttgtgaaagaaatagccgaaacccagcatggaacaatcgtcatcagagtccaatatgagggcgatggatctccctgtaaaatcccattcgagataatggacttagaaaagcgacacgttctgggcaggttaataacggtcaatccgatagtaaccgaaaaagattctcctgtaaacatcgaggcagaaccgccctttggagattcatacattatcataggagttgaacctggacaattaaaattgtcctggttcaagaaaggaagcagcataggacagatgttcgagaccacaatgagaggagctaagagaatggcaatacttggtgacactgcttgggattttgggagtttaggaggagtcttcacatcgattggaaaagcgttacatcaagtatttggagcaatctatggagcggcatttagcggagtctcgtggacaatgaaaatacttataggggttgtcattacatggattggaatgaacagcagatcaacatctttatccgtatcacttgtattggtaggggtagtgacactttatctcggagtcatggtgcaagcggactcgggttgtgtagtgtcctggaagaacaaagaattaaaatgtggcagtggaatttttattacagataatgtacatacctggacggaacaatacaagtttcaaccagaaagtccaagtaagctagctagtgctatccaaaaagcacatgaagaagggatatgtggcattagatcagtcactaggcttgaaaatctaatgtggaaacaaataacgccagaattaaaccacatcttgaccgagaatgaagtcaaactaaccattatgactggagatataaaggggataatgcaagcggggaaacgcacgcttagacctcaaccaacagaattaaaatatagctggaaagcatggggaaaggcgaaaatgttatcaacagaacttcacaatcatacctttctcatagatggaccagaaacggcggaatgtcccaatacaaatagggcgtggaactcattagaggtggaggactacggatttggtgtatttactacaaatatctggttaaaactcaaagagagacaggacgtgttctgtgactccaaattaatgtccgcagccattaaagacaatcgcgcagtacatgcggacatgggatactggatagagtcagcactaaacgacacctggaagattgaaaaagcctctttcatagaagtcaagagttgtcattggcctaaaagccataccttgtggtcaaatggagtattggaatcagaaatgataatacctaaaaattttgccggtcctgtctcacaacataactatcgaccaggataccatactcagacggctggtccgtggcaccttggaaggttagagatggactttgatttctgcgaaggaaccaccgtggtcgtaaccgaagattgcggtaaccgtggaccaagtttacgcacgacaacagctagtggtaaactgataacagaatggtgctgtaggtcttgtacactgcccccactccgctatagaggcgaagacggatgttggtacgggatggagatccggccgttgaaagaaaaagaagagaatctagtcaacagccttgttacagcgggacatggtcaaatcgacaatttctcgttgggagtgctaggcatggccttattcttagaggaaatgctaaggacccgagtgggaacaaaacatgcaattcttctcgtggcagtttcgtttgtaacgttaattactgggaatatgtcatttcgtgatttgggacgtgtaatggtgatggtaggagcgactatgactgatgatataggtatgggagtcacatatctggccctattagccgctttcaaaataagaccaacttttgcagccggtctgttgttgcgaaagttaacttctaaggaacttatgatgactaccataggaattgttcttttatcgcaaagtactatccctgagagcattctagagctcacggatgcactcgcccttggaatgatggttctgaaaatagttcgaaatatggagaaatatcaacttgcagtaactatcatggcaatactgtgtgtacctaatgccgtaatattacaaaatgcctggaaagtgagctgcacaacgctggcagtagtttctgtatcacccctcctccttacatcctcacagcagaaagcagactggattcccctagcattaacaattaagggactaaatccaacagcaatattcctgacaacgctatcacggacgagtaagaaacgatcctggccattgaacgaggctataatggccgtaggaatggtatccattctcgcatcatctcttttgaaaaatgatattccaatgacagggccattagtggcaggaggattgttaacagtctgttatgtattaacaggcaggagtgcagacctagaattagaacgcgccgcggatgttcgatgggaagaacaagcagagatttcgggaagtagtccaatccttagtataactataagtgaagatggcagcatgtcaattaagaacgaagaagaggaacaaacattaacgatattaataagaaccggcctcttggtaattagcgggctattccctgtctccataccaataacagccgcagcttggtacctttgggaagtaaagaagcaaagggcaggagttttatgggacgtcccatcacctccaccggtgggaaaagcagaattagaagacggagcttacagaataaaacaaaaaggcatcctagggtatagtcaaatcggggcaggagtttataaggaaggaacatttcatacaatgtggcatgtaacccgaggcgcagtcctgatgcacaaaggcaagcgaatagaaccatcatgggcagatgtaaagaaagatctaatctcgtatggagggggttggaagttggaaggagaatggaaagagggtgaagaagttcaagttttagctttagaacctggcaaaaaccctagagcagtccaaactaagcccgggctttttaagacaaatactgggacaataggtgcagtgagcctagatttttcccccggaacaagtggcagtcctatcgtcgacaaaaagggtaaagtcgtaggactgtacggtaacggagtcgtgactagaagtgggacctatgttagcgcgatagcccaaacggagaaaagcatcgaagataatcccgagattgaagacgatatatttaggaagaaaagactgacaatcatggatctacatcctggtgccggaaaaacaaagagatatctccctgcgattgtacgcgaagcaataaagagaggcctcagaactctcatcctagccccgacaagggtagtagcggcagaaatggaagaagcactgagaggcttgcccataagatatcagaccccagcgatcagagctgaacatactggccgcgaaattgtggatctcatgtgccatgcaacatttacgatgcgcttattatcaccaattagagtgccgaattataatttgataatcatggacgaggctcattttacggaccctgctagcatagcagccagaggatatatctcaacgagagtagaaatgggcgaagccgccggcatatttatgacagctactcctcccgggagtagggatccctttcctcagagcaacgcacctattatggatgaagaaaaagagataccggaacggtcgtggaacagcggacatgagtgggtgaccgactttaaaggcaagactgtttggtttgtaccgtctataaaagctggtaatgatatcgccgcatgtctcagaaagaacggtaaaaaggttatacaactgtccagaaagacgtttgacagcgaatatatcaaaacgagaacgaatgactgggattttgtcgttacaacagacatatcagaaatgggcgcgaactttaaagcagaacgagtaatagatccacggcgatgcatgaaaccggttatactaacagacggggaagagagggtgatactagcaggtcccatgcctgttacccacagctccgcagctcaaaggagaggaagagttggccgtaatcctaaaaatgaaaacgatcagtacatatatatgggcgaaccactcgaaaacgatgaagattgtgcacattggaaagaggcaaagatgctattggacaatattaatacacctgaaggaattataccgtcgatgttcgaaccggagagggaaaaagtggatgctatagacggagagtacaggctcagaggcgaagcccgtaaaacatttgtcgatttaatgcgtagaggggatttgcctgtctggctggcatatagggtagccgctgagggaataaattatgccgaccggaggtggtgtttcgatggagtcaaaaataaccaaatactcgaagaaaacgttgaagttgaaatatggacaaaagagggtgaaaggaagaaattaaaaccacgatggcttgatgctagaatatatagcgatcccttagctttgaaagagtttaaagagttcgctgcaggaagaaaatcactaacgttaaatttaataacagaaatgggacgacttccaacgttcatgacacagaaagcgaaaaacgccctcgacaatttggcggtactacacacagcagaagcaggaggaagggcatataaccatgctttatctgaactaccagagaccttagagacgttattactactaaccttactcgcaaccgtaaccggaggaatctttttatttttgatgtctggaaaaggaataggaaaaatgacacttggtatgtgttgcataataacagcatcaatattactttggcacgcgcagatccagcctcattggatcgcggcctcgatcatattggagttcttcctaatagtgttacttatacctgagccggaaaagcaaagaacacctcaagataatcagttgacttatgtcgttatagcaattctaactgttgtagcggctacgatggccaatgaaatgggttttctagagaaaaccaagaaagatttcggtctggggagcatcacgacacaacaacccgaaagcaatattctcgacatcgaccttagaccagcatcggcgtggacgctatacgcagttgctactacatttatcacaccgatgttaagacattcaattgaaaattcatcagtcaatgtatctctcacagcaattgctaaccaagcaacagtgctaatgggcctgggaaaaggttggccactaagcaaaatggatatcggcgttcccttacttgctataggttgttacagccaagtaaatcctattacattgacggccgccttacttcttcttgtagcgcattacgctattatcggaccagggctgcaagctaaagccacacgagaggctcagaaaagagctgctgcaggtataatgaagaatccaacagtagatggaatgacagtgattgacctagaccctataccgtacgatccgaagtttgaaaaacaattaggacaagtaatgttattagtcctgtgtgttacccaggtgctaatgatgaggactacatgggccctatgtgaagcattgaccctagcaactgggccaatatccactttatgggaaggaaaccccggacgtttttggaatactactatcgcagtttctatggctaatatctttcgtggatcctacctagcaggcgctggtttgttattcagcattatgaaaaatactgcaaacactcgaagaggcactggcaacaccggggaaactcttggagaaaagtggaaaaaccgactaaatgcattagggaaaagtgaatttcagatctacaagaaatcaggtatacaagaagtagaccgaaccctcgcaaaagaaggcataaagaggggtgaaactgatcaccatgcagtatcacgaggctctgctaaattaagatggtttgtcgaacgaaacctcgtgaccccagaagggaaggtagttgatttaggttgcgggcgaggcggttggtcctattattgtggaggacttaaaaacgtaaaagaagtgaaaggtctaaccaagggtggccccggtcacgaagaaccgattccaatgtcaacatacggctggaacttggtgaggctacaatcaggagtagatgtattcttcacatcaccagaaaaatgcgacacactcctttgcgatatcggtgagtcctcaccaaacccaacggttgaagccggtagaactttacgggttcttaacctcgtagaaaattggttaaataataatacacagttctgtataaaagtgctaaatccatacatgcccagtgtaattgagaaaatggaagctctacagagaaaatacggtggtgcacttgttcgtaaccctctatcaagaaattcaacccatgaaatgtattgggtcagtaatgcgagcggaaacattgtcagtagtgtaaatatgatatcacggatgttgataaacagattcacgatgcgtcataagaaagctacctatgaaccagacgtagatctaggaagtgggaccagaaatattggaatagaaagtgaaacccctaacttagatatcataggaaaaaggatagagaaaattaaacaagaacatgaaacctcgtggcattatgaccaagaccatccatataaaacctgggcatatcatggctcatatgaaacaaaacaaacgggctctgcctccagtatggtaaatggtgtcgttaggctattaacaaagccttgggacgtaattccgatggtcactcaaatggctatgactgataccactcctttcggacagcaaagagtatttaaggagaaagtggacacgagaacgcaggaacctaaagagggaacgaagaaactaatgaagattactgctgaatggttgtggaaagagttggggaaaaagaaaacgcctagaatgtgcacaagagaagaatttacaaggaaagtaagatcaaacgcagcacttggagccatctttacagatgaaaacaaatggaaaagtgcacgagaagctgttgaagacagtggattttgggagttagttgataaagaaagaaacctacacctcgagggtaagtgcgaaacatgtgtatataacatgatgggtaaaagagagaagaaacttggggagttcggaaaagcaaaaggctcgagagcgatatggtacatgtggttaggggcgaggtttttagagttcgaggcacttggatttcttaatgaagaccattggttttcacgagaaaattctttgtctggggttgaaggagaaggattgcataaactaggatatattttgagagatgtttctaagaaagaaggtggcgcaatgtatgcggacgacactgctggttgggacacacgaattactttagaggatttaaagaatgaggaaatggtaactaatcacatggaaggagagcacaagaaactagccgaggccatattcaagctaacatatcaaaataaggtcgtccgggtgcagcgaccgacaccaagaggtacagttatggacataatttcacgtcgagatcaacgaggctctggacaagtcgttacttatgggctcaatacatttaccaatatggaggcgcaattaataagacaaatggaaggtgaaggggtctttaaaagcatacaacaactcactgttaaagaagagatagcagttaaaaattggctgataagagttggaagagagaggttaagccggatggccatatcaggcgatgattgtgtggtaaagccattagatgaccgtttcgcttcagctttgacagcactaaacgatatgggaaaagttaggaaagacatacaacaatgggagccaagtagagggtggaatgactggacccaagtcccattttgtagccatcatttccatgaactcataatgaaagatggcagagttctagtcgtcccctgtcggaaccaagatgaactaattggtagagcaaggataagccaaggagcagggtggtctttgcgtgaaacggcttgcttagggaaaagttacgcccaaatgtggtcactaatgtatttccatcgtcgcgatttacggctagccgcaaacgccatttgctcggcagtgccaagtcattggataccgacatcgaggaccacttggagtatacacgctacacatgaatggatgactacagaggatatgttaacggtatggaatcgagtctggatacaagaaaatccatggatggaagataaaactccagttgaatcttgggaagaaataccatatttagggaagagagaggaccaatggtgtggaagtcttattggcttgacaagtcgtgcaacatgggccaaaaatatccaaacagccatcaatcaggtccgctcactaatcggcaatgaggaatatacagattatatgccttcaatgaaaagattcaggagagaagaagaggaagcaggcgtgctttggtaa

SEQ ID NO: 22220 - RNA, 9876 nt, synthetic construct
  misc_feature 1..9876: note = derived and/or modified CDS sequence (opt6) from DENV-2__KX380817__SS-prME
  source 1..9876: mol_type = other RNA
acggccggaattattataatgatgattccgacagtgatggcttttcacttaactactaggaacggagaaccacatatgatcgtctctcgccaagaaaaaggtaaaagtttactgtttaagaccgaaaacggtgttaatatgtgtacactcatggctatggatctaggagaactatgcgaggataccataacttacaactgcccactcctacgtcagaacgaacctgaagacatcgactgctggtgtaattcaacatctacttgggttacatacggaacatgcactgcaactggggaacatagacgcgaaaagcgctctgttgcattggttccacacgtggggatgggactcgaaactaggaccgaaacctggatgagctcggaaggggcatggaaacacgcacagcgtatcgaaacctggatcttaagacatcctggattcacaattatggctgcaattctggcgtataccattggaaccacttacttccaaagggttctaatattcattttgcttacagcggtgactccatcaatggccatgaggtgcataggcatcagtaatcgagattttgttgaaggggtctctggtggcagttgggtcgacattgtcttagagcacggcagctgtgtaacgacaatggctaaaaataaacccacattagattttgaattgattaaaacagaagcaaaacaccttgcgacacttagaaaatattgtgtagaggcgaagctcactaataccacaacagccagtagatgtcctactcaaggggagccgagtctaaacgaggaacaagacaagaggtttgtctgtaagcacagtatggtcgacagaggatggggtaacggatgcgggttatttggaaaaggaggaatagtcacttgtgcaatgttcacatgtaaaaaaaatatggagggaaaagtggtgcaaccagagaaccttgaatacacgattgttataactccgcatagcggtgaagaaaatgccgtgggaaatgataccggaaaacacggaaaagagatcaagataactcctcaaagttccataacagaagcagaattaacgggatatgggactgtaacaatggaatgctcccctaggaccggactggattttaacgaaatggtgcttctacaaatggagaataaagcatggcttgtacacaggcaatggtttttagacctgcccttgccatggctaccaggtgctgatacccagggatcgaattggatccaaaaggaaactttggttacgtttaaaaacccacatgcaaagaagcaggacgtcgttgttcttggttcccaggaaggagcaatgcatactgcgttaaccggtgcaacagagatacagatgtctagcggaaacctactcttcacaggacacttaaaatgtagactacgaatggacaaactgcaattaaaaggcatgtcatattctatgtgtacaggaaaatttaaagtcgttaaagaaattgcagaaactcagcatggcacaatagttattagagtacaatatgaaggagacgggagtccttgtaaaataccatttgaaataatggaccttgaaaaaagacacgtcctcggccgtttgatcaccgtaaacccgattgtcacagagaaagattccccagtaaacatagaggcagaacccccttttggagattcttatataatcatcggggtagaacccggacaactaaaactgagctggtttaaaaaaggatcatcgatcggacaaatgtttgaaacaacaatgagaggtgcgaaaagaatggcaatcctaggtgatacagcctgggactttggttcgttaggcggtgtattcactagcattggtaaagcgcttcatcaagtattcggtgcaatatacggggcagcgttctcaggtgtttcttggaccatgaaaatattaattggggtagttattacctggattggaatgaactcgcgctcaacctcattatcggtgagtttggtactggtaggagtggtaaccctctacttgggcgtaatggtgcaagctgattcaggatgtgtagtttcttggaaaaacaaggaattaaagtgtggttcaggtatatttattactgacaatgtccatacatggacagaacaatataaatttcaaccagaaagtccttccaaattagccagtgctatccagaaggcacacgaggaagggatctgtggtattcgatcagtaaccagacttgaaaaccttatgtggaaacagatcactcccgaattgaatcacattctgacagaaaatgaagtcaagctaacgataatgacaggcgatataaaaggtatcatgcaggcgggaaaacgttctttaaggccccaacctactgaactcaaatatagctggaaggcctggggtaaagccaaaatgctaagcacagaactccacaaccacacgttccttatagatgggcccgagacagcagaatgccctaacacaaatcgagcttggaatagtttagaagtcgaagactacggtttcggcgtttttacaactaacatttggctcaaactaaaggaaagacaagatgtgttttgtgactctaaattaatgtcggccgcaataaaagacaatagggccgtccatgcggacatgggatattggatagaatctgcactaaatgacacatggaagatagagaaagccagttttattgaagtaaagagctgccactggccaaaatctcacactctatggagtaatggcgtattggaatcagaaatgatcatacccaaaaattttgcaggaccagtttctcagcataactaccggccaggataccatacacagactgctgggccctggcatttggggagattagagatggatttcgatttttgtgaaggcacaacagtagtagtaactgaagattgtggtaaccgaggaccatcactacgtacaacgacagcgagcggtaaattaataaccgaatggtgttgtcgtagctgcaccttaccacctctccgatacagaggagaggacggatgttggtacgggatggaaatacgccctttaaaagaaaaagaggaaaatttggttaattcactagtcaccgcgggccatggacagattgataattttagtctgggtgtcttaggaatggcattgttcctagaagagatgcttcgaacaagagtcggaactaagcacgcaatcctactagttgctgtttcatttgtaactcttataacaggtaatatgtctttccgagacttgggaagagttatggttatggtcggggccacaatgacggatgatattggcatgggcgtcacatatcttgcattgttagcggcatttaaagtacgaccaacattcgctgctggattattgttacgaaagttaacgagtaaagaattgatgatgactacaataggaatcgtattactgagccagagcactataccggaatcaatactcgaactaacagatgccttagcacttggtatgatggtactaaaaatagtgcggaacatggaaaagtatcagttagcagtaacaattatggctatatcatgtgttccgaatgcggtgattctacaaaatgcgtggaaagtgtcatgtacaacattagcggtagtatcggtatcacccctactgttgaccagctctcaacagaaagctgattggattccccttgctttgacaataaaagggcttaatcctaccgccatatttctaacaacgctgagtagaaccagcaaaaagcggtcatggcctttaaatgaagcaataatggcagtaggcatggtatcaatattagcatcctcactgttaaaaaatgatataccgatgaccggccctttagtagcaggagggttactcactgtctgttatgtacttacaggaaggtcggctgacctcgagctagagagggcagcagatgtacgatgggaagagcaagctgagatatctggcagctcaccaatattgtcgataaccataagcgaagacggaagtatgagcattaaaaacgaagaagaagaacagactctaacgattctcatacgaaccggactcctagtaatcagcggattatttccggtttcgattccaataacagcagctgcatggtatttatgggaagttaaaaaacagagagctggagttctgtgggatgtcccatcaccaccaccagtagggaaagcagaacttgaagacggtgcctatcgtataaaacagaagggcatattaggatattctcaaataggtgctggagtatacaaagaagggaccttccatacgatgtggcacgttacaagaggggctgtattaatgcataaaggaaaacgtatagaaccatcatgggcagatgtaaaaaaagatttaattagttacggcggaggatggaaactagaaggggaatggaaggaaggcgaagaggtccaagtattagcattagaacctggaaaaaatccccgtgccgtgcaaacaaaaccagggctattcaaaacaaataccggtacaatcggcgcagtatcgcttgattttagtccaggaaccagtggttctccaatagtcgataaaaagggaaaggtagttggactctatgggaacggggtagtaacgagaagtggtacgtatgtctcagctatagcccaaactgaaaaaagcattgaagataacccagaaatagaagacgatatatttcgtaaaaaaagattaacgataatggacctacatcctggggctggaaaaacaaagcgatacctccctgcaatagtcagagaagcaatcaaacgaggtctgagaacccttatactggctccgacgagagtggtagcagctgagatggaggaggcactacgaggtcttccaattcgctaccaaactcccgcgataagagcagagcacacgggccgggaaatcgtagacttgatgtgccatgctacttttactatgagactcttgtcaccaatacgagtgccaaactataatcttataataatggacgaagctcatttcacagacccggcaagtatcgcagccagaggctacatttctactagagtggagatgggtgaagctgcaggcatatttatgacggcaaccccacctggtagtcgtgacccatttcctcaaagtaacgcgcccataatggatgaggaacgtgaaatacctgaaagatcatggaatagtggccacgagtgggttactgactttaagggtaaaacagtatggtttgttccttctataaaagctggcaatgacatagccgcttgtctccgaaaaaacgggaagaaagtcatacaactctctagaaaaacgttcgattctgagtatataaagacaaggacaaatgattgggactttgtcgtaactacagacatatcagaaatgggagctaattttaaggcagaaagagtaattgatccaagaagatgtatgaagcctgtaattcttacggatggagaagaaagggttatattagcgggaccgatgccagtaacacactcatcggctgctcaaagaagagggagagtgggcaggaatccgaaaaatgaaaacgaccaatatatatatatgggcgaacccttagaaaacgacgaggattgcgcacactggaaagaggcaaaaatgttactcgataacattaacacgccggaggggataattccttcgatgttcgaacccgagagggagaaggtagacgccatagacggtgaatatagactgaggggtgaggctagaaaaacatttgtagacttaatgcgtcgcggtgatttgccagtatggcttgcctatcgagtcgccgctgaaggtataaactatgcagatcgtcggtggtgtttcgacggagttaaaaacaatcaaatcttggaagagaacgtggaagttgaaatctggacaaaagagggagagagaaaaaaattaaaaccacgatggttagacgcaaggatttactctgatcctttagcactcaaagaatttaaagagtttgcggcgggaagaaaaagcctaactttaaatttaataactgagatgggccgtcttcctacttttatgacacagaaagccaaaaacgccctcgataatttggcggtattacacacggccgaagctggtgggagggcatacaatcacgctctcagtgaactccctgaaactctagaaacgctccttctattaacccttcttgccacggtaaccgggggaatattcttgtttctcatgtctggaaagggaatcggaaaaatgacattaggcatgtgctgcataataaccgcatcaattctcctttggtatgctcaaatacagccccattggatagcggctagtataatcttagaatttttcctaatagtccttctaattccagaacctgagaaacaacgaactccacaagataatcaactaacatatgtcgttattgcaattttaaccgtagtagccgcaaccatggcaaatgagatgggctttctggagaaaacaaaaaaagactttggattaggaagcataacaacacagcaacctgagagcaatatcctcgacatcgacctgagaccagctagcgcatggacgttatacgcagtagcaactacttttataacacctatgttaagacactcgatagaaaactcaagtgttaatgtaagtctgacagcaatagctaaccaagctacagttctgatggggctagggaagggctggccgctctcaaaaatggatattggggtccctttgttagcaataggatgttacagtcaagtgaacccaatcacacttacagcggcactactcctccttgtagcacattatgccattatcggcccagggttacaagcaaaagcgacaagagaggcacaaaagcgagctgccgctgggatcatgaaaaatccaacagtagatggaatgacagttattgatctggatcctataccatacgatcctaaattcgagaaacagttaggtcaagtgatgctattagtactgtgcgtgacacaggtattaatgatgagaacaacatgggcactatgcgaagctttaaccttggcaacgggacctatctcaactctatgggaaggaaatccaggtcgattctggaatactacgatagccgtcagtatggcaaatatattcagagggagttatttggccggggcaggccttctattctcaattatgaaaaacacagcaaatactcggcgtggaacaggaaacacaggagagacattgggagaaaaatggaaaaatagattaaacgcattaggtaagtcggagttccaaatatacaaaaagagcggaatccaggaagttgaccgcacattagcgaaagaaggaatcaaacgtggagaaacagatcatcacgcggtgtcacgagggagtgccaaacttagatggttcgttgagcgcaatttggttacccccgaagggaaggtggttgacttaggatgtgggaggggtggctggtcctattactgtgggggattaaaaaacgttaaagaagttaagggcctaacaaagggtggaccaggacatgaagaaccaataccaatgtcaacctatggctggaacctagtacgtctacaaagcggagtagacgtcttctttactccgccggagaagtgtgatacactgttatgtgacattggtgaaagttcccctaatccgaccgtcgaagcgggcagaactctaagagtcttgaacctagtagagaattggcttaacaataacacccaattttgtataaaggtattgaacccttacatgccatctgtaattgaaaagatggaagctttacagagaaaatacgggggtgcattagtccgtaatcctttatcacgaaacagcactcacgaaatgtattgggtgagcaatgcatctgggaatatcgtatctagtgttaacatgataagtcgaatgctaataaacaggtttaccatgaggcataaaaaagctacatacgaaccagacgtggacttagggtcaggtactaggaatataggaatcgaatctgaaacaccgaacttagatattatagggaaaagaatagaaaaaatcaaacaagaacacgaaacctcatggcattatgatcaagaccatccctataaaacttgggcttatcatggatcgtatgaaactaaacaaacaggttcggctagttctatggtaaatggagtagttagactgctcacgaagccttgggatgtaatacctatggttacacaaatggcgatgacagatacaacaccgttcggacaacagagagttttcaaggaaaaagtagatacccgtacccaagaacctaaagagggtactaagaaacttatgaaaatcaccgcagagtggctctggaaagaattaggaaaaaaaaagaccccaagaatgtgcactagagaggaattcacgaggaaagtaagatcgaacgcggcattgggtgcaatttttacggacgaaaataaatggaagtcggcaagagaagcggtagaggacagtggattctgggaacttgtagatcgagaacgtaatttgcacttagaaggaaaatgtgaaacgtgcgtatacaacatgatgggcaaaagagagaagaaacttggggagtttggaaaagctaaaggtagcagagccatatggtatatgtggcttggagcacgattcttagagtttgaagcacttgggtttttaaatgaagatcattggttctcccgagagaatagtttgagtggcgtggaaggagaagggttacataaattagggtatattctgcgagatgtgtcgaaaaaagagggaggcgcgatgtacgcggatgataccgcaggatgggatacccgaattacgctagaagacctaaaaaatgaagaaatggttaccaatcacatggaaggcgagcacaaaaaactagcagaggcaatattcaaattaacatatcaaaataaagtagtcagggtacaacgacctacaccaagaggaacagttatggatataataagcaggagagatcaacgaggctcaggacaagtagtaacatatggactaaatacttttacgaatatggaagcccaattgattcgacagatggaaggggaaggcgtctttaaaagtatacaacaactgaccgttaaagaggaaatagcagtaaaaaattggctcattagggtaggaagagaacgtctaagccgtatggcaataagtggtgacgattgtgtagttaaaccattagatgatagattcgcatcagctttaacagcgcttaacgatatgggaaaagtccgtaaggatatccaacaatgggaaccttcaagaggttggaatgattggacacaagttcccttctgtagtcaccactttcacgaactaatcatgaaagatgggagggtactcgtagtcccttgtcgaaatcaagatgaactgattggccgtgctcgtatctctcaaggggcaggatggtctctccgggaaacagcatgtctaggcaaatcgtatgcccaaatgtggtctctaatgtattttcacaggagagatttaagactcgctgcgaatgctatatgctctgccgtgccgtctcattggatccccacatcccgaacaacttggagtattcacgcaactcacgaatggatgacaacagaagacatgcttacggtatggaatagggtatggattcaagaaaatccttggatggaagataaaacacctgttgaatcatgggaagagataccttacttgggcaaaagagaagatcaatggtgcggcagtttgataggtctcacttcaagggctacatgggctaaaaatatccaaacggcaataaatcaggtccgatcattgatcggtaacgaggagtacactgactacatgccatcgatgaaaagattccgacgcgaggaggaagaagccggagtcctttggtaa

SEQ ID NO: 22221 - RNA, 9876 nt, synthetic construct
  misc_feature 1..9876: note = derived and/or modified CDS sequence (opt6) from DENV-2__KX380818__SS-prME
  source 1..9876: mol_type = other RNA
acggccggaataattatcatgatgataccaaccgtcatggcttttcatttaaccacccggaacggagagccacatatgattgtctcaagacaggaaaaggggaaatcactattgtttaaaactgaaaacggtgtcaacatgtgtacattaatggctatggatttaggagaattatgtgaagataccataacgtacaattgtccacttttacgacaaaatgagcccgaagacattgactgctggtgtaactcaacctccacgtgggttacatacggtacatgcactgctacgggtgaacatagacgagaaaaacgatctgtcgcgctagttccacacgttggtatggggttggagacccgcacagaaacatggatgtctagcgagggagcttggaagcatgcccaacgcatagagacatgggtcttgcgtcaccctggatttactataatggcagcgatacttgcatacacgatagggacaacctactttcaaagagttctgatatttatacttctcactgcagtcgctccttcgatgacaatgaggtgtataggaatatcaaatagagattttgttgaaggtgtaagcggtggcagctgggttgacatcgtattagaacacgggagttgcgtgaccacaatggcaaaaaataagccaactttggattttgaactgataaaaacagaggcgaaacatccggctacattacgcaaatattgcatagaagcaaagttaacgaatactacaacggcatcaagatgcccaacacaaggagaaccaagcctgaacgaagaacaagataaacgattcgtatgtaaacattctatggtggatcgaggatggggtaacggctgcggtttattcgggaaaggcggtatcgtaacatgtgctatgtttacgtgcaagaagaacatggaaggtaaaatagtacaacctgaaaatttagaatatactatagttataacccctcatagcggagaagaaaatgcagtaggcaatgatactggcaaacatggaaaagagatcaaagttacaccacagagtagcattacagaagcagaattgaccgggtatggtacagttacaatggaatgttctcctagaacgggcctagatttcaacgaaatggtattactacaaatggaaaacaaagcttggctcgttcatcgtcaatggttcttagacttacctttaccatggctacccggtgcggatacacagggatctaattggattcaaaaagaaacactagtcacttttaaaaatccacacgccaagaagcaagacgtcgtagtgctaggaagccaagaaggtgccatgcatacagcattaacaggtgcaactgaaatacaaatgagtagtggaaatttattatttacagggcatttgaaatgcagactacgaatggataaattgcaattaaaaggaatgtcttactcgatgtgtacaggaaaattcaaagtagtgaaagaaattgcggaaacgcaacacggcacaatagtaattagagtccaatacgaaggcgatggctctccgtgcaagatcccctttgaaattatggacctggaaaagaggcacgtgttaggacgtctaataactgtaaacccaattgtaacagaaaaagattctccggttaatatcgaagcagagccaccattcggtgattcatacattataataggggtagaaccaggacaattaaaattatcgtggtttaaaaaaggctcatcaataggtcaaatgttcgaaacaaccatgcggggtgcaaagcgtatggccatattgggggatacggcttgggatttcggatcgctgggtggcgtttttactagcattggaaaagcattacatcaagtttttggagcaatatacggagcagcattctcgggagtaagttggacaatgaaaatcttaataggggtggtgattacatggatagggatgaatagtcgtagtacgtcgttatcagtatcattagtactggttggcgtcgtaaccttatacctaggtgttatggtgcaggctgactcaggttgcgtagtgagttggaagaacaaagagttgaagtgtggcagcggaatctttataacagataatgttcatacatggacagaacagtataaatttcagccagaatctccgtcaaaattggctagcgcaatacaaaaagctcatgaagagggtatatgcggaataaggagtgtaacaaggttagaaaatcttatgtggaaacaaattaccccagaattaaaccacatattaaccgaaaacgaagtcaaattgacgattatgactggtgacattaaaggtataatgcaagctggtaagaggtctctaagaccacaaccaacagagctaaagtatagttggaaagcttggggaaaggcaaagatgctaagtacagaattgcataatcatacttttctgatagacggtccagagacggcagaatgcccaaacaccaacagagcttggaattctttagaagtagaagattacggctttggtgtgttcaccacaaatatatggttgaaactaaaagaaaggcaagatgtgagttgcgatagcaagctaatgagtgcagctattaaagacaatcgggctgtccatgctgacatgggatattggatcgaaagcgccctcaatgacacctggaaaatagaaaaagctagctttatagaagtcaaatcttgtcattggccaaaatctcacacactatggtcaaacggcgtgctggagtctgagatgataattcccaaaaacttcgcgggacccgtctcgcaacacaattacagacctggctatcatacacaaacagcaggcccatggcaccttggtcgactagaaatggactttgatttttgcgaaggtactaccgtagtagttaccgaagactgtggaaatagaggccccagtcttcgtactacgaccgcctcagggaaactaataacagaatggtgctgtcggagttgcacactcccacctctacgttacagaggagaggatggttgctggtatggtatggaaatccgaccgctaaaggaaaaagaagaaaacctcgtaaattcgctagtaacagcaggacatggtcaaatagacaatttctcattgggtgttcttgggatggctttatttcttgaagaaatgttgaggacacgagtaggaactaaacatgcaatattattggtagctgtctcattcgtcacattaataacaggcaatatgagctttagagacttgggtcgtgtaatggtaatggtcggagcgacaatgacagacgacatcgggatgggtgtaacttatttagcacttcttgcagcatttaaagtacgaccgacattcgcagctggacttctattgaggaaattaacgtctaaagaattgatgatgaccacaatcggtatagtgttactgtcgcagagtacaataccagaaacaattttggagctaacagatgcattagcgttgggaatgatggtgctcaaaattgtgagaaacatggaaaaataccaactagcagtcactattatggccattctatgtgtaccaaatgcagtgatattacagaatgcttggaaagtatcatgtacaactttagcagttgtgtcagtttcacccttattattgacaagcagccaacaaaaaacggattggataccattagccctaacaatcaagggtttaaatccgacagctatattcttaaccaccctatcaagaacatcaaagaaacggagttggcccctgaacgaagctataatggcggtaggcatggtaagcattctagcctcaagtttcctaaaaaacgacatcccaatgaccggaccattggtagctggcggactactcactgtttgttatgtgctcacgggacgttcggcggacctcgaactagaacgagccgcagatatcagatgggaagaacaagccgagatatctgggtcatcgccaattcttagcataactatttcagaagacggatctatgtctatcaaaaacgaagaggaggaacaaacattaaccatcctaataagaactggactactggtcatatcaggcctatttccagtgtctataccaataacagcggctgcatggtatctgtgggaagtcaaaaagcaacgagctggtgtattatgggatgtgccctctccgccaccggtcggaaaagcggaattagaagatggagcctataggatcaaacagaagggaattctaggatactcacagataggcgccggtgtctataaagaaggaacatttcatacgatgtggcacgtaacacgaggagccgttctaatgcataaagggaaacgaattgaaccatcatgggctgatgtcaaaaaagatttgattagttacggtggcgggtggaagcttgaaggagaatggaaggaaggggaggaggtgcaagtcctagccttagaacctggcaaaaatcccagagcggtacaaacgaaacccggtttattcaaaacaaacacaggtactataggcgctgtgagtctagacttctcgccaggaaccagtggcagtccaatagtcgacaaaaaaggaaaagtagttggactctacggtaatggagtcgtaacacgaagcggcacatatgtctctgctatagcacaaaccgaaaaaaatatagaagataatcctgagatcgaagatgacatctttcgtaaaaagagacttacaataatggaccttcatccaggagcaggtaaaacaaagaggtaccttccggcgatagtaagagaagcgataaagcgtgggttgcgtacacttattctagcaccgacccgtgtggtagcagcggaaatggaagaggcgttaagagggttaccaattagatatcaaacgccggcaatacgtgcagaacacacaggaagagaaatagttgatttaatgtgccacgctacatttacaatgagacttctatctccaatacgcgtgcccaattataacttgattataatggacgaagcacatttcacagatccagccagtatcgctgcacgcggatacatttctacaagggtagagatgggagaagcagcaggcatctttatgactgctacaccaccagggtcaagagacccattcccgcaaagcaatgcacctattatggacgaggaaagagaaattcctgaacgaagttggaacagcgggcacgaatgggtaactgatttcaaaggcaagaccgtatggttcgtccctagtattaaagctggaaacgacattgctgcatgtttaagaaaaaacggaaagaaagtaatacagctatcaaggaaaacatttgattccgagtacgttaaaacgcgcactaatgattgggattttgtagtaacaacagatatatcagaaatgggagcgaactttaaagctgagagagtaattgatccacgtcgatgcatgaaaccagtcattctaaccgatggcgaggaacgagtaatactagccggacccatgccggttacacatagttctgctgcgcaacgaaggggaagagtcggaagaaatccaaagaatgagaatgatcaatatatttatatgggagagccattagaaaacgatgaagattgtgcccattggaaagaagctaaaatgctactagataacattaatacccctgaagggataattccatccatgtttgagcccgaaagagaaaaagttgatgctatagatggtgagtatagattgcgaggagaggccagaaagacatttgtagacttgatgaggcgcggagacctgcctgtgtggcttgcttatcgagtagcagcagaaggaatcaattatgcagatcgacgatggtgttttgacggagtcaagaacaatcagatacttgaagaaaatgtcgaagtagagatctggacaaaagaaggggagagaaagaaattgaaaccacgctggttagacgctcgaatttacagtgacccattagctcttaaagagtttaaagagttcgctgccggacgaaagagtcttacgctaaatctgataactgaaatgggtagactccccacctttatgactcaaaaagcgcgaaatgccttagataacctggcagtgcttcatacagcagaagcgggaggaagggcatacaatcatgcgttatcagagttacctgaaaccttggaaacactcctactactcaccctactagctacagtgaccggaggtatcttcttgttcctcatgagtggaaaaggaattggaaagatgacactaggtatgtgttgtatagtaactgcaagtatattattgtggtatgcacagatacaaccacactggattgcagcgtccattatattagagttttttttaatcgtactacttatcccggaaccagagaaacaaaggactcctcaagacaaccaactaacttatgtcgttatagcaatattgacagtggtagcggctacaatggcaaatgaaatgggctttctggaaaaaacaaaaaaagattttggactcggatcaattaccacacaacaacctgaatcaaacatactagatatagacctacgcccggctagcgcctggacattatacgcagtagctactacatttataactcccatgctccgtcattctattgaaaactcaagtgttaacgtttcattaacagcaatcgctaaccaagccacagtgttaatggggctcggaaaagggtggcctctttctaaaatggatataggagttccattactagcaatcggatgttatagtcaagtgaacccaattaccttaacagctgcgcttttactgctagtggctcattacgccatcattggacctgggctacaggccaaagctacgcgggaggctcaaaaaagagcagctgccggcattatgaaaatacccgcagcagacattgggcgtgtcattgacctggatcctataccctatgaccccaaattcgaaaaacagttaggccaggtaatgttgctggtcttatgtgtcactcaggttcttatgatgagaactacctgggcattatgtgaggctttaacacttgcaactggaccaatcagcacactgtgggagggtaatcctgggagattctggaatactacaatagctgtttctatggcaaatatattccgtggaagttacttagctggcgcggggctcctgttctccataatgaaaaatacggcaaatactagacgcgggaccggtaatactggtgaaacactaggcgagaaatggaagaaccagttaaacgccctaggaaaaagtgaatttcaaatttataagaaatccggaattcaagaagtagatcgtactttagccaaagagggaattaagagaggggagactgatcatcatgcagtatcgaggggaagtgcgaaattgcgttggtttgtggaaagaaatttagtaacacctgaagggaaggtggtggacctaggttgcggaagaggtggatggagttactactgtggcggacttaaaaatgttaaagaagtaaagggattgaccaaaggagggccagggcatgaagaacccattccaatgtctacctacggctggaacctggtacgattacaatcgggagtagatgtctttttcacaccccctgaaaagtgtgatacacttctatgcgacattggtgaaagctcaccgaatccaaccgttgaagccggaagaacgctcagggtcttaaacctagtggaaaattggttaaataacaacactcaattttgcatcaaggttcttaatccgtatatgccgtctgttatagaaaagatggaagcgcttcaaagaaaatacggaggagcattagtacgtaacccgctaagcaggaatagtacccatgaaatgtattgggtctcaaatgcgagtggcaacattgtgtcatcggttaatatgattagcaggatgctaataaaccggtttaccatgagacataaaaaagccacatacgagccagacgtcgatctggggtcaggcactagaaacataggcattgagagcgaagtaccaaatttggacatcattggtaagagaatagaaaagataaagcaagaacatgaaacatcatggcattatgaccaagaccacccgtacaaaacctgggcttatcacggcagttatgaaactaaacaaacgggtagcgcatcttcaatggttaatggggtcgtacgactcttgaccaaaccgtgggacgtcattcccatggttacacagatggctatgacagatactacgccttttggccaacagcgagtttttaaagagaaagtggataccagaactcaagaacctaaggaaggtacaaaaaaactaatgaaaattacagcagaatggttatggaaagagcttggaaagaaaaagactccaagaatgtgcacacgagaagagtttacaaggaaagtacgatccaacgcagcattgggagcgatattcacagacgaaaataaatggaagtcagctagagaagctgttgaggattcaggattctgggaactggtagacaaagaacgaaacctccacttagaaggaaagtgcgagacttgtgtttataacatgatgggaaagagagaaaagaagttgggagagtttggaaaggctaaaggatcccgcgcaatttggtacatgtggcttggagcgaggtttctagagtttgaggcacttggcttccttaatgaggatcactggttttcgagagagaactccttaagcggagtcgaaggagaaggtttacataaattgggttacatcttgagggatgttagtaaaaaagaaggaggtgctatgtatgctgatgatactgctggatgggatacgcgcatcacgttagaagatttaaaaaacgaagaaatggtgacaaatcacatggaaggcgagcataaaaaattagcggaggcaatcttcagactgacatatcaaaacaaagtagttagagttcaaagaccaacaccaagaggaacggtaatggatataatcagtaggagagatcaaagaggcagcggacaagtagtcacatatgggttgaatacttttacgaatatggaagcacaactgatcagacagatggagggagaaggagtatttaagtcaatacaacatttaaccgcaaccgaggagatcgctgtcaagaactggctcgtacgagtcgggcgagaaagactctcacgaatggcaatatccggcgacgactgtgtcgtcaaaccattagatgatcgtttcgctaatgctttaacggctctaaatgatatgggtaaagtaagaaaggacatacaacaatgggagccttcacgagggtggaatgactggactcaagttccattttgtagtcatcatttccacgagctaataatgaaagatggaagggtcttggtagtaccatgcaggaatcaagacgagcttatagggagagcacgtatttcacagggggcaggatggagcctcagagaaacagcttgtttaggtaaatcatatgctcagatgtggagcctaatgtattttcatcgaagggatttaagacttgcagcgaacgctatctgttctgctgtgccttcacattgggttccaacatccagaacaacatggtcgatacacgcaacacatgaatggatgacaacagaggatatgcttactgtctggaatcgtgtttggatacaagaaaatccttggatggaggacaaaacaccagtcgaatcttgggaggaaataccgtatttaggtaagagagaagaccagtggtgcggttctttaataggtctcacaagtcgggctacctgggcaaagaatatacaaacggcgataaaccaggtgagatcactaattggcaatgaagaatacacagattatatgcctagcatgaagcgattccgacgcgaggaggaagaagctggcgtactgtggtag

SEQ ID NO: 22222 - RNA, 9876 nt, synthetic construct
  misc_feature 1..9876: note = derived and/or modified CDS sequence (opt6) from DENV-2__KX380819__SS-prME
  source 1..9876: mol_type = other RNA
actgcaggtattattatcatgatgatacctaccgtcatggcatttcacttaacaactaggaacggagaaccgcatatgatagtgagtcgccaagaaaaaggaaaatcattattgttcaaaactgaaaatggagtaaacatgtgcactcttatggcaatggacttaggggaattatgtgaagatactatcacatataactgtccactgctgagacaaaatgaaccagaagacatagactgttggtgtaattcaacatctacatgggtgacttacggaacctgcacagctacaggagaacatagaagagaaaaacgtagtgttgcattagtaccacacgtaggtatgggtctggaaacgaggactgagacctggatgagcagtgaaggggcatggaaacacgcacagagaattgaaacctgggttcttcgacatccaggttttaccgtgatggcagcaattcttgcttacacaataggcacaacgtacttccaacgcgtcttaattttcatattattaacggctgttgctccttccatgacaatgcgttgcatcggtatatcgaatagggatttcgtagaaggcatatccggaggaagttgggtagatatagtcttagaacacggatcatgcgtaaccactatggctaaaaacaaacccactctcgatttcgaactgattaaaactgaagctaaacatccggcaactttaagaaaatattgtatagaagcgaagctcaccaatactacaacagccagtagatgtccaacccaaggggaacctagtttaaacgaagaacaagacaaaagatttgtatgcaaacactccatggtagatcgcgggtggggaaacggatgtggtctatttggaaaaggaggaattgtaacatgcgccatgttcacttgcaagaaaaacatggaaggtaaaatcgtacaacccgaaaatttggaatatacaattgtaataactccgcactcaggagaggaaaacgcggtaggtaatgacacaggaaaacacggtaaagaaataaaagtcacgcctcaaagtagtataacagaagcggaacttaccgggtacggaaccgctacgatggaatgttccccaagaactggattggattttaatgaaatggtactactacaaatggagaacaaagcatggttagtacatcgtcaatggttccttgatcttcctttaccgtggttacctggagccgatacgcaaggaagcaattggatccaaaaagaaacgcttgttacctttaaaaatccgcacgccaagaaacaagatgtagtagtattaggaagccaagaaggtgccatgcatactgccttaacaggagcgacagaaatacaaatgtcatcgggaaacttattattcactgggcacttgaaatgtcgactccgaatggataaactacaattgaaaggaatgagctatagtatgtgcacaggtaaattcaaggttgtaaaagaaattgccgaaactcaacacggcacgattgtaataagagttcaatatgaaggagacggaagcccatgcaaaataccgttcgaaattatggatctggagaaaagacatgtcctgggtagactaataacggtcaatcccatagtgacagagaaggactcccctgtaaatatagaagcagaacctccattcggcgacagctatataataatcggagtcgaaccaggacaattgaaattatcttggttcaagaaaggatcgtctataggacaaatgttcgaaacaacaatgagaggtgcgaaaagaatggcaatattaggggatactgcctgggattttggaagcctaggaggagtctttacaagtataggaaaagcactccaccaggttttcggtgccatttatggagcggcgtttagtggagttagctggacaatgaaaattttaattggagtagtcataacttggattggaatgaatagtagatctacttcacttagtgtgagcctagtattggtcggaattgtaactttatacctaggtgttatggtgcaggcagatagtggttgtgtcgtaagttggaagaataaggaactaaaatgcggcagcggtattttcatcactgacaatgttcacacatggacagaacaatataaatttcaaccagaatctccaagtaaattagccagcgccattcaaaaagcacatgaagagggaatatgtggaatcagatcagtcactaggcttgaaaatttaatgtggaaacaaataacccctgagctcaatcacattttaagtgaaaatgaggttaaactcacaataatgacgggtgatataaagggaatcatgcaagcagggaaaaggtctttgagaccccaacccactgaactgaaatattcctggaaagcatggggtaaggctaaaatgttaagcactgaattgcacaatcatacttttctaatagacggtccggaaacagctgaatgccccaatacaaatagagcctggaatagccttgaagttgaggactatgggttcggcgtattcacaacaaatatatggttgaaacttaaagaaagacaagatgtattttgcgatagcaagctcatgtcagcagctatcaaagacaatagagcagtacatgcggatatgggctactggatagaaagcgcattaaatgatacctggaaaatcgaaaaagctagttttatagaagtgaaaagttgccattggcctaaatctcatactttatggtcaaatggagtgctcgagtctgaaatgattatacccaaaaactttgcagggcccgtatctcagcacaactatcggccaggctatcatacgcaaaccgcaggaccatggcatttaggacgattggagatggatttcgatttttgcgagggaacaacagtagttgtcacagaggactgtggtaatcgtggccctagtttaagaacaacaaccgcatccggtaaactaatcacagaatggtgttgtaggtcatgcacgcttccgcccttaagatatcgaggtgaagacggatgttggtacggcatggaaataagaccactaaaggaaaaggaagagaacctggtaaactccctcgttacggccggacacggtcaaatagataatttctcgttaggagtgttaggaatggctttattcttggaggagatgctaagaactagggtcggaacaaaacatgctatcctgctagtcgcagtcagctttgtaacattaattactggaaatatgagcttcagggacttaggtcgggtaatggtaatggttggcgctacaatgacagatgacataggcatgggggtcacttatttagcactattggctgcgtttaaagtaagaccaacatttgcagctggcctcttgctgagaaagctcacatctaaagaattaatgatgaccacaattggtatagttttactttcacaaagtacaattccggagaccattttagagctgacagacgcattagctcttggtatgatggttttaaaaattgtccgaaacatggaaaaataccagttagctgtcactataatggctattctttgcgttcctaacgctgtgatactccaaaatgcatggaaagtatcttgtacaatactcgctgtggtttcggtaagtccattgctcttaacaagttctcagcaaaaagctgactggatacccttagcgctaacgatcaaaggtttaaacccaacggcaatatttttgactacactatcccgcacatcaaagaaacgttcgtggcctctcaatgaagctataatggcagtgggaatggtttctatactagcatccagtttgttaaagaatgacatccccatgaccggacctctagtagctggaggcttattaacagtgtgttatgttctaacgggtaggtcagctgacttggagttagagcgtgctgctgatgtaagatgggaagaacaagcggaaatatcaggttctagtccgatattaagtataactataagtgaagacggctctatgtctattaaaaatgaagaagaagaacaaacactgacgatacttatacggacaggcctgttagtaataagtggactctttccggtatctataccgatcacggccgcagcatggtacttgtgggaagtgaagaaacagagggcgggagtcttatgggatgtcccgagcccgcctcctgtaggaaaagcggaattagaggatggagcctataggataaaacaaaaagggattctagggtattcgcaaataggcgctggtgtatataaagagggcactttccacacgatgtggcatgtaaccagaggagcggtgctaatgcacaaaggcaaaagaattgaaccaagttgggcggatgtaaagaaagacttaataagctacgggggaggctggaaacttgaaggtgaatggaaagaaggcgaagaggtacaagtattggcactagaacctggtaaaaatccgcgggcagtacaaacgaaaccaggattattcaaaacgaatactgggacaataggggctgttagtttagacttttcaccgggcacctcgggaagtccgatcgtcgataagaaaggcaaagtcgttggcctctatggtaatggagtggtcacgcggtccggcacttacgtatcagctatagcacagacagagaaatcaatagaggataatcctgaaatagaagacgatatattcaggaagaaaagacttaccatcatggacttgcatccaggagcaggcaaaacaaaaaggtaccttcctgcaattgtaagggaggctataaaaaggggattgagaacactaatcctggcaccaactcgagtagttgccgcagagatggaagaagcacttcgaggattaccaattagatatcaaacaccagcaataagagcagagcatacagggagagaaatcgtagacttgatgtgccacgcaacgttcacaatgcgtctactgtcacctattagagtaccaaattacaatctgattataatggacgaagcacactttacggatccggcatcaattgctgccagaggatatatcagcacgagggtggaaatgggcgaggcagcaggtatctttatgacggcgacacccccgggatccagagatcctttcccccagagtaacgctccgatcatggatgaggaacgtgaaataccagaaagatcctggaactctgggcatgaatgggttacggacttcaaagggaaaaccgtttggtttgtcccgagtataaaagcgggaaacgacatcgccgcatgcttgaggaaaaatggcaagaaagtcatccaactaagtaggaaaacgttcgattcggaatatattaaaacaaggactaacgactgggatttcgtagtaacaacagatatttcagaaatgggtgcaaatttcaaagctgaaagggttattgatcctagaaggtgcatgaaaccagtcatcttaaccgatggtgaagaacgcgttattttagctggacccatgcccgtaactcactctagtgcggctcaaagaagaggtagagttgggagaaatcccaaaaacgaaaatgaccagtacatttatatgggggaaccattagaaaacgatgaggactgtgcccattggaaagaggcaaaaatgctactagataatattaataccccagaaggcataatacctagtatgtttgagccagaaagagagaaagtagacgccattgacggagagtatagactccgcggcgaagcgcgcaaaaccttcgtggatttaatgcgaaggggtgacctgccagtttggctcgcttatcgagtagccgcagaaggtataaattacgccgatcgacgatggtgttttgacggagtaaagaataatcaaatcttagaggaaaacgtcgaagttgaaatttggacaaaggaaggagaaaggaagaagctaaagcctaggtggctcgacgctaggatctatagtgatccactagctctaaaggaatttaaggaatttgcggcaggccgtaagtcgctgacactaaatcttataaccgaaatgggaaggctaccaacatttatgacccaaaaagctcgcaatgctttagataatctcgcagttctacatacagcagaagcaggaggcagggcatacaatcatgcattatcagaactcccagaaacattggaaaccttattactgctcactttacttgccactgtcactggtggcatatttttattcctgatgtctggaaaaggaatcggaaaaatgacactaggtatgtgttgtattataaccgcgtcgatattactatggtacgcacagatacaaccacattggatagcggcctcaataatactagagttctttctcatagttctcttgattccggagcctgaaaaacaaaggaccccgcaagacaaccaactcacgtatgtagtaattgcaatattaacagtagttgcagccacaatggctaatgaaatgggatttctagagaaaaccaagaaagatttcggattaggtagtataaccacccagcaacccgattccaatattttagacattgatttgaggccagcatctgcttggacactatatgctgtcgcaaccacatttattacacctatgctacgtcatagcatagaaaattcgagcgttaatgtcagtctaacagctattgccaaccaagcaaccgtgttgatggggttagggaaaggttggccattaagtaaaatggacataggtgtaccattacttgcaataggctgttacagtcaggtgaatccaataaccttaaccgcagcgttgctgttattggtagctcattatgcaattattgggccaggtcttcaggcaaaagcaacgcgtgaagcccaaaaacgtgcggctgcggggataatgaaaatacctgcagcactaattggtagggttatcgatcttgatcctatcccatatgatccaaaattcgagaagcagctcggacaagtcatgctattggtattatgcgttacacaagtacttatgatgaggacaacatgggcgttatgtgaagcactaaccttagcaacaggccccatttctacattatgggaagggaatcctggacgattttggaacacaactatcgcagtcagtatggcaaatatttttaggggtagttacttagcaggagcaggtttattgttttctattatgaagaatactgcaaatacaagacggggaacagggaatactggcgaaacattgggagaaaagtggaagaataggcttaacgcactaggaaagagcgaatttcaaatatataagaaaagcgggattcaagaagtagatagaacactagcgaaagaagggatcaaacgcggagaaacagaccatcacgcagtctcgcgcgggtctgctaaattacgatggttcgtagaaaggaacctagtaactcctgagggcaaggttgttgatctagggtgtggaagaggaggatggagttactattgcggaggtctaaagaacgtaaaggaagtgaaggggttgactaaaggcggccctgggcatgaggaacccataccgatgtctacctacggttggaatttagtgagattacaatctggagtagatgtattcttcacacctccagagaaatgcgatactttattatgtgacatcggagaaagctcgccaaaccccaccgttgaagccggaagaactttaagagtattaaatttggttgaaaattggcttaataataatacacagttttgtattaaagttctcaatccctatatgccaagcgtaattgagaaaatggaagccttacaaagaaaatacggtggtgcactcgtgcgtaatcctttgagtagaaatagtacacacgagatgtactgggttagtaacgcttcaggaaatattgtttccagcgttaatatgatatctcggatgttgataaatagattcacaatgaaacataagaaagcaacctacgaaccagacgttgaccttggatcaggaaccagaaacataggaatcgaatccgaaacacctaatctggacataatcggcaagagaatagagaaaataaaacaagaacacgaaacatcttggcattatgaccaagaccatccgtacaaaacatgggcatatcatggctcttatgagacaaagcagacgggaagtgctagctcaatggtaaatggagtagtaagactactgacaaagccctgggacgtaataccaatggtgacccaaatggcaatgaccgatactacacctttcggtcaacaaagggtttttaaagaaaaagttgatacacgaacccaggaaccaaaagagggtaccaagaaactaatgaagatcaccgcagaatggctatggaaggagctgggcaagaagaaaactcccagaatgtgtactcgagaagaatttacgcgcaaggtacgctcaaatgctgcattaggcgctatcttcacagacgaaaataaatggaaatccgctagagaagcggtcgaagacagtgggttctgggaattagtggataaggaaagaaatttacatttagaagggaaatgcgaaacgtgcgtatataatatgatggggaaaagagaaaagaagctaggcgagttcggtaaagcaaaaggaagtagagcaatatggtatatgtggttgggcgcaaggttcctagaatttgaggcattaggatttctaaatgaagaccactggttttctagagaaaactccctttcaggggtggaaggcgaaggtctgcataaactgggttatatcttacgagatgtatcaaagaaagaaggaggggctatgtacgccgatgacacggcggggtgggacacccgaattacattggaagatcttaaaaacgaagagatggtgactaaccacatggaaggggaacacagaaaactagccgaagcaatctttagattaacgtatcaaaataaagttgtacgagtacaaagaccgaccccacgaggaactgtaatggatataatttcccgtagagatcaaagaggctcggggcaagtagtaacgtatggacttaatacatttacaaatatggaggctcaattaataagacaaatggaaggtgagggagtttttaagtccatccagcatttaacggtgacagaagagatagcagtcaagaactggttagagagagtaggacgagaacggttatcacgcatggcaatatcgggagatgactgtgtggtcaaacctcttgatgatcgcttcgcatccgccttaactgcattaaacgatatgggaaaagttaggaaagacatacaacagtgggagccaagtagaggctggaacgattggacccaagtacctttttgctcacatcattttcatgaacttataatgaaagacggcagagtccttgtcgtcccatgccgcaatcaggatgaactaataggacgggcaagaatttcccaaggagcgggttggtccctacgtgagacagcttgtcttggaaaatcatatgcccaaatgtggagtctaatgtattttcacagaagagatctaaggttagctgccaatgctatctgtagcgccgtgccgtcacattgggtcccgatatcgagaactacttggagcatacacgcaacacatgaatggatgacaacagaagatatgctcaccgcatggaatcgagtatggattcaagaaaacccttggatggaagacaaaacaccagtagagagctgggaagagatcccctatctaggaaaaagagaagatcaatggtgcggctctcttatcggcttaacgtcacgagcaacttgggccaaaaatatacagacggccataaaccaagtcagatcgctcatcggaaatgaagaatatacagattacatgccatcaatgaaaagattcaggagagaagaggaagaagcgggggttttatggtaa

SEQ ID NO: 22223 - RNA, 9876 nt, synthetic construct
  misc_feature 1..9876: note = derived and/or modified CDS sequence (opt6) from DENV-2__KX380821__SS-prME
  source 1..9876: mol_type = other RNA
acagctggaataattatcatgatgatcccaacagtcatggcatttcacttaacgacccgtaatggtgaacctcatatgattgtgagcagacaagaaaagggaaaatcacttttatttaaaacagaaaatggcgtaaacatgtgtacacttatggcaatggatctaggggaattatgtgaagatactattacctataactgtcctctcctacgacaaaatgagcctgaggacattgattgttggtgcaattcaacgagtacatgggtcacttatggtacatgcaccgctactggagaacatagaagagaaaaaaggtccgtagcgttggtaccacatgtgggtatgggtttagaaacgagaacagagacctggatgtcctccgagggagcatggaagcacgcacaacgaatcgaaacctgggttcttcgacaccctggatttacggtaatggccgcaatcttagcatatacaatcggtaccacttatttccaacgggtattaattttcatccttttgaccgcagtagccccctccatgacaatgcgatgtatcggtatctctaaccgggattttgtagaaggggtatcgggaggatcatgggtggacatcgtccttgaacacgggagctgtgttacaactatggcaaaaaacaaacctaccctggattttgaattaattaagacggaagcaaaacatcctgctacattgagaaagtactgcatcgaagcaaagctgacaaacacaactactgcgagccgttgccctacacaaggagagccaagtctaaacgaagagcaagataaaagattcgtgtgtaaacattctatggtcgaccgaggttggggcaatgggtgtgggctgtttggaaagggaggaatagtcacgtgtgcaatgtttacttgtaaaaaaaacatggaagggaaaattgttcaaccagaaaatttggaatatacaatagttatcacaccccattctggggaagagaatgcagtcggaaatgatacgggaaaacatggaaaagaaataaaagtcactcctcaaagctctatcactgaagcggaattaacgggctatggaacggctaccatggaatgttcacctcggacgggtttggactttaacgaaatggtattgttgcagatggaaaacaaagcatggctggtccacagacaatggttcttagaccttcctttgccttggctaccaggagcagatacccaaggttctaactggattcaaaaagaaactcttgttacctttaagaatccacacgctaaaaaacaagatgtagtcgtgcttgggtcgcaagaaggtgcaatgcatacagccttgactggggcaacagagattcagatgtcgtccggcaacttactattcacaggacatctgaagtgcaggctccgcatggataaactgcaattaaaaggtatgtcgtatagcatgtgtaccggaaagttcaaggtcgtcaaagagatcgccgaaactcagcatggcactattgttataagagtacaatacgagggcgatggatctccatgcaagataccgtttgaaataatggacttagaaaaacgccatgttctgggacgtttaataactgttaatccgatcgttacggaaaaggactcgcccgtcaatatcgaagctgaaccgccctttggagattcgtacattattataggtgttgaacctggtcaactaaaactgagttggttcaaaaaaggctccagtattggtcaaatgtttgaaacaaccatgcgcggtgctaaacgaatggcgattctaggcgataccgcttgggattttggctcattaggtggcgtttttacctccataggaaaggctttacatcaagtattcggtgcaatctacggtgccgcgtttagtggtgtaagttggacgatgaagatccttataggagtagtcataacatggataggtatgaattcacgttctacatctttaagtgttagtttagtcttagtgggtgtagtaacgctatatcttggagtaatggttcaggccgatagtggatgcgtcgtttcttggaaaaataaagaattgaaatgcggtagcggcatttttattactgataatgtacacacatggacagaacaatacaaattccaaccggaatcacccagcaaactagcgtcagcaatacaaaaagctcacgaagagggtatatgcggaattagaagtgtaactaggctagaaaacctcatgtggaaacaaattaccccagagctaaatcatatcttaacagagaatgaagttaaactaacaatcatgaccggtgacataaaaggaataatgcaagctggcaagagaacattacgcccgcaaccgaccgaattaaaatattcatggaaagcttggggtaaagcaaaaatgttatctacagaactacacaatcacacattccttatcgacggacctgaaacagcagagtgtcccaataccaatagagcctggaattcattggaagttgaagattacggttttggagttttcacgaccaacatttggcttaaattaaaagaacgccaggatgttttctgtgatagtaaactgatgagtgctgctattaaagacaatagagcagtacacgcagatatgggatattggatagaaagcgcgttaaacgatacatggaaaatcgagaaagcttcttttatcgaagttaagtcgtgccattggcccaaatcccacacactatggtccaatggtgtacttgaaagcgaaatgataatacctaagaattttgctggtccagtcagtcaacataactatcgacccggctaccatactcaaaccgctggaccgtggcacctaggtagactagaaatggacttcgacttctgtgaaggaacgactgtagtagttaccgaagactgtggtaaccgtgggccatcattaagaaccactacagcaagcggcaaactaatcacagaatggtgttgccgttcgtgcacactaccccctctgaggtaccgaggtgaagatggctgctggtatggaatggaaattcgccccttaaaagaaaaagaggagaacttggtaaattcccttgtaaccgcgggccacggacaaatagacaatttttctcttggagtactaggaatggcacttttccttgaagaaatgctacgtacgcgagtaggaaccaaacacgcgatactccttgtggcagttagctttgtaactctgattacaggaaatatgagttttcgcgacttaggacgagtaatggtaatggttggagcaactatgacagatgatataggaatgggagtgacctacttagcattattagctgccttcaagatcagacctacatttgctgcaggccttctattgaggaagttaacaagcaaagaattaatgatgacaacaataggtatagttttgctatcacaaagcaccatccctgaaagtatacttgagctgactgacgcgcttgcattgggaatgatggtattaaaaattgtaaggaatatggaaaaataccagctagcggtcacaattatggcaatattatgtgtaccaaacgctgtcattctgcaaaatgcgtggaaagtatcatgtacaacactggctgtcgtcagcgtctcgccattattactaacctcaagccaacaaaaagccgattggatcccgttggcactaacgataaagggattaaatcccactgcgattttcctaactaccctatcacgtacctctaaaaaaaggagctggcctttgaacgaagctataatggctgttggcatggtatcaatcttggcgtcatctcttttaaaaaatgacatacccatgactgggccgttagtagcaggaggattgttaacagtttgttacgtgctcacaggacgaagtgcagatttagagcttgagcgagccgcagatgtacgttgggaagaacaggctgaaattagtggaagcagtcctattctatcgatcacaataagtgaagacggttctatgagtattaaaaacgaagaagaagaacaaacactaacaattcttatcaggacgggactacttgtgataagcggattatttcccgtgagcattccgataacagcagcggcatggtacctctgggaagtgaaaaaacaacgtgcaggagtattatgggatgtacccagcccacctcctgtggggaaagcagagcttgaagacggtgcctatagaatcaaacaaaagggtatattaggatattcgcaaataggtgctggcgtttacaaagagggtacttttcacacgatgtggcacgtaacaagaggggcagttttaatgcataagggaaaacgcattgaaccatcttgggcggacgttaaaaaagaccttatatcatatgggggagggtggaaacttgaaggagagtggaaagagggagaggaagttcaagttcttgcattagagccaggaaaaaatccccgtgcggtacaaacgaagcctggattatttaaaacaaatacagggacaattggcgctgtcagcttagatttcagtccagggacctcagggtctccaatagttgataaaaaaggaaaggtcgtcggattatacggcaacggagtagtcacacgttcaggtacatatgtttctgccatagcgcaaacagaaaaatcaatagaagataatccagaaatagaggatgacatatttcgaaaaaaaaggcttacgatcatggacctgcatcctggtgcaggaaagacaaaaagatatctaccagcaatcgtgagagaggccatcaagaggggattgaggacactaatattagcccctaccagggtcgttgcagcagaaatggaggaggcattacgcgggctccctatcagataccaaactcccgctataagagccgagcatacgggaagggaaattgtagacctaatgtgtcacgcaacgtttacaatgagacttttatctcccatcagagttcctaattacaatttaataataatggatgaagcacacttcacagatcctgcaagtatcgctgctcgcggatacatatccacacgtgttgaaatgggagaggcagctggcatattcatgactgcaactccaccagggtcgagagatccattcccgcaatccaacgccccaatcatggatgaagaaaaggaaataccagaacggtcttggaatagcggtcatgagtgggttacagattttaaagggaaaaccgtctggttcgtaccaagcattaaggcaggaaatgatatagcagcttgcttacgaaagaacggaaaaaaagtaatccaattgtcgagaaaaactttcgatagcgaatacataaaaacgcgaacaaatgactgggattttgtggtaacgacggatatttcagaaatgggtgccaactttaaggcagaaagagtaattgacccaagaagatgtatgaaaccagtgattttaacagatggcgaggaaagagtgatattggcgggcccaatgccagtaacgcattcctctgccgcacaacgacgaggtagagtaggaagaaacccaaagaatgagaatgatcaatacatatacatgggagagccgttagaaaacgatgaggattgtgcacattggaaagaggctaaaatgctactagacaatatcaatacacctgaaggcataataccgagcatgtttgagcccgaaagagaaaaggttgacgcgatagatggcgaatatagactccgaggagaggccagaaaaacatttgtggaccttatgagacgtggtgacctgccagtctggcttgcttatagggtagccgccgaaggaattaactacgcagatagaagatggtgttttgatggcgtcaaaaataaccaaatattagaagagaatgtagaagtagaaatatggactaaggaaggagagagaaaaaaactaaaaccaagatggctcgacgctcgaatttactcagatccattggcactaaaggaatttaaggaattcgctgcaggacgcaagtctctaacacttaaccttattactgaaatgggacgactgccaactttcatgacacagaaagctaaaaatgccctagataacttagcggtactccacacagcagaggctgggggtagggcatacaatcacgcattatcggaactaccggaaacactagaaactttattactgctaactctattagctactgtcacaggtggcattttcttatttctgatgagtgggaaggggataggaaagatgacattaggaatgtgttgcataataacggcttccatcctcttatggtatgcacaaattcagccacactggatcgcagcatcgatcatattagaattttttcttattgttctattaatacctgaaccagaaaagcaaagaaccccgcaagacaaccagttaacgtatgtcgtaattgctattctgacagttgttgcagcaactatggctaatgaaatgggatttctagaaaaaactaaaaaagattttggtctgggttcaataactactcaacaacctgaatcaaatattctagacatcgatttacgccctgccagtgcgtggacgttgtatgctgtagcaactacctttataactccgatgctacgccatagtatagaaaactctagcgtgaacgtttcgttgaccgccatagcaaatcaagcaacagttcttatgggtctaggtaagggctggcctcttagtaaaatggatatcggagtgccactgttagctataggttgttatagccaagttaatccaatcacgctgacggcagcacttttattgcttgtagcacattatgcgatcattggtccaggtttacaagcgaaagctacacgcgaagcacaaaaaagggcagcagcaggtataatgaagaacccaacagtagatggcatgacagtcatagatttagaccctatcccatacgaccctaagtttgaaaaacaattgggtcaagtaatgcttcttgtactttgcgttacccaggtactaatgatgcgaacgacctgggcactttgcgaagcgttaactctagcgactggacctatatctacactatgggaaggaaaccccggaagattctggaacacaaccatagccgtcagtatggcaaacatattcagagggtcatacctagcaggagcaggcttactattctcaatcatgaaaaatacggctaatacaagacgaggcactggtaacacaggagaaacactaggcgagaaatggaagaataggttaaacgcactgggtaagagtgagttccagatttataagaaatcaggcatccaggaggtagaccgcactttggcgaaagaaggaatcaagaggggtgaaacagatcaccatgcagtttccagaggatcagccaagctccggtggttcgtagaaaggaacctcgtaacacccgaaggaaaagttgtagatctaggttgtggaagagggggttggtcctactattgtggtggactaaagaatgtaaaagaagtgaagggtttgacaaaaggaggccctgggcatgaggaaccaattccgatgagcacatacggatggaatctagtgagattgcaaagcggtgttgatgtctttttcacgccacctgaaaaatgtgacacattactctgtgacattggggaatcatcgccgaaccctaccgtagaagctggacgaacccttagagtactaaacttagttgagaattggctaaataacaacactcaattttgtattaaagtacttaatccctacatgccttctgtcatagagaaaatggaagctctccaacgcaaatatggaggcgcattggtacgaaacccactaagcagaaattcgacacacgaaatgtattgggtttcaaacgcgagcggcaacatagtgagtagtgtcaacatgatcagccgaatgctgataaatcgttttacaatgcgtcacaagaaagcaacatatgagccggatgtggatctagggtctggaacaaggaacatcggcattgaatcagaaactcctaatcttgatatcatcggaaagagaatcgagaaaataaaacaagaacatgaaacctcatggcattacgatcaggaccacccctacaaaacatgggcatatcatggaagttacgaaacaaaacaaacaggaagtgcctcatctatggtaaatggtgtagtaagattattaactaaaccatgggatgtcataccaatggtgactcaaatggctatgaccgacacgactccattcggtcaacaaagagtttttaaagaaaaagttgataccagaacacaagagcccaaagaaggtacaaagaaacttatgaaaataaccgccgaatggctgtggaaagaactaggaaagaagaagacaccgaggatgtgtactcgagaggaatttactagaaaggtacgttcaaatgcagcattaggcgctatattcacggacgaaaacaagtggaagtctgcacgcgaagctgtagaagatagtggattttgggaactagtggacaaagaacgaaatttgcacttagaaggtaaatgtgaaacttgcgtatacaatatgatggggaagcgagaaaaaaaactgggtgaattcgggaaagcaaaaggatcaagagccatttggtatatgtggttaggcgcacgattcttagaattcgaagcactagggttccttaacgaggaccactggttcagcagggaaaattcactatctggagtagaaggagaaggcttacataagctgggctatattttaagggatgtaagtaaaaaagagggcggcgctatgtatgcagatgatacagcaggatgggacacaaggataacattagaagatctcaagaatgaagagatggtaactaatcatatggagggcgagcacaagaaattagccgaggcgattttcaaattgacgtaccagaacaaagtagtacgagttcagcgtcctacaccgcggggaacggtaatggatatcatatcccgaagagaccaacgaggctccggtcaggtagttacttacggactaaacaccttcactaatatggaagcgcaattaatccgacagatggaaggagaaggagtgttcaaaagcatacaacaattaaccgtaaaagaagaaatcgcagtcaagaattggttaataagagttggcagagaacgactaagcagaatggcaatctccggagatgactgcgtagtcaaaccattagatgatagattcgcatcggcattaacggccttaaatgacatgggcaaagttagaaaggatatacaacaatgggagcctagccgaggatggaacgactggacacaagtcccattttgcagtcaccacttccacgaacttattatgaaagatggtagggtattggttgttccctgtcgaaatcaagacgaactaattggacgtgcccgcataagccagggtgctggttggagtctacgagaaacggcatgtctaggtaaatcttacgctcaaatgtggtcattaatgtatttccatagaagagacctaagattggcagccaatgcaatttgttcagcagtcccttctcattggataccaacgtcacgaacaacatggtcaatacacgctacacatgaatggatgactacggaagacatgcttacagtgtggaacagggtatggattcaggagaatccatggatggaagataaaacccccgttgaatcatgggaagagataccctacctgggaaaaagagaagatcaatggtgtggatcactaattggcttgactagccgtgcaacctgggccaaaaatatacagactgctataaatcaggtacgtagtctaatcggaaacgaggaatacacggattatatgccatcaatgaagagattccgacgtgaagaagaggaagccggagtactatggtaa

SEQ ID NO: 22224 - RNA, 9876 nt, synthetic construct
  misc_feature 1..9876: note = derived and/or modified CDS sequence (opt6) from DENV-2__KX380822__SS-prME
  source 1..9876: mol_type = other RNA
acagcaggtataataatcatgatgatcccaaccgtgatggcgtttcatttgacaactagaaatggagagccacatatgattgtatctagacaagagaagggaaaatcactattatttaagacagaaaatggcgtgaatatgtgtactttaatggccatggatctaggtgaattatgtgaagacacaattacttataattgtccattactacggcaaaatgaacccgaggatatagactgctggtgcaattcgacgtcaacgtgggttacctatgggacctgcacagccacgggagaacatagacgggagaagagatcggtagctttagttccacatgtggggatgggtttagaaacccgtacggaaacctggatgtctagtgagggagcctggaaacacgcacaaagaatagaaacatgggtactaaggcacccgggtttcacagtaatggctgcgattttagcctatacaatagggaccacgtacttccaaagagtattgatattcatcttactaacagcagttgcgcctagcatgactatgagatgcataggaataagcaacagagacttcgtcgaaggcgtatccggaggctcgtgggttgacatagttttggagcatggttcatgtgtgacaactatggcaaaaaataaacccacactagattttgaattaattaaaacggaagcaaaacaccctgcgactttacggaaatattgcatagaagcaaagctaacgaatacaacaacagcatctcggtgtcccacgcagggtgaaccaagtttgaacgaagaacaagataaacgattcgtatgcaaacattcaatggtagatagaggatggggtaacggatgtggacttttcggaaaaggaggcattgtgacctgtgctatgttcacatgcaagaaaaacatggaaggcaaaatagtacaacctgaaaatctagagtatactattgtaataaccccgcattcaggagaggagaacgctgttggcaatgatactggaaaacatggaaaagaaatcaaagtgacaccccaatcgagcataaccgaagccgaactaacaggatatggtacagcaactatggaatgctcaccccgcacggggttagactttaatgaaatggttctgctgcaaatggagaacaaagcatggctagttcatcgccaatggttccttgacctacctttaccttggctgccaggagccgatacacaaggctcaaattggattcaaaaagaaacactcgtaacatttaagaatccacatgcaaagaaacaagacgtggttgtgcttgggagccaggaaggcgccatgcatacagcgttgacgggtgcaacagaaatacaaatgagttccggtaatcttctattcaccgggcatcttaaatgtcggctccgaatggacaaactccagctaaaaggtatgtcctattctatgtgtacaggcaagtttaaagtagtaaaagaaatagcagaaactcaacatggtacaatcgtcatccgggtgcaatacgaaggtgacggcagtccatgtaagataccgttcgaaattatggatctcgaaaaaagacacgtgttagggagacttatcacagtcaatcctatagtcacagaaaaagatagcccggtaaatattgaagctgagccaccatttggggacagctatataattataggagtcgagcccggacagttaaaattaagctggttcaagaagggaagctcaataggacaaatgtttgaaaccacgatgcgaggtgccaaaagaatggcgattttaggtgacaccgcctgggattttggatctctgggaggtgtattcacaagcataggtaaagctttgcatcaagtatttggagcaatttatggcgctgccttctcaggggtcagctggaccatgaaaatcttaatcggagtagtaataacctggatcggtatgaacagtcggagtacctcccttagcgtaagtctggtcttggttggtattgtaacactttacctaggagtcatggtacaagcagatagcggttgtgttgtaagttggaaaaacaaggagctaaaatgtggctcaggaatattcataactgacaatgttcatacctggacggaacagtataaattccaacccgagagtcctagtaaattagcctcagccatacaaaaagcacacgaagaaggcatctgtggcatacggagtgttacaagattagaaaatcttatgtggaaacaaattactccggaactaaatcacatacttagcgaaaatgaagtaaaattaactataatgacgggtgacataaagggtataatgcaagctggaaaaaggtccctgcgaccacaacccaccgagttgaaatactcatggaaggcatggggaaaggccaaaatgttatcaacagaattgcataaccacactttcttgatagatggtccagaaaccgcggaatgtcctaatacaaacagggcctggaactctcttgaagtagaagattatggatttggagtgtttaccactaatatttggctaaaattgaaggaacgtcaggatgttttctgtgatagtaaactaatgtctgctgcgattaaagacaatagagcggtccacgcagacatgggctattggatagaaagtgccttgaatgacacgtggaagatagaaaaagcctcgttcattgaggtcaaatcatgtcattggccgaaaagccatacactttggtcaaatggagtcctagaaagcgagatgataattcccaaaaattttgctggtccagtgtcgcagcataattacagaccaggttatcacactcaaactgctggtccttggcatctaggaagactagagatggatttcgatttttgtgaaggcactacagtagtagtcactgaagattgcggcaaccgcggccccagcttacggacgaccactgccagcggcaagctaataacagaatggtgctgtcgaagttgcacattaccaccattacgatataggggggaagatggttgttggtacggaatggaaataagaccactaaaggaaaaagaagaaaacttagtaaattctttagttactgccggacatgggcaaatagacaatttctccttgggcgtcctggggatggcactattcctagaggaaatgcttaggacaagagttggaacgaagcacgcaattctgttggtcgcagttagtttcgttacattgataaccgggaacatgtcatttagagacttagggcgtgttatggtaatggtgggcgccaccatgactgacgatataggaatgggagtaacttatctagcattattggcagcgtttaaagtaagacccacatttgccgctggattactattaagaaaacttacctctaaggaactaatgatgaccacaatcggaatcgttctcttatctcaatcaacgattcctgagacaatactagaactaaccgatgcactagcgcttggcatgatggtccttaaaatcgtccgaaatatggagaaatatcaactagcagtcaccattatgacgatactatgcgtgccaaatgcagtcatactacagaatgcgtggaaagtttcttgtacaatcttggcagttgtatcggtttcaccattactattaacgagctctcaacaaaaagcagattggattcctctcgcacttacaataaaagggctcaatccaactgctatattcctaacgactctctcacgaaccagtaaaaaacgaagttggccactcaatgaggcgataatggcagtaggtatggttagtattcttgctagttcacttttaaaaaacgatatacctatgacgggaccgttagtagcaggaggtctactcaccgtttgctatgtactaacaggacgcagcgctgacttagagctggaaagagccgcggatgtgagatgggaggagcaggccgaaataagtggaagctcaccaattttaagtataaccatatctgaagatggtagcatgtcaataaaaaacgaagaggaagaacagacgctaacaatcttaatacgaactggactactagtcatatccggtctattcccagttagtatacctataaccgcggccgcatggtacttgtgggaagtaaaaaaacagagggccggtgtactctgggacgtcccatctccccctccagttggtaaagcagaacttgaagacggagcatatcgtatcaaacagaaaggaattctaggatatagccaaataggcgccggcgtatacaaagaaggtacatttcataccatgtggcatgtgactcggggtgccgtcttgatgcacaaaggcaaacggatagaaccgagctgggcagacgtgaaaaaagacttaatcagttatggtggtgggtggaagttagaaggagaatggaaagaaggggaggaagtacaagtcctagctttggaacctggtaagaaccccagagctgtacaaacgaagccgggattgtttaaaactaacacaggaacaatcggagccgtaagtcttgatttcagcccaggtacgtcaggttcgccaattgtagataagaaggggaaagttgttggtctatatgggaatggcgtcgtaactaggagcggaacctacgtctcggctatcgcacagactgaaaaaagtattgaggataatcccgaaatcgaggacgacatttttagaaagaagcgactaacgatcatggacctccatcccggcgcaggaaagacaaaacgttacctgccagccatcgttagagaagctataaaaaggggtctacgcacattgatacttgcaccaacaagagtagttgccgcggaaatggaagaagcattaagaggattaccaatcagatatcagacacctgctatacgagccgaacataccggacgagaaatagttgacctaatgtgtcatgccacctttaccatgagattattatcccctataagagtgcctaactacaacctaattattatggacgaagctcatttcaccgatccagcaagcatagctgcgagaggttatatcagcactagagtggagatgggagaagctgcaggtatattcatgacggcgacacccccagggtcacgtgatccgtttcctcagtccaatgcgccaataatggacgaggaacgagagataccagagcgaagttggaatagtggccatgaatgggtcactgattttaaaggaaagacagtttggtttgttccaagtataaaagccggaaatgatattacagcatgtttgcgaaaaaatgggaaaaaagtcatccaactaagccgaaagactttcgattcggagtacattaagacccgcactaacgactgggattttgttgtgactacggatatttctgaaatgggtgcaaatttcaaagcagagagggtcatcgacccacgaagatgtatgaagccagtgattcttacggatggggaagaacgtgtcattttggccggaccaatgccagtcacacattcaagtgcggctcaaagacgtgggagagttggcagaaatcccaagaacgaaaatgatcaatatatatacatgggcgaaccgctggaaaatgatgaggattgtgctcattggaaagaagcaaagatgcttctagacaacataaatacacctgaagggattataccaagtatgtttgaacctgagagagaaaaagtggatgcaatagatggggagtaccggctaagaggtgaagccagaaaaacatttgtagatcttatgaggcgaggtgatttaccagtatggctcgcgtatagagtcgctgcagaaggaatcaactacgcggaccgcagatggtgttttgacggcgtgaaaaataatcagattttagaagaaaacgtcgaagtagaaatatggaccaaagaaggagaaagaaaaaaattaaagccacgatggttggatgcccgtatatacagtgaccccttggccttaaaagaattcaaagaattcgctgcagggagaaaaagcctaactctaaatctcataacagaaatgggtagactacctacttttatgactcaaaaagcaagaaatgctttagataatctggcagtgttacatacagccgaagcgggagggcgtgcatacaaccatgcattatctgaattaccagaaacattagaaacacttttactattaactcttcttgcaacagtgacaggtggaatttttttgtttctaatgtctggcaagggaatagggaaaatgaccctaggaatgtgttgcattataacagcttcgatactgctgtggtatgcgcagatacaaccccattggatcgctgcatcaatcattttagaatttttcttaatagtcttgctaatacccgaaccggagaaacaaagaacaccccaggataatcagcttacttacgtggtaatagccattttaaccgtcgtagcagcaacaatggccaacgagatgggtttcttggaaaagacaaagaaagacttcggactcggatcgataactacacaacaaccagacagtaatattttagacatagacctgcgaccagcgagtgcctggacactatacgcagttgcgactactttcatcacgccaatgttgaggcactcaatcgagaactctagtgtcaatgtatcgcttacagcaatagctaatcaagcgactgttcttatgggcttaggtaaaggatggccattgtcaaaaatggatattggagtacccctactcgcgattgggtgttacagtcaagtgaatcccataacactcacagcagcgctcttattgttggttgctcactacgctataataggaccaggcctccaagcaaaagcaacacgggaagcccaaaagagagcagccgccgggattatgaaaataccagcagcagatggtatgacagtaattgatttagacccaataccgtatgatccgaaattcgaaaagcaactaggacaagttatgcttctagtattatgtgttactcaggttttgatgatgcgaacgacatgggcgctgtgtgaagcattgactttagcaacaggccccatttcaacgctatgggaaggaaatccaggaagattttggaacactactattgcggtaagtatggcaaacatatttagaggtagttacttagccggtgcaggcttgttattttcaataatgaaaaacactgcaaatactcgccgaggcacaggaaatacaggagaaacactcggagaaaaatggaaaaaccggctcaatgcattaggcaaaagcgaatttcaaatttacaaaaagagtggaatacaagaagtagatagaaccctagccaaagaaggcatcaaaagaggagaaacagaccatcacgctgtttctaggggttcggcaaaacttagatggttcgtagaaagaaatttagtaacccccgaaggaaaggtggtcgatttaggttgtggtcgaggaggttggtcgtactactgcggtggcttgaaaaacgtaaaggaagtaaaggggcttactaaaggggggcctggacatgaagagccaataccaatgagcacatatggatggaatctagtaagactacaatcaggtgtggacgttttcttcacaccccctgaaaaatgtgacactttgctgtgcgatataggtgaatcctcgccaaatcctacggtagaggctggacgcacacttagagttctcaatctggtagaaaactggcttaacaacaatacacaattttgcataaaagtattaaacccttatatgcccagtgtcatagaaaaaatggaagcacttcaacggaaatacggcggagcgcttgtccgaaaccctctaagccgaaattccacacacgagatgtactgggtatcaaatgccagcggaaacatcgtcagctccgtgaacatgataagtcggatgcttataaacagattcacgatgaaacataaaaaggcaacatatgaacctgatgtcgatttgggttcaggtactagaaatataggtatagaatctgaaacgccaaatttagacattataggtaagagaatagaaaaaataaaacaagaacacgagacatcttggcattatgaccaagatcacccttataagacgtgggcctaccatggatcatacgaaactaagcagaccggaagtgcgtcttccatggtaaacggggtggtgagattgttaacaaaaccttgggatgtaatcccgatggttacacaaatggctatgacagatacgactccgtttggacaacaaagagtcttcaaggaaaaagtcgatactcggactcaagaaccaaaggaaggaacgaagaaactgatgaaaataacggccgagtggctgtggaaagaattagggaaaaaaaaaacccctagaatgtgtactagggaagagtttacgcggaaagtaagatcgaatgcagcattaggcgcgatcttcacagatgaaaataaatggaagagtgcaagagaggccgtggaagacagcggtttttgggaattggttgataaggaaagaaatttacatttagaaggtaaatgcgagacatgtgtgtacaacatgatgggtaaaagggaaaaaaaattgggagaattcggaaaggctaagggcagtcgagcaatttggtatatgtggcttggagccagattcttagaatttgaagcgctaggattcttaaacgaggatcactggttctcaagagaaaatagtctaagtggagtggaaggagaaggcctacacaagttggggtatattcttcgagatgtgagcaaaaaagaaggaggcgcgatgtacgcagacgacacagcggggtgggatacaagaataacgttagaagacttgaagaacgaggaaatggtgacaaatcatatggaaggcgaacatcgaaaactagcagaagcgatctttagattaacttatcaaaacaaagttgtgagagttcagaggccgacaccccgaggaacggtcatggatataatctctcgcagagatcaaaggggtagtggtcaagtagttacatacgggttaaatacctttaccaatatggaggcccaacttattcgacaaatggaaggtgaaggagtctttaaatctattcagcacctcacggtaacagaagaaatagcagtaaaaaactggttagaacgtgtaggaagggaacgacttagtagaatggcaataagtggtgatgactgcgtcgttaaaccactggatgacagattcgcctctgcactaactgctttgaacgatatgggtaaagttcgaaaggatattcaacaatgggaaccgtccaggggttggaatgattggactcaggtccctttttgctcacaccactttcatgagctaataatgaaagatggcagagtcctagtggtcccatgcagaaatcaggatgagttgattggacgcgccaggataagccaaggcgcaggctggagtttaagagaaacagcttgtttagggaaaagttacgcccaaatgtggagcttaatgtattttcaccgccgagacttgcgtttagcggcaaacgccatatgttcagctgtaccatcacattgggttccgacgtcaagaacgacatggtcaattcatgcaactcatgaatggatgacgactgaagatatgttgaccgtgtggaacagagtatggatacaagagaatccttggatggaggataaaactccagtagaaagttgggaagaaatcccgtacttaggtaaaagagaagaccaatggtgtgggagcttaataggcctaacttcaagggcgacgtgggcaaaaaatatacagactgcaataaatcaagttcgatcactaataggcaatgaagaatacacagattatatgccttcgatgaagagattccgcagagaagaggaagaagcgggcgtactgtggtaa

SEQ ID NO: 22225 - RNA, 9876 nt, synthetic construct
  misc_feature 1..9876: note = derived and/or modified CDS sequence (opt6) from DENV-2__KX380828__SS-prME
  source 1..9876: mol_type = other RNA
acagctggtgtaatcataatgctaataccaaccgctatggcgttccacttgacaactaggaatggggaaccacatatgatagtctcacgacaggaaaaaggaaaatctttactatttaaaactgaagatggagtcaatatgtgcacattaatggcaatggacttaggagaattgtgtgaagatactataacatacaactgtccattactgagacaaaatgaacctgaagatatagactgttggtgtaatagtacttcaacgtgggtgacctatggaacgtgtacggctactggagaacatagaagggaaaaacggtctgtggctcttgtgccccacgtcggaatgggactagaaacgagaacagaaacatggatgtctagtgaaggtgcgtggaaacacgcccaacgtatagaaacttggatactacgacacccaggttttactattatggctgcaatattagcctacaccataggaacaacgtatttccaaagagttctaatattcatattattgacagccgtcgcgccaagtatgacaatgcgatgcatcggaatcagtaatagggattttgttgaaggagtaagcggtggatcatgggtcgatatagttctagaacacggatcttgcgtaacgactatggcgaaaaataaaccaaccctggattttgaattaatcaaaaccgaagcaaaacaaccggcgacattgcgcaaatattgcatagaggcgaaacttaccaatacaacgaccgctagccgctgtcctacgcaaggagagccatcactaaatgaagaacaagataaaaggttcgtgtgtaaacatagtatggtggatagaggttggggaaatgggtgtggattattcggtaaaggaggaatagttacatgtgctatgtttacctgtaagaaaaatatggaaggcaaaattgtacaacctgaaaacctggaatatacaatagttgtgactcctcattcaggagaagagaatgcggtgggcaatgatacaggcaaacacgggaaagaaatcaaagtcactccacaaagtagtatcacagaggctgaactcacgggatacggaaccgtcacaatggagtgttcaccaagaaccggactggattttaacgaaatggtattactccagatggaaaataaagcatggttagtgcatcggcaatggtttttggacttaccgctcccgtggcttccaggagcagatacacaaggaagcaactggatacaaaaagaaatgttagtaaccttcaaaaatcctcacgccaagaaacaagacgtagtagttctcggatcacaagaaggagcaatgcatacagctctcaccggagcaactgagatacaaatgagttctggtaatttactatttactggacatctaaaatgccgcctacgtatggataaactccaattaaaagggatgtcctattcgatgtgcaccgggaaatttaaagtggttaaagagatagcagaaacacaacatggcactatagtagtacgcgttcaatatgaaggagatggttccccttgcaaaattccctttgaaattatggacttagagaaaaggcacgtactaggacgccttattactgtcaatccaatagtaaccgaaaaggattctcctgtcaacatagaggcagaacccccgttcggggacagctatatcattataggtgtagaaccgggtcaactaaaattatcatggtttaagaaagggtcttctataggacaaatgtttgaaacaacgatgaggggtgctaagagaatggcaattctcggagatactgcctgggatttcggatcattaggtggagtatttacatctataggaaaagcgctccatcaagtgtttggcgctatttatggggccgcatttagtggtgtatcctggactatgaaaattctgatcggagtcgtgatcacatggataggtatgaacagtcgatcaaccagtctatctgtatcattagttctggtcggcgtcgttacactatacttaggagttatggttcaagcagattcaggatgtgtcgtttcatggaaaaacaaagaactaaagtgcggatcgggaatatttattacagataatgtgcacacttggaccgaacaatataaattccaacctgaaagtccgtccaaactggcttctgctatacagaaagcacacgaagagggcatatgcggtataagaagtgtaacaaggcttgaaaaccttatgtggaaacagattacgccagaattgaatcacattctatccgaaaacgaagtcaaactgacaattatgacaggagatatcaaaggtatcatgcaggctggtaaaagatctttacgacctcagccaactgaactaaagtacagctggaagacttggggtaaagcgaaaatgttgagcacagaaccacataaccagaccttcctaattgatggaccggaaaccgcagaatgtcccaatactaaccgagcttggaactcgttagaagtagaagattacgggtttggggtatttactactaacatatggttaaaactcaaagaaaggcaagatgtgttttgcgactcaaaattaatgagcgcagccataaaggataatagagctgtacacgctgatatgggttactggattgagtcggcgctaaatgacacatggaaaatagaaaaagcaagttttattgaagtaaaaagttgccactggccaaaatctcacacattatggtccaatggtgtgcttgaatcagaaatgataataccaaagaactttgctggacctgtaagccagcacaattaccgaccaggatatcacactcagaccgctggaccctggcatttgggaaaactcgaaatggatttcgatttctgtgaaggtaccacagtggttgttacagaggattgcggcaatagaggtccctctttacgtactacaacagcatcgggaaaactcataactgaatggtgttgtagatcgtgcacgttaccaccgcttcgatataaaggtgaagacggatgctggtacggaatggagatacggccgctaaaagagaaagaagaaaatttagtcaatagtttagtaactgcgggtcacggacaaattgacaacttttcattaggtgtactaggcatggcactttttctagaagaaatgctacggacgagggtaggaactaaacacgctgtcctactcgtagctgtcagttttatgacgttaataacaggcaatatgagtttccgagacttgggcagagttatggtaatggtaggagcggcaatgactgacgacataggcatgggagtgacctacttagctctattagctgcattcaaggtaagacccacctttgctgcagggcttcttttacgaaaattaacatcaaaagagctgatgatgaccaccataggtattgtattattatcacaatcgacgatccctgaaacaatactagaattaactgatgcactcgctcttggtatgatgatactaaaaattgtaagaaacatggaaaagtaccagctggcagtaacaataatggcaatcttatgcgcccctaatgctgttattttgcagaatgcctggaaagtttcctgcacgatacttgcagtcgtgtcagtatcaccgctattattgacttcaagccagcagaaagcggattggatacccctggcgttaactataaaaggtcttaatccgacagcaatattcctcactaccctaagccgaacaaataagaaacgaagttggccattgaatgaagcaattatggcagtaggaatggttagtatactagcctcatcgttattgaaaaatgacatacccatgacaggtccgctagtagcaggaggactcttgacagtatgctatgtactcactggcagatccgcagatctagaattggaaagggcagcggatgtacgatgggaagatcaagctgaaatatcggggtcgtcgccaatattgagtatcactatctcagaagatggttcgatgagtataaagaatgaggaagaagaacagacacttacgatcttaatccgtacagggcttcttgtaataagtgggctattcccggtatcaatacctattacagcggcagcatggtacctttgggaggtgaagaaacaaagggcaggcgtattatgggacgtacctagccctccgcctgtaggtaaagcggaactggaagacggggcatacagaataaagcaaaagggcatactgggatattctcaaatcggagctggggtgtataaggaaggaacgttccatacaatgtggcacgtgacaagaggagctgttctaatgcataaaggaaaaagaatcgagccgtcatgggcggatgttcggaaggatttaatttcttatggtgggggatggaaactagaaggagaatggaaggagggagaagaagtacaagtattggcactcgaacccggcaaaaatccaagagcggtacaaacgaaaccaggactttttaaaactaacaccggcaccattggtgcggtaagtttggactttagtcctggtacaagtgggagtccaatagttgataagaaaggaaaggtggtgggcttgtacggaaatggtgtggtaacgcggagtggaacatacgtcagcgctatcgcccagacagagaagtcaattgaagataaccctgaaatcgaagacgatatatttcggaagaaacgactaacgattatggatctacatccaggcgcaggcaagactaaacgatacctaccggcaatagtgcgcgaagcaataaagcgtggattgagaacattgatactagcaccgacaagagtagtagctgcagagatggaagaagcattacgcggccttccgataagatatcaaactccagcaataagagccgaacatacaggaagagaaatcgtggacttaatgtgccacgcaacatttacaatgagattattatctccagtcagggtcccaaattataatttaattataatggatgaggcgcattttacggaccctgcatctatcgccgcgagaggatacatttcgacaagggttgaaatgggggaagcagccgggatattcatgactgctaccccacctggtagtcgagatccctttccccaatccaacgcgcctataatggacgaagagagggagataccagaaaggtcgtggaactctggtcatgaatgggtcacagactttaaaggaaaaacagtatggttcgtgccttcaattaaagcgggtaatgacatagcagcatgcctacgtaaaaatgggaagaaagtaattcaactatcacgaaaaacattcgattcagagtatatcaagacgaggactaacgactgggactttgtggtaacgacagacatatcggagatgggagctaattttaaagcagagagagtaattgaccctagacgttgtatgaaaccagtaatacttaccgacggggaggaaagagttatattagctggaccgatgccggtaacgcattcctcagcagctcagaggaggggtagaataggccgtaatcccaaaaatgagaatgatcagtatatatatatgggagaaccacttgaaaatgacgaggattgtgcgcactggaaagaagcaaaaatgctcttagataatattaacacaccagaaggcataattccatcgatgttcgaacccgagcgagaaaaggtggatgctatcgacggagaatatcgactaaggggagaagcccgtaaaacgttcgtagaactcatgaggcgtggcgacctaccagtctggctcgcttatcgggtagcagcagaggggattaactatgcggatcgtagatggtgctttgatggaattaaaaacaatcaaatactagaagaaaacgtagaggtagaaatttggacaaaggagggcgagaaaaagaaacttaagccaaggtggctagacgcaaggatatattcagatccattagcacttaaagagtttaaagagtttgcagccggtagaaaaagtttaacaatgaatctaataaccgagatgggcagacttccaacatttatgacacaaaaagcccgaaacgctctagacaatcttgctgtactccacacagcggaggcaggcggacgagcatataatcacgcgttatcagaactaccagaaacactcgaaactcttcttttactcacattgcttgcgactgtaactggtggcattttcctatttctaatgtccgggaaaggaatcggtaaaatgacgctaggaatgtgctgcataataactgcatccattttactctggtatgctcaaatccagccacattggatagcagcatcaataatattagagttcttcttaatcgtgttattaattccggaacctgaaaaacaaaggacaccacaagacaatcagctaacttatgtagttatagccatacttactgtagtagcagcaaccatggctaacgaaatggggtttctagagaaaaccaagaaagattttggactgggatcaattgtagcacaacaacctgagtcaaacattttggacatagatttaagaccagcttccgcttggacgttatacgcagtggccacaacctttataactccaatgttacgacattcaatagaaaattcatcggtaaatgtcagtctaacggcaatagccaatcaggctaccgtcttaatgggattaggaaaaggttggcccttgagcaaaatggacataggggtacctctgttagccatcggttgctactctcaagtgaatccgattacactcaccgccgcactactactattagtggctcactatgcgattatagggcccggattgcaagcaaaagcaactagagaagctcaaaagagagcagcagctggaataatgaagattccgacagtagacggtataacagtaattgacctagacccgattccctatgaccctaaatttgaaaaacagctgggtcaagttatgctattagtactatgcgtaactcaggtcttgatgatgagaacaacatgggccctatgcgaagcactaacgttagccacgggcccaattagcacactctgggagggtaatccgggacgcttctggaatacaaccattgcggtttctatggctaatatattcagaggatcgtaccttgcaggggccggattgttattcagtataatgaaaaatacgacgaatactcgaagaggaaccgggaataccggggaaacgctcggtgaaaagtggaaaaatagacttaatagtctaggaaaaagtgagtttcaaatctacaaaagaagcggcattcaagaagtggatagaacattagctaaggagggcattaaacgaggagaaacagaccaccacgccgtatcgcgtggatcggcaaaactaagatggttcgtagaacgaaatttagtaacaccggaaggaaaagtgatggacttaggatgtggtcggggtgggtggtcatactactgtggcggcctgaaaaatgttagagaagttaaaggacttacaaaaggagggccggggcacgaggaaccaatcccaatgtctacttacggctggaatttggtacggttacaatctggagtggatgttttctttactccaccagaaaaatgtgatactctcttatgtgatataggggaaagctctcctaatccaaccgtcgaagcgggaagaacactgagagtactaaaccttgtagaaaattggttgaacaacaatacccaattctgtattaaggtgttaaatccttatatgccatctgtgattgagaaaatggaaactctacaacgcaaatatggtggagctctagtccggaacccactatctaggaactccactcacgaaatgtattgggtctcaaacgcaagcggtaatatagtttctagcgtgaatatgatttctagaatgctaattaatcgttttactatgcgacataagaaagcgacatacgaacctgatgtagatttgggatcaggcacacgaaacataggaatagaaagtgaaaccccaaacttagacataatcggtaaacggattgagaaaattaaacaggaacatgaaacgagttggcattacgatcaagaccacccttataaaacatgggcttaccatggtagttatgaaactaaacaaaccggatcagcatcatccatggtcaatggtgtagtcagacttcttacaaaaccgtgggatgtaattccaatggtaacgcagatggcgatgaccgatacgacgccatttggacaacaaagggtctttaaagagaaagttgatacaagaacccaagagcccaaagagggaactaagaaattaatgaaaataactgcagagtggttatggaaagagttaggcaaaaagaaaactccacgaatgtgcacgagggaagaatttacaaggaaagtaaggtctaatgcagcacttggggcaatattcacagatgagaataagtggaaatcggcacgggaagcggtagaggattcaaggttctgggagctggtagataaggaaagaaatttgcatttggagggtaaatgcgaaacttgtgtatacaatatgatgggaaaaagagagaagaaaataggagaatttggtagggcaaaaggaagtagagcgatctggtacatgtggctaggagctagatttttagagttcgaagcgctcggattccttaacgaagatcactggtttagcagagaaaattctctcagtggtgttgaaggtgaaggactacacaagttagggtacatattaagagaagtgagcaagaaagaaggtggagccatgtacgcggatgacacagcagggtgggacacaagaattacactagaggatctaaagaacgaagaaatggtaacaaatcacatggagggtgaacataagaaattagcagaagccatatttaaattgacctatcagaataaggtagttcgagtgcaacgtcccactccccgcgggacagtcatggatattatatccagaagggatcagcgagggtctggacaggtgggtacttatggactaaacacgtttaccaatatgggggcccaactaattcgtcagatggagggggaaggagtatttaagtccatacaacatctaactactacggaagaagtagcagtacaagactggttagcacgcgttggcagagaaagactttcccgcatggcaataagtggagacgattgcgtcgtaaagccccttgatgataggttcgcttcagctttgactgcactaaatgatatgggtaaagtgaggaaagacatacaacaatgggagccttcgaaagggtggaacgattggacacaggtaccattctgtagtcatcacttccatgaactaataatgaaagacgggagagtcctagtagtaccatgccgaaatcaagacgaactaattggcagagctagaatcagtcagggagccggatggagcctgcgagagacagcttgcttgggaaagtcgtatgcacaaatgtggagtttgatgtatttccataggagggacctcaggctagctgctaatgcaatatgttccgctgtaccatcgcactgggtgccaacaagtaggacgacatggtctattcatgcacgacatgaatggatgactacagaagatatgttaacagtttggaatagagtatggatacaagaaaatccatggatggaagacaaaacgccagtagaatcatgggaggaaataccatatctagggaaaagagaagatcaatggtgcggatctctcataggattaacaagcagggccacgtgggctaaaaatatacaaacagcaattaaccaggtccgctcactaataggcagcgaagagtatacagattatatgccaagtatgaaaagatttcggcgggaggaagaagaagcaggggtattgtggtaa

SEQ ID NO: 22226 - RNA, 9876 nt, synthetic construct
  misc_feature 1..9876: note = derived and/or modified CDS sequence (opt6) from DENV-2__KX380829__SS-prME
  source 1..9876: mol_type = other RNA
acggcaggagtgattattatgcttatccccacagctatggccttccatctaactacacgtaacggagaaccgcacatgatagtatcaagacaagaaaaaggaaaatccttattgttcaaaacagaagatggagttaacatgtgtactctaatggctatggacttaggtgaattatgtgaagatacaattacctataattgtcctctacttcgacaaaatgaacctgaagatatagactgttggtgcaatagcacaagtacatgggtaacatacggtacttgcacagcaacgggtgaacatcggcgtgagaaaagaagcgtagcattagttccacacgtaggtatggggctagaaacaaggacagaaacttggatgtcctccgagggggcatggaaacacgcccagagaatagaaacatggatcctgcgtcatccaggtttcactatcatggccgcgatactggcttataccataggaacaacatactttcaaagagtccttatatttattctactaacagcggtagcaccgagtatgacaatgcggtgtatagggatttcaaacagggatttcgtagaaggagtttcaggaggaagctgggttgatatagtgctggagcatgggtcttgcgtaactactatggctaaaaacaaacctacgttagacttcgagcttattaaaaccgaagccaaacagccggcaacactgagaaaatattgtatagaagccaaacttaccaatacaactactgcaagtcgatgtcctacacagggtgagccatcactaaacgaagaacaagataaacgttttgtctgcaaacattcaatggtcgacagaggatggggaaacgggtgtggactttttggaaaaggaggaatcgtaacctgcgccatgtttacatgtaagaaaaatatggaaggaaaaatcgtccaacctgaaaatttagaatatactattgttgtaactcctcattcaggagaggaaaatgctgtagggaacgacactggaaaacatggtaaagaaataaaagtaaccccacaatcatcaattactgaagcagaactaactggatacggaacagtaacaatggaatgttcaccacgcacaggccttgacttcaatgagatggttctactccaaatggaaaataaagcatggttagtccacagacagtggtttctcgatttaccactgccatggttacccggggcagacacccaagggtcgaattggatccagaaagaaatgctagtaacatttaaaaatccccatgctaagaaacaggacgtcgttgtactaggatctcaagaaggcgcgatgcatacagctttaacaggtgcaacagagattcaaatgagttcagggaatctattatttaccggccatcttaaatgtcgacttcggatggataaactacagctaaagggaatgtcatactcaatgtgcactggcaaatttaaagtggtaaaagagattgcagaaactcagcacggtactattgtggtcagagttcaatatgaaggcgatgggtcaccgtgtaaaattccatttgaaataatggacttagaaaagcgtcatgtattgggcaggttaataactgtaaacccaatagtaaccgaaaaagatagtccagtaaacatcgaggccgaaccacccttcggagattcatatataattataggggttgaaccaggtcaactaaaactctcctggttcaaaaagggatcatccatcggccaaatgttcgaaaccactatgagaggtgcaaaacgcatggcaatattaggcgatacagcgtgggactttggaagtctaggcggagttttcacgtcaataggaaaggcactccaccaggttttcggagcaatatacggagcggcatttagtggtgtatcttggacaatgaaaatactaataggcgtggtgattacatggataggtatgaactcccgatcaacaagtttgagtgtttcgctagtattggtaggcgtagttacattatatcttggtgtaatggtccaagcagactcaggatgtgtggtatcgtggaaaaataaagaacttaaatgtggatcagggatattcataactgataatgttcatacatggactgaacaatacaaatttcagcctgaaagtccatctaaattagcatcagctatacaaaaggcacacgaagaaggaatttgcggtatcaggtctgttacaagacttgagaatttaatgtggaaacaaataacacccgaactaaaccacatcttatcagagaatgaagtaaaactaactattatgacaggagacataaaggggattatgcaggcgggaaaacgatctctaagaccacaacccacagaacttaaatattcatggaaaacgtggggaaaagcgaaaatgttatcaactgaaccgcacaatcagacttttctcattgatggtccagaaaccgccgaatgccccaatacaaatagagcgtggaactctctggaagtagaggattacggatttggcgtcttcacaaccaacatttggttgaaattaaaagaaagacaggacgtattctgtgacagtaaattaatgagcgccgctataaaagataacagagcagtacatgcagacatgggatactggattgaatctgcattaaatgatacttggaagatcgaaaaggcttcatttattgaagtaaaatcctgtcattggccaaaaagccacacattatggtctaatggagtattggaaagtgaaatgattattcctaaaaacttcgctggtcccgtgtcacaacacaactaccggccgggttaccacacacagacggcaggaccttggcacctagggaaacttgaaatggacttcgatttttgcgaagggaccaccgtagttgtgaccgaagattgtggaaatagaggaccatcattaagaacaacaacagcctcgggaaaactaattaccgaatggtgttgccgaagttgtacattacctccacttcgttacaaaggtgaagatggatgttggtatggtatggagatccgacccctgaaagagaaagaagaaaatctagtaaatagtctagtaacggcaggccatggacaaattgacaatttttccttaggtgtattaggaatggcattattcttagaagagatgctacgaactagggtaggtacgaagcatgcggtcctattagttgctgttagttttatgacacttataacaggcaatatgtcatttcgtgacctaggtagagttatggtcatggttggagcggcaatgacagacgacataggtatgggtgtaacctatctagcactactggcagcatttaaagtacggccaacgtttgcagcaggattgctcttgcgaaaattgacgtcaaaagagcttatgatgactacaattggaatcgttcttcttagtcagtcaactatacctgagacaatattagaattgaccgatgcgctagctctggggatgatgatcctaaaaatagtacgaaatatggaaaaataccaattggctgtgaccatcatggcaatactttgcgctccaaacgcagtaatacttcaaaacgcttggaaagttagttgcacaattctagcagttgtgagcgtgtcccccttattattaacatcatctcaacaaaaagcggactggatcccactagcacttacaataaaaggactcaatccaactgcaatcttcctaaccacgttaagcagaacaaataaaaagcgaagctggcctttaaacgaggcaataatggctgtaggtatggtatcaatactagcctcctcactgctaaagaacgacattccaatgaccggacccctagttgctggcggtttacttacggtttgctacgtattgacgggacgcagcgctgatctagagctcgaaagagcagcagatgttaggtgggaagaccaagcggaaatttcgggttctagtcccattctgtcaatcacaatttccgaagatggttcaatgtctattaaaaacgaagaggaggagcagacgctaacaattctaatacgaacaggtttgttagtaatcagtgggctattcccagtttccataccgattacagcggcagcatggtatctatgggaagtaaagaaacaacgcgcaggggtactatgggacgtaccatcaccaccaccagtcggaaaagcagaactcgaagacggtgcatacagaataaagcaaaaagggatcttaggttattcacaaataggtgctggagtatataaagagggcacattccatacgatgtggcacgtgacccgtggggcagtactaatgcataaaggtaaaagaatagaaccaagctgggccgatgtcaggaaagacttaatatcatacggtggtggctggaaactagaaggtgagtggaaggaaggagaagaagtacaggttctcgcattagaaccagggaaaaaccctagagcagtgcaaactaaaccggggctttttaaaacgaacactggtacaatcggggctgtatcactcgacttttcgccaggcacctccggtagcccgattgtcgataagaaaggaaaggtagttggactatatggcaacggagtcgtaacacggtcaggaacgtacgttagcgcgatagcccaaacagagaaaagtatagaagacaaccctgaaatagaggatgatatttttcgaaagaaaagattaaccatcatggatctacatccaggcgccggtaaaaccaagagatacctacctgctatagttcgagaagcaattaaaagaggccttagaacgttaattcttgctcctaccagagtcgtagcagcagaaatggaagaagccctgaggggcctccctatacgctaccaaacccctgccataagagcagaacatactggacgtgaaattgtagaccttatgtgccatgcaactttcaccatgagattacttagccctgtacgtgtaccaaactataacctgataataatggacgaggcacattttacggatcctgcctctatagctgctagaggctatataagtacgagagtagaaatgggagaggctgcgggaatatttatgaccgcgacgccaccgggcagtagggatcccttcccacaatcaaatgctcctattatggatgaggaaagagagattccagagaggagttggaactcgggccacgaatgggttacggactttaaaggaaaaacggtgtggtttgtgccaagcattaaggctggcaacgatattgctgcctgtctacggaaaaatggtaagaaagtcattcaattgtccaggaaaacatttgattcggaatatataaaaactcgaacgaatgactgggacttcgtcgtaactacagatatctcagaaatgggtgcgaattttaaagcagaacgtgtaatcgatcctagacgttgcatgaaaccagtcatcttaaccgatggggaagaacgtgtcatattagcggggccaatgcctgttacgcactcgagtgctgcacaaagacgaggtcgcatcggtcggaatccgaagaatgagaacgaccaatatatatacatgggggaacccttggaaaacgacgaggattgtgctcattggaaagaggcgaaaatgttgttagataacataaacacgccagaaggtatcattccaagtatgttcgaaccagaaagagaaaaagtcgatgcaatagatggtgagtaccgattaagaggagaagcaagaaaaacatttgttgaacttatgaggcgaggggacttacctgtttggctagcttacagagtcgctgcagaaggtataaactatgcagatagaagatggtgctttgatggtataaagaataaccaaatacttgaagaaaatgtagaagttgaaatttggacaaaggaaggtgagaagaagaaactgaaacctcgctggctcgatgctcgtatttacagtgacccactcgcattgaaagagtttaaagaatttgccgcgggtaggaaatctctgaccatgaatttaattactgagatgggaagattaccaactttcatgacacagaaagcgcgtaacgctctcgataacttagcagtgttacacaccgcggaagctgggggacgtgcgtacaaccatgctttaagtgaattacccgaaacccttgaaacccttcttttgttaactttgcttgcaaccgtaacgggaggtattttcctcttcctgatgtcaggaaagggtataggtaagatgacactaggaatgtgttgtataatcactgcgtcaatactattatggtatgcacaaatacaaccccactggattgcagcttctattatacttgagttctttttaattgttcttttgatacctgaaccagaaaaacagaggacaccgcaagacaaccaattgacatatgtagtaatagcaatattaacggtcgttgcagcgaccatggctaatgaaatgggttttctagagaaaacaaagaaagattttggtcttggaagcatcgtggcacaacagccagagtcgaacatactagacatcgatttaagaccagcctcagcatggacactctatgcagttgcaaccacattcataaccccaatgttacgacactcaatagaaaatagttccgtcaacgtctcgctcactgcaattgctaatcaagcaactgtattaatgggcttaggaaaaggatggcccttaagtaaaatggatataggcgtaccgctcttagcaatcggttgctactcacaagtaaacccgataacgcttactgcagcacttctacttctagttgctcattacgcgatcataggtcctggattacaggcaaaagcaacaagagaagctcaaaagagagccgcagcaggaataatgaaaaatcccacagtcgacggaatgacagttatcgatttagatccaattccatatgatcccaaatttgaaaaacaattaggtcaagtgatgcttttggttctatgcgtaacacaggtactaatgatgcgtaccacctgggcactttgcgaggctttaacactggctactggacccatctctacactatgggaggggaaccccggccgattttggaacacaacaatagccgtatctatggcaaacatattcagagggagttatcttgctggggcaggattattattttccatcatgaagaatacgacaaatacacgtcgaggaacaggaaataccggtgaaacgctaggggagaagtggaaaaatcgacttaactcactgggtaaaagtgagtttcagatatataaaaggtcgggtatacaagaagtggacaggactctagccaaagagggtataaagcgaggagagactgatcatcatgccgtaagtcgcggatcagcaaagttacgatggtttgtggaacgaaacttagttacaccagaaggcaaagttatggatttaggatgtggccgcggcgggtggtcctactactgcggcggactaaagaatgtgagagaagtaaagggtctgacaaaaggagggccagggcatgaagaaccgatacccatgagtacatacggttggaatttagtacgacttcagtcaggtgtagatgttttcttcacccctccagaaaagtgtgacacattgctttgtgatataggagagtcctcaccgaatccaactgtagaagctggaagaactttacgcgtattaaatcttgttgagaattggttgaataataacacacaattttgtataaaagtcttgaatccttatatgccaagtgtaattgaaaagatggaaactctacagagaaagtatggaggggcactcgtccgcaacccgttgtcaagaaattctacacatgaaatgtattgggtatcgaacgcatctggaaacattgtaagtagcgtaaatatgatctcacgcatgttaatcaacaggtttacaatgagacacaagaaagccacttatgaaccagatgtagacctgggctcggggacaagaaatattggcatagagtcagagacaccaaacctggatataattgggaagcgaatcgagaaaatcaaacaagaacacgaaacgtcctggcattatgaccaagatcacccatacaaaacatgggcgtaccacggatcatatgagaccaaacaaaccggctcagcctcgtccatggtcaatggggtagtaaggttactaacgaagccatgggacgtaatccctatggttacgcaaatggcgatgaccgatactaccccatttggacaacaaagagtgtttaaagaaaaagtcgacactagaacacaagaaccaaaggaggggaccaagaaattgatgaagattacagcggaatggctctggaaagaattaggcaagaagaaaacacctagaatgtgcacacgtgaagagtttacacgaaaagtacgatccaacgctgctcttggtgcaatatttacagatgagaataaatggaaaagtgcccgtgaagctgttgaagacagccgattttgggaactcgttgacaaagaacgaaatttacacctggaaggtaaatgcgaaacatgtgtatacaatatgatgggaaaaagagagaagaaaataggtgaatttgggcgggctaaaggaagccgagcaatttggtacatgtggcttggagcgaggttccttgagttcgaagcgctaggatttttaaacgaggatcactggttcagtagagaaaactcgttaagtggtgtagaaggggaaggactacataaattaggatacatattgcgggaagtttcaaagaaagaaggaggagccatgtacgcagacgatacggcaggttgggatacacgaataacattggaagaccttaaaaacgaagaaatggtaacaaaccatatggaaggtgaacataagaaactagctgaagcaattttcaagttaacgtatcaaaacaaagttgttagggtacagagaccaacaccaagaggtacagtaatggatattatttcacggagagatcaacgtgggtcaggtcaagtgggtacgtacggactcaacacatttactaacatgggcgctcagcttataagacaaatggagggagaaggagttttcaaaagtattcagcatctcacaacgactgaagaagtagctgttcaagattggcttgcgcgggtcggcagggaacgactaagcagaatggctataagtggtgacgactgcgtagtaaaacctctggatgatcgatttgcgtcggcattaacagccctaaatgacatgggaaaagtacgaaaagatatacaacaatgggagccgtctaaaggctggaacgactggacacaagtaccattttgttcacaccatttccatgaacttattatgaaggacggtagagtgttagtagtcccatgcaggaaccaagatgagttgatagggagagcaagaataagtcaaggagcaggatggagtttgagggaaacagcgtgccttggaaagagctatgctcagatgtggagtctaatgtactttcatcgaagggacttgcgactagcagccaacgctatatgcagtgccgtgccgtcacattgggtgccaacgagtagaactacctggtcaatccacgcccggcatgaatggatgacaacggaagatatgctaactgtgtggaaccgcgtgtggatacaagaaaatccgtggatggaagataagacccctgtggaaagttgggaggaaattccttatttggggaaacgcgaagatcaatggtgcggctctctcataggactaacctcaagggccacttgggctaaaaacattcaaactgcaattaaccaagtacgtagcttaataggtagtgaagagtacactgactatatgccttccatgaagagatttcgacgagaggaagaagaagcgggggtgttatggtga

SEQ ID NO: 22227 - RNA, 9876 nt, synthetic construct
  misc_feature 1..9876: note = derived and/or modified CDS sequence (opt6) from DENV-2__KX380830__SS-prME
  source 1..9876: mol_type = other RNA
acagcaggtataatcataatgatgataccaacggtaatggcattccatctgaccacccggaatggagaaccgcatatgatagtttccagacaagaaaaagggaaaagcctattattcaaaacagaaaatggagtaaatatgtgcacattgatggcaatggatttaggagaattatgcgaagacacgataacctataattgccctttacttagacaaaatgaacctgaagacatagattgctggtgcaacagcacaagcacttgggtgacgtacgggacttgtacagcgaccggtgaacataggagagaaaaacgatcagtggctcttgtgccacacgttggaatgggattagaaacccgaacagaaacgtggatgagttcagaaggagcttggaaacatgcacaaaggattgaaacttgggtgctaaggcaccccggttttactgtgatggcagcgattctggcatatacaataggcactacctattttcaaagggtattaatatttatattgttaacagcagtagcgccatctatgactatgagatgcattggtatatcaaatagagatttcgtagaaggtgtttccggcggaagctgggtagacatagtcttagaacatggttcctgcgtcacaacgatggccaaaaataaaccaacacttgacttcgaacttataaaaacagaagctaaacatcctgctactctccgcaaatattgcattgaagcaaaactaacaaataccacgaccgcaagtcgatgtcccacgcaaggagaaccatcactcaacgaagaacaagataaaagatttgtttgtaaacattccatggtggaccgtggatggggaaatggctgtggtttattcggaaaagggggtatcgttacgtgcgcaatgttcacatgtaagaaaaatatggaaggcaaaatagtgcaacccgaaaatttggaatatactatagtgataacccctcacagcggggaagaaaatgcggtaggtaatgacactggaaaacatggaaaagaaattaaagtcactcctcaatcctcaatcactgaagccgaactaacaggatatggcactgcaacgatggaatgttctccacgaacagggctagatttcaatgaaatggttttactccaaatggagaataaagcctggcttgtccatagacaatggtttttagatctgccgttaccatggttacctggagcagatactcaaggctccaattggatacaaaaagagacattagtaacatttaaaaacccacatgccaagaaacaagatgtagtagtactcggttcccaagaaggcgcaatgcatacagcattgacaggagctactgagattcaaatgagttccggaaatttacttttcaccggacacctaaaatgccgattaaggatggacaaactacaacttaaaggtatgagttatagtatgtgtacagggaaattcaaagttgtgaaagaaattgcagagacccagcatggaacaatagtcattcgtgttcaatatgagggagatgggagtccttgtaaaatcccgtttgaaatcatggatttagagaaaagacatgtacttggtagattaatcacagtaaaccccatagtaaccgaaaaagacagcccagtaaatatagaagcagagcccccatttggtgattcctatataattataggcgtagaaccgggtcaactaaaacttagttggttcaagaaaggcagttccattggtcaaatgtttgagactaccatgagaggagctaaacgcatggcgatcctaggtgatactgcttgggattttggcagtcttggaggggtatttacatccataggaaaagcattacatcaagtgttcggagcaatttatggagcggcttttagcggtgttagttggactatgaaaatcctaataggagtagtcattacgtggatcggtatgaactcacgatcgaccagtttatctgttagtcttgtattagtaggtatagttaccttgtacttaggcgttatggtacaagcggactcgggatgcgtagtcagctggaaaaataaggaacttaagtgcgggagtggcatcttcataactgataacgtccatacatggactgaacagtacaaattccagccggaaagcccaagcaaactggcatcagctatacagaaagctcatgaagaaggcatttgcggtataaggtcggtcacacgcttggaaaatttaatgtggaaacagataacaccagaactcaaccacatcctatcagagaatgaggtgaaactaactataatgacgggggacatcaagggtatcatgcaagccggtaaaagaagccttagacctcaaccaacagaacttaaatactcgtggaaagcatggggaaaggcaaaaatgttatctacagaactgcataatcatacatttttaatagatggaccagagacagcagagtgtccaaatacgaaccgcgcatggaactcgttagaggttgaagattacggatttggagtatttacaacaaacatatggttaaaactcaaagaaaggcaggacgtattctgcgatagtaagctaatgagtgcggctatcaaagataaccgtgcagtacatgcagatatgggatattggatagagagtgcgttaaatgatacgtggaaaatagaaaaagcctcattcattgaggtgaagtcttgccattggccaaaatctcacacgttgtggagtaacggtgtgctcgaatcagaaatgattatacccaaaaatttcgcaggtcctgtaagccaacacaattatcgtccaggttaccatacacaaacagcaggaccttggcatctgggccgtttagaaatggattttgacttctgtgaagggacaacagttgttgtcactgaagattgcggtaaccgagggccgtctttacgtacaacgacagcatcaggtaagctgattacagagtggtgttgtagatcatgcacactaccgccattgcgctatcgtggagaagatggctgctggtatggcatggaaattagaccattgaaagaaaaagaagaaaatttagttaatagcctggtaacagccgggcatggacaaattgacaatttttcattaggggttctagggatggctctatttttggaagaaatgctacgtacacgcgtcggcacaaaacacgctatacttttagtagcggtctcatttgttacattaataacaggcaacatgtcctttcgtgatttgggacgcgtaatggtaatggtaggagcgactatgacggacgacattggtatgggagtcacttatttggcgctcctagcagcttttaaagttcgtccaacttttgccgcaggattacttctaaggaaactgacaagcaaggaacttatgatgacaacaataggaatagtattattatctcaatcgacaatcccagaaactatcttagagctcacggatgcgcttgcattaggaatgatggttttgaagattgtacgtaatatggaaaaatatcaactcgcagtaacaataatggctatattgtgtgtacctaacgctgtaatcctccaaaatgcgtggaaggtatcatgcacaatactggcggtagtatcggtgtcgcccctcttactaacttcctcacagcaaaaggccgattggataccccttgccctaacaattaaaggcttgaatccaacagctatttttctaacaacacttagcagaacaagtaagaaaagatcatggcccctcaatgaagctatcatggctgtagggatggtttcgatacttgcaagcagcctattgaaaaacgacatcccaatgactggtccattggtagcgggtggtttattaacggtctgttatgttctgactggaaggtctgcagacttggaattagaacgagcggcagacgtgagatgggaagaacaagctgaaataagtggcagtagtccaattctgtctatcacaataagtgaagacggatcaatgtcgatcaaaaacgaagaagaagaacaaactctgaccattctcattagaactggtctattagtaataagcggactttttcctgtaagtataccaattacggcagccgcgtggtatttatgggaagtcaaaaagcaaagagcaggggttttatgggacgtaccatctccgcctccagtaggaaaagcagaactagaagatggagcctaccgtataaaacagaaaggtatactcggatattcacaaatcggcgcaggcgtttataaagaaggaacttttcacacaatgtggcacgtaacacgcggtgcagttttaatgcataaaggcaaacggattgagccttcttgggcagatgtgaagaaagatttaataagctatggagggggatggaaactcgaaggagaatggaaagaaggagaagaggtacaggttcttgccttagagccaggtaaaaacccaagagcggttcaaacgaagcctggactgtttaagacaaacacggggactatcggagcggtgtctctagactttagtcctggcacatccggaagtcctatagtggacaagaaaggcaaagtagttggactctatgggaacggtgtagttacccgttctggaacctacgtatcagcgatcgcccaaacagagaaaagtatagaggataacccagaaatcgaagacgatatattcaggaaaaagcgcctaactataatggatttgcatccgggagcgggtaaaaccaaaagatatctaccggcaattgtacgtgaagctattaaacgcggattaagaacacttattctagcgccaacgcgtgtcgtagcagcagagatggaagaggctttaagaggattgccaatacgatatcaaacaccggcaatcagagcagaacacactggacgcgaaattgtagatctcatgtgtcatgctacttttacaatgcgcttactaagcccaataagggtgcctaactataatctaatcataatggacgaagctcatttcacagacccagcttcaattgctgccagagggtatatctctacacgtgtagaaatgggtgaagcggccggaatattcatgacagctaccccaccaggctcacgagatccttttcctcaatcaaatgcaccgattatggacgaagaacgtgaaataccagagagaagctggaactcaggtcacgaatgggtaacagatttcaaaggaaagacagtatggtttgtaccctctatcaaagctggtaatgatatagcagcctgcttacgtaaaaatggtaagaaagtaatacaactaagcagaaaaacatttgatagtgaatacataaaaactcgaacgaatgactgggacttcgtggtaacgacggatatatcggaaatgggcgcaaacttcaaagccgagagagtaatagacccaagacgctgtatgaaacctgtgatattaacagatggtgaagaaagggtaattctagctgggccgatgccagtaactcacagttcggcagcacaacgaagaggtcgggtaggaagaaatcccaagaatgaaaatgaccagtatatctacatgggtgaaccattagagaacgacgaagattgcgcccactggaaagaggccaaaatgttgttagacaacataaataccccagaaggcattataccgtcgatgttcgagccagaaagagaaaaggtggatgctatagacggagagtatcgattaaggggtgaggcgcgcaaaactttcgtcgaccttatgcgcaggggagacttaccagtgtggcttgcatatagagtcgccgccgagggaattaactacgcagatcgacgatggtgcttcgacggagttaaaaataatcaaattcttgaagaaaatgtggaagtggagatatggactaaggaaggagaaagaaagaagctaaaacctcgatggcttgatgcacgcatctattctgatccactagcactcaaggagttcaaggagtttgcagctgggagaaaatctttaaccttaaatctcataacagagatgggtagactaccgactttcatgacacagaaagcacgaaacgcactggataaccttgccgtattacatactgcggaagccggaggtagagcctataatcatgctctctccgagctaccagaaacattagaaactcttcttttgctaactctgctcgccacagtcacaggcggaatatttttatttctaatgagtggaaaaggtataggaaagatgaccttagggatgtgctgtattataactgcaagtatactattatggtatgcccaaatacaacctcactggatagcggcctcaattattttagaatttttccttattgttttgctcatacccgagccagaaaaacagagaaccccacaagataatcagctgacatacgtagtcatagctattttgactgtcgtagctgctaccatggccaatgaaatgggatttctcgaaaagaccaagaaagattttggcctaggttctattactacacagcaaccggactctaacatattagacatagacttgcgtccagcatcggcttggactttgtatgctgtcgccacaacttttatcacacctatgttgcgacactcaatcgaaaatagtagcgttaatgtatcgttaacagcgatagcgaatcaagcgacagttctaatgggtctcggaaagggttggccactatcaaagatggatataggagtaccgttgttagccataggctgctacagccaggtaaatccaattactctaaccgcggcactattactgttggtagcacactacgccattataggacccggactccaggcaaaagcaacacgggaagcacagaaaagagccgcggcaggaataatgaaaatacctgcagccgacggaatgacagtgatagatttagatccaataccttatgacccaaagttcgaaaaacaactaggccaggtcatgcttcttgtactatgcgtgactcaagtactaatgatgaggacaacatgggccctttgcgaagcattaaccctagcaaccggaccaataagtactctatgggaaggtaatccggggcgtttttggaacactacaatagctgtatcaatggccaacatatttaggggatcatatctagccggtgcagggttgcttttctcgattatgaaaaatacggctaatactagacgcggtacgggaaatacaggagaaactttgggcgaaaaatggaaaaatagactgaacgctttaggaaaatctgagtttcaaatatataagaaatcgggaatacaagaggtcgaccggacgctcgctaaagaaggaataaaaaggggcgaaacggaccatcacgctgtcagccgaggttcggcaaaacttagatggttcgtcgagcgtaatctggttactcctgaaggaaaggtggttgatcttggatgcggaagaggtgggtggtcttattattgtggaggactgaaaaatgttaaagaagtcaaaggactcacaaaagggggcccaggtcacgaagaaccaatccccatgtcaacttatggatggaatttagtaagactgcaaagcggtgtagacgtgtttttcacaccgccagaaaaatgcgataccctactatgtgatattggcgaaagcagtccaaatcccactgtcgaagcaggacgaacccttcgagtgcttaacctagtggaaaactggctgaacaacaatacccagttttgcattaaggtgcttaacccctacatgccaagtgtaattgagaagatggaagctctgcaaaggaagtacggaggggccctagtgagaaatcctttgtcaagaaactcaacacacgaaatgtactgggtatcgaatgcaagtggcaatatagtttctagtgtaaacatgattagcagaatgcttattaataggttcactatgaaacataagaaagccacttacgaacccgatgtagatttaggaagtggcacccgaaacataggaattgaaagtgaaaccccaaatctggacataattggaaaaaggattgagaaaataaaacaagaacatgaaacgagttggcactatgatcaagaccatccctataaaacatgggcctaccatgggagttacgagactaaacaaacaggttcagcttcaagcatggtgaacggtgtagtgcgattattaactaagccatgggacgttataccaatggtaactcaaatggccatgacagacacaactcctttcggtcaacaacgggtctttaaagagaaggtcgatactaggacacaagaacccaaggaggggaccaagaaattgatgaaaattacagctgaatggttatggaaagaacttgggaagaagaaaacaccaagaatgtgtacgcgagaagaatttacgagaaaagtaaggtcaaatgctgcgctaggagctatatttacggacgaaaacaagtggaaatcggcacgtgaggcggtcgaagactcaggattctgggagttagtagataaagaaagaaatctacacctagaaggaaaatgcgagacctgcgtatacaatatgatgggtaaacgcgagaagaaattaggggagttcggcaaagcaaaaggtagcagggccatatggtatatgtggcttggtgccaggtttctagaatttgaagccttaggttttctgaatgaggaccattggttcagcagagaaaattcattatcaggcgttgaaggagaaggtctacataaactgggttatattctcagggacgtgtcgaaaaaggaaggaggggctatgtatgctgacgacacagctggatgggatacacgtataacattagaagatcttaaaaacgaggaaatggttacgaaccatatggagggggaacacagaaaattggcagaggccatatttagattaacctaccaaaataaagtcgtaagggtgcaaagaccgactcccagagggactgtaatggacataatttcccgccgcgaccagaggggttccggccaggtagtcacatacggactaaacactttcacaaatatggaagcacagctaattaggcaaatggaaggggaaggtgtctttaaatctatacagcatcttacagttacggaagagatcgcagtaaagaattggcttgagagagtcggtagggaaagactgtccaggatggcaattagcggagatgactgcgtagtaaaaccattagatgaccgcttcgccagtgccctaactgctcttaatgacatgggaaaagtaagaaaagatatacaacagtgggaaccatctcggggttggaacgactggacccaagtacccttttgttcccatcattttcacgaactaattatgaaggacggacgcgttcttgtagtaccttgccgcaatcaggatgagttaattggtcgcgcaagaatatcacaaggagcggggtggtcattaagagagactgcttgccttggaaaatcctatgcgcaaatgtggagtttaatgtatttccatcgtcgagatcttagattggctgccaatgcaatatgctcagcggtaccatcccattgggttccgatatcacgcacaacgtggagtattcatgcgacacacgaatggatgacaacagaggatatgttaactgtgtggaaccgagtctggattcaagaaaatccatggatggaagacaaaaccccagtggaatcctgggaggaaattccgtatttaggtaagagggaagatcaatggtgtggctctctgattgggctaacaagtagagcaacttgggccaaaaatatccaaacggcaattaatcaagtaagatctcttatcgggaacgaagagtatactgattacatgccaagtatgaagaggtttagaagggaagaagaagaagcaggagtactatggtaa

SEQ ID NO: 22228 - RNA, 9876 nt, synthetic construct
  misc_feature 1..9876: note = derived and/or modified CDS sequence (opt6) from DENV-2__KX380831__SS-prME
  source 1..9876: mol_type = other RNA
accgccggaatcataatcatgatgatccctaccgtaatggcgttccacttaacaacaagaaatggtgaacctcatatgatcgttagtaggcaggaaaaaggcaaatctttattatttaagacagagaacggagttaatatgtgcacattaatggcaatggatttaggcgaattgtgtgaggacacaattacatacaattgtccattactgagacagaatgaacctgaagatatagattgctggtgtaatagcacaagtacatgggtgacatacggaacatgtacggcaacgggagaacatcgaagagagaagagaagtgtggccttagtcccccacgtagggatgggattggaaacgcgtaccgagacatggatgtcaagtgaaggtgcatggaaacacgcacaacggatagagacttggattttacggcacccaggtttcaccattatggcggcaatcctagcctacacgattggaactacgtatttccaacgagtacttatatttatattgttaacagcagtaaccccatcaatggcgatgcgatgtattggaatcagcaacagagattttgtagaaggcgtatcaggaggctcatgggttgacatcgttttagaacatgggtcatgcgtaactacaatggcaaaaaataaacctacattagatttcgaactaataaaaactgaggcaaaacatctagccactttacgaaaatattgtgttgaagccaaactgactaacacgactacagcctcacgatgccctacacagggagaaccatccttgaatgaagaacaagacaaacgattcgtgtgcaaacattcaatggtggatagaggatggggtaacggttgtggactgttcggtaaaggaggaatagtgacatgtgccatgtttacatgcaaaaaaaacatggaaggtaaggttgtgcaacccgaaaacctagaatatacaatcgtgatcactcctcactccggcgaggagaacgccgtaggtaacgacaccggtaaacatggaaaagagatcaaagtaactccacaatcttcaataaccgaggctgagttgacagggtacgggactgttactatggaatgttctcccagaactggcttagactttaacgagatggtattattacaaatggaaaataaagcatggctcgtacatagacagtggtttctggatctccctttaccttggttgcccggcgcagatacacaggggtcaaattggatacaaaaggagacacttgttacttttaaaaacccacatgcaaaaaaacaagacgttgttgtattaggcagccaagaaggtgcgatgcacacagcattgaccggggccaccgagattcaaatgtcgagtggcaatcttttattcacgggacatctgaaatgtagacttcgtatggataagcttcaattaaaagggatgagttactcaatgtgtacaggcaaatttaaggtggtcaaagaaatagctgaaacgcaacacggaaccatagtcatccgagtccagtatgaaggggatgggtcaccatgcaaaataccgtttgaaattatggaccttgagaagagacatgtcctcggaagattaatcacagtcaacccaatagttacagaaaaagatagtccagttaatatcgaagctgaaccccccttcggcgactcttatattattatcggcgtagaacctggacaactcaagcttagctggtttaagaaaggatcctcaataggacagatgtttgaaactacaatgcgaggagcaaaaagaatggcgattctaggagatacggcttgggacttcggctctttaggtggagtatttacaagtatagggaaggcactacaccaagtgtttggagcgatctatggtgctgcctttagtggagtgtcctggacaatgaaaattctcatcggggtcgtaataacatggataggcatgaatagtagatctaccagcctatcagtttcattagtattagtgggagttgtaaccctttatttgggcgtaatggtacaagcagactccggttgtgttgtgtcttggaaaaataaggaattgaaatgcggatcgggaatttttataacagacaatgtccacacctggactgaacaatataaattccaaccagaatccccatcgaagctagcctcagcaattcaaaaagctcatgaagaaggcatttgtggtataaggtccgtaaccagattggaaaatcttatgtggaaacaaatcacaccggaattaaatcatatactaacagaaaatgaagtaaagctcactataatgactggagatatcaaaggaataatgcaagcgggaaaaagatccctaagaccgcaaccaacagaacttaaatattcatggaaagcctggggaaaagccaaaatgctatcgacagaactacataatcacacatttttgatagatggacccgaaacagccgaatgcccaaacacaaatagggcctggaactcgctagaggtcgaagactacggcttcggagtattcaccacaaacatatggctgaagcttaaggaaagacaagatgtcttctgtgatagtaatctaatgtcagccgctattaaagataacagggccgtgcatgcagacatggggtactggatcgagagtgctttaaacgatacgtggaaaatagaaaaggcaagtttcatcgaagtcaaatcttgccattggcccaagagtcatacactctggtctaacggtgtattagagagtgaaatgataataccaaaaaatttcgcaggacctgtatcacagcacaattatcgacctggataccacacacaaacagcgggaccatggcatctgggaaggctagaaatggatttcgatttttgcgaaggcacaacagttgtggttactgaggactgtggcaatcgaggtccatctttgagaactacaacggcctcaggaaaattgataacagagtggtgctgccgaagttgcactttaccgccattacggtatcgaggagaagacggttgctggtatggcatggagatacggccacttaaagaaaaggaagaaaatctcgttaacagtttggttactgcgggacatggacaaatagataactttagtttaggcgtactaggtatggctttattcttggaagagatgttgagaaccagggtgggaacgaaacatgcgatattattagtcgcagtatcttttgttacactcataacaggaaatatgagctttcgcgacctaggacgcgtcatggtaatggtaggtgctaccatgacagatgatataggaatgggagtaacttatttggcattgctagcagcatttaaagttcgaccaacatttgccgccggattgttattgagaaaacttacttctaaagagttaatgatgacaacaataggaatagtgcttctgtctcagtcgacaataccggagagcattttggaactaactgacgccttagcgttgggcatgatggtgctgaaaatagtaagaaatatggaaaaatatcagttggcggtaactattatggccattctttgcgtgcccaacgcagtgatcctgcaaaatgcctggaaggtctcctgcacgacacttgcagttgttagtgtttctcctttgcttttgacatcatcgcagcaaaaagctgattggattccactggcactaacaattaaagggttaaatccgacagcaatcttcctaactacactgtctaggacttcaaaaaaacgaagttggcccctaaatgaagcaatcatggcggtaggtatggtgagcattttagcatcatcactactaaagaacgacattcccatgactggacccctcgttgcgggaggattactgacagtatgttacgtcctcacaggaaggtctgcggatttagaacttgaaagagccgccgatgtccggtgggaggagcaggcagaaattagcggtagctctccaatattaagcataactatctctgaagatggatcgatgtctataaaaaacgaagaggaagaacagacactaacaatcctgattcgaaccggtctcctggttatatccggcctgttcccggtaagtataccaatcactgccgccgcatggtatttatgggaagtaaaaaaacaacgtgcgggggtattatgggacgtgccatctcccccacctgtcgggaaagctgaacttgaagatggcgcctatagaataaaacaaaaaggcattcttggctactcccaaataggtgcaggcgtatacaaagaaggtacatttcatacaatgtggcacgtcacaagaggagctgttctgatgcataaaggaaaaaggatagaacctagctgggctgacgttaaaaaggacttaatcagctacggaggaggatggaagctggaaggggaatggaaagagggtgaagaagtacaagttttagcgttagaaccaggaaagaatccaagagctgtacaaactaaacccggattatttaagacaaacaccggaactataggtgccgtatctcttgatttcagtcccgggacatccggttccccaatagtagataaaaaaggtaaggtagttggattgtacggaaatggagtagtaacgcgatcgggcacctatgtcagcgccatagctcaaactgaaaaaagtattgaagacaatccagaaatagaagatgacatatttagaaaaaaaaggttaactatcatggatctccaccctggagctggaaagacaaaacgctacctacctgccatagtcagagaagcaattaagcgaggacttagaacacttatacttgcccccacgagagtcgttgcagcggaaatggaagaagccttacgaggactacctatacgatatcagactccagcaatacgagctgaacatacaggtagagaaatcgtggatctaatgtgccacgcaactttcactatgaggctactgagtcctatacgagtaccaaattacaacttgattataatggatgaagcgcattttacagacccagcatcgattgcagctagaggttatatctcaactcgagtggaaatgggagaagctgctggaatcttcatgacagcaactcccccaggctcaagagaccctttccctcaatctaatgcaccaattatggatgaagagagggaaataccagaaagatcttggaattcaggacacgaatgggtgactgattttaaaggtaaaactgtttggttcgttccttctattaaagcaggaaatgatattgccgcatgcctacgaaaaaacggaaagaaagtcattcaattatctcgaaagaccttcgatagcgaatatatcaagacccgtacaaatgattgggatttcgtggttaccactgatattagcgagatgggagcaaactttaaagcagaacgagttatagatccacgacgctgtatgaaaccagtgatcttaactgatggagaagaaagagtgattctcgcaggtccaatgcctgttacacacagttcagcagcacaacgaagaggcagagtagggcgaaacccaaagaatgaaaatgaccaatatatctatatgggggaacccctagagaatgatgaggattgcgcccactggaaggaagcgaaaatgcttttagataacatcaatacacctgagggtattattcccagtatgtttgaacctgaaagagaaaaagtcgatgcaatcgacggagaatacagacttaggggagaagcacgtaaaacatttgttgacttgatgcgtaggggcgatctgcccgtttggctagcatacagggtcgcagcagaaggaataaattatgcagacagacggtggtgttttgacggagtcaagaataatcagatcctggaggaaaacgtagaagtcgaaatatggactaaggaaggcgaacgtaaaaaactaaagccaaggtggttggatgcaagaatatacagcgaccccttagccctaaaagaatttaaagaattcgctgcggggaggaaatccctcacgctcaatcttatcacagaaatgggacgattaccgactttcatgacacaaaaagcaaagaatgcattagataacctagcggtgttacatactgcggaagctggcggaagggcatacaatcacgcattaagtgaattgccggaaacacttgagacattactcctattaacattactagccaccgtcaccggtggaattttccttttcctaatgagtggaaaagggattgggaaaatgacattgggtatgtgctgtataatcaccgcatcaatcttattatggtacgcgcaaatacaaccccattggatagcagcatctatcatattggaattttttttaatagtgcttctcataccggaaccagaaaagcagagaacgccacaggataaccaattaacctacgtcgtgattgccatccttaccgtcgtggcggccacaatggccaatgaaatgggatttttagaaaaaacgaagaaggatttcggactaggctctattacaacacagcagccagaaagcaacatattggatatagatttaagacctgctagcgcctggactctctatgccgttgcaacaacttttatcactccgatgctaagacattccatcgaaaattcatcggtaaatgtttctttaacagcaatcgcaaaccaagccacggtgttaatgggattgggtaagggatggcccctgtctaaaatggacatcggagtacccctcttggctattgggtgttatagtcaagtaaaccctataacactaactgccgctttacttctattggtggcccactatgcaataattggacctggattacaggcaaaagctaccagagaggcacaaaaaagagcagcagctggcatcatgaaaaaccccacagttgatggaatgacagttattgatctagaccctattccttatgatccaaaatttgaaaaacagctagggcaggtaatgttactcgtcttgtgcgttacacaagtattaatgatgcgaacgacttgggccttatgtgaggcactaactttagcaaccggtccgataagtacactatgggaaggaaatccgggaagattctggaatacaactatagcagtatcaatggcgaacatatttagaggctcctatcttgcaggcgcagggcttctcttctccataatgaaaaatacggcaaacacgcgtagaggaactggcaataccggcgagacccttggtgaaaaatggaaaaatcggttaaatgctttgggaaagagtgaatttcaaatctacaaaaaatctggtatacaggaggtagatagaaccctagcaaaagagggtataaaacgcggggaaactgatcaccatgcagtcagtcgaggttccgcaaagttacggtggtttgttgaaaggaatcttgtaaccccagagggcaaagtcgtggatttaggctgtggcagggggggatggtcgtattattgcgggggccttaaaaatgtaaaagaagtgaaagggctcacaaaaggaggacctggtcacgaagagccaataccaatgtctacatatggatggaacctagtgagattacaatcaggtgtggacgtcttcttcacacctcctgaaaagtgtgacactctcttatgtgacattggcgaatcgtcgcctaatccaaccgtagaagctggacgaactttgagggtcttaaacttagtagaaaactggttgaataacaatacgcagttctgcattaaggtattaaatccctacatgccaagtgtgatagaaaagatggaagcactgcaaagaaaatatggaggcgccctagtacgtaaccccttgtcacgcaattctacccatgaaatgtactgggtttcaaatgcaagcggcaatattgtgtcttctgttaatacaataagtcgaatgctcataaaccgattcaccatgagacataaaaaagcaacttatgaacccgacgttgacctagggagcgggacaagaaatatagggattgaatctgaaacgcctaatttagatatcataggtaaaagaatagagaagatcaaacaagaacacgaaacatcttggcattacgatcaagatcatccgtataaaacatgggcctaccatggctcatacgaaactaaacaaacaggaagtgcatcctccatggtaaatggagtagtcagattattaaccaaaccttgggatgtaataccgatggtaacacaaatggcgatgactgatacgacgccatttggtcaacaacgcgtcttcaaggagaaagtggatacacgcactcaagagccgaaagaaggaaccaaaaaactcatgaaaatcacagctgaatggctctggaaggaacttggtaagaagaaaacgccaagaatgtgtaccagagaagaatttactcgaaaagttagaagtaatgccgctctaggagcgatatttacggacgaaaataagtggaaatcagcaagagaagccgtagaggacagtggcttctgggaattagttgacaaagaaagaaacttgcatctcgaaggtaaatgcgaaacctgcgtttacaacatgatgggaaaaagagagaaaaagctgggtgaatttggaaaagccaaagggtctagggctatctggtacatgtggctcggagctaggtttttagaatttgaagccctaggtttcttaaatgaagatcattggttcagcagagaaaattcattatcaggagtcgaaggagaaggcctacataagctagggtacatcttgagggatgtatcaaaaaaggaaggcggagctatgtacgccgacgacaccgcagggtgggacacacggataacccttgaggatttaaaaaatgaggaaatggtgaccaaccacatggaaggcgagcacaagaaattagcagaagctatcttcaaactaacataccaaaataaagtagtgcgagtgcaaagacctacgcctcgtggaacagtaatggatatcatatcccgtagagatcaacgtggaagcggtcaggtcgttacctatggacttaatacttttaccaacatggaagctcagctgatccgtcaaatggaaggtgagggagtatttaaatccatacaacaactaaccgtaaaagaagaaattgccgttaagaattggctgattagggtagggcgagaaagattaagtcgtatggctataagcggagacgactgtgtagtcaaacctttggacgatagattcgctagtgccttgactgcattgaatgacatgggtaaagtgcgtaaggatatacaacaatgggaaccgagccgtggttggaatgattggactcaagtccccttctgcagtcatcactttcatgaattaataatgaaggacggaagagttttagtagttccatgtcgaaaccaagatgagcttataggtagagcacgaatctcacaaggagctggatggtcactgcgagaaacggcttgtcttggcaaatcttatgcccaaatgtggtcactaatgtattttcataggcgagatctacgtctagcagctaacgcaatctgtagtgctgtgcctagtcattggatccctaccagtagaacaacttggtctatccatgctacccatgaatggatgacaacagaagacatgcttactgtatggaatcgcgtttggatacaagaaaacccttggatggaagacaagacacctgtagagtcttgggaagaaatcccttatcttggaaaacgtgaggaccaatggtgcggaagtctaatcggattgacatcaagagcgacttgggcaaaaaacatacaaacagcgataaatcaagttagatcactaatagggaatgaagaatatacagattatatgcctagcatgaaaaggtttcgaagggaagaagaagaagctggggttctttggtaa

SEQ ID NO: 22229 - RNA, 9876 nt, synthetic construct
  misc_feature 1..9876: note = derived and/or modified CDS sequence (opt6) from DENV-2__KX380808__SS-prME
  source 1..9876: mol_type = other RNA
acggcaggaataattataatgatgattccaacagtaatggcattccatctaaccacaagaaacggagaaccacatatgatagtatcccgtcaagaaaaaggtaaaagcctattattcaaaactgaaaatggagtaaatatgtgcaccctcatggctatggacttaggggaattatgtgaagataccatcacttacaattgtccgctcctgaaacaaaacgaacctgaagatatagattgctggtgcaattcaacaagtacctgggtaacatacggtacatgtacagcgacgggggaacaccgaagagagaaaagatcagtggcgttagtaccccacgtaggaatgggattagaaactcgaactgagacctggatgtcgagtgaaggagcatggaaacacgcgcagagaatagagacatgggttttacgacatccaggttttaccataatggcggcaatattagcatataccataggaactacttatttccaacgtgttttgattttcatattgctaactgctattgctccctcgatgacaatgagatgcataggaattagcaacagagattttgtagaaggagtgtcaggtggaagctgggtagatatagtgctcgagcacggaagttgtgtaaccactatggcgaaaaataaaccgaccctagattttgaactaataaaaacagaagctaaacatccagctacacttcgaaaatattgtatagaggctaaactaactaacacaacgaccgcaagtagatgtccgacacaaggagaaccgtcattaaatgaagaacaagataagagatttgtatgtaagcacagtatggtagacagaggatggggaaacggatgcggattgtttggaaaaggaggtatagtaacgtgtgctatgtttacatgcaaaaagaatatggaaggaaaaatcgtacaaccagaaaacctagaatacacaatagttataacgccacactcgggagaagaaaatgcagtaggcaatgatacgggaaaacatggtaaggaaattaaggtaacacctcagagcagcattacagaggcggaattgactggatacggcaccgtgactatggaatgctcaccacggacaggtttggatttcaatgaaatggttttattgcaaatggaaaacaaagcatggctggttcatcgacaatggttccttgacctacccttgccttggctaccaggggctgatacgcaaggaagtaattggatacagaaagaaactcttgttacatttaaaaacccacatgcaaagaaacaggatgtagtcgtattgggatcacaagaaggggccatgcacaccgccctgacgggagctaccgaaatacagatgtcctcaggtaacctattgttcactggtcacttaaaatgtcgacttagaatggataagttacaactaaagggaatgtcatattctatgtgtactggaaaatttaaggttgtaaaagaaatagcagaaacacaacatggaactattgttataagagttcaatatgaaggggacggctcaccgtgtaaaattccatttgaaataatggatttagaaaaacgacatgtattgggacgtcttataacggtaaacccgatagttacagaaaaggacagtccagtaaatattgaagcagaacctcccttcggcgatagttatataattataggcgtagaaccaggacaacttaaactaagctggtttaaaaagggaagctcgatcggtcaaatgttcgagacaacaatgaggggtgcaaagcgtatggcaatactcggagacacagcatgggactttggctcactaggtggagtattcacaagcataggaaaagcattacaccaagtatttggtgcaatttatggtgctgctttttcaggggtttcatggactatgaagatacttatcggtgtggttattacatggatagggatgaatagtaggagtacatcactaagcgtatcgctggttttggtaggggtagtaacactgtatctaggagtaatggttcaggctgatagtggatgcgtcgtcagctggaaaaataaagagctaaaatgtggatcaggaatatttatcactgacaatgttcatacatggacggaacaatacaagttccaaccggagtcgccttccaaacttgcgtccgccatacagaaagcccacgaggaagggatatgtggcataagaagtgtcactagactcgaaaaccttatgtggaaacagataacacctgaattgaaccatatactatccgaaaacgaggtaaaacttacaataatgactggagacatcaagggaatcatgcaagcagggaagcgttccttacgacctcaaccaactgaactgaagtattcatggaaggcctggggaaaggcaaaaatgttatcaacagaattacataatcacacatttctaatagatggccctgaaactgctgagtgtcctaacacaaatagggcttggaatagtttagaggttgaagattatggttttggtgtgtttacaacaaacatctggttaaaactgaaggaaaggcaggatgtcttttgtgatagtaagttgatgtctgccgctataaaggataacagagctgtgcatgcagacatgggctactggatagaatctgcgctcaacgacacttggaagatcgaaaaagcctcattcatagagataaaatcatgccactggccaaaatctcacactctatggtcaaatggcgtgttagaatctgagatgattatacccaaaaattttgcagggccggtttctcaacataattacaggccaggataccatacgcaaactgctggaccatggcatttaggcagacttgaaatggactttgacttctgcgaaggtacaaccgtcgtcgtgacggaagattgcggaaatcgaggcccaagtctaagaacgacgaccgcatctggaaaactaataacggaatggtgctgtagaagctgcacactaccgccattacgctaccgaggagaagatggttgttggtatggaatggagatacgaccgttgaaagagaaagaggagaacctggtcaatagcctagtaactgctggtcacggtcagatagataatttctctctaggagtgctcggcatggctttgttcctcgaagaaatgttaagaactcgcgtaggtacgaagcatgcgattctcctagtagcagtatcatttgtcacgctgataacgggaaatatgtcatttagagatctcggaagggtcatggttatggttggagccactatgactgacgacataggtatgggagtaacatacttggcactattagcggcttttaaggttcgaccaaccttcgctgccggattgctgttacgaaaattaacgtccaaagaattaatgatgactacaattggaatcgtactgctgtctcaatccactataccagagacaatactggagttgactgacgccctagcattgggaatgatggttcttaaaatcgtacgcaacatggaaaagtaccaactagccgtaacaattatggccattttatgtgtaccaaatgcagtcatccttcagaacgcctggaaggtttcatgcactactttggcagtagtctctgtgagccccttactattgacatcaagccaacagaaagcagattggattccactagcgcttacaataaaaggcctaaacccaacggcgatattcttaactacgttatcaagaacttcgaagaaaagatcgtggccactaaacgaagcaataatggctgtggggatggttagtattttagcatcatctttattgaaaaatgacatccccatgacaggcccattagtagcaggaggtctattaactgtctgctacgtgctaacaggaagaagcgcagatttagagctagaaagagctgcagatgttaggtgggaggaacaagcagaaattagtggatcaagcccaatattatcaataaccatttctgaagacggtagtatgtcaatcaaaaatgaagaggaggagcaaacactaacaatactgataagaactggcctccttgtcatcagtggactttttcccgtaagtataccgataacggctgcagcgtggtatctatgggaagtgaagaaacaaagagcgggagttctatgggatgttcctagccctccccctgtgggaaaagctgaattggaagacggagcatatcgtataaaacaaaaagggattctaggatactctcaaataggagctggagtatataaggaaggtacatttcacactatgtggcacgtgactcgtggggcagtactcatgcacaaaggcaaaagaattgagccgtcgtgggccgatgtcaagaaagatctaataagctatggaggaggatggaaactagaaggagaatggaaagagggtgaagaagtgcaagtgttggcattagaaccaggaaagaatccaagagctgtccaaactaaaccgggtttatttaaaaccaatacaggtacaataggagctgtaagcctcgatttttccccaggaacgtctggatcgccaatcgttgataagaaaggcaaagttgtaggtttatacgggaatggtgtagttacaagaagcggcacatacgttagtgccatagcacaaactgagaaatctatcgaagacaatccagaaattgaagacgatattttccgtaagaaacgactcaccattatggacttgcacccgggtgcaggcaaaacaaaacgttacttacctgccattgttagagaagcaattaaacgtggattacgaactctaatcctggcaccaacgagagtagttgcggcagagatggaagaagcgttacgaggcctgcccatcagatatcaaactcccgctattagggcagaacatacaggacgcgaaatagtcgatttaatgtgtcatgccacatttaccatgagattactatctccaataagagtccctaattataatctgataattatggatgaagcacatttcacagatccggcgagcatcgccgcaagaggctacatctcaacacgtgtagagatgggagaagcagcgggaatattcatgacagcgactcccccaggatcacgtgaccctttccctcaaagtaacgcccctattatggacgaggaacgtgaaataccagaaaggtcatggaactctggacacgaatgggtcacagattttaaagggaagacagtatggttcgtaccatccattaaggccggtaatgacatagcagcctgcctcaggaaaaacgggaagaaagtcattcaattaagcaggaagacatttgatactgaatatataaagactcgtactaacgattgggattttgtagttactacagatattagcgagatgggagcaaattttaaggcagaaagagtgatagatccacgacgatgtatgaaaccagtaattttgacagacggtgaggaacgtgtaatacttgcagggcccatgcctgtaacgcattcgtccgcggcacaaagaaggggtcgagtaggtcgaaatcccaaaaatgaaaacgatcaatacatttacatgggtgagccactagaaaatgacgaagactgcgctcactggaaagaggcaaaaatgcttctggataatatcaataccccagaaggaatcattccttcaatgtttgaaccggaaagggaaaaagtagatgctatcgacggggagtacagattgcgcggtgaagcaaggaaaacttttgtcgatctaatgcgtcgtggggatttacctgtttggttagcatacagagttgcagctgaaggaattaactacgccgatagacgctggtgttttgacggagtgaagaacaaccaaatattagaggagaatgtggaagtagagatttggaccaaagaaggggaaaggaagaaattaaaaccaaggtggctagacgcaagaatttacagtgatccacttgctttaaaagagttcaaagagtttgcggcaggaagaaaatcgctgactcttaacctaattactgaaatgggcagacttcccaccttcatgacacagaaagcaagaaatgcgctggataacttagctgtcttgcatacagccgaagccggtggaagggcttataatcatgcattatctgaacttccagaaacgttggaaacgcttttacttttaaccttacttgccactgttacaggtggcatatttttattcttaatgtcaggcaaggggattggaaaaatgactctcggaatgtgttgtataattactgcctcgattcttctttggtacgcacaaatccaacctcattggatcgccgccagtataattttggagtttttcttaatagtgctattgataccggaacccgaaaaacaaaggacaccccaagataaccaactcacatacgtagtaattgccatattaaccgtagtggctgcgacaatggctaacgagatgggtttcctcgagaaaacaaagaaagattttggacttggtagtattactacacaacagccggaatcaaatatacttgatatcgatctgcgaccagcttccgcttggacactttatgcagtcgcaactacttttattacacctatgttacggcactcaattgaaaactcatcagtgaacgtatctcttaccgcaatagcgaatcaagctacagtattaatgggtttaggaaagggctggcctctcagtaagatggatataggagtaccactacttgctatcgggtgctattcgcaagtaaatcccataacattaactgcggccttattactattggtaacccactatgcaattattggtccggggctacaagctaaagccactagggaagcccagaaaagggcagcagccgggataatgaaaatccccaccgtggacggcataactgtcattgatttagaccctatcccctatgatcccaagtttgaaaaacaattaggccaagtgatgttattggttctatgcgtaacacaagttttgatgatgcgaacaacatgggcattatgtgaagctctgactttagcaactgggcccatctctactctatgggagggaaacccggggagattctggaataccacaattgcggtgagcatggccaacatctttcgtggtagctatttagcgggcgcagggttacttttcagtattatgaagaatacagcaaatacacgacgcggaacgggaaacaccggtgaaaccctcggtgagaaatggaaaaatagactcaacgccctaggcaaaagcgaatttcaaatatacaagaaaagtggtatacaagaagtagaccgaacattagcgaaggaagggatcaaacgtggagaaacagatcaccacgcagtgtcacgtggcagcgccaaactccgctggtttgtggagcgaaacttagtaacacccgaaggcaaagtagtagatctaggctgcgggagaggtggatggagctattactgtggtggactaaagaacgttaaagaagtcaaaggcttaactaaaggaggacctggacatgaagaaccaataccaatgtctacttacgggtggaatctagttaggcttcaatctggtgtagacgtatttttcacaccacccgaaaaatgcgatacgctactatgcgatatcggcgagtcatctcccaatcccactgttgaggctggcaggacattaagagtcctaaatttggttgaaaactggctgaacaataatacgcaattttgtataaaggtgcttaacccatatatgccgtccgtaatagagaaaatggaagccttacaaagaaaatacggaggggcactcgtaagaaatccattatctagaaacagtactcacgaaatgtattgggtcagtaatgcatctggaaacattgtaagttcagtaaatatgatatcaaggatgttgatcaatcgcttcactatgaggcataagaaagctacgtacgaacccgacgtcgatctcggttctggaacaagaaacataggtatagagagtgagactccaaacttggatattatcggcaaacggatcgagaaaataaaacaagaacatgaaacatcatggcattatgaccaagatcatccatacaaaacctgggcctatcacggtagctatgaaactaaacaaacaggctctgctagttctatggtaaatggggtggtgaggttattaacaaaaccatgggatgtgattcccatggtaacacagatggcaatgaccgatactactccatttgggcaacaaagagtctttaaggaaaaggtggacactcgaacgcaagagcctaaagaaggaactaagaaacttatgaaaataacagcggaatggctatggaaagaactaggtaaaaagaaaacaccacgaatgtgcactagggaagagttcactaggaaagtacgatccaacgctgcattaggcgcgatattcactgatgaaaacaaatggaaaagcgcaagagaggccgtagaggattcaggattttgggagttagtagataaggagcgaaatttacacttagaaggaaagtgcgaaacttgtgtttacaatatgatgggaaaacgagagaagaaacttggagaatttggcaaagctaaaggatcacgtgcaatttggtatatgtggctaggagcacgatttctggaatttgaagcactgggattcttaaacgaagatcactggttttcacgtgaaaattctctttctggggttgagggagagggccttcacaaactaggttacatattgagagacgttagtaagaaagaaggaggtgccatgtatgctgacgatactgcgggctgggacacaagaattacgctagaagatctcaaaaatgaggaaatggtaacaaatcatatggagggtgaacataagaaattagcagaagcgatttttagacttacctaccaaaacaaagtggtacgagtccagcgtcctacaccgaggggaacggttatggacattataagtcggagagaccaacgaggatctggccaggttgtaacttatggtttaaatacatttacgaatatggaagctcaactaatccgacaaatggaaggagagggtctattcaaaagcattcagcatctaaccgttacagaagaaatagcagtgaaaaactggctcgtacgagttggtagggaacgactatcccgcatggcaataagtggagacgattgtgtagtgaaaccattagacgaccggtttgcgtccgccctgacagcattaaatgatatgggtaaagttcgtaaagatatccaacaatgggaaccaagtagaggttggaatgattggacacaagtaccattctgcagccatcatttccacgaacttatcatgaaggacggaagagtcctagttgtcccatgtcgaaatcaagatgaactaataggcagagcacgaattagccaaggagctgggtggtctttaagagaaacagcgtgcctaggaaagtcgtatgctcaaatgtggtcattgatgtattttcatcgtagagatttaagattggctgccaatgccatttgcagtgccgtccccagtcattgggtccccacttctaggactacatggtcgatacatgcaactcatgaatggatgacaaccgaagatatgctaacagtgtggaatcgcgtttggatacaggagaacccttggatggaagacaaaacaccagtggaaagttgggaagaaattccatatctcggaaagagagaagaccagtggtgtggtagtttaataggattaacctcccgagcgacgtgggccaaaaatatacaaacagctataaatcaagtaagaagtcttataggtaacgaagaatacacggattatatgccaagtatgaaacgtttcagaagggaagaggaagaagctggagtattatggtaa

SEQ ID NO: 22230 - RNA, 9876 nt, synthetic construct
  misc_feature 1..9876: note = derived and/or modified CDS sequence (opt6) from DENV-2__KX380832__SS-prME
  source 1..9876: mol_type = other RNA
accgctggaattatcattatgatgatcccgactgtaatggcatttcatctgacgacacgaaacggggaaccgcacatgatcgtttcgagacaggaaaaaggaaaatcattacttttcaaaacagaaaacggtgtaaatatgtgcacattaatggcaatggacctgggagaactatgcgaagacacaatcacgtacaactgtccacttctacgacaaaacgaacctgaagacattgattgttggtgcaattccaccagcacgtgggtaacatacggaacctgcacggctacaggagaacatagacgtgagaaaaggtctgtagcgctagtgcctcatgtaggcatgggtctagaaacacgtactgaaacctggatgagttctgaaggggcatggaaacatgcgcaaagaatagaaacgtgggtactaagacatccgggattcaccgtaatggcagctattctggcatacacgatcggcacgacatactttcagcgagtactaatatttattctattaactgcagtagcaccctcgatgactatgagatgcatcggtattagtaacagggatttcgtagaaggagttagtggaggatcttgggtggatatagtcttggaacacgggtcttgcgttaccacgatggctaaaaataaaccaacgctagattttgaattaataaaaacagaagcgaaacatcccgcaactttacgtaaatattgtatcgaagcaaaattaacaaacactacaaccgcatcgcgttgccccactcaaggtgaaccatcacttaatgaagaacaagacaaaaggttcgtctgtaaacacagcatggttgatcgcggctggggaaacggatgtggcttatttggtaaaggtggcattgtaacgtgtgcgatgtttacctgtaagaaaaatatggaaggaaaaatagtacagcctgaaaatctagaatacactatagtgataactcctcatagtggagaagaaaatgctgttggaaatgatacgggtaaacatggaaaagaaataaaagttacacctcaatcgagtataactgaagctgagctcacaggttatggcacagcaacaatggaatgctctccaagaactgggctagactttaatgaaatggtactattacaaatggaaaacaaagcgtggctagtacacagacagtggtttctcgacttaccacttccatggctcccaggagcagatacacaaggctccaactggattcaaaaagaaacgttagttacattcaagaatccgcatgccaagaaacaggatgttgttgtattaggtagtcaagaaggtgcaatgcacactgcactaactggtgctaccgaaatccagatgtccagtggaaatcttttattcacgggccatctaaaatgtcgattaaggatggacaagctacaattaaaagggatgagttatagcatgtgtaccggtaaatttaaagtagttaaggaaatagcagaaacacaacatggaactatcgtgattagggtacagtatgagggcgatggaagtccttgcaaaatacccttcgaaataatggacttagagaaacgacacgtcttaggtagactaataactgttaaccctatagtaacagagaaagattcccccgtaaacatagaggcagagccccctttcggagattcatatataataattggagtggaaccaggtcaattgaaacttagctggttcaagaaagggagctccataggtcaaatgttcgaaacaacgatgaggggagcaaagcgtatggccatactcggggatacagcgtgggacttcggtagtttaggaggtgtatttacatctataggtaaagcgcttcaccaggtttttggcgctatttatggtgcagcattctccggagttagctggacaatgaaaattttgataggcgtagtcattacttggataggaatgaacagtagaagtacttccctatcagtaagtctggtcttagtgggcatagtcacgttatatctcggcgtgatggtgcaagctgattcaggatgcgtagttagttggaagaataaggaattaaagtgcggttctggtatatttataactgataatgtacacacgtggacggaacagtataaattccaaccggagtctccaagtaagctcgcatcagcaattcaaaaggcacacgaagaaggcatttgcggtattagaagcgtaacgcgacttgaaaatcttatgtggaaacagatcacccccgaattaaatcacatactctcggaaaatgaagtaaaattaacaataatgactggggatataaaaggcattatgcaagcaggaaaaaggagtttgagaccccagcccaccgagctaaaatactcatggaaagcatggggaaaagcaaagatgcttagcaccgagctacataatcatacatttctaatagatggaccagaaaccgctgaatgtcccaatactaacagagcttggaactcactggaggtagaagattatggattcggagtatttaccacgaatatttggttaaaactaaaagaacgacaagatgtcttttgtgatagcaaactcatgtctgctgcaataaaagataatagggctgtccatgcggatatgggctattggatagaatccgctcttaatgacacttggaaaattgagaaggcgagttttatcgaagttaaatcatgtcattggccgaagtcccacaccctgtggagtaacggagtattagaatctgagatgattattccgaaaaatttcgcaggaccagtgagtcaacataattaccgtcctggctatcatacacaaacagcaggtccctggcatctcggaaggttagaaatggactttgatttctgtgaaggtacaactgttgtagttactgaggactgcggaaatcgagggccgagcttaagaacgactaccgcatcgggaaaattgatcacagaatggtgttgcagatcttgtactcttccacccttaagatatagaggtgaagacggttgttggtatggaatggagatcagaccactgaaagaaaaagaggaaaacctagtaaatagcttagtaaccgcaggacatgggcaaattgacaacttttctctgggtgttctcggaatggcattatttttagaagaaatgttaaggactagagttggcacaaaacacgctatattgctagttgcggtttctttcgtaaccctcattactggcaacatgtcctttagggatttaggaagagtaatggtcatggtaggagcaacaatgacagacgacattgggatgggggtaacttatttagcgttactagcagcttttaaagttagaccgacattcgcggcaggactgctcttacgtaaacttacctccaaagaacttatgatgacaactataggaattgttttactaagccaatccacaatcccagaaactatactagaactgactgatgctttggcactcgggatgatggttttaaaaattgttagaaatatggagaagtatcaactagcagttacgataatgacaatactatgcgtacctaacgcagtgatacttcaaaatgcgtggaaagtatcatgcactatactggcagttgtatcagtaagtcctctgctactcaccagcagtcaacaaaaagcagactggatcccgctagctctgacaatcaaagggctgaatccaacagcaatatttttaaccaccctcagtaggacaagtaagaaaaggagttggccattgaatgaagctataatggcagtaggtatggtaagtatactagcctcgtcgctgctcaaaaatgacatacctatgacgggtccgttagtagcaggaggactcttaacggtatgttatgttttaactggaagaagtgcagatttagaattggagcgagccgctgatgtgcgttgggaagaacaagcagaaatcagtggaagtagccctattctaagtataacaatcagtgaagacggctcaatgtccatcaagaatgaggaagaagaacagactctgacaatcctcatacgaacaggcctcctagtaataagcgggttgtttccagtaagtattcctatcacagcagcggcttggtatttatgggaggtcaagaaacaacgtgcaggagtgctctgggacgtcccgtcaccacctcctgtagggaaggcggaactcgaagacggtgcttacagaatcaaacaaaagggaatattaggctattcgcaaatcggagcaggggtgtacaaagaggggactttccatacaatgtggcatgtgactagaggggcggtattaatgcataaaggcaaacgaatagaacctagttgggctgatgtaaagaaagatttgataagttatggaggtggatggaaactcgaaggagagtggaaagaaggtgaagaagtccaagtactagcattagaaccaggcaagaaccccagagcggtacaaacaaaacccggacttttcaaaacaaacactggcacgatcggagcagtatccctagatttttcgcctggtacatcgggatctccgatagtcgataagaaaggaaaagttgtaggactttatggaaacggtgtggttacacgctctggaacatatgtgagtgctatagcccagactgagaaaagcatagaagacaatcctgagatcgaagatgatatttttcgtaagaaacgactaaccattatggatcttcatcctggtgcaggaaaaacaaagcggtacctccctgccattgttagagaggccattaaacgcggcctaagaactttgatactagccccaactcgggtagtagctgcagagatggaagaggcgttaagggggcttccaattcgctaccagacgccggccatacgagcggaacatacggggcgggaaattgtagatctaatgtgtcacgctacgttcacaatgcggctcctatcaccaattagagtgcctaattataacttaataataatggacgaagcccattttacggatccagcatcaatagccgcacgaggatatatttcaacccgcgttgaaatgggagaggctgcgggcatcttcatgacagcaacacctccagggtctagagatccgtttccccaaagtaatgcaccaataatggatgaagaacgtgagatacctgaaagaagttggaatagtggtcatgagtgggtaactgactttaaaggtaaaacagtttggtttgtaccctcgattaaagctggaaatgacattaccgcatgtttaaggaaaaatggcaagaaagtgatacaacttagtcgtaagacgtttgatagtgaatatattaagacccgcactaatgactgggatttcgtagtcaccacagatattagtgaaatgggagcgaattttaaagctgaaagggttattgatccgcgaagatgtatgaaacctgtaattctaacagacggggaagaaagagttatacttgcaggcccgatgcctgttactcatagttcagcagcccagcgacgcggtcgagtgggaagaaatcccaagaacgaaaacgatcaatacatatatatgggtgagccgttggaaaatgacgaagactgcgctcactggaaagaagcgaaaatgttacttgacaatattaatacgccagaagggatcataccatctatgttcgaaccagaaagggaaaaagtggacgcgattgacggagaatatcgcctccgtggagaagccagaaaaactttcgtagatctaatgaggcgtggagacttacctgtctggctggcgtacagggtagcagcagaggggattaattatgcggatcgaagatggtgcttcgacggagtcaaaaataatcaaatactggaagaaaatgtagaagtagaaatctggaccaaggaaggggaaagaaagaaactcaaacctcgttggttggatgcaagaatatattcagatccactggctttaaaagaatttaaagaatttgctgcaggaaggaaaagtctaacactaaatttaatcacggaaatgggcaggctgccgacttttatgacgcaaaaagctcgtaatgcgttagataacttagctgttctacatacagctgaggcaggagggagagcttataatcacgccctatcagagttacccgagacattagaaacgttattactcttaactcttttggcaactgtaacagggggaattttcctttttcttatgtcaggaaaaggaatagggaagatgacactaggaatgtgttgcataattactgcaagcattttactttggtacgcccaaatacagccacactggatagcggcgagcatcatactagagtttttcttaatcgttctattaattccagaaccggaaaaacaaagaacaccacaggataatcaattgacgtatgttgtaatcgcaatcctgacagtggtagcggccacgatggctaacgagatgggatttctagagaaaacgaagaaagattttggcctaggctcaataactacacaacaaccagattcaaacattttagacatagatttacggccggcgtcggcttggactttatatgcagtagctactactttcataacgcctatgttaaggcacagcatagaaaattcaagcgttaatgtatcattaacggctatcgcgaatcaagcaacagtactaatgggtcttggtaaaggatggcccctaagcaaaatggacattggagtgccccttcttgctataggatgctactcgcaagtcaatccaataacattaacagcggcgttattacttctagtagctcactatgcaattataggcccaggtctacaagcaaaagctactcgcgaagcgcagaaaagagcggccgcgggtatcatgaaaattccggctgcagatggaataacagttatcgacttggaccccattccttacgatccaaaattcgaaaaacaattaggacaggtgatgcttttagtactttgtgttacacaagtcctaatgatgcgtactacctgggcactatgtgaagccctaacattagcaacaggtcctattagcaccctttgggaaggtaatccaggacggttctggaacaccacgatcgcagtatcgatggcaaacatatttcgaggctcttacttggccggtgcgggattattattttctataatgaaaaatactgcaaacacccgaagaggaaccgggaatactggggagacattaggtgaaaaatggaaaaatcgattaaatgcccttggcaaatcggagttccaaatatacaaaaagtctggtatacaggaagttgacagaacacttgccaaggaaggcataaaaagaggagaaacagaccatcacgctgtatcacgcggctctgctaaattacgttggtttgtagaaagaaacctcgtaacccctgagggtaaagtcgtagatctaggatgtgggagaggtggttggagctactactgtggtggcctgaaaaatgttaaagaagtgaaaggtctcaccaaaggagggcctgggcatgaagaaccaattccaatgtcaacatacggctggaaccttgttagacttcagtctggtgtcgacgtgttctttacaccaccagaaaaatgtgacacacttctgtgtgatattggagaatcttcacccaatcctacagtagaagcaggtcgaactctacgcgttctaaatttagtagaaaattggctaaataataacacacaattctgtattaaagtattaaatccttacatgccaagcgtaattgagaaaatggaagcattacagagaaaatacgggggagcgttagttagaaacccgttgtcgcgcaactcaacccacgaaatgtactgggtttcaaacgcttctggaaatatagtcagctctgtcaatatgatttcccgaatgttaattaataggttcacaatgaaacacaagaaagctacatacgagccggatgtagacctaggttcaggaacaagaaatataggtatcgagtctgaaacaccgaacttagatataattggaaaaagaatagaaaagatcaaacaggaacatgagaccagctggcactatgaccaagatcacccatataagacgtgggcgtatcacgggagttatgaaacaaagcagacaggctctgcaagtagtatggttaatggagtagtaagattgcttacgaaaccctgggacgtaatcccaatggtaactcaaatggcgatgactgacacaacaccgtttggacaacaaagagtgtttaaagaaaaagtagacacacgcacacaagaaccaaaagaaggaactaagaaattaatgaaaataaccgcagagtggttatggaaggaattaggaaagaagaaaaccccacgaatgtgcactagagaagagttcactagaaaagttcgatctaatgcagctttgggagcaattttcaccgacgaaaataagtggaaaagcgcaagggaagctgtcgaggacagcgggttttgggaacttgtggataaagaaagaaatttacatctggagggaaagtgcgagacgtgcgtctacaatatgatgggtaaaagagagaagaaattgggcgagttcggaaaagcgaaaggaagtagagcaatatggtatatgtggctaggggctcggttcctcgagttcgaagcccttgggttcttaaacgaagaccactggtttagtagagagaactctttgtccggggtggaaggcgagggactccataagctgggttatatactaagagacgttagtaagaaagaaggaggagctatgtatgcagacgacactgcaggttgggatacaagaattacactagaagatctaaagaacgaagagatggtaacaaatcatatggaaggagaacaccggaaattagcagaggcaatttttagattaacatatcaaaataaagttgtacgtgttcaaagacctacacccagaggaacagtgatggacataataagccggagagatcaaagaggaagtggacaagtagttacatacgggctaaatacttttacgaatatggaagcgcaactaatacgacaaatggaaggagaaggcgtattcaagtcaattcaacatttgactgtcactgaagaaatagccgtcaaaaattggttagaacgagtcggtcgagaaaggctgtcacgtatggcaatctcgggcgatgactgcgtggtcaagccactggatgacaggttcgcgtcagcgctgacagcactgaatgatatgggcaaggtgcgaaaagacatacaacaatgggaaccctcaagagggtggaacgactggacacaggttccattctgttcacaccactttcacgaacttataatgaaagacggaagagtcctagtggtaccctgtcgcaaccaagacgaattaattggtagagcaaggatctcccaaggggcaggatggtcactaagagaaactgcatgcttgggtaagagttatgcacaaatgtggagtctaatgtattttcatagacgggatctaagactagcagcgaacgcaatttgtagtgcagtaccaagccactgggtgccaaccagtagaacgacgtggagcatccatgcaacccacgaatggatgacaaccgaagatatgttaacggtatggaaccgagtatggatccaagaaaatccatggatggaggataagacgccagtcgaatcatgggaagaaataccgtatttagggaagagagaggatcaatggtgtggttcactgattggtcttaccagtcgcgcgacttgggcaaagaatatacaaacggcaatcaatcaggtaagatcattaattggaaatgaagaatatacagactatatgccgagcatgaagaggtttcgaagggaagaggaagaggcaggcgttctatggtga

SEQ ID NO: 22231 - RNA, 9876 nt, synthetic construct
  misc_feature 1..9876: note = derived and/or modified CDS sequence (opt6) from DENV-2__KX380833__SS-prME
  source 1..9876: mol_type = other RNA
accgcaggtattattatcatgatgattcccacggtaatggcttttcacttaacgacgagaaatggagaaccccacatgatagttagccgacaagaaaaaggtaaatcactcttgtttaaaacagaaaacggagtgaacatgtgcactcttatggcaatggacctcggagaattgtgcgaagacacaataacatataactgtcctcttctaagacaaaacgaacctgaagatattgattgctggtgcaacagtacttcgacttgggtaacatacggaacatgcacagcaacaggggaacatcgccgtgaaaaacgctccgttgcgttggtgcctcacgtaggaatgggtcttgaaacaaggacagaaacatggatgagcagtgagggagcgtggaaacatgctcagcgtatagagacatgggtactcaggcatccaggctttacagtgatggcagcaattctcgcgtacactataggaacgacctactttcagcgagtgctgatctttattctcttgacagcggtcgcaccttctatgacgatgcggtgcataggaatttcaaatagagattttgtagagggagtttcgggaggatcatgggtggatatcgtattagaacatggttcctgcgttaccaccatggcgaaaaacaaacccactttggatttcgaattgattaaaacggaagcgaaacaccccgcaacgctacgaaaatactgtatagaggcaaaattgactaacacaactactgcctcgagatgtccaacacaaggtgaaccttctttaaatgaggagcaagataaaaggttcgtttgcaaacattcaatggtcgataggggctggggaaatggatgcggtctgttcggcaaaggaggaatagtaacatgtgctatgttcacatgcaagaaaaatatggagggaaaaatcgtacaaccagaaaacttagaatacacaatagtaattaccccacactcaggtgaagaaaatgcggttggaaatgatactggtaaacacggaaaagagataaaagttactccgcaaagctctataaccgaagcagaattgacgggatatggaaccgctacaatggaatgttctccaagaacagggttagactttaatgaaatggttcttctgcaaatggaaaataaagcatggctagtacacaggcaatggtttttagatcttccgttgccgtggctacccggagccgacacccaaggatcaaattggatccaaaaagaaaccttggtcacatttaaaaatccacacgccaaaaagcaagatgttgtagtccttgggagtcaagaaggagcgatgcatactgctctcacaggtgcaaccgagatacaaatgtcttcgggaaatctactatttactgggcaccttaaatgtcgcctacgaatggataaacttcagctcaaaggcatgtcgtattcaatgtgcacagggaagtttaaagtggtcaaagaaatagcagagacacaacacggtacaattgtaatacgtgttcaatacgaaggagatggatcaccatgcaaaataccgtttgaaatcatggacttggaaaaacgtcatgttctgggcagactaattacggtaaatccaattgtaaccgagaaagacagtcctgttaacatcgaagctgaaccaccatttggtgatagctatataataataggagttgaacccgggcagctgaaattgtcatggttcaagaaagggagttcaatcggacagatgtttgagacaactatgcgtggagccaaaagaatggccatacttggtgataccgcttgggactttgggagtctcggaggagtgtttacgtcaataggaaaggctttacatcaagtttttggagcgatttacggagcagcatttagtggtgtaagttggactatgaaaattcttataggagtggtaataacttggattggtatgaactcaagatcaacgagtcttagtgtttcccttgtcctagtcggcatagttactctataccttggagtcatggtgcaggccgattcaggctgtgttgtaagctggaagaataaggaattgaaatgcggaagtggaatatttataacggacaatgtgcacacatggacggaacaatataagtttcagccggagtccccaagtaagctagcttctgcaatacaaaaagcgcacgaggaaggaatatgcggtataaggagtgtcactcgcttagaaaatttgatgtggaaacaaataacaccagagttaaatcatatcttatctgaaaatgaggtaaagttaaccataatgacaggcgacataaaaggaatcatgcaagcaggaaagcggtccctaaggccacaaccaacagaattaaaatacagctggaaagcatggggcaaagccaagatgttatcaaccgaactgcacaatcatacatttctaatagatggacctgagactgcggaatgcccaaacactaatcgggcctggaatagtttagaggttgaagattacggctttggcgtattcacaacaaacatctggctcaaactaaaagaaagacaagatgtgttttgtgatagcaaactcatgagcgccgctataaaagacaatcgagcagtacatgcagatatgggatattggatagaatccgcactgaatgatacttggaagattgagaaagcgtcatttattgaggtaaaaagttgtcattggccaaaatcgcatacactatggtcgaatggagtcctagaaagcgaaatgataatacctaaaaatttcgctggcccagtttcgcagcataattatagaccaggttatcacacccaaacggcaggaccatggcacctcggacgccttgagatggactttgatttctgtgaaggaacgacagtagtagttacagaagattgcggaaacagggggccatctctaagaacaaccactgcatctggaaaactaatcacagaatggtgttgcagatcctgtacgttgccccctctccgatatagaggagaggacgggtgttggtatgggatggaaatcagaccactaaaggagaaagaggaaaatttggtcaactcacttgtcacggcaggccatggacagatcgataatttcagtctaggagtacttggcatggcattatttttagaagaaatgctacgaacacgagtgggaaccaaacatgctatattattagtagctgtctcatttgtcacactaataacgggcaatatgtcatttcgagatctgggaagggtaatggttatggtaggcgcaaccatgaccgacgatataggaatgggtgtaacctacttagcgctattagccgcatttaaggtaagaccaacctttgcagccgggttattgctacgcaaactaacgtcgaaagaattaatgatgactacgattgggatagtattgttatctcagagtacaattccggagacgatactagagttgaccgatgcattggcacttggtatgatggtgctaaaaattgtgagaaacatggaaaaatatcagcttgccgtgactataatggccatattatgtgtccctaatgcagtaattcttcaaaacgcatggaaggtaagctgcacgattctggcagttgtttccgtaagtcctctactgctcacatcttcacaacaaaaagctgattggataccattagctttgaccatcaaaggtttaaatccgaccgccatctttctaacaacactatcaaggacatctaagaaaagatcttggccacttaacgaagcgattatggctgttggtatggttagtattttagcaagtagcctcttgaaaaacgatattcctatgacaggtcctctggtggcaggaggactacttacggtttgttatgtacttactggtcgctctgcagatctagaacttgagagagcagcagatgtaagatgggaagaacaggcagagatctcaggttcttctccaatactttcaattacaatttcagaagatggatccatgtcgatcaaaaatgaagaggaagaacaaacgttaaccattcttattcgaacggggttgctagtaatatcagggttattccctgtgagtataccaattacggccgccgcatggtatctttgggaagtcaagaaacagagagctggtgtgttgtgggatgtaccttcaccaccacccgtaggtaaagctgaactagaagatggcgcgtatagaattaaacagaaaggcatccttggctactctcagataggcgcaggagtttacaaagaaggaacttttcacacgatgtggcacgtaactagaggtgctgtattaatgcataaaggtaaaagaatagaaccatcatgggcagatgtaaagaaagacctaatcagttatgggggcggctggaaattggagggggaatggaaagagggagaagaagttcaggtgctagcgctggaaccagggaagaatcctcgggcggttcagactaaaccaggcctatttaagacaaataccggaactattggtgcggtatccttagacttttctcctggcacgtcgggaagccccatagtagacaaaaaggggaaagttgtaggcctttatgggaacggtgtagtaactcgttcagggacgtatgttagtgcaatcgcacaaacggaaaaatcaatcgaagataatcccgaaattgaggatgacattttcagaaagaaacgactcacaattatggatttacatccgggtgcaggaaaaaccaaaagatatctgccagccatagtacgggaagcaatcaaaagaggtttaaggacactaatactcgcgcctacacgggtcgttgcagcagaaatggaagaagcgttgagaggattgccaatcagatatcaaactccggcaatcagagcggaacatacaggtcgtgaaatagtagacctaatgtgtcacgcgacttttacaatgagattattgtctcctataagagtgcctaattacaatttaataataatggacgaagcacatttcaccgatcccgcaagtatagcagcaaggggatacatctcaactagggtagagatgggtgaagccgcaggaatatttatgacagccaccccaccaggatctagggatccatttccacaatcaaatgcgccaatcatggacgaggaacgagagattcccgaaagatcgtggaatagtgggcatgaatgggttactgattttaaaggtaaaactgtgtggtttgtcccatcgataaaagcagggaatgacatagccgcatgcttaaggaaaaatgggaagaaagtaattcagttgagtcggaaaacttttgattcagagtatataaaaactcgtaccaatgattgggactttgttgtgacaactgacatctctgaaatgggcgcgaatttcaaagcagaaagagtaatagatccaagacgctgcatgaaaccagtcatactgacagatggagaagaacgggtcatactagccggtccaatgcccgttactcacagtagtgcagcccaacgtaggggtagagtaggcagaaatcctaaaaatgaaaacgaccaatatatttatatgggtgaacctctcgaaaatgacgaagattgtgcacactggaaagaagcaaaaatgttactagataatatcaacacaccagaaggcattataccaagtatgttcgaacccgagcgggaaaaagtggatgcaatcgacggtgaatatagattgagaggcgaggctagaaagacattcgtagaccttatgagacggggagatttaccagtatggctcgcatatcgggtggctgcagaaggaataaattacgcggacagacggtggtgctttgatggagtgaaaaataatcaaatcctagaagaaaacgtagaggttgaaatatggacgaaggaaggagaacgaaagaaacttaaaccacgatggctagatgcgcgcatttacagcgacccactcgcgttaaaggaatttaaagaatttgcagctggacgaaagagcttgactctaaatctaattacagaaatgggaaggctccctacatttatgacgcaaaaggcaagaaacgcattagataatttagctgtcttacacaccgccgaagcgggaggacgtgcttataaccatgccttgtctgaattaccggagactctggaaactcttttattattaacattacttgctacggtaacaggaggcatcttcctatttttaatgtctggcaaaggaataggaaagatgaccctaggcatgtgttgcatcattacagctagtatattgctgtggtatgcccaaatccaaccgcactggatcgcagcaagcataatactggagttctttttaatcgtgctactaataccagaacctgaaaaacaacgtacaccacaagacaatcagctaacgtatgtagttatcgccatcttaacggtggtcgcagcgactatggcgaatgaaatgggatttttagagaaaactaaaaaggattttggtctaggatcaataacgacgcaacaacccgactctaacatactcgatatagacttaagacccgctagtgcatggacactttacgctgtcgcaacaacattcataacacctatgctaagacattctatcgaaaattcaagtgtaaatgtgtcactcactgcaattgcgaatcaggcaacggttttgatgggtttggggaaaggatggcccttatctaagatggacataggcgttccactcttggcgataggttgttactcccaagtaaacccaataacgttaacggccgcattattattattagtcgcacattatgcaataatcggccctggattacaagcaaaagcaacccgagaggcgcaaaaacgtgcagcagccggaatcatgaaaataccagccgccgacggcataaccgtcatcgacttagatcccattccctatgatccaaaattcgagaagcaacttggacaagttatgttattggtattatgtgttacgcaagtacttatgatgcggactacctgggccttatgcgaggccctcaccctcgctacggggcccatatcgacgctttgggaaggaaacccgggacgtttctggaatacaacgatagcagttagtatggccaacatttttcgcggctcttacttggcgggagctggtttattattttcgatcatgaaaaatacggcaaacacacggagaggtactggcaacacaggagaaacattaggtgaaaaatggaagaataggttaaatgccctcggtaagtcagagttccagatctataagaaatcagggatccaagaagtagaccgaacactagctaaggaaggtattaaaagaggagagactgatcatcacgcggtatcacgtggtagtgcaaaattgagatggttcgtggaaagaaatttggtaactcctgagggtaaagttgttgatctaggttgcgggaggggtggttggagttactactgtgggggcctcaaaaatgttaaagaggttaaaggactaacgaaaggaggcccaggacatgaagaaccaatccccatgagtacgtacggatggaatctagtcagattacaatcaggagtagacgtcttctttacccctccagagaaatgtgacacactactgtgcgatattggtgaatctagtccaaaccctaccgtggaagctggtaggacccttcgagtattaaatttagtggaaaattggctaaataataatacgcagttttgtataaaagtgttaaatccatatatgccgtcagtaatagaaaagatggaagcactccagagaaagtatggtggtgccttagttcggaatcccttatcaaggaacagcacacacgaaatgtattgggtatcgaatgcatccggtaacattgtttcatcggttaacatgataagcaggatgttaatcaacagatttaccatgaaacataagaaagcaacatatgaaccagatgttgacttaggctcgggtacaaggaatatcggcatagagtcagagacgccaaaccttgatatcattggtaaacgtattgagaaaataaaacaggagcatgaaacgtcctggcactatgatcaggatcatccatacaaaacatgggcctaccatggttcatacgaaacaaagcaaactgggagtgcatcttctatggttaatggtgtagttcgattattgactaagccatgggacgttatcccaatggtcacacaaatggccatgacagatactacaccatttggtcagcagagagtattcaaggaaaaagttgatacaagaactcaagagccaaaagaaggtacgaagaaacttatgaaaatcaccgctgaatggctttggaaggaactaggtaagaagaaaacccctcgtatgtgcaccagagaggaatttaccagaaaagtccgctcaaatgctgccctaggtgcaatttttacggatgagaataaatggaaatctgcaagagaagcagtcgaggactcaggcttttgggagctagttgataaagaaagaaatctccatctggaaggcaaatgcgaaacatgtgtctataatatgatgggtaaacgagagaagaaattaggcgagttcggaaaagccaaaggcagcagggctatctggtatatgtggttaggtgctagatttctagaatttgaagcacttgggttcttaaacgaagatcattggttctcacgagagaactctttaagcggtgtagagggcgagggtttacataaactgggttatattctaagggacgtatctaagaaagaaggaggagccatgtacgcggacgacaccgcaggatgggatacccgtataactcttgaggatctaaagaatgaggagatggtaactaaccacatggaaggtgaacataggaagttggctgaagcaatcttcagattgacgtatcaaaataaagtagtcagggtacaacgtccaacgcccagaggtactgtaatggacattataagtcgacgggaccaacgaggttccggacaggtagtgacatacggattgaacacattcaccaatatggaagcccagttaatccgccagatggagggagagggagtattcaaatcaatccaacatttaacggtcaccgaagaaatagctgtaaagaattggctggaaagagttgggagagagcgcttatcaaggatggcaatttcaggcgatgactgcgtagtgaaaccattagatgatagatttgcatccgcgcttacagcactcaatgacatgggaaaggtaagaaaagacattcaacagtgggaaccaagccgaggatggaatgactggactcaagtgcccttttgcagtcaccatttccacgagttaattatgaaagatggacgggtgttagtcgtaccttgtagaaaccaagacgaacttatcggcagggcaagaatcagccagggagcgggttggagtctaagagaaacggcgtgcttagggaaatcctatgctcaaatgtggtcgctaatgtatttccatagacgggatcttaggttggcagcgaatgcaatatgcagtgctgtcccaagtcattgggtacctataagcaggaccacatggagtatccacgcaacccatgaatggatgacaacggaagatatgctgaccgtatggaatcgcgtgtggatccaagaaaacccatggatggaagacaaaactccagtggaatcctgggaagaaataccataccttggaaagagagaagatcaatggtgcggtagtttgataggacttactagcagagcaacctgggctaaaaatattcaaacagccataaatcaagtacgaagtctgataggcaacgaagagtataccgactacatgcccagtatgaaaaggttcagaagggaggaagaagaagcaggggtgctatggtga

SEQ ID NO: 22232 - RNA, 9876 nt, synthetic construct
  misc_feature 1..9876: note = derived and/or modified CDS sequence (opt6) from DENV-2__KX380834__SS-prME
  source 1..9876: mol_type = other RNA
actgctggtataataattatgatgattcctactgtaatggcttttcacctgacgactcgaaatggtgaacctcatatgattgtttcacgacaagaaaaaggaaaaagtctgttgtttaaaacagaaaatggagtgaatatgtgcactttaatggctatggatcttggggagctatgtgaggacactataacatacaattgtccattgctaagacaaaatgaacccgaggacatcgattgctggtgtaatagtacctcaacatgggttacatacggtacttgtacagcgacaggagaacatagacgagagaaaagatcagtagcattagtaccccacgtgggaatgggactcgagactagaacagaaacctggatgtcgagcgaaggggcttggaaacacgctcaacgaattgagacgtggattcttcgacatccaggctttacaataatggccgcaatcctagcttatacaataggaactacatattttcaacgagtattaatctttatactattgacagcggtaacgccaagcatggcgatgaggtgtatcggcatatctaatagggacttcgtagaaggagtaagtgggggaagttgggtagatatagtcctggaacacgggtcgtgcgttacaacaatggcgaaaaataaaccgacgcttgatttcgaattgatcaaaaccgaagcaaaacatcttgcaacgttacgtaaatactgtgttgaggcaaaattgacgaataccacgaccgccagtcgctgcccaactcagggcgaaccaagcctgaacgaggaacaagataaaaggtttgtgtgcaaacattctatggttgatcgaggctggggtaacggctgcggactttttggaaaaggcgggatagttacatgcgcaatgttcacatgcaagaaaaacatggaaggtaaagtcgtgcaaccagagaacctcgagtacacaatagtcataacgccacatagtggcgaagaaaatgcagttggcaatgacacaggtaaacatggaaaagaaataaaagttacaccgcagagttcaattaccgaagctgaactgacaggatacggaacagtaacaatggaatgcagccccagaacaggattagactttaacgaaatggtactgctccaaatggaaaacaaagcgtggctagtacataggcaatggtttctggatctcccgcttccatggttgccgggagcagatactcaaggtagcaattggattcaaaaagaaaccttggtaacttttaaaaatccccatgcgaagaaacaagatgtagtagtgcttggtagccaagaaggagcgatgcatacagcactgacgggcgctaccgagattcaaatgagtagtggcaatctgttatttacgggtcatctgaaatgcagactccgaatggataaattacagttgaaaggaatgtcgtactcgatgtgcactggcaaatttaaagtggtaaaagaaatagcagagacccaacacggaacaatagtcatacgagtacaatatgaaggggatggtagtccatgtaaaattcctttcgaaataatggatctggagaaacgacatgtactaggacgactaataacggtaaaccctatagtcactgaaaaagatagcccagtgaacattgaggcagaacccccttttggcgatagttatataataataggagttgagccaggacaattaaaattgtcttggtttaagaaaggctcaagcatagggcagatgttcgaaacgactatgcgaggagcaaaaaggatggctatcttaggcgatacagcatgggacttcggttcactgggcggggtattcacttctataggtaaggctttacatcaggttttcggggctatttatggagcggccttttcaggagtaagttggactatgaaaatcctaataggggtggtaataacgtggataggtatgaatagcagatctacatcactatcggtttctttagttttggtgggtgttgtcacactgtacttaggtgtgatggtacaggcagattcaggatgtgtcgtctcatggaaaaacaaagaattaaaatgtgggtcggggatatttataactgataacgttcatacgtggacagaacaatacaaattccagcctgaaagcccatccaaactagcttcggctatacaaaaggcacacgaagagggaatttgtgggattcggtctgttacacgtctggaaaatttaatgtggaaacaaatcacaccagaactcaaccatatcctgaccgaaaatgaggttaaactgacaatcatgacaggagatattaaaggaataatgcaggcgggtaaacgatcgcttagacctcaacctactgaactaaaatactcatggaaggcctggggtaaggctaaaatgttgagtacagaattacataatcatacctttttgatagacgggccagaaactgcagaatgtccgaataccaatagagcttggaatagtctagaagtagaggattacggtttcggtgttttcaccactaatatatggcttaaactaaaagaacgacaggatgtcttttgcgattctaacctcatgagtgcagcgataaaggataaccgggctgtgcatgcagatatgggatactggatagaatcagctcttaacgatacatggaaaatagagaaggcttccttcattgaagtaaagtcctgtcattggcccaagtcacatacactctggtctaatggggttttagaatcagaaatgatcatccctaaaaatttcgcaggaccagtttctcagcataattatcgccccggctatcatacgcaaacagcaggcccgtggcacttgggaaggctagaaatggatttcgatttttgcgaaggaacgacagttgtagtaacagaagattgtggtaacaggggacccagcttgaggacaacaactgcatctgggaaattaataaccgaatggtgctgcagatcatgcactctaccaccactgaggtatcgaggagaagatggatgttggtatggaatggagatcagaccgttaaaagaaaaggaagaaaacttggtcaatagtttggtgactgcgggtcatggccagatagataatttcagcttaggagttctgggaatggccctctttctggaagagatgctacgaactagagttgggacgaaacatgcaatactcctcgtagcagtttcttttgtaactttaataacaggaaatatgtcatttcgagatttaggtcgagtgatggttatggtcggcgcaacaatgactgatgatatcggaatgggagtgacatatctagccctcctagctgcatttaaagtgcgaccaactttcgctgcagggttgttacttagaaagctaacaagtaaagaactaatgatgacaacaataggcatagttttactcagccaaagcacaattccagaaagtatactggaactgactgacgcgctagctcttggtatgatggtactaaaaattgtgcgcaacatggagaaataccaactcgcagttacaattatggctatactttgcgtgccaaatgctgtaattcttcaaaatgcgtggaaagtatcgtgcacaacattggctgtagtctcagtgagcccattactcttgacgtcttcacaacaaaaagctgattggataccattggcgttgacaattaaaggcttaaatccaacggctatatttttaactacactctcaagaacatcaaagaagcgaagctggcccttgaatgaggctataatggcagttggcatggtgagtatcctagcatccagcttattgaaaaatgacatccctatgacgggcccgctagttgctggcggtttattgactgtatgctacgtattaacaggacgtagcgccgatctcgagttagagagagcagcagacgtgcgctgggaagaacaagctgagatatccggatcatcgccaattctgtcaatcacaatatctgaagatgggtctatgagcatcaaaaacgaagaagaagaacaaaccttgactatcttgatcaggactgggcttctggtaatctcggggctattcccagtgagtataccaataacagcggctgcctggtacctttgggaggtcaagaaacagcgagcaggagtgttatgggatgtaccaagtccaccccctgtaggtaaagcagaattggaagacggggcgtatcgcataaaacagaagggtatattggggtattcacagataggagctggagtctacaaagaaggcacgttccacacgatgtggcatgtcacacgaggagcagtgttaatgcacaaaggaaaacgaattgaaccctcttgggctgatgttaagaaggacttaatatcatacggtggaggatggaagttggagggtgaatggaaagaaggggaagaagtccaggtcctagctttagaaccaggcaaaaatccacgtgccgtacagacaaaacctggactctttaagacaaatacaggcacgattggagccgtatcactggacttctcacccggcaccagcgggagtccgatcgttgacaaaaagggtaaagttgtcggtctatatggaaatggagtagttaccagaagtggaacatatgttagtgctatcgcacagactgagaaaagtattgaagataatcccgaaatagaagatgatatatttcgaaagaaacgcctaaccataatggacttacatccgggcgcgggaaaaaccaagagatatttaccggcaattgttcgagaagccataaaaaggggtttacgcaccttgattttagcaccaactcgtgtagtcgcagctgaaatggaagaggctctaagaggattgccaattagatatcaaacgcctgcaataagggcagagcatactggaagagaaattgtagatttgatgtgtcacgcgacatttacaatgagattgttgtctccaataagagtaccgaattacaatttaataataatggacgaagctcattttactgatccagcatctatagccgctcgtggatacatctcgactcgcgttgagatgggagaagcagcaggaatttttatgactgctacaccaccaggatctagggatcctttcccacagagcaacgctccaataatggatgaagaaagggagattccagaaagatcatggaactctggacatgaatgggtaacagactttaaaggaaaaactgtatggttcgtaccctcaataaaggctggaaatgacatagcagcttgtctgaggaaaaacggcaagaaagtgatacaactatcaagaaaaacattcgattccgagtatataaaaacacgtacaaatgattgggattttgtagtaacgacagatatttcggaaatgggagctaattttaaagcggaacgtgtaattgatcccaggagatgtatgaagccagtgatcctaacagacggcgaagaaagagttattctagccgggccgatgcctgtcactcattcatcagccgcacaaagacgtgggcgcgtaggaaggaatcccaaaaatgaaaatgatcaatatatatacatgggcgaaccattagaaaatgacgaggattgcgctcattggaaagaagcaaagatgctattagataatataaatacgcctgaaggaataattccgtcaatgtttgaacctgaacgagaaaaagtcgacgctatagacggagaataccgattaagaggtgaagctcgcaaaacgttcgttgacctaatgcgccgaggtgatctaccagtttggttagcatatagagtcgcggccgagggaattaactatgcggatcgtcgttggtgtttcgacggcgtcaaaaataatcaaatcttagaagagaatgttgaagtagaaatatggacaaaagaaggagaaagaaagaaattaaaacctagatggctcgacgcacgcatatacagtgatcctttagccttaaaggaatttaaagaatttgctgccggtcgaaaaagtcttaccttaaatctaattaccgaaatgggaagattacctacgttcatgacacagaaagccaaaaatgcactagataatttagccgtactacacacagcagaagcaggaggacgagcttataatcacgcattgtctgaattgccagaaactctcgaaacattattactattaacactcctagcaacggtaaccggaggtatattcttattcttaatgtctggaaaaggaatagggaaaatgaccctcggaatgtgttgtatcattacggcatcaatattactctggtacgcacaaatacagccacattggatagccgcttcgataatactggaatttttcctaatagtattattaatacctgaaccagaaaaacaacgtaccccacaagataaccaattaacttatgtagtgatagctatcttaacagtcgttgcagcgacgatggcgaatgaaatgggatttttagagaaaaccaagaaagattttggactggggtcgattacgacgcagcagccggaaagtaacatattagacattgatctccgacctgcgtctgcttggacattatatgcagttgccacgacattcataacccccatgttaagacactcaattgaaaattcctcagttaatgtttcattaactgcaatcgccaatcaagcaactgttttaatgggattaggtaaagggtggccgctgtcaaaaatggacattggagtacctcttctagccataggctgctactcacaggtgaatccgatcaccttaacggcggccctgctattgctagtggcacattatgccattattggacccggacttcaagccaaagccacaagggaggcacaaaagcgtgcagctgcaggaattatgaaaaatcctaccgtagatggaatgacagtaattgatttggatccaattccctatgatccaaaatttgaaaagcaacttggacaagtcatgctattagtactatgtgttacgcaagttttgatgatgcgaacgacatgggcactttgcgaagctctcaccttggctacgggccctattagtaccctatgggagggtaacccaggtagattctggaataccacaatcgctgtatctatggcgaatatatttagaggcagttacctggccggagcagggttactctttagtatcatgaaaaatacagccaacacacggcgaggaactggtaatactggagaaacactaggagaaaagtggaaaaacagattaaatgccctaggaaaaagcgaatttcagatatacaaaaagtccggaatacaagaagtggacagaaccttggcaaaagagggaataaagagaggagaaactgatcatcatgcagtatctagggggagtgcaaaacttcggtggttcgttgaacgtaatttagtgactcctgaaggtaaggttgtcgatttaggctgcggaagaggaggatggagctattactgtgggggacttaaaaacgtaaaagaggtaaaaggcctaactaagggaggaccaggacacgaagaacctatacccatgagtacctatggatggaatcttgtccgactgcaaagtggagtagatgtattctttacaccacctgagaagtgtgatacactgctctgtgacattggagaatcgtctccaaacccaactgttgaagccggacgaaccctccgagttctaaatctagtagagaattggctaaacaacaatactcagttctgtattaaggtgttaaatccatacatgccttctgttattgaaaagatggaagcattacaacgaaaatacggtggagccttggtacgcaatcctttatcaagaaactcgacacacgaaatgtactgggtatccaacgctagtggaaatattgtttcctctgtcaatatgatatcaagaatgctgattaacagattcactatgcgacataagaaagcgacttatgaaccggatgtcgacctagggtccggcactagaaatatcggcatagaatcagaaacccctaatctagacataataggcaagcgaatagagaaaattaaacaggaacatgagacttcatggcactacgatcaagaccacccttataaaacatgggcatatcatggctcttacgaaaccaaacaaacgggcagcgcatcgtctatggtcaatggtgtggtccgtttactaacgaaaccgtgggatgtaatacctatggtcactcaaatggcaatgaccgatacgacgccatttgggcagcagagagtatttaaagagaaagtggatacccgtacgcaggaaccgaaggaagggacgaagaaactaatgaaaattactgctgagtggttgtggaaagaattaggaaagaagaaaacaccaagaatgtgcactcgagaagaatttacaaggaaggttagaagcaacgcagctctaggagcgatatttactgatgaaaataaatggaaatcagcgagagaagcagttgaagacagcggattttgggaattagtagacaaagaacgtaacttgcacttggaaggaaaatgtgaaacctgtgtatataatatgatgggaaagagagagaaaaagctaggtgaatttggaaaggcaaaaggctccagggcgatttggtacatgtggttaggggctcgattccttgaatttgaagccctaggctttttaaatgaagaccattggttttcacgggaaaattcactatctggcgtagaaggggaagggttacacaagctgggttatatattgcgagatgtatctaagaaagaaggaggagcgatgtatgccgacgatactgccggttgggacacaagaatcacactagaagatctcaaaaatgaagagatggtgacaaatcacatggaaggagaacataagaaactagcagaagcaatttttaaactgacatatcagaacaaagttgtacgcgtgcagagacccacgccaagggggacagttatggacattatatcgcgaagggaccaaaggggtagtggtcaagtggtaacgtatgggctcaatacatttacaaatatggaagcacaactgatcagacagatggaaggcgagggggtctttaaatcaatacaacagctgacggtaaaagaagagatcgcagtgaaaaactggctaatccgagtaggaagagaaagattatctcgtatggcaatttccggtgacgattgtgttgtaaaaccacttgacgatcggttcgcatccgcacttactgcgttgaatgatatgggaaaagtacgaaaagatatccagcaatgggaaccaagtagaggttggaatgactggacgcaagtaccattttgtagtcaccatttccatgaactaattatgaaagatggaagggtcctggttgtcccctgtcgaaatcaggatgaacttatcggcagagcacgtatctcacaaggagcgggatggagcttaagagaaactgcctgcctaggtaaatcctatgcccaaatgtggtcgctaatgtattttcatagacgagatctgagattagcagctaatgctatatgttctgcggttccaagtcattggatcccaacgtctagaacaacctggtcaatacacgccacacacgaatggatgacgacggaagacatgttgacagtatggaaccgagtatggattcaagagaatccatggatggaggataagactccggttgagagttgggaagagataccctatttaggaaaaagggaagaccaatggtgtggctcactaataggactaacttcacgtgctacgtgggcgaagaacatccagacagcgataaaccaggtcagatcactaataggcaatgaagaatatacagattatatgccatctatgaaaagattccgaagagaggaagaagaagcaggagtcttatggtaa

SEQ ID NO: 22233 - RNA, 9876 nt, synthetic construct
  misc_feature 1..9876: note = derived and/or modified CDS sequence (opt6) from DENV-2__KX380835__SS-prME
  source 1..9876: mol_type = other RNA
actgcagggataatcataatgatgattccaacagtaatggcgtttcacttgacaacacgaaatggtgaaccacatatgattgtaagtagacaagaaaaaggtaaatcgctactctttaaaactgaaaatggtgtcaatatgtgtacattaatggcaatggatttgggagaactttgcgaagatactatcacgtacaattgtcctcttttaagacaaaatgaaccagaagacattgactgctggtgcaactctacaagtacatgggttacttatggaacgtgtaccgcaacaggagaacatcgacgagagaaaaggtcggtagctctcgtaccgcatgtaggcatgggtctcgaaacccgaactgaaacttggatgtcaagtgaaggtgcatggaaacatgcacagagaatcgaaacatgggttctcaggcaccctggctttacagtcatggcagcaatattagcatacactatcgggactacatattttcaaagggtgttaatcttcatcctcttaacggcagtcgcacccagcatgacaatgcgatgtattgggataagcaatcgagactttgtagaaggggtttcaggaggatcctgggtagacatcgtcttagaacacgggagctgtgtgaccacaatggccaaaaataaaccaaccctagactttgaattaataaaaactgaagcaaaacaccctgctacattaagaaaatactgcattgaagctaaactgactaacacgacaacggcgagtaggtgtcctacacaaggtgaaccaagcctgaacgaagaacaggacaaaagatttgtatgcaaacattctatggtggatcgaggatggggaaatggttgcgggctatttggcaaaggtgggatagtgacttgtgcaatgtttacatgtaagaaaaatatggaagggaaaattgtccaaccagagaatctagaatacacaatcgtgatcacacctcattcgggggaggagaatgccgttggaaatgatacaggaaaacatgggaaagaaattaaagtcaccccacagtctagcatcacagaggcagagttaacaggttacggaactgcaactatggaatgctcacctagaactggattagatttcaacgaaatggttcttctacaaatggaaaataaagcatggctcgtacacagacaatggtttttagacctacccctcccatggttgcccggtgctgacacacaaggaagcaattggatacaaaaagaaacgctcgttacattcaaaaatccccatgccaagaaacaagatgttgtagtactgggcagccaagaaggggctatgcacacagctctgacgggagcgaccgaaatccaaatgtctagtggtaacctattgttcacgggccatttaaaatgtcgtttgaggatggataaattacagttaaaaggaatgagttattcaatgtgcacgggaaaatttaaggtagtaaaagaaattgctgagacccaacacggaacgatcgttattcgtgtacaatatgaaggggatggttcaccatgcaaaataccatttgagataatggatcttgaaaagagacatgttctcgggagacttattacagtcaaccccatagtaacagaaaaagatagtcccgtaaatatagaagcggagcccccattcggagactcctatataatcataggagtagagccaggacaactaaagctatcatggttcaagaaaggctccagcataggacagatgtttgaaacaactatgagaggtgctaagagaatggctatattaggagatactgcttgggatttcggttccctaggtggcgttttcacttctataggtaaggcgctccatcaagtattcggtgcaatatacggcgcagctttttccggagtatcatggacaatgaaaattctaattggtgtagttattacgtggattgggatgaactcgagaagcacctcattaagcgtgtccctggtattggttgggatagtgacactatatctaggggtaatggtgcaagctgacagtggttgcgtagtatcctggaagaataaagaactaaaatgcggtagtggaatatttattacagataacgtgcatacttggacggaacaatataaatttcagcctgaatcacccagtaaattagcgtcagcgattcaaaaggcccatgaggagggtatatgtgggatacgctccgttacgagactagagaatttgatgtggaagcaaataacacccgaactaaatcacatattaagcgaaaatgaagtgaaattaacaataatgacgggtgacatcaaaggaataatgcaggctggaaaacgaagtctaagaccccaacccacagaattaaagtattcctggaaggcttggggtaaagctaaaatgttatctacagaactccataatcatacgtttctaattgatggtccagagacggctgaatgtccgaataccaatagggcctggaactctctagaagtagaggattacggatttggtgtgtttaccacaaatatctggctcaaattaaaagaaagacaagatgtattttgcgactcaaaattaatgagcgcggcaataaaagacaaccgagcagttcatgcagatatgggatattggatcgagagcgccttaaatgatacatggaaaatcgaaaaagctagttttatagaagtcaagtcctgccattggccaaaaagtcatacactttggagtaatggggtactcgagtccgaaatgatcatccccaaaaattttgcaggtcccgtctcacaacacaactatagacccggataccatacacaaaccgcaggaccgtggcacttgggaagactagaaatggatttcgatttttgtgaaggtacgacagtagtagtaactgaagattgcggaaataggggtccaagtctaaggacaactaccgcctcgggcaaactaataactgaatggtgttgccgctcttgtacgttacctcccttgcgttatagaggagaagatggatgttggtacggaatggaaatacgaccacttaaagagaaagaagaaaacttagtcaattcactggtaacagcaggacacggtcaaatagacaacttttcactaggtgtattaggaatggcattgtttttagaagaaatgcttcgtacaagggtaggaacgaaacatgccatactattagttgcggtatcatttgtaacattaattacgggaaacatgtcgtttagggatctggggcgtgtaatggttatggtgggagcgaccatgacagacgatataggaatgggggtaacatatcttgctttgctggcagcgtttaaagtaagaccaacatttgcagctggactacttctaagaaaattaacttcaaaagaattaatgatgacaacaattggaatagtgttactatcccaatcaacaattccagagactattttggagttaacagacgcgttagcactcggcatgatggtactcaaaatcgttcgaaacatggaaaaatatcaactagcggtcacgataatggctatactttgtgtaccaaacgctgttattctgcagaacgcatggaaagtaagctgcacaattttagcggttgtttcggtcagccctcttctactcacatcttctcaacaaaaagcagattggattccacttgccttaacaatcaaaggcctgaacccgacggcaatatttttaacaactcttagccgaacaagtaaaaagagatcatggccgttaaatgaagcaataatggcagtaggaatggtaagcattttagccagctcgctactcaaaaacgatatacctatgaccggccctctggtcgccggtggtctactcaccgtatgttatgttcttacaggtcgaagtgcagacctagagctggaaagggcagccgacgtaaggtgggaggaacaagctgagattagcgggtctagtcctatactaagtatcactatatcagaagacggaagcatgagtatcaaaaatgaagaggaggaacaaacgctaacaatactaataaggactggtctattagtcatatcgggtttgtttccagtctctattccgataaccgcagcagcatggtatttatgggaagtaaagaaacaaagagcgggggtgttatgggatgttccttcaccgccgcccgtcgggaaggctgagctagaagatggtgcctataggatcaaacaaaaaggtattcttggatatagccagatcggagcaggcgtatacaaagaaggtacatttcacacgatgtggcatgtaacacgaggcgcagtattaatgcataaagggaagaggatagagccatcttgggcagatgtaaagaaagatctgatttcatatggaggcggttggaaactagaaggagagtggaaagaaggtgaagaagtacaagttctagctttagaaccgggtaaaaatccccgtgctgtacagactaaacccggtttgtttaaaacgaatactggaacaataggggccgtgtcattggattttagtcctggcacgagtggctcaccaattgttgataagaaaggaaaagtagtaggactgtatggaaacggggtagttacaagatcggggacttatgtctctgctatagctcagaccgagaaaagtatagaggataatcctgaaattgaggacgatatctttagaaagaaacgcttaaccatcatggaccttcatccaggtgctggtaaaacaaaaagatatctaccagccattgtaagagaagcaataaaacgcggtttacgcacactcatattggctcctaccagagttgtggcggctgaaatggaagaagcattaagaggcctaccaataagataccagacgcccgcaatacgagcagaacacactgggagagagatcgtagacttaatgtgtcacgcaacgtttaccatgaggttacttagtcccatacgagtaccgaactacaatcttataatcatggacgaagctcatttcactgatcccgcatcaattgctgctcggggatatatatcgactcgagttgaaatgggtgaggcggctggtatatttatgaccgctacacctcctgggagtcgcgatcccttcccccaaagtaacgcacccataatggatgaagaaagggaaatacctgaacgcagctggaactcgggacatgagtgggtgacagactttaaaggaaagacagtttggttcgtaccatcgattaaagcaggaaatgatatagcagcatgtcttagaaagaatgggaagaaggttatacagttatcacgaaagacgttcgatagcgaatacattaaaacacggaccaacgattgggacttcgtagtaaccacggacataagtgaaatgggcgctaacttcaaagcagaacgggtaattgatcctagacgctgtatgaaaccggtcatcctaacagatggagaagaacgcgtaattctagcaggaccaatgcccgttactcactcaagtgcggctcaacgaagaggacgggtaggtagaaatcccaaaaatgaaaatgatcagtacatttatatgggcgaaccattagagaacgatgaggactgtgcccactggaaagaagcaaaaatgctattagataatatcaatacacccgaaggaattattccttcaatgttcgagcctgaacgagaaaaagtagatgcaatcgacggcgaatacagacttcgaggagaagctaggaagacatttgttgacttaatgcgcagaggcgatttacctgtatggctagcttatagagttgcagcggaaggtattaattacgccgatcgtcggtggtgtttcgatggagtcaaaaacaatcaaattttggaggagaatgtagaggtagaaatttggacaaaggaaggtgaaaggaagaaacttaaacctcgatggttggacgcacggatttactcagatcccttagcgctgaaagagttcaaagaatttgcggcggggagaaagagcttaaccttgaacttgataacagaaatggggagactccccacatttatgacacaaaaagcacgaaacgcactcgataatctcgcggtacttcataccgcagaggcagggggtcgtgcctataaccatgcgttgagcgaactccccgaaactcttgaaacgctattgttgctaacccttttggctactgtaacaggagggatttttctgtttctaatgtcaggaaaaggcattggcaaaatgacactggggatgtgctgtatcataactgcgagtatattgttatggtatgcacagattcaacctcactggatagccgcatctattatattggaatttttcttaatagtacttttaattccagaacctgagaaacagcgcacccctcaggataaccagctaacctatgtagtaatagcaattttaacagtggtagcagcaacaatggctaacgagatgggattccttgagaaaactaagaaagattttggtttagggtccataactacacagcaacccgattcaaatatacttgatatagacttgcgaccagcgtccgcatggacattatacgcggtggctacaacgtttataacgccaatgttaagacatagtatcgagaatagcagtgttaatgtctccttaacagcaatcgcaaaccaagcgacagtactaatggggttaggaaaaggatggccactgagtaaaatggatataggtgttcctttattagccatcggttgttatagtcaagttaatccgataacgctaaccgcggctttactactacttgttgcgcattatgccataataggacccggacttcaggccaaagcaactcgtgaagcacaaaaacgcgcggctgctggaattatgaagaatcccactgtagacggtatgaccgttatcgatttggacccaataccttatgaccccaaattcgaaaaacaattgggtcaggtaatgttgttagttctatgcgttacgcaagtgttaatgatgcgaactacatgggctctgtgcgaagcattaacacttgctacaggaccaatctcaaccctttgggaagggaatcctggacgattctggaacacaaccattgcagtgtctatggctaacatttttagaggatcgtatctcgctggcgcaggactgctattttcaattatgaaaaatacggctaatacaagaagaggaacaggaaatacaggggagacgttaggtgaaaagtggaagaaccgcctaaacgcattaggaaaaagtgagttccaaatatacaagaaaagcggaatacaagaagttgacaggaccttagcaaaagaaggtataaagagaggcgaaacagatcatcatgccgtctcaaggggatcagcaaaacttaggtggttcgtagaacgcaatcttgttacgccggaaggtaaagtagtcgatttaggatgtggtcgcggtggctggagttactactgcggtgggctaaagaatgtgaaagaagtcaagggtctgacaaaaggaggaccagggcacgaagaaccgattcctatgagcacatacggttggaacctagtgcgtctgcagtcaggggtagatgtattcttcacacctcctgaaaagtgtgatacactactttgtgatattggagaaagctcaccaaatccgaccgtggaggccgggcggactttaagggttttaaacctagttgaaaattggttaaacaataacacacaattctgtataaaagttttaaatccttatatgccatctgtaatcgagaagatggaagcattacagagaaaatacggaggagctctggtaaggaacccactaagcagaaattctacacatgagatgtactgggtgagtaatgcaagcggaaacattgtcagtagtgtcaacatgattagccgaatgctcattaatagatttactatgaagcacaagaaagcaacatatgaaccggacgtcgacttagggagcgggactaggaatatagggatcgagtcagaaaccccgaatttagatataatcgggaaaagaattgagaagataaaacaagaacatgaaacaagctggcattatgatcaagaccatccctataaaacctgggcataccatggatcgtatgaaacaaaacaaacagggagcgcaagctcaatggtcaatggcgtagtgagattattaacgaagccttgggacgtaataccaatggtcacacagatggccatgaccgacactaccccttttggtcaacaaagagtattcaaggagaaagtcgatactcgaacgcaagagccaaaagaaggcactaagaaactgatgaaaattacagccgaatggctgtggaaggaactaggcaagaagaaaacgccccgcatgtgcactagagaagagttcacaagaaaagtgaggtctaacgcggcactaggagctatctttaccgacgaaaacaaatggaagagtgcgagggaagcggtcgaggattcaggtttttgggagttggtagataaagaacggaacttgcacttggaaggtaaatgtgaaacatgcgtatacaatatgatgggaaaacgagaaaagaagctaggagagttcgggaaggcaaagggatccagagcaatatggtacatgtggttaggggcacgctttctagagttcgaagccttaggatttttaaatgaagatcattggtttagccgagagaactcattatccggagttgaaggcgaaggattacacaagctgggatatatattacgagacgtttctaagaaagagggaggagcaatgtatgcagatgatacagccggttgggacacgaggataactctagaagatctaaagaacgaagagatggtcaccaaccacatggagggagaacacagaaaacttgcagaagcaattttcagactaacgtatcaaaataaagtcgttcgtgtacaaaggccaacaccaaggggtaccgtaatggacatcatatcaagacgtgatcaacgaggtagtggtcaagtagtaacttatgggcttaatacattcacaaacatggaagcccaactgatacggcaaatggaaggtgagggtgtgtttaagtcaatacagcatctaacggttacagaagaaattgcagtgaaaaattggctagaacgggtggggagagagcggttgagccgaatggccataagtggtgacgactgcgtagtaaaaccattggacgataggtttgcttcagctttgacagcattaaatgacatggggaaagttcgaaaagatattcagcagtgggaaccttcaagagggtggaatgactggactcaagtgccgttctgttcacaccattttcacgaattaataatgaaggatggacgtgtcctagtagttccatgtcgaaatcaagacgagttaattgggagagctagaatctcgcaaggggcaggatggtcattacgagaaaccgcttgccttggcaaatcttatgctcaaatgtggagtttgatgtacttccaccggcgagacctaagattagccgccaacgccatatgctctgcagtaccatcccattgggtacccatatcacgtacaacgtggagtatacatgccactcatgaatggatgacaactgaagatatgctgacagtgtggaatcgagtatggatacaagaaaacccatggatggaagataaaaccccggtggagtcctgggaggagataccgtatctgggtaaacgcgaagatcaatggtgtgggtccttaattggtctaacttcaagagccacttgggctaagaatatccagacagccataaatcaagtacgatcactaatcggaaacgaagaatatacagattatatgccatcaatgaaaagatttaggagagaggaagaagaagcaggagtattatggtaa

SEQ ID NO: 22234 - RNA, 9876 nt, synthetic construct
  misc_feature 1..9876: note = derived and/or modified CDS sequence (opt6) from DENV-2__KX380836__SS-prME
  source 1..9876: mol_type = other RNA
actgctgggatcattatcatgatgataccgactgtaatggcattccatttaactacaagaaacggtgaacctcacatgatcgtatcacggcaagaaaaaggaaaatccctactatttaaaacggaaaacggcgtgaacatgtgcacattaatggctatggacctaggagaactttgcgaagacaccataacatacaattgcccattactacggcagaatgaaccagaagatatcgactgctggtgtaatagcacttcgacttgggtgacatatggaacatgtaccgcaaccggggaacatcgccgagaaaaacgatctgttgccttagttccgcatgttggaatggggctagaaacacgaacagaaacatggatgtccagtgaaggcgcttggaaacacgcacaaagaatcgaaacctgggtacttagacatccaggatttactgtaatggctgcaatactagcatacacaattggaactacatattttcaacgtgtactcatattcatactactcactgcagtagcaccatcgatgactatgcgctgtatagggatatcaaaccgagattttgttgaaggagtttcagggggaagttgggttgacatcgtgctagaacacggttcatgcgttacgacgatggcgaaaaataaaccaacacttgactttgaactcataaaaactgaagccaaacatcctgcgactcttagaaaatactgtatagaagctaaattaacgaatacaacaacagctagtagatgtcccacgcaaggagagccaagtttgaacgaggaacaagataaacggtttgtgtgtaaacattcaatggtagacaggggatggggtaatgggtgtggtctatttggaaaagggggaatagttacctgcgcaatgtttacctgtaagaaaaatatggaaggaaaaattgttcaaccagaaaacctggaatatacgatagttatcacaccacactcaggtgaggagaacgcagtaggaaacgatacgggcaaacatggtaaagaaataaaagtcacaccacagtctagtataaccgaagctgaattaacaggttacggtacagcaacaatggaatgctccccaagaacgggactcgactttaacgaaatggtgttactgcaaatggagaataaagcatggctagtacataggcagtggttccttgacttaccattaccctggcttcccggagcggatacccaaggaagtaattggatccaaaaagaaaccctagtgacgtttaaaaacccacacgctaagaaacaagatgtagttgtattagggagtcaagaaggagccatgcatacagcgcttacaggagctacagaaatacaaatgagcagcggcaatttactattcacaggtcacctaaaatgtagattaaggatggataaactacaactgaaaggaatgtcttattctatgtgcaccggaaaattcaaagtagttaaagaaatagccgagacacaacatggaacaatcgtgattagggtccaatatgaaggagacggctcgccatgcaaaataccattcgagataatggatttggagaaaagacacgtgctaggaaggcttatcacggttaatccgattgtcactgaaaaagactcaccagtaaacatagaagctgaaccaccgtttggcgattcgtacattatcattggcgtcgagcccgggcaattaaaattatcatggttcaagaaaggaagcagcataggtcagatgttcgaaacgaccatgcgaggggcaaaaagaatggcaattctaggagatacagcctgggattttggcagtttaggaggagtctttacgtcaataggtaaagcactgcaccaagtattcggcgctatatatggagcagcttttagcggtgtgagttggacaatgaagattcttataggagtggttataacatggattggaatgaactctcgatcaacaagtttgagtgtttcgttggtattggtaggaatcgtcaccctttacttaggtgtaatggtacaagcggatagtggttgtgtcgtaagctggaaaaataaagaattaaaatgcgggtctgggatatttataacagataatgtccatacatggacagaacagtacaagtttcaaccagaaagtcctagcaaattggcatcagcgatccagaaagctcatgaggaaggaatatgcggcatacgatcagtaacaaggttggaaaacctgatgtggaaacagattacccccgagctgaatcacatactttccgaaaacgaagttaaattaacaataatgaccggcgatataaaagggataatgcaggcaggaaaaagaagtttaagaccccaacctactgaattgaaatactcatggaaagcatggggtaaggccaaaatgttgtcaacagaacttcacaatcatacgttcctaatagacggaccggaaactgcggagtgtcctaacactaatagagcctggaactcccttgaagttgaggactacggcttcggcgtatttacaacaaacatttggctcaaattgaaagagcgacaggatgtgttctgcgactccaaattgatgtcagcagctatcaaggacaatagggcagttcatgcagatatgggttattggattgaatccgcactaaatgacacttggaagatcgagaaagctagtttcattgaagtcaaaagctgccattggcctaaatcgcacactctttggagtaatggagtactcgaatccgagatgatcatacctaaaaacttcgcaggtccggttagtcagcataattatcgccctggatatcatacgcagacagctggaccatggcacttaggaagactagagatggattttgatttttgtgagggcaccactgtcgtagtgactgaagactgcggaaatcgtggtccatcactgcgcacaacaacggccagcggaaaactaattaccgaatggtgttgtaggtcatgcaccttgcctcctctaagatatcgtggagaagatggctgttggtacggaatggagattagacctctgaaggagaaagaagagaatctagttaacagccttgtaacagctggacacggacagatcgataacttttcgctgggtgtgctaggcatggcattattcctagaagaaatgctcagaacaagagtgggtactaaacacgccatattattagtagccgttagttttgtaacactgattacagggaatatgtcatttagagacctaggcagagtaatggttatggtaggtgcaactatgacagatgatataggtatgggcgtcacttatttagcacttttggcggcttttaaagtgagacccacattcgctgcaggactattacttagaaagctcacatctaaagagcttatgatgaccacaataggaatagtcctattgagtcaaagtactatacccgaaacaatcctagaattaacggatgcattagcccttggaatgatggtcttgaaaattgtcagaaatatggaaaagtaccagttggccgtgacgattatggccattctgtgtgttccaaacgcggtcattttacaaaacgcatggaaagtttcgtgcacaatattagcagtagtttcggtaagtccacttctattaacatcttctcagcaaaaagcagactggatacctcttgctcttacgataaaaggtttgaatccaaccgcaatcttcttaactactctatctcgcacaagtaagaaaagatcgtggccattgaatgaagcaataatggcggttggaatggtttcaattttagcatcatcactactgaaaaatgatatacccatgacaggcccattagttgctggtggtttactcacagtatgctatgttctcactggtaggtccgcagacctcgaactcgagcgggcagcggacgttagatgggaagaacaggctgaaatatccggatcctcccctatcctttcaataacaatatccgaagatgggtcgatgagcatcaaaaacgaagaagaagaacaaaccttaacgatattaatccgtactgggctcctagtaatctcgggactattcccggtctcgattccgataacagcggccgcctggtatctatgggaggtcaagaaacaacgcgcaggagtcctatgggatgttccgagtcccccgccagtcggcaaagcagaattagaagatggcgcctatcggataaaacaaaaaggaatccttggatactcccagataggtgcgggtgtatataaagaaggaacatttcatactatgtggcacgtcacgcggggagcagtattgatgcacaaaggcaaaagaatagaaccctcctgggcggatgtcaagaaagaccttataagttatggaggaggatggaagttggaaggagaatggaaagaaggtgaagaggtacaggtacttgcgcttgaaccaggtaaaaacccaagggctgtacaaacaaaacctggactatttaaaactaacactggaaccataggtgcagtgagcctagacttttccccaggaaccagtgggtcaccaatagtagataagaaaggcaaagtagtcgggctatatggtaacggagtcgtcaccagaagcggaacgtatgtttcagccattgctcagacggaaaagagtatagaagacaacccagaaatcgaggatgacatatttaggaaaaagagactcactatcatggatttacatcctggcgcagggaaaacaaaaaggtatctaccagcaattgttagagaagccattaaaaggggattaagaactttaatactagctccaacacgagtagttgcagctgaaatggaagaagccttgaggggactaccaattagataccaaactcctgcgatacgagcagagcacacaggaagggagatagtagatttgatgtgtcacgctaccttcacaatgagattattaagccctatccgtgttcccaattataatctgatcataatggacgaagcgcatttcacagatcctgcctcgatagcagcacgtgggtacatctctactcgcgtagaaatgggagaagcagcgggcattttcatgactgcaacaccgcctggaagcagagatccttttcctcaaagtaatgcacctattatggacgaggaaagggaaatccccgagaggtcatggaactcaggtcatgagtgggttactgatttcaagggaaagactgtctggttcgtgccttcaataaaggccggcaatgatatcgcagcgtgcctgcgtaaaaacggcaagaaagtaattcaactaagtagaaaaacattcgactcagaatatatcaaaactagaacaaatgactgggactttgtagtaaccactgatattagtgaaatgggagccaatttcaaagccgaacgcgtgatcgacccccggagatgtatgaagccagtaattttaacggacggcgaagaacgagtgattcttgcaggacctatgccagtaacacattctagtgcagctcagagaaggggtcgtgtcggacgtaaccctaagaacgaaaatgatcagtatatatatatgggtgaacctctagagaatgatgaagactgtgcccattggaaggaggcaaaaatgctgctcgataatataaacacacctgaaggaattatcccgagcatgtttgaacctgaaagagaaaaagtcgatgcaatcgatggggaatacagactgcgaggcgaagcccgaaagactttcgtggacttaatgagacgaggagacctaccggtgtggttagcatatcgagttgcagcggagggtataaactatgccgataggcgatggtgctttgatggagttaaaaacaaccaaatcttagaagaaaacgtagaagtcgaaatctggactaaagagggtgaaagaaagaaactgaaaccaaggtggcttgatgccagaatatactctgacccactagcattaaaagagttcaaggaatttgcggcaggtaggaaaagtttgacactaaacctaatcaccgaaatgggtcgtctgccgacatttatgactcaaaaggccaaaaacgcattagacaacctcgccgtattgcatacggcagaagctggaggcagagcatataatcatgccttaagcgagctgccagagaccctagaaacacttttacttctaacacttctcgcgacagttacaggtggaatattcctctttcttatgagtggaaagggaatagggaagatgaccttgggaatgtgttgcataattaccgcaagtatactactatggtacgcacagatccagccgcattggatagccgcaagcataatacttgagttcttcttaatagttcttctcatacccgagcccgaaaaacaaagaacacctcaagataaccaactaacttatgtagtaatagctattctgacagtagtcgcagcgacaatggcaaatgaaatgggatttctagaaaagactaagaaagactttggactaggttcaataaccacccaacaacctgaaagtaacattctagacatcgatttaaggccagcgtcagcttggactctgtacgctgttgcgacgacatttataacgcctatgctgagacatagtatagaaaacagtagcgtcaatgtatcgttaacagcaatagctaaccaagcgaccgtcctcatgggattaggcaaaggctggccgttaagcaagatggacattggagtaccattacttgccattggatgctattcacaagttaatcctataacattgactgccgcactccttctattagtagctcattatgccataatagggcccggcctacaagccaaagcaactagagaggcgcaaaaacgtgcggctgcgggcattatgaaaaatccgacagtcgacggaatgactgtgatagatctagacccaattccgtatgacccaaaatttgaaaaacaactaggacaggtgatgcttctggtactgtgtgttactcaggtacttatgatgcgaaccacgtgggcattgtgtgaggccttaacattagccacaggaccaatttctacgctatgggaaggaaatcctggtcgattttggaatacaaccattgccgtaagcatggcaaacatatttcgaggttcatacctggcaggagctggcctccttttctcgatcatgaaaaacacagcaaacactcgaagagggactggcaatacaggcgaaacactaggtgaaaaatggaaaaatagattaaacgcactaggaaaatcagagttccaaatatacaagaaatcgggtattcaagaagttgacaggactttagcaaaagagggaatcaagaggggcgaaacagaccaccatgctgttagccggggaagtgcaaaattgagatggttcgtagaaagaaatttagtaacccctgaaggaaaagtagtggatcttggctgtggtagaggcggatggtcatactactgtggagggttgaaaaatgtcaaggaagtgaagggcttgactaaaggaggccccggccatgaggaaccaataccaatgtccacatacgggtggaatctagttcggttacaaagcggggtagacgtattcttcactccaccagagaagtgtgacaccctcttatgtgatattggagaatcatcaccgaaccctaccgtagaagctggtagaactctaagagttctaaatttagtcgaaaattggctaaacaacaacacacaattttgtattaaagtcttaaacccctacatgccatcagttattgagaaaatggaggctctacaaagaaaatacggtggagcattagtgagaaaccctttgtctcgtaattcaacacatgaaatgtactgggtgtcaaacgcttcgggaaacattgtctcaagcgttaacatgattagtagaatgctaataaaccgttttaccatgaaacataagaaagccacatatgaaccagatgtagatctaggttctggaacaagaaatattggaatcgaatcggaaacaccaaatcttgacataataggaaaaagaattgagaaaataaaacaagaacacgaaacaagttggcattacgatcaggatcatccatacaaaacatgggcgtaccacggttcttacgaaactaagcaaaccggttcagcatcaagcatggtgaatggagttgtcagattgttgaccaaaccatgggacgtgataccaatggtaacgcaaatggccatgacagataccaccccctttggccaacaacgagtattcaaagagaaggtagacactaggactcaagaaccgaaagaaggaaccaaaaagctaatgaaaataactgccgaatggctatggaaagaactaggtaagaagaaaacaccaagaatgtgtactagagaagaatttactaggaaagtcaggagtaacgcagctcttggagctattttcacagacgaaaataaatggaaaagcgccagagaagcagttgaagacagtggattttgggagctagtagataaggagcgcaatcttcatttagaaggcaaatgtgaaacgtgcgtctataatatgatgggaaaaagagagaagaaactaggagaatttgggaaggccaaaggaagtagagccatatggtatatgtggctcggcgctcgcttcttagaatttgaagcattgggctttctcaacgaagatcactggttttcaagggaaaattcgctaagcggagtggaaggcgaagggctgcataagttagggtacatacttagagacgtcagcaagaaagaaggtggcgctatgtatgctgatgacacagctggctgggacacacgaataacccttgaggatctgaaaaatgaggaaatggtaaccaaccacatggagggagagcataggaaattggcagaggccatattcaggttaacttatcagaataaagtagtgcgcgttcaacgaccaactcccaggggtacagtaatggacatcatctccaggagggaccaacggggtagtggacaggtagtgacttacggactaaacaccttcacaaatatggaagcccagcttataaggcaaatggaaggagaaggtgtctttaaaagcatacagcatttaacagtgacggaagagatagcggtcaaaaattggttagaacgtgtaggcagagaaaggctaagtagaatggctataagtggtgacgattgcgtcgtcaaaccattagatgacaggttcgcatcagctctaacagcactgaacgacatgggtaaagtgagaaaagatatacaacaatgggaaccgagtcgtggttggaatgactggacacaagtgccattttgctcacatcactttcatgaactaataatgaaagatggaagagtactggtagttccttgccggaaccaggacgagctaattggaagggcacgaataagccaaggtgctgggtggtccctaagagagacagcgtgtcttggaaaatcatatgcgcaaatgtggtctcttatgtattttcatcgccgtgatttaaggctcgccgctaatgcaatttgcagcgcagtaccctcacattgggttccgatatcacgaacaacctggtcgattcatgcgactcacgaatggatgactacagaagacatgcttactgtatggaaccgagtttggatacaagagaatccttggatggaggataaaacaccagtcgaatcttgggaagaaatcccatatttaggaaaaagggaagaccagtggtgtggttcactgataggattaacaagtagagctacgtgggccaaaaacatccaaactgcaataaaccaagtacgtagtctaatcggaaacgaagaatacacggactatatgccaagcatgaaaagatttagaagagaagaagaggaagcaggagtattatggtaa

SEQ ID NO: 22235 - RNA, 9876 nt, synthetic construct
  misc_feature 1..9876: note = derived and/or modified CDS sequence (opt6) from DENV-2__KX380838__SS-prME
  source 1..9876: mol_type = other RNA
acggcaggaattatcataatgatgattcccaccgtaatggcatttcacctgacaactcgtaatggagaacctcacatgatagtctcacgacaagaaaaaggcaaaagtttactcttcaaaactgaaaacggagtgaacatgtgtaccctcatggcgatggatcttggggaactatgtgaagatactataacatataattgcccactattacgccaaaatgaaccagaagatatcgactgttggtgtaactctactagcacatgggttacatacggtacgtgtacagctacgggagaacacagaagagaaaaacgttccgtggctctcgtaccccatgtgggaatgggcctagaaacaagaactgaaacatggatgtcatctgaaggcgcgtggaaacatgcacagagaatcgaaacatgggtgttaagacatccaggttttacagtcatggctgccatactagcatatacgatcggcacaacatatttccaaagagtactaatctttatcttacttacagcagtggctccaagcatgacaatgagatgtataggaatttccaatagagatttcgtggaaggagtatccggtggatcatgggtagatattgtgttagaacatggttcttgtgtaaccacgatggccaaaaataaaccaacattggacttcgaactaattaaaactgaagccaaacaccccgctacgcttcgcaaatattgtatcgaagcgaaattgacaaatactaccacagcaagtcgatgtccgactcaaggagaaccatctttaaatgaagaacaggataaacgctttgtatgcaaacattcaatggttgataggggttgggggaatggatgcgggttatttggtaaaggcggaatagtcacatgcgctatgtttacgtgcaagaaaaatatggaagggaaaatcgtccaaccggaaaatttagagtatacaatagtaatcactccccactcaggagaagaaaacgccgtaggtaatgatacagggaagcatggtaaggaaataaaagttacgccacaatcaagtatcacagaagcggaattaacgggatacggaactgctactatggaatgcagcccaagaacaggattggattttaacgagatggtattactacaaatggaaaataaagcatggctagttcaccgacagtggttcttagatttacccttaccttggcttcctggtgctgatacacagggctcaaattggatacagaaagaaacattggtaactttcaaaaatcctcatgccaagaaacaagacgtcgttgtactaggaagtcaagaaggcgctatgcacacagccctcactggcgctacggaaatacaaatgtcgtcgggtaatcttctcttcacaggacatctgaagtgccggcttaggatggataagctacaacttaaaggaatgtcatattcaatgtgtacgggaaaatttaaagtagtcaaagaaattgcggaaactcaacatggcaccatagtaataagagtgcaatatgaaggcgatggatccccatgtaaaatcccattcgaaataatggaccttgaaaaacgacacgtactcggtagactaataacagtgaaccctatagtaacagaaaaggatagtccggtcaatattgaagctgaaccccctttcggtgatagctacattattattggggtggagccgggacaacttaagttaagttggtttaaaaagggatcttcgataggtcaaatgttcgaaaccactatgcgaggagcaaaacgtatggctatcctaggcgatacagcctgggatttcggcagcctgggaggggtttttacttcaattggtaaggctctccaccaagtatttggtgcaatctatggcgctgccttttccggagtgagctggaccatgaaaatactaataggtgtggtaatcacgtggatcggtatgaactcaagaagcaccagtctatcggtaagtctagtattagtgggaatcgtaacgttatacttaggcgtaatggtacaagctgattctggatgcgttgtatcctggaagaacaaggagttaaaatgtggctcaggtattttcattacagataatgtacatacttggactgaacagtacaagttccaacctgaatctccatcaaaactcgcaagtgccatccaaaaggcccacgaagaaggaatttgtggcatacgatcagttacgcgactagaaaatctcatgtggaaacaaataactcctgaattgaatcatatcctgtccgaaaatgaagttaaactcaccattatgacgggggatattaaaggtatcatgcaagctggcaaaaggtcgctgagaccacaacctacagaactgaaatattcatggaaagcatggggtaaagctaaaatgctttcaactgaattacataaccatacctttttaattgacggaccggaaaccgctgaatgtccgaacaccaacagagcgtggaactctctggaggttgaagactacggattcggtgtatttactactaatatttggttaaagctaaaagagcgccaagacgtattttgtgattctaagttaatgagtgcagccataaaagataatcgagcagtacatgcagatatgggctattggatagaatccgccctaaatgatacctggaaaatagaaaaagcgagttttattgaagtgaaatcatgtcattggcctaaatcccacactctatggagtaatggagtactcgaaagcgaaatgataataccaaagaattttgcaggtccagtgtcacagcacaattacagacccggttaccatacacaaactgctggaccttggcacttgggcagactagaaatggacttcgacttctgtgaaggaacaactgtagttgttactgaagactgtggaaatagagggccaagtctccgtacgacaactgcatcaggtaagttaataacggaatggtgctgcaggtcatgtactttgccaccgttaaggtatagaggtgaagatggatgctggtatggtatggaaatacgaccactgaaggaaaaagaagaaaatcttgtcaattcattggtaacagcaggacatggtcaaattgataattttagtttgggggtgctaggaatggcactgttcctcgaagaaatgttaagaacccgtgtaggaactaagcatgctattttattagtagctgtaagtttcgtaaccttgataactggaaacatgtcctttcgtgacttaggccgagtcatggtaatggtgggcgcaaccatgacagatgacatcggaatgggtgtgacgtacctggcgttattggcagcttttaaagttcgaccaacatttgccgccggtttgctattacgtaagttaaccagtaaagagctcatgatgacaacaataggtattgtacttcttagccagtctacaatacctgaaactatattagaattaactgatgcactagctctaggaatgatggttctcaagatcgtacgtaatatggaaaaatatcaattagcagtgactattatggcgaccctctgtgtacccaatgcagttattctacaaaatgcgtggaaagttagttgtacaatattggccgtagtctctgtctcaccgctattgctaacatcgtctcagcaaaaagcagactggattccgctagcattaaccataaaggggctaaatccaactgcaatatttctgactacgctaagcagaactagcaagaaaagatcttggccactgaacgaagcaattatggctgtaggtatggtgtctattctggcgtcaagtcttctgaaaaacgatattccgatgacaggaccactcgtcgcaggagggctgctgacagtttgttacgtcctcacagggcgatccgctgatttagagctggagcgtgccgctgatgtaagatgggaggagcaggccgagatttccggtagctcacccattctaagtattacgatatctgaagatggcagcatgagcatcaaaaatgaagaagaagaacagacacttactattctaataaggacaggattgctagtcatttcaggacttttcccggtaagtatccctataacagcagcagcctggtatttatgggaagtgaagaaacaacgtgcaggggtcctatgggatgtaccttcgccacctccagttggaaaggcagaattggaagatggagcttaccgtatcaaacaaaaaggtatactcggatacagtcaaataggggcgggtgtctataaagaagggacatttcataccatgtggcacgtaacaagaggagctgtcctaatgcataagggtaaaagaattgaaccatcttgggctgatgtaaagaaagatctaatttcatatggtggaggctggaaattagaaggagagtggaaagaaggtgaggaggtacaggtgctcgcactagaacctgggaaaaacccaagggcggtccaaacgaaaccaggtcttttcaagacaaatacaggtacaattggagcggtgagtctagattttagtcccggcacaagtgggtcgccaatagtagataagaaaggaaaggtagttgggctttatggtaatggtgtagtaacaaggtccggaacatacgtgagtgcgatagcgcaaactgaaaaatcgattgaggataaccccgaaatagaagatgatatatttcggaaaaagagattaacaataatggacctccaccctggggcaggaaaaactaaacgttacttacctgctatcgtaagggaggcaattaagcgaggcttaaggactctcattctagctccgacccgtgtggtagcagcagaaatggaggaagccttacgggggctaccaatacgataccaaacacccgcaatcagggccgaacatacaggacgagaaattgtagatctaatgtgccatgctacttttacgatgaggctactcagcccgattagggtgcctaactataatttgataataatggacgaagcacacttcacggatccagcatcaatagctgcgcgaggttatatctcgacaagagttgaaatgggcgaagcagcaggtatatttatgaccgcaactccccctggttcaagagatccttttccgcaaagtaatgcacctattatggatgaagaaagggaaataccagaaagatcatggaatagcggacatgaatgggttacagactttaaaggcaaaacggtatggttcgtcccgtccataaaggcaggtaacgatattgctgcttgcctaaggaagaatggcaagaaagtaatccagttatcacgaaaaacatttgatagtgaatatataaagacacgaacaaacgattgggactttgttgtgacaacagacatatcggaaatgggagcaaactttaaagctgaaagagttatcgaccctcgtaggtgtatgaaacctgtcatattaactgacggtgaggaacgagtgattcttgcaggacctatgcccgtaacccacagctcagctgcacaaaggcgtggccgagtaggaagaaatcctaagaacgagaacgatcaatatatttatatgggcgagccattagaaaatgacgaagactgtgcccactggaaagaggcaaaaatgcttttagataatataaatactcctgaaggcatcattccaagcatgttcgaaccagaaagggagaaagtcgatgcaatcgatggagaatacagactacgaggcgaagcacggaagacttttgtcgatctaatgcgtaggggcgatctaccagtatggctggcatacagagtagccgctgagggaataaattatgccgatagaagatggtgctttgatggcgttaaaaataaccagattttagaggaaaacgtagaagtcgaaatatggacaaaagagggcgaaaggaagaaactcaaaccgaggtggttggacgctagaatctattcagatccactagcgttaaaagagttcaaagagtttgcagccgggagaaaatctttaacgctcaatttaattactgagatgggtagactccccacatttatgacacagaaagcccgaaatgcgctcgacaatttggctgttctacacactgctgaagccggcggaagggcttataatcatgccctatcagaattacctgagacattagaaacactacttctattgacattgcttgctaccgtaacgggaggcatatttttatttttgatgagcggaaaaggaatcggcaagatgactcttgggatgtgttgcataataacagcgagtatactattatggtatgcacaaattcaaccacactggattgcggcttctattattctggagttctttttaatagtcttgctcatccccgaaccagaaaaacaaagaacgccacaagacaaccaattaacttacgtagttatcgcaatattaacagtagtagctgcaaccatggctaacgaaatgggattcctagagaaaaccaaaaaggattttggtttaggaagtatcactacacaacaaccagactcaaatattttagatattgatcttcgacccgcttcagcatggacgttgtatgctgttgctactacatttataactcctatgctcaggcattctattgaaaattcctctgtaaatgtatcactaactgcaatagccaatcaggccactgtattaatgggattaggtaaaggatggccgcttagcaaaatggatatcggcgtaccactgttagcgattggctgttatagtcaagttaatcctatcacattgactgcggcattactgttactggtagcacactacgccataattggccctggtctgcaagcaaaggcgacgagggaagcccagaaaagagccgcagcaggcataatgaaaatacccgctgctgacggaattacggtaatagatttagaccccatcccatatgatccaaaattcgaaaagcaactaggacaggtaatgctattagtcttgtgtgttacgcaagtgctcatgatgcgaacaacttgggcgctatgtgaagcattaaccctggcgacgggtccaatatccacgctatgggaaggaaatcctgggagattttggaacacaaccatagcagtaagtatggcaaacatatttagaggcagctacttggctggcgccggtctgctattctcaattatgaagaacaccgctaatactcgaagagggacaggtaataccggcgaaactttaggagaaaaatggaaaaatcggctaaatgcccttgggaagtcagagttccaaatatacaagaaaagtggcatccaagaggttgatagaaccctcgcaaaagagggaataaaaagaggagaaacagatcaccacgcagtaagtagaggaagcgcaaaattaagatggtttgttgaacgcaacctggtaacccctgaaggaaaagtcgtagacttaggatgcggacgaggaggctggtcatattactgcggcggtttaaagaatgtaaaagaggtcaagggacttactaaagggggtccaggacatgaagaacccattccaatgtcaacttacggctggaacctagttcggctacaaagcggtgtggacgtctttttcactccgccagaaaaatgcgatacccttctttgcgatataggtgaatcttcaccgaatccgaccgtcgaagcaggaaggacgttacgggtgttgaacttagttgaaaattggctaaataacaatacacaattctgcataaaagttctgaacccttacatgccttcagtaatagaaaagatggaggccttgcaaaggaaatacggaggggccttggttagaaatccactttcgaggaatagtacacatgagatgtactgggttagcaatgctagtgggaatatagtatcaagtgtcaatatgatcagccgaatgttaataaataggtttacaatgaaacataagaaagctacttatgaacctgacgtagatctaggtagtgggacaagaaatatcggtatagaaagtgaaactccaaaccttgatataataggaaagagaattgagaaaataaagcaggaacacgaaacgagttggcattatgatcaagatcacccatataaaacttgggcataccatggctcctatgaaacaaagcagaccggtagcgcctcctctatggttaacggagtcgttagacttctcacaaagccatgggatgtaattcctatggtgacccaaatggcgatgacagatacgactccgtttggccaacagcgggtgttcaaggaaaaggttgacacacgaacccaagaaccaaaggaggggacaaagaaacttatgaagataacagctgagtggttgtggaaagaattgggtaaaaagaaaaccccaagaatgtgtactcgtgaagaatttactcgaaaagtaagatctaatgcggcgctcggcgctattttcacagatgaaaacaaatggaaatccgctcgtgaagccgttgaagattcaggtttttgggaactggttgataaagaacggaacctacacttagaaggaaaatgtgagacttgtgtttataatatgatgggaaaaagagagaagaaactgggcgaatttggaaaggctaaaggttcacgggcaatttggtatatgtggctaggtgcgagatttttggaatttgaagcactaggatttttgaatgaagatcattggttcagtcgcgaaaactcgctatctggagtagaaggtgaaggattacataaactaggatacatattgagggacgtaagcaagaaagagggaggtgctatgtatgctgacgacacagctggatgggacactagaataactttagaggacttaaagaatgaagaaatggtaacaaatcatatggaaggagagcataggaagctggccgaagccatctttagactaacatatcaaaacaaggttgtaagagtccaaagacccacaccaagaggcacagtgatggacataatatcaagaagggatcaaagaggaagcggtcaagttgtcacttacggtctaaacacgttcacgaatatggaagcgcaattaattaggcagatggagggagaaggcgtgttcaaaagtatccaacaccttactgtaacggaagagatagctgttaaaaactggctcgaaagagtaggaagagagaggttatccagaatggctattagcggggatgattgtgtagtcaagccactcgatgatcgatttgcgagcgcgttaactgcactcaacgacatgggtaaagttagaaaagacatacagcaatgggaaccgtcgcgcggatggaacgactggacacaagtcccattctgcagccaccactttcacgaattgatcatgaaagatggtagagtacttgttgttccatgtcgtaatcaggatgaattaataggacgtgcacgcattagtcaaggggctggatggagtctcagagaaacagcttgtcttggcaaaagctatgctcaaatgtggtctttaatgtacttccaccgacgggatctaaggcttgctgcaaatgcaatatgctcagcggttccttctcattgggttccgatatctcgaacgacatggagcattcacgcaacacacgaatggatgacaaccgaagacatgctaacagtatggaatcgtgtatggatacaagaaaacccctggatggaagataagactccagtagagagctgggaagaaataccgtatttaggaaaaagagaggatcagtggtgtggttctcttatcggcctgacatctcgagctacgtgggctaaaaacattcaaacagcaataaatcaagtcagaagtttaataggcaatgaagaatacaccgattacatgccgtcaatgaaacgtttccggagagaagaagaagaggctggagtactatggtga

SEQ ID NO: 22236 - RNA, 9876 nt, synthetic construct
  misc_feature 1..9876: note = derived and/or modified CDS sequence (opt6) from DENV-2__KM279515__SS-prME
  source 1..9876: mol_type = other RNA
acagcagggataataataatgatgatacccacagtgatggcttttcacttgaccacccgtaacggggaaccccatatgatagtatcaagacaagaaaaaggaaaatcactgttgtttaaaacagaaaacggagtaaatatgtgcacgttaatggcaatggatctgggggaactatgcgaagacaccataacatacaactgtccgctacttagacaaaacgaaccagaagacatagactgttggtgtaattcaacttctacatgggtaacttacggcacttgtactgctactggggaacatagaagggagaaaaggagtgtagcactcgtgccgcatgtaggaatgggactggaaactcgaacagaaacctggatgtcttccgaaggtgcgtggaaacatgcacagcgaatagaaacatggattttacgacatccaggatttacgataatggcggcgatactggcatacacaattgggacaacatatttccaaagagtactaatattcatcttactcaccgcggtcacgccatccatggcaatgcgttgtatagggatctcaaacagagactttgtagaaggcgtatccggaggatcttgggtggacattgtcttagaacatggttcgtgcgtaacaactatggctaaaaataaacctacattagatttcgaattaataaaaaccgaagctaagcacctagcaactctaagaaaatattgtgtagaagctaaattaacaaatactacgaccgcatccagatgcccaacacaaggtgaaccttccctgaatgaagaacaggataaaagattcgtgtgtaaacattcgatggtagatcgcggatggggcaatgggtgcggcttattcgggaagggcggaatagttacatgcgctatgttcacttgtaagaaaaatatggagggcaaagttgtacaacctgaaaatctggagtatacgatagtaattacaccacatagtggtgaagagaatgcagtgggaaacgacacagggaaacatggaaaagaaataaaagttactccccagagttcaataacagaggccgaactcacaggttacggtacagtaacaatggaatgcagccctaggaccggactagactttaacgaaatggttttgttacaaatggaaaataaggcttggttggtgcatagacaatggtttttagacttaccactgccttggttaccaggcgctgacacgcaaggatctaactggatacaaaaagaaacgcttgtaacctttaaaaacccacacgcaaagaaacaagatgtggtagtacttggttcacaagagggtgcgatgcacaccgctctgactggcgcgaccgagatacaaatgtcaagtggcaaccttctcttcactggacatttaaaatgtcgcctacgcatggataaacttcaactcaaaggcatgtcgtactctatgtgcacgggaaaatttaaagtagtaaaagaaatcgcggaaacacaacatggtaccattgtcattcgtgtacaatatgaaggagacggaagcccttgtaaaatcccattcgaaataatggacttggagaagagacatgcattaggaaggctaataacggtcaatccaatagtaactgaaaaggacagtcccgtgaacattgaggctgagccccctttcggagactcatatattataataggcgttgagccgggacaactcaagctctcttggtttaaaaagggaagtagtatcggacagatgtttgaaacaacgatgaggggtgcaaaaaggatggctatcctaggtgatacggcttgggattttggatccctaggtggagttttcaccagtatagggaaagcattacatcaagtctttggggcgatatatggagcagctttttctggagtatcctggacgatgaagattctaatcggagtcgttataacatggataggaatgaactcccgatcaacgtccctaagtgtaagcctagttcttgtaggggtcgtaacattatatctaggggtcatggtgcaagcagattctggatgtgtagtatcctggaaaaataaagagctaaaatgcggaagcggtatctttattacagataacgttcacacctggacggaacaatataaattccaaccggaatcaccgagcaaacttgcttcggctatacaaaaagcacatgaggaaggaatatgcgggatcaggtcagtaacaaggttagagaacctgatgtggaaacaaataactccagaattgaaccatatattgactgaaaacgaagtaaaactcacaatcatgaccggagacataaaaggaataatgcaagcaggaaaacgtagtttgagacctcaaccaacagaactaaaatatagctggaaagcatggggaaaagcaaagatgctgtcgactgaacttcataaccatacatttttgatcgatgggccggaaacagcggaatgcccaaatacgaatagagcctggaatagtttagaagtagaagattatggttttggagtttttacaactaatatatggctaaaactaaaagaacgccaggacgtgttctgtgattcaaaactcatgagcgcggcaatcaaagacaaccgagccgttcatgctgatatgggatactggatagaaagtgcccttaacgacacatggaaaattgagaaagcatcatttatagaggtcaaatcatgtcattggccgaagtcgcatactctttggtccaatggggttttggaaagcgagatgattatccctaaaaattttgcaggacctgtgagtcaacacaattacagacccggttaccatacacaaacagctggtccatggcatttaggacgattagaaatggattttgacttttgcgaaggaactactgtagtagtaactgaagattgcggtaataggggtccatcattgagaacgacaactgcaagtggaaaactaataaccgaatggtgttgccgtagttgcacgttaccacccttgagatatagaggtgaggatggatgctggtacggtatggaaataaggccactgaaagaaaaagaagaaaacttagtaaatagcttagttactgcaggtcatggacagattgataacttctctctaggagtcctcggaatggccctattcctggaagaaatgttgaggactcgggtaggaacaaaacacgcaatcctattagtagctgtatcatttgtaacactaatcacaggaaatatgagttttagagatctcggaagagtcatggtaatggttggtgccacaatgaccgatgatatcggcatgggagtgacataccttgccctgcttgcagcttttaaagtgcgcccaacctttgccgcagggctcttacttagaaaattgacaagcaaagagctaatgatgacaaccatcggcatagtgctgctctcgcaaagtaccattccagaatcgatcttagagcttacggacgctctcgcccttggaatgatggtccttaaaattgttagaaatatggaaaagtaccaattagcagtgacgataatggcaatcctatgtgtcccaaatgctgtgatattacagaatgcctggaaagtttcgtgcactacattagcagtggttagcgtcagcccattgttactaacatcttcccagcaaaaagcagactggataccactagcattaaccataaaggggctgaatcccacagctatattcctaaccacactgagcagaacatctaagaaaaggtcgtggccccttaacgaggcaattatggcggtaggcatggtcagcatactagcgagtagtttactgaaaaacgatataccgatgaccggtccattagtggcaggaggcctcttgacggtctgttatgttttgacaggaaggagtgcagatttagaactagaacgtgcggctgatgttcgatgggaagaacaagccgagatatctggtagttcacccatcctaagtataacgatctcagaagacggaagtatgtcaatcaaaaatgaagaggaagaacagacactaacaatactcattcggacaggactattagtgataagtggtttatttccagtgtctataccaataaccgcagcggcctggtacctttgggaggtaaagaaacaaagggcgggtgtattgtgggatgttccaagtccaccacctgttggaaaagcagaattggaagatggtgcataccgaattaaacaaaaagggattttaggatacagccaaataggcgcgggagtctacaaggagggtacgtttcacacaatgtggcatgttactcgcggggctgtactaatgcacaaaggcaagagaatagagccttcatgggctgacgttaagaaagatttaatttcatacggtggaggttggaagttagaaggagaatggaaggaaggggaggaagtgcaagtacttgcattagagcccggtaagaatccaagagcagtgcaaacaaagccagggttgttcaaaacaaatacagggacaatcggagcggttagcttagacttctcacctgggacatcaggaagtcctatagttgacaagaaaggaaaggtcgtaggtctatatggtaatggagttgtaacaagaagcggtacttatgtgagtgcaattgcgcagaccgaaaagagcatcgaagacaatcctgagatagaagacgatatatttagaaagaaacgacttacaattatggatcttcatccgggcgccggtaaaacaaaaagataccttccagcaattgtcagggaagccattaaaaggggccttagaacccttatcttagcaccaaccagagtggtagccgccgagatggaagaagctctaaggggattgccgataagatatcaaactcctgcgatcagggcagaacacaccggaagagaaatagtagacttaatgtgtcatgcaacattcacaatgcgcttgctctctcctattcgagtacctaattacaatttaattataatggacgaggcacattttaccgatccggcaagtatagcagcgaggggatacataagtacgagagtagaaatgggagaagccgcaggcatctttatgactgcaacgcccccaggatctcgggaccctttcccgcaaagtaatgcgcctataatggatgaagaacgcgaaataccggaaagaagttggaactccggacatgaatgggtcacagattttaaagggaaaacagtatggtttgtacccagcattaaggctggaaacgatatagcagcatgccttcgtaaaaacggtaaaaaggtcatacaattgtcaagaaaaacgttcgacagtgaatatataaagacacgtacaaacgattgggattttgttgttaccaccgacataagtgaaatgggagcaaatttcaaagctgagagagttattgacccgagaaggtgtatgaaacctgtaattttaacagacggagaggaaagagttattctagccggaccaatgccagtcacacatagtagcgctgcgcagagaagaggtagagtcgggcgaaacccgaaaaacgaaaacgatcaatacatatatatgggtgaaccattagaaaatgatgaggattgtgcacactggaaagaagccaaaatgctactagataacataaatacgcctgaaggcattattccatcaatgtttgagccagaacgagaaaaggttgatgccatagatggcgaatacagattaagaggggaagctcgtaaaacttttgtcgatcttatgcggaggggagatcttccagtgtggttagcgtacagggtagcagcggaaggtataaactacgcggacagaagatggtgttttgatggtgtgaaaaataatcagattctggaagaaaatgtagaagtggaaatatggacaaaagaaggagagagaaagaaattaaaaccaaggtggctggacgcacgtatatacagtgaccctctcgctttaaaagagttcaaagaatttgctgcaggtcgtaaaagcctaactttgaacctaataacagaaatgggcagactgcccacttttatgacacaaaaagccaaaaacgcattagacaatttagcagttttgcacacagctgaagctggtggtagggcatataaccatgctttatctgaattaccggaaactctagaaacactattgcttttaacgttactggcaacggtaaccggtggtatattcctatttttaatgagcggcaaagggattgggaaaatgaccctaggaatgtgttgtatcataaccgcaagtattctgctctggtacgctcaaattcaaccccactggatagcggctagcattatattagagttctttcttattgtccttttaataccagaaccagaaaaacaacgaaccccacaggataatcaactaacatatgtagttatagcgatcctcacagtagttgccgcaactatggccaatgagatgggcttcttagagaaaaccaaaaaggactttggactagggtctattacaacacaacagccggaaagtaatatattagatattgatctaagaccggcctcagcgtggacactatatgcagtagccacaactttcataacacccatgttacgacatagtatcgaaaacagttcagttaacgtatccttgacggccattgcaaaccaggctacggtactcatggggctcggcaaaggctggcccctctccaaaatggatatcggagtgccgctactagctattggttgctattcacaagttaatccaataacattaacagctgctctgttgctcttagtcgctcactatgcaatcataggacctggccttcaggccaaagcaacaagagaggcgcaaaaacgtgcagccgcaggaatcatgaagaatccgacagtggacggaatgaccgtaatcgatctggatcccataccttatgacccaaaatttgagaaacaacttggacaagttatgctattagtattatgtgtaactcaagtcttaatgatgaggactacctgggcattatgtgaagcccttacgttagcgactgggccaatatcgactttgtgggaaggaaacccaggcaggttctggaacacaacaatagcggtgtcgatggcaaatatattccgcggatcatacctagctggagccggactcttatttagcataatgaaaaacactgcgaatactcgcaggggtactggaaacacaggtgaaacattaggtgaaaaatggaaaaataggctgaatgcactaggaaaaagcgagttccaaatatacaagaaatctggcattcaggaagttgacagaactttagctaaggaaggaatcaaaagaggcgagactgatcaccacgcagtctcacgaggcagtgcaaaacttcgctggtttgtcgaaagaaatcttgtaacaccggaaggcaaagttgtagatcttgggtgtgggcgaggtggatggagttactactgtggtggtctaaagaacgtcaaagaagtgaaaggattaacaaaaggagggccagggcacgaagaaccaattcccatgtcaacctatgggtggaacttagttaggttacaaagtggagtagatgtattctttacaccgccagaaaaatgcgacactctactctgtgatattggcgaatcgagtccaaatccgacggtagaagccgggagaactttgcgtgtcctaaaccttgtagaaaattggctcaataataatacacaattctgtatcaaagtgctcaatccctatatgccttcagtaatcgagaaaatggaagcactgcaacgaaaatacggcggcgctctagtaagaaatcctctttctagaaattcaactcatgagatgtattgggtgagtaacgcaagcggtaatatagtctcgtccgtgaacatgatatctaggatgttaatcaacagatttacaatgagacataagaaagcaacctacgaacctgatgtagatcttggatctgggacccgaaacatcggcatagaatccgagacgccgaacctggacataatcggaaaacgtatagagaaaataaaacaagaacacgaaacgtcttggcattacgatcaagatcatccatataaaacatgggcctaccacggttcctatgaaacaaaacagacggggtcagcttcttctatggttaacggtgtggttagactgttaacaaagccgtgggatgtaataccgatggtaactcaaatggcaatgactgatacaactccatttggtcagcaaagggtatttaaggagaaggtggatacaagaacgcaggagccaaaagaaggaactaagaaattaatgaagattacggcggagtggctctggaaggagctaggcaagaagaaaacaccaagaatgtgtactcgtgaagaatttacccgaaaagtaagaagtaatgccgccctgggagccatatttacagacgaaaataaatggaaatctgctagagaagctgtcgaagatagtggattctgggaactcgtagataaagaaagaaatttacatctagaaggcaaatgcgaaacatgtgtatacaatatgatgggaaaaagagaaaagaaattgggcgagttcggtaaagccaagggttcgagagcgatttggtatatgtggttaggtgcccgcttcttggagtttgaggcattgggtttcttaaacgaggaccactggtttagcagggaaaactctttaagtggagtcgaaggggaagggcttcacaaactaggatatatattaagggatgtatcaaagaaggaaggaggcgcaatgtatgctgatgacactgccggatgggatacaaggataacactggaagatttgaaaaatgaagaaatggttacaaatcatatggaaggagaacacaagaaactcgccgaagcaatattcaaactaacatatcaaaataaggttgtaagggtccaaagacctaccccgaggggaacagttatggatattatatctcgacgtgatcagagaggttctggtcaagttgtcacatacggattaaacactttcaccaacatggaggctcaacttataaggcaaatggagggtgaaggagtgtttaaatcaatacaacaacttaccgttaaagaagaaatagccgttaaaaattggctaattcgtgtgggtcgggagagattatcaaggatggctatatcaggagacgattgtgtggtaaagccactagatgacagattcgcatccgcactgactgcactcaatgatatgggaaaggttcgaaaggatattcagcaatgggaaccatcccgtggatggaacgactggacgcaagtgccattttgctctcatcatttccacgaactaatcatgaaagatgggagggtcttagtagttccttgtcggaatcaggatgaactcataggacgtgcaagaatctcacaaggagctggatggtcactcagggaaacggcctgtttgggaaaatcgtacgctcaaatgtggtcgcttatgtattttcatcgtagagacctcaggttagccgcgaatgctatatgtagtgcagtaccaagtcattggatccccactagccgaacaacctggtctatacacgcaacgcacgaatggatgacaacagaagacatgctaaccgtctggaatcgcgtatggatacaggaaaatccgtggatggaagataagaccccagtagaaacatgggaagaaataccttatctagggaagcgcgaagaccagtggtgtggttcccttataggacttacaagtagggccacatgggccaaaaacattcagacagctattaatcaagtcaggagcttaattggcaacgaagaatatactgactatatgccatcaatgaaaagatttagacgggaggaggaggaagcaggggtattatggtga

SEQ ID NO: 22237 - RNA, 9876 nt, synthetic construct
  misc_feature 1..9876: note = derived and/or modified CDS sequence (opt6) from DENV-2__KM279516__SS-prME
  source 1..9876: mol_type = other RNA
acagcaggaataattataatgatgatcccaactgttatggcattccatctaacaacacgaaatggggaaccacacatgatagtttcacgtcaagaaaaaggtaaatcacttcttttcaaaacggaaaatggagtaaatatgtgtactctaatggctatggatctgggagaactatgtgaagacacaattacatataactgtccactccttaggcaaaatgaacctgaagatattgactgttggtgcaactcaacgtcgacctgggtaacgtatggaacatgtactgctaccggtgaacaccgtagagagaaacgatcagtagctttagtaccgcacgtaggtatggggctagaaacaagaacagaaacctggatgtcatccgaaggagcatggaaacacgcgcaaagaatagaaacatggatattacgacatcctggatttacgataatggctgcaatcttggcatataccattggcacaacctattttcagagagtgttaatattcatactcctaacagcggtaactccaagcatggcaatgcgatgcattggaataagcaatagggatttcgttgaaggagttagtggaggttcttgggttgatatagtgctcgaacacggatcgtgtgttacgactatggccaaaaataaaccaacacttgattttgaattaatcaaaactgaagcgaaacatctggcaacactacgtaaatactgtgtggaagctaaacttacaaatactacgacggcttcacgatgtcctactcaaggagaaccaagtttaaatgaagaacaagacaaaagattcgtgtgtaaacattctatggtagataggggttggggaaacgggtgcggactatttggaaaaggtgggatagtaacttgcgcaatgtttacatgtaagaaaaatatggagggaaaagtcgttcaaccagaaaatttagagtatacaatagtgataacacctcactctggggaagaaaatgcagtcggtaacgatacgggaaaacatggaaaagagattaaagtaacaccacaatctagtatcacagaagccgagcttactggttacggcacggtaacgatggagtgctcaccgagaacggggttagactttaatgaaatggtattattgcaaatggaaaacaaagcgtggttagtccataggcaatggtttttagatcttccactaccgtggctccccggcgcggatacccaaggttcaaactggatacaaaaagagacactcgtaacatttaaaaacccacatgccaagaaacaggacgttgtcgtcttgggaagtcaagaaggggctatgcataccgcgctaacaggagcaactgaaattcagatgtcgtcaggcaaccttctattcaccgggcacttgaaatgtcgattaagaatggacaaattgcaattgaaaggtatgagttattcaatgtgcacaggtaaatttaaagttgtcaaagaaattgcagagacacagcacggcactatagttatccgggtccaatacgagggggacggatctccttgtaaaatcccattcgaaatcatggatctcgagaaacggcacgtgttaggaagacttataacagttaaccccattgtcactgaaaaagattcgccagtaaacattgaagctgaaccccctttcggggattcatacataatcataggtgttgaaccagggcagctgaaattatcatggtttaagaaaggttctagcatcggccagatgttcgaaacaacgatgcgcggtgcaaaaagaatggcaatattaggtgacactgcatgggactttggcagtttaggaggtgtcttcacaagcatcggtaaagcacttcaccaagtttttggagcaatatatggagcagctttttcgggtgtgtcatggacaatgaaaatactaattggcgtcgttattacgtggattggtatgaatagtaggagtacatctctctcagtaagtttagtgcttgttggagtggtaactctgtatctaggagttatggtccaagccgatagcggttgtgtagtctcctggaaaaataaagaattaaaatgcggatccggcatattcataacagacaatgtccatacttggacggagcaatacaaattccaacctgaatcacctagcaaattagcgtcagctatccagaaagctcacgaagaaggcatttgcggcatccgctccgtgaccaggttagagaatcttatgtggaaacaaataacccccgagcttaatcacattttgactgagaatgaggtaaaattgactattatgacaggtgacattaaaggtataatgcaagcaggcaaacgctccctacgaccacagcctacagagctaaaatactcatggaaagcctggggtaaagctaaaatgctaagtaccgagttgcataatcatacgtttctgatagacggaccagaaaccgccgaatgtccaaatactaatagggcatggaactcgctagaagtagaagattacggattcggagtctttaccacaaatatatggttgaaattgaaagaacggcaggatgttttctgtgattctaaattaatgtctgcagcaatcaaagacaaccgagctgtacatgctgatatgggatactggatcgaaagcgcgctaaatgacacatggaaaatagagaaggcatcttttatagaagttaaatcatgccattggccaaaatcacataccctctggtccaacggtgtgttagaaagtgaaatgatcattcccaaaaactttgcaggaccggtctctcaacataattatagaccaggataccatacacaaacggcgggaccctggcatctggggcgcctagaaatggattttgatttttgtgaaggaacaactgtagtagtcacggaagattgtggaaatagaggcccatcactaaggacaactacagccagtggtaaattaattactgaatggtgttgtaggagttgtacactaccgccacttagatatagaggagaggatggctgctggtatggcatggaaatccgtccattaaaagagaaggaagagaaccttgttaatagcttggtaaccgctggccacgggcagattgacaacttttccctaggtgtattaggtatggctttgtttcttgaagaaatgctacgcacaagagtcgggactaaacatgcaatccttctagtggcagtcagttttgttacgttaattactggaaatatgtcatttagagatttagggcgagttatggtcatggtgggagcaacaatgaccgacgacatagggatgggagtaacctacttggcgttacttgcagcttttaaagtacgccccacttttgcagctggattactcttaaggaaactgacatcaaaagaactgatgatgacaaccatcggcatcgtcctactatctcaatccacaatacctgaaaatattctagaacttactgatgcactggctctcggaatgatggtattaaaaatcgttagaaatatggaaaaatatcaactagcagttacaataatggcaattctatgcgtgcccaacgccgtaatactccaaaatgcatggaaggtctcgtgcactacattggctgtggtttcggtttcaccgctactattgacctcatcacaacaaaaggcggattggataccactagccttgaccatcaagggattaaatccgacagcaatatttttgacgactctaagtcgaaccagcaagaaaagatcatggccacttaacgaagcgattatggcggttggcatggtttccatattagcctctagcctattgaaaaatgatataccaatgactggtccgctagtagcaggaggacttttaaccgtttgttatgttctgacaggaagatcggcagatttagaattagaaagagcagccgacgttcgatgggaagaacaagccgagataagtggtagctccccaatcttgtcaattaccatttcagaggacggatcaatgagcataaagaacgaagaggaggagcaaacattaaccatcctaattcggacaggactcttagtaatcagtggtttatttccagtatcgatacctatcacggccgctgcgtggtatttatgggaggtcaagaaacaaagggcgggcgtattatgggacgttccctctccaccaccagtaggtaaggcagaacttgaggatggtgcctaccgaatcaaacaaaaaggaatattaggctattcacagataggtgctggggtgtataaagaagggacctttcatacaatgtggcatgtgactaggggcgcggtattaatgcacaaagggaagcgaattgaaccgagttgggctgatgtcaagaaagatctcatctcatacggagggggatggaagctagaaggtgaatggaaggaaggtgaggaagtccaggtattagctctagaacccgggaaaaacccacgggctgttcagacaaaaccgggcctcttcaaaacgaatactggaacaataggagctgtatcacttgatttctccccaggaacatcaggttctccaattgtggataagaaaggaaaagtagttggactctacggtaatggggtagttactcgatctgggacatacgtaagtgcaatagctcaaaccgagaaaagtatagaagataatcccgaaatcgaggacgatatatttaggaagaaacgattaacaatcatggacttacacccaggcgccggaaaaacgaaacgttatttaccagcaatagtgcgtgaagctataaaacgtggactcagaactttaatattagctcctactagagtagttgctgctgaaatggaagaggcattaaggggactaccgatcagatatcaaacccccgcaatacgtgctgaacacacgggtagagagatcgtggatctcatgtgtcatgcgacttttacaatgcggctattgtctcctatacgtgtaccaaactataaccttatcattatggacgaggctcattttacagatccagcttccatcgctgcaagaggttatatctctactagggttgaaatgggtgaggctgcgggtatattcatgacagctacaccaccaggctcgagggatccgtttccccaatcaaacgctcccatcatggacgaagaacgggaaataccagaacgatcatggaactcagggcatgagtgggtcacagacttcaaaggtaagacagtatggttcgttccatcaataaaagcaggcaatgacattgctgcttgtttaagaaagaacggaaagaaagtaatacaactttcaaggaaaacgtttgattctgagtatatcaaaacacgaactaatgactgggatttcgtcgtaaccacagacatatcagagatgggcgctaattttaaagcggaacgagtaatcgacccacgaagatgcatgaaacctgttatcttaactgacggtgaagagagagttattttagctggaccaatgccagtaacccactcaagcgcagcgcaaaggagggggagagtaggaagaaatcccaaaaatgaaaacgatcaatatatctatatgggtgaacccctagaaaatgatgaagactgcgcacattggaaagaggcaaaaatgctccttgataatataaacacccctgaaggtataatcccttcaatgttcgaacctgaaagagaaaaggtagacgcaatcgatggagaatatcggttaagaggagaggcaaggaaaacgttcgtagacctaatgagaagaggggatctcccagtttggctagcctacagagtcgctgctgaaggaatcaactatgctgataggcgatggtgtttcgatggagtcaaaaacaaccaaatattagaagagaatgtagaggttgaaatctggacaaaagaaggcgaaagaaagaaactcaagccgaggtggttagatgcaagaatatattctgacccgttagccttaaaggagtttaaagaatttgcagctggccgtaaatcactcacgctaaatttgatcacagaaatgggcagattaccaaccttcatgacccaaaaagctaaaaatgcgttagacaatcttgcagttctccacacagccgaagctggaggtcgggcatacaaccatgccttaagcgaattaccggaaacattagagacgctgctactactaactttattagcgaccgtgacaggaggaatatttttatttttaatgagcggcaaaggaattggaaaaatgacattaggaatgtgttgtataataacagcttcaatcttattatggtacgctcagatacagccacactggattgcagcgtctataatattagagtttttccttattgtcttattaatccctgagccagaaaaacaaagaacaccccaggacaatcaattaacatacgtagtaatcgcaatcttaactgttgtcgcagccactatggcaaatgagatgggctttctagagaaaacgaagaaagatttcggtctaggctctattacaacacaacagcccgagagcaatatactagacattgatctacgtcccgcatcggcatggacgttgtacgcagtagctacaacattcattactcctatgctccgtcattctattgaaaatagcagcgttaatgtgtctttaaccgcaatagccaatcaggcaaccgtgctgatgggcttaggcaaaggttggccactatcgaagatggatataggggtacccctgttggcaataggttgttactcacaagttaacccgataaccttaactgccgcccttctcttattagtagcacattatgccataataggacccggattacaggcgaaagcaactagggaagcacaaaagagagccgccgcggggattatgaaaaatccaacagtcgacgggatgacggtgatcgacctagatcctataccttatgacccgaaattcgagaaacaattaggccaagtcatgctattagtactttgcgtcacgcaagttcttatgatgcgcactacctgggcgttatgcgaagctctaacactagcaacagggccgatctcgacactctgggaaggaaatcctggaaggttttggaacactacaattgcagtttctatggcaaacatatttcgaggaagctatctagcgggagccggtcttctattcagcatcatgaagaacacagccaatactagacgtgggacgggtaatacaggtgaaaccttaggagaaaaatggaaaaatagactcaatgcattagggaaatccgagttccaaatatataagaaatcagggatacaagaagtagacagaaccttagctaaagaagggattaaacgtggagaaacggaccatcacgcagtcagcaggggttctgcaaaactccgttggtttgtagaaagaaatcttgttacccctgaaggaaaagtggtggacctgggttgtggaagaggaggctggagctattactgtggaggtctgaagaatgtaaaggaagtaaaaggactaactaaaggaggaccgggacacgaagaaccgatacctatgtcaacgtatggatggaatctagtaagactacaaagcggggtagatgtattctttacccctccggaaaaatgtgacacattattatgtgatataggcgagtcatcgccgaaccctacggtagaagcaggaagaacgctcagagtccttaatctggtagaaaactggttaaataataacacacaattctgtataaaagtcctaaatccgtatatgccatcggtaatcgagaaaatggaagcactacaacgaaaatacggaggagctctagtaagaaatccactttcacgaaacagtacgcacgaaatgtattgggtttccaatgcatcgggaaacatagtaagcagtgttaatatgatatcaaggatgttgattaatcgtttcacaatgcgccacaagaaagcaacctatgaaccggatgttgacttgggatcaggtactagaaatattggtattgaatcagaaacgccaaatttggatatcataggaaagaggattgaaaagataaagcaggaacatgagacttcatggcattacgaccaagaccatccatacaagacttgggcatatcacgggtcatatgaaacaaaacaaacaggaagcgcatcttcaatggtgaatggagtagttcgactattgaccaaaccatgggacgttatacccatggtaacacaaatggctatgaccgatactactccctttggacaacagcgggtgttcaaagagaaagtcgatacaaggacccaagaaccaaaagaagggaccaagaaacttatgaaaattacagccgagtggttatggaaggagcttggcaagaagaaaacgcccaggatgtgtacgcgtgaagagttcacgagaaaagttagatccaatgcagcattgggagctatattcacagatgaaaacaaatggaaatcggcgagggaagccgtagaggatagtggattctgggagctagtagacaaggaaaggaatcttcaccttgaaggtaagtgtgaaacctgcgtctataacatgatgggaaagagagagaagaaactgggagagtttggcaaggcaaaagggagtagagcaatttggtatatgtggttgggtgcaagatttttggaatttgaagcattaggtttcctaaatgaagatcactggttttcaagagagaatagcttgtctggtgtagagggagaagggttacacaaactaggatacatattacgtgacgtatccaagaaagaaggaggtgccatgtatgcagacgataccgctggatgggatactcgaataaccttagaggatcttaaaaatgaagagatggttacaaatcacatggagggtgagcacaagaaattagcagaggctatcttcaaattgacataccaaaataaggttgtcagagtacaaagaccaaccccacgaggaactgtaatggacatcatatctcgaagagatcaacgtggatcaggtcaagtagtaacctatggtctaaatacattcacaaatatggaagcacaattaattaggcagatggagggtgagggtgtatttaagtctatccaacaactaacagtaaaagaagaaatcgcagtgaaaaactggttaatcagagtagggagagaacggctgtcgcgtatggcaatatctggggatgactgcgtcgttaaacccttagatgacagatttgcgagcgcacttactgctctaaacgatatgggaaaagtgagaaaggacatacaacaatgggaaccgagtagaggatggaatgattggactcaagtacctttttgttcgcatcattttcacgaattaataatgaaagacggaagggtgctggtagtaccctgcagaaatcaagatgaattaataggaagggccagaatatctcagggggcaggttggtcgttgcgagaaactgcatgtcttggcaaatcttatgcacaaatgtggtctctcatgtactttcataggagggatttgagattagccgcaaacgcgatatgtagcgccgtcccaagccactggatacctacgtcccggactacgtggagcattcatgcaacccacgagtggatgaccactgaagatatgcttacggtttggaatcgtgtatggatacaagaaaacccctggatggaagacaaaacgcctgttgagtcatgggaagaaattccgtatctaggcaaaagggaagatcaatggtgtggttctttgataggactcaccagtcgagccacatgggccaaaaacatccagactgcgataaaccaagttcgttcactcataggaaatgaagaatatacagattatatgcctagcatgaagcgattccgacgtgaggaagaagaagcgggagtcctatggtga

SEQ ID NO: 22238 - RNA, 9876 nt, synthetic construct
  misc_feature 1..9876: note = derived and/or modified CDS sequence (opt6) from DENV-2__KM279517__SS-prME
  source 1..9876: mol_type = other RNA
acggcgggaatcattataatgatgatacctaccgttatggctttccatcttacgaccagaaatggtgaacctcacatgatcgttagtcgtcaagaaaaaggaaaaagtctcctgttcaaaactgaaaatggtgtgaatatgtgcactctaatggctatggacctaggtgaattgtgcgaagacacgataacttacaattgcccattattaagacaaaatgaacctgaagacatcgactgttggtgtaattcaacgtccacatgggtaacatacggaacatgtactgcaacaggtgaacatcgaagagagaaacgatcagttgcacttgtgcctcatgttggcatgggcttagaaacacgtacagaaacttggatgtcctctgaaggggcatggaaacatgcacaaagaatagaaacctggatattacgtcaccctgggtttaccataatggcggcgatattagcatacactataggcactacttattttcaaagagtattaatattcatactactaactgcagttacaccttcaatggccatgcgatgtataggtatctcaaatcgtgactttgtagaaggggtgtcgggagggtcatgggtcgatatagtgctagaacatggttcatgcgtgaccacgatggccaaaaataaaccaaccttggattttgaactgataaaaacagaagctaaacacctcgccactttaagaaaatattgtgtagaagcaaaactcacgaatactaccactgcaagtcgctgtcctacacaaggggaacccagtctgaatgaagaacaagacaaacgatttgtatgcaaacatagcatggttgatcgtggctggggcaatgggtgtggactatttgggaaagggggtatagttacatgtgccatgttcacatgtaagaaaaacatggaagggaaagtggttcaacccgaaaacttagaatacacaatagtcataaccccgcattcgggtgaagaaaatgcggtaggaaatgatacagggaaacacggaaaagaaataaaagtaacaccccaaagctcaataacagaagcagaattaactggatacggaaccgtaacaatggaatgttccccaaggacaggcctcgacttcaatgaaatggtattattacagatggaaaataaagcgtggttagtccacagacaatggtttctagacctcccacttccttggctaccgggagcagatactcaaggttctaactggatacaaaaagaaaccctagtgacatttaaaaacccacatgccaagaaacaggatgttgtcgtgttaggcagtcaagagggagcaatgcacacggcattgacaggtgcgacggagatacaaatgagttctggaaacttactgttcactggacatctcaaatgtagactaaggatggacaagttacaactcaaaggtatgagttactcgatgtgcacagggaaatttaaggtggtgaaggagattgcagagacacaacatggaacaattgttatacgagtacaatacgaaggcgatggatctccatgtaaaattcctttcgaaatcatggatctggaaaagcgacatgtattagggagattaattacagtgaatcctatcgttactgaaaaagatagccctgtaaacattgaggcggaaccaccattcggagattcctacattatcattggtgtagagcccggacaattgaagttgtcctggttcaaaaagggttcatcgatcggccaaatgtttgaaaccactatgaggggcgccaaaagaatggcaatactaggtgatacagcatgggattttggcagcttagggggcgttttcacaagtatcggtaaagcactacaccaagtattcggggccatctacggagccgctttttccggagtcagctggacaatgaaaatattgataggggttgtcattacatggataggaatgaatagtagatctacaagtttaagtgtatcattagtcttagttggtgtagtaacactgtatctgggagtaatggtacaggcagactcgggatgtgtagtatcttggaaaaataaagaattaaagtgcggttcaggcatcttcataacggataatgtccatacatggacagagcaatacaaatttcaaccagaaagcccaccaaagctcgcaagcgcaatccaaaaggcacacgaagagggaatttgcggaatcaggtctgtaactagactagaaaatctcatgtggaaacaaattacaccagagttgaatcacattctaacggaaaacgaagttaagctcacaattatgacaggcgatataaagggtatcatgcaagctggcaaacgatccttgagacctcagcccaccgaacttaaatattcatggaaggcttggggtaaggctaaaatgctatcaacagaacttcataaccacacattcctcattgatggacctgaaacagctgaatgtcctaacaccaatagagcctggaactctctagaagtagaggattacggttttggcgtatttacgacaaacatttggctgaagctgaaggaacgacaggacgtgttttgcgacagtaagctcatgtccgccgctatcaaagacaatcgggcagttcacgccgatatgggctactggatagagagcgctttaaacgacacgtggaaaatagagaaagccagctttatcgaagtaaagagctgccactggccaaagagtcacacgttgtggtcgaatggagttctggagagcgaaatgattatacccaagaactttgcaggacctgtatctcaacacaattataggccaggttatcatacacaaaccgctggaccttggcatttaggtagactagaaatggattttgatttttgcgaaggaaccacggttgtagtaaccgaagactgtggcaacagaggcccgtcgctaagaaccactacagcaagtggaaaactaatcacggaatggtgctgcagatcatgcactctccctccgcttagatatagaggcgaagatggttgttggtacggaatggaaatacggcccctaaaagagaaagaagaaaatttagtaaatagcctagtgacagcaggccacggacaaatagacaatttttcacttggtgtcctgggaatggcattgtttctggaggagatgctccgtaccagagtgggcacaaagcacgcaatacttttggtagctgttagctttgtgacactaataacaggaaacatgtcttttcgtgacttaggccgagttatggtaatggtaggagctaccatgacagatgatatagggatgggcgttacataccttgctctactagctgcattcaaagtgagacctacatttgcagctggtttacttctccgtaaactaacatcaaaggaattaatgatgaccacgatcggaatagtattgttgtcacagtcaaccatccctgaatctattctagaattaacggacgcgctagcgctgggtatgatggtcttaaaaattgtccggaatatggaaaagtaccaattagcagttacgataatggcaattttatgtgtacctaatgcggtcattttgcaaaatgcctggaaagtgagttgtacaacgctcgcagtagtgtcagtgagtccactcctgttgaccagctcacaacagaaagctgactggataccgctagcactaactataaaaggactgaatccgactgccatatttttgaccaccttaagtaggacatcgaagaaaagatcatggccactaaacgaagcaataatggccgttggaatggtaagtatactggcaagctcattattaaagaatgatattcccatgacagggcccctagtggctggaggactattaacagtttgctacgttttgacagggaggtcagcagacctggaacttgaaagggcagcagatgtacggtgggaggaacaagctgagatctcaggatcttcgccaatcctatccataacaatatcagaagacggaagtatgagcatcaaaaatgaggaggaagaacaaaccctaacaattttaattagaacaggattattagtcatctcaggattgtttccagtatcaatcccaattacagctgcagcatggtatctatgggaggtcaagaaacaaagggcaggagtattatgggatgtgccgtcaccacctcctgtcggcaaagcagaactcgaagatggcgcgtatagaattaagcaaaaaggtatcctcggatattcacagattggagccggggtatataaggaaggaactttccatacaatgtggcatgtaactagaggggctgtattgatgcataaaggaaaacgaatcgagccatcatgggccgatgttaagaaagatttaataagttacggaggtgggtggaaacttgaaggtgaatggaaagaaggagaagaagtacaagtacttgcactagaaccagggaaaaatccacgggccgttcaaacaaaaccaggattattcaagactaacacaggtacgataggtgctgtatcactagatttcagtcctggaacgtcgggaagtcctattgtcgataaaaagggaaaagttgtcggtctatacggaaacggtgtcgtcacaagaagtggtacatacgtatcagccatagctcagaccgagaaatcaatagaggataatccagaaattgaagacgatatctttagaaagaaaaggttgacgatcatggatctacatcctggagcaggtaagacaaaaagatatcttccagctatagtaagagaagccataaaaagagggttacggacactaatacttgcaccaacaagagtcgttgcagcagaaatggaagaagccttaagggggcttcccataagatatcaaacccccgcgatacgtgcggaacatacagggagagaaatcgtggatctaatgtgccatgctacttttacaatgcggctactctcaccaatccgcgtgccaaattataatctaattattatggatgaagcacactttactgatccagcaagtatcgctgcaagaggatatatatcaacaagagtagaaatgggtgaggctgccggaatatttatgacagccacaccgcctggtagtcgggaccccttccctcagtcaaacgcaccaataatggatgaggaaagggaaataccagagaggtcctggaactcaggtcacgagtgggtgacagacttcaaaggtaaaacggtatggttcgtacctagtataaaagctggaaatgatatagccgcatgtctacggaaaaatggcaagaaagtaattcaactatccaggaaaacatttgactctgaatatataaagacacgaacaaatgattgggactttgttgttacaactgatatttccgaaatgggagcaaattttaaagcagaaagagtaattgaccctaggagatgtatgaaaccggttatcctaacagatggggaagagagagtcatcctcgcaggcccaatgccagtaacccattccagcgcggctcagcgcagagggagagttgggcgcaatccaaagaacgagaacgaccaatatatatatatgggtgagccacttgaaaatgatgaagattgtgcgcattggaaagaagccaagatgcttttagacaatataaatacaccagaggggataataccgagtatgtttgaacccgaacgtgagaaagtggatgcaattgatggagaatatcgattacgaggagaagcaagaaagactttcgtcgatctaatgagacgcggggatctccctgtttggcttgcatacagagtggcagcagaggggataaattatgctgatcgacgatggtgtttcgatggagtcaaaaataatcaaatattagaagaaaacgttgaagtagaaatttggaccaaggaaggggaacgtaagaagctaaaacctcgatggttagacgcgcgaatttacagtgatcctttagcattgaaagagttcaaagaatttgcagctggtaggaagagtcttacacttaatttaattacagaaatggggcggctcccaacatttatgacacagaaagcaaagaacgcacttgacaatctagcagtcttacacactgcagaggcgggagggagagcatataatcacgcactttctgaattacctgaaacattagaaactttgctacttctgaccctcctagcaacggtaacgggaggaattttcctatttcttatgtcgggtaaaggtatcggcaaaatgacgctcggtatgtgctgtataatcacggcgtccattctactttggtacgcccaaatacaaccacattggatagccgcgtctattattctcgagttctttttaatagtgcttctaatccctgaacctgaaaaacaacgtacaccccaagataatcaactaacgtacgtagtaatcgcaattctaactgtagtagctgcaaccatggctaacgaaatgggatttttagaaaagacgaagaaagatttcggtctaggaagcataacaacacaacaacccgaaagtaacatcctcgatatcgacttacgaccggcttcagcatggactttatatgcagtcgcaacgacgtttattactccaatgttgcgtcattcaatagaaaattcgtctgtgaacgtctcactaacagcaatagcaaatcaagcaacggtcctcatgggacttggcaaaggatggccattgagcaagatggatatcggtgtgcctctattagcaataggttgttatagccaagttaatccaattacattaacggctgcactacttctattagtagctcattacgcgataattggaccagggctacaggcaaaagctacaagagaggcacagaaaagagctgcggcgggaattatgaaaaatccaacggtagatggcatgacggttattgacctcgatccaataccctatgatccaaaatttgaaaagcaattaggccaagtaatgttacttgtgctatgtgtcacccaggtactgatgatgcgaactacttgggctctctgcgaagcacttacactcgcaacgggacctatatcaacattatgggaagggaaccccggtagattttggaatacaactattgcagtctcaatggctaacatttttcgggggagttatctagctggtgcaggattactgtttagcataatgaagaacaccgcaaatacaagaagaggcacaggaaataccggagaaacattaggagaaaaatggaaaaatcgtttaaatgccctcggcaaatcggaatttcaaatctacaagaaatcagggatacaggaggttgacagaaccctagccaaagaagggataaagcgaggtgagactgaccatcatgcagtgtctcgtggatcagcaaaacttcgctggttcgtagaaaggaatttagtaacacctgaaggtaaagttgtagacctagggtgcggaaggggaggatggagctattactgtggaggactcaagaacgtaaaagaagttaagggcttaacaaaaggaggaccaggtcatgaagaaccaatacctatgagcacatacggctggaatttagtccgtcttcaatctggagtagatgtatttttcacacctccagaaaaatgcgacacactcctgtgcgatattggagaaagttcgcctaatccaacagtggaagctggtagaacattaagagtccttaatttagtagagaattggttaaacaataatacgcaattttgtataaaagttctaaacccttacatgccaagtgttatcgagaaaatggaaacattacaaagaaaatatggtggagcactcgtgaggaatcccttgtcacgtaattcaacacatgagatgtattgggtatcaaacgcgtcggggaatatcgtatccagtgtgaatatgatttctcgaatgctcattaataggtttaccatgagacataaaaaggcaacttacgaaccagatgtggatttagggagtggtacaagaaatataggaatagaatccgaaacgcccaatctagatatcattggcaaacgtatagagaaaataaagcaagaacatgagacatcatggcactatgaccaagatcacccatacaagacatgggcatatcatggaagctatgaaactaagcaaacagggtccgcatcatcaatggtcaatggcgtagtccgtcttcttactaaaccatgggatgtgatcccaatggtgacgcaaatggcaatgactgatacgactcccttcgggcaacagcgagtttttaaagaaaaagtagatacccgcactcaagaacccaaagaaggcactaagaagttaatgaagataacagcggaatggttatggaaagaactcggcaagaagaaaacaccccggatgtgtacaagggaagagttcacgcgtaaagtacgatctaatgccgcgttaggagctattttcacggacgaaaacaaatggaaatccgcaagagaagcggtagaagactcaggcttctgggagctagttgataaagaacgtaacctacacttggaaggcaagtgtgaaacgtgcgtatacaacatgatgggaaaacgcgagaagaaactaggagaatttggcaaagcgaaaggtagcagagcaatctggtatatgtggctaggggcaaggtttctagaatttgaagccttgggtttccttaacgaagatcactggttttcgagagaaaatagtctttcgggtgtagaaggtgagggattacataaattgggatatattctacgagatgttagcaagaaagaaggtggtgcaatgtatgcggacgatacggccgggtgggacacacggataacattggaagatcttaagaatgaagaaatggtcaccaaccacatggagggagagcataaaaagctagctgaagcaatatttaaattaacataccaaaataaagtggtcagagttcagaggccaactccccgtggtactgttatggacattatcagtagaagagatcaacgtggctcgggacaagtagttacgtacgggctcaatacattcactaacatggaagcacaactaatacgccaaatggaaggtgaaggcgtgttcaaaagcatacaacaactaactgttaaagaagaaatagcggtcaaaaactggttaattagggttggacgtgaacgattatcgagaatggctataagtggagatgattgtgtcgtaaaaccattagatgacagatttgcgtcagcgcttacagcactaaatgacatgggaaaagttagaaaggatatacaacaatgggaaccatccaggggatggaatgactggacgcaagtaccattctgtagtcatcacttccacgaattgatcatgaaagatggtcgcgtcctagtggtcccatgtcgtaaccaggacgaactaattggcagggctaggattagccaaggtgcaggctggagcttgcgtgagacggcgtgtttaggtaagagttatgcgcaaatgtggtcactaatgtacttccacaggagagacctaagattagctgcgaacgcaatttgttccgcagttccaagtcactggataccaacatcaaggacaacatggtcaatacatgctacacacgagtggatgacaacagaagatatgctgactgtatggaacagagtctggatccaagaaaacccttggatggaggacaagacaccggttgaaagctgggaagagataccgtacctcgggaaaagagaagatcaatggtgtggttcacttatcgggctaacttcaagggctacatgggctaaaaatatacaaaccgctataaatcaagtacgtagcttaatcggaaatgaggagtatacagattatatgccgtctatgaagagattccgccgtgaagaggaggaggccggtgtattatggtag

SEQ ID NO: 22239 - RNA, 9876 nt, synthetic construct
  misc_feature 1..9876: note = derived and/or modified CDS sequence (opt6) from DENV-2__KM279518__SS-prME
  source 1..9876: mol_type = other RNA
actgcaggtataatcataatgatgattccaacagtaatggcattccatctaactacaagaaatggggaacctcatatgattgttagtaggcaagaaaaaggtaaaagtttactctttaaaacagaaaacggggtgaatatgtgtacgctgatggctatggatttgggagaactatgcgaagacactataacgtacaattgtccactgctaagacaaaacgaaccggaagatattgattgttggtgtaattctacaagtacatgggtaacatacggtacatgcacagcaacgggtgaacaccggagagagaaaagaagtgtcgctttagttcctcatgttgggatgggtctggaaacaagaacagaaacttggatgtcatccgaaggagcatggaaacatgcgcaaagaatcgaaacttggatattacgccatcctgggtttactataatggcagcgattctggcatacacaatcgggacaacttatttccaaagagtattgatttttatccttttgacggcggtcactccaagtatggctatgcgatgtatagggattagcaacagagacttcgtcgaaggggtatccggaggttcatgggttgacatagtcttggaacatggaagctgcgtcaccacaatggccaaaaataaaccaactttggatttcgaactgataaaaacagaggccaaacatttagcgaccttaaggaaatattgtgtagaggcaaaattaacgaatactactactgctagccggtgtcccacacaaggagaaccttcattaaatgaagaacaagacaaaagattcgtttgcaaacattctatggttgataggggatggggaaacggatgcggcttgttcggtaaaggaggaatcgttacatgcgccatgtttacttgtaagaaaaacatggaaggaaaagttgtacaacccgaaaacctggaatataccatagttattaccccacactcaggagaagaaaatgcagttggaaatgataccggtaaacatggaaaagagattaaagtaacacctcaatccagcatcactgaagccgaattgacagggtacggcacagtcacgatggaatgttccccaaggacaggacttgatttcaatgagatggttctcctacaaatggaaaataaagcctggcttgttcatagacaatggttcttggatctaccactcccttggctgccgggagccgacacccaaggtagtaattggatccaaaaagagactcttgtaactttcaaaaacccacatgccaagaaacaagatgtggtagtcctcggatcacaagaaggcgccatgcatactgctcttacgggcgcaactgaaatacaaatgtcttctggaaacctattgtttactggacatttgaaatgtagacttagaatggataaactccaactaaaaggcatgtcttattctatgtgcactggaaaatttaaagtggttaaggaaatagctgagacgcaacacggaactattgttattagagtacaatatgagggagatggaagtccatgtaagatacccttcgaaatcatggacctagaaaaacggcacgtcttaggcagactaattacagttaaccctattgtaactgaaaaagattcaccagttaacatcgaagcagaacctccgttcggagactcatatataataataggagtagagccagggcagctgaaattgtcctggtttaaaaagggatcgtctataggtcaaatgtttgagacaactatgcgtggcgcgaagcggatggctatcctaggcgacactgcatgggattttgggtcactgggaggggtcttcacctcaataggaaaagctctacatcaagtatttggagcaatctacggggctgcatttagtggagtttcttggacgatgaaaatacttattggggttgtgatcacatggatcggaatgaactcgcgaagcacgagtctctcagttagtcttgtcttagttggtgttgtgactctgtatcttggagttatggtacaggccgattctggatgcgtcgtatcatggaaaaataaagaacttaaatgcggaagtggaatttttattacagataacgtacatacttggacagaacaatataaatttcaaccagaaagcccctctaaattagcgtcagccattcaaaaagcccatgaagaaggaatctgtggaatcaggagcgtcacgagactagaaaatctgatgtggaagcaaattacgccagaattaaaccacatacttacagagaacgaggtaaaattgaccatcatgacgggagacatcaagggtataatgcaagcaggtaagcgttctttaaggcctcagcctacagaacttaaatactcttggaaggcctggggtaaagcaaaaatgttaagcaccgagttacacaatcataccttcctgattgatggcccggagaccgcagaatgcccgaataccaatcgggcctggaatagcctagaagtggaagactacggattcggtgtgtttaccactaacatatggttaaaactgaaagagagacaagatgtattctgtgactcgaaattaatgtcggcggcaataaaagacaaccgtgctgtgcatgcagatatgggttactggatcgaaagcgcactgaatgatacatggaaaatagaaaaagcatcattcatagaagtaaaatcttgccattggcccaagtctcatacgttatggtcaaacggggttttagaatcggagatgattataccaaagaattttgctggtccggtttcgcaacacaactatcgtccgggataccacacacaaacagcaggaccttggcacctaggtaggttggagatggattttgacttttgcgaaggtactactgtagtcgttaccgaagactgcggcaacagaggcccgtcacttcggaccacaactgcttctggcaaactaataacagaatggtgttgcagaagttgtacacttcctccattaaggtaccggggtgaagacggatgctggtacggaatggaaataagaccacttaaagaaaaagaagaaaatttagttaactcgttagttacggcaggacacgggcagatagataatttttccctaggagtgctgggaatggccttgtttctggaggaaatgctacgaactcgtgtaggtaccaagcatgcaatactcctagttgcagtatcatttgtcaccctgattactggaaatatgagctttcgagatttgggtcgagttatggtaatggtaggagctacaatgaccgatgatataggaatgggggtcacatatctagcattactagccgcatttaaggtacgccctacctttgcagcgggacttctattacgaaagctcacctctaaggaattaatgatgaccaccataggaatcgtgctactcagtcaatcgacaattcccgaaagtattttagaactgacggatgctctggccctaggcatgatggttttaaagatagtccgtaacatggagaagtatcaacttgcagtgactataatggcaatcctttgtgtacctaatgcggttatattacagaatgcatggaaagtaagttgtacaacattagccgtagtatctgtgtctccattactgcttacatcaagtcagcagaaggcagattggataccactagctcttaccatcaagggcctaaatcctacagcaatcttcttaacaacattgtctagaaccagcaagaaaaggagttggcccctaaacgaggccataatggcagtgggaatggtgagtatattagcatctagtttactcaaaaacgatataccaatgacaggaccgttagtagcaggcggactcttaacagtatgctacgttttaaccggtcgatctgcagacctagaactggagcgagcagcagatgttagatgggaagaacaggcagaaataagtggatctagccccattctttctataacgatctcagaagatggaagcatgtcgataaagaatgaagaggaggaacaaacattaacaattttaatacgcacaggactattagtaataagtggattattccctgttagtatcccgataacggcagctgcttggtacttgtgggaagtaaagaaacaacgagctggggtactctgggacgtccccagtccaccgccagtagggaaagcagaactagaggatggtgcatatcgaataaaacagaaaggcatcctgggatatagtcagatcggtgcgggtgtatataaagaaggaacctttcataccatgtggcatgtgacacgaggggcagtactgatgcataaagggaaacgaatagagccatcttgggcagacgtcaaaaaggatctaatatcatacgggggaggatggaagctagaaggtgaatggaaagaaggagaagaagtacaagttctagctctagaaccaggcaaaaatcctcgagccgttcaaaccaaaccaggtctgtttaagacaaatacgggtacaataggcgcagtatctctcgattttagtccaggaacatcaggatctccaatagtcgacaaaaagggaaaagttgttggattatacggaaacggtgtagtgacacgatcaggtacctacgtcagtgcgattgcccagactgagaaaagtattgaagacaatccagagattgaagatgacattttccggaagaaaagactcacaataatggatttgcatccaggtgcgggaaagactaagagatatttaccggccattgtccgcgaagcaataaaaagagggttacgcaccttgattttggctcctacgcgagtagtagcagcagagatggaagaagcgttaaggggattacctattcgttatcaaacccctgcgattcgggcagaacacactggtagagagatagtcgacttgatgtgccatgcaacatttacgatgagactattatctccgatacgagtcccaaattacaacttgataattatggacgaagcacactttactgacccagcgtcgatagctgcaagaggttatataagcacacgagttgaaatgggagaagcagcaggaatattcatgactgcgacaccacccggtagcagagatccattcccgcaatcaaacgcacctataatggatgaagagagagagatccccgaacggtcatggaactccggacacgagtgggttacagattttaaaggtaaaactgtctggttcgtacccagtataaaggcaggcaatgacatagccgcctgcttaaggaaaaacggaaagaaggttatccagctttcaaggaaaacatttgatagtgagtatatcaagactagaaccaatgactgggatttcgtagtgacaactgatattagtgaaatgggtgccaatttcaaagcagaaagagtaatagacccgcgaagatgcatgaaaccagtcatactcactgacggggaagagagagtaatattagccggtccgatgccagttacccacagttcagcagcacagaggagaggtcgagtcggcagaaatcccaaaaacgaaaacgatcaatacatatacatgggagaaccattggaaaacgacgaagactgtgcgcattggaaagaagctaaaatgctacttgacaacataaacacaccagaaggcataatcccaagcatgtttgaaccagagagagaaaaagtagatgcgatagatggcgagtacaggctgagaggagaagcacgtaaaactttcgttgacctaatgcggcgaggcgacttacccgtttggctcgcctacagggtagccgcagaagggataaattatgcagatcgtcgctggtgcttcgatggtgtcaaaaataatcaaatacttgaagaaaatgtagaggtagaaatatggacaaaagaaggagaaagaaagaagctaaagccccgatggcttgacgcaagaatttatagcgaccccttggccctgaaggaatttaaagaatttgccgcagggagaaagagtctaacattaaacctaatcactgaaatggggcggcttccaacttttatgacacaaaaagccaaaaacgcacttgataatttagcagtgctacacacagcagaagcaggcggtagggcatataatcatgctctatccgaacttcctgagactctagaaacgctattacttctaacactactggcaacggttactggcgggatatttctatttttaatgtctggaaaagggataggaaaaatgactttaggcatgtgctgtattatcaccgcgtcaatactgctgtggtatgcacaaattcaacctcattggatcgcggcatcaatcatccttgaatttttcttgatagtactacttatcccagagccagagaaacaacggacaccccaggataaccaattaacctatgtggtgatagccatactgaccgtagtagcagccactatggctaatgaaatgggatttttagagaaaaccaaaaaggattttggactgggcagcataacaacacaacaaccagagagcaatatattggatattgatctcagaccagcgtcagcatggacactatacgctgtggccaccacatttataacaccaatgttgaggcatagtattgaaaacagttctgttaatgtgtcattaactgccatcgctaatcaagcgacagttctaatgggactaggtaaagggtggcccctttctaagatggatataggagtaccattattagcaatcggatgttatagccaggtaaatccaataacactcacagcggcattgctgttattggtcgcccattatgccataataggcccaggactacaggctaaagctacacgcgaagcacagaaaagggccgcagccggaataatgaagaacccaaccgttgatggaatgacggtaattgacttagatcctataccgtacgatcctaaattcgaaaagcaattaggtcaggttatgctattagttctatgcgtaacacaagtcttaatgatgcgaacaacgtgggcattatgtgaggcattaacacttgcgacgggcccaataagcacattgtgggaagggaacccaggtcgtttttggaatacaacaatagctgtatcaatggcaaacatattccgcggctcatatctagcaggcgcaggactactattctcaataatgaagaataccgcgaatacgagacgtggtaccggaaacacgggcgaaaccctcggcgaaaaatggaaaaataggttaaacgcattgggaaagagtgagttccagatatataagaaaagcgggatacaagaagtagacaggactttggctaaagaaggcataaagcgaggagaaacagaccatcatgcagtaagtcgaggtagtgcaaaattaagatggtttgtggaaagaaacttggtcacgcctgaagggaaagttgtagatcttggatgtgggagagggggttggtcttattattgcggcggtctcaaaaatgttaaagaagttaaaggactaacaaagggaggaccaggacatgaagaacctattccgatgagtacctacggctggaatcttgtacgtttacaatcaggagtagatgtatttttcaccccaccagaaaaatgtgatacgcttttgtgtgatattggagaatcttcccctaatcccaccgtggaagccggaagaacactgagagtattgaatctagttgaaaattggttaaataataatacacaattttgcataaaagtattaaatccttacatgcctagtgtaattgagaaaatggaggctttacagcgaaaatatggaggagctttagtacgaaatccgctctctcgtaatagcacgcatgagatgtattgggtaagcaatgctagtggtaatatagtttcatccgtaaatatgatttcaagaatgttaataaaccgattcacaatgaggcataagaaagcaacatatgaaccagacgtggacttgggttccgggacccgcaatataggtatagaatcagaaactcccaatcttgatataataggaaaaagaattgaaaagattaagcaggaacacgaaactagctggcattatgatcaagaccacccatacaaaacatgggcttatcatggcagttatgaaacgaaacagacaggaagtgcatctagcatggtaaacggtgttgtaagactactgacaaaaccatgggatgtaatacccatggttactcaaatggccatgacagatacaaccccattcggccagcaacgggtgtttaaggaaaaggtagacacgagaacccaagaaccaaaagaaggaaccaagaaactcatgaaaattacggctgaatggttgtggaaagaattgggcaagaagaaaacaccccgcatgtgcactagagaagaatttacacgaaaagttagatcgaacgcggccctaggcgcaatctttacggatgaaaataaatggaagtcagcaagagaagcagtggaagattcagggttttgggaattagtagataaggaacgtaacctccaccttgaaggtaaatgtgagacctgcgtatacaacatgatgggcaaaagagagaagaaactgggggaatttggcaaagcgaaaggctccagagcaatctggtatatgtggttaggagcgagatttctagagtttgaagcgttaggatttttaaatgaggaccactggtttagcagagaaaattctctatcgggagtcgaaggagagggtttgcataaacttggatacatactgcgagacgttagcaagaaagaaggaggagcaatgtacgcggatgatactgctggatgggacaccagaatcacgctagaggacttaaagaatgaagaaatggttacaaaccacatggaaggtgaacacaagaaactagctgaagcaatattcaaactaacatatcagaataaagtcgtacgcgtacaaagacagaccccacgaggtacggtcatggacatcatatccagaagagatcaacgtggatctggccaggttgtaacatacggactaaatacatttacgaatatggaagctcaactcatacgacagatggaaggagaaggagtttttaaatcaatacagcaattaacagtaaaagaagaaatagcagtcaaaaactggctcattagagtaggaagagaaaggttatctcgaatggcgattagcggtgatgactgtgttgtaaaaccacttgatgacagattcgcctcggctttaacagcattaaatgatatgggaaaagtcagaaaagacattcagcaatgggaacccagtcggggatggaatgactggacacaagtaccgttctgctcacatcattttcatgagttaatcatgaaagacggaagagtactggtggttccctgtagaaatcaagatgaactaatcgggagagcccgaatcagccaaggagctggctggagtctcagggagactgcctgcctcgggaagtcatatgcgcaaatgtggagcttaatgtacttccatagaagagatctccgactggccgcaaatgctatctgttcagcagtgcctagccattggatcccaacctccagaaccacctggtccatacatgccacgcatgaatggatgacaacggaggatatgctaactgtatggaaccgtgtctggatacaagaaaacccttggatggaagacaaaacacccgttgaatcatgggaagagatcccctatctaggaaaaagagaagatcaatggtgcggttccctcataggcctaacaagtagagcgacttgggctaaaaacatacaaacagctattaaccaggtcaggagtctaatcggaaatgaagagtataccgattatatgccgagcatgaagagattcagacgagaagaagaagaggccggagtcttatggtga

SEQ ID NO: 22240 - RNA, 9876 nt, synthetic construct
  misc_feature 1..9876: note = derived and/or modified CDS sequence (opt6) from DENV-2__KM279519__SS-prME
  source 1..9876: mol_type = other RNA
actgcgggaatcataattatgatgataccaaccgtgatggcttttcaccttacgactagaaatggagaaccacacatgattgtatcccgtcaggaaaaaggaaaatctctactgttcaaaacagaaaacggcgtaaacatgtgcactcttatggctatggacctaggtgaattatgcgaagataccatcacatataactgtccactactgagacaaaatgaaccagaagatattgattgttggtgcaactctactagcacttgggttacctatggaacctgtacagcaaccggagaacaccgaagagagaaacgatccgtggcgcttgtacctcacgtagggatgggactagaaaccagaactgaaacatggatgtcatctgaaggggcatggaaacacgcacagagaatagaaacatggatactgagacatcctggctttacaattatggccgcaatattggcatataccataggcacgacttatttccaaagagtattaatatttattctgttaactgcagtaacaccatcaatggcaatgagatgtataggaataagtaacagggactttgtagaaggagtctccggtgggagttgggtggatatagtgctcgaacatggctcctgtgtgacaacaatggccaaaaataaaccaacgttagacttcgaattgataaaaactgaagctaaacatctggcaacactgagaaaatactgcgtcgaagcgaaattaactaataccacaaccgcgtcacgatgtccaacgcaaggtgaaccgtctcttaatgaagaacaagataaacgttttgtctgcaaacattcgatggtggatcgaggttggggaaatggatgcggattgttcggcaaaggtgggattgtaacctgtgcaatgttcacttgcaagaaaaacatggaaggtaaagtcgtccagcctgaaaatctcgaatatacgatagtaataaccccacactccggtgaagaaaacgcagtgggaaacgatacaggcaaacatggaaaagaaataaaagtaacgccgcagagcagcattaccgaagccgaactaacagggtacggtaccgttacgatggaatgttcacctcgcacgggcttagactttaacgaaatggtactgcttcaaatggaaaacaaagcatggctagtgcacaggcagtggttccttgacctgcctctaccatggctaccgggagctgatacccaaggatctaactggattcaaaaagagacattagttaccttcaagaacccacacgctaagaagcaagatgtagtcgtattgggttcacaggaaggtgctatgcacacggcactaacgggcgctacggaaatccaaatgagcagcggaaacctattatttacaggtcatcttaaatgcagacttaggatggataagctccagctaaaaggcatgtcttactccatgtgcacaggaaaattcaaagtagtaaaagaaatagcggaaacacaacatggaacaatagttatacgagtacaatatgaaggcgatggaagtccctgtaaaataccattcgaaattatggatttagagaaaagacatgttctaggtaggttaataactgtaaaccccatcgttactgaaaaagattcccctgtcaacatagaggctgagccaccattcggcgattcctatataataataggcgtagaacccggacaactcaaactgtcttggttcaagaaaggttcttcgataggacagatgttcgaaacgaccatgaggggtgccaaaagaatggctatattaggtgacacagcatgggattttggctcgttgggtggtgtatttacatcaatcggaaaggctttacatcaagtatttggtgcaatctatggagcggcattctctggagtgagttggactatgaaaatacttattggggtggtaatcacatggattgggatgaacagcagatcaaccagcctgtcagttagtttggttttggttggcgttgtaacattatacctgggtgtcatggtacaggcagattcaggttgtgtagtcagttggaaaaataaagaattaaagtgtggaagcggaatattcataactgataacgtacacacatggaccgaacaatataagtttcagccagaaagtcccagcaaacttgcaagtgcgatacagaaagcacacgaggaaggcatatgcggcatcagatcagtaacaagactggagaacctaatgtggaaacagataactcccgaattaaatcacatcctaacggaaaatgaggtgaaattaaccatcatgactggtgatattaaaggaataatgcaagcgggaaagagatcactacggccacaaccaactgaattgaaatacagttggaaggcgtggggcaaagccaaaatgttatctaccgaattacataaccacacatttttaatagacggtcctgaaactgctgaatgcccaaacacaaatcgagcgtggaactctttagaggtagaggactatgggttcggagtatttacaactaatatttggctaaaacttaaggaacgacaggacgtattttgtgattctaaattaatgtctgcggcaataaaagacaacagagccgttcatgcagatatgggatattggatagaatcggcattaaacgacacatggaagattgaaaaagccagtttcatagaagtaaagagctgccactggcctaagtcccacaccttatggtctaacggtgtactcgaatcagaaatgataattcccaaaaattttgcaggaccagtatcccaacataactatcgacctggatatcatacgcaaaccgccgggccgtggcacttgggaaggttagaaatggatttcgatttctgtgagggaacgactgtggtagtcactgaggattgcggaaaccgcgggccgtctcttcgtaccactactgcttccgggaaattaataacagaatggtgctgtagatcctgtaccctacctccattacgatatagaggagaggacggatgctggtacggcatggagataaggccattaaaagagaaagaggaaaatctagtaaattcgttggtcaccgctggacatggccagattgacaacttttcacttggggtcttaggaatggctctttttcttgaagaaatgttaagaacccgcgtagggacgaaacatgcaatattattagtagcagtttctttcgttacattaattacaggtaacatgtcttttagggatctcggccgtgtgatggtcatggttggggctacaatgacagatgacatcggtatgggagtaacatacttagctttactagccgccttcaaagtacgcccaacctttgcagcaggattactcctaagaaaactgacaagtaaggaattgatgatgacgacgattggaatagtcctcttaagtcagagcacaattcccgaatctatattggaactaacagacgctttagcactaggaatgatggtactaaagatagttcgaaacatggaaaaatatcaacttgcagtcaccattatggccattctctgtgtcccaaatgcagtgatattacaaaatgcttggaaggtatcatgtacgactttagcagttgtatcagtctctccgctactattaacatcaagtcaacaaaaagctgattggataccactagcattaacgataaaagggcttaatccaacggcaattttcctaacaactctgtcacgtacatcgaagaagagatcatggcctctcaacgaagcaattatggcagtaggaatggtatccatcttagcgtcgtcacttctaaagaatgatatccctatgacaggtcccttggtagcgggaggattactaacagtctgttacgtcttaaccggcaggtcagcagatttagaattagaaagggctgcagatgtgcgctgggaggagcaggccgaaatctcaggcagttctcctattttgtctataacaatttctgaagatggaagcatgtctatcaaaaatgaagaagaagaacagacacttaccatactcatacgtactggcttactggtcattagcggactattcccggtatcgataccaataacagccgcagcttggtatctatgggaggtgaagaagcaaagagcaggggtattgtgggatgtaccatccccaccgccagtaggcaaagcagaattggaagacggagcatataggataaaacaaaagggaatattaggatatagccaaatcggcgctggtgtttataaggaaggtactttccatacaatgtggcatgttacacgtggtgctgtattgatgcacaaaggtaaaagaatagaaccatcatgggccgatgtcaagaaagaccttataagttacggagggggttggaaacttgaaggtgaatggaaagaaggagaggaagtacaagtattggctttagagccgggcaaaaatcctagagcagttcaaacaaaaccaggactatttaaaacgaacacaggaacgataggcgcagtttcactagatttttcgccaggtacatcgggcagtccaatcgtagataagaaaggaaaggtggtcggcctgtacggcaacggagtagtaacacgatccggtacgtacgtttcagccattgcccaaactgagaaaagtatcgaagacaatcctgaaatagaagatgatatcttcaggaagaaaagactaactattatggatttacatcctggagcgggtaaaacaaagagatatctcccagctatagtcagagaagcaataaaaagaggactaaggacgttaatacttgcgccgacacgggtggtcgctgctgaaatggaagaagctctaagaggtttgccgataagatatcaaacaccagccatccgtgctgaacatactggaagggagatcgtggacctgatgtgccatgcaacttttacaatgcgattgctcagcccaatacgggttccgaattacaatctaataattatggatgaagcacattttaccgatcctgcatcaatagcggcacgtgggtacattagcacacgagtggaaatgggtgaggctgcgggaatatttatgacagcaacgccaccaggaagtagagatccttttcctcaatctaatgcccctatcatggacgaggagaaagaaatcccagaaaggtcctggaactcgggacatgagtgggtcacagattttaaaggaaaaacagtatggttcgtaccatccattaaagcgggtaacgatattgctgcatgtttaaggaaaaatggcaagaaagtcatacaattgagcagaaaaactttcgattcagaatacattaagactagaacgaacgattgggactttgtggtcacgacggatatcagcgaaatgggggcaaattttaaagcagaaagagtaattgatccaagaagatgcatgaaacccgtgatattaaccgatggagaggaaagggttatactcgctggtccaatgccagtaacacattccagcgctgcacagaggagaggcagagtaggacgaaatcccaaaaatgagaacgatcaatacatatacatgggcgagcccttggaaaacgacgaggattgcgcgcactggaaagaagcgaaaatgttattggacaatattaacacaccggagggaataataccgtccatgtttgagccagaaagggagaaagtagatgcaattgatggagaataccgattacgtggggaagctagaaaaacattcgtagacctgatgcgtaggggcgatttgcctgtgtggctagcgtatagggtggcagctgaaggcatcaattatgcagacagacgctggtgttttgatggagtcaaaaataaccaaattctagaagaaaacgttgaagttgagatttggacaaaagaaggtgaaaggaagaaactgaagccaagatggctagacgccagaatttattcagacccactagcccttaaagaatttaaagaatttgcggctggcaggaaatcattaacattaaaccttatcaccgaaatgggcagactacctacctttatgacacagaaagcaaagaatgcattagataacctggcagttttacataccgcagaggctggtgggcgcgcgtataaccatgcattatcggagttaccagaaacccttgaaacattattgctactcacacttctagctaccgtgacaggcggaatctttttatttcttatgagcggcaaaggaattggtaagatgacattaggaatgtgttgcataataacagcatcaattttattatggtatgcacaaatccaaccacactggatagcagctagtataatattagagttctttttaattgtattgttaatccccgaacctgaaaaacaaaggacaccgcaagataatcaactaacttatgttgtaatagctatcctaacagtcgttgcggcaaccatggcaaatgaaatgggattcttagaaaagacaaagaaagatttcggcctcggaagcataacaacacaacaaccggagtcaaatatactagatatagatttaagaccagcctctgcatggactctatatgccgttgcaacaaccttcatcacccctatgttaaggcatagtatcgaaaactcaagtgtaaacgtgagtctaacagccatagctaatcaggctaccgtactcatgggtttaggaaagggatggccactttcaaaaatggacattggagtacccctcttagctataggctgttatagtcaagtcaatccaataacattaactgcggctttattacttttggttgcccactacgcaatcattgggccaggcctacaagcaaaggcaactcgagaggcccaaaaacgggcagcagcaggaataatgaaaaaccctactgtagatggtatgaccgtaattgatctcgatccaattccatatgatccaaagttcgaaaaacaactcggccaagtgatgcttctcgttctttgcgtcacacaagtacttatgatgagaacaacatgggcgttatgtgaagcgttaacactagcaactgggcctatatcaacgctatgggagggcaatccaggccgattttggaatactacaattgctgtatctatggccaatattttccggggcagttatttggccggtgcgggattactattttcaataatgaagaacaccgcaaacacacgtaggggtactggaaacacgggagaaacattgggagaaaaatggaagaatagattgaatgccctaggaaaaagcgagttccagatctataagaaatcaggtatacaggaagtagaccgtacgcttgccaaagaaggcataaagagaggagagactgaccatcacgccgtaagcagaggaagcgccaaattacgttggtttgttgaaagaaatcttgtaacgccagaggggaaggtagttgacctaggttgcggacgtggtggttggtcgtattactgtggaggtcttaaaaatgttaaagaggttaaaggcttaacaaaaggcggaccaggccatgaggagcccatcccaatgtccacgtatggctggaatttagtgcggttacaatccggagtagatgtatttttcacaccaccggaaaaatgcgacactttattatgtgatatcggtgagtcaagcccaaatccaacggtggaagctggccgaacattgcgagtcctaaacctcgttgaaaattggctcaataataatacacaattctgtataaaagtcttaaatccctatatgccctcagtaatagagaaaatggaggccctacaacgcaaatatggtggggcattggtccgaaatccattgagtagaaattccacccacgagatgtactgggtaagtaatgcaagtggtaacattgtaagttccgtcaatatgatttcaagaatgctaattaaccggtttacgatgagacacaagaaagctacttatgaaccagatgttgatctggggagtggaacgagaaatatcggtatcgaatcggaaacaccgaatttagacattataggaaaaaggatagagaaaatcaagcaagaacatgaaactagctggcactatgatcaagatcacccttacaagacatgggcctaccacggttcatatgaaacaaaacaaacaggctccgcgtcgagcatggtgaatggggttgtaaggttattaactaagccatgggacgtaattcctatggtaacgcaaatggcgatgaccgataccactccattcggtcaacagcgagtcttcaaggaaaaggtggatacaagaacacaagaacccaaggaaggaacaaagaaattaatgaaaataacggcggagtggctatggaaagaattaggaaagaaaaagacacccaggatgtgcacaagggaagaatttaccaggaaagttcgttcaaacgctgctcttggtgccatattcactgacgaaaataaatggaaaagcgctcgcgaagcggttgaagacagcggattttgggaattagtcgacaaagagaggaacttacatctagaagggaaatgcgagacatgcgtttataacatgatgggaaagagagagaagaaacttggagagttcggaaaagctaagggatctagggcgatatggtatatgtggctgggggcacgatttttagaatttgaagccttaggatttttaaacgaagatcattggttctcaagagaaaactccttatcaggagttgagggagaggggttgcataaactaggatatatattacgcgatgtgagcaagaaagaaggaggcgcgatgtacgcggacgacacggccggctgggacacgagaattacgttggaagatttgaaaaatgaggaaatggttaccaatcacatggaaggagaacataagaaactcgcagaggcaattttcaaactaacgtatcagaataaagttgttcgtgtccaaagacctacgccaagaggaactgtcatggatataattagccgccgagaccaaagaggaagtggacaagtggtaacatatggtctcaatacttttacaaatatggaggcgcagctaatcagacaaatggagggtgaaggggtatttaaatctatacaacaactgactgttaaagaggagattgccgtcaaaaattggttaataagggtaggtagagagagactatcaaggatggcaatatccggggacgactgcgttgtgaagcctttagatgaccgctttgccagtgcgctcactgcccttaatgatatgggaaaagtccgcaaggacatacaacaatgggagccaagtagagggtggaacgactggacacaagtaccattctgttcacaccactttcacgaactaataatgaaagatggacgggtccttgcagtaccgtgtagaaatcaagatgaattaatcggtcgggcacgcatatcacaaggtgcaggatggagcctaagagaaacagcatgtctcggtaagtcatatgcacaaatgtggagcttgatgtactttcataggagagatctaagattagctgccaatgccatatgtagtgcagtgccaagtcactggatacctacaagtagaacaacttggtcaatacatgcaactcatgaatggatgactacagaagacatgcttacggtatggaatagggtctggatccaagaaaatccatggatggaagacaagacaccagtagaaagttgggaagaaatcccatatttaggtaagcgagaggatcagtggtgtggaagtctcataggtttaacaagtagagcaacatgggcgaaaaatatacagacagcgataaatcaggttcggagcctcatagggaacgaagaatataccgactatatgccgtcaatgaaaagatttcgcagagaagaagaagaggcgggagtgttatggtaa

SEQ ID NO: 22241 - RNA, 9876 nt, synthetic construct
  misc_feature 1..9876: note = derived and/or modified CDS sequence (opt6) from DENV-2__KM279520__SS-prME
  source 1..9876: mol_type = other RNA
actgcagggattataataatgatgattccaacagttatggcatttcacttgactactagaaatggagaaccacatatgattgtttcaaggcaagaaaaaggtaaatcattactatttaaaacagaaaacggagtaaatatgtgtacgctaatggcaatggacctaggcgaactttgcgaagacaccatcacttataattgtccacttttacgacaaaacgaaccagaagatatcgactgctggtgcaattcaacgtctacttgggtaacctacggtacatgcactgctacaggagaacacagaagagagaaacgctctgtagcgttagtaccacacgttggaatgggactggaaacacgcacagagacatggatgtcttcagaaggagcatggaaacacgctcaacgcattgaaacttggatattaagacatcctggatttacaatcatggcagctattctcgcatacacgataggtactacatattttcaaagagttttaatctttatactactaactgcagttactccctccatggcaatgagatgcatcggcatctcaaacagagatttcgtagaaggagtaagcggcggcagctgggtagatatagtcctagaacacggtagttgcgtgacgacaatggcacgaaataaacccacattggatttcgaattaatcaaaacggaagcaaaacaccttgctacattacggaaatattgcgtggaagcgaaattgacaaatactacaacagcctcgcgatgtcctactcaaggagagccatcgttaaatgaagaacaagataaaagattcgtctgcaaacatagtatggtagataggggatggggcaatggctgtggtctattcggaaaagggggaatagtaacatgtgctatgtttacctgcaagaaaaacatggaaggaaaagtggtacaaccagaaaacttagaatataccatagttatcacgcctcactctggcgaggaaaacgccgtcgggaacgacaccggaaaacatggaaaagaaattaaagtaacacctcaatcgagtataaccgaagctgaactcacgggatatggaacggttacaatggaatgttcacccaggacagggctggatttcaacgagatggtccttttacaaatggaaaacaaagcatggttggtacaccgtcaatggttcttggatcttccactcccctggctaccaggggcggacacccagggctcaaattggatacaaaaagagaccttagtcacctttaaaaatccccacgccaagaaacaggatgtcgtagtactcggttctcaagaaggagcgatgcacactgccctcacaggtgcaacagaaatacaaatgagtagcggtaacttactgtttaccggacatttaaaatgcagactacggatggataaactacagttgaaaggaatgtcctactcaatgtgtaccggcaaatttaaagtagtcaaagagattgcagaaacccagcatggtaccatagtaatccgcgttcagtacgaaggcgacggtagtccttgtaaaatcccatttgagattatggatttagagaaaagacacgcactaggacgattaatcacggtaaatccaatagtgactgaaaaagatagtccagttaatatagaagcagagccacccttcggagacagctatattatcatcggagtagaaccgggccagctcaagctcagttggttcaagaaaggtagcagtatcggtcaaatgtttgaaaccacgatgcgtggtgcaaaaagaatggcaattttaggtgatactgcatgggacttcggaagtttagggggagtgttcacatcaatagggaaagcactgcatcaagtgtttggagcaatctatggcgcggcattttccggagtatcgtggactatgaagattcttattggagtagtaataacttggataggaatgaatagtagatcaacaagtttatcagtatcccttgtcttggttggtgtcgtcacactctatttaggcgtaatggtgcaggcagactccggttgtgtggtttcttggaaaaacaaagaactgaaatgtggaagtggcatattcataactgataatgtacacacatggacagaacagtataaatttcaacccgaatcaccaagtaaacttgcaagcgcaatccaaaaagcacatgaagaagggatatgtggtatcagatcagtaactcgcctcgaaaacttaatgtggaagcaaataacgcccgaattaaaccatatattaacagagaatgaagttaaattaacgataatgactggcgacataaagggtatcatgcaagccggtaagcgatcgctccgaccccaaccgacagaactgaaatattcatggaaggcttggggtaaggccaagatgttaagcactgagctacataatcacacattcttgatagacggtcctgaaacagctgaatgtccaaatacaaacagggcttggaactcccttgaagttgaagattatggatttggcgtatttaccacaaatatatggttgaaattgaaagaaaggcaagacgtcttttgtgatagtaaacttatgagtgcagctataaaagataatagggccgtccatgcggacatggggtattggattgaaagcgcgcttaatgatacatggaaaatagaaaaggcttccttcatagaagtaaagtcatgccactggcctaagtcacacacattatggtcaaacggagttctcgaatcggaaatgataataccgaaaaatttcgcagggcccgtttcccaacataattataggccaggatatcatactcaaactgccggcccctggcacttagggagactagaaatggatttcgacttttgtgaaggtacaactgtggtggtcaccgaagactgcggaaacagaggaccgtccctacggacaacaacagcgtcagggaaactcatcactgaatggtgttgtcggagttgtacattgcccccactgaggtaccgcggtgaagatggatgctggtatggaatggagatcagaccattaaaagaaaaagaggagaatctagtgaactccttagtgacagcaggccatggtcaaattgacaatttcagtcttggtgtactcggtatggcgctattcctagaagagatgctacgcacaagagtgggcacgaaacatgctattttgcttgttgccgtttcttttgtcacattaataacaggaaacatgtcgtttagggaccttggcagagtaatggttatggttggagcaacgatgacagatgatatagggatgggcgttacctacttggccctgctcgcagcattcaaagttcgtcccacgttcgcggctggtttactgttacgcaaactcacatctaaggaacttatgatgacaacaattggcatagtattattatcacagtcaaccataccagaaagtattttagaactgacagatgcactagcgctaggtatgatggtactcaaaatagtacgtaatatggaaaagtatcaacttgcagtgacaattatggcaatattatgtgtaccgaatgcagtcatccttcaaaatgcttggaaagtaagttgtacgactttagctgttgttagtgttagtccattactcctcacctcctcgcaacaaaaagcggattggattccattagcattaaccataaagggattgaatccaacagctatattcctgacaactctctctagaacatcgaagaaaagaagctggcctttgaacgaagcaataatggcagtagggatggttagtatcctagctagttcactgttgaaaaacgatatcccaatgactggacctttagttgcaggcggcttactaacggtatgctatgtactcacaggaagatctgctgacctagaactcgagagagccgcggacgtaagatgggaggaacaggcagaaataagtggatcgtcaccaattcttagtattaccattagcgaagacggcagtatgtcaattaaaaatgaggaagaagaacaaacgttaacaattttaattagaacaggactattagtgattagcggactctttccagttagcattccaatcacggcagctgcgtggtatctatgggaagtcaagaaacagcgtgctggtgtcctttgggacgtgcctagccctccgcctgtaggtaaagctgagttagaggacggagcgtaccggataaaacaaaaaggaatactgggctattcacagataggtgccggagtatataaagagggcacatttcacaccatgtggcacgttacacgcggagctgtgctaatgcataaggggaagcgaatagagcccagttgggcagacgtcaagaaagatctaataagctacggtggtggttggaagttagagggtgaatggaaagaaggagaagaagtacaagtactggcattagagccaggtaaaaatcccagagcggtacagactaaacccggactatttaaaacgaatacaggcactatcggtgcggtatccttagatttctcacccggcacaagtggcagtcccatagtagacaaaaagggcaaggttgtgggactatacggaaacggagtagttacgcgatctgggacatacgtttcagcaatagcacagaccgaaaagtctatagaggacaatccagaaatcgaagacgatatatttaggaaaaagcggttaaccataatggatctacatccgggtgcaggcaaaactaaacgttacttaccagcgatagtcagagaagcaataaaacgcggactccgaacattgatcttagcaccaacgagggtagtcgctgctgaaatggaagaggcattaaggggtcttcccattagatatcaaacccctgcaataagagcagagcatacaggacgtgaaatagtagacttgatgtgtcacgcaacctttacaatgaggctattatcaccgataagagtcccgaattataatttaattattatggatgaagcgcatttcacagacccagccagcatagcggcgcgggggtacattagtactagggtagaaatgggcgaggctgcaggtattttcatgacagcgacaccacccggtagccgggacccattccctcaatctaatgcacccataatggatgaagaacgagaaataccagaaagatcttggaactcaggtcatgaatgggtaacagattttaaaggtaaaaccgtatggtttgtaccatctataaaagcaggtaacgatatagctgcttgtttgcgcaagaatgggaagaaagtaattcaactttccaggaaaacattcgactcggaatatattaaaaccagaactaatgactgggactttgtggttacgacagatatttcagaaatgggcgcaaattttaaggcagaaagagtaatagaccccagaagatgcatgaaacctgttatattaacggatggggaggaaagagtcatattggcaggaccaatgccagtcactcatagcagtgctgcccaacggcgaggacgcgttggccgtaatcccaaaaatgagaacgatcaatatatatatatgggtgagccgttagaaaacgatgaagattgtgcacattggaaagaagccaagatgctattagacaatatcaatactcctgaaggtattattccatcaatgtttgaaccagagcgagaaaaagtagacgcaatcgatggggagtatagattgagaggcgaagctcgaaagacatttgtagatctcatgcggaggggtgacctgccggtgtggttagcttatagggtagccgcggaagggataaattatgccgatagacgttggtgcttcgatggagtcaaaaataaccagatattagaggaaaatgtagaggtagaaatatggacaaaagaaggtgaaaggaagaaacttaaaccaagatggcttgatgcacgtatttattccgacccattagcactcaaagagttcaaagaatttgctgcaggacgaaaatctttgaccttgaatttaataacggaaatggggcgactcccaacattcatgacgcagaaggccaaaaatgctttagataatctggcagtacttcatacagcagaagcaggaggacgagcatacaaccacgcattatcagagctacctgaaacattagagaccctactgttattaacactacttgcgacagtgactggaggcatatttttatttctcatgagtggtaaaggtattggtaagatgactttaggaatgtgttgtataattacagcttcaattttattatggtatgcccaaatccagccgcattggattgccgctagcataatattagagttctttttaatagtccttctgatccccgaacctgagaagcagagaactcctcaagataatcagttaacttatgttgttattgcaatattgacagttgtcgccgctacaatggcgaatgaaatgggatttttagagaaaacaaagaaagattttggattaggttcaattacgacccaacagccagagtccaacattctagatatcgacctacgtccagcatcggcgtggacattatatgcagtagctacaacttttatcaccccaatgcttagacactcgatagaaaatagttccgttaatgtctcattaacagcaatcgccaaccaggcaactgtcttgatgggattaggaaaaggttggccactatctaaaatggacataggagtacctctattagccatcgggtgttacagtcaagtaaaccctattactctcactgcagcactgttactattagtagcacattacgccataatcggaccggggctacaagccaaagcgacacgagaggctcagaaaagagcagccgctgggataatgaaaaatcctacggttgatggcatgactgttattgatttagaccctataccgtatgaccccaaatttgaaaagcaattaggacaagtgatgctattagtcctatgcgtgacccaagtacttatgatgcgaacaacttgggcattatgtgaagcattaaccttggcaaccggacccatatctacgttgtgggaaggtaacccaggaagattctggaacacgacaatcgcagtctcgatggcgaacatattccgaggctcttatttggccggtgcagggctattgttctccataatgaagaacacagcgaatactcgaaggggtacaggaaacaccggagaaacattaggagagaaatggaaaaaccggttaaatgccctggggaaatctgagtttcagatatacaagaaatctgggatccaggaagtagatagaacattagcaaaggaaggcatcaagagaggtgaaacagaccatcacgcagtgtcaagaggaagcgctaaactaaggtggttcgttgaaagaaacctcgtcactcccgaaggaaaggttgtagatcttggatgtgggagaggagggtggtcgtactactgcggaggtcttaaaaatgtaaaggaagtgaaagggttgacaaaaggagggccaggtcacgaagaacctatccccatgagtacatacggttggaatctagttagactccaaagtggagttgatgtcttcttcacgccgcctgagaaatgtgataccttactctgtgacattggagaatcgagccctaatccaacggtagaagcggggagaactctacgagtattgaatctcgtagaaaactggctaaataacaatactcaattctgtataaaagtccttaatccatacatgccttcggtgatagaaaagatggaagccttacaaagaaaatatggtggggcgctagtacgcaaccccctttcgcgcaactctacacatgagatgtattgggttagtaacgcatcaggaaacattgtatctagtgttaacatgatatcaagaatgctaataaacaggtttactatgaggcataagaaagcaacctatgagccagatgtagatttaggatctggcacgaggaacataggaatagagagtgagacccctaatctggatataataggtaaaagaattgaaaagataaaacaggaacacgagacgtcctggcattatgatcaagaccacccttataaaacttgggcttatcacggttcatacgaaactaaacagactgggtctgcttcaagtatggtcaacggggtcgtaagacttttaactaaaccctgggacgtcattccaatggtaacacaaatggcgatgacagacacaacaccatttggacaacaaagagtctttaaagaaaaagtagataccagaactcaggaacctaaagagggaacaaagaagctaatgaaaataaccgctgaatggttatggaaagagctaggcaagaagaaaacaccacgcatgtgtacaagagaagaatttacgcgaaaggtaaggtcaaatgccgcattaggagccatctttactgatgagaacaaatggaaaagtgccagagaagcagtcgaagactccggcttctgggaattagtagataaggaacgaaatttacacttggagggaaagtgcgagacgtgtgtttacaatatgatgggtaagagagagaagaaattaggcgaatttggtaaagcaaaaggatctagagcaatttggtacatgtggttaggggcgcgatttctagaatttgaagcacttggttttctaaatgaggatcactggttttccagagagaacagccttagcggtgtagaaggagaaggcctccacaaattaggatatatactaagggatgtaagcaagaaagaagggggtgcaatgtatgctgatgataccgcgggctgggataccagaataactttggaagatttaaagaacgaagaaatggtcactaatcatatggaaggagaacataagaaattagccgaagcaatttttaagttaacctaccaaaataaagtagtacgcgtacaaagaccaacaccgcggggaactgtcatggatataatttctcggcgagatcaaaggggctcagggcaagttgtaacctacggattaaacaccttcactaatatggaagcgcagcttatcagacaaatggaaggagaaggagtctttaaaagcatacagcaacttacggtaaaagaagagatagcagtcaaaaactggctcattcgcgttggaagagaaagattatcccgaatggcaatcagtggagatgactgcgtagttaagccactagatgatagattcgctagtgctcttacagcgttaaacgatatgggtaaagtccgaaaagatatacaacagtgggaaccctcccgtggatggaatgactggacgcaggttccgttctgtagtcaccattttcacgagctgattatgaaagatggcagggtgttagtagttccatgcagaaaccaagatgagcttattgggagagcgaggatcagtcaaggtgcaggttggtctctacgagaaaccgcgtgtctaggcaaaagctacgcacaaatgtggagtctcatgtacttccatcgaagggatttgcggttagcagcgaatgccatatgttcagcagttccttcacattggatcccaacaagcaggaccacatggtccatccatgcaacacacgaatggatgacgacagaggatatgttaaccgtctggaatcgtgtttggattcaagagaatccctggatggaagataaaactcccgtggaaacttgggaagaaataccatatctagggaagagagaagatcaatggtgtggtagtctcataggattaacaagtagagcgacatgggccaaaaatattcagactgcaataaaccaggtcaggtcattaatagggaatgaagaatatactgattacatgccatcgatgaaaaggtttagaagagaagaagaggaagctggggtactatggtaa

SEQ ID NO: 22242 - RNA, 9876 nt, synthetic construct
  misc_feature 1..9876: note = derived and/or modified CDS sequence (opt6) from DENV-2__KM279521__SS-prME
  source 1..9876: mol_type = other RNA
acagctggtataatcattatgatgatccccaccgtgatggcatttcacttgacaacacgaaatggcgagccacatatgatcgtatcccggcaagagaaaggaaaaagtttactattcaaaactgaaaatggtgtgaacatgtgcacattgatggcaatggaccttggagaactttgcgaagatactataacttataattgcccattattgagacaaaatgaaccagaagacatagattgttggtgcaattcaacaagtacatgggtaacatacggaacttgcactgcaacgggagaacaccgcagagagaaacgaagcgtggctctagtgccccacgtaggaatgggattagaaacacgtacagaaacgtggatgagtagtgaaggagcttggaaacatgcacagagaatagaaacttggattctgaggcatccaggttttacaataatggctgctatcctcgcatatacaattgggacaacttattttcagagagtactcatctttatcctattaacagctgtaacaccatctatggcgatgagatgtattggaataagcaacagggatttcgttgaaggtgtgtccggaggctcatgggttgatatcgtgttagagcacggtagttgcgtaaccacaatggcgaaaaacaaaccaacactcgatttcgagttaataaaaacggaagcaaaacacctcgctaccttaagaaaatattgtgttgaagcaaaactgaccaacacaactactgcttcacgttgccctacacaaggagaaccaagccttaatgaagaacaagacaaacggtttgtttgtaaacatagcatggtagaccgaggttggggaaacggatgcggattattcggaaaaggtggaatagttacttgtgcgatgtttacctgcaagaagaatatggaaggcaaggtcgttcaaccggagaacttagaatacactatagtgattacaccccattcgggagaagaaaatgcagtaggtaatgatacgggtaaacatggaaaagaaattaaagtgactcctcaaagttccatcacagaagcggaattgaccgggtatgggacggtgacaatggagtgcagtcctagaacagggttggacttcaacgagatggtcctattgcaaatggaaaacaaagcatggttagtacatcggcaatggtttcttgacctaccgcttccctggttaccaggtgcagacacccagggatcaaattggattcagaaagagacattggtaacgttcaaaaatccacatgccaagaaacaggacgtagtggtgctaggaagtcaagaaggcgcaatgcatacggcactaacaggagcgactgaaatccagatgagctcaggcaacctactattcacaggacatttgaaatgtagattacggatggataaattacaactaaaaggtatgtcatattcaatgtgtactggtaaattcaaagtagtaaaagagatagccgaaactcaacatggaacaatcgtaataagagtacaatatgaaggcgacggctcaccctgtaaaattccgtttgagattatggacttagaaaaacgacatgttttgggacgtctaattacggtaaacccaatagtcactgaaaaagacagtaccgtcaatatagaagctgaaccaccatttggtgattcatacattataattggcgtagaaccaggtcagctaaaattatcgtggttcaagaaagggagtagtattggtcaaatgtttgaaacaacaatgcggggagcgaaaagaatggcaattttaggtgacactgcatgggacttcggaagcctcggcggagtatttacttctatcggtaaagccttacaccaagtgttcggcgctatctacggagcagcctttagtggagtatcttggacaatgaaaatcttaattggcgtagtaataacgtggatcggaatgaactcaagaagcaccagtctttcagtaagcctagtgttagtgggagtcgtgactttgtacttaggcgtaatggtacaagcagattctggatgtgtagtgagctggaaaaacaaagaacttaaatgtggtagtggtattttcatcacagacaacgtgcatacttggacagaacaatacaagttccaaccagagtcacctagtaaacttgcaagtgctatccaaaaagcacacgaagaaggaatttgcggtatcagatctgtaaccagactagaaaatttaatgtggaaacaaataacacctgaactaaatcacatcttaacagaaaacgaagttaaactgacgattatgacaggtgatatcaaaggaataatgcaagctggaaagcgatctctccgtccacagccaacagaactaaaatactcctggaaagcgtggggaaaagctaaaatgctttcaaccgaattacataatcatacctttctaatagacgggccggagactgcagaatgccctaacacgaacagagcatggaacagtctagaagttgaagactatggcttcggcgtttttacaaccaacatctggttaaagctgaaggaaagacaggacgttttctgtgactcgaaactgatgtcggcagctataaaggataacagggcagtacacgccgatatgggttactggatagagagcgctttaaacgatacttggaaaatagaaaaagcaagtttcatcgaagtaaagtcttgtcattggccgaaaagtcacacactatggtccaacggagtactagaaagcgagatgatcatccctaaaaactttgctgggccagtatcacaacataattatcgaccggggtaccatactcaaacggcaggcccatggcatctaggcagactggaaatggactttgatttctgtgaaggtacgacagttgttgtcaccgaagattgcggaaacagaggcccgtcactaagaacaacgactgcatcaggcaaattaataactgaatggtgctgccgctcctgtactcttcccccactaaggtacaggggtgaagatggatgttggtacggcatggagattcggccgctaaaagaaaaggaagaaaacttggtaaatagcttagtaacagcaggccatggtcaaatcgataatttcagcctaggtgttttaggcatggcactgtttttagaagagatgttaaggacaagagtcgggacaaaacatgctattctattagtggctgtatcatttgtcacgctaataacaggaaatatgtcttttagggacttaggaagagttatggtgatggttggcgctacgatgaccgacgacataggaatgggggtgacgtacctagccttactagctgcatttaaggttagaccgacttttgctgccggattgttattacgtaaattaacatctaaagaacttatgatgactaccatcggaatagtgctacttagtcagtcgaccatacctgaaagcatattggaattaacggatgcattagctctagggatgatggtactgaaaatcgtacgaaatatggagaaatatcaattagcggtgacgataatggccatcttatgtgtacctaacgcggttatactacaaaacgcttggaaggtatcttgcacaacactcgccgtagtatccgtgagtccgctacttcttacatctagtcagcaaaaagccgattggatcccattagccttaacaattaaaggtctcaatccgactgcgatattcctaactacattgtctcgaacaagcaagaaaagatcttggcccctaaacgaagcaataatggcagtaggaatggtatcaatacttgcctcatctcttttgaagaatgacattcccatgactggcccgctagtcgcgggaggtttgttaacagtatgttatgtgctaactgggcgatcagcagatttggaattagaaagagccgccgatgttcgatgggaagaacaagctgagataagtgggagctcgccaatattaagtataacaatatccgaagatggcagtatgagcatcaaaaatgaagaggaagaacagacgttgacgattctaattagaaccggattgctcgttatatcgggattatttccagtatcaataccgataactgcagctgcatggtatctgtgggaggtgaagaaacaacgtgccggagttctatgggatgtaccaagtcccccgcccgttggtaaagcggagctagaagacggcgcttatcgaatcaaacagaaagggatattaggatattcccagattggagctggggtttataaggaaggtacgttccatacaatgtggcatgtgacgaggggagcagtcctcatgcacaaaggaaagcgaatagaaccatcatgggccgacgttaagaaagatctgatttcctatggaggaggttggaaattagaaggagaatggaaagaaggtgaggaagtacaagtattagctttagagccaggtaaaaatcctcgagctgtacaaacgaaacctgggcttttcaaaactaacacagggactataggggctgttagtctcgatttctcacccggaacatcagggtcaccaatagtagataagaaaggtaaggtagtgggattgtatggtaacggtgtagtaacgcgatcaggtacgtatgtcagtgcaattgctcagactgagaagtcgatagaagataacccagagattgaagatgacatcttcagaaagaaaagactaacaataatggatttacacccaggggcaggaaaaacaaagagatatcttcctgcaatagttcgtgaagcgattaaacgaggattaaggacattaatactagctccaacaagagtggttgcggcggaaatggaagaggctctccgtggattacctatacgttaccaaacgccggcaatcagggccgaacatacaggaagagaaatagtagatttgatgtgccacgccacttttacgatgaggttactatctcccatccgagtacccaactataacttgataataatggacgaggcccattttacagatcccgccagtatagcggcaagaggttatatatcaactagagtggaaatgggagaagccgcagggatatttatgacagcaacgccccctggttcaagagacccattcccacagtcgaacgcacctataatggatgaggaaagggaaattccagaaagatcatggaactcaggccatgagtgggtgactgacttcaagggaaagactgtgtggttcgtacctagtattaaggcgggtaacgacatagcagcatgcttacgtaagaatgggaaaaaggtgatacaattgagcagaaagacatttgattctgagtacataaaaacaaggacgaatgattgggacttcgtcgtgactacagacatatccgagatgggagctaattttaaagccgagagggtaattgatccacgacggtgcatgaaaccagtaatactaactgacggggaagaacgtgtaatcctagcaggaccgatgcccgtcactcatagtagcgctgcccagaggaggggaagagtgggccgaaaccccaagaatgaaaatgatcaatatatatatatgggcgaaccactagaaaacgatgaagattgcgctcattggaaagaggcgaaaatgttgcttgataatataaatacaccggaaggtattattccctcaatgtttgaacctgaaagagaaaaggttgatgctatagacggtgaatacagactaaggggcgaagcgcggaaaacctttgttgatctaatgaggaggggtgatttgcctgtatggcttgcgtatagagttgccgcagaagggattaactacgctgacagaagatggtgtttcgacggtgtgaaaaataatcaaatactcgaagaaaatgtagaagttgaaatttggacaaaagagggagaaagaaagaaactaaaacctaggtggttagatgcaagaatatattcagaccctttagcacttaaagaatttaaggagttcgccgctgggaggaagtcattaaccctgaatctaatcacagaaatgggacggttacccacgttcatgactcagaaagccaaaaacgcactcgataatctagcagtattgcatactgcagaagcaggaggtcgtgcatacaaccatgctttatcagaacttcctgaaacattagaaacattattgttactaacattactagctacagtaactggaggaatatttttgtttctgatgtccggcaaaggcattggcaaaatgacattaggaatgtgttgcattattactgcgtcaatattgttgtggtatgctcaaatccagcctcattggatagcagcatcgattatcttagagtttttccttatcgttttgttgattcctgaaccagagaaacaaagaactccacaagacaatcaactcacatatgtagtgatagccattttgacggtggtagctgcgactatggccaatgagatgggcttcttagagaaaactaagaaagattttggtcttggaagtatcacaacgcaacaacctgaatcaaatatattggacatcgatcttcgaccggcgagtgcgtggacactatatgcagtcgcaactacatttataacacctatgctacgccactcgattgaaaacagcagcgtaaatgtaagcctcacagctatagcaaaccaagcaacggtactaatgggcttgggtaaaggatggccactaagcaaaatggatataggagtgccactgctcgcaattgggtgctactcccaagtaaaccccatcacattaactgctgcattactactcctagtggcacattacgcaatcataggccctggtttacaagctaaggctacccgagaagcacaaaaacgcgcagccgcgggcataatgaagaaccctacagtagatggtatgacagtaattgatcttgatccgattccctatgatccgaaattcgaaaagcaattgggtcaggtaatgttattagttctctgcgtcacccaagtattgatgatgcgaactacgtgggccttatgtgaagctctaactttggctacaggaccgatatcgaccttatgggaaggaaacccagggagattctggaatactaccattgcagtgtcaatggccaacatcttccgtggaagttacctagcgggagcgggactgctatttagtattatgaaaaatactgctaatacaagacggggtacggggaatactggagaaacattaggtgaaaaatggaagaaccgtttaaatgctctaggcaagtcagaatttcaaatatataagaaatccggaatccaagaggttgacagaaccttggccaaagagggcattaaacgaggcgaaacagaccatcacgccgtcagtaggggcagtgctaaactccggtggtttgtagaaagaaatcttgtgactcccgaaggtaaagtagtggatctcggatgcggtagaggagggtggtcatactattgtggtggattaaagaatgttaaggaagtaaagggattaacaaaagggggcccaggtcatgaggaaccaatccctatgtctacatacggctggaatctggtaaggctacagagtggcgtagatgtattctttacaccacccgaaaaatgtgatactttactttgtgacataggagaaagcagcccgaatccgaccgtggaagccggtagaaccttacgagtccttaacctagtagaaaactggctcaataacaatacacagttttgtattaaagttttaaacccgtacatgccatcagtcattgagaaaatggaagcacttcaaagaaaatatgggggtgcgttggttcgtaatccgttgtcgaggaacagtactcatgaaatgtattgggtcagcaatgccagtggaaatatcgtctcatcagtgaatatgattagcagaatgttaataaaccgctttactatgcgccacaagaaagcgacatacgaaccagacgtagaccttgggagtggaaccagaaacatcggaattgaaagtgagacaccaaatcttgatataattggcaaaagaatagaaaagataaagcaagaacacgagaccagttggcattacgatcaagatcatccttacaaaacatgggcataccatggatcctacgaaacaaagcagaccggtagtgcttctagtatggttaacggggttgttaggctattaactaagccctgggacgttattccgatggtgacacaaatggccatgactgatacaacaccatttggacaacagagagtatttaaggaaaaagtggatacgagaactcaagaaccaaaagaaggtactaagaaactaatgaaaataacagcagaatggctatggaaagaactagggaagaagaaaaccccaagaatgtgcacgagagaagaatttaccagaaaagtaagatcaaatgcagccctcggcgcaatcttcacagatgaaaacaaatggaaaagtgctagagaggcagtagaagactcaggtttctgggaattggtggacaaggaacgaaatcttcatttggaaggtaaatgtgagacttgtgtttacaacatgatgggcaagcgtgaaaagaaattgggcgagtttggaaaggcgaagggatcaagggctatctggtatatgtggttaggcgcccgatttttggaatttgaagcacttggatttctaaatgaagatcactggtttagccgagagaactcgttaagcggtgtcgagggagagggattacacaagttaggatacatcctccgagacgtatcaaagaaagagggaggagcaatgtacgcggatgatacagcggggtgggacactaggatcacgcttgaggatttaaagaacgaggaaatggtaaccaaccacatggaaggagaacataaaaagttagctgaggcaatatttaaattaacttatcaaaataaggttgttcgcgtccaacgtccaacgccgagaggaacagttatggacatcatctcacgcagggatcaacgtggctcaggacaagtagttacatatgggctaaatactttcacgaatatggaagctcaactgataagacaaatggaaggagaaggcgtctttaaatccattcagcagctaacagtaaaagaggaaattgcagtcaaaaattggcttataagagtaggacgagagcggcttagtcgaatggctatatcaggagatgattgcgtagtaaaaccccttgacgacagatttgctagcgcattaacagctttaaatgatatgggcaaagttcgtaaagatatccagcaatgggaaccttcgcgaggttggaatgactggactcaggtaccattctgtagtcaccatttccacgaattaataatgaaagatggacgcgtcctagtcgttccatgccgtaatcaagatgaattaataggtagagcacgaatctcacaaggagctggttggtctctaagagaaaccgcttgcttaggcaagtcttatgcacagatgtggtccttgatgtattttcacaggagggacctaagactagccgcaaatgcgatatgcagcgcagtaccgagtcactggatacctaccagtagaacgacttggagcatccacgctacacatgaatggatgaccacggaggatatgttaacagtttggaatcgagtatggatccaagaaaatccttggatggaagataaaactccagtggaatcatgggaagaaataccctatctgggtaaacgagaagatcaatggtgtggaagtttaataggtctaaccagtcgagctacgtgggccaaaaacatccaaacagcaatcaaccaagtaagatcacttataggcaacgaagagtataccgattatatgccctccatgaaaagattcagacgggaagaagaagaagcaggagtgttgtggtaa

SEQ ID NO: 22243 - RNA, 9876 nt, synthetic construct
  misc_feature 1..9876: note = derived and/or modified CDS sequence (opt6) from DENV-2__KM279583__SS-prME
  source 1..9876: mol_type = other RNA
actgcgggtattataattatgatgatacccacggtaatggcattccacctcacaacgagaaatggagaaccacatatgatagtatcaaggcaggaaaaaggtaaaagtctattgtttaaaaccgaaaacggagtgaatatgtgcacgttaatggcgatggatttaggagaattatgcgaagatacgattacatataactgtcctctactacggcagaatgaaccagaagacattgattgctggtgtaattcaacatctacatgggtaacttacggtacatgtacggcaacaggtgaacataggagagagaaaagaagtgtagctttggtaccccacgttggcatgggactagaaacgcgaactgaaacctggatgtcaagtgaaggcgcttggaaacatgctcaaaggatagaaacatggatactaagacatcctggctttactataatggcagcaatattggcatataccatcggcactacgtactttcaacgtgtcttgatatttatacttctcacagcagtaactccatcaatggccatgagatgcattggcatatcaaatagagatttcgtagaaggtgtctccggaggctcttgggttgatatagtcctggaacatggcagctgtgtaactacaatggctaaaaacaaaccaacattggactttgaactaataaaaacggaagcaaaacacttagcaacattaagaaaatattgcgtggaagcaaaattaacaaatactacaacggcaagtcgatgtccgacacaaggagaaccatcattaaatgaagaacaagataaaaggtttgtatgcaaacactcaatggtcgatcgaggttggggaaatggatgcggtctattcggaaaaggaggtatagtgacatgcgcaatgtttacatgtaagaaaaatatggaaggaaaagtggttcaacctgaaaatctagaatacaccattgtaattacgccacattctggtgaagagaacgctgttggaaatgacactggaaaacacgggaaagaaataaaagtaactcctcagagttcaataaccgaagcggaattaacaggatatggaactgtgaccatggaatgttcaccaaggacgggattagattttaatgaaatggcactactacaaatggaaaataaagcctggttggtccatcgacaatggtttttggatctaccacttccttggttgccaggagcggacacccaaggatcgaattggattcagaaagaaacgctcgtaacatttaaaaatcctcatgcgaaaaagcaagatgttgtcgtactagggtcgcaagaaggagctatgcatacggcccttacgggggcaacagaaatacaaatgtcttcaggtaacttattatttactggacatctaaaatgtaggttacgaatggataaactccagcttaagggtatgagttattcgatgtgtacgggaaaatttaaagtagttaaagaaattgcagaaactcaacacggtacaatagttattagggtacaatatgaaggcgacgggagtccatgtaaaataccatttgaaataatggaccttgaaaaacgacacgttttaggccggttaataactgttaatccaattgttacagaaaaggatagtccagtcaatattgaggctgaaccacctttcggagactcatatatcatcataggagtcgagcccggacaattaaaactaagttggttcaagaaaggatcgagcataggacagatgttcgaaacaaccatgagaggggcgaaacggatggctatactaggtgacactgcatgggattttggaagccttggcggggtattcacctcaattgggaaagcactccatcaagtttttggagcgatttacggcgcagctttctcaggagtaagttggacgatgaaaattctaattggcgtagtcatcacatggatcgggatgaactcgaggtcaacttccctaagcgtatctcttgtcctagtaggagtagtaacactttacttaggtgtaatggtacaggcagactctggttgtgtagtgtcttggaagaacaaagaactaaaatgtggatctggtatatttataacagataatgtgcacacttggacagaacaatacaagtttcaacccgagagcccgtcaaaactagccagcgcgattcaaaaagcgcacgaagaaggaatttgtggaatacgatcagtcacacgtcttgaaaatcttatgtggaaacaaatcaccccggaactgaatcacatactgactgaaaacgaagttaaactaaccattatgaccggtgatataaaaggtataatgcaagcaggtaaacgctctttacgcccacaacctactgaattaaaatatagttggaaagcctggggtaaagcgaagatgttgagtacggaattacacaatcacacatttcttatagacgggccagaaaccgcagaatgcccgaatacgaatcgagcatggaactcacttgaggtagaagactacggctttggcgtttttactactaacatctggttgaaactaaaagaacgacaagacgtattctgcgattccaaacttatgtcggcagcaataaaagataatcgtgccgtacatgctgatatgggctactggatagagagcgcactaaacgatacatggaaaatagagaaagcaagtttcattgaagtaaaaagttgtcattggccaaaatcgcatactctatggagtaatggcgttttagaatcagagatgataatccccaagaactttgcgggccctgtttcgcaacataattaccgaccgggttatcacactcaaacagcgggaccctggcatctcggtagactagaaatggattttgacttctgtgaggggacaacggtagttgtcacagaagattgtggaaacagaggacctagcttaagaactactacggcatcagggaaacttataacggaatggtgttgccgctcgtgcactcttcctccattacgttacagaggagaagatggctgttggtatggaatggagatacggcctttgaaagaaaaagaagaaaacttggtaaattcattagtaacggcaggccatggacagatagataacttttccctaggagtacttggcatggcattgtttcttgaagaaatgttaagaactagggtcggaactaaacacgcaattctattagtagctgtgagtttcgtaacgttaataacagggaacatgtcttttagagatcttggacgcgtaatggtaatggtaggagcaacaatgactgacgatataggaatgggagtaacatatctagctctattggcagcattcaaagttaggcctacatttgctgctggtctactgctaagaaaattgaccagtaaagaattaatgatgacaacaatcggcattgttctgctttctcaaagtactataccagaatccatacttgagcttacagatgcactagcattaggcatgatggtgttaaaaattgtcagaaacatggaaaaatatcaactagctgtaacaatcatggcgatattatgcgttcctaatgcagtaatccttcaaaacgcatggaaggtctcatgtaccactctagcagtagtttccgtgagtccattattattgacttcatcccagcaaaaagccgactggataccactcgcgttaactataaaaggtctaaatcccacggcaatatttctcaccacattatcccgtacttctaagaaacgaagttggccattaaatgaagcaataatggcagtggggatggttagtatacttgcctcgtcattactcaaaaatgatataccaatgacaggaccattagtagccggcggactactaactgtttgttatgtactaacaggtcgaagtgccgatttagagttggaaagagctgcagacgtacgctgggaagaacaagcggaaatttccggatctagtccaattttatcgattacgatatctgaagatggaagtatgtcaatcaaaaatgaagaagaagaacagacactgacaattctaataagaaccggattattagttatttcgggcctctttcccgtgtctataccaattacagccgctgcatggtacttatgggaagtcaaaaagcagcgtgcaggagtcctatgggatgtaccttcacctccaccggtaggaaaagcggaattggaagatggggcgtaccggattaaacaaaaaggtattttaggctatagtcagataggggctggagtatataaagaagggacttttcataccatgtggcatgtcacacgaggagcggtacttatgcataaaggaaaacgcatagaacccagttgggccgacgtcaagaaagatctaatttcctacgggggaggctggaaattagaaggtgagtggaaagaaggagaggaagtccaagtactcgccctagagccaggtaaaaatcctcgggcagtacaaactaagcccggactctttaaaacgaatacgggcactattggagctgtctctttagacttttcgccaggaacaagtgggtctccgatagttgataagaagggaaaagtagtcggactgtatggaaatggagttgttactaggagtggaacgtatgtatctgcgatagcacaaactgaaaaatctatagaagataatccggaaatcgaagatgatattttcagaaagaaacgattaacgatcatggatctccatccaggagctggcaaaaccaaacgatatcttcccgcgatagtaagagaagcaattaagagagggctcagaacactgatacttgcacctaccagagtagtagctgctgagatggaggaagcattacgaggcctaccgataagataccagacccccgccattagagcagaacataccggacgagaaatagtagacttaatgtgccacgctacattcacgatgcggcttttaagccctatacgggtacctaactataatttgattataatggatgaagcgcacttcacagaccctgcaagcatagctgcccgagggtatatatcaaccagggtagaaatgggcgaagcagcaggtatcttcatgactgctacgcctccaggcagtagagatccatttccgcaaagtaacgctcccataatggatgaagaacgggagatccctgagagatcctggaatagcggccatgagtgggttaccgattttaaaggaaagactgtatggtttgtaccaagtattaaggctggcaatgacatagcagcttgcctacggaaaaatggtaagaaagtaattcaactatcccgaaaaaccttcgactcagaatatatcaaaacaagaactaatgactgggatttcgtagtaacaaccgacatcagtgagatgggagccaattttaaagcagagagagttattgacccaagacgatgtatgaaaccagtaatcctaactgatggcgaggagagagtgattctcgccggtccaatgccagtcacacacagcagcgcggcacaacgcagagggcgggtcggcagaaatcccaaaaatgagaatgaccaatatatatacatgggtgaaccactagagaatgacgaagactgtgcacactggaaagaagctaaaatgttactcgataacatcaatacaccagaaggaataataccttcaatgtttgaaccggagagggaaaaagttgacgctatagacggcgagtacaggctaagaggagaagcccggaaaactttcgtagacctgatgcggagaggggatcttcccgtctggctagcatatagggttgctgcagagggtatcaactatgcagatcgtagatggtgttttgacggagtgaaaaacaaccagattttagaggaaaacgtggaggtagagatatggactaaggaaggggaaaggaagaaactgaagcctcgttggttagacgctagaatatattctgacccacttgcgttaaaagagtttaaagaatttgcagcagggaggaaaagcctaactctgaacctgatcaccgaaatgggcagattacccactttcatgacacagaaggccaaaaatgcactggataatctcgccgtacttcatactgctgaagcaggaggacgggcttataatcatgcgctgtctgaactgccagagactctagaaactctcttgctattaacactactggctactgtaacgggaggtatatttttatttctaatgagcggtaaaggtatagggaaaatgacgctgggaatgtgttgtattatcacagcctctattctcttatggtatgcacagatacaaccacattggattgccgcatctataattttggagttctttctgattgttctgcttataccagaacctgaaaaacaaagaactccccaggataaccaattgacatacgttgtaatagcaattttaaccgtggttgccgcgacgatggctaatgaaatgggcttcctagagaaaacgaagaaggattttgggctcggtagtataacaactcaacaacctgaaagtaacatactagatatcgacttgagacctgcatcagcttggacactatacgcagtcgctactacatttattactccgatgctgcgtcactcaattgagaactcctcagttaacgtctcactgacggcaatagcgaaccaagctaccgtattaatgggtcttggaaaaggatggcctctatcaaagatggatattggtgtaccactcttagctattggatgttatagtcaggtcaatcccattacattgactgctgccttattactacttgtcgcacattacgctataattggtccaggcctacaggcaaaagccactcgcgaggcacagaaacgagctgcagcaggaatcatgaaaaatccaacagtagacggcatgacagtcatagatcttgatccaataccttatgaccctaaattcgagaaacaactaggccaagtgatgttattagtactatgtgtcacgcaggttctaatgatgaggactacgtgggctctatgtgaagcactaacattggccacgggcccaatatctacgttgtgggaaggaaatccgggaagattttggaacacgacaattgcggtttccatggctaatattttccgggggtcatatttagcaggagcgggattgctattttcgataatgaaaaacacggcaaacactagacgcgggacaggtaataccggcgaaactctaggcgagaaatggaaaaacagactaaatgcgttaggaaagagtgagttccaaatatataagaaaagtggaatacaggaggtcgacagaactttagcaaaagagggtatcaagagaggtgaaacagatcatcacgcggtctcgagaggctcggcgaaattgaggtggttcgtagagcgaaaccttgtcacaccagaaggaaaagtggtagatttagggtgtggaaggggaggatggagttattattgtggagggcttaaaaatgtgaaagaagttaaaggcctgacgaaaggcggtccaggacacgaagaaccaataccaatgtcaacatatggatggaacttagtaagactacagagtggagtcgatgtattctttacgccacccgagaaatgcgacaccttattatgcgacataggggaaagctcacctaatccaacggttgaggcaggcagaacactacgcgtactaaatcttgtagaaaattggctaaacaataatacacagttttgtattaaagtacttaatccgtacatgccatcggttattgagaaaatggaagcgctacaacgaaaatatgggggagctttagtccgtaacccgttaagccgaaactcgacgcatgaaatgtattgggtgagcaacgctagtggcaatattgtaagttcagttaacatgataagtagaatgcttatcaatcgttttacaatgagacacaagaaagcaacctacgaaccggacgtggaccttggtagcggaactagaaacattggaatagaatcagaaaccccaaaccttgatataataggtaaaaggatagagaaaattaaacaagaacatgagacttcttggcactatgatcaagatcatccttataaaacttgggcctaccatggctcgtatgaaaccaaacaaacaggatcagcatcatctatggttaacggtgttgtcagacttttgacaaagccttgggatgtaattcctatggttacgcagatggcaatgacggatactaccccgtttggacagcaaagagtttttaaagagaaagtcgacacgcggacgcaagagccaaaggaaggtactaagaaacttatgaagataacagcagaatggctatggaaagaacttggcaagaagaaaactcctcgaatgtgtaccagagaggagttcacccgaaaggtacgtagtaacgccgcattaggagcaatcttcactgatgagaacaagtggaaatcagcccgagaagcagttgaagatagtggtttttgggagctagttgataaagaacgcaacctccacctcgaaggtaagtgcgagacctgtgtctacaacatgatggggaagcgtgagaagaaattaggcgaatttggtaaagctaaaggctcgagagctatctggtacatgtggctaggcgctagatttttggagttcgaagctcttggatttctaaacgaagatcattggttttcaagagagaacagtcttagtggagtagaaggagaaggtttgcataagttgggatatatattaagagatgtgagtaagaaagaaggcggtgcgatgtatgcagatgacaccgccggatgggacacaagaataacattagaagatcttaaaaacgaggagatggtgacaaatcacatggaaggagaacacaagaaattagcagaagccattttcaaactaacgtatcagaacaaggtagtaagagttcagagaccaactccccggggaaccgttatggacattatctcgcgtcgagaccaaagaggcagtggccaagtcgtaacatatggactaaatacattcacaaacatggaggctcaactaatacgacagatggaaggagaaggcgtcttcaaatcgatacaacaattgactgtgaaagaagaaatcgcagtgaaaaattggctaataagagtaggcagggaaagactaagtagaatggcaatttcaggcgatgattgtgtagttaaaccactagacgaccgttttgcaagcgcactaactgcactcaacgatatgggaaaggtccgcaaagatatccagcaatgggaaccgtcacggggctggaatgattggacacaagtccccttttgttcgcatcactttcatgaacttatcatgaaagacggaagggtactggtagtaccttgcagaaatcaggatgagttaatcggtagagcaagaatatctcaaggggcagggtggtcactcagggagaccgcatgcctggggaaatcgtacgctcaaatgtggagtttaatgtattttcaccgcagagacttaagacttgcggcaaatgcaatttgctccgcagttccttcacattggataccgacatcacgcacaacatggtcaattcatgcaacccatgaatggatgacgaccgaagatatgctcacggtttggaacagagtctggatacaggaaaatccttggatggaagacaaaacaccggttgagagctgggaagaaataccctatttaggtaaaagagaggaccaatggtgtggcagcttaattgggctaacgagtcgtgcaacgtgggcgaaaaatatacaaacggccataaaccaggtaaggagtttgattggcaacgaagaatatactgactacatgccatctatgaaacgctttagaagggaagaagaagaggccggggtactatggtag

SEQ ID NO: 22244 - RNA, 9876 nt, synthetic construct
  misc_feature 1..9876: note = derived and/or modified CDS sequence (opt6) from DENV-2__KM279585__SS-prME
  source 1..9876: mol_type = other RNA
actgcaggaataattattatgatgatacccacggttatggcttttcacctgacaactagaaacggagaacctcatatgatcgtaagccggcaagaaaaaggtaaatcacttctattcaaaacagaaaacggagttaacatgtgtacattaatggctatggatctaggtgaactatgtgaagatacaataacgtataactgtccgctattaaggcaaaatgaaccagaagatatcgactgttggtgtaactcaacgtcaacatgggtaacatatggaacatgcacagctacaggcgaacatagacgagagaaaaggtcagttgccttagtaccacacgtgggtatgggcctagaaacacgaacagaaacgtggatgtccagtgaaggtgcttggaaacacgcacaacgcatagaaacttggattttgagacatccggggttcacaattatggcagctattttagcgtatacaattggaaccacatactttcagcgagttctaatatttatcctgctaacagcagttacaccaagtatggcgatgagatgtatagggatcagtaatcgcgatttcgtggaaggggtaagcggaggaagttgggttgatatcgtgttagaacatggttcctgcgtaacgaccatggctaaaaataaacctacacttgattttgaattaataaaaactgaagcaaaacatttggctacattgcgaaaatattgtgtcgaagcaaaacttacaaatacgactaccgcgtccagatgcccaactcaaggtgaaccgtcattaaatgaagaacaggacaaaagattcgtgtgcaaacacagtatggttgatcgaggctggggtaatggatgcggattatttggtaaaggagggattgtaacatgcgctatgttcacatgtaagaagaatatggaaggaaaggtagtacagccagaaaacttagaatatacaatagtaataacccctcactcgggggaagaaaacgcagtaggaaatgatactggaaaacacggaaaagaaattaaagtcactccacaatctagcataaccgaagcggaactaactggatacgggacggtcactatggaatgcagcccgaggactggtttagattttaacgaaatggtcctcctgcaaatggagaataaagcatggctagtacaccgccaatggtttttagacctaccactaccatggttacctggggctgatacacaaggatcaaattggattcaaaaagaaacactcgtaacatttaaaaatccacatgcaaagaaacaagatgttgttgtattagggtctcaagaaggagcaatgcataccgcattaaccggggccaccgaaattcagatgagctcaggaaacctattgtttacaggacacctaaaatgtagactgagaatggacaaattgcaactgaaaggaatgagctatagtatgtgtacaggtaaatttaaagtcgttaaagaaatcgcagagacccaacatggtacgattgtagtcagagtccaatatgaaggggatggaagcccatgcaaaatcccattcgagattatggatttggagaaacgacacgtacttggccgtcttataacagtgaatcctattgtaacggaaaaggattcccctgttaacatagaagcggaaccccctttcggagacagctatataataataggagtcgaacccggacaacttaaattaagctggtttaagaaaggttcatctattggtcaaatgttcgaaacaaccatgcgaggggcaaaaagaatggcgattctcggtgatacggcatgggattttggctcattgggaggagtttttacctcaataggaaaggcacttcatcaagttttcggcgccatctatggagcagcgtttagcggtgtatcctggacaatgaaaatcctaataggtgtagtgattacgtggataggaatgaatagcagatcgacttctctcagtgtatcgctagtcctagtaggggtggtaactctatatcttggtgtaatggttcaagcagactccggatgtgtagtcagttggaagaataaggaactaaagtgtggtagtggaatattcataacagacaatgtgcatacatggacggaacagtataagtttcaaccagagagcccttcaaaattagcatcagcgatacagaaagcccatgaagagggtatttgtggaataagaagtgtgacgcgattagaaaacctaatgtggaaacaaattaccccagaattaaatcatattctaacagaaaacgaggtaaaactcacaatcatgaccggagatattaaaggaataatgcaggcaggcaaacgaagcctacgaccacaaccaacggagttaaaatatagttggaaagcatggggaaaagcaaaaatgcttagtacagaattacacaatcatacgtttttgatagatgggcctgaaactgctgaatgtcctaatacaaacagagcatggaactctctagaagtagaagattacggattcggggtctttacaacgaatatatggctaaaacttaaggaaagacaggatgtgttttgtgactcaaaactaatgagtgcagcgatcaaggataatcgtgcagtgcatgctgacatggggtattggatcgaatcagcactaaacgacacttggaaaattgaaaaggctagcttcatcgaagttaaaagttgtcattggccgaaaagtcataccttgtggtccaacggagttttagaatcagaaatgataataccgaaaaattttgcaggtccagtcagtcaacataattatagacctggataccatacacagacagccggtccatggcatctaggaagactagaaatggactttgacttctgcgagggtactacagtcgtggtaaccgaggattgcggcaacaggggacccagtcttagaaccaccaccgcttctggaaagttaattactgaatggtgttgccgaagttgtaccttaccgccattgcgatatagaggagaggacggctgttggtatggcatggaaataagacccctaaaagaaaaggaagaaaatctcgtaaattccttagttactgcaggacatggtcagattgacaatttttcactaggagtactcgggatggcattatttttagaagaaatgctaaggacacgggtcgggaccaagcatgctatcctattagtggccgtctcatttgttacgttgataactgggaatatgtcatttagagacttaggaagagttatggtgatggtgggtgcaactatgaccgatgatataggaatgggcgtaacgtacttagcgctgttggccgctttcaaagtaagaccaacattcgcagcaggtcttttactgaggaaactaacttcaaaggaactaatgatgacaacaatcggaatcgtgttgttatcacaatccaccattcccgaatccatactcgaactcacagacgcactagccctgggtatgatggtactcaagatagtaaggaacatggaaaaatatcagcttgcagtaacaatcatggctatcttatgcgtaccgaacgcggtcatcttacaaaatgcgtggaaagtaagttgcaccacattagccgtagtcagcgtctcacctctcctattaacatcctcacaacagaaagcagattggatccctcttgccctcaccattaagggcttaaacccaacagcaatctttttaaccacactaagtcgcacctccaagaaaagatcatggcctcttaacgaagcaatcatggcggtagggatggtaagcatattggctagttcgttactcaaaaatgatataccgatgacgggtcccctagttgctggtggtcttcttacagtctgctatgttttaacgggtcggtcggctgatcttgagttagaacgcgcagcagatgtacgttgggaagaacaagcagaaatatcaggctccagtccaatactttccatcaccatatctgaggatggaagcatgtccattaagaacgaggaagaagaacagacgttgacaatcctaatccggaccgggctattagtgatatctggcttgtttccggtaagcataccaatcacggcagctgcatggtacctttgggaagtgaagaaacagagagcgggagtattgtgggatgtacccagtccaccaccagttggaaaggctgaactagaagacggagcttatagaataaaacagaaaggaatattgggctatagtcaaataggagctggtgtttacaaagaagggacctttcataccatgtggcatgtaacccgaggagcggtattaatgcataaaggaaaaagaatcgaaccctcatgggcagatgttaagaaagaccttatctcgtatggtggaggatggaaacttgaaggcgaatggaaagaaggtgaagaagttcaagtattagcgttagaaccggggaaaaatccccgcgcagtccaaacaaaacccggactatttaaaactaatactggtacaattggtgcagtctcgttggattttagtccaggtacaagtgggagcccgattgtggataagaaaggaaaagtagttggactatatggaaacggagtagtaacacgatccgggacctatgtatcggcaattgcgcaaacggagaaaagtatcgaagacaatcctgaaatagaagatgatatcttccgaaagaaaaggttaacgataatggatcttcacccgggagctgggaaaacgaaaagatacctaccagcaatcgttagagaagcaattaaacggggactaagaaccttaatactagctccgaccagagtagtagcagctgaaatggaagaggccctacggggactgcctattcgttaccaaacacccgcaatccgtgcagaacacacaggacgagaaatagtagatcttatgtgccatgctacttttacgatgcgacttctttcacctatacgcgtaccgaattataatctaatcatcatggatgaagcacattttactgatcctgcatctatcgcggcgaggggatacatatctactcgtgtcgaaatgggtgaggcagcagggatatttatgactgcaactccaccgggaagtagggatccattcccgcaatcaaacgctcctataatggatgaggagagagaaataccagaaagatcgtggaatagcggtcatgaatgggtaactgatttcaaaggtaaaaccgtctggttcgtcccttccataaaggcgggtaacgatattgccgcgtgtcttagaaagaacggcaagaaagtgatacaattatccagaaaaacatttgactcagaatacatcaagacaagaactaatgactgggattttgtcgttactacagatatatcagaaatgggtgccaacttcaaggcagagagagtaatagacccaaggcgttgcatgaaaccagtaattttaacagacggagaagaaagagtaatcctggccggacctatgcccgtaacccactcaagtgctgcacagcgaagggggagagtaggtcggaatcctaaaaacgaaaatgatcaatatatttacatgggtgaaccacttgaaaacgacgaagattgcgcccattggaaagaagctaaaatgcttctagataatatcaacaccccagaaggtataataccatcaatgttcgaaccagagcgcgagaaagttgatgccattgatggggaataccgactccgaggagaagcacgaaaaactttcgtagatttaatgaggcgaggggatctaccagtatggctcgcctacagagtagcagcagaaggcattaattacgcagatcgacgatggtgtttcgacggagtcaaaaacaatcagatactagaagagaatgtagaagtagaaatatggactaaagaaggagagcgtaagaaactcaaaccacgatggttagatgcgagaatttacagtgatcctctggcactcaaagaatttaaagagtttgcagcgggtagaaagagtctcaccctaaacctcataacagaaatgggtagactcccaacattcatgactcaaaaggcgaagaacgcactagacaatttggccgtactacacacagctgaagcgggtgggagagcttataatcacgctttgtctgaattacccgagacattagagacactactattactaacgctgctagccacagttaccgggggaattttcttatttctaatgtccgggaaaggaatagggaagatgacactagggatgtgttgcataattacagcatctatcttactttggtacgcccagattcaacctcattggattgccgcatcgataattttagagttctttctcatcgtactactaataccagaaccagaaaaacaaaggactccccaggataatcaactaacctatgtagtaatagcgatacttacagtggtagcagcaacaatggcaaacgaaatgggattcctggagaaaacaaagaaagatttcgggttaggaagtataacaacccaacagccagaaagcaatatattagacatagacctaagaccagcgagtgcttggaccttatatgccgtagccaccacatttatcacgcctatgctgaggcacagtatcgaaaattcatcagtgaatgtatccctaacagcaatcgcaaaccaagctacagttcttatgggattaggaaaaggatggccattatcaaaaatggatatcggtgtcccccttttagcgattgggtgctactcacaagtgaacccaattactctaacagctgcacttttgttactggttgcccattatgcaataataggaccaggattacaagcgaaagctacaagagaagcacaaaaacgagcagcagcagggatcatgaaaaatccgactgttgacggaatgactgtaattgacctagatccaattccatacgatccaaaatttgagaaacaactaggtcaggtcatgttgctggtcttatgtgtcacacaggtgctcatgatgaggacgacgtgggcattgtgcgaagctcttacgttggcaacaggaccaatatcaacattgtgggaaggaaatccaggacgcttttggaatacaacaatagctgtctctatggctaacatcttccgcggctcctatctagctggcgcaggtttactattctctataatgaaaaacacagctaatacacgaaggggaaccggaaatacaggagaaacactaggagaaaaatggaaaaacagactaaacgcactcggtaagagcgaatttcaaatttacaaaaagtccggaatacaggaagtggatcggacacttgccaaagagggaattaaacgtggagagacggaccaccacgcggtatctcgaggctcggctaaactacgatggttcgtcgaaagaaatttggtaactccagaaggaaaggtcgtcgatttagggtgcggcagaggcggatggagctattattgcggtggacttaaaaatgtgaaagaagtgaagggtctaacgaaaggtgggccagggcatgaagaacctattcccatgtcaacttatggttggaacctagtaagactccagtcaggagtggacgtatttttcaccccgccagaaaaatgcgacacgctattatgtgatataggagaatctagtccaaatcctactgttgaagcgggaagaacattaagagttcttaatcttgtagataattggctcaataataacacgcaattctgcattaaagtactaaacccttatatgcccagtgtaatagagaagatggaagccctacaacgaaaatacggaggcgctcttgtacgtaacccgctttcaagaaattccacacatgagatgtattgggtgtcaaacgcttccggtaacattgtctcctctgtaaacatgatctctcggatgttaatcaatagatttactatgcgacataagaaagcaacttatgaaccagacgtcgatctaggaagtggaacacgcaatatcggcatagaatctgaaactccaaatcttgatataattggtaaaaggattgagaagataaaacaagaacatgagacgtcgtggcattatgaccaagatcacccatacaaaacctgggcctatcatggatcttacgaaaccaaacaaacaggatctgccagctctatggtaaatggggtagtccggctgctaacaaaaccatgggacgtaatccctatggttactcagatggcaatgactgatacaactccttttggtcaacaaagagtattcaaagaaaaagttgatacgcgtacacaagagcctaaagagggaacgaagaaattaatgaagatcacggcagaatggttatggaaagaactaggcaagaagaaaacgcccagaatgtgtactcgggaagagttcactcgtaaagttagatctaacgcagctcttggagcaatttttaccgacgagaacaaatggaaatcagcgcgcgaagcagttgaggactcaggcttctgggaattggtagataaggaaagaaaccttcacctagaaggcaaatgtgagacttgcgtatataatatgatggggaaaagagagaagaaactcggggaatttgggaaggcaaaaggttcccgcgctatatggtatatgtggctaggggcaagatttttagagttcgaagcattgggatttttgaatgaagatcattggttctctcgcgaaaattcgttatccggagtagagggagaaggcctgcataaattgggttatattctacgagacgtgtctaagaaagaaggtggagccatgtatgctgatgatacggcgggttgggacacaagaatcacattagaagatcttaaaaatgaagaaatggtgacaaaccacatggagggagaacacaagaaactggctgaagccatattcaaacttacataccaaaataaagtagtacgagtacaaagacctacaccaagaggtacagtcatggacatcataagcagaagggaccaaagaggttcaggtcaagtagttacatatggcttaaatactttcaccaatatggaagctcaacttataagacaaatggaaggagaaggggtatttaaaagtatccaacaattaacagttaaggaagagatagcagtaaagaactggctaattcgtgttggaagggagcgattgtcgcgtatggctatctcgggagatgattgcgtagtcaagccgctcgacgatcgatttgcttccgcacttacagctctcaacgatatgggcaaggtgcgcaaagatattcagcaatgggaaccgtctagaggttggaatgattggacccaagtgccattttgtagccatcatttccatgagttgattatgaaagacgggcgcgtgctcgtagtcccatgtcgtaatcaagatgaattaattggtcgcgcacgcatctcgcaaggtgcgggttggtcgttgcgtgaaactgcatgcctcggcaagagctatgcccagatgtggaacctcatgtatttccatagacgagatttaaggcttgccgccaatgccatttgtagtgcggtaccatcacactggatacctacctctagaacgacatggtctatccacgcaacgcacgaatggatgacaactgaagacatgctgacagtttggaaccgagtttggattcaagaaaacccatggatggaagataaaactcctgtagagagttgggaagaaatcccatatctgggaaaaagagaagatcaatggtgtggttccctaattggattgacatcccgagccacatgggcgaaaaatatccaaaccgcaattaaccaagtccgttccctaattggaaacgaagagtacacagactacatgccatcaatgaagagatttagaagagaagaagaagaagcaggcgttctttggtag

SEQ ID NO: 22245 - RNA, 9876 nt, synthetic construct
  misc_feature 1..9876: note = derived and/or modified CDS sequence (opt6) from DENV-2__KM279525__SS-prME
  source 1..9876: mol_type = other RNA
actgctggaataataataatgatgataccaactgtaatggcgtttcatttaaccacgaggaatggagaacctcatatgattgtttctcgacaagaaaaaggcaaatctctcctatttaaaacagaaaatggtgtaaatatgtgtaccctgatggcaatggaccttggtgaattatgcgaagatacaattacgtataattgcccccttcttcgacaaaatgaaccggaagatatcgattgttggtgtaactcaacaagtacatgggttacatacgggacgtgtacggcgacaggagaacacaggcgagagaaacggagtgttgcgctcgtaccgcatgtaggtatgggactagaaacaaggacggaaacctggatgtcttcagaaggggcttggaaacatgcgcaaagaattgaaacatggattttgaggcacccgggtttcacaataatggcggcaatattagcatacacaattggaaccacatatttccagcgagttttgatattcatcttgctgaccgcagttacaccatccatggcgatgcgttgcataggaatctctaaccgtgacttcgtggaaggagtatccggtggaagttgggtagacattgtattagaacatggtagttgcgttacaactatggccaaaaataaacctaccctcgactttgagctgataaaaacagaagcgaaacacttggcaaccctccgtaaatattgcgtcgaggctaaattaactaataccacaacagcatcacgatgtcccactcaaggtgagcccagtctcaacgaggagcaagacaaacgattcgtttgtaaacattcaatggtcgataggggatggggtaacgggtgtggtttatttggaaaaggtggtatcgtaacatgcgcaatgttcacatgtaagaaaaatatggaaggtaaagttgtacaaccggaaaacctagaatacacaattgtaatcacgccacacagtggagaagaaaatgcagttggcaatgatacaggcaaacatgggaaagaaattaaagtgaccccacagtcatcaataacggaagcagaattaactggttatggaacagttactatggaatgtagcccccgcaccggcttagacttcaatgaaatggtattactacaaatggagaacaaagcatggttagtacataggcaatggttcttagatttaccgttaccatggctaccaggagcagatacccagggatcgaactggatacaaaaagagacattagtcacgttcaaaaatccacatgccaagaaacaagacgtggttgtattaggatcccaggagggagcgatgcatacagctctgactggagctacagagattcaaatgagttcaggaaacctactatttactggacacctcaaatgtagattgagaatggataaattgcaattaaaaggaatgtcgtactccatgtgcacaggaaaattcaaagttgttaaagagatagcagagacacaacatggcacaatcgtgataagagtccaatatgaaggagatggcagcccatgtaaaattcccttcgaaatcatggatctagagaaaagacatgttctggggcggttgataacagtcaaccctatagtaacggaaaaagattcgccggtaaatatagaagcagaacctccattcggagatagttatataataattggggtggagcccggacaacttaaattatcctggtttaaaaagggaagttcaatcggtcagatgtttgaaacaacgatgagaggcgctaaacgaatggcaattctaggcgacacagcatgggactttggctcccttggtggcgtgtttacaagtatcggtaaagcgttgcatcaagtttttggagccatatacggagcggcgtttagcggagtgagctggacaatgaaaattttgatcggagtcgttataacatggattggaatgaactccagatcaacgtcgctttcggtctcgcttgttttagtaggagtggttacactgtacctcggagtaatggttcaagctgatagtggttgcgtcgtcagttggaaaaataaagaattaaaatgcggaagcggtatattcataacagacaacgtacacacatggactgaacaatacaagtttcagccagagtcaccaagcaagctcgcctctgcaatacaaaaagcccatgaagagggtatttgcgggatcaggagtgtaacacgtttggaaaacctgatgtggaaacagataacaccggaacttaatcatatcctaactgaaaatgaagttaaactaaccataatgacgggtgatattaaaggtataatgcaagctggaaagcgaagtctaagacctcaacctacagaattaaagtattcgtggaaagcatgggggaaagccaagatgttatcgacggaattgcataatcacactttccttatagacggaccagaaacagcggaatgtcccaatacaaacagagcgtggaactcattggaagttgaagattatggatttggcgtgtttacaactaatatttggttaaaattaaaagaacgacaagatgtattttgtgattcgaaactaatgagtgcagcaataaaagacaacagagctgtacatgctgacatggggtactggatcgaatcagcactaaacgacacgtggaaaattgaaaaagcgtcttttattgaagtaaagtcctgccactggcctaagtctcataccttatggtctaatggagtacttgaatccgaaatgatcattcctaaaaattttgctggaccggtaagtcagcacaattacagacccggatatcatactcaaactgcaggtccttggcatctcggccgacttgaaatggacttcgacttttgtgaaggaaccacagtagttgtaacagaagactgtggaaatcgtggccctagcttacgaacaaccacagcatccggcaaattgataactgaatggtgctgccgaagttgtactttacctcctcttcgctatcgcggtgaagacggatgttggtatggaatggagattcggcccttaaaggaaaaagaagaaaatttggtcaacagtttggtaacggcagggcatggtcaaatcgataatttcagcttgggagtactaggaatggcactcttcctcgaagagatgttgaggactcgagtaggcactaaacatgctatcttattagtagctgtttcgttcgttatactaataaccggaaacatgagttttagagacctcggtcgtgtgatggttatggtgggggcaacgatgaccgatgatattgggatgggagtaacatatcttgctttattagcagcctttaaagtccggcccacttttgctgccggattactcctaagaaaactaacaagtaaagaattaatgatgacaacaattggaatagttttgttatctcaatcaactatacctgaaaacattctggaacttactgacgctttagctttaggaatgatggtgctgaaaatagtcagaaatatggaaaaatatcaactagcagtaactatcatggctatattatgcgtacctaatgcagtgattttacaaaacgcttggaaagtttcctgtaccaccctcgcggtggttagcgtcagtccattattactcacatcctcccaacaaaaggccgattggattccacttgctctcacaataaaaggattgaatccgacagcaatattcttaacaactctaagcagaacgagcaagaaacgctcctggcccctaaacgaagctattatggcagtaggcatggtctccatactcgcttcatcgttactgaaaaacgatataccaatgacaggaccccttgtggcaggaggcctattgacggtgtgctatgttttaacaggacgaagtgccgatcttgaattagaacgtgcagcggatgtccgctgggaagaacaagctgaaatctcaggtagttctcctattctctcgataacgatctctgaggacggttctatgtcaattaaaaacgaggaagaagaacaaacattgactatattgatacgcacaggtctattagttatttcgggtctttttccagtcagcatacctataacagccgctgcgtggtacctctgggaggtcaagaaacaacgcgcaggagttttgtgggacgtgcctagcccaccgccagttggaaaagccgaactagaggacggcgcatacagaattaagcaaaaaggaatattaggatactctcaaattggtgccggcgtatataaagaaggcacgtttcacactatgtggcacgtaactagaggggctgtactaatgcataagggtaaacgcatagaaccgtcatgggcagatgttaagaaagatctaatatcatacggcggagggtggaagttagagggagaatggaaagagggagaagaagttcaagtactagctctagagcctggtaaaaatcctagggctgttcaaacaaaacctggtttatttaagacaaacacaggtactataggtgcagtttctcttgatttctcgccaggcacctccggatctccaatagttgacaagaaaggaaaagtagttggactatatggtaatggagtagtaacaaggagtggcacatacgtaagcgcaatagcgcagactgaaaagtcaatagaagataatccggaaatagaagatgatatcttccgtaaaaagcgattgaccataatggacctacatccaggagccggaaaaactaaaagatatctgccggccattgtaagggaagccataaagagaggattgagaaccttgatactagcaccgactcgagtagtagcggctgaaatggaagaggctttacgagggctaccgatccgttatcaaactcctgctatccgtgccgagcatacaggcagggagatcgtagacctgatgtgtcacgcaacttttacaatgagactactctcaccgatccgagttccgaactacaatttaataataatggacgaggctcacttcacggaccccgcttctatagctgcaagaggatacatcagtactcgcgtagaaatgggagaggcagctggaatttttatgacagccactccacccggcagtcgggatccatttcctcaatctaatgctccaataatggacgaagaacgcgaaataccagagcgaagctggaacagtggtcatgaatgggttacagactttaaaggaaaaacagtgtggtttgtcccgtcaataaaagctggtaatgatatagctgcctgtctacgaaagaacgggaagaaagtaatccagctctctaggaagactttcgatagtgagtatattaagacgcggacgaatgactgggattttgttgttaccaccgacatatcagagatgggggcgaattttaaggcagaaagagtcatagatccgaggcgatgcatgaaacccgtaatactaacagacggtgaagaacgagtaattttggcagggccaatgcccgttacccatagctctgcagcccaacgaaggggtagagttggtcgcaaccctaagaatgagaacgatcaatatatctatatgggtgaaccactcgaaaatgacgaagattgcgcacattggaaagaagcaaagatgttactcgacaacatcaatacgcccgaaggcattattcctagcatgtttgaaccagaaagagagaaagttgacgctattgatggcgaatataggcttcgaggagaagccagaaaaacttttgtagacttgatgcgacgcggcgatcttccagtatggttagcctaccgggttgcagccgaagggataaactacgctgataggagatggtgttttgatggggtgaaaaataatcaaatactcgaggagaacgtagaagtggaaatatggactaaagaaggcgagcgaaagaaactaaaaccaagatggttagatgcccggatctattcagatccgcttgccttaaaagagttcaaagagttcgctgccggcagaaaaagtcttactctcaaccttattacagaaatggggagattaccgaccttcatgacacaaaaggctaaaaacgcattagacaatttggcagtacttcatacagcggaagctggcggtcgagcatataaccacgcactgtctgaactaccggaaactttagaaacactactattattaacacttctcgccacagtgaccggcggcatttttctatttttaatgtccgggaagggaatagggaagatgactctcgggatgtgttgtataataaccgcatctattttactatggtatgcgcagattcaacctcattggatagcagccagcataattctcgaatttttcctaatagtcttacttatacccgagcccgagaaacaacgaactccacaagacaaccagctcacatatgtcgttattgcgatattgacggttgtagctgcgacaatggcaaatgaaatgggatttttagagaaaactaagaaagactttggtcttggttcgattacgacacaacaacctgaatcaaatatcttagacatagacctgcgacccgcaagcgcatggactctatatgctgtagcaacaacctttattacacccatgttaagacattctattgaaaactcatcagtgaacgtttccctcacagctatagcgaaccaagcaaccgtgttaatgggcttgggtaaaggatggcctttgagtaaaatggatatcggggtcccactactagcgattggttgttactcacaagtcaatcctattaccctcactgcagcgttgcttctcctagttgctcactatgcaataatagggccaggacttcaagcgaaggccacccgagaggctcagaaaagggccgcagccgggataatgaaaaatccgacagtagatggtatgaccgttatagaccttgatcccattccatacgatcctaagttcgagaaacaattaggtcaagtgatgctcttagttctatgtgtcacccaagtactgatgatgagaacaacgtgggcactgtgtgaggcgctgacattagccacaggtccaataagtacgctgtgggaaggcaatccaggaagattctggaacacgacaattgctgtgtccatggctaatatttttcgaggctcatatctcgccggtgcgggattgttattttcgataatgaaaaatacggcaaacactcgaagaggaacaggaaacaccggagaaacgttaggagaaaaatggaaaaacagactaaatgcattaggaaaaagcgagtttcaaatctacaaaaagtcgggcattcaagaagtcgatcgtacattagcaaaggaagggataaaaaggggtgagacggatcaccacgcggtatcgagaggatccgcgaaacttagatggtttgttgaaagaaatctagttacacccgaaggaaaagtggttgatctaggatgtggacgtgggggttggtcgtattattgtggcggactcaaaaacgttaaggaagtgaagggcctaacgaaaggtgggccgggacacgaagaaccaattccaatgagtacctatggatggaatctagtacgactacaatctggagttgatgtctttttcacaccacccgaaaaatgtgatacattgttatgtgacataggcgaatctagtccgaatccaacagtggaagcagggcgaactctaagagtattaaacttagtagaaaattggctgaataataacacccaattctgtataaaggttcttaacccttacatgccttcagtcattgagaaaatggaagctctacaaagaaaatacggaggggcacttgttcgaaaccctctaagcagaaattctactcacgaaatgtactgggtttcaaacgctagtggaaatatcgtttcctctgtgaacatgatatcacgcatgttgattaatcgctttacgatgaggcacaagaaagcgacttacgaaccagatgttgacttaggtagcggcacaagaaatataggtatagaaagtgaaaccccaaatttagacataatagggaagcgtattgagaaaataaaacaagagcacgaaacaagctggcactacgaccaggaccatccttacaaaacatgggcgtatcacgggagttacgaaactaaacagactggttccgccagtagtatggtcaacggagtagtaagactattaacaaaaccatgggatgttataccgatggtcacccagatggctatgacagacacaacgccttttggacaacaacgtgtgttcaaagaaaaggtagataccaggacccaagaaccaaaagaaggaactaagaaactaatgaaaattacagctgagtggctctggaaagaactaggcaagaagaaaacgccccggatgtgtacgagagaagaatttactcgtaaagtacgctccaacgcagctttaggagctatctttactgacgagaataaatggaaatccgcacgagaagctgtagaagattcaggcttttgggaacttgtagataaagaaaggaatctccatctagaaggaaaatgcgaaacttgtgtctataacatgatgggaaaacgtgaaaagaagctcggggagttcggcaaagccaagggaagtcgagcgatttggtatatgtggttaggggcccgttttctagagttcgaagcgctcggcttcttaaacgaagatcattggtttagtagggaaaattccctgagtggcgtagaaggagagggcctccataagttaggctacattctgagagatgtttctaaaaaggaaggaggagcaatgtacgctgacgatactgcaggttgggacacaagaattacattagaggatcttaaaaatgaagaaatggttacaaaccacatggaaggtgagcacaaaaagttggcagaagctatatttaagctgacataccaaaacaaagtagtcagagttcaaagaccaactccgcgaggaacagttatggatataataagtagacgagatcaacgaggtagtggccaagttgtcacgtacggattgaatacattcaccaacatggaagcgcagctcatcagacaaatggagggagaaggtgtatttaaatctattcaacaactgaccgtaaaggaagaaatagcagtcaaaaattggttgattagagtcgggcgcgaaagacttagtaggatggccatttcaggcgatgattgcgtagttaaaccgttagatgatcggttcgcatctgctttaactgcactaaatgacatgggaaaagtacgaaaagacattcagcaatgggagcctagccgtggttggaacgattggacacaagtaccattttgctcacatcactttcatgaactaattatgaaggatggacgtgttcttgtagttccttgtaggaatcaagatgagcttatcggaagggcaaggatatcacagggagcaggctggtcgctacgggaaaccgcttgtttaggaaagagttacgcacaaatgtggtcattaatgtattttcacagacgtgatctgcggttagctgcgaatgctatttgtagcgctgttccgagtcactggattccaacttcacgaaccacctggagtatccatgctacacacgaatggatgacaacagaggacatgttaacagtatggaacagagtttggatacaagaaaatccttggatggaagataagacgccagtagaatcctgggaagagattccatacttaggaaaaagagaagatcaatggtgtggttccttaataggcctcacatcgcgtgcaacatgggcaaagaacatacaaacggcaataaaccaagtacgttcactcatcgggaacgaagagtacacagactacatgccatctatgaaacgctttagaagggaagaagaagaagccggtgtgctttggtaa

SEQ ID NO: 22246 - RNA, 9876 nt, synthetic construct
  misc_feature 1..9876: note = derived and/or modified CDS sequence (opt6) from DENV-2__KM279528__SS-prME
  source 1..9876: mol_type = other RNA
actgcaggaataataataatgatgatacccactgtaatggcatttcacttaaccaccagaaacggagaaccccatatgatagtatctcgccaagaaaaaggaaaatctctcctatttaaaactgaaaatggcgtaaacatgtgtaccctaatggcgatggacttaggcgaactatgcgaagacacaataacttacaattgcccactgctacggcaaaatgaaccagaagatatagattgttggtgtaacagcacttcgacttgggtcacatatggaacatgtacagccactggtgaacaccgtagagagaaaagatctgtcgcgttagtaccacacgttgggatgggactagaaactcgaaccgaaacatggatgagctcagaaggcgcgtggaaacatgcgcagagaatagagacatggatactaagacacccaggatttacaatcatggcggcgattttagcgtatacaatagggacaacatatttccaaagagttttaatattcatactcctcacagccgtcacaccatcgatggcgatgagatgtattggaatctcaaatagagactttgtcgaaggagtaagcgggggatcttgggtggatatagtgttagagcacggatcttgtgtcacgaccatggctaaaaataaacctacgttagacttcgaattgataaaaaccgaggccaaacatctagctacactaagaaaatactgtgttgaagccaaactgaccaacactacaacagcttcaagatgtcctacacagggggaaccaagcctaaatgaagaacaagataaaagatttgtttgtaaacactcgatggtagatcgcggatggggaaacgggtgcggtctgtttggtaaaggtgggatagttacatgtgcaatgtttacgtgtaagaaaaacatggaaggcaaagttgtgcagccagaaaatctcgaatatactattgtgataacaccacacagtggggaggagaatgctgttggcaatgacacaggtaaacatggaaaagaaattaaagtaacaccccaatcttctatcacggaagcagagctaaccgggtatggaaccgtaacaatggaatgttctccaagaacgggactagattttaatgagatggttttattacaaatggaaaataaagcctggttagttcacagacagtggtttctcgacttaccacttccctggctacccggtgcagacactcaaggatcgaattggattcaaaaagagacacttgttactttcaaaaatcctcatgccaagaaacaagacgtggtcgttttgggttctcaagaaggagctatgcacacggcactaaccggagcaacagaaatccaaatgtcaagcgggaatttattgtttactgggcatttaaaatgccggcttagaatggacaaactccaattaaaaggaatgtcatattcaatgtgtactggtaaatttaaagttgtaaaagaaattgcagaaacgcaacatggaactatagtcataagagtccaatatgaaggtgatgggtccccttgtaaaattccttttgaaattatggatcttgaaaaacggcatgttctgggacgattaattactgtgaacccaatagtaaccgaaaaagattcgcctgtcaacatcgaagctgaaccaccatttggtgattcatacatcattataggagtcgaaccagggcaacttaaattgtcttggttcaagaaagggagtagtatagggcaaatgttcgagacaacaatgagaggggccaaacgaatggcaatactaggcgacaccgcatgggacttcggaagtctcgggggagtatttacatctatagggaaagccctccaccaagtatttggagctatatatggagcagcattctccggagtgtcatggactatgaaaatccttataggggtcgtcatcacgtggataggaatgaatagcagatcaacttcactttccgttagcttagtacttgtaggtgtagttactctgtacttaggagtaatggtccaagcagatagcggatgtgttgttagctggaaaaacaaagagcttaaatgtggaagcggtatcttcatcacggataatgtccacacctggactgaacaatataagtttcagccagaaagtcctagtaagttggcttctgcaatccaaaaagcacacgaagagggaatatgtggtattcgttcggttaccagactcgaaaaccttatgtggaagcagataactccagaattgaatcatattcttacagagaatgaggtaaaactaaccataatgaccggtgacataaaaggaattatgcaagccgggaaaagatcattaagaccacaacctactgaattgaaatattcgtggaaagcatggggaaaagcaaagatgctgagcaccgaactacataatcacacgttcttgatagatggaccggaaactgcagaatgcccgaatactaatagagcttggaactcactagaagtagaagactatggatttggagtctttactaccaacatctggttgaaactaaaagaacgccaggacgtattttgtgacagtaaacttatgagcgcagctattaaggataacagagcagtgcatgcagatatgggatactggatagagtctgcacttaacgacacatggaaaattgagaaggcttcgttcatcgaagttaagtcatgtcattggcccaaaagtcacactttatggtcaaatggtgtattagaatcagaaatgataataccaaagaatttcgccggtcctgtctcacaacataattatagacccgggtatcatacacagacggctggtccatggcacctgggaagattagaaatggatttcgatttttgtgagggtacgactgtagtcgtcacagaggattgtggcaacagaggaccatctctaagaacaactactgcctcagggaagctgattacagaatggtgttgtagatcgtgtactttgccacccctcagataccgtggcgaagacggatgctggtatggtatggaaatcagaccacttaaagaaaaagaggaaaacttagtaaatagcttggttacggcgggacatggccagattgacaatttttcgcttggcgttttaggcatggcactcttcctcgaagaaatgctacgaacacgagttggtaccaagcacgcgatactattagttgcagtcagcttcgtaacactaataactggaaacatgtcttttcgtgatcttggaagggtgatggtaatggttggagcaacaatgactgatgacatcggcatgggtgttacttatctagccctgctagcagcctttaaagtacgtccaacattcgctgcaggtttgttgttgaggaaactaacttcgaaagagttaatgatgactaccataggaattgtcttgctttctcagagcactataccgaaaagtatcttggaactaacagatgcgttggcattaggcatgatggtactaaaaatcgtcaggaatatggaaaaatatcaattagcagtcactattatggctatcctttgtgtaccaaatgcggtaatattacaaaacgcgtggaaagtgagctgcaccactctagcagtagtgtccgtatcgccactactgctgacctcatctcagcaaaaggctgattggattccactcgctttaactataaaaggactaaatccaacagcgatatttcttacgacattgagtcggacttccaagaagcgaagctggccattaaacgaagctattatggcggtaggtatggtctcaatactagccagcagtctcttgaaaaacgatattccaatgacaggacccctcgttgcagggggattattgacagtctgttacgtacttacaggaagatctgcggatctcgaactcgaacgtgccgcagatgtccgctgggaagaacaagccgagatcagcggatcaagcccgattttgtccattacgataagtgaagacggcagtatgagtatcaaaaatgaagaggaagaacaaactctaaccatcctgatacgtacgggtctattggttatctccgggcttttccctgtcagcattcccataaccgcggccgcatggtatttgtgggaagtgaagaaacagcgcgcaggagttctatgggatgtcccatcacctcccccagtgggaaaagcagaattggaagatggagcatatcggattaaacaaaaaggaatcctagggtactcacaaataggtgcaggagtttataaggaaggcacatttcacactatgtggcatgttacccggggcgcagttttgatgcataaagggaaacggatcgagccaagctgggcagacgtgaagaaagatttgatttcatatggaggaggatggaaacttgaaggagaatggaaagagggagaagaagtgcaagtcctggccctagagccaggcaaaaatcctcgggcagttcaaactaaacccgggttgtttaaaaccaacacgggaacaattggtgctgttagtctagatttcagtccaggaacatccggatcaccgatcgtagacaagaaaggaaaagttgtgggcctatatggtaatggtgtagtcactcgaagtgggacatatgtaagtgccatagctcaaaccgaaaagtccatcgaggataaccccgaaatagaggacgatatctttcgtaagaaaagactaactatcatggacctccaccctggcgcgggaaaaacgaaacgatatttaccggcaattgtaagggaagcaataaagagaggtcttcgaacattaattcttgctccgaccagagtggtagccgccgaaatggaagaagcacttagaggactccccattagatatcaaactccagcgatcagggctgaacacacagggcgagagatagtggatctaatgtgccacgccacctttacaatgagacttttaagtccaatcagggtaccaaactataatttgattattatggatgaagcacactttacagatccagcaagcatagcagcacgaggttatataagtacaagagtcgaaatgggtgaagcagcgggaattttcatgacagcgacaccacccgggtccagggatccattccctcaaagtaatgcacctataatggatgaagaacgcgaaatccccgaaaggtcatggaactctggacacgagtgggtcacggactttaaaggaaagactgtttggtttgtaccttcgatcaaggcaggtaatgacatcgcggcctgcttgcgcaaaaacgggaagaaagtaatacaattatctcgaaaaacgtttgattctgagtatattaaaacacgtacaaacgattgggattttgttgtgacaacagatataagcgaaatgggtgcgaacttcaaagcggagagggttatcgacccaagaagatgcatgaaacccgtaatcttaactgacggcgaagaacgtgtaattctagcagggccaatgccagtaacgcacagctccgcagcacaacgcagaggacgagttggtaggaatcccaaaaacgagaatgatcaatacatttacatgggtgaaccgttggaaaacgacgaggattgtgcacactggaaagaagccaaaatgctactcgacaatattaacacacctgaaggcattattccatcaatgtttgagccagaaagagagaaggtggacgcgattgatggggaatatagattaagaggagaagcacgtaaaactttcgttgatttgatgagacgcggggatctaccggtttggcttgcttatcgagttgccgctgaagggattaactatgcagatcgtcgatggtgcttcgacggggtcaaaaacaatcaaatcttagaagaaaacgtagaggtagaaatatggactaaagagggagaaaggaagaaattaaaacctagatggttagacgcacgaatctatagtgatccactcgcattaaaggaatttaaagaatttgccgccggaagaaaatcgcttacattaaatttaataacagaaatgggaagactaccaaccttcatgacacaaaaagctaagaacgcgctagataatttagcagtgctgcacactgccgaagcgggaggacgtgcatacaatcacgctctcagtgaactgcctgaaaccctggaaactttactgctgctaacgctgctcgcgaccgttaccgggggaatattccttttcctaatgtctgggaaaggaattggaaaaatgacgttaggcatgtgctgtataattacggccagtatactattatggtacgctcaaattcagccacattggatagctgcgagtataattcttgagttctttttaattgtccttctaatccccgagccagaaaaacagcgaacgccacaggataatcagttaacatacgtcgtaatagcaattttaacagtggtagctgccacgatggctaatgagatgggatttttagagaaaaccaagaaagactttggactgggatccataaccactcagcaacccgagtcaaatatcttagatatagatcttcgacctgctagcgcatggaccctatatgctgtggcaaccactttcataacacccatgcttagacattcaatcgaaaatagttcagtcaacgtaagcctgactgctatagctaaccaagctacagtattaatgggattaggtaaaggatggccactctctaagatggatattggggttccactattagcaattggatgctactcgcaagtaaacccaataacactaactgcagcattattactgctagttgctcactatgcaattataggtcctgggctacaagctaaagcgacgcgcgaagcacaaaagcgcgcagcagctggaattatgaaaaatccaacagtagatggaatgacagtgattgatttagatccaattccttacgatcctaaattcgaaaagcagttaggacaggtaatgttactggtcctatgtgtgacccaagtactaatgatgagaacaacatgggccctctgcgaagcccttaccctagcaactggtccaatttctacattatgggaaggaaacccgggacgattctggaacactacgatagcagtctctatggctaatatattccgtggatcttatctagctggagcaggactcctgtttagtattatgaagaatactgcaaatacccggcggggtacaggcaatactggcgagacgttgggagaaaaatggaaaaatcgtctgaacgcgcttggaaagtcagagttccaaatatataagaaatcaggaatacaagaggtagatcgaactctcgctaaagaaggtatcaaaagaggcgaaactgaccaccatgcagtgagtcgaggttccgccaaacttcgatggttcgttgaacggaatttagttactcccgagggtaaagtcgtagatctcggatgtggtagaggcggatggtcctattattgtggaggattgaaaaatgtaaaagaagtaaaaggtctaacaaagggtggtccgggacatgaagaacccataccaatgagtacatatggctggaaccttgtgcgattgcagtcgggggtagacgtcttctttacaccccctgaaaaatgcgatactctactgtgcgacataggagagagtagtccgaatccaacagttgaggcaggtagaacattaagggttttgaatctagtggaaaactggttaaacaataacacacaattttgcattaaagtcttaaatccttacatgcccagtgtaatcgagaagatggaagcattacaacgaaaatatggaggtgccctcgtgagaaatccgctatcccgaaattcgactcatgaaatgtattgggtttccaatgcttccggtaatatagtcagtagcgtgaatatgatctctaggatgttaataaataggttcaccatgagacataagaaagcgacttacgaacctgacgtagatctgggttcagggacgcgcaatataggaatagagtcggaaacccctaatctggacattataggcaaaagaattgaaaagattaaacaggagcatgaaacgtcctggcattatgatcaggatcacccctacaaaacttgggcctaccacggatcgtacgaaaccaaacaaacaggtagtgcatcaagtatggttaatggtgtcgttaggttattaacaaaaccatgggatgtaattcccatggtaacacaaatggcaatgactgatactacaccatttggccaacaaagagtatttaaagaaaaggtagacactagaacacaggaaccaaaggaagggactaagaaactgatgaaaataacagccgaatggttatggaaggagcttgggaagaagaaaactccaagaatgtgtaccagagaggagtttactcgaaaagtgagatctaacgctgcacttggagcaatatttacagatgaaaataaatggaaatcggcgagagaagcggtcgaagactccggattctgggagctggtagataaggagcgaaaccttcacctcgagggaaaatgcgagacctgcgtatataacatgatgggcaaacgggagaagaaattaggagagtttggaaaggcgaaagggtcacgagcaatctggtacatgtggctaggagcgagattcctcgagtttgaggcactaggattccttaacgaagaccattggttttctagagaaaattcattaagcggagtagaaggtgagggtttgcacaaactaggatacatattgagagatgtgtcgaagaaggaaggtggagcaatgtatgccgacgacacagcgggatgggataccagaataactcttgaagatctaaagaacgaagaaatggtgactaaccatatggagggagaacataagaaattggcagaagcgatatttaaactaacctatcaaaacaaagttgtccgtgttcaacgacccactccgcggggcacagtaatggatataatctcaagacgcgatcaacgtggttctggccaggttgttacgtacgggctgaatacattcacaaatatggaggcgcagctcataaggcaaatggaaggggagggagtatttaaaagtatccagcaattaacagtgaaagaggaaattgccgtcaaaaactggttgataagagtgggaagagaacgtcttagtagaatggcaattagtggtgacgattgcgtagtgaagccactagacgacagatttgcatcggcattaacagcgttaaatgatatgggtaaggtacgcaaagacatacaacagtgggagccaagcaggggatggaacgattggactcaggtaccattttgttcacaccactttcacgagttaataatgaaggatggccgtgtattagttgtgccttgcagaaaccaagatgaactaataggtcgggctcggatatcccagggagccgggtggtcactgagggagacagcatgtctagggaaaagttatgcccagatgtggagcttaatgtacttccacagacgtgacctccgtttagcagcaaacgcaatctgttcggctgtacccagccattggattccaacaagcaggaccacatggtccatacatgcaacacacgagtggatgaccactgaagatatgctaacagtttggaatagagtctggatacaggaaaatccatggatggaggataaaaccccagtagagtcatgggaagaaatcccttacttagggaaaagagaggatcaatggtgtgggtctttaataggtctcacatcacgcgctacatgggccaaaaatatacaaacggcgataaatcaagtaagatcattgatagggaacgaagaatacactgattacatgcccagcatgaaacggttccgaagagaagaagaagaagcaggagtactgtggtaa

SEQ ID NO: 22247 - RNA, 9876 nt, synthetic construct
  misc_feature 1..9876: note = derived and/or modified CDS sequence (opt6) from DENV-2__KM279533__SS-prME
  source 1..9876: mol_type = other RNA
acagcgggtataataataatgatgattccaacggtaatggcatttcatctaaccacaaggaatggtgaaccacatatgatcgtcagtagacaagaaaaaggcaaaagcctattgtttaaaacggaaaatggagtcaacatgtgcactctaatggcaatggatctaggagaattgtgcgaagacacaataacctataattgtccactactacgccaaaatgaaccggaagatattgactgctggtgtaattcgacgagtacctgggtcacatacggaacctgtaccgcaacaggagaacatcgacgtgagaaacgaagcgtagcattggtacctcacgtaggaatgggtttagaaacacgaaccgaaacatggatgagcagtgaaggagcatggaaacacgcacaaaggatagaaacctggatcctacgccacccaggattcacaataatggctgcaatcttggcgtataccataggaacgacttattttcaacgtgttttaatctttatactattaacggccgtcactccctcgatggcgatgcgttgcataggcatctcgaatcgcgatttcgtcgagggagtatccggtggaagctgggtagacattgtattagaacatgggtcatgcgtaacaacaatggccaaaaataaacctaccctagacttcgagctaataaaaactgaagcaaaacatctagccaccctaagaaaatattgtgtggaggcgaaattaacaaacacgactacagcatctcgttgccccacccaaggtgaaccctccttaaatgaagaacaagataaacgcttcgtatgtaaacattcaatggttgaccgaggctggggaaacggctgcggattattcggtaaaggtggaatagtgacgtgtgcaatgttcacatgcaagaaaaatatggagggtaaagtggtacaacccgaaaatttagaatatacaatagttataacacctcatagtggtgaagaaaatgcagtaggaaatgacacaggtaaacatgggaaggaaattaaagtaaccccgcaaagctctattaccgaagcggaattaacgggatatggaacagttacaatggaatgcagcccaagaacaggattagattttaatgaaatggtgttactacagatggaaaacaaagcatggctcgtacaccggcaatggtttctcgatctaccattaccatggctaccaggagcagatactcaaggatctaattggatacaaaaggaaacactcgtaacttttaagaatccccatgccaagaaacaagacgtcgttgtattaggatcgcaagagggagccatgcataccgcactcacgggtgcaacggaaatccaaatgtcgtctggaaacttattgtttacgggacacctaaaatgtagattaaggatggacaagctccagctgaaaggaatgagctacagtatgtgtactgggaaatttaaagtggtaaaagaaattgcggaaactcagcatggaacaatagtgataagagtacaatacgaaggcgatgggtcaccatgtaaaatcccatttgaaataatggatttagaaaaacgacacgtacttggacgattaataactgtaaacccaattgtaacagaaaaagatagccccgtaaacattgaagcggaacctccatttggagattcctatataatcataggggtcgaacctggccaactaaaactatcatggtttaagaaaggttcaagcataggtcaaatgtttgaaacaactatgagaggtgcaaaacgaatggcgattttaggcgacacagcctgggattttggctccttaggtggagtatttacatctattggaaaagcactacaccaggtttttggtgccatttatggcgcggcctttagcggggttagttggacaatgaaaatactaataggggtagttattacttggatcggtatgaactcacgaagtacgagcttgtccgtatccctagtcttagtaggagtcgtaactttatatctgggggtaatggtacaagccgatagtggatgcgtagtcagttggaaaaacaaagaactaaagtgtgggtcaggcatatttattacagacaacgtacacacatggacagaacagtataagttccaacctgaatctccaagtaagctagcctctgcaatccaaaaggctcacgaggagggcatatgtggaatacgaagtgtcacaaggcttgaaaatttaatgtggaaacagatcactccagaactgaaccacatcttaacagagaatgaagttaaattaacaatcatgactggggatatcaaaggaataatgcaagcagggaaaagatcactaagaccgcaaccaactgagctaaaatactcctggaaagcgtgggggaaggctaaaatgctaagtactgaactgcataaccacacatttcttattgatggaccagaaactgcagaatgcccgaatacaaatagggcttggaatagtttggaggtagaggattacgggttcggtgttttcaccacgaatatctggctaaagttaaaggagagacaagatgtattctgtgatagtaaacttatgagtgcagctatcaaagacaatcgagcagtacacgcagatatgggatactggattgagtcagcattaaatgatacatggaaaatagagaaggcaagtttcatcgaagtcaaatcctgtcattggcccaaaagtcacactttatggtcgaacggtgtcctagagagtgaaatgatcattcctaaaaatttcgctggcccggtaagtcaacataactaccgaccgggttatcacacacagacagcgggaccttggcatcttggacgattagaaatggactttgatttctgcgaggggacgactgtagtagtcacggaggattgcggaaatagaggaccctcattaaggacaactacggcatccgggaaactaataaccgaatggtgttgcaggtcttgtacattaccaccattgagatatcggggagaagatggatgttggtatggaatggaaataagaccattaaaagaaaaggaagagaatctagtaaattcgctcgtaacagccggtcacggacaaatagataatttcagccttggtgtcttgggtatggccctatttttagaagaaatgcttagaactagagtaggaaccaaacatgctatattactcgtagctgtttcattcgtcacactaattactggaaatatgtcctttagagatcttggaagagttatggttatggtcggagctacaatgaccgatgatatcggtatgggagtaacatatttagcacttctagcagcttttaaagtaaggcctacatttgcagcgggtcttctccttaggaaactaactagcaaagaacttatgatgaccacaataggaattgttttactatctcaaagtacaataccagaatcaattcttgagcttacggacgctttagcactagggatgatggtactaaaaatagttcgtaatatggaaaaataccagctggctgttacaatcatggcaatattatgcgttccgaatgcagtaatccttcaaaatgcctggaaggtatcttgtactactcttgcggtcgtatcggtgagtcccttattattgacaagtagtcaacaaaaagctgattggataccattagctttgacaataaagggactaaaccctactgctatctttctaactacgttgtcaagaacaagtaagaaacggagttggccactcaatgaagcaatcatggctgtaggaatggtcagtatactcgcgtccagcctactgaaaaatgacattccaatgactgggccattggtagccggcggtcttttaaccgtatgttatgtactaacaggtcggagtgctgatttagagctagaaagggcagctgacgtcagatgggaggaacaagcagagatatcaggaagctctccaatcttatcaattactataagtgaggatggatccatgagcatcaaaaatgaggaagaggagcaaacattaaccatactaatcagaacagggctcctagtaattagtgggttatttcctgttagcattccaattacggccgcagcatggtatttgtgggaagtcaagaaacaaagagcaggcgtactttgggatgttccatctccaccacctgttggaaaagcagaacttgaagatggagcgtataggataaaacaaaagggaatactaggttacagtcagataggcgccggggtttacaaagaaggcacattccatactatgtggcatgtcacccggggtgcagtactcatgcataaaggaaaacggatagaaccctcatgggccgatgttaaaaaggatttaatatcatacggtgggggatggaagttagaaggggagtggaaagagggtgaagaagtccaagtactggcattagaaccaggtaagaacccaagggccgttcaaaccaagcccggattatttaaaacaaacacgggcacaatcggtgctgtgagtctagatttcagccccggaacaagcggaagcccaattgttgataagaagggcaaagtagtaggtctttacgggaatggcgttgtcacaaggagcggaacatacgtatccgccatcgcacaaacggagaaatcaatcgaagataatccagaaatagaagatgacatctttaggaaaaagcgactaacaataatggaccttcaccctggtgcaggaaaaacaaaaagatacttgccagcgatagtaagagaagcgattaaaagaggtttacgcacattaatacttgcaccaaccagagtagtagcagccgaaatggaagaagcactaagaggtctacctatcagatatcagactcccgctattagagctgaacatacaggacgagagattgtagacctgatgtgtcacgcaacttttactatgcgattactatcaccgatccgagtcccgaactataatcttataattatggacgaagcccattttacagatccggcatcaatcgctgccagggggtatatatccacacgggtagaaatgggtgaggcagcagggatattcatgacagcgaccccaccaggctcaagagacccttttccacagtcaaatgcaccaataatggacgaagaaagagaaatacctgagagatcttggaactctggccatgagtgggtcacggacttcaaaggaaaaacagtatggttcgtaccctcaattaaggccgggaatgacatagcggcatgtttaagaaagaacggtaagaaagtcatacaactaagcaggaaaacttttgattctgaatatattaaaaccagaacaaatgattgggatttcgtcgttaccacagatataagcgagatgggtgctaactttaaagctgaacgcgtaattgacccacgtcgatgtatgaagcctgtaatcctcactgatggggaagaacgggtaatcctggctggacctatgccagtcacgcactcatctgctgctcaaagaagagggagagtaggacgaaatccgaaaaacgaaaatgatcaatacatatatatgggcgaaccccttgaaaacgacgaagattgtgcacattggaaagaagcaaaaatgctcctagacaatataaacacaccggaaggaatcattccatctatgttcgaacctgaaagagaaaaagtcgatgcaattgacggtgaatacagattaagaggtgaggcacgaaaaacttttgtcgatttaatgcgccgaggagaccttccggtttggctagcctatagggttgcggcggaggggataaattatgcagatagacgatggtgcttcgatggagttaaaaataatcaaatcctcgaagaaaacgttgaagtagaaatctggactaaagaaggggaacgaaagaaacttaagccaagatggctagacgcccgtatatatagtgaccctctagccttaaaagaatttaaggaatttgcagccggaaggaaaagtctaaccttaaacctaatcacagagatgggaagactacccactttcatgacacaaaaagcaaagaatgccttagataatctggccgtattacatacggcagaagcaggaggtagagcttacaatcatgcattaagcgaactgcctgaaacactagaaacactcctattgcttacattactagctactgtaacaggaggaatttttctttttcttatgtcaggaaaggggatagggaaaatgactttaggaatgtgctgtataattacggcatccatcttactgtggtatgctcaaatacagccacactggattgcagcctccatcatactggagttctttctaattgtactcttgattccagaacctgaaaagcaaaggacgccacaggacaatcagttaacatatgtagtcatagctatcctgacggtcgtagcagcaacaatggctaatgaaatgggatttctggagaaaacaaagaaagacttcggactcggatcaataacaactcaacagcctgagtccaacatcttggatatagatttaagacctgcgagcgcgtggactctatacgcggtagcaacaacctttatcactccaatgttgcggcactcgatagaaaattcttcagtaaatgtatcgctcacagccatcgctaatcaagctacggttttaatgggcctcggcaaaggctggcccctgtcaaagatggatattggggtaccactgctagcaatagggtgctattctcaagtaaacccgataacattaaccgctgcactattgctcctagttgcgcactacgcaattatcggaccggggctacaagccaaagcaactagagaagcacagaagagagcggcagctggtatcatgaaaaacccaacggtggacgggatgactgttatagatttggatcccataccgtacgacccaaagttcgagaagcagttaggacaagtaatgcttctggtactatgcgtgacgcaggttttaatgatgagaaccacttgggctctatgcgaagcgttaacgttagccactggacctatatctacattatgggaaggtaatccaggtaggttttggaatactacaattgctgtaagcatggccaatatatttaggggatcctatctagccggtgctggtttactcttctcaataatgaaaaacacagcaaatacacgcaggggtacgggtaacacaggtgaaaccttaggagaaaaatggaaaaatagattaaacgcattgggaaaatcagaatttcaaatttataagaagtctggaatacaagaagttgatagaaccctagctaaggaagggataaaaaggggcgagacagatcatcacgctgttagcaggggcagcgcaaaacttagatggtttgtcgaaagaaacctagttacacccgaagggaaggtagtcgatctaggatgtggacgtggaggttggtcatattattgcggaggactcaaaaatgtgaaggaagtaaaagggttgacaaaaggtggaccgggacatgaggagccaatacctatgtctacttatggttggaacttagtacggcttcagagtggtgttgacgtattctttaccccgccagaaaaatgcgatacactattgtgcgatattggagaaagttcacccaatccaactgtagaagccggaagaactttaagagtgttaaatttagtagaaaattggttaaataataatacgcagttctgtataaaagtgctgaatccctacatgccatctgttattgagaaaatggaagctctgcagcgtaaatatggaggcgctctagttcgcaatccattatccagaaattctacgcacgaaatgtattgggtgtccaacgcatctggaaacattgtatcttccgttaatatgataagccgaatgctgataaatagattcacaatgagacataagaaagcgacatatgagcccgatgtagatttaggatcgggaacaagaaatataggcatcgaatccgaaacgcctaatttagacattatcggtaagcggatagagaaaataaagcaagaacatgaaacctcttggcactatgatcaagaccatccttacaaaacatgggcttatcatggcagctacgaaactaaacaaaccggcagcgcatctagtatggtgaatggtgtagttagattattgaccaagccatgggatgtcatacctatggtgacgcaaatggcaatgactgatacgacaccattcggacaacaaagggtatttaaagaaaaggtagatacgcgaacccaggaaccgaaagaaggtaccaaaaagctcatgaaaataacagctgaatggttatggaaggagctcggcaagaagaaaacgcctcgaatgtgcacgagagaagaatttacccgtaaagttcgtagcaatgcggccctgggggcgatattcacagatgaaaataaatggaaaagcgcaagagaagcagtagaagattccggattctgggagctagttgataaggaaagaaatctccatttagagggtaaatgcgaaacatgcgtgtataatatgatggggaaaagagaaaagaagttgggagagttcgggaaggctaaggggtcgagggcaatatggtatatgtggctaggtgcccgatttttagagtttgaggctttaggatttctaaatgaggatcactggtttagccgggaaaactcgttaagtggtgtggaaggggagggactacataaattaggttacatcctaagggacgtaagcaagaaagagggtggcgccatgtatgcggatgatacagccggctgggatactagaataacgcttgaggaccttaaaaatgaagaaatggtcactaatcatatggaaggcgagcataagaagctagcagaagccatttttaagttgacataccaaaataaagttgtacgagttcaaagacccacacctcgtggtacagtcatggatatcatatccagacgagatcaacgaggatcaggtcaagtagtcacatatggcttgaatacctttaccaatatggaagcacaattaattcgacaaatggaaggagagggagtttttaagtcaatacagcaattaacagttaaagaagaaatagcggtgaaaaattggttaatacgggtcggacgagaaagattaagtagaatggcaatatcgggcgatgattgtgtggttaaaccattagacgatcgctttgcgtccgcgttaactgctctaaatgatatgggaaaagttagaaaagacatccagcagtgggaaccatctagaggatggaacgactggacacaggtaccattttgctctcatcattttcacgagttgatcatgaaagatggaagagtattggttgttccatgtaggaaccaagacgagctaattggacgagcgcgaatctcacaaggcgccggctggagcctgagagaaacagcatgcctaggcaaaagttatgctcagatgtggtccttaatgtactttcataggagagatttgcgacttgcagcaaacgcaatttgcagtgctgtgcccagccactggataccaacatctcgaacaacgtggagtatacacgcgactcatgaatggatgacaacagagaacatgttaactgtttggaatagagtctggatacaagagaatccatggatggaggataaaacacctgttgaatcgtgggaggaaataccctatttaggcaaacgagaagaccagtggtgtgggtcactcatcggtctgacttcaagggccacatgggccaaaaatatccagacagctattaaccaagtaaggagtcttataggaaatgaagagtataccgattatatgccgagcatgaaaagattccgcagagaggaagaagaagcaggagttctatggtag

SEQ ID NO: 22248 - RNA, 9876 nt, synthetic construct
  misc_feature 1..9876: note = derived and/or modified CDS sequence (opt6) from DENV-2__KM279535__SS-prME
  source 1..9876: mol_type = other RNA
accgcgggcataataattatgatgataccaacagtaatggcttttcacctaacgacaagaaacggagaaccacacatgattgtaagtcgacaagaaaaaggtaaatcattactttttaaaacagaaaatggcgtgaatatgtgcacattaatggcgatggacttaggggaattatgtgaagatacaatcacatacaattgtccgctacttcgtcagaacgaaccagaagacattgattgttggtgtaattctacaagtacatgggtgacatacggaacatgtacagccactggtgaacataggagagagaaaagatcagtagcgctagttccacatgtaggaatgggactcgaaaccagaacggaaacttggatgagttcagaaggtgcgtggaaacacgcacaaagaattgaaacgtggatacttaggcatcccggattcacgataatggccgcaatactagcctatacaatcgggaccacttactttcaaagggtgttaatattcatattgttaacagccgtaactccctcaatggcaatgagatgcataggaatatccaatcgtgactttgtagaaggcgtaagcggaggaagttgggtcgacattgtattggaacacggatcctgtgtaacaacgatggctaaaaataaaccgactcttgattttgaacttattaaaacagaagcaaaacacttagcaacactacgaaaatactgtgtggaagctaaattgaccaacacaacaacagcatctcgttgtcccacacagggagaaccgtcgttgaacgaagaacaagataaacgatttgtatgcaaacatagtatggtcgatcgagggtggggcaatggatgtggactatttgggaaaggaggaatagtcacttgcgcaatgtttacttgtaagaagaacatggaaggaaaggtcgtccaaccagaaaatttggaatataccatagtcattaccccacacagtggtgaagaaaatgcagtaggaaatgatactggaaaacacggaaaagaaataaaagtaactcctcaatcatcaataacggaagcagaattgacagggtatggcactgtaacgatggaatgcagtccacgaacggggttagatttcaacgagatggtacttttgcagatggaaaacaaggcctggttagtacacagacaatggttcctcgatttaccgcttccatggttgcccggtgcagacacacagggatctaattggattcaaaaggaaaccttagttaccttcaaaaatccgcatgccaagaaacaagatgtcgtagtactcggaagtcaggaaggcgcaatgcacactgcattgaccggagcaaccgagatccaaatgtcgtcaggaaatctattatttaccggtcacttgaaatgcagactaagaatggataagctgcaattaaagggtatgagctatagtatgtgcactggcaaattcaaagtagtaaaagagattgcggaaacacaacacgggaccattgtaatccgagtacagtacgaaggggacggtagtccctgcaaaataccctttgaaatcatggacctagagaaaagacacgttttaggaaggctaatcacagtaaatcctattgtcactgagaaagattcgcccgttaacatagaagcagagcccccatttggtgatagctatatcataataggggtcgaaccaggacaattaaaactttcttggtttaagaaaggtagtagtataggccagatgtttgaaactaccatgaggggcgcaaaaagaatggctatattaggtgacacagcctgggacttcggatcgttaggcggtgtgtttacaagcattggaaaagcactccatcaagtctttggcgccatatacggcgccgcttttagcggggttagctggactatgaagatactcataggggtggtaataacatggataggcatgaactcacgaagtacgagtttgtcagtaagtctcgtgctggtaggagtagttactttatatctcggagtaatggtacaagcagactctgggtgcgtagtctcatggaagaataaagagctaaaatgcggaagtggtatatttattaccgataacgttcacacatggacagaacagtacaaattccaaccggaatcgcctagtaaactagccagcgcgattcaaaaagctcacgaagaaggtatctgcggtataaggtctgtaactcgtctggaaaacctcatgtggaaacaaattacgcccgaattaaatcatatacttactgaaaacgaagttaaacttacaatcatgacaggcgatattaaagggataatgcaagcgggaaaaaggtcactacgcccgcaaccaaccgaattaaaatattcctggaaagcctggggaaaggccaaaatgttatccacggaactacataatcatacctttctgatagatggaccagaaaccgctgagtgccccaacacaaatagagcatggaatagtctagaagtagaggattatggttttggcgttttcactacaaatatctggctaaaattaaaagagcgacaagacgtattttgtgattcaaaattaatgtctgcagccataaaggataatagggccgtacatgcagatatgggctactggatagagtctgcactcaatgacacgtggaagatagagaaagcgtcgttcatagaggttaaatcctgccattggccaaagagccacacattatggagtaatggagtactggagtctgaaatgatcatacccaagaacttcgctgggccggtaagccaacataattatagaccagggtatcatactcaaacagctggtccatggcatctggggcgtcttgaaatggactttgatttctgcgaaggcacaactgtagtagtaactgaagattgtggaaaccgtggaccatcccttcggactacaacggcgtcaggaaaacttataactgaatggtgctgccggtcgtgtacgctacctcccctacgttatcgaggcgaagatggatgttggtatggtatggaaataagacccttaaaggagaaggaggaaaatttagtaaactcactcgttactgcaggacacggccaaattgataacttctccttaggtgtattgggaatggccttatttctggaagagatgcttagaacgcgcgtgggaacaaaacacgctatcttattggtggccgttagcttcgtcactctaattacagggaatatgtcattcagagatttggggcgtgttatggtaatggtaggagcgacaatgactgacgacattggtatgggtgtcacctacttagcacttctagcagcttttaaagttagaccgacatttgcagcaggactattgttgagaaaacttacttcaaaggaactcatgatgacgaccataggtatagttttattaagccaatccactataccggaatcaattcttgagcttactgatgctctagccctgggaatgatggtactaaaaatagttcgaaatatggaaaaataccagcttgctgtcactataatggcaatttcatgtgtcccaaatgctgtgatactacagaatgcctggaaagtgtcatgtacaactttagcggtcgtaagtgtttctccacttttgttaacctcttctcaacaaaaagctgattggatcccattagccttaacgataaaaggtctcaacccaactgcgatatttctgaccacactaagtagaacgagtaagaaaagatcttggccattaaatgaagcaataatggcagtaggtatggtatcaattctcgcgagctcactgctcaagaatgatataccaatgactggcccacttgttgctggtggcctgcttacggtgtgctacgttctaacagggcgatcagctgatctggaacttgaaagagcagccgatgtacgttgggaagaacaagctgaaattagcgggagctctcccatacttagtataacaatcagtgaggacggtagcatgtctattaaaaacgaagaagaagaacagacattgacaatactcatcaggacaggcctgttagtaatatcagggctgtttccggtaagtatacctatcactgctgctgcatggtacttgtgggaagtaaagaaacaacgagctggtgttctgtgggacgtaccgtcaccacctccagtaggaaaagccgaactagaggacggtgcttatagaatcaaacagaaaggcatacttggctattctcaaattggagctggggtttataaggaaggtacttttcacacaatgtggcacgtcactcgtggagcagtattaatgcacaagggaaaaagaatagagcctagttgggcagatgtgaagaaagacttgattagctatgggggcggttggaaactagaaggcgagtggaaagagggcgaagaagtgcaagtgttggccttagaacctgggaaaaatccgcgcgccgtacaaacaaagccaggactcttcaaaactaacaccggtacaataggggccgtatctcttgacttcagtccggggacgtccggtagcccaattgtagacaagaaaggaaaagtagtgggcctttatggaaacggcgttgttactcgctcgggtacttacgttagtgcaatagcacaaactgaaaagtcgattgaggataacccagaaattgaggacgatatctttaggaagaaaaggctaactattatggacctacacccaggagctggaaaaacaaaaagatatttgcccgcaatagtgcgcgaagccattaaaagaggcttacgtacgttaatattagctccaacccgagttgtcgctgctgagatggaagaagcactcagaggtttaccaataaggtatcaaacacccgcaataagagcagaacacaccggcagagaaatagtagatcttatgtgtcacgcgacttttacgatgagattattatctccaattagagtaccgaactataatctaattataatggatgaagcacatttcactgatccagcatctattgcagcacgggggtacatatccacaagagttgaaatgggtgaggctgcgggtatttttatgacagcaactccaccaggatctcgggacccctttccccagagcaacgctccaatcatggatgaggaacgggaaattccggagcgctcatggaatagtgggcatgaatgggtaacagatttcaaagggaaaaccgtatggtttgtccccagcataaaggccggcaatgatattgccgcctgcctgcggaaaaacggcaagaaagtgattcaactaagtcggaaaacttttgattctgagtacataaagacacgcactaatgattgggattttgtagtaactactgacatatcggaaatgggagccaactttaaagctgagcgtgtcatcgaccccagacgatgcatgaaacccgtgatattaacggatggagaagaaagagttatattagcaggaccgatgccagttactcactcaagtgcggcacaaaggagaggtcgggtagggcgtaaccccaagaacgaaaatgatcaatatatatatatgggagaaccactagagaatgacgaagattgtgcgcattggaaagaggcaaaaatgctcctggacaatatcaatacacctgaaggtattataccatcaatgtttgaaccagaaagagagaaagttgatgcgatagatggagagtatcgactaagaggagaagctagaaagacttttgtagatcttatgagacgaggcgatttaccggtttggttggcataccgagttgcggcagaagggattaactacgccgatcgacgatggtgctttgacggagtcaaaaataatcaaattttagaggaaaatgtggaagtcgaaatatggactaaagaaggcgaaagaaagaaacttaaaccaagatggttggacgcaaggatatactctgatcctttggctttaaaggagttcaaagagtttgctgcaggcagaaaatcattgaccctcaacttaattacagaaatgggacgtttacctacctttatgacccaaaaagcaaagaatgctttagataacctggctgtcctacacacggcagaggctggcggtagagcatataatcacgcattgtctgaattgccggagaccttagaaaccttgctacttttaacgctactcgctacggtcaccggaggaatttttctgttcttaatgtcaggcaagggaataggtaaaatgaccctaggtatgtgttgtattatcactgcaagtatcctattgtggtatgctcagatacaaccgcactggatagcggcatcaattatattggaatttttcttaatagttttgttaattcccgaaccagaaaaacaaagaaccccacaagacaatcaactaacatacgtagtaattgcaatattgaccgtagttgccgcaacgatggccaatgagatgggattcctagagaagactaagaaagactttggactcggtagcataaccacacagcaaccagaaagcaacatactcgatatagacttacgccccgcatcggcatggacgctttacgcagttgccactacctttataacgccaatgttgagacactcaatagaaaactcgtctgttaatgtatctttaactgctattgcaaaccaagcaacagtcctgatgggactaggaaaagggtggccgctgagtaaaatggacatcggggttccacttctcgcaataggttgttactctcaagtcaatcctataacattaacagccgctctattactactcgtagctcattatgcaataatagggccaggtttacaagcaaaagcaactagagaggcacagaaacgagcggcagcaggcattatgaaaaacccgacagtggacggcatgactgtgattgacctggaccctatcccatatgaccctaagtttgaaaaacaactgggccaagtcatgttattagttctatgtgttacacaagtattaatgatgcggactacgtgggccttgtgtgaagcactgactttggctaccggccccataagcacactctgggaaggtaatccaggacggttctggaacacgactattgcagtgtctatggcgaatatatttcgcggttcgtatctagcaggggcaggactattgtttagcattatgaaaaatactgcaaatacacgtaggggaactggtaatacgggagaaacacttggagaaaaatggaaaaacaggttgaatgcattaggtaaatctgagtttcaaatatacaagaaaagtggtatacaagaggtagataggactttagctaaggaaggaattaaacggggtgaaacagatcaccatgctgtatccagaggcagtgcgaaactgcgctggttcgtagaaagaaatttagttacgccagagggtaaggttgtcgatcttggatgtggaaggggtgggtggtcatactattgtggtgggttaaagaatgttaaagaggtaaaaggtctaaccaaaggtggccccgggcacgaggaaccaatacctatgtcaacttatggatggaacttggtccgtctacagtcaggagttgacgtcttctttacgccacctgaaaaatgcgatacgcttttatgcgatatcggagaatcgagtcccaatcccacagtggaagccgggcgaaccctgagggtccttaaccttgttgaaaattggttaaataataatacacaattctgcattaaagtgctcaacccatacatgccttcagtcattgagaaaatggaggctctgcaacgcaaatatggaggtgcattagtaagaaatcctctaagtcgaaatagcacacacgaaatgtactgggtttcaaatgcaagtggcaacatagtttccagcgtcaatatgatttctcgaatgttaataaacaggtttactatgcgtcataagaaagcaacgtatgaaccagacgtagatctaggtagcgggacgcgaaacattggtattgaaagtgagacaccgaatcttgacataataggtaaaagaatcgaaaagattaaacaagaacacgaaacaagttggcattatgatcaagatcatccttataaaacctgggcgtatcacggatcatatgagactaaacaaacaggatcagcatcaagcatggtaaacggggtagtgagactactaacaaaaccgtgggacgtcatcccaatggttacacaaatggcaatgacagacaccaccccattcggacaacaacgtgtcttcaaggaaaaggtagatacacgtacacaggaacctaaagagggaactaagaaactaatgaaaataactgcggagtggttatggaaagaactaggtaagaagaaaacgccacgaatgtgtacacgagaagagttcacacggaaggttagatctaatgcagcgctaggggcaatttttacagatgagaacaaatggaaaagcgctagagaagccgttgaagatagtggattttgggaacttgtcgacaaagaaagaaacctccacttagaaggtaaatgtgaaacctgtgtatataacatgatgggtaagagagagaagaaattaggagaatttggaaaagcaaaaggatcaagagcgatttggtatatgtggttaggtgcacgatttcttgaatttgaagccttgggatttttaaacgaggatcactggttctccagagaaaatagtctttcaggagtagaaggagaagggttacacaaactaggttacatcctgagagacgtatcaaagaaagaagggggtgcgatgtatgcagacgatacagcggggtgggatacaaggatcactctggaagacctaaagaatgaagaaatggtcactaaccacatggagggcgaacacaagaaattagcagaagctatctttaaattaacttaccagaataaggtagtaagagtccaaagacccacccctcgaggaacagtcatggacattataagccgacgtgatcaacgtggatcaggacaagtcgttacttacggacttaatactttcactaacatggaggcacaacttataagacaaatggaaggtgaaggagtatttaaatctatccaacaattaacagttaaagaagaaatagcagttaaaaattggttgatacgtgttgggagagaaaggctgtctagaatggctatctctggtgacgactgtgttgtgaagccattagacgatcgattcgcttcagcacttacagcgctaaacgatatgggtaaagtaagaaaagacattcaacaatgggaaccctcaagaggttggaatgactggactcaggtacctttctgttcgcatcactttcatgaacttataatgaaagacggaagagtcttagttgtcccatgtaggaatcaagatgaactaattggacgagccagaatatcacaaggagcgggttggtctttgcgagaaactgcctgtctaggtaaaagttacgcacaaatgtggtctttaatgtatttccatcgacgggatttaagattggcagctaacgctatttgttctgcagtgccctcacactggatacctacctcaagaactacttggtcaatacacgctactcatgagtggatgactacagaagacatgctgactgtatggaatagagtttggatacaagaaaatccctggatggaagataaaacccctgtagaatcgtgggaggaaataccttatctgggaaagagagaagaccagtggtgcgggtccttgattggattgacaagtagagctacatgggctaaaaacattcagactgctatcaatcaggtgaggagcctaataggcaatgaggaatatacagactatatgccaagtatgaaaagatttcgccgcgaagaggaagaagcgggcgtcttgtggtaa

SEQ ID NO: 22249 - RNA, 9876 nt, synthetic construct
  misc_feature 1..9876: note = derived and/or modified CDS sequence (opt6) from DENV-2__KM279539__SS-prME
  source 1..9876: mol_type = other RNA
acagcaggaatcattattatgatgatcccaacagtaatggcatttcatctaacaacgcgaaatggagaacctcatatgattgttagccgtcaagagaagggcaaaagcttattatttaaaacagaaaatggtgttaatatgtgcactctaatggcgatggacttgggcgaattatgcgaagatacaataacatataattgtcctttactaagacaaaatgaacctgaggatatcgactgttggtgcaacagcacgagcacgtgggtaacgtacggaacatgcaccgctacgggcgaacaccgaagagaaaagagaagtgttgcattggtaccgcatgtagggatggggttggaaacacgtaccgagacatggatgtcctcagaaggagcatggaagcatgcccaacgaatcgaaacgtggatcctcaggcatccaggttttactataatggcagcaatattggcatatacaatcgggaccacgtatttccaacgagtgctaatttttattttactgacagccgttacaccctcaatggcaatgcgatgcattggtatcagtaatagagattttgtagaaggcgtaagtggcggatcctgggtagatattgtcttagaacacggatcttgtgtaaccacgatggcaaaaaacaaacctacattagactttgagctcattaaaactgaagcaaaacatctggctacattaaggaaatattgtgtggaagctaaactgaccaatactacgactgctagtcgatgtccgactcaaggcgagccgtctttaaatgaagagcaagacaaacgatttgtctgtaaacatagtatggttgatagagggtggggaaatggatgtggccttttcggtaaaggcgggattgttacatgtgcaatgttcacatgtaaaaaaaacatggagggaaaagtagtacagccagaaaatctggaatacacgattgtaataacaccacacagcggggaagaaaacgctgtcggcaatgatacaggaaaacatgggaaggaaataaaagtaacgccacaatctagcataaccgaggctgaactaacaggatacgggactgtgactatggaatgcagtccaaggacaggattagatttcaacgaaatggtactactacaaatggaaaacaaagcatggttagttcacagacagtggtttctagaccttccactaccatggttaccgggcgccgatacacagggttcaaattggatacaaaaggagacacttgtcacatttaaaaacccgcacgcgaagaaacaggatgttgttgtactaggatctcaggaaggtgctatgcacacagccctgaccggcgcaactgagatacaaatgtcgagtggaaatcttctattcacaggtcatctaaagtgtagactacgaatggacaagcttcagcttaaagggatgagttactcgatgtgtacagggaaatttaaggtagttaaggaaattgctgaaacgcagcacggcactattgtaattcgtgtacaatacgaaggcgacggcagtccctgtaaaataccattcgaaattatggatttagagaaacgccacgtattgggtagattaataacagtgaaccctatagtaaccgaaaaagatagtccagtaaatattgaggcagaacccccctttggtgatagttatataatcattggagtggagcctggtcaacttaagctatcttggtttaaaaaagggagtagcataggacaaatgttcgagacaacaatgcggggagctaaacgcatggcaattttaggagatacagcatgggattttggaagcttgggaggtgtatttacatcgattggaaaagcgttgcatcaggtgtttggagcaatttatggagccgcattctctggtgtctcctggacaatgaaaattctaatcggtgtcgtcataacctggattggcatgaactctcgtagtactagcttaagcgtttcgctagttcttgtgggggtagtcacgttgtatctgggagtaatggtgcaagcagactctggctgtgtggtatcttggaaaaacaaggaattaaagtgcggatcagggatttttataacagacaatgtacatacatggactgaacagtataaattccaacccgaaagcccttcaaaactagcttccgctatacaaaaagctcatgaagaaggtatttgcggtatacgctcagtaacacgactcgaaaatctgatgtggaagcaaatcacgcctgaactaaaccatatactaacagaaaatgaggtgaaactgacaatcatgacaggcgatataaagggtataatgcaagctggaaaaaggtcattgcgcccacaacccacagaattaaagtatagttggaaagcgtggggcaaagccaaaatgctatcaaccgaactacataatcacacgtttctaattgacggtccagaaactgctgaatgcccaaatactaatcgtgcttggaatagcctcgaagtagaagactatggatttggagtattcacgacgaacatttggctaaagcttaaagagcgacaagatgtattttgcgattcgaaacttatgtccgctgcaattaaagataatcgtgccgtacatgccgacatgggatactggattgaatcggcattaaatgacacatggaaaatcgagaaagcatctttcatagaggtaaaaagctgccattggccaaagtcacacacattatggtcgaacggggtgctcgagtcagaaatgataataccgaaaaatttcgctggaccagtatcgcaacataactacaggcctggttatcacacgcaaacagcgggtccatggcatctcggaagacttgaaatggactttgacttttgtgaaggaacaaccgtcgttgtaacagaagattgtggcaacagaggaccttctttgagaacgacgacggcttctggcaaactaataacagagtggtgttgcagatcctgtaccttaccacctttaagatatcgcggggaggatggatgttggtatggtatggaaattagaccattgaaagagaaagaggagaatctagttaatagcctagtgaccgctggccatggacagatagataacttttctttaggtgttctcgggatggcgcttttccttgaggaaatgctccggaccagagtgggaactaaacatgcgatcctattagtcgcagtgtcgtttgttacattaataacgggcaatatgtcattccgcgacctaggacgtgttatggtgatggtaggtgcaaccatgacagatgacatagggatgggggttacatatctagcccttttagcagcttttaaagtcagaccgacattcgctgctggcttattgttaagaaaactcactagcaaagaacttatgatgactacgataggtatcgtcttattgtcccaatcaacgataccagaatcaattttagagcttacagatgccctcgccctcggaatgatggtacttaaaatcgtacggaatatggagaagtaccaactagcagtaacaataatggcgatactctgcgtcccaaatgccgtgatactccaaaatgcatggaaggtatcatgcactacactagccgtggtctcagttagtcctctattattaactagctcacaacaaaaagcggattggatccccttagccttaaccattaaggggctgaatcccacggcaatattccttacgacactatcacggactagtaaaaaaagatcttggcctctcaatgaagccataatggcagtggggatggtgtcaatattagcaagtagcttgttgaaaaacgacatccctatgaccggaccattagttgcaggtgggttattgacggtttgttacgtacttaccggaagaagtgcagacttagaactggaacgtgcagcagatgtaagatgggaagagcaagcagagatcagcggttcttcacctatattgtcaattacaatatccgaagatggttctatgtcaattaagaatgaggaagaagaacaaacgttaacaatacttatcaggacaggactccttgtaatatcaggactctttcctgtatcaatacctataaccgcagccgcatggtatctttgggaggttaagaaacaaagagctggtgttctctgggatgtaccctctcctcccccggttggaaaggctgaactagaagatggggcatataggataaagcagaagggaattttgggttactcgcaaattggtgcgggtgtatacaaagaaggaactttccacactatgtggcatgtaaccagaggtgcagtcctaatgcacaaaggtaaacgaatagaaccctcgtgggcagacgttaaaaaagacctcataagctatgggggcggatggaaactagaaggggagtggaaggaaggagaagaagtgcaagtactagcattagagccgggaaaaaatcctagagcagttcaaacaaagccaggcttatttaaaactaacaccggtacaataggagctgtgtcactagacttttcacctggaacctccgggtcgcccatagtagacaaaaaagggaaagtggtcggtctatatgggaatggagtagtcacacgtagtggaacctatgtgtccgctatcgcacagacagaggaatctatcgaagataaccctgagatagaagatgacatatttcggaaaaagcgattaacaataatggatttgcacccgggagctggaaagacgaagcgttacttacccgcaattgtacgtgaggcaattaaaagaggccttagaacattaattttagctcccactagagtagtcgcggccgaaatggaagaagcattaagaggactaccaatacggtatcagacacctgcaataagagcggaacacacgggaagggagatagtagacctcatgtgccatgcaactttcactatgcggttattatcaccaatacgagttccgaactacaacctaataatcatggatgaagcacacttcacagaccctgccagcatcgccgcacgaggatatatatcaacacgagtagaaatgggggaagcagcagggatttttatgacagctacgcctccaggctccagagacccgtttccacaatcaaacgcaccaattatggatgaagaacgtgaaatacctgaaagatcctggaattctgggcacgagtgggtcacagatttcaagggtaaaacagtttggttcgtaccatcaatcaaggctggtaatgacattgcagcctgtttacgaaaaaacggtaagaaagtaatacaattgtctcgaaaaacgtttgatagtgagtacataaaaacaaggacaaacgattgggactttgtagtgacaaccgatattagtgagatgggggcgaatttcaaagcggagcgcgttatcgatccaagacgttgcatgaaaccagtaatactcactgatggcgaggaaagggtaatattagcaggaccgatgccagtaacacattccagtgccgcgcaacgacgtggacgtgtgggtagaaacccaaaaaatgaaaatgatcaatatatctatatgggagaacccctagaaaatgacgaggattgcgcccactggaaagaggcgaaaatgttattagataatataaatacaccagaagggattataccgtcaatgtttgaaccggaaagagagaaagtagacgcaatcgatggggaatatcgtttgaggggagaagctagaaaaacttttgtcgatcttatgcgaagaggtgatctaccagtatggctggcttatcgggtcgctgccgaaggaataaactatgctgacagaagatggtgttttgatggtgtaaaaaataatcaaatactagaagaaaacgtcgaggtcgaaatttggaccaaggagggagaacgtaaaaaactaaagccgcgctggttagacgcacgtatatattcagacccgctagcactaaaagaattcaaagagttcgcagccggacgaaaatcactaacactaaacctcattactgaaatgggaagattaccgactttcatgacacaaaaagctaaaaatgccctagataaccttgcagtactgcacactgcagaagcaggaggaagagcttataatcatgcactctctgaattacctgaaacactagaaactttgttgttattaactctacttgccacagtaaccggaggtatattccttttcctaatgtcaggtaaagggataggaaaaatgacattgggaatgtgttgtataataacagctagtatactactttggtatgcacaaattcaaccgcactggattgctgcgagtataatcttagagttctttttaattgttctactaatacccgaacccgagaaacaacgaacaccacaagacaaccaattaacatatgtagtcatagctatattaacggtggtagccgctacgatggcaaatgaaatgggcttcttagaaaaaacgaagaaagatttcggacttgggagcataacaacgcaacaaccagagagtaacatccttgatatcgatttacgtccagcctctgcttggactctgtatgcggtcgcaacgacttttataacaccaatgcttcgacactcaattgagaactccagcgtaaatgttagcttaacagcgatagcaaaccaagctactgtcctgatgggattgggaaaaggatggcctctgagtaagatggacataggtgtcccattactagctataggatgctactcccaagtcaatcccataacgctcactgccgctctcttactattggtagcccattacgccataataggacctggcctgcaagcgaaagctacacgcgaagcgcaaaagcgagccgctgcgggcataatgaaaaacccaactgtggacggaatgactgtcattgatttagacccgataccctatgatccgaaattcgaaaaacaacttggtcaggttatgctattagtgctttgtgtcacccaagtgctaatgatgcgaactacttgggcattgtgtgaggcgttaacactagcgaccgggccaatcagtactctttgggaaggaaatcctggacgattttggaatacaacaatagcagttagcatggcaaatattttccgagggagctatctagcaggtgctggcttactcttttcaataatgaaaaacacagcgaatacacggcgaggtactggaaataccggtgaaacacttggcgaaaagtggaaaaatcggttaaacgcactaggaaaaagcgagtttcaaatttacaaaaaaagcggtatacaggaggtagaccgaacgctagcaaaagagggaatcaagagaggagaaaccgatcatcatgcggtatcgcgtggctcagcgaagctgcgctggttcgtggagaggaacctagttacgcccgaaggaaaggtagtggaccttggatgcggtcgtggtggctggagctattactgcggaggtttaaaaaatgtaaaagaagtcaaaggattaactaagggaggtcccggacatgaagaacctatcccgatgagtacatacggatggaatctagttagactacaatcaggtgtcgatgttttttttacaccaccagaaaaatgtgatactttactatgcgacataggggagtcaagtccgaatcctacggtagaggctggtaggacgctaagagtgttaaacttggtggaaaattggttgaacaataacactcaattttgtataaaagtcttgaatccgtatatgccttccgtaatagaaaaaatggaggcgctgcaacggaaatacggaggagcacttgttcggaatcccctaagtagaaactctacgcatgaaatgtactgggtatctaatgcatcaggaaatattgtatcctcggtaaatatgataagtcgcatgttgatcaatagatttactatgagacataaaaaagccacttatgaacctgatgtcgacctcggttctggtactagaaatatagggatcgaaagcgagacacctaatttggatataataggaaaaagaattgagaagatcaaacaagaacatgagaccagttggcattatgaccaagatcacccatataagacctgggcttaccatggatcctatgagactaaacaaacaggatcagcaagctccatggtaaatggtgtcgtaaggctgcttacaaaaccatgggacgtaattcctatggtgacacaaatggcaatgaccgatactaccccttttggacaacaaagagtattcaaagaaaaggtggatacacggactcaagaacccaaagaaggtacgaagaaattaatgaaaataactgccgagtggttatggaaagaactcggaaaaaaaaaaacgccccgcatgtgtactcgagaagaattcacaagaaaagttcgttcaaatgcggcattaggagctatttttacggatgagaataaatggaaatcagcgcgcgaagcggtagaagacagcggattttgggaactagttgacaaagagcgcaacctacatttggaaggaaagtgtgaaacatgtgtttataacatgatgggaaagagagagaaaaaactgggagagtttggaaaagcgaaaggcagtcgagctatttggtatatgtggcttggcgcaagatttctagagttcgaggcactaggctttcttaatgaggatcactggtttagtagggaaaattctctaagtggggttgaaggcgaaggtctacacaagctaggttatattctcagagatgtttctaaaaaagaaggaggagccatgtacgccgacgatactgcaggctgggatactcgaataacattagaagatcttaaaaatgaagaaatggtcactaaccatatggaaggagaacataaaaaacttgcggaagcaatttttaagcttacttatcaaaacaaagtagtaagggttcaacgtcctacacctagaggcacagttatggacatcatatccagacgggatcaaagaggtagtggtcaggttgtgacatatggtctaaacacatttactaatatggaagcacagttaatcagacaaatggaaggtgaaggggtgtttaaaagtatccagcagctgactgtaaaagaagaaattgcggttaaaaattggctaataagagttgggagggagcgcctttcacgaatggccatttcaggggacgactgtgtagtaaaacctttagatgacaggttcgcgtccgcacttacagcactaaacgacatgggaaaagtcagaaaagatatacaacaatgggaacctagtcgaggatggaatgattggactcaagtgccgttttgcagtcaccattttcatgagttgataatgaaagatggaagagttttagtggttccgtgtagaaaccaagacgaacttatcggtcgagctaggatatctcaaggggctggttggagcttacgcgaaacagcatgtttaggaaagagttacgcacagatgtggtctttgatgtacttccatcggagggacctaaggctagcagcgaatgcaatctgttctgccgtgccaagccactggatacccactagcaggacgacttggtcaattcacgcaacacatgaatggatgacgacggaagacatgttaacagtctggaatcgagtctggattcaagaaaatccttggatggaagataaaacccccgtagaatcctgggaagagataccgtatttgggaaaacgcgaagaccagtggtgcggatcgttaattggtctaacatcccgtgcaacatgggccaaaaacatccaaacggcgatcaatcaagtacgatctttaattggaaacgaagaatacacagattatatgccaagtatgaagaggtttcgacgagaagaagaagaagcaggtgtactatggtaa

SEQ ID NO: 22250 - RNA, 9876 nt, synthetic construct
  misc_feature 1..9876: note = derived and/or modified CDS sequence (opt6) from DENV-2__KM279543__SS-prME
  source 1..9876: mol_type = other RNA
acagctggaattattattatgatgataccaacagttatggcatttcaccttacaactagaaatggtgaaccacatatgatcgttagccgtcaagaaaaagggaaaagcctgttattcaaaacagaaaacggagtgaatatgtgtacgttaatggcgatggatctaggggaactttgcgaagataccattacatataactgcccacttctaagacaaaatgaacctgaagatatcgactgttggtgcaatagtacatcgacatgggttacctatggaacatgtactgcaacaggtgaacaccggcgcgagaaacgttctgtagcgttggtgccgcacgtagggatgggattggaaactagaaccgagacttggatgagcagtgaaggggcatggaaacatgcacagcgaatagaaacctggatattgagacatccaggatttacaataatggctgcaatattagcatatacgatagggacgacttactttcaaagagtactaatttttatattgctaacagcagtgactcctagcatggcgatgcgatgtataggcatatcaaatcgagacttcgtcgaaggtgtatcaggtggatcatgggttgatatagtcttagaacatggaagttgtgttactacaatggccaaaaataaaccaacgttggactttgagcttattaaaacagaagcaaaacacttagcaacactgaggaaatattgtgtagaggctaaattaacaaacacgacaaccgcctcgcgatgcccaacgcagggcgagccatcactaaacgaagaacaggataaacggttcgtgtgtaaacattcaatggtcgacaggggttggggcaacggatgtggattattcggaaaaggaggaattgtaacgtgcgctatgtttacatgcaagaaaaatatggaagggaaagtagtccagccagaaaatttagaatacactatagtaataacacctcatagtggagaagagaacgctgtaggaaacgatactggtaaacatggtaaagaaataaaagtaacaccccaaagttcaataaccgaggcagaattaacgggatacggcaccgtcactatggaatgttcaccgcgaacaggactagacttcaatgaaatggtattattgcaaatggaaaataaagcatggttagtccatcgacagtggtttctagacctcccattaccttggctccccggggcagatactcaaggatcaaattggatccaaaaagagacgctggtgacatttaaaaaccctcacgccaagaaacaagacgtggtagttctaggatcgcaggaaggagccatgcacacagcgctaacgggcgcgactgaaatacaaatgagttctggaaaccttttattcactggacacttaaaatgtaggttaagaatggacaaactacaacttaaaggaatgagctattccatgtgcacggggaaatttaaagtagtgaaagaaatcgctgaaacgcaacatgggaccatagtaattagagtgcaatatgaaggagatggctctccatgcaaaataccatttgaaatcatggatctcgaaaagaggcacgtactaggaagactcattactgttaacccaatcgtaacagaaaaggactcacccgtaaatatagaagctgaaccgccgtttggagatagctacataataattggggtagaacctggacaattaaaactgagttggtttaagaaaggctcaagtataggtcaaatgtttgaaacaactatgaggggtgctaaaaggatggccatcctaggagatacagcttgggactttggatcactaggaggaatgttcacgtcaattggcaaggctttgcaccaagtgtttggagcaatttacggcgctgcattttcaggagtatcctggacaatgaagatattgataggagttgttatcacatggataggaatgaactctagatcgacatccttatcagtaagtctcgtcctcgttggggtagtcacactttacctgggagtcatggtacaagctgatagcggatgtgtagttagttggaaaaacaaagaattaaaatgcggtagcggaatatttattaccgataatgtacacacctggactgaacagtataaatttcaaccagagtctccatccaaattagcatctgctatccaaaaagcacatgaagaagggatatgcggtattagatcagttacgagattagagaatctaatgtggaaacaaataaccccggaactgaaccacatattgactgagaatgaggtcaagctaacaataatgaccggagatataaaaggaatcatgcaagccggcaagcggtcattgagaccacaaccaactgaactgaaatatagctggaaagcatggggaaaagctaaaatgctatctactgaactacacaatcacacgttcttgattgatggcccagaaactgcagaatgtcctaacacaaatagggcatggaactccttagaagtggaagattatgggttcggagtttttacaacgaacatttggttaaaacttaaagagcggcaagacgtgttttgtgattctaaactaatgagtgctgctataaaagataaccgagcagtacacgccgatatgggttattggattgagagcgcattaaacgacacatggaaaattgaaaaagcctcattcattgaagtcaagtcatgtcattggccgaagagtcatacactttggagtaatggagtgttagaaagcgaaatgataatccctaaaaatttcgccggaccagtgagtcagcataactatcgacctggataccacacgcaaacagccggaccgtggcacttggggcgcctagagatggatttcgatttttgcgaaggcactacggtagttgttacagaagattgcggaaatagaggcccatcactacggacgaccacagcatcgggaaaattaataactgagtggtgctgcagaagctgtactttaccaccactcagatatagaggagaagatggatgctggtatgggatggaaatacgacctctaaaagagaaggaggaaaacctagtgaatagtttagttacagccggacacggccaaatagacaatttcagtctcggtgtcttgggaatggcactatttctagaagaaatgctacgtactagagtaggaacgaaacatgcaattctcctagtagcagtgtcattcgtaactttgataactgggaacatgtctttccgagatctaggacgagtaatggtaatggtaggagctacaatgaccgacgacataggaatgggtgtgacatatctagccttgcttgcggcgtttaaggtaagacccacttttgccgcaggtttattgctgcgaaagctgactagcaaagaacttatgatgactacaataggcatagtgttgttatcgcaaagtaccataccagagagcatacttgaattaacagatgcactggccctaggtatgatggttttaaagatagtaagaaacatggaaaagtatcagttagcagtaacaataatggcaatattatgtgtaccgaatgcagtaatccttcaaaatgcatggaaagtgagttgcacgacactcgcagttgtttcagtcagtccacttttactaacaagtagtcagcagaaagctgactggataccactcgcactcacaataaaagggctgaatccaaccgcgattttcttgactactctatcgcgaaccagtaagaaacgatcatggccgttgaacgaagcaataatggcagttggaatggtaagtattttagcatcaagcctcctaaagaacgatatcccaatgaccggacccttagtagcaggaggtctattaactgtatgttatgttctgacgggaaggagcgcagatttagagttggaacgcgcagctgacgttaggtgggaagaacaggccgaaatatcaggctcatcaccaatactctcaataacaatttctgaagatggaagtatgtcaatcaaaaacgaagaggaagaacaaaccctcacgatcttaatacgcacaggtttattagtcatctctgggttgtttcctgtaagtataccaataaccgcagctgcgtggtatctgtgggaagttaagaaacagagagccggggttctatgggacgtaccaagtcctccacctgttggcaaggcagaattagaggacggagcatatagaataaaacaaaaaggtatccttggatacagccagatcggtgcaggggtctacaaagaagggacattccacaccatgtggcacgtaactcgtggagcggtcctaatgcataaaggtaagcgaatagaaccgtcatgggcagacgttaagaaggatctgatctcctacggaggaggatggaaacttgaaggtgaatggaaggaaggagaagaagtacaagtcttagccctagaaccgggtaagaacccaagggcagttcaaactaaacccggactatttaaaaccaacacaggcacaattggcgcggtcagtttggattttagcccagggacctcgggtagcccaatagtagataagaaaggaaaagtggtaggcttatatgggaatggagtagtgacgagatcgggaacatatgtatcggcaatagcacagaccgagaaatctatcgaagataatcctgaaatagaagatgatatatttaggaagaaacgattgactataatggatctgcatccaggagccggaaaaaccaaaagatatttacctgcgatagtgcgtgaagctattaaacgcgggctgaggactttaatactggcacctactcgagtggtagcagctgaaatggaggaagcattacgagggttgccaattaggtaccagacgcctgcaataagagcggaacataccggtagagaaatagtcgatttgatgtgccatgccacttttactatgaggttattaagtcccatacgcgtaccaaactataacctgatcataatggacgaagcacattttacagaccctgcgagcatagcagcgagaggatacatctccacaagagtggagatgggagaggctgccgggattttcatgaccgcaacacctcctggttctcgagacccatttccgcaaagcaatgcaccgataatggatgaagaaagggagatacctgagcgcagttggaactctggtcacgagtgggtaacagattttaaaggaaaaactgtttggtttgttccttccataaaagctgggaatgatatagctgcctgtctaaggaaaaatggcaagaaagtcatccaattatccagaaaaacatttgacagcgaatatatcaaaactcggactaacgactgggactttgtagtaacaactgacataagtgaaatgggtgcaaacttcaaggctgagagagttatagacccaaggcgttgcatgaaaccagttatattaactgatggtgaggaaagggttatactagctggacctatgcctgtgacacattcatcagcggcacaaagacgaggaagggttggtcgaaatccgaagaatgaaaacgatcaatacatctacatgggtgaacctttagagaatgatgaagattgcgcacattggaaagaagctaagatgctcctagataacattaatacccccgaaggcataattccgtctatgtttgaaccggaacgagaaaaagtggacgcaatagatggcgaatatcgtttaagaggagaggcaagaaaaactttcgtcgatttaatgagaagaggtgaccttcccgtgtggctggcgtaccgagttgcagctgaaggaataaattacgcagacagaaggtggtgtttcgatggcgtcaaaaacaatcaaatactagaagaaaatgtcgaagtggaaatatggactaaagaaggcgagcgcaagaagttaaagccacgctggctagatgcacgaatatattccgatcccctagcgctcaaggagttcaaagagtttgcagcaggacgtaaatcactgactcttaaccttattactgagatgggaagactaccgacctttatgacccaaaaggccaaaaatgccctggataatctagcggttctacataccgcagaagcaggaggacgagcctacaatcatgcactgagcgagctacctgaaacgctagaaacactgttgctcttgacattattagccacagtgaccgggggtatcttcctcttcctaatgagcggcaaaggtataggtaaaatgacacttggaatgtgctgcataataacagcttcaatactcttatggtatgcgcaaatacaaccacattggatagcggcttcgataattttagaatttttcttgatagtactactcatacctgaacccgaaaaacagagaacaccgcaagataatcaattgacatacgttgttatagcaatactaacagtggttgctgccaccatggcgaatgaaatgggattcctcgagaaaaccaagaaagactttggattgggtagtataactacgcagcaaccggaatcgaacattcttgatattgaccttagaccagcctccgcatggacactttatgccgtagccacaacttttatcactcctatgctacgtcacagcatagaaaatagtagtgtcaacgtaagtttaacagctattgcgaatcaggcaaccgtattgatgggtctaggtaaagggtggccgcttagtaaaatggatatcggggtaccacttctagcaattgggtgttacagtcaagtaaatcctattactctcacggccgcattattgctcctagtagctcattatgcaattatagggccagggttgcaggcaaaagcaactcgagaagcacaaaagagggcagcggctgggattatgaaaaacccaacagtagacggtatgactgtcatagatttggatcccatcccctatgatcccaaatttgaaaaacaactaggacaagtaatgttgcttgtcctttgcgttacgcaagttttaatgatgagaacaacttgggcattatgtgaggctctgacattagcaactggaccgatcagtaccttatgggaaggtaacccaggacgcttttggaacacgacaatagcagtaagcatggcaaatatctttcgcggaagctaccttgcaggagctggattgttattttcaattatgaaaaacactgctaatactcgtagaggaacaggaaatacgggggaaacacttggagaaaaatggaaaaacagactaaacgccttgggtaaaagcgagttccagatatacaaaaagtccggcattcaagaagttgaccggacactggccaaagaaggaataaaaaggggagaaacggatcaccatgcagttagcagaggttcagccaagttacgttggtttgtagaaagaaatttagttacaccagaaggtaaagttgtcgatctaggatgtggtcgaggaggttggtcttactattgtggtggactaaagaacgttaaagaggttaaagggctaaccaaaggtggtcctggccacgaggaacccattcctatgtcgacctatggatggaacttagttcgcctacaatctggagtagacgttttctttacacccccggaaaaatgcgacacactattgtgtgatatcggagaaagcagcccaaacccaaccgtagaagctggaaggacacttagagttttaaacctagtagaaaattggctaaataacaacacacaattctgtataaaagtgctgaatccatatatgccatccgtaatagagaaaatggaagctctacaaagaaaatatggaggcgcccttgttcgaaatccattatcacgtaattcgacacacgaaatgtactgggtgagcaacgcgagcggaaatatagtttcaagtgtaaacatgattagtcgtatgctaatcaatcgatttacgatgcgacataaaaaggcaacgtatgaaccggacgtggaccttggtagtggaactagaaacataggaatagaaagcgaaactccaaatctggacataatcggaaagcgcatagaaaagattaaacaggaacatgagacttcatggcactacgaccaggaccatccttataaaacctgggcttaccatggttcttatgaaacaaaacaaacaggatcagcatcatcgatggtgaacggggtagttcgactgttaactaaaccctgggatgttataccaatggttacacagatggctatgacggacacaacaccgtttggccagcagagggttttcaaagaaaaagtcgatactcgaacccaagaaccaaaagagggcaccaagaaattgatgaaaatcactgcagaatggttgtggaaagaattgggcaagaaaaagactccaaggatgtgtacgagagaagagttcacacggaaagtacggtctaatgctgcgttgggagcaatcttcaccgatgaaaataagtggaaatcagcacgcgaggcagtagaagattctgggttttgggaattggttgacaaagagcgaaacttacacctggaaggaaaatgtgaaacatgtgtgtataatatgatgggaaaacgcgaaaagaagttaggagaatttggcaaggctaaaggatctcgagcgatatggtatatgtggttaggagcaagatttctcgagtttgaggctttagggttcctaaatgaagatcactggtttagccgagaaaattctctctcaggcgtggaaggagaaggtctacataaactaggatacatcctaagagatgtcagtaagaaagaaggcggagcaatgtacgcagatgacacagccggttgggatactcgaataacgttagaggatctaaagaacgaggaaatggttactaatcatatggaaggggagcataagaaactggctgaggcaattttcaaactgacctatcaaaataaagtagtcagagttcagagaccaacgccacgaggaaccgttatggacataataagtagaagggaccagcgaggaagtggtcaagtggtaacgtacggacttaatacgtttaccaatatggaggcgcaactaatacggcaaatggagggggagggagtttttaagtccatacaacaattaacagtaaaggaggaaatagccgtgaaaaattggctaatacgagttggaagggaacgacttagcagaatggctatcagcggcgatgactgcgttgtcaagccgttagatgatagatttgctagtgccctaacagcattaaacgatatgggtaaggtacggaaggatattcagcaatgggaacccagtagaggttggaacgactggactcaagtgcccttttgtagccaccacttccatgaactaatcatgaaggatggccgcgtattagtggtcccatgcagaaaccaggacgaattaataggccgcgcacgtatcagtcaaggggccgggtggtcgttgagagaaaccgcatgtctaggaaagagttacgcacaaatgtggtctttaatgtactttcaccgtagagatcttcgactcgctgcaaatgcgatatgttccgcagtaccatcacactggatcccgacatccagaacaacatggtcgattcacgcaacccatgaatggatgacaactgaggatatgttaaccgtgtggaatcgcgtttggattcaagaaaacccttggatggaagataaaactccggtagaatcctgggaagaaataccttatttaggaaaaagagaagatcagtggtgtggatccttaataggacttacttctagagctacatgggccaaaaacatacagaccgcaataaatcaagtacgaagccttattggtaacgaagaatacacagattacatgcctagcatgaaaagatttcgaagggaagaggaagaggctggtgtactctggtga

SEQ ID NO: 22251 - RNA, 9876 nt, synthetic construct
  misc_feature 1..9876: note = derived and/or modified CDS sequence (opt6) from DENV-2__KM279571__SS-prME
  source 1..9876: mol_type = other RNA
actgcgggtatcattataatgatgattccgacagtaatggctttccaccttaccaccagaaacggtgaaccacacatgattgtttcaagacaagaaaaaggaaaaagtttgttatttaaaacagaaaatggagttaacatgtgcacattgatggcaatggaccttggtgaactatgcgaagacactatcacgtacaactgcccgctattacggcaaaatgaaccagaagatattgactgttggtgtaattcaacaagtacctgggtaacttatggtacgtgcaccgctacaggagaacaccgtagagagaaaagatcagtagcgctagtaccacacgtgggaatgggactagaaactcggactgaaacatggatgtcctctgaaggagcttggaaacatgcgcaaaggatcgaaacatggatactacggcacccaggcttcaccataatggcggcaatactagcatatacaatcgggacaacgtatttccaacgtgtcttaatatttatactgctcaccgcagttacaccatcaatggcgatgagatgtatagggatttcaaatagagactttgtcgaaggagttagcgggggatcctgggtcgacatcgttttagaacacggaagctgtgtaactactatggccaaaaacaaaccaacattagattttgaattaataaaaacggaagcaaaacatctggcgactctaagaaaatattgtgtagaagcaaaattgacgaacactacgaccgcctctcggtgcccaacgcaaggggagccaagtttaaacgaggaacaagataaacgattcgtatgcaaacattcgatggtagaccgtggttggggaaacggttgcgggttattcggaaaagggggaatcgtaacatgtgccatgttcacttgcaagaaaaatatggagggtaaagtcgtgcaaccggagaatttagagtatacaattgtaataacaccgcactcaggcgaggaaaacgcagttggaaatgacactggtaaacacgggaaagaaataaaagttacaccacaatcaagtataacagaagcggaactgaccggttatggcacagtaacaatggagtgcagtccgagaacagggttggactttaacgagatggttctacttcagatggaaaacaaagcatggctagtacacagacagtggtttctagatttaccgctaccgtggctccccggagcagatacacaggggtctaattggattcagaaagaaacactcgtgacctttaaaaatccacatgccaagaaacaagatgtcgtagttcttggatctcaagaaggagcaatgcacacagctctgactggcgccacagaaatccaaatgtcctctggtaacttgctctttacaggacacctcaaatgcagactcagaatggataaattgcaattgaaaggaatgagctactcaatgtgtacaggaaaatttaaagtggtaaaagaaatagcagaaacacaacacggaacgatagtaatccgagtgcaatacgaaggtgatggctccccatgtaaaataccttttgaaatcatggacttggagaaacgacacgtgttgggacgactaattaccgtgaaccccatcgtcacagaaaaagattcacctgtaaacatagaagcagaacctcctttcggggattcctatattataatcggcgtagagccaggccagctaaaactatcgtggttcaagaaagggagcagtataggccagatgttcgaaacaactatgagaggagctaaacgtatggcaattctaggcgatacagcttgggattttggctctttgggtggggtatttaccagtatcggcaaagcacttcatcaagtttttggtgcaatttatggggccgcatttagtggcgtgtcatggacaatgaaaatccttataggtgtagtgatcacatggatcgggatgaatagccgttctacatcgctatccgtttcattagttcttgtgggggttgtaacgctctacttaggtgtaatggtccaagcagattcaggctgtgtagtgagttggaaaaataaagaattaaaatgcggttcaggaatctttatcacagataatgtacatacctggaccgagcaatacaaattccagccagaatctccaagcaaattagcgagtgcaatacaaaaagctcatgaagaaggaatttgtggtatacgaagcgtaacaagacttgaaaatctaatgtggaaacaaattactccagaattaaatcacatacttacagagaacgaggttaaattgaccatcatgacaggcgacatcaaaggtataatgcaggcgggtaaacgaacattgagacctcaacctacagaattaaaatactcatggaaagcatgggggaaagctaaaatgctttctacggagttacataatcacacgtttctaattgacggacccgaaactgccgagtgccctaacacgaatagggcgtggaacagtttagaagttgaagattatggtttcggtgtatttaccaccaatatatggttaaaactaaaagaacgccaagacgtattctgtgactccaaattaatgtcagcagccattaaagataaccgtgccgttcatgcagatatgggatactggattgaatccgccctaaatgatacatggaaaattgaaaaagcatcttttatagaagtaaagtcatgtcattggccgaagtcacatactctttggtctaacggagtgcttgaaagtgagatgattattcccaaaaatttcgccggcccagtatcacagcacaattatcgaccaggttatcatacacaaacagccggaccatggcaccttggaaggttggagatggactttgatttttgcgaagggaccactgtagtcgtcacagaagactgtggtaaccgcggtccaagtttaagaaccactaccgcttccggaaaacttataactgaatggtgctgtagaagttgtacattacctccgctcagatacagaggagaagacggatgttggtatggaatggagataaggccattaaaagaaaaagaagaaaacctggttaatagtttagttacagccggccacgggcagattgataacttttccctaggtgtactaggcatggcgttatttctcgaagaaatgttaaggacccgcgtaggaacaaaacacgcaatactcttagtagcggtaagtttcgtaacgttgataacaggcaacatgtcatttagagatttaggacgagttatggtaatggttggagcgactatgactgatgatataggaatgggagttacatatttggctttactggcagcattcaaaataaggccgacgtttgcagcaggattacttttaaggaaattgacaagcaaagaactcatgatgaccaccatcggaatagttctactttcacagagtacaatccccgaatcaatactagaactaactgatgcgttagccctcggtatgatggtactaaaaattgtacgtaatatggaaaaataccaattagcagtaacgatcatggcaatattgtgcgttccaaatgcagtcatattacaaaacgcttggaaagtcagctgcacaactctagcagtcgtgtcagtatcgccgcttctgttaacaagcagtcaacaaaaagccgattggatcccactagcgttaacaataaaaggattgaatcctacagcaattttcttaacaacgttatcaaggacaagcaagaaaaggagttggccattaaatgaagcaataatggcagtcggcatggttagtattctagcatcatcgttattaaagaatgatatcccaatgacaggacccttggtggctggaggtctattaactgtatgctacgtactaacgggtcgaagtgcagatctggagctagaacgagccgccgacgtaagatgggaggaacaggctgaaatttcaggcagttcacctatattgtcgattacgatcagtgaagacggttccatgtctatcaagaatgaagaagaagaacaaacgttaacaatattaatccgaactggacttttggtcataagtggtttgtttccggtgtctataccaattaccgctgcagcttggtatttatgggaggtgaaaaagcagcgtgcaggagtactctgggacgttccaagtcctcctcctgttggtaaagcagaattagaggatggcgcctaccgaattaagcaaaaaggtattctcggctattctcaaataggtgcgggcgtatataaagaaggtaccttccacacgatgtggcatgttactcgcggagctgtgctaatgcacaaagggaaaaggattgaaccaagttgggcagatgttaagaaagacctaataagctatggtggtggctggaaactagaaggtgaatggaaagaaggggaagaagtccaagtgttagcattggaaccagggaaaaacccacgagctgtacaaactaaacctggcttattcaaaacaaacactgggaccattggagctgtgtcattagatttttcccctgggacgtctggttcaccaattgtggacaagaaaggcaaagtggtgggcttatacggcaacggagtcgtcacgagatcgggaacgtatgtaagtgcaattgcccaaacggagaagagtattgaagacaaccctgaaatcgaagacgatatatttagaaagaaaagattgactattatggatttacatccgggggcgggtaaaacgaaaagatacctaccagctatagtacgcgaagccataaaaagaggtctgagaacgttgatattagcgccgacaagagtagtcgctgcagaaatggaagaagcactacgaggtctaccaatcaggtaccaaacgccagcgatcagggcggaacatactggaagagaaattgtcgatttaatgtgtcatgcgacatttacaatgaggctactaagtccaattagggtacccaattacaatttaatcataatggacgaggcgcacttcacggatccagcaagtatagctgcccgaggatacataagcacaagagtagaaatgggagaggcagctggtatatttatgactgcaactccaccaggatccagagatccatttcctcaatctaacgcaccaattatggacgaggaaaaggaaattcctgagaggagttggaactcaggccatgaatgggtgactgactttaaaggcaaaacagtatggtttgtaccgagcattaaagctgggaacgacatagcagcgtgtttaaggaaaaacggtaagaaagtaatccagttatcaagaaaaacatttgactcagaatatattaaaacacgtacaaacgactgggacttcgttgtgactacagacatttccgaaatgggggcgaacttcaaggctgaaagggtgatagatccgcggagatgtatgaaacccgtaatattgacagatggtgaagaacgagttatacttgctgggccaatgccagtaacacattcatcggcagcacaacgtagaggccgggtaggtcgtaatcccaaaaatgaaaacgatcaatacatctatatgggtgaacccctcgaaaacgatgaagactgtgcccattggaaagaagctaaaatgctattagataacatcaatacgccagaaggaataataccgagtatgtttgagccagaacgtgaaaaggtagatgcaatcgatggagaataccgtctgaggggtgaggctcggaaaacatttgtagatctaatgcgtcgcggggacctaccagtatggttagcttatagagtagcggcagaaggtatcaattatgctgataggaggtggtgttttgatggagtcaaaaataaccaaatactagaagagaatgttgaagtggagatttggacgaaagaaggggaaagaaagaaactaaagcccagatggctagatgcgcgtatatattcagatcctcttgcacttaaagagtttaaagaatttgctgccggaagaaagtctctgacattaaatttaatcacagaaatgggaagattacctacgtttatgacgcagaaagcaaagaatgcactagataatctcgcagtgttacacacggctgaggccggaggccgtgcctataatcatgcactctcagaactacctgaaacattggaaactttgcttctacttaccttgctagctacagttacaggaggtatatttttgttcttaatgtctggtaaaggtattggtaagatgactctaggaatgtgttgcataataacggcaagtatccttctatggtatgcccaaatccaaccacattggatcgctgcatcaataattttagaatttttcttaatagttctcctaataccggaaccggaaaaacagagaacgccacaagacaatcaattaacttatgtagtaatagctattctaacagttgttgcggcaaccatggcgaacgaaatgggatttttagagaaaaccaagaaagactttggtctgggaagtataacgacccaacaaccagaatcaaatattcttgatatcgatctacgtccggcctccgcctggactttatatgctgttgccacaacctttattacaccgatgctaagacattctatagaaaattcatcggtaaacgtttccttgaccgctattgctaaccaagcgacagttctaatgggactaggaaagggctggccgctgagtaagatggatataggtgtacctctattagcaatcggttgttattctcaggtgaaccccattacgctaacggctgctctcttacttctagtagctcattacgcgataattggaccaggtctacaagccaaagcgacaagagaggcgcaaaagcgcgccgcagccggcataatgaaaaatcccacggtagatggcatgacagtcattgacctggatcccataccgtatgatccaaagtttgaaaagcaattgggacaagtaatgctcctagtgctgtgtgtgactcaagtcttaatgatgagaacaacttgggcgctatgcgaggctttaacattagcaacgggcccaataagcacactatgggaaggcaaccccggaagattctggaatacaactatagccgtgagcatggcaaacatattcagaggttcttatctcgctggagcgggtttactcttcagtatcatgaaaaacactgccaacacgagaaggggaactggcaatactggagaaacattaggcgagaaatggaaaaaccgattgaatgcactgggaaaaagcgagttccaaatatataagaaatcaggaatccaggaggtcgatcgtactttggcgaaagagggcataaagagaggggaaacagaccatcacgcagtaagcagaggaagtgctaaactacgttggtttgtagagagaaacttggtgacacctgaaggtaaagtagtcgaccttggttgcggacgcggagggtggtcttattactgcggaggactcaaaaacgtcaaagaggtaaagggactaacgaagggcggaccaggtcatgaagaaccaataccaatgagtacttacgggtggaatctagttcgcctacaatcaggggtagacgtattctttacgcctcctgaaaaatgtgatacgcttttgtgtgatatcggagaaagctcaccaaacccaacagtggaagcaggcagaacacttcgagtgttaaacctggttgaaaattggctcaataataatacgcaattctgtattaaagtattgaatccctatatgccatcagttattgagaaaatggaggcacttcaacgaaaatatggcggtgccctagtaagaaatcccttaagccgcaacagcacgcacgagatgtattgggtgtcaaatgcatctggcaacatagtttcttctgttaatatgatatctagaatgctaattaaccgtttcacaatgaggcataagaaagcaacgtatgaaccagatgtagacttaggttccggtacaaggaatataggcatagaaagcgagactccaaatctcgatattataggaaagcgaattgagaaaataaaacaagagcatgaaaccagctggcattatgaccaagaccacccttacaaaacatgggcataccatggctcttatgagaccaagcaaactggatcagcctcaagtatggtaaacggagttgtcaggttacttacaaaaccatgggatgttatcccaatggtaactcaaatggccatgaccgatacgaccccattcgggcaacagagggtcttcaaggaaaaagtagacactcggacacaggagccgaaggaaggcacgaagaaattaatgaaaattacagcagaatggctatggaaagaactaggaaagaagaaaactccacgaatgtgtacaagagaagagttcaccaggaaagtaaggtcaaatgcagcacttggtgccatattcacagatgagaacaaatggaaatcagcccgagaagctgtggaagatagcgggttttgggaattagttgacaaagaaagaaacctccatttagaaggtaaatgcgaaacatgtgtgtacaacatgatggggaaaagagagaagaaacttggcgaatttggcaaagcaaaaggctcaagggctatatggtatatgtggttaggcgctagattcctcgagttcgaagcattaggtttcttaaatgaggaccattggttcagtcgtgagaactccctatccggagttgaaggagaaggacttcataaactaggttatatccttagagacgtaagtaagaaagaagggggtgctatgtacgctgatgacacggcaggttgggacactcgtattacactggaggatttaaagaacgaggaaatggttacaaaccatatggagggagagcataagaaactggccgaggcaatttttaagttgacataccaaaacaaagtggtacgagtacagcgacccacaccacgaggtacggtgatggacatcattagtcggagagaccaacggggttccggtcaagtcgtcacatacggacttaatacgtttactaacatggaagcacaattgatacgccaaatggaaggagagggagtatttaagagtatacagcaattaacggttaaagaagaaatcgcggttaaaaactggttaatccgcgtaggcagagagagattgtcaagaatggcaatctctggagatgattgcgttgtaaaacctctggacgatcgttttgctagtgcattaacggctctcaatgatatgggaaaagttagaaaggatatacaacagtgggaaccatctagaggatggaacgactggacacaagttcccttttgttctcatcattttcatgagttaataatgaaggatggaagggtgttggtcgtgccttgtagaaaccaagatgagctaatcggtcgtgcaagaatatctcaaggagcgggttggtccttaagggaaacggcttgcctcggaaaaagttacgcccaaatgtggagtttgatgtactttcatagacgagatctccgactagctgcgaacgccatttgtagtgcagtgcctagtcactggattccaacaagtaggacgacgtggtcaatccatgcaacacatgaatggatgaccacagaagatatgctaacggtttggaacagagtttggattcaagaaaatccttggatggaagataagacaccagttgaaagttgggaagaaataccttacctcggaaagagagaggaccaatggtgtgggtcactaataggactgaccagtcgcgctacttgggccaaaaacattcagaccgcgataaatcaagttagatcattaataggtaatgaagaatacactgattacatgccttcgatgaagcggtttagaagagaagaggaagaagccggagttctatggtaa

SEQ ID NO: 22252 - RNA, 9876 nt, synthetic construct
  misc_feature 1..9876: note = derived and/or modified CDS sequence (opt6) from DENV-2__KM279544__SS-prME
  source 1..9876: mol_type = other RNA
accgcggggataataataatgatgattccaacagtaatggcctttcatttaactactcgtaatggtgaaccacacatgatagtaagtcgacaagaaaaaggaaaaagtttattatttaaaacagaaaacggtgttaacatgtgcacacttatggccatggatctaggggaattatgcgaagatactatcacttataattgccctctactacgacagaacgaacctgaagacatagactgttggtgcaacagtaccagtacctgggtaacctatggaacatgtacagctactggagaacaccgtagagaaaaacgtagcgtggcgctagttccacacgttggtatgggcttagaaacccgaactgaaacatggatgtcttctgaaggtgcgtggaaacatgcccaaagaatagaaacatggatacttagacatccaggttttaccatcatggcggcaatcctagcatacacaataggcaccacttattttcagagagtcctaatattcattctattgactgcagtaactccgtcaatggcaatgcgatgcataggtaccagtaatagagactttgtcgaaggtgtatcaggcggttcatgggttgacatagtcttagaacatggctcgtgtgtgacaacaatggctaaaaataaacctacccttgacttcgaattgatcaaaaccgaagccaaacatctagcaaccttaagaaaatactgtgtggaagcaaaattaaccaatacaaccacggcttcccgatgtcccactcaaggcgaaccatcattgaatgaagaacaagataaacgattcgtatgtaaacacagtatggtagatcgagggtggggtaacggatgtggactatttggcaaaggagggattgtaacctgtgcaatgtttacttgcaagaaaaatatggaaggaaaagtagtacaacctgagaacctagaatatacgatagttattactccacattcaggtgaagaaaatgctgttggaaatgataccggtaaacatggaaaagaaataaaagtcactccgcagagcagcattacagaggctgagctaacgggctatggaacagttacgatggaatgttctccgaggactggattagatttcaatgaaatggtactacttcaaatggaaaacaaggcttggctcgtacacagacaatggttcttagacctcccattaccatggcttccaggagcagatacacaaggatctaactggatacaaaaagaaaccttggtcacattcaagaatccccacgccaagaaacaggatgtcgttgttttaggttcccaagaaggtgctatgcacaccgcgttgacaggagctactgaaatccaaatgagttcgggcaatcttttgttcacaggccacctaaagtgtagactaaggatggataaattacaattaaaaggtatgtcgtacagtatgtgcacaggaaaattcaaagtggtaaaagaaatagcagaaacacaacatggtacaatcgtaattcgggtacaatatgaaggagatggatcgccatgtaagatcccatttgaaataatggatctggaaaaacgacacgtacttggtcgattaataacagtaaatccaatcgtaacagaaaaagactcccccgttaatatagaagccgaaccgccttttggtgactcttatataataataggtgtagaaccgggtcaattaaaactcagctggtttaagaaaggatcatcaatcgggcaaatgtttgaaacaacaatgcgtggtgcaaaaaggatggcaatacttggcgacacagcgtgggatttcgggtcattaggaggcatgtttacgtctatcggaaaagcgcttcatcaagtttttggggccatatatggagccgccttttctggagtgtcttggaccatgaaaatccttatcggagttgttataacttggataggaatgaactcgagaagcacttctctcagcgtatcattggtattagtaggcgtagtgactttatatcttggggtgatggtacaagcagattcaggatgtgttgtatcttggaaaaacaaagaactaaaatgcggctctggcatatttatcacagacaacgttcatacttggactgagcagtataaattccaaccggagtcgccatcgaagctagctagtgccattcaaaaagcgcacgaagaaggaatttgtggtatccgatcagtcacgcgacttgaaaaccttatgtggaaacaaataacacctgaattaaaccacattttaacagaaaatgaagtaaaacttacaatcatgaccggagacataaaaggcattatgcaagccggaaaaaggtcactgcgtcctcaaccaactgaactgaaatatagttggaaagcatggggtaaagcaaaaatgttatcaactgagctccataatcatacatttctcatcgacgggcctgagactgctgaatgtccaaatacaaatcgggcgtggaactcattggaggtagaagattatggatttggcgttttcactacaaacatatggttaaaactaaaagagagacaagatgtcttttgtgactctaaacttatgtcagcagcaattaaggataatagagcagtacacgcagatatgggctactggatcgaatccgccttaaacgatacgtggaaaatagaaaaagcctcattcattgaggttaaaagctgtcattggcctaaaagtcacactttatggtccaatggtgtactagaaagtgaaatgatcatacccaaaaattttgccggaccagtttcgcaacacaattatcgaccaggttatcatacccaaacggcaggaccatggcatctcggtagattggaaatggacttcgatttctgtgagggcacaactgttgttgtcacagaagattgcggcaaccgaggcccatctttgcggaccactaccgctagtggtaaattaataacggaatggtgttgtcggagttgtaccttaccaccactaagataccgtggagaagatggatgctggtacggtatggaaattagacccctaaaagaaaaggaagaaaacttagtaaacagtttggtgacggcagggcacggacaaatagataatttctctctaggtgtactaggcatggccctattccttgaagaaatgttaaggactagagtcggtaccaagcacgctattttgcttgtagctgtttcctttgttactttaatcactggaaacatgtcatttcgagatctagggagagtaatggttatggtgggagcaactatgacagatgatataggcatgggagtcacttatctggcacttctggctgcttttaaggtccgaccaacgtttgcagcaggattacttttacgtaaactgacgagtaaagaacttatgatgactacaataggtatagtattattatcacaaagtacaattcccgagtcaatactagaattaacagacgcactcgctttaggaatgatggttttaaaaattgtgcgtaacatggaaaagtaccagctcgccgtcacaatcatggcaattttatgcgttcctaatgccgtaatacttcaaaacgcttggaaagtgtcctgcacaacattagccgttgtctcagtatctcctctattattaacctctagtcaacaaaaggctgactggataccactggctttaacaatcaaagggttaaatccaacggcgatatttttgacaactttgagtagaacaagcaagaaaagaagttggcctttaaatgaagcaatcatggcggtggggatggtaagtatattagcctcctcactacttaaaaatgatatacctatgacggggcctttagtagcgggtgggttgttgacggtctgttacgttttaacaggaaggagcgcagatctggagcttgaacgtgccgctgatgttcgttgggaggagcaagccgaaatttctggttcatccccaatcttaagtattacaatttccgaagatgggtctatgagtatcaaaaatgaagaggaagaacaaactctgacaatactaataaggacgggacttttagtcatctcgggtttatttcccgtctcgattcctattacggcggccgcttggtacttatgggaagtgaaaaagcagcgagctggagtgttatgggacgttccaagcccgcctcctgtaggaaaagcagaactggaagacggtgcatatagaataaagcagaaaggcattcttggatatagtcagataggggcaggagtctacaaagagggaacgttccatacaatgtggcatgttacaagaggagccgttttaatgcataaaggtaaaagaatagaaccaagttgggctgatgttaagaaagatttaatatcttacggaggcggatggaaacttgaaggcgagtggaaagaaggggaagaggtgcaagtgctcgccttagagcctggaaagaaccctagagcggttcaaacgaaaccaggtttatttaagactaatacgggaacgataggagctgttagtcttgattttagtccaggtacttctggtagtccgatcgtagataaaaagggaaaagtagtcgggctctatggtaatggtgtagtaacccgatcaggtacatatgtcagcgcaattgcacagactgagaagtcaatcgaagacaatcccgaaatagaagacgatatattcagaaagaagagactaacaattatggatttacaccctggggcgggtaaaacgaagcggtacttacccgctattgtaagagaagcgattaaaagaggactccggacccttatactagctcccacacgagtggtagcagcagagatggaagaagccttacgcggcctccctataagatatcaaacaccggcgattcgtgctgaacacacaggaagagaaatagtagatttgatgtgtcatgcaactttcactatgagattgctaagccctatacgagtgccaaattataatttaattatcatggatgaagcacacttcacagatcccgcctctattgcagccagaggatacatatcaacaagagttgagatgggtgaagccgcgggtatttttatgacagcaacaccgcctgggagcagagatccttttccacaaagtaatgcaccgatcatggatgaagaaagagaaatccctgagcgttcgtggaactcaggacacgaatgggtaacggattttaaagggaaaactgtttggtttgtaccttcaataaaagcaggtaatgatatagctgcctgcctaaggaaaaatggtaaaaaggtaatccaattatcaagaaaaacatttgatagtgagtacatcaaaaccagaacaaatgattgggattttgtagtaaccacggatattagcgaaatgggagcaaatttcaaagcagaacgggtaatcgacccacgtcgctgtatgaaaccggtgatattgaccgatggtgaagaaagagtcatcctagcaggcccaatgcctgttacacattcgtctgcagctcaacgacgaggcagggtgggtcgcaacccgaagaatgaaaatgaccaatacatatatatgggagaaccacttgaaaacgatgaagattgtgcccactggaaggaagctaaaatgttgctagataatataaatacacctgagggaataattccctccatgttcgagcctgaacgagaaaaagtggacgctatagacggagaatacagacttcgaggagaagcacgcaaaactttcgtagacctaatgaggcgaggcgatctcccagtttggctagcgtatagagtagctgctgaaggaatcaattacgctgatcgtaggtggtgtttcgacggagtcaaaaataaccaaatcttagaagaaaatgtagaggtagaaatctggacaaaggagggtgaacggaagaaattaaaaccacgttggttagacgcccgaatttactcggatccactagcgctgaaagagttcaaagagttcgctgcgggacgaaaaagtctaacactaaacttgattaccgaaatgggtagattacctacatttatgacgcaaaaagctaagaatgccttggataacttagcggtattacatacagctgaagcaggcggcagagcttataatcacgccctcagtgagctgccggagacattagaaacgcttttactcctaactttattagcaacggttactggtggaatatttttgttcctcatgtctggtaagggtatagggaaaatgactctcggtatgtgttgcatcataacggcatcaatattgctgtggtatgcccagatacagccacactggatcgctgcatccataatactggagttcttccttattgtactattaatacctgagcccgaaaaacaaaggacacctcaggataaccaattaacttatgtcgttatagctattttgactgtagttgcagcaacgatggcaaacgaaatggggtttttggagaaaaccaagaaggacttcggtctaggaagtattacaacgcaacaacctgaaagtaacatattagatattgatctccgccccgcaagtgcatggactttatacgcagtggccacaacattcatcacgccaatgctccgacatagcattgaaaattcgagtgtaaatgttagcttgactgcgatagccaatcaagctactgtgttaatgggcctgggaaaaggatggccattatccaaaatggacatcggagttcctctcctagcaattggttgttatagccaagttaatccaattacccttactgcagcgttgttactattagttgctcattatgctataatcggtccggggttacaagcaaaagcaaccagggaagcgcagaaaagagctgcagccggaataatgaaaaacccgacagtagacggaatgacggtaatagatttagatcctataccctacgacccaaaatttgaaaaacaactaggtcaagtaatgcttctggttttatgtgtaacacaagtacttatgatgcgaacaacatgggccttatgcgaagctctaaccttagccactggaccaatcagcactctatgggagggaaatccaggaagattttggaatacgactatcgcagtcagcatggccaacatttttcgggggtcctatttagccggagccggtctgctattttccataatgaaaaatacagcaaacacccggaggggcaccggaaataccggagaaacgttaggggagaagtggaaaaaccgcttgaacgcgttaggtaaaagcgaatttcaaatatacaaaaagtccggaatacaagaagtagatagaacattagccaaagaaggaatcaagagaggtgaaacagaccatcatgcagtatctagagggtcagccaagttacgatggtttgtagaaagaaacctagttacgccagagggcaaggtagttgaccttggctgcggaagaggcggatggagttattattgcggaggactcaaaaatgtgaaggaggtaaaaggtttgaccaagggaggaccaggccatgaggaacccataccaatgagtacatatggatggaacctagtgcgtttacaaagtggagttgacgtgttctttacaccccctgagaaatgcgacaccctgctgtgtgacataggtgaatcctctccaaatccaaccgtcgaagcaggaagaactctgagagtacttaacctggtcgaaaactggctgaacaataatacccagttttgtataaaggttctgaatccgtacatgcccagcgtaatcgagaaaatggaggcgttacaaagaaaatacggcggggctctggtgcgaaaccccttatcaagaaattctacgcatgaaatgtactgggtcagtaacgcttccggaaatatagttagtagcgtaaacatgataagtcggatgctaatcaaccgttttaccatgcgacacaagaaagcgacatatgagccagatgttgacctagggtcaggaacaaggaacatcggcattgaatccgaaacgcctaatttggacattatcggaaagcgcattgagaaaattaaacaagagcatgaaacatcttggcattatgatcaagatcatccatataagacttgggcatatcatgggtcgtatgaaacaaaacagacgggatcagcaagcagtatggtgaatggagtagtacgactactcactaaaccgtgggacgtaattccaatggtaacccaaatggccatgaccgatactacgccattcggacaacaacgagtcttcaaggaaaaggttgatacgcgtacacaagaaccaaaagaaggtaccaagaaactgatgaaaataacagctgaatggttatggaaagaactgggaaagaagaagacaccaaggatgtgtacaagagaagaatttactagaaaggtccggagcaatgcagccttaggcgcgatatttacagacgaaaataaatggaaatcagcaagagaagccgtagaagactccggattttgggagttagttgataaagaaagaaatttacatctagaaggtaaatgcgaaacgtgtgtgtataacatgatgggcaaaagagaaaagaaactaggagagtttggaaaggcaaaaggaagtagagctatatggtatatgtggttaggagcgagattcctggagtttgaagccttaggtttcttaaatgaggatcattggttttctcgtgaaaattctctctctggggtagaaggtgaaggattacacaaactagggtatatattacgggacgtgtctaagaaagaaggaggtgcgatgtatgcagatgacaccgcaggctgggacacaagaattactttagaagatcttaaaaacgaagaaatggtaactaaccatatggaaggagaacataagaaactagctgaggcaatcttcaagctaacataccaaaataaagtcgtacgcgtacaaagaccaactccaagaggaacagtaatggatataataagtagaagagaccaacgaggatccggccaggtggtaacttatggcttaaatacatttactaacatggaggcacaattaatacgtcaaatggagggcgaaggtgtatttaaaagtatacagcagctaaccgttaaagaagagattgctgtcaaaaattggctaatcagagtggggcgtgaaaggttatcaagaatggctattagtggcgatgattgcgtcgtaaaaccgttggacgatagatttgcgagtgcattgacagctttaaacgatatggggaaggtacgcaaagatatacaacaatgggagccgtccagaggatggaatgattggacccaggtaccattttgctcacatcattttcatgagctaataatgaaagacggtagagtcttagttgtgccatgtcgaaatcaagacgaattaatagggcgagcacgcatcagtcaaggagctggatggagtttacgtgaaacagcttgccttggaaaatcatatgcacaaatgtggagcctcatgtacttccaccgacgcgacttaaggctagctgctaacgcaatctgctcagcagtgccgagtcactggattcctacgtcgagaacaacatggagtattcatgcgacacatgaatggatgactacagaggacatgttaactgtttggaacagagtatggattcaggaaaatccatggatggaagataagacattagtggaatcatgggaggaaattccatatctaggaaaaagggaagatcagtggtgtggatcattaatagggctcacttcacgggctacatgggcgaagaatatacaaacggctatcaaccaagtacgatctcttataggaaatgaagaatacactgactatatgccgagtatgaaacgctttagacgagaagaagaggaagcaggagttttatggtag

SEQ ID NO: 22253 - RNA, 9876 nt, synthetic construct
  misc_feature 1..9876: note = derived and/or modified CDS sequence (opt6) from DENV-2__KM279549__SS-prME
  source 1..9876: mol_type = other RNA
acagcaggtatcataatcatgatgattcccactgttatggcattccacctaacaacaagaaatggagaacctcatatgattgttagcagacaagaaaaaggaaaatcgctgcttttcaaaacggaaaatggggtgaacatgtgtacattaatggcgatggacctaggcgaattatgtgaagacactataacgtataactgtccattacttcgtcaaaacgaaccagaagatatagactgttggtgtaatagtacaagtacatgggtgacatacggaacatgtacagcgacaggcgaacatagacgagagaaacgctcggtagcgctagtaccccacgttggcatgggactagagacaagaacagaaacatggatgagttcagagggggcttggaaacacgctcaaagaatagagacatggattctacgacatccaggattcacaattatggcagcgatcttagcttatactatcgggacaacatactttcaacgagtactaattttcatcttactgacagcagtaactccaagcatggctatgcgatgtataggtatatccaatcgagattttgtcgaaggcgtatctggtggtagttgggttgatattgtactagaacacggaagctgtgtaactacgatggctaaaaacaaacccactttagattttgaactaataaaaaccgaggcaaaacatttagcaaccttgcgtaaatattgtgtcgaggcaaaacttactaatacaacaaccgcaagtcgttgtccaacacaaggagaaccttctctgaacgaggagcaagacaaaagattcgtttgtaaacactccatggtggacagaggctggggcaacggatgtgggttatttgggaaaggaggtatcgttacatgtgctatgtttacgtgtaagaaaaacatggaaggaaaagtggtacaacctgaaaacctcgaatacaccatagttataacacctcacagcggcgaagaaaatgcagtaggcaacgatacaggaaaacatggtaaagaaataaaagtaacaccacaatcgagcattactgaggcagaactcacaggttatggtaccgttaccatggaatgtagtccccgaactggattagattttaacgaaatggtgcttcttcaaatggaaaataaagcatggttggtgcaccgtcaatggttcttagatctaccccttccatggcttccaggggctgatactcagggctccaattggatacagaaagagaccttagttacatttaaaaacccgcacgcaaagaaacaagatgtagtggtattgggctcacaagaaggggcgatgcacacagctctaactggagcaacggaaattcaaatgtcctcaggcaatttactctttacgggccatttaaaatgccgactgcgaatggataaattacaacttaaaggaatgagctatagtatgtgcacaggcaaatttaaggtggtcaaagaaatcgccgaaacacaacatggcacaatagtaatccgcgtgcaatacgagggagacggttcaccatgcaaaataccctttgaaataatggacctcgagaaaagacatgtactgggaaggcttatcacagtaaacccaatagttacagaaaaagattccccggtcaatatcgaagcagagccgccatttggggatagctacataattatcggagttgaaccaggccaattgaagttgagttggtttaagaaaggctcatcaattggacaaatgtttgaaacaaccatgagaggcgcgaaacgaatggccattttgggagataccgcatgggattttgggagtctgggaggggttttcacatcaattggaaaagcattacatcaagtctttggcgctatatatggagcagcatttagtggtgtaagctggaccatgaaaatactaataggagtagtaataacgtggatcggaatgaacagtcgatctacgtcattgtcggtaagccttgtcttagtaggcgtagtaactctctaccttggcgtcatggtacaagctgacagtggatgtgtagtatcgtggaagaataaagaactaaagtgtgggagcggcatattcataactgacaatgttcacacatggaccgaacagtacaagttccagcctgaaagcccctcgaaactcgcatctgcaatacaaaaagcacatgaagagggaatctgtggcatcagatccgtaaccagactcgagaatttgatgtggaaacaaataacacctgaacttaatcacattctaactgagaacgaagttaaattaacaataatgacaggagacattaagggaataatgcaagcaggaaagaggagcttaagacctcaaccaacggaacttaaatatagttggaaagcatggggcaaagcgaagatgctatcaacagaactacacaatcacaccttcttaattgatggacccgaaactgcagaatgccctaacaccaatagggcctggaacagcctagaggtagaagattatggctttggagtctttactaccaatatttggctaaaattaaaagaacgtcaggatgtattttgcgacagtaaactaatgagtgcggcaataaaggataatagggccgtacacgccgacatgggatattggatcgaaagtgcgcttaacgatacttggaaaattgaaaaagctagctttatcgaggtcaagtcttgccattggccaaagtcacatacactatggtcgaatggagtgttggaatcagaaatgatcatccccaaaaatttcgcaggacccgtttcacagcacaactacaggccggggtaccatacacaaacagcaggaccgtggcacctgggaagattagaaatggactttgacttttgtgaagggacgacggtcgtagttacagaggactgcggaaatcgaggaccgagcttaagaacaacgactgcgtcaggaaagttaataacagaatggtgctgtcgatcctgtaccttaccgccgttgcgatataggggagaggatggctgctggtatggaatggaaattaggcctctgaaagaaaaagaagaaaaccttgtaaactctttggttactgctggtcatggccaaatagataatttctccctaggtgtactaggtatggcgttgtttttagaagaaatgttgcgcactagagtgggaacaaaacacgcaatactgttagtagcggtatccttcgtaactttaatcaccggaaatatgtctttcagggatctaggcagagtgatggtaatggtaggagctactatgacggatgatataggaatgggcgttacctacttagcattactagctgcctttaaagtacgaccaacatttgctgccgggttgcttctaagaaaattaacgagtaaagaactcatgatgacgactattggtatagtattgctttcacaatcgactatacctgaaagcattctagagttgaccgatgccctcgcacttggtatgatggtacttaagattgtaagaaatatggaaaaataccaactagctgtaaccatcatggctatcctatgcgtgccaaacgcagtaattctacagaatgcttggaaagtatcttgcactactctcgctgtggtctctgtttccccattattactaacatctagccaacaaaaagcggactggataccattagcattgactataaaaggcctgaatccaactgctatatttttaactacgctatctcgcacctcaaagaaaagatcatggccgttaaatgaagcaattatggcagtagggatggtgtcaatcctagcgtcttcactgctcaaaaacgatatacccatgaccggaccattggtagctggcggcctcttgacagtatgctatgtcttaacaggtagaagtgcggacctagagttagaacgtgcggcagatgttcgatgggaagaacaggccgaaatatcaggctcatcacccatcttgagtataacaataagtgaagacgggagcatgtcaattaaaaatgaggaagaagaacagacattaactatactaataaggactggactattagtaatatctgggttattccccgtgagcataccaataacggcggcggcttggtacctatgggaagtcaagaaacagagagcaggcgttttgtgggatgtcccatcaccacccccggttgggaaagccgaactagaagatggtgcataccgcatcaaacagaagggaatactagggtactcacagattggagccggtgtatataaagaaggaacgtttcataccatgtggcacgtaactagaggcgcggtgttaatgcataagggtaaacgtatcgagccatcgtgggctgacgtgaaaaaggatctaatctcctatggcggcggatggaaattagaaggcgaatggaaagaaggtgaagaagttcaggtactagcactcgaaccaggcaaaaacccccgagcagtccaaacaaagccaggcttgtttaaaacaaatactggaaccattggtgcggtgagtctagattttagtccgggcacaagtgggtcacccatagtggataagaaaggcaaagtagtaggtctatacggaaatggtgtcgtaacacgtagtgggacttatgtgagtgctatagcgcaaaccgaaaaatcaatagaagacaatcccgaaatcgaagatgatattttccgcaaaaagagacttaccataatggatcttcacccaggagcaggtaagactaaaagatatctacccgcgatagtcagagaagcaataaaacgtgggctgagaacccttatattagcacctactagggttgtggcagcagaaatggaggaggccctaagggggctacctatacggtaccagacaccagcgatccgcgctgaacatacaggaagagaaatcgtagaccttatgtgtcatgctacatttaccatgagactactttctccaattcgggttccaaattacaacttaattataatggatgaggcacacttcaccgatcccgcaagcattgccgcaagaggatacatatcaacaagagttgagatgggagaagcagcgggaatatttatgaccgctacaccacctggatcgagggatccattcccacaatcgaacgccccaattatggatgaggagagagaaatcccggaacgaagctggaatagcggtcatgaatgggttactgatttcaaaggaaaaacggtatggtttgtgcccagtataaaggcgggaaatgatatagcggcttgcttaaggaaaaacggaaagaaagttatccaactatctagaaaaaccttcgatagtgaatatataaaaacaagaacaaacgactgggattttgtagttaccacggatatatccgaaatgggtgctaactttaaagcagagcgagtgatcgacccaagaaggtgtatgaaacccgttatactaactgatggggaagaacgagtaattctcgcaggaccgatgccggtcacccacagcagtgcagctcaacgacgaggaagagtgggtagaaatcccaaaaatgaaaacgatcaatacatttacatgggtgaaccacttgagaacgacgaagactgcgcccactggaaagaggcgaagatgcttctagacaacattaatacgcctgaaggaatcataccatcgatgttcgaaccagaacgtgaaaaggttgatgcaatcgatggcgaataccgattaaggggagaagctagaaaaacattcgttgacttaatgaggagaggagacttacccgtttggctcgcatatagagtggctgccgagggcataaactacgtagatagacgctggtgtttcgatggagttaaaaacaatcaaatacttgaagaaaatgtagaagttgaaatatggacaaaggagggtgaaaggaagaaactaaagcctcgttggttagatgcgagaatttactcagatccgcttgcattaaaagaatttaaagagtttgcagccggacgcaagtcccttacacttaatttaattacggaaatgggaagattgccaactttcatgacacaaaaggctaaaaatgcactagataatctggcagtactacacacagctgaggcaggcggcagagcatataaccacgcactaagcgaattacctgaaacattggaaactttattattactaacgttactagccactgtaacgggaggaatatttctatttttaatgagcggaaaaggtattgggaaaatgactttgggtatgtgttgcatcataacagcatccatattactatggtatgcacagattcaaccacactggattgctgcttcaattattttggaatttttcctcatcgtcttactaattcccgaaccagaaaaacagagaacccctcaagacaatcaactcacatacgtagtgattgccatattgaccgttgtcgctgctacaatggctaacgaaatgggatttctagagaagaccaagaaagacttcggattaggatcaataacaacacaacaaccagaaagtaatatcctcgatatagacttacgaccagcatcagcgtggaccctatatgcagtagccacaacattcattacgccgatgttacgacacagtatagaaaacagcagcgtgaatgtctctttgactgctatcgcaaatcaagcaactgtactgatgggattaggaaagggttggccactgagcaagatggatataggagtaccactgttagcaataggctgttacagccaggtaaaccccataacattaaccgcagctttactattattagtagcgcattatgcaataatagggccaggattacaagcaaaagcgacacgagaggcacaaaagcgtgcagctgccggaataatgaaaaatccaacggtagatggaatgacagttattgacttggatccgataccgtatgatccaaagttcgaaaaacagctaggtcaagttatgttactggtcctttgtgtgacgcaagtattgatgatgaggacaacctgggcgttgtgcgaagcccttacactagcaactggacccataagtacactttgggaaggtaatcccggtaggttctggaatacgactattgcagtgtcaatggccaatatatttagggggtcgtatctcgctggtgcggggctcttattcagcataatgaaaaacacagctaacaccaggcgagggaccggtaatacaggcgaaactctaggtgagaagtggaaaaatagattaaacgcacttggtaaatcagagttccaaatttacaaaaagagtggtatccaagaagtagatagaactttggcaaaagaaggaattaaaagaggggagactgatcaccatgcggtttcacgtggaagcgcaaagttacgttggttcgttgaaaggaacctggttacaccggagggaaaagtggtagacctcggatgcggtagaggaggttggtcgtattattgcggtgggttgaaaaacgtcaaagaagtaaaaggactaacaaaaggaggaccaggtcatgaggagcccattccaatgtcaacatacggttggaatttagtgaggttgcagtcaggtgtagatgtatttttcactcccccagaaaaatgtgacacattactatgtgatataggtgaatcttcccccaatccaacagtagaagcgggtagaacattgagggtattaaatttagtcgaaaactggttaaataacaatacacaattttgtataaaagtgttaaacccttatatgccatcagtcatagagaaaatggaagcgttacagagaaaatatggtggtgcattagtaagaaatcctttatcacgcaactcaacacatgaaatgtattgggtttctaacgcttcaggaaacatagtttcaagtgtcaacatgataagccggatgctcataaaccgctttacaatgcgtcacaagaaagccacctacgagcccgacgttgatttgggaagtggaacaagaaatatcggaatcgaatcagaaacacccaatcttgatataataggaaaaagaattgaaaagatcaaacaagagcacgaaacatcttggcattatgatcaggatcatccgtataaaacttgggcataccatggatcatatgaaactaaacaaaccggtagcgcttcttcaatggtgaatggtgtagtgaggctgttaacgaagccctgggatgtgatacccatggtaactcagatggcaatgacggacaccactccttttggacaacaacgtgtgtttaaagagaaggtagacacaagaacacaagaaccaaaagaaggaaccaagaaacttatgaaaattacggcagaatggttatggaaagagcttggaaagaagaaaacaccacgaatgtgtacccgcgaagaatttacaagaaaagtacgatcaaatgcggccttgggtgcaattttcacggacgaaaacaaatggaaaagcgcaagggaggccgttgaggacagcggattctgggaacttgttgacaaggaacgtaacttgcacctcgagggcaaatgcgagacgtgtgtatataatatgatggggaaacgagagaagaaattgggtgaatttggaaaagcaaaaggatcgcgcgccatttggtatatgtggctgggcgcacgatttcttgaatttgaggctctgggcttcctaaatgaagaccactggttctcaagagaaaattccctctctggtgttgaaggtgaaggtctacacaaactgggatacattctgagggatgtatccaagaaagaaggaggggcgatgtatgcagatgatacagccggatgggatacgcgcataaccctagaggatttgaaaaatgaagaaatggttacaaatcatatggaaggagagcataaaaagctagcagaagcgatcttcaaactgacttatcaaaacaaagtcgttcgggttcagagaccgacgccccgaggtacggtcatggacataatctcacgacgcgatcaacgtgggtccggacaagttgtaacatatggccttaacacattcacgaacatggaggcccaattaatccgacaaatggaaggcgaaggagtctttaagagtatccagcaacttacagtaaaagaggaaatagcagtcaaaaattggctaatacgcgtaggccgagaaagattatcacgaatggctatatctggggacgattgcgttgtgaaaccacttgacgatagattcgcatctgcactaaccgcattaaacgatatgggtaaagtccgtaaggacatacagcaatgggaaccaagtaggggatggaatgactggactcaagtaccattctgcagccatcatttccacgagttgatcatgaaagacggaagagtcttagtagtaccatgtagaaaccaagacgaacttatcgggagggctcgtatatcccaaggcgctggatggagtctaagagaaacagcttgtctcggaaagagttacgcacaaatgtggagtctgatgtactttcaccgcagagatctccgtcttgcagcaaacgctatttgcagcgccgtaccatctcattggataccaacctcaaggactacttggagtatacatgcaactcacgaatggatgaccaccgaagatatgttaactgtgtggaatagagtgtggatacaagaaaatccatggatggaagacaaaacaccagttgaaagctgggaagaaattccatatttgggaaagagagaagatcagtggtgcggcagtctgatcggattaacgtcaagggctacatgggccaaaaatatccaaactgctataaaccaggttagaagtttaatcgggaatgaggaatatacagactatatgccatcgatgaaaagattccgcagagaggaagaagaagccggtgtattgtggtaa
